United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 18

SEQ ID NO: 728913 - DNA, 15 bp, Homo sapiens
tgtatgtgtgtgagt

SEQ ID NO: 728914 - DNA, 14 bp, Homo sapiens
tgtatgttaaagca

SEQ ID NO: 728915 - DNA, 15 bp, Homo sapiens
tgtatgttatgatat

SEQ ID NO: 728916 - DNA, 21 bp, Homo sapiens
tgtatgttattatattccgta

SEQ ID NO: 728917 - DNA, 16 bp, Homo sapiens
tgtatgtttacatatc

SEQ ID NO: 728918 - DNA, 13 bp, Homo sapiens
tgtatgtttagta

SEQ ID NO: 728919 - DNA, 14 bp, Homo sapiens
tgtatgtttcttct

SEQ ID NO: 728920 - DNA, 17 bp, Homo sapiens
tgtctgaagtcactgca

SEQ ID NO: 728921 - DNA, 18 bp, Homo sapiens
tgtctgaagtcactgcac

SEQ ID NO: 728922 - DNA, 19 bp, Homo sapiens
tgtctgaggagtaagtgta

SEQ ID NO: 728923 - DNA, 15 bp, Homo sapiens
tgtctgagtgaacct

SEQ ID NO: 728924 - DNA, 20 bp, Homo sapiens
tgtctgagtgaacctgtata

SEQ ID NO: 728925 - DNA, 21 bp, Homo sapiens
tgtctgagtgaacctgtataa

SEQ ID NO: 728926 - DNA, 14 bp, Homo sapiens
tgtctgataatgat

SEQ ID NO: 728927 - DNA, 13 bp, Homo sapiens
tgtctgcacagag

SEQ ID NO: 728928 - DNA, 15 bp, Homo sapiens
tgtctgcacccaggg

SEQ ID NO: 728929 - DNA, 13 bp, Homo sapiens
tgtctgcacctcc

SEQ ID NO: 728930 - DNA, 13 bp, Homo sapiens
tgtctgcagctgt

SEQ ID NO: 728931 - DNA, 16 bp, Homo sapiens
tgtctgccaaacacat

SEQ ID NO: 728932 - DNA, 15 bp, Homo sapiens
tgtctgccaacctaa

SEQ ID NO: 728933 - DNA, 19 bp, Homo sapiens
tgtctgccaacctaaaact

SEQ ID NO: 728934 - DNA, 16 bp, Homo sapiens
tgtctgccagccagca

SEQ ID NO: 728935 - DNA, 19 bp, Homo sapiens
tgtctgccagccagcagcc

SEQ ID NO: 728936 - DNA, 14 bp, Homo sapiens
tgtctgccaggcac

SEQ ID NO: 728937 - DNA, 19 bp, Homo sapiens
tgtctgcccaatgaataat

SEQ ID NO: 728938 - DNA, 19 bp, Homo sapiens
tgtctgccccagcccagat

SEQ ID NO: 728939 - DNA, 21 bp, Homo sapiens
tgtctgccctctgggtccctc

SEQ ID NO: 728940 - DNA, 23 bp, Homo sapiens
tgtctgccctctgggtccctcct

SEQ ID NO: 728941 - DNA, 13 bp, Homo sapiens
tgtctgccttcac

SEQ ID NO: 728942 - DNA, 21 bp, Homo sapiens
tgtctgcgtggttcctttctc

SEQ ID NO: 728943 - DNA, 23 bp, Homo sapiens
tgtctgctaggcgctggggagac

SEQ ID NO: 728944 - DNA, 11 bp, Homo sapiens
tgtctgctggt

SEQ ID NO: 728945 - DNA, 20 bp, Homo sapiens
tgtctggaagacgtggctct

SEQ ID NO: 728946 - DNA, 15 bp, Homo sapiens
tgtctggaattgtgg

SEQ ID NO: 728947 - DNA, 15 bp, Homo sapiens
tgtctggccaggcct

SEQ ID NO: 728948 - DNA, 20 bp, Homo sapiens
tgtctggcccgcaatactgt

SEQ ID NO: 728949 - DNA, 22 bp, Homo sapiens
tgtctggcctcacgtgtctcag

SEQ ID NO: 728950 - DNA, 19 bp, Homo sapiens
tgtctggcgttctcaagaa

SEQ ID NO: 728951 - DNA, 21 bp, Homo sapiens
tgtctggctcggacccacccc

SEQ ID NO: 728952 - DNA, 22 bp, Homo sapiens
tgtctggctcggacccacccca

SEQ ID NO: 728953 - DNA, 15 bp, Homo sapiens
tgtctgggagagcct

SEQ ID NO: 728954 - DNA, 18 bp, Homo sapiens
tgtctgggagagcctggc

SEQ ID NO: 728955 - DNA, 16 bp, Homo sapiens
tgtctgggtttgagaa

SEQ ID NO: 728956 - DNA, 19 bp, Homo sapiens
tgtctgggtttgagaaatg

SEQ ID NO: 728957 - DNA, 12 bp, Homo sapiens
tgtctggtaact

SEQ ID NO: 728958 - DNA, 20 bp, Homo sapiens
tgtctggtgaggtggcccag

SEQ ID NO: 728959 - DNA, 21 bp, Homo sapiens
tgtctggtgcccctactggag

SEQ ID NO: 728960 - DNA, 15 bp, Homo sapiens
tgtctggtgcctgga

SEQ ID NO: 728961 - DNA, 13 bp, Homo sapiens
tgtctggtggccc

SEQ ID NO: 728962 - DNA, 16 bp, Homo sapiens
tgtctggtggccccgt

SEQ ID NO: 728963 - DNA, 15 bp, Homo sapiens
tgtctggttttaaca

SEQ ID NO: 728964 - DNA, 22 bp, Homo sapiens
tgtctgtacatactggcctctg

SEQ ID NO: 728965 - DNA, 19 bp, Homo sapiens
tgtctgtaggtgtctctgg

SEQ ID NO: 728966 - DNA, 14 bp, Homo sapiens
tgtctgtatttcat

SEQ ID NO: 728967 - DNA, 22 bp, Homo sapiens
tgtctgtcaaatgtttccttaa

SEQ ID NO: 728968 - DNA, 15 bp, Homo sapiens
tgtctgtcacaggct

SEQ ID NO: 728969 - DNA, 11 bp, Homo sapiens
tgtctgtcacc

SEQ ID NO: 728970 - DNA, 23 bp, Homo sapiens
tgtctgtccatctgtctgtccta

SEQ ID NO: 728971 - DNA, 21 bp, Homo sapiens
tgtctgtcccttttctttgac

SEQ ID NO: 728972 - DNA, 16 bp, Homo sapiens
tgtctgtcctcagagc

SEQ ID NO: 728973 - DNA, 23 bp, Homo sapiens
tgtctgtcctcagagcaggggcc

SEQ ID NO: 728974 - DNA, 22 bp, Homo sapiens
tgtctgtcgcccttctcccggc

SEQ ID NO: 728975 - DNA, 11 bp, Homo sapiens
tgtctgtctcc

SEQ ID NO: 728976 - DNA, 21 bp, Homo sapiens
tgtctgtctccctcccctctc

SEQ ID NO: 728977 - DNA, 15 bp, Homo sapiens
tgtctgtctctcccc

SEQ ID NO: 728978 - DNA, 13 bp, Homo sapiens
tgtctgtctgtgg

SEQ ID NO: 728979 - DNA, 11 bp, Homo sapiens
tgtctgtcttc

SEQ ID NO: 728980 - DNA, 12 bp, Homo sapiens
tgtctgtgccat

SEQ ID NO: 728981 - DNA, 13 bp, Homo sapiens
tgtctgtgccatg

SEQ ID NO: 728982 - DNA, 20 bp, Homo sapiens
tgtctgtgccctccaaagag

SEQ ID NO: 728983 - DNA, 17 bp, Homo sapiens
tgtctgtggatggtcat

SEQ ID NO: 728984 - DNA, 15 bp, Homo sapiens
tgtctgtggattttt

SEQ ID NO: 728985 - DNA, 14 bp, Homo sapiens
tgtctgtgggcttc

SEQ ID NO: 728986 - DNA, 12 bp, Homo sapiens
tgtctgtgtgca

SEQ ID NO: 728987 - DNA, 11 bp, Homo sapiens
tgtctgttaca

SEQ ID NO: 728988 - DNA, 12 bp, Homo sapiens
tgtctgttacac

SEQ ID NO: 728989 - DNA, 16 bp, Homo sapiens
tgtctgttgtattcat

SEQ ID NO: 728990 - DNA, 20 bp, Homo sapiens
tgtctgtttattaactactg

SEQ ID NO: 728991 - DNA, 22 bp, Homo sapiens
tgtctgtttattaactactgaa

SEQ ID NO: 728992 - DNA, 15 bp, Homo sapiens
tgtctgtttgtttca

SEQ ID NO: 728993 - DNA, 17 bp, Homo sapiens
tgtctgtttttgtatct

SEQ ID NO: 728994 - DNA, 18 bp, Homo sapiens
tgtctgtttttgtatctt

SEQ ID NO: 728995 - DNA, 19 bp, Homo sapiens
tgtctgtttttgtatcttt

SEQ ID NO: 728996 - DNA, 21 bp, Homo sapiens
tgtcttaaaaaatgtgaaatg

SEQ ID NO: 728997 - DNA, 18 bp, Homo sapiens
tgtcttaaaaatttatac

SEQ ID NO: 728998 - DNA, 18 bp, Homo sapiens
tgtcttaaactaaatgtg

SEQ ID NO: 728999 - DNA, 13 bp, Homo sapiens
tgtcttaaatgct

SEQ ID NO: 729000 - DNA, 14 bp, Homo sapiens
tgtcttaaatgctc

SEQ ID NO: 729001 - DNA, 23 bp, Homo sapiens
tgtcttaaatgctcataaagatg

SEQ ID NO: 729002 - DNA, 18 bp, Homo sapiens
tgtcttaacaaatcagat

SEQ ID NO: 729003 - DNA, 15 bp, Homo sapiens
tgtcttaactgtcac

SEQ ID NO: 729004 - DNA, 15 bp, Homo sapiens
tgtcttaattattat

SEQ ID NO: 729005 - DNA, 19 bp, Homo sapiens
tgtcttagtgcaaaaaaca

SEQ ID NO: 729006 - DNA, 23 bp, Homo sapiens
tgtcttatcccccccagcctggc

SEQ ID NO: 729007 - DNA, 16 bp, Homo sapiens
tgtcttatctggccct

SEQ ID NO: 729008 - DNA, 15 bp, Homo sapiens
tgtcttatgaggaat

SEQ ID NO: 729009 - DNA, 15 bp, Homo sapiens
tgtcttatggtccag

SEQ ID NO: 729010 - DNA, 14 bp, Homo sapiens
tgtcttatgtgaaa

SEQ ID NO: 729011 - DNA, 16 bp, Homo sapiens
tgtcttatgtgaaaaa

SEQ ID NO: 729012 - DNA, 22 bp, Homo sapiens
tgtcttattaggataatacata

SEQ ID NO: 729013 - DNA, 23 bp, Homo sapiens
tgtcttcagtggaacacaaatga

SEQ ID NO: 729014 - DNA, 15 bp, Homo sapiens
tgtcttcatagcaga

SEQ ID NO: 729015 - DNA, 23 bp, Homo sapiens
tgtcttcatcacttcttccactg

SEQ ID NO: 729016 - DNA, 21 bp, Homo sapiens
tgtcttcatttcattgtatga

SEQ ID NO: 729017 - DNA, 18 bp, Homo sapiens
tgtcttccaggtccaaac

SEQ ID NO: 729018 - DNA, 23 bp, Homo sapiens
tgtcttccaggtccaaacccttc

SEQ ID NO: 729019 - DNA, 18 bp, Homo sapiens
tgtcttccattccattgt

SEQ ID NO: 729020 - DNA, 16 bp, Homo sapiens
tgtcttcccccctctc

SEQ ID NO: 729021 - DNA, 21 bp, Homo sapiens
tgtcttcccccctctcctccc

SEQ ID NO: 729022 - DNA, 22 bp, Homo sapiens
tgtcttcctcaaaataaagaag

SEQ ID NO: 729023 - DNA, 12 bp, Homo sapiens
tgtcttctctcc

SEQ ID NO: 729024 - DNA, 21 bp, Homo sapiens
tgtcttctctccacttctggt

SEQ ID NO: 729025 - DNA, 13 bp, Homo sapiens
tgtcttctgcctg

SEQ ID NO: 729026 - DNA, 17 bp, Homo sapiens
tgtcttctgcctgttat

SEQ ID NO: 729027 - DNA, 12 bp, Homo sapiens
tgtcttctgctg

SEQ ID NO: 729028 - DNA, 19 bp, Homo sapiens
tgtcttctgggcacagtgg

SEQ ID NO: 729029 - DNA, 21 bp, Homo sapiens
tgtcttcttttgtggtgtctt

SEQ ID NO: 729030 - DNA, 23 bp, Homo sapiens
tgtcttcttttgtggtgtcttcc

SEQ ID NO: 729031 - DNA, 16 bp, Homo sapiens
tgtcttgaaaactgtg

SEQ ID NO: 729032 - DNA, 20 bp, Homo sapiens
tgtcttgaatgtcttttgaa

SEQ ID NO: 729033 - DNA, 19 bp, Homo sapiens
tgtcttgcaacttcagttt

SEQ ID NO: 729034 - DNA, 13 bp, Homo sapiens
tgtcttgccccag

SEQ ID NO: 729035 - DNA, 17 bp, Homo sapiens
tgtcttgccttcatttc

SEQ ID NO: 729036 - DNA, 20 bp, Homo sapiens
tgtcttgctgttgacatatt

SEQ ID NO: 729037 - DNA, 13 bp, Homo sapiens
tgtcttggaacat

SEQ ID NO: 729038 - DNA, 13 bp, Homo sapiens
tgtcttgggcaga

SEQ ID NO: 729039 - DNA, 16 bp, Homo sapiens
tgtcttgggcagagct

SEQ ID NO: 729040 - DNA, 18 bp, Homo sapiens
tgtgcaaggtattacact

SEQ ID NO: 729041 - DNA, 21 bp, Homo sapiens
tgtgcaagtgtgtgcatgtgt

SEQ ID NO: 729042 - DNA, 23 bp, Homo sapiens
tgtgcaataatttgtacaatggt

SEQ ID NO: 729043 - DNA, 13 bp, Homo sapiens
tgtgcaatagaag

SEQ ID NO: 729044 - DNA, 22 bp, Homo sapiens
tgtgcaataggtgagagaatgt

SEQ ID NO: 729045 - DNA, 18 bp, Homo sapiens
tgtgcaatgtaaatattt

SEQ ID NO: 729046 - DNA, 17 bp, Homo sapiens
tgtgcaattgtgaggga

SEQ ID NO: 729047 - DNA, 19 bp, Homo sapiens
tgtgcacacacaccacaca

SEQ ID NO: 729048 - DNA, 17 bp, Homo sapiens
tgtgcacacgtgtgtat

SEQ ID NO: 729049 - DNA, 17 bp, Homo sapiens
tgtgcacagtggcttct

SEQ ID NO: 729050 - DNA, 21 bp, Homo sapiens
tgtgcacatacgggctttaat

SEQ ID NO: 729051 - DNA, 17 bp, Homo sapiens
tgtgcaccaccatgccc

SEQ ID NO: 729052 - DNA, 18 bp, Homo sapiens
tgtgcaccctctatccca

SEQ ID NO: 729053 - DNA, 23 bp, Homo sapiens
tgtgcactaaggggcccggccag

SEQ ID NO: 729054 - DNA, 13 bp, Homo sapiens
tgtgcactgccca

SEQ ID NO: 729055 - DNA, 15 bp, Homo sapiens
tgtgcactgggcagg

SEQ ID NO: 729056 - DNA, 20 bp, Homo sapiens
tgtgcactttttttctatat

SEQ ID NO: 729057 - DNA, 19 bp, Homo sapiens
tgtgcagaaaagctcagag

SEQ ID NO: 729058 - DNA, 14 bp, Homo sapiens
tgtgcagacccagt

SEQ ID NO: 729059 - DNA, 20 bp, Homo sapiens
tgtgcagatcatccgtctgt

SEQ ID NO: 729060 - DNA, 15 bp, Homo sapiens
tgtgcagatgctgct

SEQ ID NO: 729061 - DNA, 17 bp, Homo sapiens
tgtgcagatgctgctga

SEQ ID NO: 729062 - DNA, 13 bp, Homo sapiens
tgtgcagcagccc

SEQ ID NO: 729063 - DNA, 14 bp, Homo sapiens
tgtgcagcagccca

SEQ ID NO: 729064 - DNA, 15 bp, Homo sapiens
tgtgcagcagcccag

SEQ ID NO: 729065 - DNA, 16 bp, Homo sapiens
tgtgcagcagcccagc

SEQ ID NO: 729066 - DNA, 18 bp, Homo sapiens
tgtgcagcagcccagctt

SEQ ID NO: 729067 - DNA, 21 bp, Homo sapiens
tgtgcagcagcccagcttcct

SEQ ID NO: 729068 - DNA, 18 bp, Homo sapiens
tgtgcagcgacccttggt

SEQ ID NO: 729069 - DNA, 15 bp, Homo sapiens
tgtgcagcgcagctg

SEQ ID NO: 729070 - DNA, 15 bp, Homo sapiens
tgtgcagcttcgagg

SEQ ID NO: 729071 - DNA, 18 bp, Homo sapiens
tgtgcagcttcgaggaca

SEQ ID NO: 729072 - DNA, 13 bp, Homo sapiens
tgtgcagggtgga

SEQ ID NO: 729073 - DNA, 16 bp, Homo sapiens
tgtgcaggtggggaga

SEQ ID NO: 729074 - DNA, 19 bp, Homo sapiens
tgtgcagtactttgtgcat

SEQ ID NO: 729075 - DNA, 18 bp, Homo sapiens
tgtgcagtcactggaggt

SEQ ID NO: 729076 - DNA, 20 bp, Homo sapiens
tgtgcagtgaaggttgctga

SEQ ID NO: 729077 - DNA, 20 bp, Homo sapiens
tgtgcataagttcttaatgt

SEQ ID NO: 729078 - DNA, 18 bp, Homo sapiens
tgtgcataattcttccaa

SEQ ID NO: 729079 - DNA, 16 bp, Homo sapiens
tgtgcatagcgtcctg

SEQ ID NO: 729080 - DNA, 17 bp, Homo sapiens
tgtgcatagtgctggga

SEQ ID NO: 729081 - DNA, 23 bp, Homo sapiens
tgtgcatcatgtttctgagacca

SEQ ID NO: 729082 - DNA, 12 bp, Homo sapiens
tgtgcatgtgtg

SEQ ID NO: 729083 - DNA, 15 bp, Homo sapiens
tgtgcatgtgtgtgc

SEQ ID NO: 729084 - DNA, 19 bp, Homo sapiens
tgtgcatgtgtgtgtctgt

SEQ ID NO: 729085 - DNA, 16 bp, Homo sapiens
tgtgcattatctagat

SEQ ID NO: 729086 - DNA, 15 bp, Homo sapiens
tgtgcattctggatt

SEQ ID NO: 729087 - DNA, 17 bp, Homo sapiens
tgtgcattctttggtaa

SEQ ID NO: 729088 - DNA, 21 bp, Homo sapiens
tgtgcattcttttaaaagaca

SEQ ID NO: 729089 - DNA, 23 bp, Homo sapiens
tgtgcatttggtggtttcagaaa

SEQ ID NO: 729090 - DNA, 12 bp, Homo sapiens
tgtgcattttat

SEQ ID NO: 729091 - DNA, 10 bp, Homo sapiens
tgtgccaagc

SEQ ID NO: 729092 - DNA, 22 bp, Homo sapiens
tgtgccacctgtccggcccagt

SEQ ID NO: 729093 - DNA, 21 bp, Homo sapiens
tgtgccagacaaataggagtg

SEQ ID NO: 729094 - DNA, 21 bp, Homo sapiens
tgtgccagacattgctctcag

SEQ ID NO: 729095 - DNA, 22 bp, Homo sapiens
tgtgccagaggaatcctggcag

SEQ ID NO: 729096 - DNA, 13 bp, Homo sapiens
tgtgccagcacct

SEQ ID NO: 729097 - DNA, 22 bp, Homo sapiens
tgtgccaggaggcggcagctct

SEQ ID NO: 729098 - DNA, 23 bp, Homo sapiens
tgtgccaggaggcggcagctctt

SEQ ID NO: 729099 - DNA, 23 bp, Homo sapiens
tgtgccaggctgaattacagtga

SEQ ID NO: 729100 - DNA, 20 bp, Homo sapiens
tgtgccatagagtttaacac

SEQ ID NO: 729101 - DNA, 23 bp, Homo sapiens
tgtgccatctgtacatattactg

SEQ ID NO: 729102 - DNA, 12 bp, Homo sapiens
tgtgccatgccc

SEQ ID NO: 729103 - DNA, 19 bp, Homo sapiens
tgtgccatggatctgatct

SEQ ID NO: 729104 - DNA, 20 bp, Homo sapiens
tgtgcccaagtgggcagtca

SEQ ID NO: 729105 - DNA, 23 bp, Homo sapiens
tgtgcccaagtgggcagtcacca

SEQ ID NO: 729106 - DNA, 12 bp, Homo sapiens
tgtgcccagcag

SEQ ID NO: 729107 - DNA, 15 bp, Homo sapiens
tgtgcccagcaggcc

SEQ ID NO: 729108 - DNA, 17 bp, Homo sapiens
tgtgcccagcaggccca

SEQ ID NO: 729109 - DNA, 19 bp, Homo sapiens
tgtgcccagcaggcccagc

SEQ ID NO: 729110 - DNA, 22 bp, Homo sapiens
tgtgcccagcaggcccagcatg

SEQ ID NO: 729111 - DNA, 19 bp, Homo sapiens
tgtgcccagcccggacctt

SEQ ID NO: 729112 - DNA, 14 bp, Homo sapiens
tgtgcccattccta

SEQ ID NO: 729113 - DNA, 15 bp, Homo sapiens
tgtgccccaccacgt

SEQ ID NO: 729114 - DNA, 13 bp, Homo sapiens
tgtgcccccagcc

SEQ ID NO: 729115 - DNA, 17 bp, Homo sapiens
tgtggcccccgccccct

SEQ ID NO: 729116 - DNA, 18 bp, Homo sapiens
tgtggcccccgccccctc

SEQ ID NO: 729117 - DNA, 17 bp, Homo sapiens
tgtggcccctgaacaag

SEQ ID NO: 729118 - DNA, 23 bp, Homo sapiens
tgtggccccttttacttttttat

SEQ ID NO: 729119 - DNA, 24 bp, Homo sapiens
tgtggcccgaggaagctggacagc

SEQ ID NO: 729120 - DNA, 12 bp, Homo sapiens
tgtggccctgcc

SEQ ID NO: 729121 - DNA, 14 bp, Homo sapiens
tgtggccctgccct

SEQ ID NO: 729122 - DNA, 12 bp, Homo sapiens
tgtggccctgga

SEQ ID NO: 729123 - DNA, 12 bp, Homo sapiens
tgtggccctggc

SEQ ID NO: 729124 - DNA, 17 bp, Homo sapiens
tgtggccctggcctgct

SEQ ID NO: 729125 - DNA, 20 bp, Homo sapiens
tgtggccctggcctgctggg

SEQ ID NO: 729126 - DNA, 17 bp, Homo sapiens
tgtggccgccatctgcg

SEQ ID NO: 729127 - DNA, 16 bp, Homo sapiens
tgtggccgtctcctcc

SEQ ID NO: 729128 - DNA, 11 bp, Homo sapiens
tgtggcctcag

SEQ ID NO: 729129 - DNA, 13 bp, Homo sapiens
tgtggcctcagaa

SEQ ID NO: 729130 - DNA, 13 bp, Homo sapiens
tgtggcctccctg

SEQ ID NO: 729131 - DNA, 17 bp, Homo sapiens
tgtggcctgcacagtga

SEQ ID NO: 729132 - DNA, 14 bp, Homo sapiens
tgtggcctgcccag

SEQ ID NO: 729133 - DNA, 22 bp, Homo sapiens
tgtggcctgtgccagcaccaca

SEQ ID NO: 729134 - DNA, 24 bp, Homo sapiens
tgtggcctgtgccagcaccacagc

SEQ ID NO: 729135 - DNA, 15 bp, Homo sapiens
tgtggcctgtgtcca

SEQ ID NO: 729136 - DNA, 16 bp, Homo sapiens
tgtggcctgtgtccag

SEQ ID NO: 729137 - DNA, 15 bp, Homo sapiens
tgtggccttttttat

SEQ ID NO: 729138 - DNA, 16 bp, Homo sapiens
tgtggcgggcagtggg

SEQ ID NO: 729139 - DNA, 13 bp, Homo sapiens
tgtggcggtgcct

SEQ ID NO: 729140 - DNA, 21 bp, Homo sapiens
tgtggctcagtgccttcctct

SEQ ID NO: 729141 - DNA, 14 bp, Homo sapiens
tgtggctcccctct

SEQ ID NO: 729142 - DNA, 15 bp, Homo sapiens
tgtggctcccctcta

SEQ ID NO: 729143 - DNA, 23 bp, Homo sapiens
tgtggctcccctctatttagcat

SEQ ID NO: 729144 - DNA, 13 bp, Homo sapiens
tgtggctcctacc

SEQ ID NO: 729145 - DNA, 14 bp, Homo sapiens
tgtggctccttccc

SEQ ID NO: 729146 - DNA, 22 bp, Homo sapiens
tgtggctgctatttcatctggt

SEQ ID NO: 729147 - DNA, 17 bp, Homo sapiens
tgtggctggctctacct

SEQ ID NO: 729148 - DNA, 18 bp, Homo sapiens
tgtggctgggggcaggag

SEQ ID NO: 729149 - DNA, 20 bp, Homo sapiens
tgtggctggtgtccccttcc

SEQ ID NO: 729150 - DNA, 20 bp, Homo sapiens
tgtggctgtagatcccaaga

SEQ ID NO: 729151 - DNA, 22 bp, Homo sapiens
tgtggcttctctgtctctgtgg

SEQ ID NO: 729152 - DNA, 13 bp, Homo sapiens
tgtggctttccag

SEQ ID NO: 729153 - DNA, 19 bp, Homo sapiens
tgtggctttttgttcagaa

SEQ ID NO: 729154 - DNA, 21 bp, Homo sapiens
tgtgggaaaaaaatgaatgag

SEQ ID NO: 729155 - DNA, 11 bp, Homo sapiens
tgtgggaaagc

SEQ ID NO: 729156 - DNA, 15 bp, Homo sapiens
tgtgggaagaaacaa

SEQ ID NO: 729157 - DNA, 15 bp, Homo sapiens
tgtgggaagaccaaa

SEQ ID NO: 729158 - DNA, 15 bp, Homo sapiens
tgtgggaaggccagc

SEQ ID NO: 729159 - DNA, 18 bp, Homo sapiens
tgtgggaatgcggcaaga

SEQ ID NO: 729160 - DNA, 19 bp, Homo sapiens
tgtgggaatgcggcaagaa

SEQ ID NO: 729161 - DNA, 14 bp, Homo sapiens
tgtgggacacctgg

SEQ ID NO: 729162 - DNA, 17 bp, Homo sapiens
tgtgggagacagcagcc

SEQ ID NO: 729163 - DNA, 18 bp, Homo sapiens
tgtgggagggggaggaag

SEQ ID NO: 729164 - DNA, 19 bp, Homo sapiens
tgtgggatgttcagcactg

SEQ ID NO: 729165 - DNA, 17 bp, Homo sapiens
tgtgggcaaaggcaggg

SEQ ID NO: 729166 - DNA, 20 bp, Homo sapiens
tgtgggcaaaggcagggcca

SEQ ID NO: 729167 - DNA, 18 bp, Homo sapiens
tgtgggcactggcccagg

SEQ ID NO: 729168 - DNA, 17 bp, Homo sapiens
tgtgggcagcaccctcc

SEQ ID NO: 729169 - DNA, 19 bp, Homo sapiens
tgtgggcagcaccctcccc

SEQ ID NO: 729170 - DNA, 19 bp, Homo sapiens
tgtgggcagcatgcccaga

SEQ ID NO: 729171 - DNA, 19 bp, Homo sapiens
tgtgggcaggcaagccctt

SEQ ID NO: 729172 - DNA, 14 bp, Homo sapiens
tgtgggcatggccg

SEQ ID NO: 729173 - DNA, 18 bp, Homo sapiens
tgtgggccaagtccactg

SEQ ID NO: 729174 - DNA, 21 bp, Homo sapiens
tgtgggcctcaaggacttgaa

SEQ ID NO: 729175 - DNA, 19 bp, Homo sapiens
tgtgggctggtgccccaca

SEQ ID NO: 729176 - DNA, 23 bp, Homo sapiens
tgtggggaaccaattgctttgtc

SEQ ID NO: 729177 - DNA, 23 bp, Homo sapiens
tgtggggaagaggggctggggca

SEQ ID NO: 729178 - DNA, 16 bp, Homo sapiens
tgtggggaggctgcac

SEQ ID NO: 729179 - DNA, 17 bp, Homo sapiens
tgtggggaggctgcact

SEQ ID NO: 729180 - DNA, 16 bp, Homo sapiens
tgtggggcaggagtgc

SEQ ID NO: 729181 - DNA, 22 bp, Homo sapiens
tgtggggcaggagtgccaggac

SEQ ID NO: 729182 - DNA, 13 bp, Homo sapiens
tgtggggctgggc

SEQ ID NO: 729183 - DNA, 19 bp, Homo sapiens
tgtgggggagattctgggt

SEQ ID NO: 729184 - DNA, 14 bp, Homo sapiens
tgtgggggtggcca

SEQ ID NO: 729185 - DNA, 20 bp, Homo sapiens
tgtgggggtggccatccctg

SEQ ID NO: 729186 - DNA, 21 bp, Homo sapiens
tgtgggggtggccatccctgg

SEQ ID NO: 729187 - DNA, 22 bp, Homo sapiens
tgtggggtgcagctgggtgggg

SEQ ID NO: 729188 - DNA, 13 bp, Homo sapiens
tgtggggtggggt

SEQ ID NO: 729189 - DNA, 15 bp, Homo sapiens
tgtgggtccccactc

SEQ ID NO: 729190 - DNA, 14 bp, Homo sapiens
tgtgggtcccgcac

SEQ ID NO: 729191 - DNA, 18 bp, Homo sapiens
tgtgggtgaaatggagat

SEQ ID NO: 729192 - DNA, 16 bp, Homo sapiens
tgtgggtgaagcgcct

SEQ ID NO: 729193 - DNA, 21 bp, Homo sapiens
tgtgggtgaatgtgtgttcat

SEQ ID NO: 729194 - DNA, 13 bp, Homo sapiens
tgtgggtgagcca

SEQ ID NO: 729195 - DNA, 14 bp, Homo sapiens
tgtgggtggggagg

SEQ ID NO: 729196 - DNA, 15 bp, Homo sapiens
tgtgggtggggaggc

SEQ ID NO: 729197 - DNA, 19 bp, Homo sapiens
tgtgggtgtgtgcgcctga

SEQ ID NO: 729198 - DNA, 18 bp, Homo sapiens
tgtgggtgttctttcctg

SEQ ID NO: 729199 - DNA, 22 bp, Homo sapiens
tgtgggtgttctttcctgccct

SEQ ID NO: 729200 - DNA, 17 bp, Homo sapiens
tgtgggttggccaggag

SEQ ID NO: 729201 - DNA, 16 bp, Homo sapiens
tgtgggtttctctgtg

SEQ ID NO: 729202 - DNA, 14 bp, Homo sapiens
tgtattttcctgga

SEQ ID NO: 729203 - DNA, 14 bp, Homo sapiens
tgtattttgcatac

SEQ ID NO: 729204 - DNA, 15 bp, Homo sapiens
tgtattttgcatact

SEQ ID NO: 729205 - DNA, 22 bp, Homo sapiens
tgtattttgcatactcaaggtg

SEQ ID NO: 729206 - DNA, 18 bp, Homo sapiens
tgtattttggctttctcc

SEQ ID NO: 729207 - DNA, 20 bp, Homo sapiens
tgtattttggctttctccct

SEQ ID NO: 729208 - DNA, 15 bp, Homo sapiens
tgtattttgtccaag

SEQ ID NO: 729209 - DNA, 15 bp, Homo sapiens
tgtattttgtgtgac

SEQ ID NO: 729210 - DNA, 14 bp, Homo sapiens
tgtatttttaatgg

SEQ ID NO: 729211 - DNA, 21 bp, Homo sapiens
tgtatttttactattgaactg

SEQ ID NO: 729212 - DNA, 19 bp, Homo sapiens
tgtatttttagtagagatg

SEQ ID NO: 729213 - DNA, 16 bp, Homo sapiens
tgtattttttaaaaca

SEQ ID NO: 729214 - DNA, 19 bp, Homo sapiens
tgtattttttaaaacacta

SEQ ID NO: 729215 - DNA, 14 bp, Homo sapiens
tgtattttttaaag

SEQ ID NO: 729216 - DNA, 22 bp, Homo sapiens
tgtattttttatttacatttta

SEQ ID NO: 729217 - DNA, 14 bp, Homo sapiens
tgtattttttcctt

SEQ ID NO: 729218 - DNA, 15 bp, Homo sapiens
tgtattttttcctta

SEQ ID NO: 729219 - DNA, 14 bp, Homo sapiens
tgtatttttttaac

SEQ ID NO: 729220 - DNA, 23 bp, Homo sapiens
tgtcaaaaaagaatctgtattca

SEQ ID NO: 729221 - DNA, 15 bp, Homo sapiens
tgtcaaaacactgtg

SEQ ID NO: 729222 - DNA, 18 bp, Homo sapiens
tgtcaaaacactgtggaa

SEQ ID NO: 729223 - DNA, 20 bp, Homo sapiens
tgtcaaactgaaattcagag

SEQ ID NO: 729224 - DNA, 18 bp, Homo sapiens
tgtcaaactgtagaaatg

SEQ ID NO: 729225 - DNA, 14 bp, Homo sapiens
tgtcaaagaagctt

SEQ ID NO: 729226 - DNA, 23 bp, Homo sapiens
tgtcaaagaagcttccacaaaat

SEQ ID NO: 729227 - DNA, 14 bp, Homo sapiens
tgtcaaatgaactt

SEQ ID NO: 729228 - DNA, 15 bp, Homo sapiens
tgtcaaatgaacttt

SEQ ID NO: 729229 - DNA, 19 bp, Homo sapiens
tgtcaaatgatgtgcaaaa

SEQ ID NO: 729230 - DNA, 20 bp, Homo sapiens
tgtcaaatgcccactctcca

SEQ ID NO: 729231 - DNA, 19 bp, Homo sapiens
tgtcaaattttcaaataat

SEQ ID NO: 729232 - DNA, 15 bp, Homo sapiens
tgtcaactatgatat

SEQ ID NO: 729233 - DNA, 15 bp, Homo sapiens
tgtcaactctttgtt

SEQ ID NO: 729234 - DNA, 18 bp, Homo sapiens
tgtcaactgagagtcata

SEQ ID NO: 729235 - DNA, 15 bp, Homo sapiens
tgtcaacttttgact

SEQ ID NO: 729236 - DNA, 19 bp, Homo sapiens
tgtcaagaagatgatcaga

SEQ ID NO: 729237 - DNA, 14 bp, Homo sapiens
tgtcaagcaatggg

SEQ ID NO: 729238 - DNA, 19 bp, Homo sapiens
tgtcaagcatattggaaag

SEQ ID NO: 729239 - DNA, 23 bp, Homo sapiens
tgtcaagcatattggaaagtgat

SEQ ID NO: 729240 - DNA, 23 bp, Homo sapiens
tgtgtctgtaggtgtctctgggc

SEQ ID NO: 729241 - DNA, 14 bp, Homo sapiens
tgtgtctgtcacag

SEQ ID NO: 729242 - DNA, 15 bp, Homo sapiens
tgtgtctgtcacagg

SEQ ID NO: 729243 - DNA, 20 bp, Homo sapiens
tgtgtctgtcacaggctggg

SEQ ID NO: 729244 - DNA, 19 bp, Homo sapiens
tgtgtctgtctttgtggga

SEQ ID NO: 729245 - DNA, 21 bp, Homo sapiens
tgtgtctgtgccctccaaaga

SEQ ID NO: 729246 - DNA, 15 bp, Homo sapiens
tgtgtctgtgttgct

SEQ ID NO: 729247 - DNA, 16 bp, Homo sapiens
tgtgtctgtgtttaat

SEQ ID NO: 729248 - DNA, 14 bp, Homo sapiens
tgtgtcttaattat

SEQ ID NO: 729249 - DNA, 16 bp, Homo sapiens
tgtgtcttaattatta

SEQ ID NO: 729250 - DNA, 17 bp, Homo sapiens
tgtgtcttcaatttgta

SEQ ID NO: 729251 - DNA, 22 bp, Homo sapiens
tgtgtctttccagaaggtcacg

SEQ ID NO: 729252 - DNA, 12 bp, Homo sapiens
tgtgtctttcta

SEQ ID NO: 729253 - DNA, 17 bp, Homo sapiens
tgtgtcttttaaactgg

SEQ ID NO: 729254 - DNA, 15 bp, Homo sapiens
tgtgtgaaacaatgt

SEQ ID NO: 729255 - DNA, 22 bp, Homo sapiens
tgtgtgaaacaatgttgtccaa

SEQ ID NO: 729256 - DNA, 22 bp, Homo sapiens
tgtgtgaaaggaagctccactg

SEQ ID NO: 729257 - DNA, 20 bp, Homo sapiens
tgtgtgaaataccagtgtgg

SEQ ID NO: 729258 - DNA, 20 bp, Homo sapiens
tgtgtgaactgctttcaagt

SEQ ID NO: 729259 - DNA, 15 bp, Homo sapiens
tgtgtgaactgggca

SEQ ID NO: 729260 - DNA, 16 bp, Homo sapiens
tgtgtgaatgaacact

SEQ ID NO: 729261 - DNA, 17 bp, Homo sapiens
tgtgtgaatgaacactc

SEQ ID NO: 729262 - DNA, 19 bp, Homo sapiens
tgtgtgacagaatcttgta

SEQ ID NO: 729263 - DNA, 12 bp, Homo sapiens
tgtgtgaccaac

SEQ ID NO: 729264 - DNA, 17 bp, Homo sapiens
tgtgtgaccaactgtgt

SEQ ID NO: 729265 - DNA, 20 bp, Homo sapiens
tgtgtgaccaactgtgttgt

SEQ ID NO: 729266 - DNA, 23 bp, Homo sapiens
tgtgtgagaggggcgccttttca

SEQ ID NO: 729267 - DNA, 14 bp, Homo sapiens
tgtgtgagcagtgg

SEQ ID NO: 729268 - DNA, 21 bp, Homo sapiens
tgtgtttactttttggctgga

SEQ ID NO: 729269 - DNA, 12 bp, Homo sapiens
tgtgtttatatg

SEQ ID NO: 729270 - DNA, 15 bp, Homo sapiens
tgtgtttatttcact

SEQ ID NO: 729271 - DNA, 22 bp, Homo sapiens
tgtgtttcaaaaccatgcctgg

SEQ ID NO: 729272 - DNA, 15 bp, Homo sapiens
tgtgtttcaagttca

SEQ ID NO: 729273 - DNA, 18 bp, Homo sapiens
tgtgtttcacttaatgtt

SEQ ID NO: 729274 - DNA, 21 bp, Homo sapiens
tgtgtttccagatcgatcctg

SEQ ID NO: 729275 - DNA, 12 bp, Homo sapiens
tgtgtttctgta

SEQ ID NO: 729276 - DNA, 15 bp, Homo sapiens
tgtgtttctgtataa

SEQ ID NO: 729277 - DNA, 14 bp, Homo sapiens
tgtgtttctttata

SEQ ID NO: 729278 - DNA, 14 bp, Homo sapiens
tgtgtttgaagttt

SEQ ID NO: 729279 - DNA, 13 bp, Homo sapiens
tgtgtttgacatg

SEQ ID NO: 729280 - DNA, 10 bp, Homo sapiens
tgtgtttgcc

SEQ ID NO: 729281 - DNA, 21 bp, Homo sapiens
tgtgtttgcttaaacaaagtg

SEQ ID NO: 729282 - DNA, 18 bp, Homo sapiens
tgtgtttggttctggggc

SEQ ID NO: 729283 - DNA, 18 bp, Homo sapiens
tgtgtttgttcataataa

SEQ ID NO: 729284 - DNA, 14 bp, Homo sapiens
tgtgttttaaaaaa

SEQ ID NO: 729285 - DNA, 14 bp, Homo sapiens
tgtgttttcatcat

SEQ ID NO: 729286 - DNA, 23 bp, Homo sapiens
tgtgttttctgaataacatttgt

SEQ ID NO: 729287 - DNA, 16 bp, Homo sapiens
tgtgttttctgtagac

SEQ ID NO: 729288 - DNA, 16 bp, Homo sapiens
tgtgttttgaaagaat

SEQ ID NO: 729289 - DNA, 22 bp, Homo sapiens
tgtgttttgtcctgcctcttgt

SEQ ID NO: 729290 - DNA, 14 bp, Homo sapiens
tgtgtttttaaaag

SEQ ID NO: 729291 - DNA, 14 bp, Homo sapiens
tgttccctctgctc

SEQ ID NO: 729292 - DNA, 15 bp, Homo sapiens
tgttccctctggctt

SEQ ID NO: 729293 - DNA, 17 bp, Homo sapiens
tgttccctgcaccctgg

SEQ ID NO: 729294 - DNA, 11 bp, Homo sapiens
tgttccctgga

SEQ ID NO: 729295 - DNA, 14 bp, Homo sapiens
tgttcccttcctct

SEQ ID NO: 729296 - DNA, 21 bp, Homo sapiens
tgttccgcttctctcttttaa

SEQ ID NO: 729297 - DNA, 16 bp, Homo sapiens
tgttcctatctgcagg

SEQ ID NO: 729298 - DNA, 15 bp, Homo sapiens
tgttcctatggaaac

SEQ ID NO: 729299 - DNA, 18 bp, Homo sapiens
tgttcctatggaaacatt

SEQ ID NO: 729300 - DNA, 19 bp, Homo sapiens
tgttcctatggaaacattt

SEQ ID NO: 729301 - DNA, 17 bp, Homo sapiens
tgttcctcaaggtccat

SEQ ID NO: 729302 - DNA, 15 bp, Homo sapiens
tgttcctccattttc

SEQ ID NO: 729303 - DNA, 17 bp, Homo sapiens
tgttcctccattttctt

SEQ ID NO: 729304 - DNA, 22 bp, Homo sapiens
tgttcctctagtagtatattta

SEQ ID NO: 729305 - DNA, 15 bp, Homo sapiens
tgttcctgaagctgc

SEQ ID NO: 729306 - DNA, 18 bp, Homo sapiens
tgttcctgaagctgctgt

SEQ ID NO: 729307 - DNA, 23 bp, Homo sapiens
tgttcctgcagccccagaagaaa

SEQ ID NO: 729308 - DNA, 13 bp, Homo sapiens
tgttcctgctctt

SEQ ID NO: 729309 - DNA, 18 bp, Homo sapiens
tgttcctgctcttcccag

SEQ ID NO: 729310 - DNA, 19 bp, Homo sapiens
tgttcctggcagtttaaaa

SEQ ID NO: 729311 - DNA, 14 bp, Homo sapiens
tgttcctggctgat

SEQ ID NO: 729312 - DNA, 15 bp, Homo sapiens
tgttcctgtgttctt

SEQ ID NO: 729313 - DNA, 19 bp, Homo sapiens
tgttccttagaccttccat

SEQ ID NO: 729314 - DNA, 16 bp, Homo sapiens
tgttccttatttctct

SEQ ID NO: 729315 - DNA, 13 bp, Homo sapiens
tgttccttcctcc

SEQ ID NO: 729316 - DNA, 22 bp, Homo sapiens
tgttcctttatttaggaaacac

SEQ ID NO: 729317 - DNA, 22 bp, Homo sapiens
tgttccttttctctcctgtgtg

SEQ ID NO: 729318 - DNA, 13 bp, Homo sapiens
tgttccttttgaa

SEQ ID NO: 729319 - DNA, 20 bp, Homo sapiens
tgttcgcatggtcacacact

SEQ ID NO: 729320 - DNA, 15 bp, Homo sapiens
tgttcgctcctccca

SEQ ID NO: 729321 - DNA, 20 bp, Homo sapiens
tgttcggaaggggttcctca

SEQ ID NO: 729322 - DNA, 21 bp, Homo sapiens
tgttcgggggagcagagagag

SEQ ID NO: 729323 - DNA, 22 bp, Homo sapiens
tgttcgggggagcagagagagc

SEQ ID NO: 729324 - DNA, 22 bp, Homo sapiens
tgttcgtctttagttttgattt

SEQ ID NO: 729325 - DNA, 17 bp, Homo sapiens
tgttcgtttccatcatg

SEQ ID NO: 729326 - DNA, 11 bp, Homo sapiens
tgttctagact

SEQ ID NO: 729327 - DNA, 16 bp, Homo sapiens
tgttctagacttcccc

SEQ ID NO: 729328 - DNA, 19 bp, Homo sapiens
tgttctagacttccccatc

SEQ ID NO: 729329 - DNA, 20 bp, Homo sapiens
tgttctagacttccccatcc

SEQ ID NO: 729330 - DNA, 14 bp, Homo sapiens
tgttctagtttttt

SEQ ID NO: 729331 - DNA, 21 bp, Homo sapiens
tgttctattaatcacctctct

SEQ ID NO: 729332 - DNA, 19 bp, Homo sapiens
tgttctatttaacaactgg

SEQ ID NO: 729333 - DNA, 22 bp, Homo sapiens
tgttctcacaccaacagtgtga

SEQ ID NO: 729334 - DNA, 12 bp, Homo sapiens
tgttctcagatt

SEQ ID NO: 729335 - DNA, 15 bp, Homo sapiens
tgttctcatgaagca

SEQ ID NO: 729336 - DNA, 21 bp, Homo sapiens
tgttctcatgaagcaggaggc

SEQ ID NO: 729337 - DNA, 20 bp, Homo sapiens
tgttctccgggtgtggcctc

SEQ ID NO: 729338 - DNA, 21 bp, Homo sapiens
tgttctccttttcctctctcc

SEQ ID NO: 729339 - DNA, 15 bp, Homo sapiens
tgttctctcttctcc

SEQ ID NO: 729340 - DNA, 17 bp, Homo sapiens
tgttctctgctgagggc

SEQ ID NO: 729341 - DNA, 15 bp, Homo sapiens
tgttctctgggagaa

SEQ ID NO: 729342 - DNA, 17 bp, Homo sapiens
tgttctctgggagaaaa

SEQ ID NO: 729343 - DNA, 18 bp, Homo sapiens
tgttctcttcccaggcct

SEQ ID NO: 729344 - DNA, 13 bp, Homo sapiens
tgttctcttctgc

SEQ ID NO: 729345 - DNA, 23 bp, Homo sapiens
tgttctcttgggaactgaactca

SEQ ID NO: 729346 - DNA, 17 bp, Homo sapiens
tgttctgaaatgttctt

SEQ ID NO: 729347 - DNA, 21 bp, Homo sapiens
tgttctgaagtgggaaaaaat

SEQ ID NO: 729348 - DNA, 19 bp, Homo sapiens
tgttctgacattaacagtt

SEQ ID NO: 729349 - DNA, 15 bp, Homo sapiens
tgttctgaccctgct

SEQ ID NO: 729350 - DNA, 18 bp, Homo sapiens
tgttctgaccctgcttca

SEQ ID NO: 729351 - DNA, 20 bp, Homo sapiens
tgttctgagtaagtgtgttc

SEQ ID NO: 729352 - DNA, 22 bp, Homo sapiens
tgttctgattagaaatgaccaa

SEQ ID NO: 729353 - DNA, 18 bp, Homo sapiens
tgttctgcaagaattaaa

SEQ ID NO: 729354 - DNA, 20 bp, Homo sapiens
tgttctgcaagaattaaaac

SEQ ID NO: 729355 - DNA, 21 bp, Homo sapiens
tgttctgcagtggagaagaca

SEQ ID NO: 729356 - DNA, 14 bp, Homo sapiens
tgttctgcccccag

SEQ ID NO: 729357 - DNA, 16 bp, Homo sapiens
tgttctgcccccagcc

SEQ ID NO: 729358 - DNA, 18 bp, Homo sapiens
tgttctgcccccagccca

SEQ ID NO: 729359 - DNA, 15 bp, Homo sapiens
tgttctgctcctgct

SEQ ID NO: 729360 - DNA, 24 bp, Homo sapiens
tgttctgctcctgcttttctgtcc

SEQ ID NO: 729361 - DNA, 23 bp, Homo sapiens
tgttctggactacacccaagcct

SEQ ID NO: 729362 - DNA, 13 bp, Homo sapiens
tgttctgggctgg

SEQ ID NO: 729363 - DNA, 12 bp, Homo sapiens
tgttctggggga

SEQ ID NO: 729364 - DNA, 17 bp, Homo sapiens
tgttctgtagctttctg

SEQ ID NO: 729365 - DNA, 20 bp, Homo sapiens
tgttctgtagctttctggaa

SEQ ID NO: 729366 - DNA, 15 bp, Homo sapiens
tgttctgtcttccca

SEQ ID NO: 729367 - DNA, 17 bp, Homo sapiens
tgttctgtcttcccaaa

SEQ ID NO: 729368 - DNA, 18 bp, Homo sapiens
tgttctgtcttcccaaac

SEQ ID NO: 729369 - DNA, 20 bp, Homo sapiens
tgttctgtgggcttggcctt

SEQ ID NO: 729370 - DNA, 19 bp, Homo sapiens
tgttctgtggtcacagtga

SEQ ID NO: 729371 - DNA, 12 bp, Homo sapiens
tgttctgtgtcc

SEQ ID NO: 729372 - DNA, 13 bp, Homo sapiens
tgttctgttctgg

SEQ ID NO: 729373 - DNA, 10 bp, Homo sapiens
tgttctgttt

SEQ ID NO: 729374 - DNA, 16 bp, Homo sapiens
tgttctgtttgaaact

SEQ ID NO: 729375 - DNA, 17 bp, Homo sapiens
tgttctgtttggcactt

SEQ ID NO: 729376 - DNA, 22 bp, Homo sapiens
tgttctgtttggcacttgtatt

SEQ ID NO: 729377 - DNA, 14 bp, Homo sapiens
tgttctgtttgtta

SEQ ID NO: 729378 - DNA, 16 bp, Homo sapiens
tgttctgtttgttaaa

SEQ ID NO: 729379 - DNA, 16 bp, Homo sapiens
tgttcttaagacgtga

SEQ ID NO: 729380 - DNA, 16 bp, Homo sapiens
tgttcttaattcttag

SEQ ID NO: 729381 - DNA, 15 bp, Homo sapiens
tgttcttaattgtga

SEQ ID NO: 729382 - DNA, 14 bp, Homo sapiens
tgttcttacaaatg

SEQ ID NO: 729383 - DNA, 17 bp, Homo sapiens
tgttcttacctgtatgt

SEQ ID NO: 729384 - DNA, 15 bp, Homo sapiens
tgttcttagagtgta

SEQ ID NO: 729385 - DNA, 20 bp, Homo sapiens
tgttcttagtgacacacact

SEQ ID NO: 729386 - DNA, 18 bp, Homo sapiens
tgttcttagtttgcagtt

SEQ ID NO: 729387 - DNA, 14 bp, Homo sapiens
tgttcttcacttct

SEQ ID NO: 729388 - DNA, 20 bp, Homo sapiens
tgttcttcacttctgggaaa

SEQ ID NO: 729389 - DNA, 13 bp, Homo sapiens
tgttcttccttcc

SEQ ID NO: 729390 - DNA, 12 bp, Homo sapiens
tgttcttcttgg

SEQ ID NO: 729391 - DNA, 21 bp, Homo sapiens
tgttcttgcataggctcttaa

SEQ ID NO: 729392 - DNA, 19 bp, Homo sapiens
tgttcttgccactgcactc

SEQ ID NO: 729393 - DNA, 15 bp, Homo sapiens
tgttcttggttcctg

SEQ ID NO: 729394 - DNA, 20 bp, Homo sapiens
tgttcttggttcctgtttga

SEQ ID NO: 729395 - DNA, 18 bp, Homo sapiens
tgttctttccaaagtaca

SEQ ID NO: 729396 - DNA, 16 bp, Homo sapiens
tgttctttcctgccct

SEQ ID NO: 729397 - DNA, 17 bp, Homo sapiens
tgttctttcctgccctg

SEQ ID NO: 729398 - DNA, 16 bp, Homo sapiens
tgttctttctggagtc

SEQ ID NO: 729399 - DNA, 20 bp, Homo sapiens
tgttctttctggctatgcat

SEQ ID NO: 729400 - DNA, 22 bp, Homo sapiens
tgttctttctggctatgcattt

SEQ ID NO: 729401 - DNA, 23 bp, Homo sapiens
tgttctttctggctatgcatttg

SEQ ID NO: 729402 - DNA, 18 bp, Homo sapiens
tgttctttggaaagtaca

SEQ ID NO: 729403 - DNA, 14 bp, Homo sapiens
tgtttcatatctgg

SEQ ID NO: 729404 - DNA, 12 bp, Homo sapiens
tgtttcattatg

SEQ ID NO: 729405 - DNA, 15 bp, Homo sapiens
tgtttcattcatcct

SEQ ID NO: 729406 - DNA, 11 bp, Homo sapiens
tgtttccagaa

SEQ ID NO: 729407 - DNA, 15 bp, Homo sapiens
tgtttccaggagaaa

SEQ ID NO: 729408 - DNA, 20 bp, Homo sapiens
tgtttccattttaaggatat

SEQ ID NO: 729409 - DNA, 15 bp, Homo sapiens
tgtttccccatctct

SEQ ID NO: 729410 - DNA, 17 bp, Homo sapiens
tgtttccccatctctgt

SEQ ID NO: 729411 - DNA, 21 bp, Homo sapiens
tgtttccccatctctgtctgg

SEQ ID NO: 729412 - DNA, 14 bp, Homo sapiens
tgtttccctcgtcc

SEQ ID NO: 729413 - DNA, 14 bp, Homo sapiens
tgtttcccttcctc

SEQ ID NO: 729414 - DNA, 15 bp, Homo sapiens
tgtttcccttgcttt

SEQ ID NO: 729415 - DNA, 20 bp, Homo sapiens
tgtttccctttcactggcat

SEQ ID NO: 729416 - DNA, 21 bp, Homo sapiens
tgtttcctaatatcaaatgca

SEQ ID NO: 729417 - DNA, 16 bp, Homo sapiens
tgtttcctcttccaaa

SEQ ID NO: 729418 - DNA, 16 bp, Homo sapiens
tgtttcctgcaggcca

SEQ ID NO: 729419 - DNA, 14 bp, Homo sapiens
tgtttcctggcaat

SEQ ID NO: 729420 - DNA, 15 bp, Homo sapiens
tgtttccttaaacat

SEQ ID NO: 729421 - DNA, 22 bp, Homo sapiens
tgtttccttgtgcctgctcctg

SEQ ID NO: 729422 - DNA, 21 bp, Homo sapiens
tgtttccttgttggtcagagg

SEQ ID NO: 729423 - DNA, 23 bp, Homo sapiens
tgtttccttgtttatcagataca

SEQ ID NO: 729424 - DNA, 16 bp, Homo sapiens
tgtttcctttttcaga

SEQ ID NO: 729425 - DNA, 16 bp, Homo sapiens
tgtttccttttttccc

SEQ ID NO: 729426 - DNA, 21 bp, Homo sapiens
tgtttcgagtaaacttgaaaa

SEQ ID NO: 729427 - DNA, 20 bp, Homo sapiens
tgtttcgcattaagcacaca

SEQ ID NO: 729428 - DNA, 15 bp, Homo sapiens
tgtttcgtgaagtat

SEQ ID NO: 729429 - DNA, 19 bp, Homo sapiens
tgtttcgtgaagtatactg

SEQ ID NO: 729430 - DNA, 20 bp, Homo sapiens
tgtttcgtgaagtatactgt

SEQ ID NO: 729431 - DNA, 14 bp, Homo sapiens
tgtttctagaacag

SEQ ID NO: 729432 - DNA, 15 bp, Homo sapiens
tgtttctaggctgtt

SEQ ID NO: 729433 - DNA, 22 bp, Homo sapiens
tgtttctattttttgaaaagca

SEQ ID NO: 729434 - DNA, 21 bp, Homo sapiens
tgtttctccacaacagcctgg

SEQ ID NO: 729435 - DNA, 22 bp, Homo sapiens
tgtttctccacaacagcctggg

SEQ ID NO: 729436 - DNA, 23 bp, Homo sapiens
tgtttctccacaacagcctgggg

SEQ ID NO: 729437 - DNA, 15 bp, Homo sapiens
tgtttctcctgagct

SEQ ID NO: 729438 - DNA, 17 bp, Homo sapiens
tgtttctccttctgaaa

SEQ ID NO: 729439 - DNA, 14 bp, Homo sapiens
tgtttctctgctgt

SEQ ID NO: 729440 - DNA, 18 bp, Homo sapiens
tgtttctcttgagctggc

SEQ ID NO: 729441 - DNA, 20 bp, Homo sapiens
tgtttctcttgagctggcct

SEQ ID NO: 729442 - DNA, 21 bp, Homo sapiens
tgtttctgaaaattccagaaa

SEQ ID NO: 729443 - DNA, 18 bp, Homo sapiens
tgtttctgacacaagatc

SEQ ID NO: 729444 - DNA, 12 bp, Homo sapiens
tgtttctgactc

SEQ ID NO: 729445 - DNA, 19 bp, Homo sapiens
tgtttctgactctgagcta

SEQ ID NO: 729446 - DNA, 19 bp, Homo sapiens
tgtttctggaagactgctc

SEQ ID NO: 729447 - DNA, 22 bp, Homo sapiens
tgtttctgggtccctgctcccc

SEQ ID NO: 729448 - DNA, 13 bp, Homo sapiens
tgtttctgtaaca

SEQ ID NO: 729449 - DNA, 21 bp, Homo sapiens
tgtttctgtaacaaattggga

SEQ ID NO: 729450 - DNA, 13 bp, Homo sapiens
tgtttctgtagaa

SEQ ID NO: 729451 - DNA, 14 bp, Homo sapiens
tgtttctgtagaaa

SEQ ID NO: 729452 - DNA, 12 bp, Homo sapiens
tgtttctgtcct

SEQ ID NO: 729453 - DNA, 22 bp, Homo sapiens
tgtttctgtcctgtaactgtta

SEQ ID NO: 729454 - DNA, 13 bp, Homo sapiens
tgtttctgtgccc

SEQ ID NO: 729455 - DNA, 12 bp, Homo sapiens
tgtttctgttat

SEQ ID NO: 729456 - DNA, 19 bp, Homo sapiens
tgtttctgttattaacaaa

SEQ ID NO: 729457 - DNA, 16 bp, Homo sapiens
tgtttctgttccaaat

SEQ ID NO: 729458 - DNA, 13 bp, Homo sapiens
tgtttctgtttct

SEQ ID NO: 729459 - DNA, 14 bp, Homo sapiens
tgtttctgtttctt

SEQ ID NO: 729460 - DNA, 23 bp, Homo sapiens
tgtttcttctttcttttaagcag

SEQ ID NO: 729461 - DNA, 12 bp, Homo sapiens
tgtttcttgctc

SEQ ID NO: 729462 - DNA, 21 bp, Homo sapiens
tgtttctttctctgaggacaa

SEQ ID NO: 729463 - DNA, 17 bp, Homo sapiens
tgtttctttcttcctct

SEQ ID NO: 729464 - DNA, 15 bp, Homo sapiens
tgtttcttttcacat

SEQ ID NO: 729465 - DNA, 14 bp, Homo sapiens
tgtttcttttgtat

SEQ ID NO: 729466 - DNA, 20 bp, Homo sapiens
tgtttcttttgtatgtaaat

SEQ ID NO: 729467 - DNA, 21 bp, Homo sapiens
tgtttcttttgtatgtaaatg

SEQ ID NO: 729468 - DNA, 23 bp, Homo sapiens
tgtttctttttacagcattgtct

SEQ ID NO: 729469 - DNA, 13 bp, Homo sapiens
tgtttgaaaatgc

SEQ ID NO: 729470 - DNA, 17 bp, Homo sapiens
tgtttgaaaatgctctt

SEQ ID NO: 729471 - DNA, 18 bp, Homo sapiens
tgtttgaaacaaagaagg

SEQ ID NO: 729472 - DNA, 13 bp, Homo sapiens
tgtttgaaagtag

SEQ ID NO: 729473 - DNA, 16 bp, Homo sapiens
tgtttgaaatatcatg

SEQ ID NO: 729474 - DNA, 13 bp, Homo sapiens
tgtttgaaatctt

SEQ ID NO: 729475 - DNA, 13 bp, Homo sapiens
tgtttgaaatgtc

SEQ ID NO: 729476 - DNA, 18 bp, Homo sapiens
tgtttgaacacttactgt

SEQ ID NO: 729477 - DNA, 19 bp, Homo sapiens
tgtttgagacagggtctca

SEQ ID NO: 729478 - DNA, 14 bp, Homo sapiens
tgtttgagctcaga

SEQ ID NO: 729479 - DNA, 23 bp, Homo sapiens
tgtttgagctcagacccccactc

SEQ ID NO: 729480 - DNA, 22 bp, Homo sapiens
tgtttgaggatatattttcact

SEQ ID NO: 729481 - DNA, 21 bp, Homo sapiens
tgtttgaggcaaattaactgt

SEQ ID NO: 729482 - DNA, 23 bp, Homo sapiens
tgtttgagtttttcctcccagtg

SEQ ID NO: 729483 - DNA, 13 bp, Homo sapiens
tgtttgatagatt

SEQ ID NO: 729484 - DNA, 21 bp, Homo sapiens
tgtttgatataccaaattaaa

SEQ ID NO: 729485 - DNA, 21 bp, Homo sapiens
tgtttgatgctatttatgcaa

SEQ ID NO: 729486 - DNA, 14 bp, Homo sapiens
tgtttgatgtatgt

SEQ ID NO: 729487 - DNA, 15 bp, Homo sapiens
tgtttgatgtatgtg

SEQ ID NO: 729488 - DNA, 19 bp, Homo sapiens
tgtttgatgtatgtgtgaa

SEQ ID NO: 729489 - DNA, 15 bp, Homo sapiens
tgtttgattccattc

SEQ ID NO: 729490 - DNA, 11 bp, Homo sapiens
tgtttgatttc

SEQ ID NO: 729491 - DNA, 22 bp, Homo sapiens
tgtttgcacctttctagttgaa

SEQ ID NO: 729492 - DNA, 22 bp, Homo sapiens
tgtttgcataaacattctttta

SEQ ID NO: 729493 - DNA, 15 bp, Homo sapiens
tgtttgcatgagaaa

SEQ ID NO: 729494 - DNA, 12 bp, Homo sapiens
tgtttgccaaat

SEQ ID NO: 729495 - DNA, 15 bp, Homo sapiens
tgtttgccaaataaa

SEQ ID NO: 729496 - DNA, 16 bp, Homo sapiens
tgtttgccaagctgaa

SEQ ID NO: 729497 - DNA, 17 bp, Homo sapiens
tgtttgccaagctgaag

SEQ ID NO: 729498 - DNA, 15 bp, Homo sapiens
tgtttgctgttgggt

SEQ ID NO: 729499 - DNA, 12 bp, Homo sapiens
tgtttgcttaaa

SEQ ID NO: 729500 - DNA, 16 bp, Homo sapiens
tgtttgcttaaaatat

SEQ ID NO: 729501 - DNA, 13 bp, Homo sapiens
tgtttgcttaatt

SEQ ID NO: 729502 - DNA, 15 bp, Homo sapiens
tgtttgcttccatta

SEQ ID NO: 729503 - DNA, 23 bp, Homo sapiens
tgtttgcttcttgccatcactgg

SEQ ID NO: 729504 - DNA, 18 bp, Homo sapiens
tgtttggaatattgtcca

SEQ ID NO: 729505 - DNA, 21 bp, Homo sapiens
tgtttggaggagcaaagttaa

SEQ ID NO: 729506 - DNA, 18 bp, Homo sapiens
tgtttggatacatctgct

SEQ ID NO: 729507 - DNA, 18 bp, Homo sapiens
tgtttggcacttgtattt

SEQ ID NO: 729508 - DNA, 19 bp, Homo sapiens
tgtttggcttataaacaca

SEQ ID NO: 729509 - DNA, 17 bp, Homo sapiens
tgtttggcttggccttg

SEQ ID NO: 729510 - DNA, 22 bp, Homo sapiens
tgtttgggatcagcttcttgca

SEQ ID NO: 729511 - DNA, 23 bp, Homo sapiens
tgtttgggggaaaaaaaagaaaa

SEQ ID NO: 729512 - DNA, 18 bp, Homo sapiens
tgtttgggggacgtttct

SEQ ID NO: 729513 - DNA, 20 bp, Homo sapiens
tgtttgggggacgtttctca

SEQ ID NO: 729514 - DNA, 21 bp, Homo sapiens
tgtttgggggacgtttctcat

SEQ ID NO: 729515 - DNA, 21 bp, Homo sapiens
tgtttgggggttctgtttcag

SEQ ID NO: 729516 - DNA, 18 bp, Homo sapiens
tgtttgggtatcctgccc

SEQ ID NO: 729517 - DNA, 18 bp, Homo sapiens
tgtttgggtttttttcct

SEQ ID NO: 729518 - DNA, 16 bp, Homo sapiens
tgtttggttctggggc

SEQ ID NO: 729519 - DNA, 18 bp, Homo sapiens
tgtttggttgtaaatgct

SEQ ID NO: 729520 - DNA, 14 bp, Homo sapiens
tgtttgtaaaacca

SEQ ID NO: 729521 - DNA, 21 bp, Homo sapiens
tgtttgtaaataagagatttg

SEQ ID NO: 729522 - DNA, 13 bp, Homo sapiens
tgtttgtaaatta

SEQ ID NO: 729523 - DNA, 19 bp, Homo sapiens
tgtttgtaagtttgaattt

SEQ ID NO: 729524 - DNA, 21 bp, Homo sapiens
ttaaaataccagccagtaaat

SEQ ID NO: 729525 - DNA, 22 bp, Homo sapiens
ttaaaatactcagtgctaaaca

SEQ ID NO: 729526 - DNA, 20 bp, Homo sapiens
ttaaaatagaaattttgtaa

SEQ ID NO: 729527 - DNA, 19 bp, Homo sapiens
ttaaaatagcaaaagaaga

SEQ ID NO: 729528 - DNA, 17 bp, Homo sapiens
ttaaaatagcatactgt

SEQ ID NO: 729529 - DNA, 23 bp, Homo sapiens
ttaaaatagcgttcttgtaattt

SEQ ID NO: 729530 - DNA, 22 bp, Homo sapiens
ttaaaataggggatatttaagg

SEQ ID NO: 729531 - DNA, 16 bp, Homo sapiens
ttaaaatatatgttct

SEQ ID NO: 729532 - DNA, 18 bp, Homo sapiens
ttaaaatatatgttctgc

SEQ ID NO: 729533 - DNA, 20 bp, Homo sapiens
ttaaaatatatgttctgcaa

SEQ ID NO: 729534 - DNA, 16 bp, Homo sapiens
ttaaaatattcctgca

SEQ ID NO: 729535 - DNA, 19 bp, Homo sapiens
ttaaaatattcctgcattt

SEQ ID NO: 729536 - DNA, 14 bp, Homo sapiens
ttaaaatatttaac

SEQ ID NO: 729537 - DNA, 12 bp, Homo sapiens
ttaaaatatttc

SEQ ID NO: 729538 - DNA, 18 bp, Homo sapiens
ttaaaatatttgaatgaa

SEQ ID NO: 729539 - DNA, 21 bp, Homo sapiens
ttaaaatatttgtctttaaac

SEQ ID NO: 729540 - DNA, 18 bp, Homo sapiens
ttaaaatcactgtcaata

SEQ ID NO: 729541 - DNA, 20 bp, Homo sapiens
ttaaaatcactgtcaatatt

SEQ ID NO: 729542 - DNA, 16 bp, Homo sapiens
ttaaaatcagctattt

SEQ ID NO: 729543 - DNA, 12 bp, Homo sapiens
ttaaaatcctca

SEQ ID NO: 729544 - DNA, 13 bp, Homo sapiens
ttaaaatctggaa

SEQ ID NO: 729545 - DNA, 16 bp, Homo sapiens
ttaaaatctggaaatc

SEQ ID NO: 729546 - DNA, 14 bp, Homo sapiens
ttaaaatcttaaac

SEQ ID NO: 729547 - DNA, 14 bp, Homo sapiens
ttaaaatgaataat

SEQ ID NO: 729548 - DNA, 18 bp, Homo sapiens
ttaaaatgattctctacc

SEQ ID NO: 729549 - DNA, 21 bp, Homo sapiens
ttaaaatgcaggtgaactttt

SEQ ID NO: 729550 - DNA, 18 bp, Homo sapiens
ttaaaatgcattgaaaga

SEQ ID NO: 729551 - DNA, 21 bp, Homo sapiens
ttaaaatgcattgaaagaatt

SEQ ID NO: 729552 - DNA, 23 bp, Homo sapiens
ttaaaatgcgaaattattggttg

SEQ ID NO: 729553 - DNA, 21 bp, Homo sapiens
ttaaaatggatgccttgaata

SEQ ID NO: 729554 - DNA, 21 bp, Homo sapiens
ttaaaatgtcggatttatctt

SEQ ID NO: 729555 - DNA, 12 bp, Homo sapiens
ttaaaatgtgat

SEQ ID NO: 729556 - DNA, 16 bp, Homo sapiens
ttaaaattaagtagaa

SEQ ID NO: 729557 - DNA, 19 bp, Homo sapiens
ttaaaattaagtagaacaa

SEQ ID NO: 729558 - DNA, 23 bp, Homo sapiens
ttaaaattatcaatatctaatat

SEQ ID NO: 729559 - DNA, 12 bp, Homo sapiens
ttaaaattcagt

SEQ ID NO: 729560 - DNA, 23 bp, Homo sapiens
ttaaaattgatttttctcttcat

SEQ ID NO: 729561 - DNA, 11 bp, Homo sapiens
ttaaaattggc

SEQ ID NO: 729562 - DNA, 13 bp, Homo sapiens
ttaaaatttcata

SEQ ID NO: 729563 - DNA, 19 bp, Homo sapiens
ttaaaatttgttcttgtat

SEQ ID NO: 729564 - DNA, 12 bp, Homo sapiens
ttaaaattttgg

SEQ ID NO: 729565 - DNA, 19 bp, Homo sapiens
ttaaacaaaaacaaagaaa

SEQ ID NO: 729566 - DNA, 18 bp, Homo sapiens
ttaaacaaaatttcacag

SEQ ID NO: 729567 - DNA, 15 bp, Homo sapiens
ttaaacaaagcagta

SEQ ID NO: 729568 - DNA, 21 bp, Homo sapiens
ttaaacaaagcagtatataat

SEQ ID NO: 729569 - DNA, 22 bp, Homo sapiens
ttaaacaaagcagtatataata

SEQ ID NO: 729570 - DNA, 23 bp, Homo sapiens
ttaaacaaagcagtatataataa

SEQ ID NO: 729571 - DNA, 14 bp, Homo sapiens
ttaaacaaagtttc

SEQ ID NO: 729572 - DNA, 16 bp, Homo sapiens
ttaaacaaatatgaaa

SEQ ID NO: 729573 - DNA, 22 bp, Homo sapiens
ttaaacaatctttcatgtcttg

SEQ ID NO: 729574 - DNA, 13 bp, Homo sapiens
ttaaacaatgtat

SEQ ID NO: 729575 - DNA, 16 bp, Homo sapiens
ttaaacaatttatttt

SEQ ID NO: 729576 - DNA, 22 bp, Homo sapiens
ttaaacacacagatacacacac

SEQ ID NO: 729577 - DNA, 19 bp, Homo sapiens
ttaaacacatgccttaaat

SEQ ID NO: 729578 - DNA, 13 bp, Homo sapiens
ttaaacacctcct

SEQ ID NO: 729579 - DNA, 14 bp, Homo sapiens
ttaaacagcagtgt

SEQ ID NO: 729580 - DNA, 18 bp, Homo sapiens
ttaaacagtgagcctgaa

SEQ ID NO: 729581 - DNA, 21 bp, Homo sapiens
ttaaacatctagcagtaaata

SEQ ID NO: 729582 - DNA, 21 bp, Homo sapiens
ttaaacatgaaactgaataag

SEQ ID NO: 729583 - DNA, 22 bp, Homo sapiens
ttaaacatgctaaatagttcta

SEQ ID NO: 729584 - DNA, 15 bp, Homo sapiens
ttaaacatgctgtta

SEQ ID NO: 729585 - DNA, 12 bp, Homo sapiens
ttaaacattatt

SEQ ID NO: 729586 - DNA, 15 bp, Homo sapiens
ttaaacattgaagta

SEQ ID NO: 729587 - DNA, 17 bp, Homo sapiens
ttaaacatttgttcctg

SEQ ID NO: 729588 - DNA, 18 bp, Homo sapiens
ttaaacatttgttcctgg

SEQ ID NO: 729589 - DNA, 19 bp, Homo sapiens
ttaaacatttgttcctgga

SEQ ID NO: 729590 - DNA, 19 bp, Homo sapiens
ttaaacccaatcagatgcc

SEQ ID NO: 729591 - DNA, 16 bp, Homo sapiens
ttaaacccatacaatg

SEQ ID NO: 729592 - DNA, 17 bp, Homo sapiens
ttaaacccatacaatgt

SEQ ID NO: 729593 - DNA, 19 bp, Homo sapiens
ttaaacccatacaatgtat

SEQ ID NO: 729594 - DNA, 22 bp, Homo sapiens
ttaaacccatacaatgtatgta

SEQ ID NO: 729595 - DNA, 20 bp, Homo sapiens
ttaaaccctggatcagtcct

SEQ ID NO: 729596 - DNA, 18 bp, Homo sapiens
ttaaacctgaactcagac

SEQ ID NO: 729597 - DNA, 19 bp, Homo sapiens
ttaaacctgtctccactgt

SEQ ID NO: 729598 - DNA, 15 bp, Homo sapiens
ttaaacctttaatga

SEQ ID NO: 729599 - DNA, 14 bp, Homo sapiens
ttaaaccttttatt

SEQ ID NO: 729600 - DNA, 22 bp, Homo sapiens
ttaaacgcgtgatgaagacaga

SEQ ID NO: 729601 - DNA, 16 bp, Homo sapiens
ttaaacgtgtaaattg

SEQ ID NO: 729602 - DNA, 21 bp, Homo sapiens
ttaaactaaataatgaataaa

SEQ ID NO: 729603 - DNA, 20 bp, Homo sapiens
ttaaactaatgaacaaatat

SEQ ID NO: 729604 - DNA, 22 bp, Homo sapiens
ttaaactaggagaaccaaatct

SEQ ID NO: 729605 - DNA, 18 bp, Homo sapiens
ttaaactatgttcctaac

SEQ ID NO: 729606 - DNA, 21 bp, Homo sapiens
ttaaactatgttcctaacaaa

SEQ ID NO: 729607 - DNA, 22 bp, Homo sapiens
ttaaactattagagtatttccc

SEQ ID NO: 729608 - DNA, 14 bp, Homo sapiens
ttaaactcaagaca

SEQ ID NO: 729609 - DNA, 22 bp, Homo sapiens
ttaaactcagggacagagccat

SEQ ID NO: 729610 - DNA, 17 bp, Homo sapiens
ttaaactctgccagaaa

SEQ ID NO: 729611 - DNA, 19 bp, Homo sapiens
ttaaactctggacactcta

SEQ ID NO: 729612 - DNA, 19 bp, Homo sapiens
ttaaactcttcacaaaatc

SEQ ID NO: 729613 - DNA, 20 bp, Homo sapiens
ttaaactgattagtattcag

SEQ ID NO: 729614 - DNA, 12 bp, Homo sapiens
ttaaactgtaca

SEQ ID NO: 729615 - DNA, 19 bp, Homo sapiens
ttaaactgtgtacataact

SEQ ID NO: 729616 - DNA, 18 bp, Homo sapiens
ttaaacttaatctaaatg

SEQ ID NO: 729617 - DNA, 14 bp, Homo sapiens
ttaaacttgaaata

SEQ ID NO: 729618 - DNA, 13 bp, Homo sapiens
ttaaactttgtgc

SEQ ID NO: 729619 - DNA, 18 bp, Homo sapiens
ttaaacttttaattcatt

SEQ ID NO: 729620 - DNA, 20 bp, Homo sapiens
ttaaactttttaaaatactt

SEQ ID NO: 729621 - DNA, 17 bp, Homo sapiens
ttaaagaaaaaaattga

SEQ ID NO: 729622 - DNA, 16 bp, Homo sapiens
ttaaagaaaagatgaa

SEQ ID NO: 729623 - DNA, 15 bp, Homo sapiens
ttaaagaaaattgca

SEQ ID NO: 729624 - DNA, 17 bp, Homo sapiens
ttaaagaaaattgcatg

SEQ ID NO: 729625 - DNA, 18 bp, Homo sapiens
ttaaagaaaattgcatga

SEQ ID NO: 729626 - DNA, 12 bp, Homo sapiens
ttaaagaaatga

SEQ ID NO: 729627 - DNA, 12 bp, Homo sapiens
ttaaagaagacc

SEQ ID NO: 729628 - DNA, 17 bp, Homo sapiens
ttaaagaagctctccag

SEQ ID NO: 729629 - DNA, 14 bp, Homo sapiens
ttaaagaagctgca

SEQ ID NO: 729630 - DNA, 19 bp, Homo sapiens
ttaatgcattaaacctgtc

SEQ ID NO: 729631 - DNA, 22 bp, Homo sapiens
ttaatgcattaaacctgtctcc

SEQ ID NO: 729632 - DNA, 23 bp, Homo sapiens
ttaatgcattaaacctgtctcca

SEQ ID NO: 729633 - DNA, 12 bp, Homo sapiens
ttaatgcccagc

SEQ ID NO: 729634 - DNA, 19 bp, Homo sapiens
ttaatgctctatgtttgta

SEQ ID NO: 729635 - DNA, 20 bp, Homo sapiens
ttaatgctctatgtttgtat

SEQ ID NO: 729636 - DNA, 17 bp, Homo sapiens
ttaatgctgccttttct

SEQ ID NO: 729637 - DNA, 15 bp, Homo sapiens
ttaatgctgtctttg

SEQ ID NO: 729638 - DNA, 21 bp, Homo sapiens
ttaatgctgtttctaagaaaa

SEQ ID NO: 729639 - DNA, 23 bp, Homo sapiens
ttaatgctgtttctaagaaaatg

SEQ ID NO: 729640 - DNA, 14 bp, Homo sapiens
ttaatgcttcattc

SEQ ID NO: 729641 - DNA, 13 bp, Homo sapiens
ttaatggaaagtt

SEQ ID NO: 729642 - DNA, 14 bp, Homo sapiens
ttaatggaaagttg

SEQ ID NO: 729643 - DNA, 14 bp, Homo sapiens
ttaatggaaatgtt

SEQ ID NO: 729644 - DNA, 18 bp, Homo sapiens
ttaatggctgataatttt

SEQ ID NO: 729645 - DNA, 23 bp, Homo sapiens
ttaatggcttccctctttcatct

SEQ ID NO: 729646 - DNA, 21 bp, Homo sapiens
ttaatgggggtagcagctgga

SEQ ID NO: 729647 - DNA, 19 bp, Homo sapiens
ttaatgtatagtaaatcac

SEQ ID NO: 729648 - DNA, 17 bp, Homo sapiens
ttaatgtatataaaaat

SEQ ID NO: 729649 - DNA, 21 bp, Homo sapiens
ttaatgtatataaaaatggct

SEQ ID NO: 729650 - DNA, 18 bp, Homo sapiens
ttaatgtatgttaccaaa

SEQ ID NO: 729651 - DNA, 20 bp, Homo sapiens
ttaatgtcattgctaaaaaa

SEQ ID NO: 729652 - DNA, 11 bp, Homo sapiens
ttaatgtgaat

SEQ ID NO: 729653 - DNA, 22 bp, Homo sapiens
ttaatgtgaatttttgcctatc

SEQ ID NO: 729654 - DNA, 11 bp, Homo sapiens
ttaatgtgagt

SEQ ID NO: 729655 - DNA, 20 bp, Homo sapiens
ttaatgtgatggatggcaca

SEQ ID NO: 729656 - DNA, 23 bp, Homo sapiens
ttaatgttcattttctctgtatg

SEQ ID NO: 729657 - DNA, 23 bp, Homo sapiens
ttaatgttctgaataatttctta

SEQ ID NO: 729658 - DNA, 22 bp, Homo sapiens
ttaatgttctgaatttcctttt

SEQ ID NO: 729659 - DNA, 13 bp, Homo sapiens
ttaatgttctgtg

SEQ ID NO: 729660 - DNA, 17 bp, Homo sapiens
ttaatgtttattcctga

SEQ ID NO: 729661 - DNA, 18 bp, Homo sapiens
ttaatgttttaaatgtac

SEQ ID NO: 729662 - DNA, 13 bp, Homo sapiens
ttaatgttttcat

SEQ ID NO: 729663 - DNA, 15 bp, Homo sapiens
ttaatgttttcatta

SEQ ID NO: 729664 - DNA, 21 bp, Homo sapiens
ttaatgttttcattatgttca

SEQ ID NO: 729665 - DNA, 13 bp, Homo sapiens
ttaatgttttgta

SEQ ID NO: 729666 - DNA, 22 bp, Homo sapiens
ttaattaagcaaagcacccatt

SEQ ID NO: 729667 - DNA, 19 bp, Homo sapiens
ttaattaggggttgctaag

SEQ ID NO: 729668 - DNA, 14 bp, Homo sapiens
ttaattattaatac

SEQ ID NO: 729669 - DNA, 14 bp, Homo sapiens
ttaattattattct

SEQ ID NO: 729670 - DNA, 17 bp, Homo sapiens
ttaattattattcttca

SEQ ID NO: 729671 - DNA, 14 bp, Homo sapiens
ttaattattattta

SEQ ID NO: 729672 - DNA, 15 bp, Homo sapiens
ttaattcactcccac

SEQ ID NO: 729673 - DNA, 15 bp, Homo sapiens
ttaattcagtacaac

SEQ ID NO: 729674 - DNA, 15 bp, Homo sapiens
ttaattcatgtttct

SEQ ID NO: 729675 - DNA, 23 bp, Homo sapiens
ttaattccatattgatgaagatg

SEQ ID NO: 729676 - DNA, 21 bp, Homo sapiens
ttacccgaaagcatcactgcc

SEQ ID NO: 729677 - DNA, 22 bp, Homo sapiens
ttacccgaaagcatcactgcct

SEQ ID NO: 729678 - DNA, 22 bp, Homo sapiens
ttaccctcaggcataggcctgg

SEQ ID NO: 729679 - DNA, 17 bp, Homo sapiens
ttaccctcctctgctgg

SEQ ID NO: 729680 - DNA, 16 bp, Homo sapiens
ttaccctcctgtaaat

SEQ ID NO: 729681 - DNA, 15 bp, Homo sapiens
ttaccctctttgctg

SEQ ID NO: 729682 - DNA, 17 bp, Homo sapiens
ttaccctctttgctgca

SEQ ID NO: 729683 - DNA, 22 bp, Homo sapiens
ttaccctgcgattttgcctgtg

SEQ ID NO: 729684 - DNA, 14 bp, Homo sapiens
ttaccctgtgtcag

SEQ ID NO: 729685 - DNA, 17 bp, Homo sapiens
ttacccttccctgcact

SEQ ID NO: 729686 - DNA, 13 bp, Homo sapiens
ttaccctttagac

SEQ ID NO: 729687 - DNA, 18 bp, Homo sapiens
ttacctaaacagatataa

SEQ ID NO: 729688 - DNA, 15 bp, Homo sapiens
ttacctaaactgagc

SEQ ID NO: 729689 - DNA, 14 bp, Homo sapiens
ttacctaagattac

SEQ ID NO: 729690 - DNA, 18 bp, Homo sapiens
ttacctaccacagtgtct

SEQ ID NO: 729691 - DNA, 21 bp, Homo sapiens
ttacctaccacagtgtctgta

SEQ ID NO: 729692 - DNA, 13 bp, Homo sapiens
ttacctactttga

SEQ ID NO: 729693 - DNA, 15 bp, Homo sapiens
ttacctatctgtgga

SEQ ID NO: 729694 - DNA, 16 bp, Homo sapiens
ttacctcatccatgca

SEQ ID NO: 729695 - DNA, 12 bp, Homo sapiens
ttacctccctcg

SEQ ID NO: 729696 - DNA, 19 bp, Homo sapiens
ttacctcctgcccaggaga

SEQ ID NO: 729697 - DNA, 21 bp, Homo sapiens
ttacctctgatacctcaaccc

SEQ ID NO: 729698 - DNA, 17 bp, Homo sapiens
ttacctgacctcttgct

SEQ ID NO: 729699 - DNA, 23 bp, Homo sapiens
ttacctgacctcttgctgtctct

SEQ ID NO: 729700 - DNA, 16 bp, Homo sapiens
ttacctggaatcaaat

SEQ ID NO: 729701 - DNA, 18 bp, Homo sapiens
ttacctgggcattcttgt

SEQ ID NO: 729702 - DNA, 20 bp, Homo sapiens
ttacctgtggatatttgtat

SEQ ID NO: 729703 - DNA, 15 bp, Homo sapiens
ttacctgttccattg

SEQ ID NO: 729704 - DNA, 19 bp, Homo sapiens
ttaccttttcctattctgt

SEQ ID NO: 729705 - DNA, 17 bp, Homo sapiens
ttaccttttctataagt

SEQ ID NO: 729706 - DNA, 18 bp, Homo sapiens
ttaccttttctgttgtac

SEQ ID NO: 729707 - DNA, 19 bp, Homo sapiens
ttaccttttttatacataa

SEQ ID NO: 729708 - DNA, 23 bp, Homo sapiens
ttacgaaaaaatggtagcatttt

SEQ ID NO: 729709 - DNA, 13 bp, Homo sapiens
ttacgaagacaaa

SEQ ID NO: 729710 - DNA, 20 bp, Homo sapiens
ttacgatctgtttccaaatc

SEQ ID NO: 729711 - DNA, 17 bp, Homo sapiens
ttacggcatcacactta

SEQ ID NO: 729712 - DNA, 20 bp, Homo sapiens
ttacggttttccaggtttaa

SEQ ID NO: 729713 - DNA, 18 bp, Homo sapiens
ttacgtactgtaactgct

SEQ ID NO: 729714 - DNA, 13 bp, Homo sapiens
ttacgtataatgc

SEQ ID NO: 729715 - DNA, 18 bp, Homo sapiens
ttacgtgaagaaataaat

SEQ ID NO: 729716 - DNA, 12 bp, Homo sapiens
ttacgtgagcca

SEQ ID NO: 729717 - DNA, 23 bp, Homo sapiens
ttacgtgcaaacaacctgaatct

SEQ ID NO: 729718 - DNA, 12 bp, Homo sapiens
ttacgtgcattt

SEQ ID NO: 729719 - DNA, 13 bp, Homo sapiens
ttacgtgcattta

SEQ ID NO: 729720 - DNA, 14 bp, Homo sapiens
ttacgtgtatgttt

SEQ ID NO: 729721 - DNA, 15 bp, Homo sapiens
ttacgtttaaagtgc

SEQ ID NO: 729722 - DNA, 19 bp, Homo sapiens
ttacgtttgttattcctag

SEQ ID NO: 729723 - DNA, 17 bp, Homo sapiens
ttactaaaaaaaagatg

SEQ ID NO: 729724 - DNA, 22 bp, Homo sapiens
ttactaaagaaagattacttag

SEQ ID NO: 729725 - DNA, 13 bp, Homo sapiens
ttactaagaagaa

SEQ ID NO: 729726 - DNA, 22 bp, Homo sapiens
ttactaagatgaaattgccaaa

SEQ ID NO: 729727 - DNA, 22 bp, Homo sapiens
ttactaagccacaagaaatttg

SEQ ID NO: 729728 - DNA, 23 bp, Homo sapiens
ttactaagtcaggagtgtagttg

SEQ ID NO: 729729 - DNA, 13 bp, Homo sapiens
ttactaagttttt

SEQ ID NO: 729730 - DNA, 14 bp, Homo sapiens
ttactaagttttta

SEQ ID NO: 729731 - DNA, 17 bp, Homo sapiens
ttactaattatactact

SEQ ID NO: 729732 - DNA, 20 bp, Homo sapiens
ttactacactggtgtgtccc

SEQ ID NO: 729733 - DNA, 18 bp, Homo sapiens
ttactacagccttaatat

SEQ ID NO: 729734 - DNA, 13 bp, Homo sapiens
ttactacagttgt

SEQ ID NO: 729735 - DNA, 14 bp, Homo sapiens
ttactaggtaactt

SEQ ID NO: 729736 - DNA, 18 bp, Homo sapiens
ttactatagcaaagtagt

SEQ ID NO: 729737 - DNA, 22 bp, Homo sapiens
ttactatagcaaagtagtactt

SEQ ID NO: 729738 - DNA, 16 bp, Homo sapiens
ttactatgcacaattt

SEQ ID NO: 729739 - DNA, 20 bp, Homo sapiens
ttagaatcaaacattttgaa

SEQ ID NO: 729740 - DNA, 18 bp, Homo sapiens
ttagaatccaaacttgga

SEQ ID NO: 729741 - DNA, 14 bp, Homo sapiens
ttagaatgaattta

SEQ ID NO: 729742 - DNA, 17 bp, Homo sapiens
ttagaatgaatttatct

SEQ ID NO: 729743 - DNA, 17 bp, Homo sapiens
ttagaatgccataaaat

SEQ ID NO: 729744 - DNA, 17 bp, Homo sapiens
ttagaattaaaaaagca

SEQ ID NO: 729745 - DNA, 13 bp, Homo sapiens
ttagaattattta

SEQ ID NO: 729746 - DNA, 16 bp, Homo sapiens
ttagaattatttaaac

SEQ ID NO: 729747 - DNA, 14 bp, Homo sapiens
ttagacaactagat

SEQ ID NO: 729748 - DNA, 18 bp, Homo sapiens
ttagacaactagatttgt

SEQ ID NO: 729749 - DNA, 21 bp, Homo sapiens
ttagacaactagatttgtcct

SEQ ID NO: 729750 - DNA, 23 bp, Homo sapiens
ttagacaactagatttgtccttt

SEQ ID NO: 729751 - DNA, 14 bp, Homo sapiens
ttagacagaacacc

SEQ ID NO: 729752 - DNA, 17 bp, Homo sapiens
ttagacatcttcagatt

SEQ ID NO: 729753 - DNA, 17 bp, Homo sapiens
ttagaccccatacaagt

SEQ ID NO: 729754 - DNA, 16 bp, Homo sapiens
ttagacctatactgaa

SEQ ID NO: 729755 - DNA, 15 bp, Homo sapiens
ttagacctcagcctg

SEQ ID NO: 729756 - DNA, 15 bp, Homo sapiens
ttagacctttatcca

SEQ ID NO: 729757 - DNA, 17 bp, Homo sapiens
ttagacctttatttttc

SEQ ID NO: 729758 - DNA, 19 bp, Homo sapiens
ttagacctttatttttcta

SEQ ID NO: 729759 - DNA, 20 bp, Homo sapiens
ttagacgccttccaggtcag

SEQ ID NO: 729760 - DNA, 18 bp, Homo sapiens
ttagactacatttagaga

SEQ ID NO: 729761 - DNA, 21 bp, Homo sapiens
ttagactcatcaatcaaataa

SEQ ID NO: 729762 - DNA, 19 bp, Homo sapiens
ttagactcatcttactgta

SEQ ID NO: 729763 - DNA, 13 bp, Homo sapiens
ttagactcttccc

SEQ ID NO: 729764 - DNA, 15 bp, Homo sapiens
ttagactggacagct

SEQ ID NO: 729765 - DNA, 22 bp, Homo sapiens
ttagagaaatgaattataacta

SEQ ID NO: 729766 - DNA, 21 bp, Homo sapiens
ttagagaagtatacataagtt

SEQ ID NO: 729767 - DNA, 15 bp, Homo sapiens
ttagagagaaagaga

SEQ ID NO: 729768 - DNA, 12 bp, Homo sapiens
ttagagagagga

SEQ ID NO: 729769 - DNA, 15 bp, Homo sapiens
ttagagattgcccca

SEQ ID NO: 729770 - DNA, 18 bp, Homo sapiens
ttagagcagcctcgtgga

SEQ ID NO: 729771 - DNA, 20 bp, Homo sapiens
ttagagcagcctcgtggagc

SEQ ID NO: 729772 - DNA, 18 bp, Homo sapiens
ttagaggaaaaaaatgac

SEQ ID NO: 729773 - DNA, 23 bp, Homo sapiens
ttagaggaaataagaaaaatcat

SEQ ID NO: 729774 - DNA, 20 bp, Homo sapiens
ttagaggcattgttagttta

SEQ ID NO: 729775 - DNA, 18 bp, Homo sapiens
ttagagggaggtgtttaa

SEQ ID NO: 729776 - DNA, 18 bp, Homo sapiens
ttagagggccttgcttct

SEQ ID NO: 729777 - DNA, 21 bp, Homo sapiens
ttagagggccttgcttctctt

SEQ ID NO: 729778 - DNA, 23 bp, Homo sapiens
ttagagtatttcccttccaaaga

SEQ ID NO: 729779 - DNA, 22 bp, Homo sapiens
ttagagtcaactacacaaagca

SEQ ID NO: 729780 - DNA, 12 bp, Homo sapiens
ttagagtgccca

SEQ ID NO: 729781 - DNA, 17 bp, Homo sapiens
ttagagtggttattcat

SEQ ID NO: 729782 - DNA, 15 bp, Homo sapiens
ttagagtgtagctgt

SEQ ID NO: 729783 - DNA, 16 bp, Homo sapiens
ttagagtgtctttcca

SEQ ID NO: 729784 - DNA, 14 bp, Homo sapiens
ttagagttgatact

SEQ ID NO: 729785 - DNA, 21 bp, Homo sapiens
ttagataaagatttctagtag

SEQ ID NO: 729786 - DNA, 13 bp, Homo sapiens
ttagatagaagaa

SEQ ID NO: 729787 - DNA, 16 bp, Homo sapiens
ttagatagccctgtcc

SEQ ID NO: 729788 - DNA, 17 bp, Homo sapiens
ttagatagccctgtcct

SEQ ID NO: 729789 - DNA, 18 bp, Homo sapiens
ttagatagccctgtcctg

SEQ ID NO: 729790 - DNA, 17 bp, Homo sapiens
ttagatagctgcatgtg

SEQ ID NO: 729791 - DNA, 22 bp, Homo sapiens
ttagatatgttaagcatggatt

SEQ ID NO: 729792 - DNA, 21 bp, Homo sapiens
ttagatcccatgtcacctcag

SEQ ID NO: 729793 - DNA, 13 bp, Homo sapiens
ttagatctgtccc

SEQ ID NO: 729794 - DNA, 16 bp, Homo sapiens
ttagatgagtgaaata

SEQ ID NO: 729795 - DNA, 17 bp, Homo sapiens
ttagatgagtgaaatac

SEQ ID NO: 729796 - DNA, 15 bp, Homo sapiens
ttagatgattatata

SEQ ID NO: 729797 - DNA, 15 bp, Homo sapiens
ttagatgtttcacac

SEQ ID NO: 729798 - DNA, 19 bp, Homo sapiens
ttagattaagattttactt

SEQ ID NO: 729799 - DNA, 16 bp, Homo sapiens
ttagattagctctgga

SEQ ID NO: 729800 - DNA, 17 bp, Homo sapiens
ttagattagctctggac

SEQ ID NO: 729801 - DNA, 14 bp, Homo sapiens
ttagattatttctg

SEQ ID NO: 729802 - DNA, 19 bp, Homo sapiens
ttagattatttctgtattt

SEQ ID NO: 729803 - DNA, 15 bp, Homo sapiens
ttagattcactttga

SEQ ID NO: 729804 - DNA, 16 bp, Homo sapiens
ttagattccaggatca

SEQ ID NO: 729805 - DNA, 14 bp, Homo sapiens
ttagattgtgttcc

SEQ ID NO: 729806 - DNA, 14 bp, Homo sapiens
tgttgtattaacaa

SEQ ID NO: 729807 - DNA, 14 bp, Homo sapiens
tgttgtatttaatt

SEQ ID NO: 729808 - DNA, 12 bp, Homo sapiens
tgttgtcaagga

SEQ ID NO: 729809 - DNA, 13 bp, Homo sapiens
tgttgtcataaca

SEQ ID NO: 729810 - DNA, 14 bp, Homo sapiens
tgttgtcattgctg

SEQ ID NO: 729811 - DNA, 13 bp, Homo sapiens
tgttgtcattgta

SEQ ID NO: 729812 - DNA, 19 bp, Homo sapiens
tgttgtcccaatgaaatac

SEQ ID NO: 729813 - DNA, 14 bp, Homo sapiens
tgttgtccttttca

SEQ ID NO: 729814 - DNA, 20 bp, Homo sapiens
tgttgtcgtaaagatttggg

SEQ ID NO: 729815 - DNA, 15 bp, Homo sapiens
tgttgtctcttgagt

SEQ ID NO: 729816 - DNA, 14 bp, Homo sapiens
tgttgtctttttta

SEQ ID NO: 729817 - DNA, 21 bp, Homo sapiens
tgttgtgacacatcaagcttt

SEQ ID NO: 729818 - DNA, 22 bp, Homo sapiens
tgttgtgacacatcaagctttt

SEQ ID NO: 729819 - DNA, 22 bp, Homo sapiens
tgttgtgggcgctgcttccagg

SEQ ID NO: 729820 - DNA, 14 bp, Homo sapiens
tgttgtgggcttcc

SEQ ID NO: 729821 - DNA, 23 bp, Homo sapiens
tgttgtgggcttcctgctgggac

SEQ ID NO: 729822 - DNA, 13 bp, Homo sapiens
tgttgtgttcctg

SEQ ID NO: 729823 - DNA, 19 bp, Homo sapiens
tgttgtgttcctggctgat

SEQ ID NO: 729824 - DNA, 21 bp, Homo sapiens
tgttgtgttcctggctgatga

SEQ ID NO: 729825 - DNA, 15 bp, Homo sapiens
tgttgttaaacacgt

SEQ ID NO: 729826 - DNA, 15 bp, Homo sapiens
tgttgttccatttta

SEQ ID NO: 729827 - DNA, 19 bp, Homo sapiens
tgttgttccattttatgca

SEQ ID NO: 729828 - DNA, 22 bp, Homo sapiens
tgttgttccattttatgcagaa

SEQ ID NO: 729829 - DNA, 14 bp, Homo sapiens
tgttgttccttttg

SEQ ID NO: 729830 - DNA, 18 bp, Homo sapiens
tgttgttccttttgaaag

SEQ ID NO: 729831 - DNA, 22 bp, Homo sapiens
tgttgttctgttaactgaatac

SEQ ID NO: 729832 - DNA, 14 bp, Homo sapiens
tgttgttgccaaag

SEQ ID NO: 729833 - DNA, 16 bp, Homo sapiens
tgttgttgtgtgtata

SEQ ID NO: 729834 - DNA, 11 bp, Homo sapiens
tgttgtttgat

SEQ ID NO: 729835 - DNA, 11 bp, Homo sapiens
tgttgtttgcc

SEQ ID NO: 729836 - DNA, 12 bp, Homo sapiens
tgttgtttgcca

SEQ ID NO: 729837 - DNA, 15 bp, Homo sapiens
tgttgtttgtaaata

SEQ ID NO: 729838 - DNA, 13 bp, Homo sapiens
tgttgttttacta

SEQ ID NO: 729839 - DNA, 13 bp, Homo sapiens
tgttgttttgtgt

SEQ ID NO: 729840 - DNA, 20 bp, Homo sapiens
tgtttaaaaaccgaataaat

SEQ ID NO: 729841 - DNA, 22 bp, Homo sapiens
tgtttaaaaaccgaataaatgt

SEQ ID NO: 729842 - DNA, 22 bp, Homo sapiens
tgtttaaaactcagaatataac

SEQ ID NO: 729843 - DNA, 18 bp, Homo sapiens
tgtttaaaagaaatatat

SEQ ID NO: 729844 - DNA, 12 bp, Homo sapiens
tgtttaaaataa

SEQ ID NO: 729845 - DNA, 14 bp, Homo sapiens
tgtttaaaataaaa

SEQ ID NO: 729846 - DNA, 15 bp, Homo sapiens
tgtttaaaataaaat

SEQ ID NO: 729847 - DNA, 12 bp, Homo sapiens
tgtttaaaattc

SEQ ID NO: 729848 - DNA, 14 bp, Homo sapiens
tgtttaaaattcag

SEQ ID NO: 729849 - DNA, 14 bp, Homo sapiens
tgtttaaaattctc

SEQ ID NO: 729850 - DNA, 19 bp, Homo sapiens
tgtttaaacaatctttcat

SEQ ID NO: 729851 - DNA, 21 bp, Homo sapiens
tgtttaaacccaagtgctgca

SEQ ID NO: 729852 - DNA, 14 bp, Homo sapiens
tgtttaaacctttt

SEQ ID NO: 729853 - DNA, 13 bp, Homo sapiens
tgtttaaagaagg

SEQ ID NO: 729854 - DNA, 16 bp, Homo sapiens
tgtttaaagaataaag

SEQ ID NO: 729855 - DNA, 17 bp, Homo sapiens
tgtttaaagagaggtta

SEQ ID NO: 729856 - DNA, 13 bp, Homo sapiens
tgtttaaagtggc

SEQ ID NO: 729857 - DNA, 23 bp, Homo sapiens
tgtttaaagttcaacatgttatt

SEQ ID NO: 729858 - DNA, 21 bp, Homo sapiens
tgtttaaataaagacctatgt

SEQ ID NO: 729859 - DNA, 14 bp, Homo sapiens
tgtttaaataaagt

SEQ ID NO: 729860 - DNA, 17 bp, Homo sapiens
tgtttaaataaagtatc

SEQ ID NO: 729861 - DNA, 16 bp, Homo sapiens
tgtttaaatagcctaa

SEQ ID NO: 729862 - DNA, 13 bp, Homo sapiens
tgtttaaatataa

SEQ ID NO: 729863 - DNA, 16 bp, Homo sapiens
tgtttaaatataaatg

SEQ ID NO: 729864 - DNA, 22 bp, Homo sapiens
tgtttaaatataaatgtttaaa

SEQ ID NO: 729865 - DNA, 18 bp, Homo sapiens
tgtttaaatcatgtatgt

SEQ ID NO: 729866 - DNA, 21 bp, Homo sapiens
tgtttaaatcatgtatgttat

SEQ ID NO: 729867 - DNA, 21 bp, Homo sapiens
tgtttaacacttctgtatgca

SEQ ID NO: 729868 - DNA, 14 bp, Homo sapiens
tgtttaagatgggc

SEQ ID NO: 729869 - DNA, 13 bp, Homo sapiens
tgtttaagctgag

SEQ ID NO: 729870 - DNA, 17 bp, Homo sapiens
tgtttaatatttaaaca

SEQ ID NO: 729871 - DNA, 22 bp, Homo sapiens
tgtttacaaacatggaaaacag

SEQ ID NO: 729872 - DNA, 12 bp, Homo sapiens
tgtttacaataa

SEQ ID NO: 729873 - DNA, 13 bp, Homo sapiens
tgtttacacaatt

SEQ ID NO: 729874 - DNA, 18 bp, Homo sapiens
tgtttacactctttgtaa

SEQ ID NO: 729875 - DNA, 19 bp, Homo sapiens
tgtttacactctttgtaag

SEQ ID NO: 729876 - DNA, 20 bp, Homo sapiens
tgtttacagcactactctgt

SEQ ID NO: 729877 - DNA, 18 bp, Homo sapiens
tgtttacagtatgatgaa

SEQ ID NO: 729878 - DNA, 15 bp, Homo sapiens
tgtttacagtgagga

SEQ ID NO: 729879 - DNA, 21 bp, Homo sapiens
tgtttacatggcgccctgcct

SEQ ID NO: 729880 - DNA, 14 bp, Homo sapiens
tgtttacctggtgc

SEQ ID NO: 729881 - DNA, 20 bp, Homo sapiens
tgtttacgatttcactagga

SEQ ID NO: 729882 - DNA, 12 bp, Homo sapiens
tgtttactgaaa

SEQ ID NO: 729883 - DNA, 19 bp, Homo sapiens
tgtttacttgaatagtatt

SEQ ID NO: 729884 - DNA, 12 bp, Homo sapiens
tgtttagaaaaa

SEQ ID NO: 729885 - DNA, 16 bp, Homo sapiens
tgtttagaaacagaaa

SEQ ID NO: 729886 - DNA, 22 bp, Homo sapiens
tgtttagaacactggtttaaag

SEQ ID NO: 729887 - DNA, 15 bp, Homo sapiens
tgtttagattccagg

SEQ ID NO: 729888 - DNA, 16 bp, Homo sapiens
tgtttagcagtggctg

SEQ ID NO: 729889 - DNA, 18 bp, Homo sapiens
tgtttagtagcagtgatt

SEQ ID NO: 729890 - DNA, 13 bp, Homo sapiens
tgtttagtggaaa

SEQ ID NO: 729891 - DNA, 14 bp, Homo sapiens
tgtttagttgcaga

SEQ ID NO: 729892 - DNA, 14 bp, Homo sapiens
tgtttagttttaca

SEQ ID NO: 729893 - DNA, 16 bp, Homo sapiens
tgtttataatctgaag

SEQ ID NO: 729894 - DNA, 18 bp, Homo sapiens
tgtttataatctgaagat

SEQ ID NO: 729895 - DNA, 19 bp, Homo sapiens
tgtttataatctgaagata

SEQ ID NO: 729896 - DNA, 21 bp, Homo sapiens
tgtttatacacaactttgcaa

SEQ ID NO: 729897 - DNA, 22 bp, Homo sapiens
tgtttatactgtatttctaaga

SEQ ID NO: 729898 - DNA, 15 bp, Homo sapiens
tgtttatacttgaga

SEQ ID NO: 729899 - DNA, 16 bp, Homo sapiens
tgtttatcagatacat

SEQ ID NO: 729900 - DNA, 18 bp, Homo sapiens
tgtttatcagatacatca

SEQ ID NO: 729901 - DNA, 12 bp, Homo sapiens
tgtttatctctg

SEQ ID NO: 729902 - DNA, 17 bp, Homo sapiens
tgtttatgccacagaat

SEQ ID NO: 729903 - DNA, 14 bp, Homo sapiens
tgtttatggcctca

SEQ ID NO: 729904 - DNA, 23 bp, Homo sapiens
tgtttatggcctcagctgcctca

SEQ ID NO: 729905 - DNA, 20 bp, Homo sapiens
tgtttatgtaggtacttcac

SEQ ID NO: 729906 - DNA, 22 bp, Homo sapiens
tgtttatgttgtttataataaa

SEQ ID NO: 729907 - DNA, 15 bp, Homo sapiens
tgtttatgtttaaaa

SEQ ID NO: 729908 - DNA, 15 bp, Homo sapiens
tgtttattacttcca

SEQ ID NO: 729909 - DNA, 14 bp, Homo sapiens
tgtttattatacca

SEQ ID NO: 729910 - DNA, 13 bp, Homo sapiens
tgtttattattta

SEQ ID NO: 729911 - DNA, 15 bp, Homo sapiens
tgtttattatttaca

SEQ ID NO: 729912 - DNA, 13 bp, Homo sapiens
tgtttattcctga

SEQ ID NO: 729913 - DNA, 18 bp, Homo sapiens
tgtttattcctgataata

SEQ ID NO: 729914 - DNA, 21 bp, Homo sapiens
tgtttattctctgctgcatct

SEQ ID NO: 729915 - DNA, 16 bp, Homo sapiens
tgtttattcttccaga

SEQ ID NO: 729916 - DNA, 23 bp, Homo sapiens
tgtttatttataagcagatttaa

SEQ ID NO: 729917 - DNA, 15 bp, Homo sapiens
tgtttatttatcagt

SEQ ID NO: 729918 - DNA, 15 bp, Homo sapiens
tgtttatttttcata

SEQ ID NO: 729919 - DNA, 13 bp, Homo sapiens
tgtttcaaagcac

SEQ ID NO: 729920 - DNA, 19 bp, Homo sapiens
tgtttcaaatgcagaaacc

SEQ ID NO: 729921 - DNA, 15 bp, Homo sapiens
tgtttcaattctgta

SEQ ID NO: 729922 - DNA, 16 bp, Homo sapiens
tgtttcaattgcatct

SEQ ID NO: 729923 - DNA, 23 bp, Homo sapiens
tgtttcacaccggaaggttttta

SEQ ID NO: 729924 - DNA, 14 bp, Homo sapiens
tgtttcactccacc

SEQ ID NO: 729925 - DNA, 16 bp, Homo sapiens
tgtttcactcctgctt

SEQ ID NO: 729926 - DNA, 19 bp, Homo sapiens
tgtttcactcctgcttctc

SEQ ID NO: 729927 - DNA, 14 bp, Homo sapiens
tgtttcagagcata

SEQ ID NO: 729928 - DNA, 19 bp, Homo sapiens
ttatcattcattcttagct

SEQ ID NO: 729929 - DNA, 16 bp, Homo sapiens
ttatcattcctttcca

SEQ ID NO: 729930 - DNA, 19 bp, Homo sapiens
ttatcattgctcccctgat

SEQ ID NO: 729931 - DNA, 17 bp, Homo sapiens
ttatccaaaatgtgtat

SEQ ID NO: 729932 - DNA, 22 bp, Homo sapiens
ttatccaaaatgtgtatttctt

SEQ ID NO: 729933 - DNA, 19 bp, Homo sapiens
ttatccagctagtgccaaa

SEQ ID NO: 729934 - DNA, 15 bp, Homo sapiens
ttatccctcacctgt

SEQ ID NO: 729935 - DNA, 23 bp, Homo sapiens
ttatcccttccttttagcctagt

SEQ ID NO: 729936 - DNA, 12 bp, Homo sapiens
ttatcctctctc

SEQ ID NO: 729937 - DNA, 14 bp, Homo sapiens
ttatcctctgatct

SEQ ID NO: 729938 - DNA, 16 bp, Homo sapiens
ttatcctctgatctcc

SEQ ID NO: 729939 - DNA, 20 bp, Homo sapiens
ttatcctctgatctccatgg

SEQ ID NO: 729940 - DNA, 21 bp, Homo sapiens
ttatcctctgatctccatggc

SEQ ID NO: 729941 - DNA, 16 bp, Homo sapiens
ttatcctgaaatttca

SEQ ID NO: 729942 - DNA, 23 bp, Homo sapiens
ttatccttaggaaaatgcttctg

SEQ ID NO: 729943 - DNA, 20 bp, Homo sapiens
ttatcctttcattaggcaaa

SEQ ID NO: 729944 - DNA, 21 bp, Homo sapiens
ttatcctttcattaggcaaag

SEQ ID NO: 729945 - DNA, 23 bp, Homo sapiens
ttatcgagcatgttgttttttca

SEQ ID NO: 729946 - DNA, 21 bp, Homo sapiens
ttatcgccttttgacagctgt

SEQ ID NO: 729947 - DNA, 15 bp, Homo sapiens
ttatcggaagcagtg

SEQ ID NO: 729948 - DNA, 16 bp, Homo sapiens
ttatcgggaacagtgt

SEQ ID NO: 729949 - DNA, 19 bp, Homo sapiens
ttatcgggagcagtgtctt

SEQ ID NO: 729950 - DNA, 23 bp, Homo sapiens
ttatcgggagcagtgtcttccat

SEQ ID NO: 729951 - DNA, 14 bp, Homo sapiens
ttatctaaatgaat

SEQ ID NO: 729952 - DNA, 16 bp, Homo sapiens
ttatctaaatgaatga

SEQ ID NO: 729953 - DNA, 20 bp, Homo sapiens
ttatctaactatatgtacag

SEQ ID NO: 729954 - DNA, 21 bp, Homo sapiens
ttatctaagttaatttaaagt

SEQ ID NO: 729955 - DNA, 16 bp, Homo sapiens
ttatctaatttataaa

SEQ ID NO: 729956 - DNA, 17 bp, Homo sapiens
ttatctacctgttctgt

SEQ ID NO: 729957 - DNA, 19 bp, Homo sapiens
ttatctacctgttctgtag

SEQ ID NO: 729958 - DNA, 14 bp, Homo sapiens
ttatctagatactg

SEQ ID NO: 729959 - DNA, 14 bp, Homo sapiens
ttatctatggaaat

SEQ ID NO: 729960 - DNA, 23 bp, Homo sapiens
ttatctatggaaatgtgagaaat

SEQ ID NO: 729961 - DNA, 16 bp, Homo sapiens
ttatctcagatgttaa

SEQ ID NO: 729962 - DNA, 20 bp, Homo sapiens
ttatctcttttatatttgta

SEQ ID NO: 729963 - DNA, 20 bp, Homo sapiens
ttatctgaatagtgtcacca

SEQ ID NO: 729964 - DNA, 20 bp, Homo sapiens
ttatctgagcaataacttct

SEQ ID NO: 729965 - DNA, 17 bp, Homo sapiens
ttattctctcacagtgt

SEQ ID NO: 729966 - DNA, 13 bp, Homo sapiens
ttattctgattct

SEQ ID NO: 729967 - DNA, 23 bp, Homo sapiens
ttattctgggcaccacaaaatat

SEQ ID NO: 729968 - DNA, 13 bp, Homo sapiens
ttattctgttccc

SEQ ID NO: 729969 - DNA, 16 bp, Homo sapiens
ttattcttattactat

SEQ ID NO: 729970 - DNA, 17 bp, Homo sapiens
ttattcttattactatt

SEQ ID NO: 729971 - DNA, 12 bp, Homo sapiens
ttattcttgctg

SEQ ID NO: 729972 - DNA, 12 bp, Homo sapiens
ttattcttggtt

SEQ ID NO: 729973 - DNA, 15 bp, Homo sapiens
ttattctttgaaaac

SEQ ID NO: 729974 - DNA, 21 bp, Homo sapiens
ttattgaaaaaaaaaatgttg

SEQ ID NO: 729975 - DNA, 14 bp, Homo sapiens
ttattgaaagaatt

SEQ ID NO: 729976 - DNA, 18 bp, Homo sapiens
ttattgaacttgaaatct

SEQ ID NO: 729977 - DNA, 13 bp, Homo sapiens
ttattgaagtgtt

SEQ ID NO: 729978 - DNA, 20 bp, Homo sapiens
ttattgaatctatttaagta

SEQ ID NO: 729979 - DNA, 16 bp, Homo sapiens
ttattgaatcttaatt

SEQ ID NO: 729980 - DNA, 19 bp, Homo sapiens
ttattgacacagaaaatgt

SEQ ID NO: 729981 - DNA, 13 bp, Homo sapiens
ttattgacactga

SEQ ID NO: 729982 - DNA, 15 bp, Homo sapiens
ttattgacactgaac

SEQ ID NO: 729983 - DNA, 17 bp, Homo sapiens
ttattgacactgaactt

SEQ ID NO: 729984 - DNA, 14 bp, Homo sapiens
ttattgacatcagt

SEQ ID NO: 729985 - DNA, 16 bp, Homo sapiens
ttattgacatcagtaa

SEQ ID NO: 729986 - DNA, 14 bp, Homo sapiens
ttattgagaaagag

SEQ ID NO: 729987 - DNA, 14 bp, Homo sapiens
ttattgagctctat

SEQ ID NO: 729988 - DNA, 21 bp, Homo sapiens
ttattgatattctaagaaata

SEQ ID NO: 729989 - DNA, 17 bp, Homo sapiens
ttattgcaataaagtat

SEQ ID NO: 729990 - DNA, 11 bp, Homo sapiens
ttattgcacta

SEQ ID NO: 729991 - DNA, 14 bp, Homo sapiens
ttattgcagtttat

SEQ ID NO: 729992 - DNA, 22 bp, Homo sapiens
ttattgcagtttatcattcaag

SEQ ID NO: 729993 - DNA, 16 bp, Homo sapiens
ttattgcatatagatt

SEQ ID NO: 729994 - DNA, 11 bp, Homo sapiens
ttcaaggcaga

SEQ ID NO: 729995 - DNA, 11 bp, Homo sapiens
ttcaaggcatt

SEQ ID NO: 729996 - DNA, 11 bp, Homo sapiens
ttcaaggcctt

SEQ ID NO: 729997 - DNA, 13 bp, Homo sapiens
ttcaaggccttca

SEQ ID NO: 729998 - DNA, 13 bp, Homo sapiens
ttcaaggctttaa

SEQ ID NO: 729999 - DNA, 16 bp, Homo sapiens
ttcaagggaagaaaca

SEQ ID NO: 730000 - DNA, 21 bp, Homo sapiens
ttcaagggaagaaacactctt

SEQ ID NO: 730001 - DNA, 24 bp, Homo sapiens
ttcaaggggagccaaaatctcaag

SEQ ID NO: 730002 - DNA, 17 bp, Homo sapiens
ttcaaggtggccaaatt

SEQ ID NO: 730003 - DNA, 15 bp, Homo sapiens
ttcaagtaacacttt

SEQ ID NO: 730004 - DNA, 16 bp, Homo sapiens
ttcaagtaattgtgaa

SEQ ID NO: 730005 - DNA, 19 bp, Homo sapiens
ttcaagtgactctcctgcc

SEQ ID NO: 730006 - DNA, 13 bp, Homo sapiens
ttcaagtgattct

SEQ ID NO: 730007 - DNA, 22 bp, Homo sapiens
ttcaagtgattctcctgcctca

SEQ ID NO: 730008 - DNA, 17 bp, Homo sapiens
ttcaagtgcctcttgtt

SEQ ID NO: 730009 - DNA, 21 bp, Homo sapiens
ttcaagtgcctttctgcagtt

SEQ ID NO: 730010 - DNA, 23 bp, Homo sapiens
ttcaagtgcctttctgcagtttt

SEQ ID NO: 730011 - DNA, 14 bp, Homo sapiens
ttcaagtgctaaaa

SEQ ID NO: 730012 - DNA, 20 bp, Homo sapiens
ttcaagtgcttaaaaatact

SEQ ID NO: 730013 - DNA, 22 bp, Homo sapiens
ttcaagtggggctcgccatgcc

SEQ ID NO: 730014 - DNA, 15 bp, Homo sapiens
ttcaagtgtaaatga

SEQ ID NO: 730015 - DNA, 13 bp, Homo sapiens
ttcaagttaaagt

SEQ ID NO: 730016 - DNA, 17 bp, Homo sapiens
ttcaagttagctcagga

SEQ ID NO: 730017 - DNA, 13 bp, Homo sapiens
ttcaagttattca

SEQ ID NO: 730018 - DNA, 16 bp, Homo sapiens
ttcaagttattcaaat

SEQ ID NO: 730019 - DNA, 17 bp, Homo sapiens
ttcaagttattgtacag

SEQ ID NO: 730020 - DNA, 20 bp, Homo sapiens
ttcaagttattgtacagctg

SEQ ID NO: 730021 - DNA, 19 bp, Homo sapiens
ttcaagttgtaaaaatgaa

SEQ ID NO: 730022 - DNA, 20 bp, Homo sapiens
ttcaagttttgggtatgttt

SEQ ID NO: 730023 - DNA, 21 bp, Homo sapiens
ttcaataaaaaaaagaaatga

SEQ ID NO: 730024 - DNA, 23 bp, Homo sapiens
ttcaataaaaaaaagaaatgaaa

SEQ ID NO: 730025 - DNA, 21 bp, Homo sapiens
ttcaataaaagataaattatt

SEQ ID NO: 730026 - DNA, 19 bp, Homo sapiens
ttcaataaagcactgagca

SEQ ID NO: 730027 - DNA, 20 bp, Homo sapiens
ttcaataaagcatttataaa

SEQ ID NO: 730028 - DNA, 13 bp, Homo sapiens
ttcaataaatctt

SEQ ID NO: 730029 - DNA, 19 bp, Homo sapiens
ttcaataaatctttggaaa

SEQ ID NO: 730030 - DNA, 15 bp, Homo sapiens
ttcaataccgctcag

SEQ ID NO: 730031 - DNA, 13 bp, Homo sapiens
ttcaatactgtat

SEQ ID NO: 730032 - DNA, 23 bp, Homo sapiens
ttcaatagccactaaccttgcct

SEQ ID NO: 730033 - DNA, 16 bp, Homo sapiens
ttcaatataagaagca

SEQ ID NO: 730034 - DNA, 17 bp, Homo sapiens
ttcaatatattgaactt

SEQ ID NO: 730035 - DNA, 18 bp, Homo sapiens
ttcaatatattgaacttt

SEQ ID NO: 730036 - DNA, 11 bp, Homo sapiens
ttcaatatgca

SEQ ID NO: 730037 - DNA, 16 bp, Homo sapiens
ttcaatattgaatttt

SEQ ID NO: 730038 - DNA, 19 bp, Homo sapiens
ttcaatattgaatttttcc

SEQ ID NO: 730039 - DNA, 14 bp, Homo sapiens
ttcaatattgacat

SEQ ID NO: 730040 - DNA, 22 bp, Homo sapiens
ttcaatattgacatttgtagtt

SEQ ID NO: 730041 - DNA, 18 bp, Homo sapiens
ttcaatatttagaaaatt

SEQ ID NO: 730042 - DNA, 23 bp, Homo sapiens
ttcaatcagagctccagtttgca

SEQ ID NO: 730043 - DNA, 22 bp, Homo sapiens
ttcaatcctcaaatcagtcttc

SEQ ID NO: 730044 - DNA, 17 bp, Homo sapiens
ttcaatgacctgtattt

SEQ ID NO: 730045 - DNA, 20 bp, Homo sapiens
ttcaatgacttctaatttat

SEQ ID NO: 730046 - DNA, 17 bp, Homo sapiens
ttcaatgcaaagtaaaa

SEQ ID NO: 730047 - DNA, 18 bp, Homo sapiens
ttcaatgcgttttgttgt

SEQ ID NO: 730048 - DNA, 18 bp, Homo sapiens
ttcaatggttgggacaat

SEQ ID NO: 730049 - DNA, 23 bp, Homo sapiens
ttcaatggttgggacaatggcaa

SEQ ID NO: 730050 - DNA, 16 bp, Homo sapiens
ttcaatgtaattaaac

SEQ ID NO: 730051 - DNA, 11 bp, Homo sapiens
ttcaatgtgaa

SEQ ID NO: 730052 - DNA, 15 bp, Homo sapiens
ttcaatgtgcataat

SEQ ID NO: 730053 - DNA, 14 bp, Homo sapiens
ttcaatgtgtataa

SEQ ID NO: 730054 - DNA, 19 bp, Homo sapiens
ttcaatgtgtataaattgt

SEQ ID NO: 730055 - DNA, 15 bp, Homo sapiens
ttcaatgttagcctc

SEQ ID NO: 730056 - DNA, 18 bp, Homo sapiens
ttcaattagtggtcataa

SEQ ID NO: 730057 - DNA, 12 bp, Homo sapiens
ttcaattcctct

SEQ ID NO: 730058 - DNA, 16 bp, Homo sapiens
ttcaattcctctggga

SEQ ID NO: 730059 - DNA, 16 bp, Homo sapiens
ttcaattcctgggccc

SEQ ID NO: 730060 - DNA, 13 bp, Homo sapiens
ttcaattctgtaa

SEQ ID NO: 730061 - DNA, 19 bp, Homo sapiens
ttcaattctgtaattacat

SEQ ID NO: 730062 - DNA, 17 bp, Homo sapiens
ttcaattgcatctccca

SEQ ID NO: 730063 - DNA, 12 bp, Homo sapiens
ttcaattgtaaa

SEQ ID NO: 730064 - DNA, 13 bp, Homo sapiens
ttcaattgtattt

SEQ ID NO: 730065 - DNA, 15 bp, Homo sapiens
ttcaattgtatttta

SEQ ID NO: 730066 - DNA, 22 bp, Homo sapiens
ttcaatttggagcattaactaa

SEQ ID NO: 730067 - DNA, 15 bp, Homo sapiens
ttcaatttgtcatgt

SEQ ID NO: 730068 - DNA, 19 bp, Homo sapiens
ttcaatttgtcatgttact

SEQ ID NO: 730069 - DNA, 14 bp, Homo sapiens
ttcaattttaaaga

SEQ ID NO: 730070 - DNA, 20 bp, Homo sapiens
ttcacaaaaggcatctgaac

SEQ ID NO: 730071 - DNA, 15 bp, Homo sapiens
ttcacaaactgtgaa

SEQ ID NO: 730072 - DNA, 16 bp, Homo sapiens
ttcacaaactgtgaaa

SEQ ID NO: 730073 - DNA, 16 bp, Homo sapiens
ttcacaaacttttata

SEQ ID NO: 730074 - DNA, 17 bp, Homo sapiens
ttcacaaacttttatac

SEQ ID NO: 730075 - DNA, 15 bp, Homo sapiens
ttcacaaagcccaag

SEQ ID NO: 730076 - DNA, 21 bp, Homo sapiens
ttcacaacataaggagaatgt

SEQ ID NO: 730077 - DNA, 16 bp, Homo sapiens
ttcacaacctcaccaa

SEQ ID NO: 730078 - DNA, 13 bp, Homo sapiens
ttcacaatgtggc

SEQ ID NO: 730079 - DNA, 13 bp, Homo sapiens
ttcacaatgttaa

SEQ ID NO: 730080 - DNA, 22 bp, Homo sapiens
ttcacacatctgggtgccctga

SEQ ID NO: 730081 - DNA, 19 bp, Homo sapiens
ttcacacctgactctgaaa

SEQ ID NO: 730082 - DNA, 18 bp, Homo sapiens
ttcacactggtaaatgtt

SEQ ID NO: 730083 - DNA, 19 bp, Homo sapiens
ttcacactggtaaatgtta

SEQ ID NO: 730084 - DNA, 15 bp, Homo sapiens
ttcacagaaaaagca

SEQ ID NO: 730085 - DNA, 20 bp, Homo sapiens
ttcacagagcacgcctgcca

SEQ ID NO: 730086 - DNA, 19 bp, Homo sapiens
ttcacagcctataaccaga

SEQ ID NO: 730087 - DNA, 13 bp, Homo sapiens
ttcacagctcctc

SEQ ID NO: 730088 - DNA, 17 bp, Homo sapiens
ttcacaggcagtgcatg

SEQ ID NO: 730089 - DNA, 23 bp, Homo sapiens
ttcacaggggttcccttctctca

SEQ ID NO: 730090 - DNA, 15 bp, Homo sapiens
ttcacagtagagcca

SEQ ID NO: 730091 - DNA, 15 bp, Homo sapiens
ttcacagtgctcttt

SEQ ID NO: 730092 - DNA, 22 bp, Homo sapiens
ttcacagtgtttcgacagctga

SEQ ID NO: 730093 - DNA, 15 bp, Homo sapiens
ttcacagttctgtaa

SEQ ID NO: 730094 - DNA, 16 bp, Homo sapiens
ttcacagttctgtaat

SEQ ID NO: 730095 - DNA, 20 bp, Homo sapiens
ttcacataagctcagaatcc

SEQ ID NO: 730096 - DNA, 17 bp, Homo sapiens
ttcacataccctccccc

SEQ ID NO: 730097 - DNA, 18 bp, Homo sapiens
ttcacatagctgtctaga

SEQ ID NO: 730098 - DNA, 17 bp, Homo sapiens
ttcacatcccattggga

SEQ ID NO: 730099 - DNA, 18 bp, Homo sapiens
ttcacatcctgtgtttct

SEQ ID NO: 730100 - DNA, 21 bp, Homo sapiens
ttcacatcctgtgtttctagg

SEQ ID NO: 730101 - DNA, 17 bp, Homo sapiens
ttcacattaaaaaatga

SEQ ID NO: 730102 - DNA, 19 bp, Homo sapiens
ttatgtagtaattgacatg

SEQ ID NO: 730103 - DNA, 23 bp, Homo sapiens
ttatgtatgaaggaatcattcca

SEQ ID NO: 730104 - DNA, 16 bp, Homo sapiens
ttatgtattttgaaaa

SEQ ID NO: 730105 - DNA, 22 bp, Homo sapiens
ttatgtcagcacacacttacag

SEQ ID NO: 730106 - DNA, 18 bp, Homo sapiens
ttatgtcatcagtaaagt

SEQ ID NO: 730107 - DNA, 20 bp, Homo sapiens
ttatgtcctgtgagatgtgt

SEQ ID NO: 730108 - DNA, 14 bp, Homo sapiens
ttatgtctcatgta

SEQ ID NO: 730109 - DNA, 17 bp, Homo sapiens
ttatgtcttcttttgtg

SEQ ID NO: 730110 - DNA, 12 bp, Homo sapiens
ttatgtgaaaaa

SEQ ID NO: 730111 - DNA, 23 bp, Homo sapiens
ttatgtgaatgatctctctgaat

SEQ ID NO: 730112 - DNA, 20 bp, Homo sapiens
ttatgtgacattttacatta

SEQ ID NO: 730113 - DNA, 13 bp, Homo sapiens
ttatgtgagattt

SEQ ID NO: 730114 - DNA, 14 bp, Homo sapiens
ttatgtgatcaatt

SEQ ID NO: 730115 - DNA, 16 bp, Homo sapiens
ttatgtgatcatgtgt

SEQ ID NO: 730116 - DNA, 17 bp, Homo sapiens
ttatgtgggtggcttct

SEQ ID NO: 730117 - DNA, 19 bp, Homo sapiens
ttatgtgtgaggagctgct

SEQ ID NO: 730118 - DNA, 17 bp, Homo sapiens
ttatgtgttatgaacat

SEQ ID NO: 730119 - DNA, 13 bp, Homo sapiens
ttatgttcagaaa

SEQ ID NO: 730120 - DNA, 18 bp, Homo sapiens
ttatgttgaaaaaattta

SEQ ID NO: 730121 - DNA, 17 bp, Homo sapiens
ttatgtttaaaagaaat

SEQ ID NO: 730122 - DNA, 19 bp, Homo sapiens
ttatgtttaaaagaaatat

SEQ ID NO: 730123 - DNA, 14 bp, Homo sapiens
ttatgtttaataag

SEQ ID NO: 730124 - DNA, 16 bp, Homo sapiens
ttatgttttcaactca

SEQ ID NO: 730125 - DNA, 18 bp, Homo sapiens
ttatgttttctttctcac

SEQ ID NO: 730126 - DNA, 15 bp, Homo sapiens
ttattaaaaaatttg

SEQ ID NO: 730127 - DNA, 16 bp, Homo sapiens
ttattaaaaaatttgt

SEQ ID NO: 730128 - DNA, 14 bp, Homo sapiens
ttattaaaatgatt

SEQ ID NO: 730129 - DNA, 20 bp, Homo sapiens
ttattaaaatgattgtaaaa

SEQ ID NO: 730130 - DNA, 21 bp, Homo sapiens
ttattaaaatgattgtaaaat

SEQ ID NO: 730131 - DNA, 15 bp, Homo sapiens
ttattaaaattctga

SEQ ID NO: 730132 - DNA, 16 bp, Homo sapiens
ttattaaaattctgaa

SEQ ID NO: 730133 - DNA, 16 bp, Homo sapiens
ttattaaacaaataat

SEQ ID NO: 730134 - DNA, 19 bp, Homo sapiens
ttattaaacaattttgtta

SEQ ID NO: 730135 - DNA, 21 bp, Homo sapiens
ttcaccatgttggccaggctg

SEQ ID NO: 730136 - DNA, 17 bp, Homo sapiens
ttcaccccaatcccagc

SEQ ID NO: 730137 - DNA, 15 bp, Homo sapiens
ttcaccccagaggac

SEQ ID NO: 730138 - DNA, 13 bp, Homo sapiens
ttcacccccaact

SEQ ID NO: 730139 - DNA, 22 bp, Homo sapiens
ttcaccccccactcaccagtgt

SEQ ID NO: 730140 - DNA, 21 bp, Homo sapiens
ttcacccctacactgtgaagg

SEQ ID NO: 730141 - DNA, 12 bp, Homo sapiens
ttcacccctgca

SEQ ID NO: 730142 - DNA, 18 bp, Homo sapiens
ttcacccgagttcctctg

SEQ ID NO: 730143 - DNA, 22 bp, Homo sapiens
ttcaccctcaccccctcctggc

SEQ ID NO: 730144 - DNA, 16 bp, Homo sapiens
ttcaccctcatgaaaa

SEQ ID NO: 730145 - DNA, 14 bp, Homo sapiens
ttcaccctgggcag

SEQ ID NO: 730146 - DNA, 15 bp, Homo sapiens
ttcaccctgggcagt

SEQ ID NO: 730147 - DNA, 22 bp, Homo sapiens
ttcacccttaacccaaggagca

SEQ ID NO: 730148 - DNA, 19 bp, Homo sapiens
ttcaccgtgttagccagga

SEQ ID NO: 730149 - DNA, 19 bp, Homo sapiens
ttcacctaagtctctgtga

SEQ ID NO: 730150 - DNA, 13 bp, Homo sapiens
ttcacctatgtta

SEQ ID NO: 730151 - DNA, 11 bp, Homo sapiens
ttcacctcagc

SEQ ID NO: 730152 - DNA, 15 bp, Homo sapiens
ttcacctcagcctgg

SEQ ID NO: 730153 - DNA, 19 bp, Homo sapiens
ttcacctccaggttcaagt

SEQ ID NO: 730154 - DNA, 22 bp, Homo sapiens
ttcacctccctgctcagtgctt

SEQ ID NO: 730155 - DNA, 17 bp, Homo sapiens
ttcacctcctaaaacaa

SEQ ID NO: 730156 - DNA, 12 bp, Homo sapiens
ttcacctctatc

SEQ ID NO: 730157 - DNA, 14 bp, Homo sapiens
ttcacctctatcca

SEQ ID NO: 730158 - DNA, 22 bp, Homo sapiens
ttcacctctattcttgggaaac

SEQ ID NO: 730159 - DNA, 13 bp, Homo sapiens
ttcacctcttcct

SEQ ID NO: 730160 - DNA, 16 bp, Homo sapiens
ttcacctcttcctctg

SEQ ID NO: 730161 - DNA, 21 bp, Homo sapiens
ttcacctggaagcatttgttt

SEQ ID NO: 730162 - DNA, 11 bp, Homo sapiens
ttcacctgtaa

SEQ ID NO: 730163 - DNA, 16 bp, Homo sapiens
ttcacctgtaaaactt

SEQ ID NO: 730164 - DNA, 17 bp, Homo sapiens
ttcacctgtaaaacttt

SEQ ID NO: 730165 - DNA, 22 bp, Homo sapiens
ttcacctgtttttaagctgttt

SEQ ID NO: 730166 - DNA, 21 bp, Homo sapiens
ttcacctttcctctccctcag

SEQ ID NO: 730167 - DNA, 16 bp, Homo sapiens
ttcacctttggtgcag

SEQ ID NO: 730168 - DNA, 14 bp, Homo sapiens
ttcacgaactgttc

SEQ ID NO: 730169 - DNA, 20 bp, Homo sapiens
ttcacgaagtgttgcatgga

SEQ ID NO: 730170 - DNA, 23 bp, Homo sapiens
ttcacgacaatgttgagaagttc

SEQ ID NO: 730171 - DNA, 18 bp, Homo sapiens
ttcacggaagagccttgc

SEQ ID NO: 730172 - DNA, 14 bp, Homo sapiens
ttcacggtgacaca

SEQ ID NO: 730173 - DNA, 18 bp, Homo sapiens
ttcacgtcttggtgcctt

SEQ ID NO: 730174 - DNA, 18 bp, Homo sapiens
ttcacgtggcctccgcag

SEQ ID NO: 730175 - DNA, 14 bp, Homo sapiens
ttcactaatcatga

SEQ ID NO: 730176 - DNA, 17 bp, Homo sapiens
ttcactactttaataaa

SEQ ID NO: 730177 - DNA, 16 bp, Homo sapiens
ttcactataatgtgaa

SEQ ID NO: 730178 - DNA, 17 bp, Homo sapiens
ttcactattcctatgct

SEQ ID NO: 730179 - DNA, 13 bp, Homo sapiens
ttcactatttcct

SEQ ID NO: 730180 - DNA, 23 bp, Homo sapiens
ttcactcaagagttcagtgctca

SEQ ID NO: 730181 - DNA, 20 bp, Homo sapiens
ttcactcatgcaaactgctt

SEQ ID NO: 730182 - DNA, 21 bp, Homo sapiens
ttcactcatgcaaactgcttt

SEQ ID NO: 730183 - DNA, 16 bp, Homo sapiens
ttcactcattgacatg

SEQ ID NO: 730184 - DNA, 12 bp, Homo sapiens
ttcactccctct

SEQ ID NO: 730185 - DNA, 24 bp, Homo sapiens
ttcactccggtgtgcctgcagccc

SEQ ID NO: 730186 - DNA, 19 bp, Homo sapiens
ttcactctatacttaatct

SEQ ID NO: 730187 - DNA, 16 bp, Homo sapiens
ttcactcttcacttga

SEQ ID NO: 730188 - DNA, 21 bp, Homo sapiens
ttcactgagagctgcctcctg

SEQ ID NO: 730189 - DNA, 16 bp, Homo sapiens
ttcactgagctcccca

SEQ ID NO: 730190 - DNA, 13 bp, Homo sapiens
ttcactgccatga

SEQ ID NO: 730191 - DNA, 13 bp, Homo sapiens
ttcactgccccca

SEQ ID NO: 730192 - DNA, 20 bp, Homo sapiens
ttcactgccttcctctctct

SEQ ID NO: 730193 - DNA, 10 bp, Homo sapiens
ttcactgctg

SEQ ID NO: 730194 - DNA, 22 bp, Homo sapiens
ttcactgctgctcctctttccc

SEQ ID NO: 730195 - DNA, 21 bp, Homo sapiens
ttcactggaatgaagaccatg

SEQ ID NO: 730196 - DNA, 16 bp, Homo sapiens
ttcactggagttacat

SEQ ID NO: 730197 - DNA, 19 bp, Homo sapiens
ttcactggagttacattaa

SEQ ID NO: 730198 - DNA, 13 bp, Homo sapiens
ttcactgtaagtt

SEQ ID NO: 730199 - DNA, 19 bp, Homo sapiens
ttcactgtactgcatgtga

SEQ ID NO: 730200 - DNA, 15 bp, Homo sapiens
ttcactgtagaatga

SEQ ID NO: 730201 - DNA, 17 bp, Homo sapiens
ttcactgtatataaaca

SEQ ID NO: 730202 - DNA, 21 bp, Homo sapiens
ttcactgtcaggaagaaatca

SEQ ID NO: 730203 - DNA, 16 bp, Homo sapiens
ttcactgtcatcttca

SEQ ID NO: 730204 - DNA, 22 bp, Homo sapiens
ttcactgtcctccaagccagcg

SEQ ID NO: 730205 - DNA, 16 bp, Homo sapiens
ttcactgtctttaatt

SEQ ID NO: 730206 - DNA, 21 bp, Homo sapiens
ttcactgtgaggggaaggcct

SEQ ID NO: 730207 - DNA, 21 bp, Homo sapiens
ttcactgttgaaaattatttt

SEQ ID NO: 730208 - DNA, 20 bp, Homo sapiens
ttcactgttgtacacagtct

SEQ ID NO: 730209 - DNA, 22 bp, Homo sapiens
ttcacttaagttagttccactg

SEQ ID NO: 730210 - DNA, 22 bp, Homo sapiens
ttcacttacaagaaaggcctga

SEQ ID NO: 730211 - DNA, 12 bp, Homo sapiens
ttcacttcttcc

SEQ ID NO: 730212 - DNA, 14 bp, Homo sapiens
ttcacttcttccta

SEQ ID NO: 730213 - DNA, 19 bp, Homo sapiens
ttcacttgagttggctgtg

SEQ ID NO: 730214 - DNA, 21 bp, Homo sapiens
ttcacttgatgatacaatgaa

SEQ ID NO: 730215 - DNA, 18 bp, Homo sapiens
ttcacttgggctctctct

SEQ ID NO: 730216 - DNA, 17 bp, Homo sapiens
ttcacttgtattgactt

SEQ ID NO: 730217 - DNA, 19 bp, Homo sapiens
ttcacttgtattgacttta

SEQ ID NO: 730218 - DNA, 19 bp, Homo sapiens
ttcacttgtctcctttctg

SEQ ID NO: 730219 - DNA, 15 bp, Homo sapiens
ttcactttcctcagt

SEQ ID NO: 730220 - DNA, 10 bp, Homo sapiens
ttcactttga

SEQ ID NO: 730221 - DNA, 22 bp, Homo sapiens
ttcactttgaaaagttggaagg

SEQ ID NO: 730222 - DNA, 14 bp, Homo sapiens
ttcactttgacact

SEQ ID NO: 730223 - DNA, 18 bp, Homo sapiens
ttcacttttcaatcccaa

SEQ ID NO: 730224 - DNA, 17 bp, Homo sapiens
ttcacttttgacaaagg

SEQ ID NO: 730225 - DNA, 15 bp, Homo sapiens
ttcagaaaaagaaat

SEQ ID NO: 730226 - DNA, 19 bp, Homo sapiens
ttcagaaaatgttctgttt

SEQ ID NO: 730227 - DNA, 18 bp, Homo sapiens
ttcagaaacagggcagca

SEQ ID NO: 730228 - DNA, 20 bp, Homo sapiens
ttcagaaacccggcttcctg

SEQ ID NO: 730229 - DNA, 20 bp, Homo sapiens
ttcagaaaggggctcttctg

SEQ ID NO: 730230 - DNA, 22 bp, Homo sapiens
ttcagaaaggggctcttctgag

SEQ ID NO: 730231 - DNA, 19 bp, Homo sapiens
ttcagaaatgctgcctgcc

SEQ ID NO: 730232 - DNA, 16 bp, Homo sapiens
ttcagaaccatccata

SEQ ID NO: 730233 - DNA, 18 bp, Homo sapiens
ttcagaactaaatttttc

SEQ ID NO: 730234 - DNA, 16 bp, Homo sapiens
ttcagaagacactgca

SEQ ID NO: 730235 - DNA, 17 bp, Homo sapiens
ttcagaattaagcagaa

SEQ ID NO: 730236 - DNA, 20 bp, Homo sapiens
ttcagaattatccattacgt

SEQ ID NO: 730237 - DNA, 19 bp, Homo sapiens
ttcagacaaaatggataca

SEQ ID NO: 730238 - DNA, 15 bp, Homo sapiens
ttcagacaagcaaca

SEQ ID NO: 730239 - DNA, 21 bp, Homo sapiens
ttcagacaagcaacaggtttt

SEQ ID NO: 730240 - DNA, 19 bp, Homo sapiens
ttcagacacagctcttcca

SEQ ID NO: 730241 - DNA, 18 bp, Homo sapiens
ttcagacacaggaaaaat

SEQ ID NO: 730242 - DNA, 19 bp, Homo sapiens
ttcagacacaggaaaaata

SEQ ID NO: 730243 - DNA, 21 bp, Homo sapiens
ttcagacacaggaaaaataaa

SEQ ID NO: 730244 - DNA, 10 bp, Homo sapiens
ttcagacagg

SEQ ID NO: 730245 - DNA, 13 bp, Homo sapiens
ttcagacccagag

SEQ ID NO: 730246 - DNA, 15 bp, Homo sapiens
ttcagaccccagcgg

SEQ ID NO: 730247 - DNA, 20 bp, Homo sapiens
ttcatcttccaactcaaact

SEQ ID NO: 730248 - DNA, 13 bp, Homo sapiens
ttcatcttcctgt

SEQ ID NO: 730249 - DNA, 17 bp, Homo sapiens
ttcatcttcctgtgtcc

SEQ ID NO: 730250 - DNA, 12 bp, Homo sapiens
ttcatcttctgg

SEQ ID NO: 730251 - DNA, 19 bp, Homo sapiens
ttcatcttctggaatattg

SEQ ID NO: 730252 - DNA, 17 bp, Homo sapiens
ttcatcttgaagttttt

SEQ ID NO: 730253 - DNA, 16 bp, Homo sapiens
ttcatctttgccatat

SEQ ID NO: 730254 - DNA, 11 bp, Homo sapiens
ttcatctttgg

SEQ ID NO: 730255 - DNA, 16 bp, Homo sapiens
ttcatcttttgaagag

SEQ ID NO: 730256 - DNA, 22 bp, Homo sapiens
ttcatgaaaaagctgcttctta

SEQ ID NO: 730257 - DNA, 22 bp, Homo sapiens
ttcatgaaaatagctctttcag

SEQ ID NO: 730258 - DNA, 13 bp, Homo sapiens
ttcatgaaatcct

SEQ ID NO: 730259 - DNA, 21 bp, Homo sapiens
ttcatgaaatgattggaatat

SEQ ID NO: 730260 - DNA, 17 bp, Homo sapiens
ttcatgaacttggctgt

SEQ ID NO: 730261 - DNA, 23 bp, Homo sapiens
ttcatgaatctttcatacatata

SEQ ID NO: 730262 - DNA, 17 bp, Homo sapiens
ttcatgagtattcctag

SEQ ID NO: 730263 - DNA, 16 bp, Homo sapiens
ttcatgatgtgtgagt

SEQ ID NO: 730264 - DNA, 22 bp, Homo sapiens
ttcatgattatagcaactaatg

SEQ ID NO: 730265 - DNA, 23 bp, Homo sapiens
ttcatgattatagcaactaatgt

SEQ ID NO: 730266 - DNA, 20 bp, Homo sapiens
ttcatgcaaggggaaaatct

SEQ ID NO: 730267 - DNA, 16 bp, Homo sapiens
ttcatgccatctgttt

SEQ ID NO: 730268 - DNA, 18 bp, Homo sapiens
ttcatgccatctgttttc

SEQ ID NO: 730269 - DNA, 18 bp, Homo sapiens
ttcatgcctttgtaagtt

SEQ ID NO: 730270 - DNA, 17 bp, Homo sapiens
ttcatgctcagccctga

SEQ ID NO: 730271 - DNA, 15 bp, Homo sapiens
ttcatgcttgacata

SEQ ID NO: 730272 - DNA, 16 bp, Homo sapiens
ttcatgcttgacatac

SEQ ID NO: 730273 - DNA, 19 bp, Homo sapiens
ttcatgcttgacataccta

SEQ ID NO: 730274 - DNA, 20 bp, Homo sapiens
ttcatggaatggacatcctg

SEQ ID NO: 730275 - DNA, 21 bp, Homo sapiens
ttcatggacactttgaaatgt

SEQ ID NO: 730276 - DNA, 16 bp, Homo sapiens
ttcatggatcagatct

SEQ ID NO: 730277 - DNA, 21 bp, Homo sapiens
ttcatggcctttgataaatgt

SEQ ID NO: 730278 - DNA, 18 bp, Homo sapiens
ttcatggggatctggggg

SEQ ID NO: 730279 - DNA, 22 bp, Homo sapiens
ttcatggtttgcatttaaacat

SEQ ID NO: 730280 - DNA, 14 bp, Homo sapiens
ttcatgtaaactgt

SEQ ID NO: 730281 - DNA, 21 bp, Homo sapiens
ttcatgtaacagttgtgtcat

SEQ ID NO: 730282 - DNA, 12 bp, Homo sapiens
ttcatgtaactc

SEQ ID NO: 730283 - DNA, 18 bp, Homo sapiens
ttcatgtaactctccagc

SEQ ID NO: 730284 - DNA, 22 bp, Homo sapiens
ttcatgtctttccacttctctg

SEQ ID NO: 730285 - DNA, 17 bp, Homo sapiens
ttcatgtgatgtcatga

SEQ ID NO: 730286 - DNA, 23 bp, Homo sapiens
ttcatgtggcacttgggcattta

SEQ ID NO: 730287 - DNA, 13 bp, Homo sapiens
ttcatgttagtta

SEQ ID NO: 730288 - DNA, 16 bp, Homo sapiens
ttcatgttagttacct

SEQ ID NO: 730289 - DNA, 18 bp, Homo sapiens
ttcatgttcactgtgagt

SEQ ID NO: 730290 - DNA, 17 bp, Homo sapiens
ttcatgttttgtgacta

SEQ ID NO: 730291 - DNA, 13 bp, Homo sapiens
ttcattaaacttg

SEQ ID NO: 730292 - DNA, 12 bp, Homo sapiens
ttcattaaataa

SEQ ID NO: 730293 - DNA, 14 bp, Homo sapiens
ttcattaaataaat

SEQ ID NO: 730294 - DNA, 23 bp, Homo sapiens
ttcattaattagttccagtttct

SEQ ID NO: 730295 - DNA, 16 bp, Homo sapiens
ttcattaattcaggca

SEQ ID NO: 730296 - DNA, 16 bp, Homo sapiens
ttcattaattctataa

SEQ ID NO: 730297 - DNA, 13 bp, Homo sapiens
ttcattacagctt

SEQ ID NO: 730298 - DNA, 18 bp, Homo sapiens
ttcattacagcttaatca

SEQ ID NO: 730299 - DNA, 20 bp, Homo sapiens
ttcattagcagttgctcaca

SEQ ID NO: 730300 - DNA, 14 bp, Homo sapiens
ttcattaggcaaag

SEQ ID NO: 730301 - DNA, 15 bp, Homo sapiens
ttcattaggcaaagt

SEQ ID NO: 730302 - DNA, 17 bp, Homo sapiens
ttcattataatctcaaa

SEQ ID NO: 730303 - DNA, 23 bp, Homo sapiens
ttcattatcacatgattatagaa

SEQ ID NO: 730304 - DNA, 16 bp, Homo sapiens
ttcattatgctttgaa

SEQ ID NO: 730305 - DNA, 13 bp, Homo sapiens
ttcattatgttca

SEQ ID NO: 730306 - DNA, 19 bp, Homo sapiens
ttcattattcaagaatgaa

SEQ ID NO: 730307 - DNA, 20 bp, Homo sapiens
ttcattattcctcagattgc

SEQ ID NO: 730308 - DNA, 15 bp, Homo sapiens
ttcattattctctgc

SEQ ID NO: 730309 - DNA, 20 bp, Homo sapiens
ttcattattggaattaacct

SEQ ID NO: 730310 - DNA, 15 bp, Homo sapiens
ttcattatttgtcaa

SEQ ID NO: 730311 - DNA, 16 bp, Homo sapiens
ttcattattttgtggt

SEQ ID NO: 730312 - DNA, 17 bp, Homo sapiens
ttcattcaaatcagtga

SEQ ID NO: 730313 - DNA, 13 bp, Homo sapiens
ttcattcaagcta

SEQ ID NO: 730314 - DNA, 14 bp, Homo sapiens
ttcattcaagctat

SEQ ID NO: 730315 - DNA, 15 bp, Homo sapiens
ttcattcaatattga

SEQ ID NO: 730316 - DNA, 21 bp, Homo sapiens
ttcattcaatattgacatttg

SEQ ID NO: 730317 - DNA, 13 bp, Homo sapiens
ttcattcatcctg

SEQ ID NO: 730318 - DNA, 13 bp, Homo sapiens
ttcattccagcag

SEQ ID NO: 730319 - DNA, 16 bp, Homo sapiens
ttcattcctaaagaaa

SEQ ID NO: 730320 - DNA, 18 bp, Homo sapiens
ttcattcctaacacagca

SEQ ID NO: 730321 - DNA, 16 bp, Homo sapiens
ttcattctaaaccaaa

SEQ ID NO: 730322 - DNA, 18 bp, Homo sapiens
ttcattctcataattcct

SEQ ID NO: 730323 - DNA, 13 bp, Homo sapiens
ttcattctcctgc

SEQ ID NO: 730324 - DNA, 15 bp, Homo sapiens
ttcattctccttgtt

SEQ ID NO: 730325 - DNA, 17 bp, Homo sapiens
ttcattctccttgttgt

SEQ ID NO: 730326 - DNA, 21 bp, Homo sapiens
ttcattctcgtgagtcattta

SEQ ID NO: 730327 - DNA, 13 bp, Homo sapiens
ttcattctgcaag

SEQ ID NO: 730328 - DNA, 13 bp, Homo sapiens
ttcattctggaaa

SEQ ID NO: 730329 - DNA, 13 bp, Homo sapiens
ttcattcttagct

SEQ ID NO: 730330 - DNA, 13 bp, Homo sapiens
ttcattcttgaaa

SEQ ID NO: 730331 - DNA, 19 bp, Homo sapiens
ttcattcttgaaagctgtg

SEQ ID NO: 730332 - DNA, 17 bp, Homo sapiens
ttcattgcctttccagg

SEQ ID NO: 730333 - DNA, 16 bp, Homo sapiens
ttcattggttaatttt

SEQ ID NO: 730334 - DNA, 16 bp, Homo sapiens
ttcattgtatgatgtg

SEQ ID NO: 730335 - DNA, 14 bp, Homo sapiens
ttcattgtgattta

SEQ ID NO: 730336 - DNA, 14 bp, Homo sapiens
ttcatttaaaatga

SEQ ID NO: 730337 - DNA, 17 bp, Homo sapiens
ttcatttaaaatgatta

SEQ ID NO: 730338 - DNA, 15 bp, Homo sapiens
ttcatttaagggaaa

SEQ ID NO: 730339 - DNA, 20 bp, Homo sapiens
ttcatttaagggaaagaaaa

SEQ ID NO: 730340 - DNA, 14 bp, Homo sapiens
ttcatttaatatat

SEQ ID NO: 730341 - DNA, 21 bp, Homo sapiens
ttcatttagctaaacggattc

SEQ ID NO: 730342 - DNA, 17 bp, Homo sapiens
ttcatttatctataatt

SEQ ID NO: 730343 - DNA, 13 bp, Homo sapiens
ttcatttcaatca

SEQ ID NO: 730344 - DNA, 21 bp, Homo sapiens
ttcatttcaatcattgaagta

SEQ ID NO: 730345 - DNA, 21 bp, Homo sapiens
ttcatttcacacagtgaaacg

SEQ ID NO: 730346 - DNA, 18 bp, Homo sapiens
ttcatttcagggtcttgg

SEQ ID NO: 730347 - DNA, 13 bp, Homo sapiens
ttcatttcattgt

SEQ ID NO: 730348 - DNA, 13 bp, Homo sapiens
ttcatttcctgcc

SEQ ID NO: 730349 - DNA, 14 bp, Homo sapiens
ttcatttcctgccc

SEQ ID NO: 730350 - DNA, 20 bp, Homo sapiens
ttcatttgagttattttaat

SEQ ID NO: 730351 - DNA, 16 bp, Homo sapiens
ttcatttgctttggaa

SEQ ID NO: 730352 - DNA, 21 bp, Homo sapiens
ttcatttggtgttcctggaag

SEQ ID NO: 730353 - DNA, 12 bp, Homo sapiens
ttcatttgtaca

SEQ ID NO: 730354 - DNA, 21 bp, Homo sapiens
ttcatttgtacaaggtaattg

SEQ ID NO: 730355 - DNA, 11 bp, Homo sapiens
ttcatttgtat

SEQ ID NO: 730356 - DNA, 17 bp, Homo sapiens
ttcatttgtatgtcaaa

SEQ ID NO: 730357 - DNA, 13 bp, Homo sapiens
ttcatttgtgtca

SEQ ID NO: 730358 - DNA, 22 bp, Homo sapiens
ttcatttgtttgtttgtttgtc

SEQ ID NO: 730359 - DNA, 16 bp, Homo sapiens
ttcatttgttttgctt

SEQ ID NO: 730360 - DNA, 15 bp, Homo sapiens
ttcattttaaaaagt

SEQ ID NO: 730361 - DNA, 13 bp, Homo sapiens
ttcattttcctgt

SEQ ID NO: 730362 - DNA, 14 bp, Homo sapiens
ttcattttcctgtt

SEQ ID NO: 730363 - DNA, 19 bp, Homo sapiens
ttcattttctagatacaat

SEQ ID NO: 730364 - DNA, 13 bp, Homo sapiens
ttcattttgaaaa

SEQ ID NO: 730365 - DNA, 19 bp, Homo sapiens
ttcattttgagtattttta

SEQ ID NO: 730366 - DNA, 16 bp, Homo sapiens
ttccagcaataagaaa

SEQ ID NO: 730367 - DNA, 20 bp, Homo sapiens
ttccagcaataagaaatgaa

SEQ ID NO: 730368 - DNA, 18 bp, Homo sapiens
ttccagcagctgcacccc

SEQ ID NO: 730369 - DNA, 21 bp, Homo sapiens
ttccagccacattgagacttt

SEQ ID NO: 730370 - DNA, 15 bp, Homo sapiens
ttccagccaggccca

SEQ ID NO: 730371 - DNA, 17 bp, Homo sapiens
ttccagccaggcccagg

SEQ ID NO: 730372 - DNA, 19 bp, Homo sapiens
ttccagccaggcccaggcc

SEQ ID NO: 730373 - DNA, 23 bp, Homo sapiens
ttccagcccagacccccagtgta

SEQ ID NO: 730374 - DNA, 17 bp, Homo sapiens
ttccagcccctctggtc

SEQ ID NO: 730375 - DNA, 12 bp, Homo sapiens
ttccagcctggg

SEQ ID NO: 730376 - DNA, 16 bp, Homo sapiens
ttccagcctgggacac

SEQ ID NO: 730377 - DNA, 22 bp, Homo sapiens
ttccagccttatgtgttacatt

SEQ ID NO: 730378 - DNA, 20 bp, Homo sapiens
ttccctctctgatgtcccag

SEQ ID NO: 730379 - DNA, 22 bp, Homo sapiens
ttccctctctgatgtcccagtg

SEQ ID NO: 730380 - DNA, 18 bp, Homo sapiens
ttccctctgcctgtccct

SEQ ID NO: 730381 - DNA, 19 bp, Homo sapiens
ttccctctgctcctggagc

SEQ ID NO: 730382 - DNA, 13 bp, Homo sapiens
ttccctctggctt

SEQ ID NO: 730383 - DNA, 21 bp, Homo sapiens
ttccctgaacgttttcttctt

SEQ ID NO: 730384 - DNA, 16 bp, Homo sapiens
ttccctgactcattct

SEQ ID NO: 730385 - DNA, 11 bp, Homo sapiens
ttccctgagga

SEQ ID NO: 730386 - DNA, 15 bp, Homo sapiens
ttccctgaggaatga

SEQ ID NO: 730387 - DNA, 11 bp, Homo sapiens
ttccctgcacc

SEQ ID NO: 730388 - DNA, 15 bp, Homo sapiens
ttccctgcaccctgg

SEQ ID NO: 730389 - DNA, 22 bp, Homo sapiens
ttccctgcactaaagccagcct

SEQ ID NO: 730390 - DNA, 16 bp, Homo sapiens
ttccctgcagacctca

SEQ ID NO: 730391 - DNA, 19 bp, Homo sapiens
ttccctgcatttctgagtt

SEQ ID NO: 730392 - DNA, 22 bp, Homo sapiens
ttccctgcccaaacccttaact

SEQ ID NO: 730393 - DNA, 23 bp, Homo sapiens
ttccctgcccaaacccttaactg

SEQ ID NO: 730394 - DNA, 14 bp, Homo sapiens
ttccctgcctctca

SEQ ID NO: 730395 - DNA, 22 bp, Homo sapiens
ttccctgcgagacgcacacagc

SEQ ID NO: 730396 - DNA, 19 bp, Homo sapiens
ttccctgcgcctgtgatgc

SEQ ID NO: 730397 - DNA, 22 bp, Homo sapiens
ttccctgctgtcgtcttagcaa

SEQ ID NO: 730398 - DNA, 14 bp, Homo sapiens
ttccctgcttccag

SEQ ID NO: 730399 - DNA, 12 bp, Homo sapiens
ttccctggacag

SEQ ID NO: 730400 - DNA, 21 bp, Homo sapiens
ttccctggacaggcagcctcc

SEQ ID NO: 730401 - DNA, 13 bp, Homo sapiens
ttcctggacacac

SEQ ID NO: 730402 - DNA, 10 bp, Homo sapiens
ttcctggagt

SEQ ID NO: 730403 - DNA, 18 bp, Homo sapiens
ttcctggagtgccctgca

SEQ ID NO: 730404 - DNA, 22 bp, Homo sapiens
ttcctggcaatagtgtgttctg

SEQ ID NO: 730405 - DNA, 23 bp, Homo sapiens
ttcctggcaatagtgtgttctga

SEQ ID NO: 730406 - DNA, 13 bp, Homo sapiens
ttcctggcagctg

SEQ ID NO: 730407 - DNA, 17 bp, Homo sapiens
ttcctggcagctgctgt

SEQ ID NO: 730408 - DNA, 12 bp, Homo sapiens
ttcctggcccag

SEQ ID NO: 730409 - DNA, 13 bp, Homo sapiens
ttcctggcccagg

SEQ ID NO: 730410 - DNA, 15 bp, Homo sapiens
ttcctggcccaggcc

SEQ ID NO: 730411 - DNA, 15 bp, Homo sapiens
ttcctggccccctca

SEQ ID NO: 730412 - DNA, 24 bp, Homo sapiens
ttcctggccccgggctctggccac

SEQ ID NO: 730413 - DNA, 18 bp, Homo sapiens
ttcctggcctcactggct

SEQ ID NO: 730414 - DNA, 21 bp, Homo sapiens
ttcctggcctcactggctggg

SEQ ID NO: 730415 - DNA, 17 bp, Homo sapiens
ttcctggcctcttctgg

SEQ ID NO: 730416 - DNA, 14 bp, Homo sapiens
ttcctggcctgaga

SEQ ID NO: 730417 - DNA, 22 bp, Homo sapiens
ttcctggcgggggtgggccgtg

SEQ ID NO: 730418 - DNA, 12 bp, Homo sapiens
ttcctggctcta

SEQ ID NO: 730419 - DNA, 13 bp, Homo sapiens
ttcctggctgatg

SEQ ID NO: 730420 - DNA, 20 bp, Homo sapiens
ttcctggctgatgatccaga

SEQ ID NO: 730421 - DNA, 17 bp, Homo sapiens
ttcctgggaatggaata

SEQ ID NO: 730422 - DNA, 17 bp, Homo sapiens
ttcctgggaccccctcg

SEQ ID NO: 730423 - DNA, 19 bp, Homo sapiens
ttcctgggaccccctcgcc

SEQ ID NO: 730424 - DNA, 18 bp, Homo sapiens
ttcctgggagaaagacca

SEQ ID NO: 730425 - DNA, 21 bp, Homo sapiens
ttcctgggatggcgatgggga

SEQ ID NO: 730426 - DNA, 11 bp, Homo sapiens
ttcctgggcct

SEQ ID NO: 730427 - DNA, 23 bp, Homo sapiens
ttcctggggccgcctgccctgcc

SEQ ID NO: 730428 - DNA, 17 bp, Homo sapiens
ttcctgggtgccctggc

SEQ ID NO: 730429 - DNA, 19 bp, Homo sapiens
ttcctggtacccagccatc

SEQ ID NO: 730430 - DNA, 21 bp, Homo sapiens
ttcctggtacccagccatctg

SEQ ID NO: 730431 - DNA, 19 bp, Homo sapiens
ttcctggttaagcaggcat

SEQ ID NO: 730432 - DNA, 22 bp, Homo sapiens
ttcctgtaaagaaacatttcct

SEQ ID NO: 730433 - DNA, 19 bp, Homo sapiens
ttcctgtaacacaagccac

SEQ ID NO: 730434 - DNA, 23 bp, Homo sapiens
ttcctgtaacacaagccacagaa

SEQ ID NO: 730435 - DNA, 16 bp, Homo sapiens
ttcctgtatgttgtcc

SEQ ID NO: 730436 - DNA, 15 bp, Homo sapiens
ttcctgtccctttgt

SEQ ID NO: 730437 - DNA, 12 bp, Homo sapiens
ttcctgtcctgc

SEQ ID NO: 730438 - DNA, 15 bp, Homo sapiens
ttcctgtcctgcctc

SEQ ID NO: 730439 - DNA, 17 bp, Homo sapiens
ttcctgtcctgcctcct

SEQ ID NO: 730440 - DNA, 13 bp, Homo sapiens
ttcctgtctgttt

SEQ ID NO: 730441 - DNA, 22 bp, Homo sapiens
ttcctgtgacagtgaaatacat

SEQ ID NO: 730442 - DNA, 21 bp, Homo sapiens
ttcctgtgatacatttctgaa

SEQ ID NO: 730443 - DNA, 22 bp, Homo sapiens
ttcctgtgatccacccaaccct

SEQ ID NO: 730444 - DNA, 18 bp, Homo sapiens
ttcctgtgcctttcctat

SEQ ID NO: 730445 - DNA, 14 bp, Homo sapiens
ttcctgtggagaca

SEQ ID NO: 730446 - DNA, 17 bp, Homo sapiens
ttcctgtggagacactg

SEQ ID NO: 730447 - DNA, 21 bp, Homo sapiens
ttcctgtggttttattacaaa

SEQ ID NO: 730448 - DNA, 19 bp, Homo sapiens
ttcctgtgtaaaaacaaca

SEQ ID NO: 730449 - DNA, 11 bp, Homo sapiens
ttcctgtgtcc

SEQ ID NO: 730450 - DNA, 17 bp, Homo sapiens
ttcctgtgtgtactctg

SEQ ID NO: 730451 - DNA, 10 bp, Homo sapiens
ttcctgtgtt

SEQ ID NO: 730452 - DNA, 19 bp, Homo sapiens
ttcctgttcagtaataaaa

SEQ ID NO: 730453 - DNA, 15 bp, Homo sapiens
ttcctgttccctcct

SEQ ID NO: 730454 - DNA, 21 bp, Homo sapiens
ttcctgttccctcctggtcct

SEQ ID NO: 730455 - DNA, 14 bp, Homo sapiens
ttcctgttcttcct

SEQ ID NO: 730456 - DNA, 17 bp, Homo sapiens
ttcctgttcttccttcc

SEQ ID NO: 730457 - DNA, 17 bp, Homo sapiens
ttcctgttgtcaagaat

SEQ ID NO: 730458 - DNA, 13 bp, Homo sapiens
ttcctgtttgaaa

SEQ ID NO: 730459 - DNA, 19 bp, Homo sapiens
ttcctgtttttcacatttt

SEQ ID NO: 730460 - DNA, 15 bp, Homo sapiens
ttccttaaacatgaa

SEQ ID NO: 730461 - DNA, 19 bp, Homo sapiens
ttccttaaatttttagcca

SEQ ID NO: 730462 - DNA, 14 bp, Homo sapiens
ttccttaagagcta

SEQ ID NO: 730463 - DNA, 17 bp, Homo sapiens
ttccttaagagctattt

SEQ ID NO: 730464 - DNA, 19 bp, Homo sapiens
ttccttaagtcagaacagc

SEQ ID NO: 730465 - DNA, 19 bp, Homo sapiens
ttccttaattgtattgttt

SEQ ID NO: 730466 - DNA, 16 bp, Homo sapiens
ttccttactgcagaat

SEQ ID NO: 730467 - DNA, 14 bp, Homo sapiens
ttccttacttgcac

SEQ ID NO: 730468 - DNA, 17 bp, Homo sapiens
ttccttacttgcactgt

SEQ ID NO: 730469 - DNA, 23 bp, Homo sapiens
ttccttagctatttatccctttc

SEQ ID NO: 730470 - DNA, 22 bp, Homo sapiens
ttccttagcttagacctcagcc

SEQ ID NO: 730471 - DNA, 15 bp, Homo sapiens
ttccttatactgtat

SEQ ID NO: 730472 - DNA, 21 bp, Homo sapiens
ttccttatgggatcatttttc

SEQ ID NO: 730473 - DNA, 15 bp, Homo sapiens
ttccttatttcaagg

SEQ ID NO: 730474 - DNA, 19 bp, Homo sapiens
ttccttatttctctctcct

SEQ ID NO: 730475 - DNA, 23 bp, Homo sapiens
ttccttatttctctctcctggtg

SEQ ID NO: 730476 - DNA, 22 bp, Homo sapiens
ttccttcagggtttaatagact

SEQ ID NO: 730477 - DNA, 23 bp, Homo sapiens
ttccttcagtttgtaaagtcggt

SEQ ID NO: 730478 - DNA, 14 bp, Homo sapiens
ttccttcatttcca

SEQ ID NO: 730479 - DNA, 20 bp, Homo sapiens
ttccttccaaggtcactctt

SEQ ID NO: 730480 - DNA, 13 bp, Homo sapiens
ttccttccactgt

SEQ ID NO: 730481 - DNA, 16 bp, Homo sapiens
ttccttccactgtagc

SEQ ID NO: 730482 - DNA, 21 bp, Homo sapiens
ttccttccactgtagctatta

SEQ ID NO: 730483 - DNA, 23 bp, Homo sapiens
ttccttcccccatcccctttcct

SEQ ID NO: 730484 - DNA, 15 bp, Homo sapiens
ttccttccctctctg

SEQ ID NO: 730485 - DNA, 13 bp, Homo sapiens
ttccttccctggg

SEQ ID NO: 730486 - DNA, 16 bp, Homo sapiens
ttccttccctgggctg

SEQ ID NO: 730487 - DNA, 20 bp, Homo sapiens
ttccttccctgggctgtgct

SEQ ID NO: 730488 - DNA, 20 bp, Homo sapiens
ttctcccccgccctgccccg

SEQ ID NO: 730489 - DNA, 17 bp, Homo sapiens
ttctccccctgggctct

SEQ ID NO: 730490 - DNA, 18 bp, Homo sapiens
ttctccccctgggctctg

SEQ ID NO: 730491 - DNA, 20 bp, Homo sapiens
ttctcccccttgtcttcccc

SEQ ID NO: 730492 - DNA, 16 bp, Homo sapiens
ttctcccctgcccttc

SEQ ID NO: 730493 - DNA, 19 bp, Homo sapiens
ttctccccttcctggacac

SEQ ID NO: 730494 - DNA, 22 bp, Homo sapiens
ttctcccgggggcagggtgggg

SEQ ID NO: 730495 - DNA, 21 bp, Homo sapiens
ttctcccgttcacgttgccta

SEQ ID NO: 730496 - DNA, 19 bp, Homo sapiens
ttctccctgaccttagcgt

SEQ ID NO: 730497 - DNA, 16 bp, Homo sapiens
ttctccctgcagcctt

SEQ ID NO: 730498 - DNA, 19 bp, Homo sapiens
ttctccctttatgtatctc

SEQ ID NO: 730499 - DNA, 14 bp, Homo sapiens
ttctccctttctct

SEQ ID NO: 730500 - DNA, 19 bp, Homo sapiens
ttctccctttctctctcct

SEQ ID NO: 730501 - DNA, 21 bp, Homo sapiens
ttctccgcattggaagagccc

SEQ ID NO: 730502 - DNA, 17 bp, Homo sapiens
ttctccggggtctgtgc

SEQ ID NO: 730503 - DNA, 17 bp, Homo sapiens
ttctccgggtcctccta

SEQ ID NO: 730504 - DNA, 17 bp, Homo sapiens
ttctccgttagctcctg

SEQ ID NO: 730505 - DNA, 18 bp, Homo sapiens
ttctccgttagctcctgt

SEQ ID NO: 730506 - DNA, 19 bp, Homo sapiens
ttctccgttagctcctgtg

SEQ ID NO: 730507 - DNA, 22 bp, Homo sapiens
ttctccgttagctcctgtggcc

SEQ ID NO: 730508 - DNA, 22 bp, Homo sapiens
ttctcctacttagggaagaaaa

SEQ ID NO: 730509 - DNA, 14 bp, Homo sapiens
ttctcctatgtttg

SEQ ID NO: 730510 - DNA, 14 bp, Homo sapiens
ttctcctccccacc

SEQ ID NO: 730511 - DNA, 17 bp, Homo sapiens
ttctcctccccacctgt

SEQ ID NO: 730512 - DNA, 18 bp, Homo sapiens
ttctcctccccacctgta

SEQ ID NO: 730513 - DNA, 20 bp, Homo sapiens
ttctcctccccacctgtagc

SEQ ID NO: 730514 - DNA, 19 bp, Homo sapiens
ttctcctcccttccttttc

SEQ ID NO: 730515 - DNA, 14 bp, Homo sapiens
ttctcctccgcctg

SEQ ID NO: 730516 - DNA, 23 bp, Homo sapiens
ttctcctccgcctgtgtccatct

SEQ ID NO: 730517 - DNA, 14 bp, Homo sapiens
ttctcctctctggg

SEQ ID NO: 730518 - DNA, 15 bp, Homo sapiens
ttctcctctctgggc

SEQ ID NO: 730519 - DNA, 14 bp, Homo sapiens
ttctcctcttgtaa

SEQ ID NO: 730520 - DNA, 17 bp, Homo sapiens
ttctcctcttgtaaata

SEQ ID NO: 730521 - DNA, 11 bp, Homo sapiens
ttctcctgcca

SEQ ID NO: 730522 - DNA, 11 bp, Homo sapiens
ttctcctgccc

SEQ ID NO: 730523 - DNA, 21 bp, Homo sapiens
ttctcctggagatagctgggg

SEQ ID NO: 730524 - DNA, 23 bp, Homo sapiens
ttctcctggagatagctggggct

SEQ ID NO: 730525 - DNA, 14 bp, Homo sapiens
ttctcctgtgaatg

SEQ ID NO: 730526 - DNA, 15 bp, Homo sapiens
ttctcctgtgaatgg

SEQ ID NO: 730527 - DNA, 16 bp, Homo sapiens
ttctcctgtgaatgga

SEQ ID NO: 730528 - DNA, 12 bp, Homo sapiens
ttctcctgtgcc

SEQ ID NO: 730529 - DNA, 13 bp, Homo sapiens
ttctcctgtgccc

SEQ ID NO: 730530 - DNA, 20 bp, Homo sapiens
ttctcctgtttattcccatc

SEQ ID NO: 730531 - DNA, 19 bp, Homo sapiens
tgtacttctgtgttcattt

SEQ ID NO: 730532 - DNA, 20 bp, Homo sapiens
tgtacttctgtgttcatttt

SEQ ID NO: 730533 - DNA, 22 bp, Homo sapiens
tgtacttgcttgtattgtaaat

SEQ ID NO: 730534 - DNA, 22 bp, Homo sapiens
tgtacttggagtattggggtct

SEQ ID NO: 730535 - DNA, 20 bp, Homo sapiens
tgtactttatatcttgttta

SEQ ID NO: 730536 - DNA, 20 bp, Homo sapiens
tgtactttatcatgaatgct

SEQ ID NO: 730537 - DNA, 20 bp, Homo sapiens
tgtactttatttttctgata

SEQ ID NO: 730538 - DNA, 21 bp, Homo sapiens
tgtactttatttttgtataaa

SEQ ID NO: 730539 - DNA, 15 bp, Homo sapiens
tgtactttgccattt

SEQ ID NO: 730540 - DNA, 13 bp, Homo sapiens
tgtacttttcatt

SEQ ID NO: 730541 - DNA, 22 bp, Homo sapiens
tgtacttttcattctcttttaa

SEQ ID NO: 730542 - DNA, 21 bp, Homo sapiens
tgtacttttctggttccaaac

SEQ ID NO: 730543 - DNA, 21 bp, Homo sapiens
tgtactttttagtaatttctt

SEQ ID NO: 730544 - DNA, 15 bp, Homo sapiens
tgtactttttccaga

SEQ ID NO: 730545 - DNA, 20 bp, Homo sapiens
tgtacttttttaaaaagaaa

SEQ ID NO: 730546 - DNA, 19 bp, Homo sapiens
tgtagaaaagggaactgaa

SEQ ID NO: 730547 - DNA, 23 bp, Homo sapiens
tgtagaaaatttgttattttgca

SEQ ID NO: 730548 - DNA, 19 bp, Homo sapiens
tgtagaactcactctgggc

SEQ ID NO: 730549 - DNA, 21 bp, Homo sapiens
tgtagaagatggactctgaaa

SEQ ID NO: 730550 - DNA, 20 bp, Homo sapiens
tgtagaagtgagtttgtaaa

SEQ ID NO: 730551 - DNA, 14 bp, Homo sapiens
tgtagaataaatga

SEQ ID NO: 730552 - DNA, 20 bp, Homo sapiens
tgtagaatctcttcatgctt

SEQ ID NO: 730553 - DNA, 21 bp, Homo sapiens
tgtagaatctcttcatgcttg

SEQ ID NO: 730554 - DNA, 21 bp, Homo sapiens
tgtagaatgccgcgaactggg

SEQ ID NO: 730555 - DNA, 21 bp, Homo sapiens
tgtagacctagggaggacctt

SEQ ID NO: 730556 - DNA, 19 bp, Homo sapiens
tgtagacctgagctgggag

SEQ ID NO: 730557 - DNA, 21 bp, Homo sapiens
tgtagactctaagatacactg

SEQ ID NO: 730558 - DNA, 18 bp, Homo sapiens
tgtagacttactttccta

SEQ ID NO: 730559 - DNA, 23 bp, Homo sapiens
tgtagagaacacgcgtatttaca

SEQ ID NO: 730560 - DNA, 18 bp, Homo sapiens
tgtagagaatgtcactgt

SEQ ID NO: 730561 - DNA, 14 bp, Homo sapiens
tgtagagcaagcca

SEQ ID NO: 730562 - DNA, 17 bp, Homo sapiens
tgtagagcaagccagtg

SEQ ID NO: 730563 - DNA, 13 bp, Homo sapiens
tgtagagtgggag

SEQ ID NO: 730564 - DNA, 22 bp, Homo sapiens
tgtagatattgttttctgtaaa

SEQ ID NO: 730565 - DNA, 13 bp, Homo sapiens
tgtagatcaggtt

SEQ ID NO: 730566 - DNA, 13 bp, Homo sapiens
tgtagatgaactt

SEQ ID NO: 730567 - DNA, 16 bp, Homo sapiens
tgtagatggaaaaact

SEQ ID NO: 730568 - DNA, 19 bp, Homo sapiens
tgtagatggaaaaacttgt

SEQ ID NO: 730569 - DNA, 14 bp, Homo sapiens
tgtagatgtatgca

SEQ ID NO: 730570 - DNA, 18 bp, Homo sapiens
tgtagatgtatgcacaca

SEQ ID NO: 730571 - DNA, 16 bp, Homo sapiens
tgtagattcaggtaat

SEQ ID NO: 730572 - DNA, 22 bp, Homo sapiens
tgtagattgattgtattgttga

SEQ ID NO: 730573 - DNA, 16 bp, Homo sapiens
tgtagatttatttcat

SEQ ID NO: 730574 - DNA, 12 bp, Homo sapiens
tgtagatttctg

SEQ ID NO: 730575 - DNA, 12 bp, Homo sapiens
tgtagatttgaa

SEQ ID NO: 730576 - DNA, 13 bp, Homo sapiens
tgtagatttgaaa

SEQ ID NO: 730577 - DNA, 17 bp, Homo sapiens
tgtagattttatagtgt

SEQ ID NO: 730578 - DNA, 20 bp, Homo sapiens
tgtagcaactacagtctaaa

SEQ ID NO: 730579 - DNA, 20 bp, Homo sapiens
tgtagcaataagctggacta

SEQ ID NO: 730580 - DNA, 19 bp, Homo sapiens
tgtagcaatggccagagcc

SEQ ID NO: 730581 - DNA, 14 bp, Homo sapiens
gtggaagggggagg

SEQ ID NO: 730582 - DNA, 18 bp, Homo sapiens
gtggaagtatacctggct

SEQ ID NO: 730583 - DNA, 15 bp, Homo sapiens
gtggaagtcagtacg

SEQ ID NO: 730584 - DNA, 15 bp, Homo sapiens
gtggaatataaatag

SEQ ID NO: 730585 - DNA, 18 bp, Homo sapiens
gtggaatgcagggaagag

SEQ ID NO: 730586 - DNA, 16 bp, Homo sapiens
gtggaattagagggcc

SEQ ID NO: 730587 - DNA, 16 bp, Homo sapiens
gtggacacacacagac

SEQ ID NO: 730588 - DNA, 15 bp, Homo sapiens
gtggacaccaggagt

SEQ ID NO: 730589 - DNA, 16 bp, Homo sapiens
gtggacaccccagacc

SEQ ID NO: 730590 - DNA, 23 bp, Homo sapiens
gtggacacgcgtgattgaccctt

SEQ ID NO: 730591 - DNA, 18 bp, Homo sapiens
gtggacagcgctgtattt

SEQ ID NO: 730592 - DNA, 21 bp, Homo sapiens
gtggacaggcgcctggtgtga

SEQ ID NO: 730593 - DNA, 20 bp, Homo sapiens
gtggacatggtcacagtcct

SEQ ID NO: 730594 - DNA, 17 bp, Homo sapiens
gtggaccaatgcatctc

SEQ ID NO: 730595 - DNA, 19 bp, Homo sapiens
gtggaccaatgcatctctt

SEQ ID NO: 730596 - DNA, 13 bp, Homo sapiens
gtggaccaggaca

SEQ ID NO: 730597 - DNA, 17 bp, Homo sapiens
gtggaccaggcctggag

SEQ ID NO: 730598 - DNA, 11 bp, Homo sapiens
gtggaccctgg

SEQ ID NO: 730599 - DNA, 18 bp, Homo sapiens
gtggacctagcctggatg

SEQ ID NO: 730600 - DNA, 21 bp, Homo sapiens
gtggacggcgctgcctcaggc

SEQ ID NO: 730601 - DNA, 20 bp, Homo sapiens
gtggacgtgcactgacagcc

SEQ ID NO: 730602 - DNA, 20 bp, Homo sapiens
gtggactaaatatctgtcat

SEQ ID NO: 730603 - DNA, 17 bp, Homo sapiens
gtggactgagtgggaag

SEQ ID NO: 730604 - DNA, 17 bp, Homo sapiens
gtggactggctgtgccc

SEQ ID NO: 730605 - DNA, 21 bp, Homo sapiens
gtggactgggaccgtgcgagc

SEQ ID NO: 730606 - DNA, 11 bp, Homo sapiens
gtggactggtg

SEQ ID NO: 730607 - DNA, 16 bp, Homo sapiens
gtggactttccacccc

SEQ ID NO: 730608 - DNA, 20 bp, Homo sapiens
gtggactttccaccccctcc

SEQ ID NO: 730609 - DNA, 22 bp, Homo sapiens
gtggagaaataaaaatacctct

SEQ ID NO: 730610 - DNA, 23 bp, Homo sapiens
gtggagaaataaaaatacctctt

SEQ ID NO: 730611 - DNA, 15 bp, Homo sapiens
gtggagaccctgcca

SEQ ID NO: 730612 - DNA, 16 bp, Homo sapiens
gtggagactgcttccc

SEQ ID NO: 730613 - DNA, 12 bp, Homo sapiens
gtggagagctgg

SEQ ID NO: 730614 - DNA, 21 bp, Homo sapiens
gtggagagggagactcctggg

SEQ ID NO: 730615 - DNA, 21 bp, Homo sapiens
gtggagatagtgccaggtggc

SEQ ID NO: 730616 - DNA, 14 bp, Homo sapiens
gtggagatgctgtg

SEQ ID NO: 730617 - DNA, 20 bp, Homo sapiens
gtggagcaaaaggcagctca

SEQ ID NO: 730618 - DNA, 12 bp, Homo sapiens
gtggagcagcca

SEQ ID NO: 730619 - DNA, 14 bp, Homo sapiens
gtggagcagccaga

SEQ ID NO: 730620 - DNA, 17 bp, Homo sapiens
gtggagcagccagagct

SEQ ID NO: 730621 - DNA, 15 bp, Homo sapiens
gtggagccagggagc

SEQ ID NO: 730622 - DNA, 15 bp, Homo sapiens
gtggagccagggcct

SEQ ID NO: 730623 - DNA, 21 bp, Homo sapiens
gtggagccaggttgtcgggcc

SEQ ID NO: 730624 - DNA, 23 bp, Homo sapiens
gtggagcccgcacccccaccctt

SEQ ID NO: 730625 - DNA, 19 bp, Homo sapiens
gtggagcggggtatgaaga

SEQ ID NO: 730626 - DNA, 15 bp, Homo sapiens
gtggagctgagaaga

SEQ ID NO: 730627 - DNA, 17 bp, Homo sapiens
gtggagctgagaagagg

SEQ ID NO: 730628 - DNA, 19 bp, Homo sapiens
gtggagctgagaagaggag

SEQ ID NO: 730629 - DNA, 20 bp, Homo sapiens
gtggagctgagaagaggagg

SEQ ID NO: 730630 - DNA, 22 bp, Homo sapiens
gtggagctgagaagaggaggag

SEQ ID NO: 730631 - DNA, 18 bp, Homo sapiens
gtggagctgccacagaga

SEQ ID NO: 730632 - DNA, 19 bp, Homo sapiens
gtggaggaaggtgctgagc

SEQ ID NO: 730633 - DNA, 17 bp, Homo sapiens
gtggaggaatgctcccc

SEQ ID NO: 730634 - DNA, 23 bp, Homo sapiens
gtggaggaatgctcccccatcct

SEQ ID NO: 730635 - DNA, 16 bp, Homo sapiens
gtggaggacagacggc

SEQ ID NO: 730636 - DNA, 14 bp, Homo sapiens
gtggaggagaggag

SEQ ID NO: 730637 - DNA, 19 bp, Homo sapiens
gtggaggagctgagggagg

SEQ ID NO: 730638 - DNA, 19 bp, Homo sapiens
gtggaggaggaaggcaaga

SEQ ID NO: 730639 - DNA, 21 bp, Homo sapiens
gtggaggaggaggaggagcct

SEQ ID NO: 730640 - DNA, 14 bp, Homo sapiens
gtggaggaggttgg

SEQ ID NO: 730641 - DNA, 13 bp, Homo sapiens
gtggaggcacttt

SEQ ID NO: 730642 - DNA, 13 bp, Homo sapiens
gtggaggcagcca

SEQ ID NO: 730643 - DNA, 19 bp, Homo sapiens
gtggaggcctgatgctgcc

SEQ ID NO: 730644 - DNA, 20 bp, Homo sapiens
gtggaggcctgatgctgccc

SEQ ID NO: 730645 - DNA, 16 bp, Homo sapiens
gtggaggctgcagtga

SEQ ID NO: 730646 - DNA, 13 bp, Homo sapiens
gtggaggcttcct

SEQ ID NO: 730647 - DNA, 14 bp, Homo sapiens
gtggagggaaggat

SEQ ID NO: 730648 - DNA, 13 bp, Homo sapiens
gtggagggcactt

SEQ ID NO: 730649 - DNA, 20 bp, Homo sapiens
gtggagggcacttcaggtcc

SEQ ID NO: 730650 - DNA, 12 bp, Homo sapiens
gtggagggccac

SEQ ID NO: 730651 - DNA, 14 bp, Homo sapiens
gtggaggggcgccc

SEQ ID NO: 730652 - DNA, 23 bp, Homo sapiens
gtggaggggtgtggcagtggttt

SEQ ID NO: 730653 - DNA, 18 bp, Homo sapiens
gtggaggttgagtgagcc

SEQ ID NO: 730654 - DNA, 21 bp, Homo sapiens
gtggaggttgagtgagccggg

SEQ ID NO: 730655 - DNA, 20 bp, Homo sapiens
gtggagtcggagtggacacc

SEQ ID NO: 730656 - DNA, 21 bp, Homo sapiens
gtggagtcggagtggacaccg

SEQ ID NO: 730657 - DNA, 22 bp, Homo sapiens
tgtaggtgtctctgggcctgtg

SEQ ID NO: 730658 - DNA, 19 bp, Homo sapiens
tgtaggtgtctgcacccag

SEQ ID NO: 730659 - DNA, 18 bp, Homo sapiens
tgtaggtgtctgccttca

SEQ ID NO: 730660 - DNA, 23 bp, Homo sapiens
tgtagtaaaagtggtctctgctg

SEQ ID NO: 730661 - DNA, 19 bp, Homo sapiens
tgtagtaaactatttatct

SEQ ID NO: 730662 - DNA, 14 bp, Homo sapiens
tgtagtaacactaa

SEQ ID NO: 730663 - DNA, 19 bp, Homo sapiens
tgtagtaatctgcattatt

SEQ ID NO: 730664 - DNA, 14 bp, Homo sapiens
tgtagtaattgaca

SEQ ID NO: 730665 - DNA, 18 bp, Homo sapiens
tgtagtagccctttctgt

SEQ ID NO: 730666 - DNA, 23 bp, Homo sapiens
tgtagtagcgttttttaaatgta

SEQ ID NO: 730667 - DNA, 14 bp, Homo sapiens
tgtagtagtctcat

SEQ ID NO: 730668 - DNA, 19 bp, Homo sapiens
tgtagtataatttcaagga

SEQ ID NO: 730669 - DNA, 18 bp, Homo sapiens
tgtagtattttttgtata

SEQ ID NO: 730670 - DNA, 20 bp, Homo sapiens
tgtagtattttttgtataat

SEQ ID NO: 730671 - DNA, 15 bp, Homo sapiens
tgtagtcagttgcat

SEQ ID NO: 730672 - DNA, 12 bp, Homo sapiens
tgtagtcccagc

SEQ ID NO: 730673 - DNA, 13 bp, Homo sapiens
tgtagtgcaaaat

SEQ ID NO: 730674 - DNA, 13 bp, Homo sapiens
tgtagtggaagag

SEQ ID NO: 730675 - DNA, 15 bp, Homo sapiens
tgtagtggaagagca

SEQ ID NO: 730676 - DNA, 12 bp, Homo sapiens
tgtagttaggaa

SEQ ID NO: 730677 - DNA, 13 bp, Homo sapiens
tgtagttaggaaa

SEQ ID NO: 730678 - DNA, 18 bp, Homo sapiens
tgtagttctgccaggcaa

SEQ ID NO: 730679 - DNA, 22 bp, Homo sapiens
tgtagttttccctgcactgtgt

SEQ ID NO: 730680 - DNA, 15 bp, Homo sapiens
tgtagtttttgaaaa

SEQ ID NO: 730681 - DNA, 17 bp, Homo sapiens
tgtagtttttgaaaatt

SEQ ID NO: 730682 - DNA, 14 bp, Homo sapiens
tgtataaaaaggaa

SEQ ID NO: 730683 - DNA, 18 bp, Homo sapiens
tgtataaaaaggaaatta

SEQ ID NO: 730684 - DNA, 19 bp, Homo sapiens
tgtataaaatccaaaatga

SEQ ID NO: 730685 - DNA, 23 bp, Homo sapiens
tgtataaagcaactgttatgaaa

SEQ ID NO: 730686 - DNA, 15 bp, Homo sapiens
tgtataaataagagc

SEQ ID NO: 730687 - DNA, 20 bp, Homo sapiens
tgtataaataataaagaact

SEQ ID NO: 730688 - DNA, 21 bp, Homo sapiens
tgtataaataataaagaactc

SEQ ID NO: 730689 - DNA, 13 bp, Homo sapiens
tgtataaattaaa

SEQ ID NO: 730690 - DNA, 21 bp, Homo sapiens
tgtataaattaaataaactgt

SEQ ID NO: 730691 - DNA, 23 bp, Homo sapiens
tgtataaattaaataaactgttt

SEQ ID NO: 730692 - DNA, 14 bp, Homo sapiens
tgtataaatttatt

SEQ ID NO: 730693 - DNA, 16 bp, Homo sapiens
tgtataaccaagtgtg

SEQ ID NO: 730694 - DNA, 21 bp, Homo sapiens
tgtataacttcttaaaagttg

SEQ ID NO: 730695 - DNA, 16 bp, Homo sapiens
tgtataagcactgaaa

SEQ ID NO: 730696 - DNA, 14 bp, Homo sapiens
tgtataagtaagaa

SEQ ID NO: 730697 - DNA, 20 bp, Homo sapiens
tgtataagtaagaaaatatt

SEQ ID NO: 730698 - DNA, 19 bp, Homo sapiens
tgtataagtactagatgca

SEQ ID NO: 730699 - DNA, 21 bp, Homo sapiens
tgtataagtcaagcacatgta

SEQ ID NO: 730700 - DNA, 15 bp, Homo sapiens
tgtataatactttgt

SEQ ID NO: 730701 - DNA, 17 bp, Homo sapiens
tgtataatactttgtat

SEQ ID NO: 730702 - DNA, 22 bp, Homo sapiens
tgtataatattgaaaattgaaa

SEQ ID NO: 730703 - DNA, 18 bp, Homo sapiens
gtggcacctcctgagaag

SEQ ID NO: 730704 - DNA, 16 bp, Homo sapiens
gtggcacctgtttccc

SEQ ID NO: 730705 - DNA, 18 bp, Homo sapiens
gtggcacgggccctccct

SEQ ID NO: 730706 - DNA, 19 bp, Homo sapiens
gtggcactcaactctgagc

SEQ ID NO: 730707 - DNA, 23 bp, Homo sapiens
gtggcactcaactctgagcccat

SEQ ID NO: 730708 - DNA, 19 bp, Homo sapiens
gtggcactggccacccctc

SEQ ID NO: 730709 - DNA, 21 bp, Homo sapiens
gtggcactggtaggttgggac

SEQ ID NO: 730710 - DNA, 16 bp, Homo sapiens
gtggcacttctgcctt

SEQ ID NO: 730711 - DNA, 18 bp, Homo sapiens
gtggcagaaaagaggaga

SEQ ID NO: 730712 - DNA, 18 bp, Homo sapiens
gtggcagaagtgtcaccc

SEQ ID NO: 730713 - DNA, 15 bp, Homo sapiens
gtggcagagttacag

SEQ ID NO: 730714 - DNA, 18 bp, Homo sapiens
gtggcagatgtcttccct

SEQ ID NO: 730715 - DNA, 18 bp, Homo sapiens
gtggcagattttacaaaa

SEQ ID NO: 730716 - DNA, 15 bp, Homo sapiens
gtggcagccatgcct

SEQ ID NO: 730717 - DNA, 17 bp, Homo sapiens
gtggcagccatgcctca

SEQ ID NO: 730718 - DNA, 20 bp, Homo sapiens
gtggcagccatgcctcatgc

SEQ ID NO: 730719 - DNA, 12 bp, Homo sapiens
gtggcagcccat

SEQ ID NO: 730720 - DNA, 12 bp, Homo sapiens
gtggcagccctg

SEQ ID NO: 730721 - DNA, 14 bp, Homo sapiens
gtggcagccctgta

SEQ ID NO: 730722 - DNA, 19 bp, Homo sapiens
gtggcagctgccccagggc

SEQ ID NO: 730723 - DNA, 19 bp, Homo sapiens
gtggcaggcacacagcagc

SEQ ID NO: 730724 - DNA, 20 bp, Homo sapiens
gtggcaggcacacagcagcc

SEQ ID NO: 730725 - DNA, 18 bp, Homo sapiens
gtggcagggggccccgcc

SEQ ID NO: 730726 - DNA, 18 bp, Homo sapiens
gtggcagtggaggtgggg

SEQ ID NO: 730727 - DNA, 21 bp, Homo sapiens
gtggcagtggttttggcaaac

SEQ ID NO: 730728 - DNA, 16 bp, Homo sapiens
gtggcagttctttact

SEQ ID NO: 730729 - DNA, 22 bp, Homo sapiens
gtggcatcgtagaagagatgtg

SEQ ID NO: 730730 - DNA, 14 bp, Homo sapiens
gtggcatggaaggg

SEQ ID NO: 730731 - DNA, 15 bp, Homo sapiens
gtggcatgtggcctg

SEQ ID NO: 730732 - DNA, 22 bp, Homo sapiens
gtggcatgttcatcgtataaca

SEQ ID NO: 730733 - DNA, 21 bp, Homo sapiens
gtggcattggggggccgggca

SEQ ID NO: 730734 - DNA, 21 bp, Homo sapiens
gtggcatttcaattcctggcc

SEQ ID NO: 730735 - DNA, 19 bp, Homo sapiens
gtggccaaattatttgtgt

SEQ ID NO: 730736 - DNA, 17 bp, Homo sapiens
gtggccaagaagcagtg

SEQ ID NO: 730737 - DNA, 18 bp, Homo sapiens
gtggccaagcctgctgtg

SEQ ID NO: 730738 - DNA, 14 bp, Homo sapiens
gtggccacagcacc

SEQ ID NO: 730739 - DNA, 19 bp, Homo sapiens
gtggccacagcccccttgc

SEQ ID NO: 730740 - DNA, 16 bp, Homo sapiens
gtggccacagcgccag

SEQ ID NO: 730741 - DNA, 21 bp, Homo sapiens
gtggccaccgggggtggctct

SEQ ID NO: 730742 - DNA, 20 bp, Homo sapiens
gtggccacgggggcagtgtg

SEQ ID NO: 730743 - DNA, 21 bp, Homo sapiens
gtggccacgggggcagtgtga

SEQ ID NO: 730744 - DNA, 23 bp, Homo sapiens
gtggccacgggggcagtgtgagg

SEQ ID NO: 730745 - DNA, 21 bp, Homo sapiens
gtggccactccagacccctgg

SEQ ID NO: 730746 - DNA, 21 bp, Homo sapiens
gtggccacttcattccagcag

SEQ ID NO: 730747 - DNA, 23 bp, Homo sapiens
gtggccacttcattccagcagct

SEQ ID NO: 730748 - DNA, 13 bp, Homo sapiens
gtggccagagctg

SEQ ID NO: 730749 - DNA, 17 bp, Homo sapiens
gtggccagagctgggag

SEQ ID NO: 730750 - DNA, 18 bp, Homo sapiens
gtggccagcgccagggcc

SEQ ID NO: 730751 - DNA, 10 bp, Homo sapiens
gtggccaggg

SEQ ID NO: 730752 - DNA, 20 bp, Homo sapiens
gtggccatcactcagcccct

SEQ ID NO: 730753 - DNA, 21 bp, Homo sapiens
gtggccatcactcagccccta

SEQ ID NO: 730754 - DNA, 16 bp, Homo sapiens
gtggccatcagggtgg

SEQ ID NO: 730755 - DNA, 16 bp, Homo sapiens
gtggccatccctgggc

SEQ ID NO: 730756 - DNA, 15 bp, Homo sapiens
gtggccatcctaccc

SEQ ID NO: 730757 - DNA, 16 bp, Homo sapiens
gtggccatggcctctg

SEQ ID NO: 730758 - DNA, 13 bp, Homo sapiens
gtggcccaggacc

SEQ ID NO: 730759 - DNA, 14 bp, Homo sapiens
gtggcccaggcccc

SEQ ID NO: 730760 - DNA, 17 bp, Homo sapiens
gtggcccaggcccccgg

SEQ ID NO: 730761 - DNA, 12 bp, Homo sapiens
gtggccccaccc

SEQ ID NO: 730762 - DNA, 18 bp, Homo sapiens
gtggccccaccctgggcc

SEQ ID NO: 730763 - DNA, 21 bp, Homo sapiens
gtggcccccgccccctcccta

SEQ ID NO: 730764 - DNA, 17 bp, Homo sapiens
gtggcccccgggcctgc

SEQ ID NO: 730765 - DNA, 14 bp, Homo sapiens
gtggccccctgtcc

SEQ ID NO: 730766 - DNA, 16 bp, Homo sapiens
gtggccccgtttctgg

SEQ ID NO: 730767 - DNA, 17 bp, Homo sapiens
gtggcccgacagcctgg

SEQ ID NO: 730768 - DNA, 19 bp, Homo sapiens
gtggcccgacagcctggca

SEQ ID NO: 730769 - DNA, 22 bp, Homo sapiens
gtggccctgactgtcagggagg

SEQ ID NO: 730770 - DNA, 13 bp, Homo sapiens
gtggccctgccat

SEQ ID NO: 730771 - DNA, 21 bp, Homo sapiens
gtggccctgcccttggcacca

SEQ ID NO: 730772 - DNA, 13 bp, Homo sapiens
gtggccctggcct

SEQ ID NO: 730773 - DNA, 19 bp, Homo sapiens
gtggcccttctgtccacca

SEQ ID NO: 730774 - DNA, 22 bp, Homo sapiens
gtggccgcccacccgcccgagg

SEQ ID NO: 730775 - DNA, 18 bp, Homo sapiens
gtggccgctcctccctgc

SEQ ID NO: 730776 - DNA, 20 bp, Homo sapiens
gtggccgtctcctccctcag

SEQ ID NO: 730777 - DNA, 21 bp, Homo sapiens
gtggcctcaaccctccctcag

SEQ ID NO: 730778 - DNA, 12 bp, Homo sapiens
gtggcctcagcc

SEQ ID NO: 730779 - DNA, 13 bp, Homo sapiens
gtggcctcagccc

SEQ ID NO: 730780 - DNA, 19 bp, Homo sapiens
gtggcctcagccctcagaa

SEQ ID NO: 730781 - DNA, 13 bp, Homo sapiens
gtggcctccccat

SEQ ID NO: 730782 - DNA, 15 bp, Homo sapiens
gtggcctccctgctg

SEQ ID NO: 730783 - DNA, 19 bp, Homo sapiens
gtggcctccctgctgtgcc

SEQ ID NO: 730784 - DNA, 22 bp, Homo sapiens
gtggcctccctgctgtgccatg

SEQ ID NO: 730785 - DNA, 19 bp, Homo sapiens
tgtatcctggaacaatatt

SEQ ID NO: 730786 - DNA, 12 bp, Homo sapiens
tgtatcctggcc

SEQ ID NO: 730787 - DNA, 19 bp, Homo sapiens
tgtatcctggggctccctt

SEQ ID NO: 730788 - DNA, 21 bp, Homo sapiens
tgtatccttccaatttggaat

SEQ ID NO: 730789 - DNA, 16 bp, Homo sapiens
tgtatcgcatattagt

SEQ ID NO: 730790 - DNA, 21 bp, Homo sapiens
tgtatctaagaataataaaat

SEQ ID NO: 730791 - DNA, 15 bp, Homo sapiens
tgtatctacaataca

SEQ ID NO: 730792 - DNA, 23 bp, Homo sapiens
tgtatctacaatacatatatcta

SEQ ID NO: 730793 - DNA, 19 bp, Homo sapiens
tgtatctagtgcagctgat

SEQ ID NO: 730794 - DNA, 21 bp, Homo sapiens
tgtatctagtgcagctgattt

SEQ ID NO: 730795 - DNA, 18 bp, Homo sapiens
tgtatctatttgtacaat

SEQ ID NO: 730796 - DNA, 17 bp, Homo sapiens
tgtatctcatactgtct

SEQ ID NO: 730797 - DNA, 24 bp, Homo sapiens
tgtatctcatactgtctgggatta

SEQ ID NO: 730798 - DNA, 13 bp, Homo sapiens
tgtatctcctcct

SEQ ID NO: 730799 - DNA, 18 bp, Homo sapiens
tgtatctctgaagcatgt

SEQ ID NO: 730800 - DNA, 23 bp, Homo sapiens
tgtatctctgaagcatgtttcat

SEQ ID NO: 730801 - DNA, 17 bp, Homo sapiens
tgtatctgaattcctgt

SEQ ID NO: 730802 - DNA, 13 bp, Homo sapiens
tgtatctgagcag

SEQ ID NO: 730803 - DNA, 12 bp, Homo sapiens
tgtatctgagtt

SEQ ID NO: 730804 - DNA, 15 bp, Homo sapiens
tgtatctgagttgcc

SEQ ID NO: 730805 - DNA, 16 bp, Homo sapiens
tgtatctgagttgcca

SEQ ID NO: 730806 - DNA, 18 bp, Homo sapiens
tgtatctgcaggcagaca

SEQ ID NO: 730807 - DNA, 12 bp, Homo sapiens
tgtatctgtctt

SEQ ID NO: 730808 - DNA, 19 bp, Homo sapiens
tgtatctgtctttccactc

SEQ ID NO: 730809 - DNA, 13 bp, Homo sapiens
tgtatctgtgaag

SEQ ID NO: 730810 - DNA, 11 bp, Homo sapiens
tgtatctgtgt

SEQ ID NO: 730811 - DNA, 13 bp, Homo sapiens
tgtatctgtgtag

SEQ ID NO: 730812 - DNA, 16 bp, Homo sapiens
tgtatctgtgtagact

SEQ ID NO: 730813 - DNA, 19 bp, Homo sapiens
tgtatcttcctttcttgtc

SEQ ID NO: 730814 - DNA, 12 bp, Homo sapiens
tgtatctttgta

SEQ ID NO: 730815 - DNA, 19 bp, Homo sapiens
tgtatctttgtaagagcaa

SEQ ID NO: 730816 - DNA, 20 bp, Homo sapiens
tgtatgaaaaattggggagg

SEQ ID NO: 730817 - DNA, 21 bp, Homo sapiens
tgtatgaaaatccttttaacc

SEQ ID NO: 730818 - DNA, 22 bp, Homo sapiens
tgtatgaaagatggctgtgcct

SEQ ID NO: 730819 - DNA, 18 bp, Homo sapiens
tgtatgaaattataatct

SEQ ID NO: 730820 - DNA, 16 bp, Homo sapiens
tgtatgactaaagaga

SEQ ID NO: 730821 - DNA, 22 bp, Homo sapiens
tgtatgagacaggaaaaaccaa

SEQ ID NO: 730822 - DNA, 19 bp, Homo sapiens
tgtatgaggtcctcaggtc

SEQ ID NO: 730823 - DNA, 13 bp, Homo sapiens
tgtatgatgtgtt

SEQ ID NO: 730824 - DNA, 12 bp, Homo sapiens
tgtatgattact

SEQ ID NO: 730825 - DNA, 20 bp, Homo sapiens
gtggctcagtgccttcctct

SEQ ID NO: 730826 - DNA, 14 bp, Homo sapiens
gtggctcatgcctg

SEQ ID NO: 730827 - DNA, 19 bp, Homo sapiens
gtggctccccacctggaca

SEQ ID NO: 730828 - DNA, 21 bp, Homo sapiens
gtggctccccctctgcttctc

SEQ ID NO: 730829 - DNA, 23 bp, Homo sapiens
gtggctcccctctatttagcatg

SEQ ID NO: 730830 - DNA, 18 bp, Homo sapiens
gtggctcctatctgtgtt

SEQ ID NO: 730831 - DNA, 13 bp, Homo sapiens
gtggctcctggta

SEQ ID NO: 730832 - DNA, 13 bp, Homo sapiens
gtggctccttccc

SEQ ID NO: 730833 - DNA, 15 bp, Homo sapiens
gtggctcgctccctg

SEQ ID NO: 730834 - DNA, 14 bp, Homo sapiens
gtggctctcagagc

SEQ ID NO: 730835 - DNA, 21 bp, Homo sapiens
gtggctctcagagcagcagaa

SEQ ID NO: 730836 - DNA, 21 bp, Homo sapiens
gtggctctgaggtgcctgtcc

SEQ ID NO: 730837 - DNA, 11 bp, Homo sapiens
gtggctctggg

SEQ ID NO: 730838 - DNA, 12 bp, Homo sapiens
gtggctctggga

SEQ ID NO: 730839 - DNA, 13 bp, Homo sapiens
gtggctctgggag

SEQ ID NO: 730840 - DNA, 14 bp, Homo sapiens
gtggctctgggaga

SEQ ID NO: 730841 - DNA, 18 bp, Homo sapiens
gtggctctgggagagcca

SEQ ID NO: 730842 - DNA, 20 bp, Homo sapiens
gtggctctgggagagccagc

SEQ ID NO: 730843 - DNA, 14 bp, Homo sapiens
gtggctctggggta

SEQ ID NO: 730844 - DNA, 15 bp, Homo sapiens
gtggctgacccagtc

SEQ ID NO: 730845 - DNA, 15 bp, Homo sapiens
gtggctgagcccctg

SEQ ID NO: 730846 - DNA, 17 bp, Homo sapiens
gtggctgagcccctgtc

SEQ ID NO: 730847 - DNA, 18 bp, Homo sapiens
gtggctgccacacccagg

SEQ ID NO: 730848 - DNA, 20 bp, Homo sapiens
gtggctgccccacctgccgc

SEQ ID NO: 730849 - DNA, 15 bp, Homo sapiens
gtggctgccccggcc

SEQ ID NO: 730850 - DNA, 21 bp, Homo sapiens
gtggctgcctttgatcacagg

SEQ ID NO: 730851 - DNA, 20 bp, Homo sapiens
gtggctgcgcccccagcttc

SEQ ID NO: 730852 - DNA, 22 bp, Homo sapiens
gtggctggaaccacattgaaga

SEQ ID NO: 730853 - DNA, 17 bp, Homo sapiens
gtggctggaagatcctg

SEQ ID NO: 730854 - DNA, 15 bp, Homo sapiens
gtggctggctctacc

SEQ ID NO: 730855 - DNA, 21 bp, Homo sapiens
gtggctggctctaccttcctg

SEQ ID NO: 730856 - DNA, 11 bp, Homo sapiens
gtggctggggg

SEQ ID NO: 730857 - DNA, 17 bp, Homo sapiens
gtggctgggggcaggag

SEQ ID NO: 730858 - DNA, 22 bp, Homo sapiens
gtggctgggggcaggagggccc

SEQ ID NO: 730859 - DNA, 16 bp, Homo sapiens
gtggctgggtgccctc

SEQ ID NO: 730860 - DNA, 22 bp, Homo sapiens
gtggctgggtgggcccagaact

SEQ ID NO: 730861 - DNA, 15 bp, Homo sapiens
gtggctggtccaggg

SEQ ID NO: 730862 - DNA, 17 bp, Homo sapiens
gtggctggtccagggct

SEQ ID NO: 730863 - DNA, 15 bp, Homo sapiens
gtggctggtctggag

SEQ ID NO: 730864 - DNA, 18 bp, Homo sapiens
gtggctggtctggagtcc

SEQ ID NO: 730865 - DNA, 20 bp, Homo sapiens
gtggctggtctggagtccca

SEQ ID NO: 730866 - DNA, 18 bp, Homo sapiens
gtggcttcccgctcagcc

SEQ ID NO: 730867 - DNA, 21 bp, Homo sapiens
gtggcttcccgctcagccctc

SEQ ID NO: 730868 - DNA, 14 bp, Homo sapiens
gtggcttctctgtc

SEQ ID NO: 730869 - DNA, 14 bp, Homo sapiens
gtggcttctttcca

SEQ ID NO: 730870 - DNA, 18 bp, Homo sapiens
gtggcttcttttgaactg

SEQ ID NO: 730871 - DNA, 14 bp, Homo sapiens
gtggcttggagtgg

SEQ ID NO: 730872 - DNA, 24 bp, Homo sapiens
gtggcttgggacatggcacaggcc

SEQ ID NO: 730873 - DNA, 18 bp, Homo sapiens
gtggcttgggctggtcag

SEQ ID NO: 730874 - DNA, 16 bp, Homo sapiens
gtggctttccaggcac

SEQ ID NO: 730875 - DNA, 18 bp, Homo sapiens
gtggctttggcagtgttt

SEQ ID NO: 730876 - DNA, 18 bp, Homo sapiens
gtggctttttgttcagaa

SEQ ID NO: 730877 - DNA, 12 bp, Homo sapiens
gtgggaaaacac

SEQ ID NO: 730878 - DNA, 17 bp, Homo sapiens
gtgggaacgtgactgcc

SEQ ID NO: 730879 - DNA, 21 bp, Homo sapiens
gtgggaagaaacaaacccgtt

SEQ ID NO: 730880 - DNA, 21 bp, Homo sapiens
gtgggaagaccaaaggaagga

SEQ ID NO: 730881 - DNA, 21 bp, Homo sapiens
gtgggaagcccatcctgacca

SEQ ID NO: 730882 - DNA, 20 bp, Homo sapiens
gtgggaaggacttggcgcgc

SEQ ID NO: 730883 - DNA, 14 bp, Homo sapiens
gtgggaagggagag

SEQ ID NO: 730884 - DNA, 18 bp, Homo sapiens
gtgggacacaacacagat

SEQ ID NO: 730885 - DNA, 20 bp, Homo sapiens
gtgggacacctgggagaagg

SEQ ID NO: 730886 - DNA, 22 bp, Homo sapiens
gtgggacactgggcagcaaggc

SEQ ID NO: 730887 - DNA, 17 bp, Homo sapiens
gtgggacagaggagcaa

SEQ ID NO: 730888 - DNA, 21 bp, Homo sapiens
gtgggacagcccagagcctgg

SEQ ID NO: 730889 - DNA, 15 bp, Homo sapiens
gtgggaccgcctggc

SEQ ID NO: 730890 - DNA, 18 bp, Homo sapiens
gtgggaccgcctggccct

SEQ ID NO: 730891 - DNA, 19 bp, Homo sapiens
gtgggaccgcctggccctc

SEQ ID NO: 730892 - DNA, 22 bp, Homo sapiens
gtgggaccgcctggccctccct

SEQ ID NO: 730893 - DNA, 22 bp, Homo sapiens
gtgggacttggagagcaaaggc

SEQ ID NO: 730894 - DNA, 16 bp, Homo sapiens
gtgggagacagcagcc

SEQ ID NO: 730895 - DNA, 19 bp, Homo sapiens
gtgggagacagcagcctgt

SEQ ID NO: 730896 - DNA, 13 bp, Homo sapiens
gtgggagcagctt

SEQ ID NO: 730897 - DNA, 21 bp, Homo sapiens
gtgggagccctgaccttggct

SEQ ID NO: 730898 - DNA, 21 bp, Homo sapiens
gtgggagctgaaccacagaaa

SEQ ID NO: 730899 - DNA, 20 bp, Homo sapiens
gtgggaggaaagggcctggc

SEQ ID NO: 730900 - DNA, 23 bp, Homo sapiens
gtgggaggaaagggcctggccag

SEQ ID NO: 730901 - DNA, 16 bp, Homo sapiens
gtgggaggcagaaacc

SEQ ID NO: 730902 - DNA, 14 bp, Homo sapiens
gtgggaggccaggc

SEQ ID NO: 730903 - DNA, 14 bp, Homo sapiens
gtgggagggagcag

SEQ ID NO: 730904 - DNA, 15 bp, Homo sapiens
gtgggagggagcaga

SEQ ID NO: 730905 - DNA, 20 bp, Homo sapiens
gtgggagggcgtcaggcaga

SEQ ID NO: 730906 - DNA, 22 bp, Homo sapiens
gtgggagggcgtcaggcagagg

SEQ ID NO: 730907 - DNA, 16 bp, Homo sapiens
gtgggagggggaggaa

SEQ ID NO: 730908 - DNA, 16 bp, Homo sapiens
gtgggagggtaccagc

SEQ ID NO: 730909 - DNA, 20 bp, Homo sapiens
gtgggagggtaccagcagaa

SEQ ID NO: 730910 - DNA, 22 bp, Homo sapiens
gtgggaggtaggctgtggggtg

SEQ ID NO: 730911 - DNA, 14 bp, Homo sapiens
gtgggagtgtgtgc

SEQ ID NO: 730912 - DNA, 11 bp, Homo sapiens
gtgggataatg

SEQ ID NO: 730913 - DNA, 15 bp, Homo sapiens
tgtattgagtcttaa

SEQ ID NO: 730914 - DNA, 23 bp, Homo sapiens
tgtattgatgcaatataagcata

SEQ ID NO: 730915 - DNA, 14 bp, Homo sapiens
tgtattgcacattg

SEQ ID NO: 730916 - DNA, 14 bp, Homo sapiens
tgtattgctcctcc

SEQ ID NO: 730917 - DNA, 15 bp, Homo sapiens
tgtattgctcctccc

SEQ ID NO: 730918 - DNA, 15 bp, Homo sapiens
tgtattgcttatttt

SEQ ID NO: 730919 - DNA, 13 bp, Homo sapiens
tgtattggcctgg

SEQ ID NO: 730920 - DNA, 14 bp, Homo sapiens
tgtattggcctgga

SEQ ID NO: 730921 - DNA, 18 bp, Homo sapiens
tgtattgggccttttgga

SEQ ID NO: 730922 - DNA, 16 bp, Homo sapiens
tgtattggttaaaact

SEQ ID NO: 730923 - DNA, 15 bp, Homo sapiens
tgtattgtaaacatg

SEQ ID NO: 730924 - DNA, 16 bp, Homo sapiens
tgtattgtatattaca

SEQ ID NO: 730925 - DNA, 16 bp, Homo sapiens
tgtattgttagatgtt

SEQ ID NO: 730926 - DNA, 19 bp, Homo sapiens
tgtattgttagatgtttgt

SEQ ID NO: 730927 - DNA, 21 bp, Homo sapiens
tgtatttaaagaaaataaaca

SEQ ID NO: 730928 - DNA, 15 bp, Homo sapiens
tgtatttaacagaaa

SEQ ID NO: 730929 - DNA, 18 bp, Homo sapiens
tgtatttaacagggaggg

SEQ ID NO: 730930 - DNA, 20 bp, Homo sapiens
tgtatttaactcagatgaat

SEQ ID NO: 730931 - DNA, 18 bp, Homo sapiens
tgtatttaagatgtacat

SEQ ID NO: 730932 - DNA, 15 bp, Homo sapiens
tgtatttataattta

SEQ ID NO: 730933 - DNA, 19 bp, Homo sapiens
tgtatttataatttaaatg

SEQ ID NO: 730934 - DNA, 20 bp, Homo sapiens
tgtatttataatttaaatga

SEQ ID NO: 730935 - DNA, 19 bp, Homo sapiens
tgtatttatataagtctgt

SEQ ID NO: 730936 - DNA, 21 bp, Homo sapiens
tgtatttatggattaaaaact

SEQ ID NO: 730937 - DNA, 17 bp, Homo sapiens
tgtatttatgtgtgagg

SEQ ID NO: 730938 - DNA, 21 bp, Homo sapiens
tgtatttatttaaaactctgg

SEQ ID NO: 730939 - DNA, 19 bp, Homo sapiens
tgtatttattttcctcccc

SEQ ID NO: 730940 - DNA, 20 bp, Homo sapiens
tgtatttattttcctcccca

SEQ ID NO: 730941 - DNA, 15 bp, Homo sapiens
tgtatttcagggacc

SEQ ID NO: 730942 - DNA, 13 bp, Homo sapiens
tgtatttcagtat

SEQ ID NO: 730943 - DNA, 19 bp, Homo sapiens
tgtatttcctgaaataaat

SEQ ID NO: 730944 - DNA, 21 bp, Homo sapiens
tgtatttcctgaaataaatgt

SEQ ID NO: 730945 - DNA, 14 bp, Homo sapiens
tgtatttgaaaatt

SEQ ID NO: 730946 - DNA, 20 bp, Homo sapiens
tgtatttgagaagataatca

SEQ ID NO: 730947 - DNA, 19 bp, Homo sapiens
gtgggcggacaaaagggcc

SEQ ID NO: 730948 - DNA, 19 bp, Homo sapiens
gtgggcggatcacaaggtc

SEQ ID NO: 730949 - DNA, 15 bp, Homo sapiens
gtgggcggggagaag

SEQ ID NO: 730950 - DNA, 23 bp, Homo sapiens
gtgggcgtttggggccctctatg

SEQ ID NO: 730951 - DNA, 16 bp, Homo sapiens
gtgggctacatgctgg

SEQ ID NO: 730952 - DNA, 14 bp, Homo sapiens
gtgggctcccctct

SEQ ID NO: 730953 - DNA, 20 bp, Homo sapiens
gtgggctcccctcttcctct

SEQ ID NO: 730954 - DNA, 22 bp, Homo sapiens
gtgggctcccctcttcctcttg

SEQ ID NO: 730955 - DNA, 15 bp, Homo sapiens
gtgggctgagccctg

SEQ ID NO: 730956 - DNA, 20 bp, Homo sapiens
gtgggctgatggcctggctg

SEQ ID NO: 730957 - DNA, 10 bp, Homo sapiens
gtgggctgca

SEQ ID NO: 730958 - DNA, 19 bp, Homo sapiens
gtgggctgcacgctcccct

SEQ ID NO: 730959 - DNA, 21 bp, Homo sapiens
gtgggctgcacgctcccctcc

SEQ ID NO: 730960 - DNA, 23 bp, Homo sapiens
gtgggctgcacgctcccctccat

SEQ ID NO: 730961 - DNA, 15 bp, Homo sapiens
gtgggctgcatctgg

SEQ ID NO: 730962 - DNA, 17 bp, Homo sapiens
gtgggctgctgcagtga

SEQ ID NO: 730963 - DNA, 18 bp, Homo sapiens
gtgggctgctggccatga

SEQ ID NO: 730964 - DNA, 23 bp, Homo sapiens
gtgggctggagtcctctccagag

SEQ ID NO: 730965 - DNA, 13 bp, Homo sapiens
gtgggctgggccc

SEQ ID NO: 730966 - DNA, 15 bp, Homo sapiens
gtgggctgggccctc

SEQ ID NO: 730967 - DNA, 18 bp, Homo sapiens
gtgggctggggactctgg

SEQ ID NO: 730968 - DNA, 19 bp, Homo sapiens
gtgggctggggctgctccc

SEQ ID NO: 730969 - DNA, 20 bp, Homo sapiens
gtgggctggtgccccacagc

SEQ ID NO: 730970 - DNA, 21 bp, Homo sapiens
gtgggctgtgttgactgctgc

SEQ ID NO: 730971 - DNA, 17 bp, Homo sapiens
gtgggctgttcagcttc

SEQ ID NO: 730972 - DNA, 21 bp, Homo sapiens
gtgggcttcctgcccttccct

SEQ ID NO: 730973 - DNA, 23 bp, Homo sapiens
gtgggcttcctgcccttccctct

SEQ ID NO: 730974 - DNA, 17 bp, Homo sapiens
gtgggcttcctgctggg

SEQ ID NO: 730975 - DNA, 15 bp, Homo sapiens
gtgggcttggccttg

SEQ ID NO: 730976 - DNA, 18 bp, Homo sapiens
gtgggcttgtgctcggga

SEQ ID NO: 730977 - DNA, 21 bp, Homo sapiens
gtggggaagaggggctggggc

SEQ ID NO: 730978 - DNA, 13 bp, Homo sapiens
gtggggaaggagg

SEQ ID NO: 730979 - DNA, 14 bp, Homo sapiens
gtggggaaggaggg

SEQ ID NO: 730980 - DNA, 15 bp, Homo sapiens
gtggggaaggggtgc

SEQ ID NO: 730981 - DNA, 13 bp, Homo sapiens
gtggggacagatt

SEQ ID NO: 730982 - DNA, 16 bp, Homo sapiens
gtggggacagggaggg

SEQ ID NO: 730983 - DNA, 18 bp, Homo sapiens
gtggggacccaggctccg

SEQ ID NO: 730984 - DNA, 21 bp, Homo sapiens
gtggggacccaggctccgccc

SEQ ID NO: 730985 - DNA, 17 bp, Homo sapiens
gtggggagactgggctg

SEQ ID NO: 730986 - DNA, 22 bp, Homo sapiens
gtggggagcagttttcccctgg

SEQ ID NO: 730987 - DNA, 20 bp, Homo sapiens
gtggggagcgggagcaagag

SEQ ID NO: 730988 - DNA, 17 bp, Homo sapiens
gtggggaggaggaagcc

SEQ ID NO: 730989 - DNA, 18 bp, Homo sapiens
gtggggaggctgcactgg

SEQ ID NO: 730990 - DNA, 22 bp, Homo sapiens
gtggggaggctgcactggagcc

SEQ ID NO: 730991 - DNA, 13 bp, Homo sapiens
gtggggagggccg

SEQ ID NO: 730992 - DNA, 11 bp, Homo sapiens
gtggggagggt

SEQ ID NO: 730993 - DNA, 11 bp, Homo sapiens
gtggggccagg

SEQ ID NO: 730994 - DNA, 15 bp, Homo sapiens
gtggggccctgcccc

SEQ ID NO: 730995 - DNA, 16 bp, Homo sapiens
gtggggccctgcccct

SEQ ID NO: 730996 - DNA, 22 bp, Homo sapiens
gtggggcccttggccccagagg

SEQ ID NO: 730997 - DNA, 17 bp, Homo sapiens
gtggggccgccgcctct

SEQ ID NO: 730998 - DNA, 15 bp, Homo sapiens
gtggggcctcagcct

SEQ ID NO: 730999 - DNA, 18 bp, Homo sapiens
gtggggcctgcctggtct

SEQ ID NO: 731000 - DNA, 21 bp, Homo sapiens
gtggggctcacttttcatcct

SEQ ID NO: 731001 - DNA, 15 bp, Homo sapiens
gtggggctgagctgg

SEQ ID NO: 731002 - DNA, 17 bp, Homo sapiens
gtggggctgcaggcagg

SEQ ID NO: 731003 - DNA, 14 bp, Homo sapiens
gtggggctgctcct

SEQ ID NO: 731004 - DNA, 18 bp, Homo sapiens
gtggggctgctcctccag

SEQ ID NO: 731005 - DNA, 12 bp, Homo sapiens
gtggggctgggc

SEQ ID NO: 731006 - DNA, 14 bp, Homo sapiens
gtggggctgggcac

SEQ ID NO: 731007 - DNA, 12 bp, Homo sapiens
gtggggcttggg

SEQ ID NO: 731008 - DNA, 14 bp, Homo sapiens
gtgggggaactgac

SEQ ID NO: 731009 - DNA, 20 bp, Homo sapiens
gtgggggagaaaaaatcact

SEQ ID NO: 731010 - DNA, 14 bp, Homo sapiens
gtgggggcagaggg

SEQ ID NO: 731011 - DNA, 17 bp, Homo sapiens
gtgggggcagagggcag

SEQ ID NO: 731012 - DNA, 19 bp, Homo sapiens
gtgggggccacctgcctgc

SEQ ID NO: 731013 - DNA, 12 bp, Homo sapiens
gtgggggctgca

SEQ ID NO: 731014 - DNA, 15 bp, Homo sapiens
gtgggggctgtggcc

SEQ ID NO: 731015 - DNA, 16 bp, Homo sapiens
gtgggggctgtggccc

SEQ ID NO: 731016 - DNA, 16 bp, Homo sapiens
gtggggggacagacag

SEQ ID NO: 731017 - DNA, 16 bp, Homo sapiens
gtggggggaggaagca

SEQ ID NO: 731018 - DNA, 12 bp, Homo sapiens
gtggggggtgac

SEQ ID NO: 731019 - DNA, 13 bp, Homo sapiens
gtgggggtgggca

SEQ ID NO: 731020 - DNA, 15 bp, Homo sapiens
gtgggggtgggcagc

SEQ ID NO: 731021 - DNA, 16 bp, Homo sapiens
gtgggggttctggcag

SEQ ID NO: 731022 - DNA, 18 bp, Homo sapiens
gtggggtacatttctctg

SEQ ID NO: 731023 - DNA, 22 bp, Homo sapiens
gtggggtacatttctctgagca

SEQ ID NO: 731024 - DNA, 21 bp, Homo sapiens
gtggggtcatgccctcctctc

SEQ ID NO: 731025 - DNA, 20 bp, Homo sapiens
gtggggtgaaattttcttaa

SEQ ID NO: 731026 - DNA, 17 bp, Homo sapiens
gtggggtgcagctgggt

SEQ ID NO: 731027 - DNA, 20 bp, Homo sapiens
gtggggtgcagctgggtggg

SEQ ID NO: 731028 - DNA, 17 bp, Homo sapiens
gtggggtgggctggagt

SEQ ID NO: 731029 - DNA, 17 bp, Homo sapiens
gtggggtgggggtgggc

SEQ ID NO: 731030 - DNA, 13 bp, Homo sapiens
gtggggtgtgctg

SEQ ID NO: 731031 - DNA, 22 bp, Homo sapiens
gtggggtgtgttccaactgccc

SEQ ID NO: 731032 - DNA, 17 bp, Homo sapiens
gtgggtatgcgagacca

SEQ ID NO: 731033 - DNA, 17 bp, Homo sapiens
gtgggtcaaaccaagaa

SEQ ID NO: 731034 - DNA, 16 bp, Homo sapiens
gtgggtcagaacatgt

SEQ ID NO: 731035 - DNA, 19 bp, Homo sapiens
gtgggtccaggaaggcagc

SEQ ID NO: 731036 - DNA, 20 bp, Homo sapiens
gtgggtccatgggcagagcc

SEQ ID NO: 731037 - DNA, 22 bp, Homo sapiens
gtgggtctacctcatctctgaa

SEQ ID NO: 731038 - DNA, 16 bp, Homo sapiens
gtgggtctgagctgga

SEQ ID NO: 731039 - DNA, 17 bp, Homo sapiens
gtgggtctgagctggac

SEQ ID NO: 731040 - DNA, 17 bp, Homo sapiens
tgtcacgtgaaatattt

SEQ ID NO: 731041 - DNA, 22 bp, Homo sapiens
tgtcacgtgaaatatttaagta

SEQ ID NO: 731042 - DNA, 14 bp, Homo sapiens
tgtcactatatctt

SEQ ID NO: 731043 - DNA, 17 bp, Homo sapiens
tgtcactcactgaggcc

SEQ ID NO: 731044 - DNA, 18 bp, Homo sapiens
tgtcactcactgaggcca

SEQ ID NO: 731045 - DNA, 19 bp, Homo sapiens
tgtcactcactgaggccat

SEQ ID NO: 731046 - DNA, 15 bp, Homo sapiens
tgtcactcattgctg

SEQ ID NO: 731047 - DNA, 22 bp, Homo sapiens
tgtcactcattgctgagcctct

SEQ ID NO: 731048 - DNA, 22 bp, Homo sapiens
tgtcactctaggaagaagacaa

SEQ ID NO: 731049 - DNA, 18 bp, Homo sapiens
tgtcactggcagagcaca

SEQ ID NO: 731050 - DNA, 20 bp, Homo sapiens
tgtcactggcagagcacagc

SEQ ID NO: 731051 - DNA, 22 bp, Homo sapiens
tgtcactggcagagcacagccc

SEQ ID NO: 731052 - DNA, 21 bp, Homo sapiens
tgtcactggtagaccaaaata

SEQ ID NO: 731053 - DNA, 23 bp, Homo sapiens
tgtcactggtagaccaaaataaa

SEQ ID NO: 731054 - DNA, 14 bp, Homo sapiens
tgtcactgtagttt

SEQ ID NO: 731055 - DNA, 12 bp, Homo sapiens
tgtcactgtggt

SEQ ID NO: 731056 - DNA, 15 bp, Homo sapiens
tgtcactgtggtcct

SEQ ID NO: 731057 - DNA, 14 bp, Homo sapiens
tgtcacttgccaca

SEQ ID NO: 731058 - DNA, 15 bp, Homo sapiens
tgtcacttggtggcg

SEQ ID NO: 731059 - DNA, 20 bp, Homo sapiens
tgtcacttgtcgggggccca

SEQ ID NO: 731060 - DNA, 14 bp, Homo sapiens
tgtcactttgctct

SEQ ID NO: 731061 - DNA, 16 bp, Homo sapiens
tgtcactttgctctgg

SEQ ID NO: 731062 - DNA, 17 bp, Homo sapiens
tgtcactttgctctggg

SEQ ID NO: 731063 - DNA, 18 bp, Homo sapiens
tgtcactttgctctgggt

SEQ ID NO: 731064 - DNA, 22 bp, Homo sapiens
tgtcacttttccttttcttaaa

SEQ ID NO: 731065 - DNA, 12 bp, Homo sapiens
tgtcacttttta

SEQ ID NO: 731066 - DNA, 16 bp, Homo sapiens
tgtcagaaaaaatatg

SEQ ID NO: 731067 - DNA, 20 bp, Homo sapiens
tgtcagaaacaatgacatcc

SEQ ID NO: 731068 - DNA, 16 bp, Homo sapiens
tgtcagaaaccagtta

SEQ ID NO: 731069 - DNA, 22 bp, Homo sapiens
tgtcatgtacttcctgtgtact

SEQ ID NO: 731070 - DNA, 15 bp, Homo sapiens
tgtcattaaacatga

SEQ ID NO: 731071 - DNA, 23 bp, Homo sapiens
tgtcattaaatggggctcacaaa

SEQ ID NO: 731072 - DNA, 15 bp, Homo sapiens
tgtcattacatagaa

SEQ ID NO: 731073 - DNA, 16 bp, Homo sapiens
tgtcattcaagcctgt

SEQ ID NO: 731074 - DNA, 15 bp, Homo sapiens
tgtcattcagaaaaa

SEQ ID NO: 731075 - DNA, 23 bp, Homo sapiens
tgtcattcgctactatgatttaa

SEQ ID NO: 731076 - DNA, 19 bp, Homo sapiens
tgtcattctgcctgctcca

SEQ ID NO: 731077 - DNA, 16 bp, Homo sapiens
tgtcattgaaaaacta

SEQ ID NO: 731078 - DNA, 16 bp, Homo sapiens
tgtcattgagcctggc

SEQ ID NO: 731079 - DNA, 14 bp, Homo sapiens
tgtcattgctaaaa

SEQ ID NO: 731080 - DNA, 14 bp, Homo sapiens
tgtcattgtaaaca

SEQ ID NO: 731081 - DNA, 18 bp, Homo sapiens
tgtcattgtaaacaaact

SEQ ID NO: 731082 - DNA, 13 bp, Homo sapiens
tgtcattgtattc

SEQ ID NO: 731083 - DNA, 15 bp, Homo sapiens
tgtcattgtccagct

SEQ ID NO: 731084 - DNA, 16 bp, Homo sapiens
tgtcatttcagaagtt

SEQ ID NO: 731085 - DNA, 15 bp, Homo sapiens
tgtcatttcattcca

SEQ ID NO: 731086 - DNA, 20 bp, Homo sapiens
tgtcatttcattccattgcc

SEQ ID NO: 731087 - DNA, 18 bp, Homo sapiens
tgtcatttgactgtctca

SEQ ID NO: 731088 - DNA, 16 bp, Homo sapiens
tgtcatttgttaaaat

SEQ ID NO: 731089 - DNA, 18 bp, Homo sapiens
tgtcattttaaaatctga

SEQ ID NO: 731090 - DNA, 23 bp, Homo sapiens
tgtcattttaaaatctgatttaa

SEQ ID NO: 731091 - DNA, 22 bp, Homo sapiens
tgtcattttattttttccctcc

SEQ ID NO: 731092 - DNA, 13 bp, Homo sapiens
tgtcattttggta

SEQ ID NO: 731093 - DNA, 14 bp, Homo sapiens
tgtcatttttaaaa

SEQ ID NO: 731094 - DNA, 19 bp, Homo sapiens
tgtcatttttaacagcatg

SEQ ID NO: 731095 - DNA, 16 bp, Homo sapiens
tgtcatttttaatgta

SEQ ID NO: 731096 - DNA, 15 bp, Homo sapiens
tgtcatttttgcagt

SEQ ID NO: 731097 - DNA, 17 bp, Homo sapiens
tgtccaaacatttcatc

SEQ ID NO: 731098 - DNA, 22 bp, Homo sapiens
tgtccaagacacatgctgaggt

SEQ ID NO: 731099 - DNA, 14 bp, Homo sapiens
tgtccaaggaaact

SEQ ID NO: 731100 - DNA, 18 bp, Homo sapiens
tgtccaagtgtgtgtgcg

SEQ ID NO: 731101 - DNA, 21 bp, Homo sapiens
tgtccaagttcttcacctcta

SEQ ID NO: 731102 - DNA, 23 bp, Homo sapiens
tgtccaattgttgacagttctga

SEQ ID NO: 731103 - DNA, 18 bp, Homo sapiens
tgtccacatccccagagc

SEQ ID NO: 731104 - DNA, 19 bp, Homo sapiens
tgtccacatccccagagcc

SEQ ID NO: 731105 - DNA, 21 bp, Homo sapiens
tgtccacatccccagagccca

SEQ ID NO: 731106 - DNA, 23 bp, Homo sapiens
tgtccacatccccagagcccagc

SEQ ID NO: 731107 - DNA, 14 bp, Homo sapiens
tgtccacatctgcc

SEQ ID NO: 731108 - DNA, 21 bp, Homo sapiens
tgtccaccagtttatacagaa

SEQ ID NO: 731109 - DNA, 14 bp, Homo sapiens
tgtccacctggccc

SEQ ID NO: 731110 - DNA, 19 bp, Homo sapiens
tgtccacctgtgctgctgc

SEQ ID NO: 731111 - DNA, 15 bp, Homo sapiens
tgtccacctgtgggt

SEQ ID NO: 731112 - DNA, 18 bp, Homo sapiens
tgtccacgactgtctcca

SEQ ID NO: 731113 - DNA, 19 bp, Homo sapiens
tgtccactctcggggccct

SEQ ID NO: 731114 - DNA, 20 bp, Homo sapiens
tgtccagaagaatattcagg

SEQ ID NO: 731115 - DNA, 13 bp, Homo sapiens
tgtccagcagctg

SEQ ID NO: 731116 - DNA, 21 bp, Homo sapiens
tgtccagcagctgcgggtctg

SEQ ID NO: 731117 - DNA, 18 bp, Homo sapiens
tgtccagcattgaagaga

SEQ ID NO: 731118 - DNA, 12 bp, Homo sapiens
tgtccagcctgg

SEQ ID NO: 731119 - DNA, 19 bp, Homo sapiens
tgtccagcctgggcagcca

SEQ ID NO: 731120 - DNA, 17 bp, Homo sapiens
tgtccagctgagcgcca

SEQ ID NO: 731121 - DNA, 16 bp, Homo sapiens
tgtccagcttccaaag

SEQ ID NO: 731122 - DNA, 17 bp, Homo sapiens
tgtccagcttccaaagc

SEQ ID NO: 731123 - DNA, 21 bp, Homo sapiens
tgtccaggagctaatctgacc

SEQ ID NO: 731124 - DNA, 19 bp, Homo sapiens
tgtccaggcactgctgccc

SEQ ID NO: 731125 - DNA, 12 bp, Homo sapiens
tgtccaggcagc

SEQ ID NO: 731126 - DNA, 12 bp, Homo sapiens
tgtccaggccac

SEQ ID NO: 731127 - DNA, 14 bp, Homo sapiens
tgtccaggccactg

SEQ ID NO: 731128 - DNA, 20 bp, Homo sapiens
tgtccaggccactgtggcca

SEQ ID NO: 731129 - DNA, 21 bp, Homo sapiens
tgtccaggccactgtggccag

SEQ ID NO: 731130 - DNA, 20 bp, Homo sapiens
tgtccaggctctgggcacag

SEQ ID NO: 731131 - DNA, 14 bp, Homo sapiens
tgtccagggcccca

SEQ ID NO: 731132 - DNA, 19 bp, Homo sapiens
tgtccagggccctgagctc

SEQ ID NO: 731133 - DNA, 16 bp, Homo sapiens
tgtccagtcatcctgc

SEQ ID NO: 731134 - DNA, 22 bp, Homo sapiens
tgtccagtcatcctgccctgca

SEQ ID NO: 731135 - DNA, 20 bp, Homo sapiens
tgtccatacactttgttgca

SEQ ID NO: 731136 - DNA, 14 bp, Homo sapiens
tgtccatctgtctg

SEQ ID NO: 731137 - DNA, 19 bp, Homo sapiens
tgtccatctgtctgtccta

SEQ ID NO: 731138 - DNA, 21 bp, Homo sapiens
tgtccatctgtctgtcctacc

SEQ ID NO: 731139 - DNA, 20 bp, Homo sapiens
tgtccatgtggttcttcaaa

SEQ ID NO: 731140 - DNA, 12 bp, Homo sapiens
tgtccatgtgtg

SEQ ID NO: 731141 - DNA, 21 bp, Homo sapiens
tgtccatttatccacaggaaa

SEQ ID NO: 731142 - DNA, 13 bp, Homo sapiens
tgtccattttgca

SEQ ID NO: 731143 - DNA, 19 bp, Homo sapiens
tgtcccaaaatcccctcag

SEQ ID NO: 731144 - DNA, 16 bp, Homo sapiens
tgtcccaacttgtaaa

SEQ ID NO: 731145 - DNA, 16 bp, Homo sapiens
tgtcccaaggagctga

SEQ ID NO: 731146 - DNA, 13 bp, Homo sapiens
tgtcccaccaact

SEQ ID NO: 731147 - DNA, 22 bp, Homo sapiens
tgtcccaccaactctgcactcc

SEQ ID NO: 731148 - DNA, 18 bp, Homo sapiens
tgtcccaccatacgagca

SEQ ID NO: 731149 - DNA, 12 bp, Homo sapiens
tgtcccacccac

SEQ ID NO: 731150 - DNA, 18 bp, Homo sapiens
tgtcccacccacacagct

SEQ ID NO: 731151 - DNA, 20 bp, Homo sapiens
tgtcccacccacacagctgc

SEQ ID NO: 731152 - DNA, 22 bp, Homo sapiens
tgtcccacccacacagctgccc

SEQ ID NO: 731153 - DNA, 19 bp, Homo sapiens
tgtcccacccccttccccc

SEQ ID NO: 731154 - DNA, 16 bp, Homo sapiens
tgtcccaccgggagcc

SEQ ID NO: 731155 - DNA, 22 bp, Homo sapiens
tgtcccaccgggagcctccccc

SEQ ID NO: 731156 - DNA, 16 bp, Homo sapiens
tgtcccacctggctcc

SEQ ID NO: 731157 - DNA, 17 bp, Homo sapiens
tgtcccacgtgtcttcc

SEQ ID NO: 731158 - DNA, 15 bp, Homo sapiens
tgtcccactatctgg

SEQ ID NO: 731159 - DNA, 22 bp, Homo sapiens
tgtcccagaggttatctgcctg

SEQ ID NO: 731160 - DNA, 17 bp, Homo sapiens
tgtcccagcctggggct

SEQ ID NO: 731161 - DNA, 18 bp, Homo sapiens
tgtcccagcctggggctc

SEQ ID NO: 731162 - DNA, 12 bp, Homo sapiens
tgtcccaggact

SEQ ID NO: 731163 - DNA, 20 bp, Homo sapiens
tgtcccaggcagcacagtgt

SEQ ID NO: 731164 - DNA, 23 bp, Homo sapiens
tgtcccaggcatgcagctgcctg

SEQ ID NO: 731165 - DNA, 13 bp, Homo sapiens
tgtcccagggccc

SEQ ID NO: 731166 - DNA, 19 bp, Homo sapiens
tgtcccagggccctcccag

SEQ ID NO: 731167 - DNA, 21 bp, Homo sapiens
tgtcccagggccctcccagcc

SEQ ID NO: 731168 - DNA, 13 bp, Homo sapiens
tgtcccagtgctc

SEQ ID NO: 731169 - DNA, 14 bp, Homo sapiens
gtgtacagcacaga

SEQ ID NO: 731170 - DNA, 22 bp, Homo sapiens
gtgtacagtcttgtattaagtt

SEQ ID NO: 731171 - DNA, 16 bp, Homo sapiens
gtgtacataactgaaa

SEQ ID NO: 731172 - DNA, 12 bp, Homo sapiens
gtgtacatatgt

SEQ ID NO: 731173 - DNA, 21 bp, Homo sapiens
gtgtacatttatgttccttta

SEQ ID NO: 731174 - DNA, 21 bp, Homo sapiens
gtgtaccacttctgtgggcat

SEQ ID NO: 731175 - DNA, 23 bp, Homo sapiens
gtgtacccatctttaatttatat

SEQ ID NO: 731176 - DNA, 20 bp, Homo sapiens
gtgtactctataagaggtgt

SEQ ID NO: 731177 - DNA, 13 bp, Homo sapiens
gtgtactgataaa

SEQ ID NO: 731178 - DNA, 19 bp, Homo sapiens
gtgtagatgtagcattgtt

SEQ ID NO: 731179 - DNA, 18 bp, Homo sapiens
gtgtagattttatagtgt

SEQ ID NO: 731180 - DNA, 20 bp, Homo sapiens
gtgtagattttatagtgtgt

SEQ ID NO: 731181 - DNA, 14 bp, Homo sapiens
gtgtagccaaggtc

SEQ ID NO: 731182 - DNA, 16 bp, Homo sapiens
gtgtagccttgcccgg

SEQ ID NO: 731183 - DNA, 17 bp, Homo sapiens
gtgtagccttgcccgga

SEQ ID NO: 731184 - DNA, 17 bp, Homo sapiens
gtgtagcgtcctgagga

SEQ ID NO: 731185 - DNA, 22 bp, Homo sapiens
gtgtagcgtcctgaggaataaa

SEQ ID NO: 731186 - DNA, 16 bp, Homo sapiens
gtgtagctgagctgtg

SEQ ID NO: 731187 - DNA, 20 bp, Homo sapiens
gtgtagctgccacattgatt

SEQ ID NO: 731188 - DNA, 22 bp, Homo sapiens
gtgtagctgtaagggcagtgcc

SEQ ID NO: 731189 - DNA, 23 bp, Homo sapiens
gtgtagctgtaagggcagtgccc

SEQ ID NO: 731190 - DNA, 16 bp, Homo sapiens
tgtccccaggcccagc

SEQ ID NO: 731191 - DNA, 21 bp, Homo sapiens
tgtccccaggcccagccctcc

SEQ ID NO: 731192 - DNA, 18 bp, Homo sapiens
tgtccccaggtcctgtct

SEQ ID NO: 731193 - DNA, 21 bp, Homo sapiens
tgtccccaggtcctgtctctg

SEQ ID NO: 731194 - DNA, 9 bp, Homo sapiens
tgtccccca

SEQ ID NO: 731195 - DNA, 13 bp, Homo sapiens
tgtcccccactct

SEQ ID NO: 731196 - DNA, 14 bp, Homo sapiens
tgtcccccactctc

SEQ ID NO: 731197 - DNA, 22 bp, Homo sapiens
tgtcccccactctctcacccac

SEQ ID NO: 731198 - DNA, 24 bp, Homo sapiens
tgtcccccactctctcacccacca

SEQ ID NO: 731199 - DNA, 12 bp, Homo sapiens
tgtcccccagca

SEQ ID NO: 731200 - DNA, 16 bp, Homo sapiens
tgtcccccagctctgg

SEQ ID NO: 731201 - DNA, 15 bp, Homo sapiens
tgtcccccaggctgg

SEQ ID NO: 731202 - DNA, 16 bp, Homo sapiens
tgtcccccaggctgga

SEQ ID NO: 731203 - DNA, 19 bp, Homo sapiens
tgtcccccccaggccttgt

SEQ ID NO: 731204 - DNA, 17 bp, Homo sapiens
tgtccccctacccaccg

SEQ ID NO: 731205 - DNA, 19 bp, Homo sapiens
tgtccccctcccctcccag

SEQ ID NO: 731206 - DNA, 16 bp, Homo sapiens
tgtccccgccttccct

SEQ ID NO: 731207 - DNA, 18 bp, Homo sapiens
tgtccccgccttccctca

SEQ ID NO: 731208 - DNA, 16 bp, Homo sapiens
tgtcccctcactctgt

SEQ ID NO: 731209 - DNA, 14 bp, Homo sapiens
tgtcccctctgtca

SEQ ID NO: 731210 - DNA, 18 bp, Homo sapiens
tgtcccctgacagggcca

SEQ ID NO: 731211 - DNA, 14 bp, Homo sapiens
tgtcccctgtccca

SEQ ID NO: 731212 - DNA, 15 bp, Homo sapiens
tgtcccctgtcccac

SEQ ID NO: 731213 - DNA, 13 bp, Homo sapiens
tgtccccttcctg

SEQ ID NO: 731214 - DNA, 23 bp, Homo sapiens
tgtcccgccttcctcctccacag

SEQ ID NO: 731215 - DNA, 23 bp, Homo sapiens
tgtccctaagtaagtttcttcct

SEQ ID NO: 731216 - DNA, 19 bp, Homo sapiens
tgtccctacacccctcccc

SEQ ID NO: 731217 - DNA, 16 bp, Homo sapiens
tgtccctatacactag

SEQ ID NO: 731218 - DNA, 22 bp, Homo sapiens
tgtccctatctattaaagtgac

SEQ ID NO: 731219 - DNA, 21 bp, Homo sapiens
tgtccctcactgttgaatttt

SEQ ID NO: 731220 - DNA, 14 bp, Homo sapiens
tgtccctccaggga

SEQ ID NO: 731221 - DNA, 14 bp, Homo sapiens
tgtccctccccctt

SEQ ID NO: 731222 - DNA, 11 bp, Homo sapiens
tgtccctctca

SEQ ID NO: 731223 - DNA, 14 bp, Homo sapiens
tgtccctctcaggc

SEQ ID NO: 731224 - DNA, 14 bp, Homo sapiens
tgtccctctgcccc

SEQ ID NO: 731225 - DNA, 19 bp, Homo sapiens
tgtccctctgggccaatgc

SEQ ID NO: 731226 - DNA, 16 bp, Homo sapiens
tgtccctcttcactcc

SEQ ID NO: 731227 - DNA, 16 bp, Homo sapiens
tgtccctgcactgtgc

SEQ ID NO: 731228 - DNA, 17 bp, Homo sapiens
tgtccctgccccgcccc

SEQ ID NO: 731229 - DNA, 11 bp, Homo sapiens
tgtccctggat

SEQ ID NO: 731230 - DNA, 15 bp, Homo sapiens
tgtccctgggccagg

SEQ ID NO: 731231 - DNA, 16 bp, Homo sapiens
tgtccctgtcaccaag

SEQ ID NO: 731232 - DNA, 15 bp, Homo sapiens
tgtccctgtccctgc

SEQ ID NO: 731233 - DNA, 18 bp, Homo sapiens
tgtccctgtccctgcccc

SEQ ID NO: 731234 - DNA, 18 bp, Homo sapiens
tgtccctgtgttgtccca

SEQ ID NO: 731235 - DNA, 22 bp, Homo sapiens
tgtccctgtgttgtcccatctg

SEQ ID NO: 731236 - DNA, 16 bp, Homo sapiens
tgtcccttaaacaaaa

SEQ ID NO: 731237 - DNA, 23 bp, Homo sapiens
tgtcccttaataaaaatatatat

SEQ ID NO: 731238 - DNA, 15 bp, Homo sapiens
tgtcccttcctttct

SEQ ID NO: 731239 - DNA, 17 bp, Homo sapiens
tgtcccttcgagtccag

SEQ ID NO: 731240 - DNA, 19 bp, Homo sapiens
tgtcccttcgagtccagga

SEQ ID NO: 731241 - DNA, 12 bp, Homo sapiens
tgtcccttgctg

SEQ ID NO: 731242 - DNA, 14 bp, Homo sapiens
tgtccctttcccta

SEQ ID NO: 731243 - DNA, 18 bp, Homo sapiens
tgtccctttcttggccag

SEQ ID NO: 731244 - DNA, 12 bp, Homo sapiens
tgtcccttttct

SEQ ID NO: 731245 - DNA, 22 bp, Homo sapiens
tgtccgctgggtggtaccctct

SEQ ID NO: 731246 - DNA, 23 bp, Homo sapiens
tgtccgctgggtggtaccctctg

SEQ ID NO: 731247 - DNA, 17 bp, Homo sapiens
tgtccggcccagtgcca

SEQ ID NO: 731248 - DNA, 19 bp, Homo sapiens
tgtccggcccagtgccact

SEQ ID NO: 731249 - DNA, 18 bp, Homo sapiens
tgtccggcccagtgccag

SEQ ID NO: 731250 - DNA, 22 bp, Homo sapiens
tgtccggcccagtgccagctcc

SEQ ID NO: 731251 - DNA, 18 bp, Homo sapiens
tgtccgtccagagccggc

SEQ ID NO: 731252 - DNA, 22 bp, Homo sapiens
tgtcctaaaacacctggtagga

SEQ ID NO: 731253 - DNA, 16 bp, Homo sapiens
tgtcctaaatgcaaag

SEQ ID NO: 731254 - DNA, 16 bp, Homo sapiens
tgtcctaagagattta

SEQ ID NO: 731255 - DNA, 16 bp, Homo sapiens
tgtcctaaggaacctt

SEQ ID NO: 731256 - DNA, 18 bp, Homo sapiens
tgtcctaaggacacacta

SEQ ID NO: 731257 - DNA, 15 bp, Homo sapiens
tgtcctaaggcccat

SEQ ID NO: 731258 - DNA, 18 bp, Homo sapiens
tgtcctaattcttctgtc

SEQ ID NO: 731259 - DNA, 14 bp, Homo sapiens
tgtcctacagtgac

SEQ ID NO: 731260 - DNA, 14 bp, Homo sapiens
tgtcctacccgccc

SEQ ID NO: 731261 - DNA, 19 bp, Homo sapiens
tgtcctacctccactctct

SEQ ID NO: 731262 - DNA, 15 bp, Homo sapiens
tgtcctacgtccaag

SEQ ID NO: 731263 - DNA, 18 bp, Homo sapiens
tgtcctacttctgacttt

SEQ ID NO: 731264 - DNA, 18 bp, Homo sapiens
tgtcctatggacaactta

SEQ ID NO: 731265 - DNA, 18 bp, Homo sapiens
tgtcctcaccctgtggga

SEQ ID NO: 731266 - DNA, 14 bp, Homo sapiens
tgtcctcagagcag

SEQ ID NO: 731267 - DNA, 19 bp, Homo sapiens
tgtcctcagagcaggggcc

SEQ ID NO: 731268 - DNA, 15 bp, Homo sapiens
tgtcctcagcatttc

SEQ ID NO: 731269 - DNA, 23 bp, Homo sapiens
tgtcctcagcttgggcttcttcc

SEQ ID NO: 731270 - DNA, 12 bp, Homo sapiens
tgtcctcaggga

SEQ ID NO: 731271 - DNA, 18 bp, Homo sapiens
tgtcctcaggtggccatg

SEQ ID NO: 731272 - DNA, 18 bp, Homo sapiens
tgtcctccagaagcctct

SEQ ID NO: 731273 - DNA, 19 bp, Homo sapiens
tgtcctcccacagacctgc

SEQ ID NO: 731274 - DNA, 14 bp, Homo sapiens
tgtcctcccatccc

SEQ ID NO: 731275 - DNA, 15 bp, Homo sapiens
tgtcctcccatcccc

SEQ ID NO: 731276 - DNA, 17 bp, Homo sapiens
tgtcctcccatcccctg

SEQ ID NO: 731277 - DNA, 17 bp, Homo sapiens
tgtcctcccgagctcct

SEQ ID NO: 731278 - DNA, 21 bp, Homo sapiens
tgtcctcccgagctcctcttc

SEQ ID NO: 731279 - DNA, 12 bp, Homo sapiens
tgtcctccctcc

SEQ ID NO: 731280 - DNA, 21 bp, Homo sapiens
tgtcctccctccctcccttcc

SEQ ID NO: 731281 - DNA, 10 bp, Homo sapiens
tgtcctcctc

SEQ ID NO: 731282 - DNA, 11 bp, Homo sapiens
tgtcctccttc

SEQ ID NO: 731283 - DNA, 18 bp, Homo sapiens
tgtcctccttcctgggac

SEQ ID NO: 731284 - DNA, 18 bp, Homo sapiens
tgtcctccttttcacttt

SEQ ID NO: 731285 - DNA, 20 bp, Homo sapiens
tgtcctctcccccaaccccc

SEQ ID NO: 731286 - DNA, 15 bp, Homo sapiens
tgtcctctccccctt

SEQ ID NO: 731287 - DNA, 14 bp, Homo sapiens
tgtcctctgcctgg

SEQ ID NO: 731288 - DNA, 23 bp, Homo sapiens
tgtcctcttgctcaaaaatctgt

SEQ ID NO: 731289 - DNA, 22 bp, Homo sapiens
tgtcctgaaacgctcctttgtg

SEQ ID NO: 731290 - DNA, 23 bp, Homo sapiens
tgtcctgaaccgactgaccctga

SEQ ID NO: 731291 - DNA, 15 bp, Homo sapiens
tgtcctgatgctttt

SEQ ID NO: 731292 - DNA, 18 bp, Homo sapiens
tgtcctgatggtcagctc

SEQ ID NO: 731293 - DNA, 20 bp, Homo sapiens
tgtcctgatggtcagctccc

SEQ ID NO: 731294 - DNA, 12 bp, Homo sapiens
tgtcctgccagc

SEQ ID NO: 731295 - DNA, 22 bp, Homo sapiens
tgtcctgccagctgccttcctc

SEQ ID NO: 731296 - DNA, 12 bp, Homo sapiens
tgtcctgcccac

SEQ ID NO: 731297 - DNA, 20 bp, Homo sapiens
gtgtcctcctctgaggaagc

SEQ ID NO: 731298 - DNA, 20 bp, Homo sapiens
gtgtcctcctggggttcttt

SEQ ID NO: 731299 - DNA, 16 bp, Homo sapiens
gtgtcctctgcctggg

SEQ ID NO: 731300 - DNA, 17 bp, Homo sapiens
gtgtcctctgcctgggc

SEQ ID NO: 731301 - DNA, 22 bp, Homo sapiens
gtgtcctctgcctgggctctgg

SEQ ID NO: 731302 - DNA, 14 bp, Homo sapiens
gtgtcctctgtgcc

SEQ ID NO: 731303 - DNA, 16 bp, Homo sapiens
gtgtcctctgtgccca

SEQ ID NO: 731304 - DNA, 13 bp, Homo sapiens
gtgtcctgaccac

SEQ ID NO: 731305 - DNA, 17 bp, Homo sapiens
gtgtcctgaccaccctc

SEQ ID NO: 731306 - DNA, 18 bp, Homo sapiens
gtgtcctgaccaccctcc

SEQ ID NO: 731307 - DNA, 13 bp, Homo sapiens
gtgtcctgcccac

SEQ ID NO: 731308 - DNA, 22 bp, Homo sapiens
gtgtcctgcccaccctaccagc

SEQ ID NO: 731309 - DNA, 16 bp, Homo sapiens
gtgtcctgcccatgcc

SEQ ID NO: 731310 - DNA, 17 bp, Homo sapiens
gtgtccttgaactgagg

SEQ ID NO: 731311 - DNA, 18 bp, Homo sapiens
gtgtccttgcacctgcat

SEQ ID NO: 731312 - DNA, 16 bp, Homo sapiens
gtgtcggatcctgtga

SEQ ID NO: 731313 - DNA, 21 bp, Homo sapiens
tgtctcctcaagcctgtgggc

SEQ ID NO: 731314 - DNA, 15 bp, Homo sapiens
tgtctcctccctggg

SEQ ID NO: 731315 - DNA, 18 bp, Homo sapiens
tgtctcctccctgggcta

SEQ ID NO: 731316 - DNA, 14 bp, Homo sapiens
tgtctcctctcaga

SEQ ID NO: 731317 - DNA, 11 bp, Homo sapiens
tgtctccttcc

SEQ ID NO: 731318 - DNA, 18 bp, Homo sapiens
tgtctcctttctgactgt

SEQ ID NO: 731319 - DNA, 20 bp, Homo sapiens
tgtctcgcgcgactgagaac

SEQ ID NO: 731320 - DNA, 16 bp, Homo sapiens
tgtctcgggctgaccc

SEQ ID NO: 731321 - DNA, 18 bp, Homo sapiens
tgtctcgggctgaccctt

SEQ ID NO: 731322 - DNA, 21 bp, Homo sapiens
tgtctcgtggtaggactgtag

SEQ ID NO: 731323 - DNA, 17 bp, Homo sapiens
tgtctcgtgtacagctc

SEQ ID NO: 731324 - DNA, 21 bp, Homo sapiens
tgtctcgtgtcagtaatttat

SEQ ID NO: 731325 - DNA, 22 bp, Homo sapiens
tgtctctaaccattcaaatgac

SEQ ID NO: 731326 - DNA, 17 bp, Homo sapiens
tgtctctagctgttctg

SEQ ID NO: 731327 - DNA, 22 bp, Homo sapiens
tgtctctagctgttctggacta

SEQ ID NO: 731328 - DNA, 16 bp, Homo sapiens
tgtctctattagctgg

SEQ ID NO: 731329 - DNA, 20 bp, Homo sapiens
tgtctctattagctgggttc

SEQ ID NO: 731330 - DNA, 14 bp, Homo sapiens
tgtctctctgccaa

SEQ ID NO: 731331 - DNA, 12 bp, Homo sapiens
tgtctctctggg

SEQ ID NO: 731332 - DNA, 13 bp, Homo sapiens
tgtctctctgggc

SEQ ID NO: 731333 - DNA, 19 bp, Homo sapiens
tgtctctgatgcagcttat

SEQ ID NO: 731334 - DNA, 19 bp, Homo sapiens
tgtctctgcatccatttga

SEQ ID NO: 731335 - DNA, 22 bp, Homo sapiens
tgtctctgcctccctcaccctg

SEQ ID NO: 731336 - DNA, 14 bp, Homo sapiens
tgtctctgctccta

SEQ ID NO: 731337 - DNA, 13 bp, Homo sapiens
tgtctctgcttcc

SEQ ID NO: 731338 - DNA, 15 bp, Homo sapiens
tgtctctgcttccat

SEQ ID NO: 731339 - DNA, 12 bp, Homo sapiens
tgtctctggagt

SEQ ID NO: 731340 - DNA, 14 bp, Homo sapiens
tgtctctgggcctg

SEQ ID NO: 731341 - DNA, 15 bp, Homo sapiens
tgtctctgggcctgt

SEQ ID NO: 731342 - DNA, 19 bp, Homo sapiens
tgtctctgggcctgtgtgt

SEQ ID NO: 731343 - DNA, 14 bp, Homo sapiens
tgtctctgggctga

SEQ ID NO: 731344 - DNA, 18 bp, Homo sapiens
tgtctctgggctgaggaa

SEQ ID NO: 731345 - DNA, 17 bp, Homo sapiens
tgtctctgtggaaaagc

SEQ ID NO: 731346 - DNA, 19 bp, Homo sapiens
tgtctctgtgtttgaagtt

SEQ ID NO: 731347 - DNA, 20 bp, Homo sapiens
tgtctctgttcagatgtgca

SEQ ID NO: 731348 - DNA, 22 bp, Homo sapiens
tgtctctgttggtccactgtgt

SEQ ID NO: 731349 - DNA, 20 bp, Homo sapiens
tgtctcttcatctaatatga

SEQ ID NO: 731350 - DNA, 15 bp, Homo sapiens
tgtctcttcctctgt

SEQ ID NO: 731351 - DNA, 17 bp, Homo sapiens
tgtctcttgagcatcaa

SEQ ID NO: 731352 - DNA, 20 bp, Homo sapiens
tgtctcttgagcatcaatct

SEQ ID NO: 731353 - DNA, 18 bp, Homo sapiens
tgtctcttgtagaagatg

SEQ ID NO: 731354 - DNA, 16 bp, Homo sapiens
tgtctcttttctcttt

SEQ ID NO: 731355 - DNA, 18 bp, Homo sapiens
tgtctcttttctctttct

SEQ ID NO: 731356 - DNA, 22 bp, Homo sapiens
tgtctcttttctcttttgcttt

SEQ ID NO: 731357 - DNA, 22 bp, Homo sapiens
tgtctgaaaaattcctttgtgt

SEQ ID NO: 731358 - DNA, 17 bp, Homo sapiens
tgtctgaaaagggactg

SEQ ID NO: 731359 - DNA, 15 bp, Homo sapiens
tgtctgaacatagaa

SEQ ID NO: 731360 - DNA, 13 bp, Homo sapiens
tgtctgaacttgc

SEQ ID NO: 731361 - DNA, 16 bp, Homo sapiens
tgtctgaacttgcatt

SEQ ID NO: 731362 - DNA, 22 bp, Homo sapiens
tgtctgaaggacacttcctgcc

SEQ ID NO: 731363 - DNA, 20 bp, Homo sapiens
tgtctgaagtcactgcacag

SEQ ID NO: 731364 - DNA, 21 bp, Homo sapiens
tgtctgacacgcaagtgtgtg

SEQ ID NO: 731365 - DNA, 22 bp, Homo sapiens
tgtctgacacgcaagtgtgtga

SEQ ID NO: 731366 - DNA, 21 bp, Homo sapiens
tgtctgaggagtaagtgtaca

SEQ ID NO: 731367 - DNA, 17 bp, Homo sapiens
tgtctgagtgaacctgt

SEQ ID NO: 731368 - DNA, 21 bp, Homo sapiens
tgtctgcacaccttgaatctg

SEQ ID NO: 731369 - DNA, 14 bp, Homo sapiens
tgtctgcacagagg

SEQ ID NO: 731370 - DNA, 21 bp, Homo sapiens
tgtctgcatttcggtggctag

SEQ ID NO: 731371 - DNA, 12 bp, Homo sapiens
tgtctgccaggc

SEQ ID NO: 731372 - DNA, 13 bp, Homo sapiens
tgtctgccaggca

SEQ ID NO: 731373 - DNA, 14 bp, Homo sapiens
tgtctgccccagcc

SEQ ID NO: 731374 - DNA, 16 bp, Homo sapiens
tgtctgccctctgggt

SEQ ID NO: 731375 - DNA, 16 bp, Homo sapiens
tgtctgccttactggt

SEQ ID NO: 731376 - DNA, 17 bp, Homo sapiens
tgtctgccttcacaaat

SEQ ID NO: 731377 - DNA, 18 bp, Homo sapiens
tgtctgccttcacaaatg

SEQ ID NO: 731378 - DNA, 13 bp, Homo sapiens
tgtctgccttccc

SEQ ID NO: 731379 - DNA, 17 bp, Homo sapiens
tgtctgctggtatttct

SEQ ID NO: 731380 - DNA, 13 bp, Homo sapiens
tgtctgcttctgt

SEQ ID NO: 731381 - DNA, 14 bp, Homo sapiens
tgtctgcttctgtc

SEQ ID NO: 731382 - DNA, 19 bp, Homo sapiens
tgtctgcttctgtccagga

SEQ ID NO: 731383 - DNA, 21 bp, Homo sapiens
tgtctgctttaaagggcctgc

SEQ ID NO: 731384 - DNA, 20 bp, Homo sapiens
tgtctggcaaggactttgta

SEQ ID NO: 731385 - DNA, 18 bp, Homo sapiens
tgtctggccagaaaaggc

SEQ ID NO: 731386 - DNA, 20 bp, Homo sapiens
tgtctggctcggacccaccc

SEQ ID NO: 731387 - DNA, 19 bp, Homo sapiens
tgtctggctgaggatttca

SEQ ID NO: 731388 - DNA, 19 bp, Homo sapiens
tgtctgggagagcctggca

SEQ ID NO: 731389 - DNA, 21 bp, Homo sapiens
tgtctgggattaagggcaaat

SEQ ID NO: 731390 - DNA, 16 bp, Homo sapiens
tgtctggtttctgtcc

SEQ ID NO: 731391 - DNA, 16 bp, Homo sapiens
tgtctggttttaacaa

SEQ ID NO: 731392 - DNA, 22 bp, Homo sapiens
tgtctggttttaacaatttcct

SEQ ID NO: 731393 - DNA, 23 bp, Homo sapiens
tgtctgtaaaaaatggagctcag

SEQ ID NO: 731394 - DNA, 18 bp, Homo sapiens
tgtctgtaaaagagccta

SEQ ID NO: 731395 - DNA, 13 bp, Homo sapiens
tgtctgtaatcat

SEQ ID NO: 731396 - DNA, 11 bp, Homo sapiens
tgtctgtacat

SEQ ID NO: 731397 - DNA, 18 bp, Homo sapiens
tgtctgtaggtgtctctg

SEQ ID NO: 731398 - DNA, 21 bp, Homo sapiens
tgtctgtaggtgtctctgggc

SEQ ID NO: 731399 - DNA, 22 bp, Homo sapiens
tgtctgtatttcatgtggctgt

SEQ ID NO: 731400 - DNA, 21 bp, Homo sapiens
tgtctgtcaaatgtttcctta

SEQ ID NO: 731401 - DNA, 15 bp, Homo sapiens
tgtctgtcaatcaca

SEQ ID NO: 731402 - DNA, 17 bp, Homo sapiens
tgtctgtcaatcacagt

SEQ ID NO: 731403 - DNA, 20 bp, Homo sapiens
tgtctgtcacaggctgggtc

SEQ ID NO: 731404 - DNA, 21 bp, Homo sapiens
tgtctgtcaccagctatctgt

SEQ ID NO: 731405 - DNA, 12 bp, Homo sapiens
tgtctgtccctt

SEQ ID NO: 731406 - DNA, 20 bp, Homo sapiens
tgtctgtcccttttctttga

SEQ ID NO: 731407 - DNA, 18 bp, Homo sapiens
tgtctgtcctacccgccc

SEQ ID NO: 731408 - DNA, 13 bp, Homo sapiens
tgtctgtcctcag

SEQ ID NO: 731409 - DNA, 17 bp, Homo sapiens
tgtctgtcctcagagca

SEQ ID NO: 731410 - DNA, 18 bp, Homo sapiens
tgtctgtcctcagagcag

SEQ ID NO: 731411 - DNA, 17 bp, Homo sapiens
tgtctgtcctgatttct

SEQ ID NO: 731412 - DNA, 15 bp, Homo sapiens
tgtctgtctccctcc

SEQ ID NO: 731413 - DNA, 14 bp, Homo sapiens
tgtctgtctgtggg

SEQ ID NO: 731414 - DNA, 15 bp, Homo sapiens
tgtctgtctgtgggc

SEQ ID NO: 731415 - DNA, 15 bp, Homo sapiens
tgtctgtcttctcct

SEQ ID NO: 731416 - DNA, 14 bp, Homo sapiens
tgtctgtgaacaga

SEQ ID NO: 731417 - DNA, 17 bp, Homo sapiens
tgtctgtgtgattttca

SEQ ID NO: 731418 - DNA, 19 bp, Homo sapiens
tgtctgtgtgattttcata

SEQ ID NO: 731419 - DNA, 14 bp, Homo sapiens
tgtctgtgttgctt

SEQ ID NO: 731420 - DNA, 19 bp, Homo sapiens
tgtctgttaccatgtcact

SEQ ID NO: 731421 - DNA, 23 bp, Homo sapiens
tgtctgttaccatgtcactgtgg

SEQ ID NO: 731422 - DNA, 21 bp, Homo sapiens
tgtctgttctacatagatgct

SEQ ID NO: 731423 - DNA, 14 bp, Homo sapiens
tgtctgttgaacag

SEQ ID NO: 731424 - DNA, 15 bp, Homo sapiens
tgtctgttgaacagc

SEQ ID NO: 731425 - DNA, 13 bp, Homo sapiens
tgtctgttgcttg

SEQ ID NO: 731426 - DNA, 22 bp, Homo sapiens
tgtctgtttcaatgacctgtat

SEQ ID NO: 731427 - DNA, 13 bp, Homo sapiens
tgtctgtttgttt

SEQ ID NO: 731428 - DNA, 16 bp, Homo sapiens
tgtctgtttgtttcaa

SEQ ID NO: 731429 - DNA, 19 bp, Homo sapiens
tgtctgtttgtttcaagaa

SEQ ID NO: 731430 - DNA, 20 bp, Homo sapiens
gtgttgcccaggctggtctc

SEQ ID NO: 731431 - DNA, 21 bp, Homo sapiens
gtgttgccttgaaccacttcc

SEQ ID NO: 731432 - DNA, 14 bp, Homo sapiens
gtgttggcattggt

SEQ ID NO: 731433 - DNA, 23 bp, Homo sapiens
gtgttggggaaaccttcatctga

SEQ ID NO: 731434 - DNA, 24 bp, Homo sapiens
gtgttggtctttctaatgtagcta

SEQ ID NO: 731435 - DNA, 18 bp, Homo sapiens
tgtgatgaatactgtatt

SEQ ID NO: 731436 - DNA, 13 bp, Homo sapiens
tgtgatgagctga

SEQ ID NO: 731437 - DNA, 19 bp, Homo sapiens
tgtgatgccatatcaagtc

SEQ ID NO: 731438 - DNA, 17 bp, Homo sapiens
tgtgatgcgccttgctg

SEQ ID NO: 731439 - DNA, 19 bp, Homo sapiens
tgtgatgctgtgtgcccaa

SEQ ID NO: 731440 - DNA, 15 bp, Homo sapiens
tgtgatggagtgctg

SEQ ID NO: 731441 - DNA, 17 bp, Homo sapiens
tgtgatggagtgctgtt

SEQ ID NO: 731442 - DNA, 19 bp, Homo sapiens
tgtgatggatggcacaatg

SEQ ID NO: 731443 - DNA, 20 bp, Homo sapiens
gttaatttttcctgcatgtt

SEQ ID NO: 731444 - DNA, 22 bp, Homo sapiens
gttaatttttcctgcatgttct

SEQ ID NO: 731445 - DNA, 14 bp, Homo sapiens
gttaatttttctta

SEQ ID NO: 731446 - DNA, 23 bp, Homo sapiens
gttacaaactgcaatagagactg

SEQ ID NO: 731447 - DNA, 20 bp, Homo sapiens
gttacaagattgtaagtaaa

SEQ ID NO: 731448 - DNA, 15 bp, Homo sapiens
gttacaagtttgcta

SEQ ID NO: 731449 - DNA, 17 bp, Homo sapiens
gttacaagtttgctaaa

SEQ ID NO: 731450 - DNA, 20 bp, Homo sapiens
gttacaagtttgctaaaaga

SEQ ID NO: 731451 - DNA, 18 bp, Homo sapiens
gttacaatcattgctgaa

SEQ ID NO: 731452 - DNA, 21 bp, Homo sapiens
gttacacactttttaagaaat

SEQ ID NO: 731453 - DNA, 23 bp, Homo sapiens
gttacactggaggagagaagaat

SEQ ID NO: 731454 - DNA, 22 bp, Homo sapiens
gttacactttttggaagtgaaa

SEQ ID NO: 731455 - DNA, 13 bp, Homo sapiens
gttacagagacct

SEQ ID NO: 731456 - DNA, 17 bp, Homo sapiens
gttacagagacctatgt

SEQ ID NO: 731457 - DNA, 22 bp, Homo sapiens
gttacagagacctatgtaagaa

SEQ ID NO: 731458 - DNA, 21 bp, Homo sapiens
gttacagcctgttagtaacat

SEQ ID NO: 731459 - DNA, 22 bp, Homo sapiens
gttacagtaatgtcataaagtg

SEQ ID NO: 731460 - DNA, 17 bp, Homo sapiens
gttacagtgcagacagg

SEQ ID NO: 731461 - DNA, 17 bp, Homo sapiens
gttacatcacagtgttt

SEQ ID NO: 731462 - DNA, 12 bp, Homo sapiens
gttacatcttgt

SEQ ID NO: 731463 - DNA, 14 bp, Homo sapiens
gttacatgtttgca

SEQ ID NO: 731464 - DNA, 19 bp, Homo sapiens
gttacattaatgcccagcc

SEQ ID NO: 731465 - DNA, 21 bp, Homo sapiens
gttacatttttaagtgctgca

SEQ ID NO: 731466 - DNA, 12 bp, Homo sapiens
gttaccacagca

SEQ ID NO: 731467 - DNA, 20 bp, Homo sapiens
gttaccatactgtctctgga

SEQ ID NO: 731468 - DNA, 15 bp, Homo sapiens
gttaccatgtcactg

SEQ ID NO: 731469 - DNA, 21 bp, Homo sapiens
gttaccattatttaatttgta

SEQ ID NO: 731470 - DNA, 23 bp, Homo sapiens
gttacccaaaatctgattagaag

SEQ ID NO: 731471 - DNA, 21 bp, Homo sapiens
gttaccgagacatgaatacta

SEQ ID NO: 731472 - DNA, 16 bp, Homo sapiens
gttaccgagtatctgt

SEQ ID NO: 731473 - DNA, 13 bp, Homo sapiens
gttacctactttg

SEQ ID NO: 731474 - DNA, 17 bp, Homo sapiens
gttacctctatatacca

SEQ ID NO: 731475 - DNA, 23 bp, Homo sapiens
gttacctctattttaattactgc

SEQ ID NO: 731476 - DNA, 13 bp, Homo sapiens
gttacctgtagat

SEQ ID NO: 731477 - DNA, 18 bp, Homo sapiens
gttaccttatagttactg

SEQ ID NO: 731478 - DNA, 20 bp, Homo sapiens
gttaccttatagttactgtg

SEQ ID NO: 731479 - DNA, 22 bp, Homo sapiens
gttacggagggaggacatcata

SEQ ID NO: 731480 - DNA, 17 bp, Homo sapiens
gttacgtataatgcttt

SEQ ID NO: 731481 - DNA, 16 bp, Homo sapiens
gttacgtgaagaaata

SEQ ID NO: 731482 - DNA, 16 bp, Homo sapiens
gttactaagatgaaat

SEQ ID NO: 731483 - DNA, 21 bp, Homo sapiens
gttactaagatgaaattgcca

SEQ ID NO: 731484 - DNA, 22 bp, Homo sapiens
gttactaagatgaaattgccaa

SEQ ID NO: 731485 - DNA, 22 bp, Homo sapiens
gttactaagtttttatggcttt

SEQ ID NO: 731486 - DNA, 14 bp, Homo sapiens
gttactagcctctc

SEQ ID NO: 731487 - DNA, 19 bp, Homo sapiens
gttactcacacctgtaatc

SEQ ID NO: 731488 - DNA, 13 bp, Homo sapiens
gttactcagccct

SEQ ID NO: 731489 - DNA, 18 bp, Homo sapiens
gttactcagccctgggcc

SEQ ID NO: 731490 - DNA, 14 bp, Homo sapiens
gttactcagggctc

SEQ ID NO: 731491 - DNA, 19 bp, Homo sapiens
gttactcagtgttagagaa

SEQ ID NO: 731492 - DNA, 19 bp, Homo sapiens
gttactcatcgggcccagg

SEQ ID NO: 731493 - DNA, 22 bp, Homo sapiens
gttactcatcgggcccagggac

SEQ ID NO: 731494 - DNA, 22 bp, Homo sapiens
gttactctaaatagaaatatag

SEQ ID NO: 731495 - DNA, 14 bp, Homo sapiens
gttactctccaacc

SEQ ID NO: 731496 - DNA, 22 bp, Homo sapiens
gttactctccaacctggacaac

SEQ ID NO: 731497 - DNA, 11 bp, Homo sapiens
gttactctgaa

SEQ ID NO: 731498 - DNA, 16 bp, Homo sapiens
gttactcttaatttta

SEQ ID NO: 731499 - DNA, 17 bp, Homo sapiens
gttactgatcatgcatt

SEQ ID NO: 731500 - DNA, 18 bp, Homo sapiens
gttactgatcatgcattg

SEQ ID NO: 731501 - DNA, 21 bp, Homo sapiens
gttactgccttaataaaaaat

SEQ ID NO: 731502 - DNA, 18 bp, Homo sapiens
gttactggataaattgtt

SEQ ID NO: 731503 - DNA, 18 bp, Homo sapiens
gttactggtgatgttgaa

SEQ ID NO: 731504 - DNA, 12 bp, Homo sapiens
gttactgtattt

SEQ ID NO: 731505 - DNA, 13 bp, Homo sapiens
gttactgtgtaat

SEQ ID NO: 731506 - DNA, 16 bp, Homo sapiens
gttacttagaatgcca

SEQ ID NO: 731507 - DNA, 17 bp, Homo sapiens
gttacttagaatgccat

SEQ ID NO: 731508 - DNA, 22 bp, Homo sapiens
gttacttagaatgccataaaat

SEQ ID NO: 731509 - DNA, 22 bp, Homo sapiens
gttacttagcaagacctgaaaa

SEQ ID NO: 731510 - DNA, 15 bp, Homo sapiens
gttacttgcttcagt

SEQ ID NO: 731511 - DNA, 17 bp, Homo sapiens
gttacttgcttcagtgg

SEQ ID NO: 731512 - DNA, 23 bp, Homo sapiens
gttacttgtctgaggcctcatcc

SEQ ID NO: 731513 - DNA, 15 bp, Homo sapiens
gttactttttgtaga

SEQ ID NO: 731514 - DNA, 16 bp, Homo sapiens
gttagaaaatgactta

SEQ ID NO: 731515 - DNA, 22 bp, Homo sapiens
gttagaaaatgacttatttctg

SEQ ID NO: 731516 - DNA, 13 bp, Homo sapiens
gttagaaagtgct

SEQ ID NO: 731517 - DNA, 11 bp, Homo sapiens
gttagaagaac

SEQ ID NO: 731518 - DNA, 18 bp, Homo sapiens
gttagaagaagaggaaga

SEQ ID NO: 731519 - DNA, 14 bp, Homo sapiens
gttagaaggcttaa

SEQ ID NO: 731520 - DNA, 19 bp, Homo sapiens
gttagaatcttgttttgtt

SEQ ID NO: 731521 - DNA, 14 bp, Homo sapiens
gttagaatgtctgc

SEQ ID NO: 731522 - DNA, 22 bp, Homo sapiens
gttagactgacttgtttgtctt

SEQ ID NO: 731523 - DNA, 18 bp, Homo sapiens
gttagagagattggccag

SEQ ID NO: 731524 - DNA, 19 bp, Homo sapiens
gttagagcagcctcgtgga

SEQ ID NO: 731525 - DNA, 18 bp, Homo sapiens
gttagagccaagctgcac

SEQ ID NO: 731526 - DNA, 22 bp, Homo sapiens
gttagaggttttaaagtgatta

SEQ ID NO: 731527 - DNA, 12 bp, Homo sapiens
gttagatgtttg

SEQ ID NO: 731528 - DNA, 11 bp, Homo sapiens
gttagcaaaga

SEQ ID NO: 731529 - DNA, 15 bp, Homo sapiens
gttagcactgatagt

SEQ ID NO: 731530 - DNA, 14 bp, Homo sapiens
gttagcactgttga

SEQ ID NO: 731531 - DNA, 19 bp, Homo sapiens
gttagcagggatgttcctt

SEQ ID NO: 731532 - DNA, 22 bp, Homo sapiens
gttagccccagggatcactggc

SEQ ID NO: 731533 - DNA, 15 bp, Homo sapiens
gttagccctcagtca

SEQ ID NO: 731534 - DNA, 18 bp, Homo sapiens
gttagctccctgtggggc

SEQ ID NO: 731535 - DNA, 20 bp, Homo sapiens
gttagctcctgtggccccac

SEQ ID NO: 731536 - DNA, 22 bp, Homo sapiens
gttagctgataaggaaacttta

SEQ ID NO: 731537 - DNA, 18 bp, Homo sapiens
gttaggaaaaaattgaaa

SEQ ID NO: 731538 - DNA, 16 bp, Homo sapiens
gttaggaaataaaacc

SEQ ID NO: 731539 - DNA, 17 bp, Homo sapiens
gttaggaaataaaacct

SEQ ID NO: 731540 - DNA, 18 bp, Homo sapiens
gttaggaaataaaacctt

SEQ ID NO: 731541 - DNA, 21 bp, Homo sapiens
gttaggaaataaaacctttca

SEQ ID NO: 731542 - DNA, 15 bp, Homo sapiens
gttaggaggctgcat

SEQ ID NO: 731543 - DNA, 18 bp, Homo sapiens
gttaggatgcggctttct

SEQ ID NO: 731544 - DNA, 14 bp, Homo sapiens
gttaggattcagat

SEQ ID NO: 731545 - DNA, 18 bp, Homo sapiens
gttaggcattaatgtttc

SEQ ID NO: 731546 - DNA, 11 bp, Homo sapiens
gttagggaggg

SEQ ID NO: 731547 - DNA, 23 bp, Homo sapiens
gttaggggcctggcccaaagcag

SEQ ID NO: 731548 - DNA, 22 bp, Homo sapiens
gttaggggccttagggcactgg

SEQ ID NO: 731549 - DNA, 21 bp, Homo sapiens
gttagggtgtgtgttcacctt

SEQ ID NO: 731550 - DNA, 22 bp, Homo sapiens
gttaggtggccgctcctccctg

SEQ ID NO: 731551 - DNA, 15 bp, Homo sapiens
gttagtaatctgtat

SEQ ID NO: 731552 - DNA, 13 bp, Homo sapiens
gttagtagaaatt

SEQ ID NO: 731553 - DNA, 21 bp, Homo sapiens
gttagtagcatgttgagccag

SEQ ID NO: 731554 - DNA, 17 bp, Homo sapiens
gttagtatcttttgata

SEQ ID NO: 731555 - DNA, 18 bp, Homo sapiens
gttagtatcttttgatat

SEQ ID NO: 731556 - DNA, 20 bp, Homo sapiens
gttcagagtggctcactggc

SEQ ID NO: 731557 - DNA, 23 bp, Homo sapiens
gttcagatcttaatataaattca

SEQ ID NO: 731558 - DNA, 18 bp, Homo sapiens
gttcagcactgtcccttg

SEQ ID NO: 731559 - DNA, 12 bp, Homo sapiens
gttcagccaagg

SEQ ID NO: 731560 - DNA, 17 bp, Homo sapiens
gttcagcccctcctctg

SEQ ID NO: 731561 - DNA, 13 bp, Homo sapiens
gttcagctactcc

SEQ ID NO: 731562 - DNA, 17 bp, Homo sapiens
gttcagctctttccaaa

SEQ ID NO: 731563 - DNA, 21 bp, Homo sapiens
gttcagctctttccaaattaa

SEQ ID NO: 731564 - DNA, 20 bp, Homo sapiens
gttcagcttcctgctgctgg

SEQ ID NO: 731565 - DNA, 21 bp, Homo sapiens
gttcaggagtcccaaggaaag

SEQ ID NO: 731566 - DNA, 19 bp, Homo sapiens
gttcaggcccggcagggcg

SEQ ID NO: 731567 - DNA, 13 bp, Homo sapiens
gttcagggagggg

SEQ ID NO: 731568 - DNA, 23 bp, Homo sapiens
gttcaggtcccacgtctggccag

SEQ ID NO: 731569 - DNA, 23 bp, Homo sapiens
gttcagtactctacaattcctct

SEQ ID NO: 731570 - DNA, 24 bp, Homo sapiens
gttcagtactctacaattcctctg

SEQ ID NO: 731571 - DNA, 18 bp, Homo sapiens
gttcagtgtcccaggcag

SEQ ID NO: 731572 - DNA, 16 bp, Homo sapiens
tgtgcctcaggccagg

SEQ ID NO: 731573 - DNA, 17 bp, Homo sapiens
tgtgcctccccccagac

SEQ ID NO: 731574 - DNA, 17 bp, Homo sapiens
tgtgcctcccttcccag

SEQ ID NO: 731575 - DNA, 18 bp, Homo sapiens
tgtgcctcccttcccagt

SEQ ID NO: 731576 - DNA, 21 bp, Homo sapiens
tgtgcctcccttttctcctct

SEQ ID NO: 731577 - DNA, 15 bp, Homo sapiens
tgtgcctcctcaccc

SEQ ID NO: 731578 - DNA, 14 bp, Homo sapiens
tgtgcctctgcctg

SEQ ID NO: 731579 - DNA, 13 bp, Homo sapiens
tgtgcctctggga

SEQ ID NO: 731580 - DNA, 17 bp, Homo sapiens
tgtgcctctgggactgg

SEQ ID NO: 731581 - DNA, 12 bp, Homo sapiens
tgtgcctgcagc

SEQ ID NO: 731582 - DNA, 15 bp, Homo sapiens
tgtgcctgccctgga

SEQ ID NO: 731583 - DNA, 19 bp, Homo sapiens
tgtgcctgctagagcaacc

SEQ ID NO: 731584 - DNA, 15 bp, Homo sapiens
tgtgcctgctcagca

SEQ ID NO: 731585 - DNA, 17 bp, Homo sapiens
tgtgcctggccccagcc

SEQ ID NO: 731586 - DNA, 21 bp, Homo sapiens
tgtgcctgggatcgtgcattt

SEQ ID NO: 731587 - DNA, 18 bp, Homo sapiens
tgtgcctgtaatcttttt

SEQ ID NO: 731588 - DNA, 14 bp, Homo sapiens
tgtgcctgtgggag

SEQ ID NO: 731589 - DNA, 18 bp, Homo sapiens
tgtgcctgtgggaggggg

SEQ ID NO: 731590 - DNA, 16 bp, Homo sapiens
tgtgccttcttttgat

SEQ ID NO: 731591 - DNA, 19 bp, Homo sapiens
tgtgccttgtccaggaact

SEQ ID NO: 731592 - DNA, 18 bp, Homo sapiens
tgtgccttttatagctat

SEQ ID NO: 731593 - DNA, 15 bp, Homo sapiens
tgtgccttttcccca

SEQ ID NO: 731594 - DNA, 17 bp, Homo sapiens
tgtgccttttgtaggct

SEQ ID NO: 731595 - DNA, 17 bp, Homo sapiens
tgtgcgcctgagtgagt

SEQ ID NO: 731596 - DNA, 15 bp, Homo sapiens
tgtgcggaggcagga

SEQ ID NO: 731597 - DNA, 13 bp, Homo sapiens
tgtgcgtgaaaca

SEQ ID NO: 731598 - DNA, 16 bp, Homo sapiens
tgtgcgtgaaacacac

SEQ ID NO: 731599 - DNA, 20 bp, Homo sapiens
tgtgcgtgtgtccatgtgtg

SEQ ID NO: 731600 - DNA, 16 bp, Homo sapiens
tgtgctaccagagtta

SEQ ID NO: 731601 - DNA, 20 bp, Homo sapiens
tgtgctagaaattttcaaga

SEQ ID NO: 731602 - DNA, 13 bp, Homo sapiens
tgtgctagaacaa

SEQ ID NO: 731603 - DNA, 13 bp, Homo sapiens
tgtgctatactgc

SEQ ID NO: 731604 - DNA, 20 bp, Homo sapiens
tgtgctatactgcatacttt

SEQ ID NO: 731605 - DNA, 18 bp, Homo sapiens
tgtgctattaatatttgt

SEQ ID NO: 731606 - DNA, 14 bp, Homo sapiens
tgtgctcagccaaa

SEQ ID NO: 731607 - DNA, 22 bp, Homo sapiens
tgtgctcatgcattgcttgtgt

SEQ ID NO: 731608 - DNA, 12 bp, Homo sapiens
tgtgctcatttt

SEQ ID NO: 731609 - DNA, 19 bp, Homo sapiens
tgtgctcattttgcaattt

SEQ ID NO: 731610 - DNA, 17 bp, Homo sapiens
tgtgctcccctgccaca

SEQ ID NO: 731611 - DNA, 23 bp, Homo sapiens
tgtgctcccctgccacactgatg

SEQ ID NO: 731612 - DNA, 14 bp, Homo sapiens
tgtgctccgtgcct

SEQ ID NO: 731613 - DNA, 20 bp, Homo sapiens
tgtgctccgtgcctccacca

SEQ ID NO: 731614 - DNA, 22 bp, Homo sapiens
tgtgctctgaatgggagccaga

SEQ ID NO: 731615 - DNA, 13 bp, Homo sapiens
tgtgctctggagg

SEQ ID NO: 731616 - DNA, 16 bp, Homo sapiens
tgtgctctggaggctg

SEQ ID NO: 731617 - DNA, 16 bp, Homo sapiens
tgtgctctttgaagag

SEQ ID NO: 731618 - DNA, 20 bp, Homo sapiens
tgtgctctttttttaaaagg

SEQ ID NO: 731619 - DNA, 15 bp, Homo sapiens
tgtgctgaagacatg

SEQ ID NO: 731620 - DNA, 13 bp, Homo sapiens
tgtgctgaatgtg

SEQ ID NO: 731621 - DNA, 19 bp, Homo sapiens
tgtgctgaattctgcaatg

SEQ ID NO: 731622 - DNA, 22 bp, Homo sapiens
tgtgctgacaacttagctcagg

SEQ ID NO: 731623 - DNA, 20 bp, Homo sapiens
tgtgctgcccgtcttcagcc

SEQ ID NO: 731624 - DNA, 12 bp, Homo sapiens
tgtgctgccctg

SEQ ID NO: 731625 - DNA, 16 bp, Homo sapiens
tgtgctgccctgaaga

SEQ ID NO: 731626 - DNA, 18 bp, Homo sapiens
tgtgctgccctgaagaat

SEQ ID NO: 731627 - DNA, 16 bp, Homo sapiens
tgtgctgctgctgcta

SEQ ID NO: 731628 - DNA, 17 bp, Homo sapiens
tgtgctgctgctgctat

SEQ ID NO: 731629 - DNA, 23 bp, Homo sapiens
tgtgctggactttaaaaaaacaa

SEQ ID NO: 731630 - DNA, 12 bp, Homo sapiens
tgtgctgggagc

SEQ ID NO: 731631 - DNA, 23 bp, Homo sapiens
tgtgctgggggaatgagcccaga

SEQ ID NO: 731632 - DNA, 24 bp, Homo sapiens
tgtgctgggggaatgagcccagag

SEQ ID NO: 731633 - DNA, 13 bp, Homo sapiens
tgtgctgggtccc

SEQ ID NO: 731634 - DNA, 16 bp, Homo sapiens
tgtgctggtgaacact

SEQ ID NO: 731635 - DNA, 20 bp, Homo sapiens
tgtgctggtgaacactgtga

SEQ ID NO: 731636 - DNA, 12 bp, Homo sapiens
tgtgctgtgact

SEQ ID NO: 731637 - DNA, 15 bp, Homo sapiens
tgtgctgtgcctgct

SEQ ID NO: 731638 - DNA, 15 bp, Homo sapiens
tgtgctgtggagaga

SEQ ID NO: 731639 - DNA, 12 bp, Homo sapiens
tgtgctgtgggc

SEQ ID NO: 731640 - DNA, 13 bp, Homo sapiens
tgtgctgtgggca

SEQ ID NO: 731641 - DNA, 16 bp, Homo sapiens
tgtgctgtgggcagca

SEQ ID NO: 731642 - DNA, 16 bp, Homo sapiens
tgtgctgtttgaaaat

SEQ ID NO: 731643 - DNA, 13 bp, Homo sapiens
tgtgcttacagta

SEQ ID NO: 731644 - DNA, 15 bp, Homo sapiens
tgtgcttcacagtag

SEQ ID NO: 731645 - DNA, 22 bp, Homo sapiens
tgtgcttcacagtagagccagc

SEQ ID NO: 731646 - DNA, 17 bp, Homo sapiens
tgtgcttcgactactgc

SEQ ID NO: 731647 - DNA, 18 bp, Homo sapiens
tgtgcttgtcattccaga

SEQ ID NO: 731648 - DNA, 19 bp, Homo sapiens
tgtgcttgttttataaaat

SEQ ID NO: 731649 - DNA, 19 bp, Homo sapiens
tgtgctttattgaattaga

SEQ ID NO: 731650 - DNA, 13 bp, Homo sapiens
tgtgctttcaaga

SEQ ID NO: 731651 - DNA, 12 bp, Homo sapiens
tgtgctttccca

SEQ ID NO: 731652 - DNA, 20 bp, Homo sapiens
tgtgctttgactcacctgtt

SEQ ID NO: 731653 - DNA, 22 bp, Homo sapiens
tgtgctttgctcttgtcccacg

SEQ ID NO: 731654 - DNA, 23 bp, Homo sapiens
tgtgctttgctcttgtcccacgt

SEQ ID NO: 731655 - DNA, 21 bp, Homo sapiens
tgtgcttttttaaccaaggag

SEQ ID NO: 731656 - DNA, 17 bp, Homo sapiens
tgtgctttttttgtgtg

SEQ ID NO: 731657 - DNA, 14 bp, Homo sapiens
tgtggaaaaccagg

SEQ ID NO: 731658 - DNA, 15 bp, Homo sapiens
tgtggaaagcctctg

SEQ ID NO: 731659 - DNA, 16 bp, Homo sapiens
tgtggaaagtgaattt

SEQ ID NO: 731660 - DNA, 22 bp, Homo sapiens
tgtggaaagtgaatttgaatga

SEQ ID NO: 731661 - DNA, 19 bp, Homo sapiens
tgtggaaattaagaagaaa

SEQ ID NO: 731662 - DNA, 22 bp, Homo sapiens
tgtggaactaataaatacatac

SEQ ID NO: 731663 - DNA, 16 bp, Homo sapiens
tgtggaaggcctccct

SEQ ID NO: 731664 - DNA, 14 bp, Homo sapiens
tgtggaagggacta

SEQ ID NO: 731665 - DNA, 18 bp, Homo sapiens
tgtggaagggactaggag

SEQ ID NO: 731666 - DNA, 20 bp, Homo sapiens
tgtggaagtcagtacgatca

SEQ ID NO: 731667 - DNA, 14 bp, Homo sapiens
tgtggaatataaat

SEQ ID NO: 731668 - DNA, 17 bp, Homo sapiens
tgtggaatataaatagc

SEQ ID NO: 731669 - DNA, 19 bp, Homo sapiens
tgtggaatataaatagctg

SEQ ID NO: 731670 - DNA, 16 bp, Homo sapiens
tgtggaatgagtgtgc

SEQ ID NO: 731671 - DNA, 18 bp, Homo sapiens
tgtggaatgagtgtgcat

SEQ ID NO: 731672 - DNA, 20 bp, Homo sapiens
tgtggaattttgagaaaaat

SEQ ID NO: 731673 - DNA, 21 bp, Homo sapiens
tgtggaccaatgcatctcttt

SEQ ID NO: 731674 - DNA, 18 bp, Homo sapiens
tgtggaccatattttgta

SEQ ID NO: 731675 - DNA, 22 bp, Homo sapiens
tgtggacggcgctgcctcaggc

SEQ ID NO: 731676 - DNA, 21 bp, Homo sapiens
tgtggacgtcacgctccctga

SEQ ID NO: 731677 - DNA, 18 bp, Homo sapiens
tgtggacgtgcactgaca

SEQ ID NO: 731678 - DNA, 17 bp, Homo sapiens
tgtggggggacagacag

SEQ ID NO: 731679 - DNA, 14 bp, Homo sapiens
tgtggggggtcctt

SEQ ID NO: 731680 - DNA, 16 bp, Homo sapiens
tgtgggggtggccatc

SEQ ID NO: 731681 - DNA, 17 bp, Homo sapiens
tgtgggggtggccatcc

SEQ ID NO: 731682 - DNA, 14 bp, Homo sapiens
tgtggggtctggct

SEQ ID NO: 731683 - DNA, 15 bp, Homo sapiens
tgtggggtgaaaagt

SEQ ID NO: 731684 - DNA, 14 bp, Homo sapiens
tgtggggtgggctg

SEQ ID NO: 731685 - DNA, 12 bp, Homo sapiens
tgtggggtgggg

SEQ ID NO: 731686 - DNA, 12 bp, Homo sapiens
tgtgggtcccgc

SEQ ID NO: 731687 - DNA, 13 bp, Homo sapiens
tgtgggtctctga

SEQ ID NO: 731688 - DNA, 14 bp, Homo sapiens
tgtgggtctttttc

SEQ ID NO: 731689 - DNA, 19 bp, Homo sapiens
tgtgggtgggagtgtgtct

SEQ ID NO: 731690 - DNA, 12 bp, Homo sapiens
tgtgggtgtagc

SEQ ID NO: 731691 - DNA, 15 bp, Homo sapiens
tgtgggtgtagccag

SEQ ID NO: 731692 - DNA, 15 bp, Homo sapiens
tgtgggtgtcctgcc

SEQ ID NO: 731693 - DNA, 16 bp, Homo sapiens
tgtgggtgtctccctc

SEQ ID NO: 731694 - DNA, 14 bp, Homo sapiens
tgtgggtgtgtgcg

SEQ ID NO: 731695 - DNA, 22 bp, Homo sapiens
tgtgggtgttaatttttgatac

SEQ ID NO: 731696 - DNA, 15 bp, Homo sapiens
tgtgggttggccagg

SEQ ID NO: 731697 - DNA, 16 bp, Homo sapiens
tgtgggttggccagga

SEQ ID NO: 731698 - DNA, 22 bp, Homo sapiens
tgtggtacctagtcagatggta

SEQ ID NO: 731699 - DNA, 19 bp, Homo sapiens
tgtggtaccttcagccctg

SEQ ID NO: 731700 - DNA, 14 bp, Homo sapiens
tgtggtagaaacaa

SEQ ID NO: 731701 - DNA, 15 bp, Homo sapiens
tgtggtaggggcagg

SEQ ID NO: 731702 - DNA, 17 bp, Homo sapiens
tgtggtaggggcaggga

SEQ ID NO: 731703 - DNA, 19 bp, Homo sapiens
gttcctgaagctgctgtgt

SEQ ID NO: 731704 - DNA, 20 bp, Homo sapiens
gttcctgaagctgctgtgtc

SEQ ID NO: 731705 - DNA, 22 bp, Homo sapiens
gttcctgagacacccgattcct

SEQ ID NO: 731706 - DNA, 19 bp, Homo sapiens
gttcctgcggagtgaagag

SEQ ID NO: 731707 - DNA, 15 bp, Homo sapiens
gttcctgctctctgc

SEQ ID NO: 731708 - DNA, 16 bp, Homo sapiens
gttcctgctctctgct

SEQ ID NO: 731709 - DNA, 15 bp, Homo sapiens
gttcctgctgtgggg

SEQ ID NO: 731710 - DNA, 13 bp, Homo sapiens
gttcctggagttt

SEQ ID NO: 731711 - DNA, 12 bp, Homo sapiens
gttcctggcaat

SEQ ID NO: 731712 - DNA, 17 bp, Homo sapiens
gttcctggcatttgctg

SEQ ID NO: 731713 - DNA, 19 bp, Homo sapiens
gttcctggcccactctgta

SEQ ID NO: 731714 - DNA, 15 bp, Homo sapiens
gttcctggccccctc

SEQ ID NO: 731715 - DNA, 19 bp, Homo sapiens
gttcctggggccgcctgcc

SEQ ID NO: 731716 - DNA, 21 bp, Homo sapiens
gttcctggggccgcctgccct

SEQ ID NO: 731717 - DNA, 20 bp, Homo sapiens
gttcctgttcagtaataaaa

SEQ ID NO: 731718 - DNA, 13 bp, Homo sapiens
gttccttagacct

SEQ ID NO: 731719 - DNA, 19 bp, Homo sapiens
gttccttaggttttctttg

SEQ ID NO: 731720 - DNA, 18 bp, Homo sapiens
gttccttatttctctctc

SEQ ID NO: 731721 - DNA, 23 bp, Homo sapiens
gttccttcatttccaccaggccg

SEQ ID NO: 731722 - DNA, 17 bp, Homo sapiens
gttccttcctctgagcc

SEQ ID NO: 731723 - DNA, 18 bp, Homo sapiens
gttccttcctctgagcct

SEQ ID NO: 731724 - DNA, 22 bp, Homo sapiens
gttccttttctctcctgtgtgc

SEQ ID NO: 731725 - DNA, 23 bp, Homo sapiens
gttcctttttaaatgtgaatttt

SEQ ID NO: 731726 - DNA, 12 bp, Homo sapiens
gttcctttttca

SEQ ID NO: 731727 - DNA, 19 bp, Homo sapiens
gttcgagaccaacctgacc

SEQ ID NO: 731728 - DNA, 16 bp, Homo sapiens
gttcgagaccagtctg

SEQ ID NO: 731729 - DNA, 21 bp, Homo sapiens
gttcgggggagcagagagagc

SEQ ID NO: 731730 - DNA, 16 bp, Homo sapiens
gttcgggtgtgcaatg

SEQ ID NO: 731731 - DNA, 15 bp, Homo sapiens
gttcggttccagaca

SEQ ID NO: 731732 - DNA, 22 bp, Homo sapiens
gttcgtttccatcatgtctgta

SEQ ID NO: 731733 - DNA, 14 bp, Homo sapiens
gttctaaagatgga

SEQ ID NO: 731734 - DNA, 18 bp, Homo sapiens
gttctaaaggactaacat

SEQ ID NO: 731735 - DNA, 16 bp, Homo sapiens
gttctaacctttacat

SEQ ID NO: 731736 - DNA, 17 bp, Homo sapiens
gttctaagtctttccat

SEQ ID NO: 731737 - DNA, 14 bp, Homo sapiens
gttctacaagcata

SEQ ID NO: 731738 - DNA, 16 bp, Homo sapiens
gttctacaagcatatt

SEQ ID NO: 731739 - DNA, 19 bp, Homo sapiens
gttctacagtcgtaaaaga

SEQ ID NO: 731740 - DNA, 17 bp, Homo sapiens
gttctaccaggcaaatt

SEQ ID NO: 731741 - DNA, 21 bp, Homo sapiens
gttctacctcaggcagctcaa

SEQ ID NO: 731742 - DNA, 17 bp, Homo sapiens
gttctagaaaatatagt

SEQ ID NO: 731743 - DNA, 15 bp, Homo sapiens
gttctagacttcccc

SEQ ID NO: 731744 - DNA, 19 bp, Homo sapiens
gttctagacttccccatcc

SEQ ID NO: 731745 - DNA, 20 bp, Homo sapiens
gttctaggaaattcttgaaa

SEQ ID NO: 731746 - DNA, 14 bp, Homo sapiens
gttctagtactgta

SEQ ID NO: 731747 - DNA, 21 bp, Homo sapiens
gttctagtctcctttgcactg

SEQ ID NO: 731748 - DNA, 14 bp, Homo sapiens
gttctagtctctct

SEQ ID NO: 731749 - DNA, 14 bp, Homo sapiens
gttctagtttttta

SEQ ID NO: 731750 - DNA, 20 bp, Homo sapiens
gttctatcagttatcctttg

SEQ ID NO: 731751 - DNA, 21 bp, Homo sapiens
gttctatccccaagctggcca

SEQ ID NO: 731752 - DNA, 14 bp, Homo sapiens
gttctatgaacaac

SEQ ID NO: 731753 - DNA, 21 bp, Homo sapiens
gttctatggagactttgctgt

SEQ ID NO: 731754 - DNA, 23 bp, Homo sapiens
gttctatttaacaactgggtcat

SEQ ID NO: 731755 - DNA, 15 bp, Homo sapiens
gttctattttacttt

SEQ ID NO: 731756 - DNA, 16 bp, Homo sapiens
gttctcacacccaccg

SEQ ID NO: 731757 - DNA, 12 bp, Homo sapiens
gttctcactgtt

SEQ ID NO: 731758 - DNA, 16 bp, Homo sapiens
gttctcactgttccct

SEQ ID NO: 731759 - DNA, 19 bp, Homo sapiens
gttctcactgttccctctg

SEQ ID NO: 731760 - DNA, 11 bp, Homo sapiens
gttctcagagc

SEQ ID NO: 731761 - DNA, 12 bp, Homo sapiens
gttctcagagcc

SEQ ID NO: 731762 - DNA, 17 bp, Homo sapiens
gttctcaggttcactca

SEQ ID NO: 731763 - DNA, 19 bp, Homo sapiens
gttctcaggttcactcatt

SEQ ID NO: 731764 - DNA, 14 bp, Homo sapiens
gttctcatgaagca

SEQ ID NO: 731765 - DNA, 22 bp, Homo sapiens
gttctcatgataccacctttac

SEQ ID NO: 731766 - DNA, 23 bp, Homo sapiens
gttctcatgataccacctttact

SEQ ID NO: 731767 - DNA, 19 bp, Homo sapiens
gttctcatgggtggcactc

SEQ ID NO: 731768 - DNA, 12 bp, Homo sapiens
gttctcatttct

SEQ ID NO: 731769 - DNA, 13 bp, Homo sapiens
gttctcatttctc

SEQ ID NO: 731770 - DNA, 21 bp, Homo sapiens
gttctccaacatcacagccca

SEQ ID NO: 731771 - DNA, 19 bp, Homo sapiens
gttctccaagaaactgaat

SEQ ID NO: 731772 - DNA, 19 bp, Homo sapiens
gttctccagaatgtaagaa

SEQ ID NO: 731773 - DNA, 20 bp, Homo sapiens
gttctccagcttcagctcaa

SEQ ID NO: 731774 - DNA, 15 bp, Homo sapiens
gttctcccaccagcc

SEQ ID NO: 731775 - DNA, 20 bp, Homo sapiens
gttctcccagcactgcctcc

SEQ ID NO: 731776 - DNA, 20 bp, Homo sapiens
gttctcccagggagtgagca

SEQ ID NO: 731777 - DNA, 21 bp, Homo sapiens
gttctcccagggagtgagcag

SEQ ID NO: 731778 - DNA, 16 bp, Homo sapiens
gttctccccctcctga

SEQ ID NO: 731779 - DNA, 15 bp, Homo sapiens
gttctccctttctct

SEQ ID NO: 731780 - DNA, 17 bp, Homo sapiens
gttctccctttctctct

SEQ ID NO: 731781 - DNA, 18 bp, Homo sapiens
gttctccctttctctctc

SEQ ID NO: 731782 - DNA, 20 bp, Homo sapiens
gttctccgggtgtggcctca

SEQ ID NO: 731783 - DNA, 22 bp, Homo sapiens
gttctccgggtgtggcctcagc

SEQ ID NO: 731784 - DNA, 23 bp, Homo sapiens
gttctccgggtgtggcctcagcc

SEQ ID NO: 731785 - DNA, 21 bp, Homo sapiens
gttctccgttagctcctgtgg

SEQ ID NO: 731786 - DNA, 18 bp, Homo sapiens
gttctccttttcctctct

SEQ ID NO: 731787 - DNA, 21 bp, Homo sapiens
gttctccttttgaacttgtca

SEQ ID NO: 731788 - DNA, 19 bp, Homo sapiens
gttctcgttttgggccaga

SEQ ID NO: 731789 - DNA, 22 bp, Homo sapiens
gttctctaagttccactgagct

SEQ ID NO: 731790 - DNA, 12 bp, Homo sapiens
gttctctcccct

SEQ ID NO: 731791 - DNA, 19 bp, Homo sapiens
gttctctgatgcagaaatt

SEQ ID NO: 731792 - DNA, 14 bp, Homo sapiens
gttctctgctgagg

SEQ ID NO: 731793 - DNA, 12 bp, Homo sapiens
gttctctgcttg

SEQ ID NO: 731794 - DNA, 13 bp, Homo sapiens
gttctctgggaga

SEQ ID NO: 731795 - DNA, 16 bp, Homo sapiens
gttctctgggagaaaa

SEQ ID NO: 731796 - DNA, 13 bp, Homo sapiens
gttctctgtccta

SEQ ID NO: 731797 - DNA, 16 bp, Homo sapiens
gttctcttcccaggcc

SEQ ID NO: 731798 - DNA, 11 bp, Homo sapiens
gttctctttaa

SEQ ID NO: 731799 - DNA, 13 bp, Homo sapiens
gttctgaaatgtt

SEQ ID NO: 731800 - DNA, 23 bp, Homo sapiens
gttctgaatgctgcttccatttg

SEQ ID NO: 731801 - DNA, 18 bp, Homo sapiens
tgttgctagggagaggga

SEQ ID NO: 731802 - DNA, 20 bp, Homo sapiens
tgttgctagggagagggaag

SEQ ID NO: 731803 - DNA, 16 bp, Homo sapiens
tgttgctataataaag

SEQ ID NO: 731804 - DNA, 21 bp, Homo sapiens
tgttgctcaaatctattcaga

SEQ ID NO: 731805 - DNA, 23 bp, Homo sapiens
tgttgctcaaatctattcagaca

SEQ ID NO: 731806 - DNA, 14 bp, Homo sapiens
tgttgctcagtctc

SEQ ID NO: 731807 - DNA, 15 bp, Homo sapiens
tgttgctctaggaag

SEQ ID NO: 731808 - DNA, 17 bp, Homo sapiens
tgttgctctaggaagac

SEQ ID NO: 731809 - DNA, 20 bp, Homo sapiens
tgttgctctaggaagacatt

SEQ ID NO: 731810 - DNA, 13 bp, Homo sapiens
tgttgctcttgga

SEQ ID NO: 731811 - DNA, 14 bp, Homo sapiens
tgttgctcttggaa

SEQ ID NO: 731812 - DNA, 14 bp, Homo sapiens
tgttgctgccaacc

SEQ ID NO: 731813 - DNA, 19 bp, Homo sapiens
tgttgctgtacaaaagcaa

SEQ ID NO: 731814 - DNA, 15 bp, Homo sapiens
tgttgcttagatgag

SEQ ID NO: 731815 - DNA, 23 bp, Homo sapiens
tgttgcttagatgagggtgactg

SEQ ID NO: 731816 - DNA, 20 bp, Homo sapiens
tgttgcttagtcacttattt

SEQ ID NO: 731817 - DNA, 17 bp, Homo sapiens
tgttgcttctgaatcac

SEQ ID NO: 731818 - DNA, 13 bp, Homo sapiens
tgttggaaaaaat

SEQ ID NO: 731819 - DNA, 15 bp, Homo sapiens
tgttggaaaaaattt

SEQ ID NO: 731820 - DNA, 19 bp, Homo sapiens
tgttggaaagagtctccag

SEQ ID NO: 731821 - DNA, 15 bp, Homo sapiens
tgttggaaatgtgtt

SEQ ID NO: 731822 - DNA, 21 bp, Homo sapiens
tgttggaagcttgttttccag

SEQ ID NO: 731823 - DNA, 14 bp, Homo sapiens
tgttggagcctgca

SEQ ID NO: 731824 - DNA, 22 bp, Homo sapiens
tgttggaggaccccgagggctg

SEQ ID NO: 731825 - DNA, 21 bp, Homo sapiens
tgttggataaggaattataga

SEQ ID NO: 731826 - DNA, 11 bp, Homo sapiens
tgttggatctt

SEQ ID NO: 731827 - DNA, 21 bp, Homo sapiens
tgttggatcttcaatggcttt

SEQ ID NO: 731828 - DNA, 17 bp, Homo sapiens
tgttggatttataaatg

SEQ ID NO: 731829 - DNA, 19 bp, Homo sapiens
tgttggatttataaatgct

SEQ ID NO: 731830 - DNA, 15 bp, Homo sapiens
tgttggcaaatcact

SEQ ID NO: 731831 - DNA, 17 bp, Homo sapiens
tgttggcaagctgcagg

SEQ ID NO: 731832 - DNA, 13 bp, Homo sapiens
tgttggcagagct

SEQ ID NO: 731833 - DNA, 23 bp, Homo sapiens
tgttggcagagcttttgcatttc

SEQ ID NO: 731834 - DNA, 13 bp, Homo sapiens
tgttggcagctct

SEQ ID NO: 731835 - DNA, 17 bp, Homo sapiens
tgttggcatagctctgg

SEQ ID NO: 731836 - DNA, 14 bp, Homo sapiens
tgttggccaggctg

SEQ ID NO: 731837 - DNA, 14 bp, Homo sapiens
tgttggcccttcca

SEQ ID NO: 731838 - DNA, 17 bp, Homo sapiens
tgttggcccttccagtg

SEQ ID NO: 731839 - DNA, 17 bp, Homo sapiens
tgttggcctgtcaccag

SEQ ID NO: 731840 - DNA, 15 bp, Homo sapiens
tgttggcctgtgggc

SEQ ID NO: 731841 - DNA, 14 bp, Homo sapiens
tgttggctgtgtga

SEQ ID NO: 731842 - DNA, 16 bp, Homo sapiens
tgttggctgtgtgaca

SEQ ID NO: 731843 - DNA, 18 bp, Homo sapiens
tgttggggaaaccttcat

SEQ ID NO: 731844 - DNA, 14 bp, Homo sapiens
tgttggtacctttc

SEQ ID NO: 731845 - DNA, 13 bp, Homo sapiens
tgttggtcagagg

SEQ ID NO: 731846 - DNA, 17 bp, Homo sapiens
tgttggtcaggctggtc

SEQ ID NO: 731847 - DNA, 21 bp, Homo sapiens
tgttggtccactgtgtttagt

SEQ ID NO: 731848 - DNA, 18 bp, Homo sapiens
tgttggtgcacagcacaa

SEQ ID NO: 731849 - DNA, 21 bp, Homo sapiens
tgttggttagccgactgtctt

SEQ ID NO: 731850 - DNA, 14 bp, Homo sapiens
tgttggttcaaact

SEQ ID NO: 731851 - DNA, 20 bp, Homo sapiens
tgttggttgttttttccttt

SEQ ID NO: 731852 - DNA, 17 bp, Homo sapiens
tgttgtaaaacaaaatt

SEQ ID NO: 731853 - DNA, 22 bp, Homo sapiens
tgttgtaaaacaaaatttgact

SEQ ID NO: 731854 - DNA, 23 bp, Homo sapiens
tgttgtaaaacaaaatttgacta

SEQ ID NO: 731855 - DNA, 13 bp, Homo sapiens
tgttgtaaactgt

SEQ ID NO: 731856 - DNA, 14 bp, Homo sapiens
tgttgtaaatattt

SEQ ID NO: 731857 - DNA, 21 bp, Homo sapiens
tgttgtaaatatttatgtaaa

SEQ ID NO: 731858 - DNA, 18 bp, Homo sapiens
tgttgtaacctgctgtga

SEQ ID NO: 731859 - DNA, 22 bp, Homo sapiens
tgttgtacatttcaccatggcc

SEQ ID NO: 731860 - DNA, 15 bp, Homo sapiens
gtttgatttcattaa

SEQ ID NO: 731861 - DNA, 18 bp, Homo sapiens
gtttgatttttttaaagt

SEQ ID NO: 731862 - DNA, 15 bp, Homo sapiens
gtttgcacacttgtg

SEQ ID NO: 731863 - DNA, 20 bp, Homo sapiens
gtttgcactgtatgctggac

SEQ ID NO: 731864 - DNA, 15 bp, Homo sapiens
gtttgcaggggtgac

SEQ ID NO: 731865 - DNA, 19 bp, Homo sapiens
gtttgcataaacattcttt

SEQ ID NO: 731866 - DNA, 17 bp, Homo sapiens
gtttgccagtgaagact

SEQ ID NO: 731867 - DNA, 22 bp, Homo sapiens
gtttgccatactttgtctgaaa

SEQ ID NO: 731868 - DNA, 17 bp, Homo sapiens
gtttgcccagtcctggg

SEQ ID NO: 731869 - DNA, 15 bp, Homo sapiens
gtttgccggatacaa

SEQ ID NO: 731870 - DNA, 22 bp, Homo sapiens
gtttgcctcagtagatactaaa

SEQ ID NO: 731871 - DNA, 12 bp, Homo sapiens
gtttgcctcctg

SEQ ID NO: 731872 - DNA, 14 bp, Homo sapiens
gtttgcctgagggc

SEQ ID NO: 731873 - DNA, 21 bp, Homo sapiens
gtttgcgggggtctgagtcta

SEQ ID NO: 731874 - DNA, 16 bp, Homo sapiens
gtttgctaaaagaaga

SEQ ID NO: 731875 - DNA, 17 bp, Homo sapiens
gtttgctcatgtaatgt

SEQ ID NO: 731876 - DNA, 15 bp, Homo sapiens
gtttgctgattattt

SEQ ID NO: 731877 - DNA, 12 bp, Homo sapiens
gtttgctgctat

SEQ ID NO: 731878 - DNA, 18 bp, Homo sapiens
gtttgctgttgatttctt

SEQ ID NO: 731879 - DNA, 21 bp, Homo sapiens
gtttgcttaaacaaagtgact

SEQ ID NO: 731880 - DNA, 16 bp, Homo sapiens
gtttgcttaatttcct

SEQ ID NO: 731881 - DNA, 17 bp, Homo sapiens
gtttgcttaatttcctt

SEQ ID NO: 731882 - DNA, 15 bp, Homo sapiens
gtttgcttattgttc

SEQ ID NO: 731883 - DNA, 17 bp, Homo sapiens
gtttgcttattgttcca

SEQ ID NO: 731884 - DNA, 13 bp, Homo sapiens
gtttgcttccatt

SEQ ID NO: 731885 - DNA, 19 bp, Homo sapiens
gtttggaaataaactgtgc

SEQ ID NO: 731886 - DNA, 23 bp, Homo sapiens
gtttggaacggcaaaaaaaaatt

SEQ ID NO: 731887 - DNA, 16 bp, Homo sapiens
gtttggactgttttca

SEQ ID NO: 731888 - DNA, 18 bp, Homo sapiens
gtttggactgttttcaat

SEQ ID NO: 731889 - DNA, 21 bp, Homo sapiens
gtttggagcactagtttgatt

SEQ ID NO: 731890 - DNA, 19 bp, Homo sapiens
gtttggatacatctgctgt

SEQ ID NO: 731891 - DNA, 21 bp, Homo sapiens
gtttggatatgtaaaacattt

SEQ ID NO: 731892 - DNA, 21 bp, Homo sapiens
gtttggatctccaattgcctc

SEQ ID NO: 731893 - DNA, 18 bp, Homo sapiens
gtttggattcttatgtag

SEQ ID NO: 731894 - DNA, 14 bp, Homo sapiens
gtttggcaaggaaa

SEQ ID NO: 731895 - DNA, 12 bp, Homo sapiens
gtttggccaggg

SEQ ID NO: 731896 - DNA, 13 bp, Homo sapiens
gtttggccaggga

SEQ ID NO: 731897 - DNA, 16 bp, Homo sapiens
gtttggccagggaggc

SEQ ID NO: 731898 - DNA, 20 bp, Homo sapiens
gtttggccagggaggcgcag

SEQ ID NO: 731899 - DNA, 18 bp, Homo sapiens
gtttggccctggagccag

SEQ ID NO: 731900 - DNA, 18 bp, Homo sapiens
gtttggcgggccaaggac

SEQ ID NO: 731901 - DNA, 21 bp, Homo sapiens
gtttggctggcttgtttgatt

SEQ ID NO: 731902 - DNA, 20 bp, Homo sapiens
gtttggctgtgtctaaactg

SEQ ID NO: 731903 - DNA, 15 bp, Homo sapiens
gtttgggaaagatgg

SEQ ID NO: 731904 - DNA, 14 bp, Homo sapiens
gtttgggctgtctt

SEQ ID NO: 731905 - DNA, 13 bp, Homo sapiens
gtttggggagaaa

SEQ ID NO: 731906 - DNA, 14 bp, Homo sapiens
gtttggggagaaat

SEQ ID NO: 731907 - DNA, 16 bp, Homo sapiens
gtttggggccctctat

SEQ ID NO: 731908 - DNA, 14 bp, Homo sapiens
gtttgggggaaaaa

SEQ ID NO: 731909 - DNA, 20 bp, Homo sapiens
gtttgggggacgtttctcat

SEQ ID NO: 731910 - DNA, 18 bp, Homo sapiens
gtttgggggcgccctctc

SEQ ID NO: 731911 - DNA, 21 bp, Homo sapiens
gtttgggggcgccctctctgc

SEQ ID NO: 731912 - DNA, 22 bp, Homo sapiens
gtttgggggcgccctctctgct

SEQ ID NO: 731913 - DNA, 19 bp, Homo sapiens
gtttgggtaaaatactttt

SEQ ID NO: 731914 - DNA, 22 bp, Homo sapiens
gtttgggtatcctgcccagtgt

SEQ ID NO: 731915 - DNA, 20 bp, Homo sapiens
gtttgggtgcctcctgcagt

SEQ ID NO: 731916 - DNA, 15 bp, Homo sapiens
gtttggtagtgcccc

SEQ ID NO: 731917 - DNA, 16 bp, Homo sapiens
gtttggtgcaaagtat

SEQ ID NO: 731918 - DNA, 15 bp, Homo sapiens
gtttggtgtgtccca

SEQ ID NO: 731919 - DNA, 17 bp, Homo sapiens
gtttggtgtttttacag

SEQ ID NO: 731920 - DNA, 14 bp, Homo sapiens
gtttggttgtaaat

SEQ ID NO: 731921 - DNA, 20 bp, Homo sapiens
gtttggtttttttgtacaat

SEQ ID NO: 731922 - DNA, 17 bp, Homo sapiens
gtttgtaaaatccacag

SEQ ID NO: 731923 - DNA, 17 bp, Homo sapiens
gttttccatgaaaacgt

SEQ ID NO: 731924 - DNA, 18 bp, Homo sapiens
gttttccatgaaaacgtt

SEQ ID NO: 731925 - DNA, 17 bp, Homo sapiens
gttttcccctccctggg

SEQ ID NO: 731926 - DNA, 21 bp, Homo sapiens
gttttccctgacctccctcta

SEQ ID NO: 731927 - DNA, 15 bp, Homo sapiens
gttttccctgcactg

SEQ ID NO: 731928 - DNA, 16 bp, Homo sapiens
gttttcctaaatgcag

SEQ ID NO: 731929 - DNA, 15 bp, Homo sapiens
gttttcctcatcctt

SEQ ID NO: 731930 - DNA, 14 bp, Homo sapiens
gttttcctcccttc

SEQ ID NO: 731931 - DNA, 24 bp, Homo sapiens
gttttcctctatacatctctcccc

SEQ ID NO: 731932 - DNA, 15 bp, Homo sapiens
gttttccttctgtta

SEQ ID NO: 731933 - DNA, 16 bp, Homo sapiens
gttttcgaaaatcaaa

SEQ ID NO: 731934 - DNA, 17 bp, Homo sapiens
gttttcgaagctcagcc

SEQ ID NO: 731935 - DNA, 15 bp, Homo sapiens
gttttctaaagccag

SEQ ID NO: 731936 - DNA, 21 bp, Homo sapiens
gttttctagcaattttctttg

SEQ ID NO: 731937 - DNA, 19 bp, Homo sapiens
gttttctcagaacagctga

SEQ ID NO: 731938 - DNA, 18 bp, Homo sapiens
gttttctccaagagctac

SEQ ID NO: 731939 - DNA, 23 bp, Homo sapiens
gttttctccctctcatgtccctc

SEQ ID NO: 731940 - DNA, 16 bp, Homo sapiens
gttttctccgggtcct

SEQ ID NO: 731941 - DNA, 19 bp, Homo sapiens
gttttctccgggtcctcct

SEQ ID NO: 731942 - DNA, 19 bp, Homo sapiens
gttttctcctgcctgtgct

SEQ ID NO: 731943 - DNA, 16 bp, Homo sapiens
gttttctctctggatg

SEQ ID NO: 731944 - DNA, 17 bp, Homo sapiens
gttttctctctggatgg

SEQ ID NO: 731945 - DNA, 17 bp, Homo sapiens
gttttctgaaaatataa

SEQ ID NO: 731946 - DNA, 17 bp, Homo sapiens
gttttctgagcccgggc

SEQ ID NO: 731947 - DNA, 11 bp, Homo sapiens
gttttctgttc

SEQ ID NO: 731948 - DNA, 12 bp, Homo sapiens
gttttctgttct

SEQ ID NO: 731949 - DNA, 14 bp, Homo sapiens
gttttctgttcttt

SEQ ID NO: 731950 - DNA, 22 bp, Homo sapiens
gttttctgtttgtaaattattt

SEQ ID NO: 731951 - DNA, 15 bp, Homo sapiens
gttttcttcccatca

SEQ ID NO: 731952 - DNA, 19 bp, Homo sapiens
gttttcttctttccctgga

SEQ ID NO: 731953 - DNA, 21 bp, Homo sapiens
gttttcttctttccctggaca

SEQ ID NO: 731954 - DNA, 20 bp, Homo sapiens
gttttcttgtaaatgtttct

SEQ ID NO: 731955 - DNA, 14 bp, Homo sapiens
gttttcttttaaga

SEQ ID NO: 731956 - DNA, 13 bp, Homo sapiens
gttttgaaatgct

SEQ ID NO: 731957 - DNA, 16 bp, Homo sapiens
gttttgaataaaaagt

SEQ ID NO: 731958 - DNA, 18 bp, Homo sapiens
gttttgaatggtgttgta

SEQ ID NO: 731959 - DNA, 21 bp, Homo sapiens
gttttgaattttgtttttatt

SEQ ID NO: 731960 - DNA, 16 bp, Homo sapiens
gttttgacacttccca

SEQ ID NO: 731961 - DNA, 23 bp, Homo sapiens
gttttgaggtttccttcagacag

SEQ ID NO: 731962 - DNA, 23 bp, Homo sapiens
gttttgagtgtactgtgcctggt

SEQ ID NO: 731963 - DNA, 16 bp, Homo sapiens
gttttgataaagtaat

SEQ ID NO: 731964 - DNA, 21 bp, Homo sapiens
gttttgatgaaattcttgaag

SEQ ID NO: 731965 - DNA, 17 bp, Homo sapiens
gttttgatgagaaaaaa

SEQ ID NO: 731966 - DNA, 21 bp, Homo sapiens
gttttgatgtttgtggcctca

SEQ ID NO: 731967 - DNA, 22 bp, Homo sapiens
gttttgatttgtagcactgagg

SEQ ID NO: 731968 - DNA, 13 bp, Homo sapiens
gttttgcaaaggg

SEQ ID NO: 731969 - DNA, 14 bp, Homo sapiens
gttttgcaataact

SEQ ID NO: 731970 - DNA, 22 bp, Homo sapiens
gttttgcacagccaaatttaaa

SEQ ID NO: 731971 - DNA, 22 bp, Homo sapiens
gttttgccccaagtcctcattt

SEQ ID NO: 731972 - DNA, 12 bp, Homo sapiens
gttttggaatct

SEQ ID NO: 731973 - DNA, 17 bp, Homo sapiens
gttttggacagtttacc

SEQ ID NO: 731974 - DNA, 15 bp, Homo sapiens
gttttggagagtttg

SEQ ID NO: 731975 - DNA, 18 bp, Homo sapiens
gttttggatcttgaatgt

SEQ ID NO: 731976 - DNA, 22 bp, Homo sapiens
gttttggctgaaattctcctgg

SEQ ID NO: 731977 - DNA, 15 bp, Homo sapiens
gttttgggtatgttt

SEQ ID NO: 731978 - DNA, 18 bp, Homo sapiens
gttttgggttttttctgt

SEQ ID NO: 731979 - DNA, 14 bp, Homo sapiens
gttttgtaaaagaa

SEQ ID NO: 731980 - DNA, 16 bp, Homo sapiens
gttttgtaaacattta

SEQ ID NO: 731981 - DNA, 19 bp, Homo sapiens
gttttgtacatgtaacatt

SEQ ID NO: 731982 - DNA, 15 bp, Homo sapiens
gttttgtattctctg

SEQ ID NO: 731983 - DNA, 15 bp, Homo sapiens
gttttgtcctgcctc

SEQ ID NO: 731984 - DNA, 19 bp, Homo sapiens
gttttgtcctgcctcttgt

SEQ ID NO: 731985 - DNA, 17 bp, Homo sapiens
gttttgtctgtctccct

SEQ ID NO: 731986 - DNA, 19 bp, Homo sapiens
gttttgtcttgaaagtggc

SEQ ID NO: 731987 - DNA, 20 bp, Homo sapiens
gttttgtgtatatttgcttc

SEQ ID NO: 731988 - DNA, 16 bp, Homo sapiens
gttttgtgttgtgtct

SEQ ID NO: 731989 - DNA, 18 bp, Homo sapiens
gttttgtgtttgttgtag

SEQ ID NO: 731990 - DNA, 19 bp, Homo sapiens
tgtttattacaagtggctc

SEQ ID NO: 731991 - DNA, 18 bp, Homo sapiens
tgtttattacaattttta

SEQ ID NO: 731992 - DNA, 21 bp, Homo sapiens
tgtttattacttccatgaatt

SEQ ID NO: 731993 - DNA, 16 bp, Homo sapiens
tgtttattatttacat

SEQ ID NO: 731994 - DNA, 14 bp, Homo sapiens
tgtttattgttttt

SEQ ID NO: 731995 - DNA, 20 bp, Homo sapiens
tgtttatttattcactgtaa

SEQ ID NO: 731996 - DNA, 19 bp, Homo sapiens
tgtttatttttcttgtctt

SEQ ID NO: 731997 - DNA, 23 bp, Homo sapiens
tgtttatttttcttgtctttatt

SEQ ID NO: 731998 - DNA, 15 bp, Homo sapiens
tgtttcaaactgagt

SEQ ID NO: 731999 - DNA, 15 bp, Homo sapiens
tgtttcaaactttac

SEQ ID NO: 732000 - DNA, 16 bp, Homo sapiens
tgtttcaaatgtgcat

SEQ ID NO: 732001 - DNA, 16 bp, Homo sapiens
tgtttcaagaacctgg

SEQ ID NO: 732002 - DNA, 14 bp, Homo sapiens
tgtttcaattctgt

SEQ ID NO: 732003 - DNA, 16 bp, Homo sapiens
tgtttcaattctgtaa

SEQ ID NO: 732004 - DNA, 18 bp, Homo sapiens
tgtttcacgaagtttgtt

SEQ ID NO: 732005 - DNA, 13 bp, Homo sapiens
tgtttcagaatct

SEQ ID NO: 732006 - DNA, 21 bp, Homo sapiens
tgtttcagagcataaaaccta

SEQ ID NO: 732007 - DNA, 21 bp, Homo sapiens
tgtttcagaggctcagattgt

SEQ ID NO: 732008 - DNA, 20 bp, Homo sapiens
tgtttcatattgatgtgtgt

SEQ ID NO: 732009 - DNA, 13 bp, Homo sapiens
tgtttcatgtttt

SEQ ID NO: 732010 - DNA, 18 bp, Homo sapiens
tgtttcattcactgtgca

SEQ ID NO: 732011 - DNA, 16 bp, Homo sapiens
tgtttccaacttgtct

SEQ ID NO: 732012 - DNA, 15 bp, Homo sapiens
tgtttccatttctca

SEQ ID NO: 732013 - DNA, 22 bp, Homo sapiens
tgtttcccaggcccactgtgcc

SEQ ID NO: 732014 - DNA, 22 bp, Homo sapiens
tgtttcccataattttcttcat

SEQ ID NO: 732015 - DNA, 19 bp, Homo sapiens
tgtttccccatctctgtct

SEQ ID NO: 732016 - DNA, 20 bp, Homo sapiens
tgtttccctacttgataata

SEQ ID NO: 732017 - DNA, 19 bp, Homo sapiens
tgtttccctcgtccgtctg

SEQ ID NO: 732018 - DNA, 12 bp, Homo sapiens
tgtttcccttcc

SEQ ID NO: 732019 - DNA, 23 bp, Homo sapiens
tgtttcccttgctttgttttaat

SEQ ID NO: 732020 - DNA, 20 bp, Homo sapiens
tgtttcctaactgtgatttg

SEQ ID NO: 732021 - DNA, 13 bp, Homo sapiens
tgtttcctccaaa

SEQ ID NO: 732022 - DNA, 19 bp, Homo sapiens
tgtttcctccaaatctgat

SEQ ID NO: 732023 - DNA, 14 bp, Homo sapiens
tgtttcctctagtt

SEQ ID NO: 732024 - DNA, 21 bp, Homo sapiens
tgtttcctgacattgtctcct

SEQ ID NO: 732025 - DNA, 18 bp, Homo sapiens
tgtttcctttttcagata

SEQ ID NO: 732026 - DNA, 13 bp, Homo sapiens
tgtttcctttttt

SEQ ID NO: 732027 - DNA, 18 bp, Homo sapiens
tgtttcgagtaaacttga

SEQ ID NO: 732028 - DNA, 22 bp, Homo sapiens
tgtttcgagtaaacttgaaaag

SEQ ID NO: 732029 - DNA, 15 bp, Homo sapiens
tgtttctaaaactat

SEQ ID NO: 732030 - DNA, 21 bp, Homo sapiens
tgtttctaacaattttcagac

SEQ ID NO: 732031 - DNA, 20 bp, Homo sapiens
tgtttctaccggagagagaa

SEQ ID NO: 732032 - DNA, 17 bp, Homo sapiens
tgtttctactttgatat

SEQ ID NO: 732033 - DNA, 17 bp, Homo sapiens
tgtttctagctaaataa

SEQ ID NO: 732034 - DNA, 21 bp, Homo sapiens
tgtttctagctaaataaatgg

SEQ ID NO: 732035 - DNA, 16 bp, Homo sapiens
tgtttctattttttga

SEQ ID NO: 732036 - DNA, 16 bp, Homo sapiens
tgtttctctgctgtca

SEQ ID NO: 732037 - DNA, 15 bp, Homo sapiens
tgtttctctgctgtt

SEQ ID NO: 732038 - DNA, 24 bp, Homo sapiens
tgtttctggaagactgctcccggc

SEQ ID NO: 732039 - DNA, 21 bp, Homo sapiens
tgtttctgggtccctgctccc

SEQ ID NO: 732040 - DNA, 14 bp, Homo sapiens
tgtttctgtaacaa

SEQ ID NO: 732041 - DNA, 15 bp, Homo sapiens
tgtttctgtaacaaa

SEQ ID NO: 732042 - DNA, 16 bp, Homo sapiens
tgtttctgtaacaaat

SEQ ID NO: 732043 - DNA, 13 bp, Homo sapiens
tgtttctgttatt

SEQ ID NO: 732044 - DNA, 14 bp, Homo sapiens
tgtttctgttatta

SEQ ID NO: 732045 - DNA, 21 bp, Homo sapiens
taaaaatctcaaatttctaaa

SEQ ID NO: 732046 - DNA, 22 bp, Homo sapiens
taaaaatgaaagtgactttaaa

SEQ ID NO: 732047 - DNA, 15 bp, Homo sapiens
taaaaatgatctaaa

SEQ ID NO: 732048 - DNA, 19 bp, Homo sapiens
taaaaatgatttcagtagc

SEQ ID NO: 732049 - DNA, 11 bp, Homo sapiens
taaaaatgcaa

SEQ ID NO: 732050 - DNA, 20 bp, Homo sapiens
taaaaatgcaaaaaaaatta

SEQ ID NO: 732051 - DNA, 15 bp, Homo sapiens
taaaaatggacaaaa

SEQ ID NO: 732052 - DNA, 23 bp, Homo sapiens
taaaaatggcagggggtggaatt

SEQ ID NO: 732053 - DNA, 20 bp, Homo sapiens
taaaaatggtatcaaaatta

SEQ ID NO: 732054 - DNA, 16 bp, Homo sapiens
taaaaatgtcagaaaa

SEQ ID NO: 732055 - DNA, 15 bp, Homo sapiens
taaaaatgttctcaa

SEQ ID NO: 732056 - DNA, 17 bp, Homo sapiens
taaaaatgttcttacac

SEQ ID NO: 732057 - DNA, 17 bp, Homo sapiens
taaaaattaaaaaatga

SEQ ID NO: 732058 - DNA, 17 bp, Homo sapiens
taaaaattacatatata

SEQ ID NO: 732059 - DNA, 19 bp, Homo sapiens
taaaaattatcaaaaagct

SEQ ID NO: 732060 - DNA, 21 bp, Homo sapiens
taaaaattctagattaccatg

SEQ ID NO: 732061 - DNA, 15 bp, Homo sapiens
taaaaattctgaatg

SEQ ID NO: 732062 - DNA, 16 bp, Homo sapiens
taaaaattgaaaaaag

SEQ ID NO: 732063 - DNA, 16 bp, Homo sapiens
taaaaattgtagcttt

SEQ ID NO: 732064 - DNA, 14 bp, Homo sapiens
taaaaattgtttct

SEQ ID NO: 732065 - DNA, 22 bp, Homo sapiens
taaaaattgtttcttgacaagc

SEQ ID NO: 732066 - DNA, 21 bp, Homo sapiens
taaaaatttttacaaaactgc

SEQ ID NO: 732067 - DNA, 10 bp, Homo sapiens
taaaacaaaa

SEQ ID NO: 732068 - DNA, 15 bp, Homo sapiens
taaaacaaaatctga

SEQ ID NO: 732069 - DNA, 23 bp, Homo sapiens
taaaacaaaatctgaactctcaa

SEQ ID NO: 732070 - DNA, 14 bp, Homo sapiens
taaaacaaaatttg

SEQ ID NO: 732071 - DNA, 15 bp, Homo sapiens
taaaacaaaatttga

SEQ ID NO: 732072 - DNA, 15 bp, Homo sapiens
taaaacaaatataca

SEQ ID NO: 732073 - DNA, 19 bp, Homo sapiens
taaaacaaatatacatttt

SEQ ID NO: 732074 - DNA, 21 bp, Homo sapiens
taaaacaaatatacattttct

SEQ ID NO: 732075 - DNA, 19 bp, Homo sapiens
taaaacaacagatgtacga

SEQ ID NO: 732076 - DNA, 20 bp, Homo sapiens
taaaacaactctgatgtgga

SEQ ID NO: 732077 - DNA, 22 bp, Homo sapiens
taaaacaactctgatgtggaat

SEQ ID NO: 732078 - DNA, 18 bp, Homo sapiens
taaaacacatatcaaatg

SEQ ID NO: 732079 - DNA, 19 bp, Homo sapiens
taaaacacttccataatct

SEQ ID NO: 732080 - DNA, 18 bp, Homo sapiens
taaaacagaatcttctgg

SEQ ID NO: 732081 - DNA, 19 bp, Homo sapiens
taaaacagacactggcatg

SEQ ID NO: 732082 - DNA, 23 bp, Homo sapiens
taaaacaggcaaagttttacaga

SEQ ID NO: 732083 - DNA, 21 bp, Homo sapiens
taaaacaggtagaattatcta

SEQ ID NO: 732084 - DNA, 15 bp, Homo sapiens
taaaacatatttcat

SEQ ID NO: 732085 - DNA, 12 bp, Homo sapiens
taaaacattaaa

SEQ ID NO: 732086 - DNA, 16 bp, Homo sapiens
taaaacattaagaaaa

SEQ ID NO: 732087 - DNA, 17 bp, Homo sapiens
taaaacattaagaaaat

SEQ ID NO: 732088 - DNA, 14 bp, Homo sapiens
taaaacatttattt

SEQ ID NO: 732089 - DNA, 15 bp, Homo sapiens
taaaacattttgact

SEQ ID NO: 732090 - DNA, 19 bp, Homo sapiens
taaaacccatttaaatttt

SEQ ID NO: 732091 - DNA, 15 bp, Homo sapiens
taaaaccctatacaa

SEQ ID NO: 732092 - DNA, 16 bp, Homo sapiens
taaaaccttgttctat

SEQ ID NO: 732093 - DNA, 11 bp, Homo sapiens
taaaacctttc

SEQ ID NO: 732094 - DNA, 13 bp, Homo sapiens
taaaacctttcaa

SEQ ID NO: 732095 - DNA, 23 bp, Homo sapiens
taaaacgttagttaatccctttg

SEQ ID NO: 732096 - DNA, 20 bp, Homo sapiens
taaaactaagctctttgaga

SEQ ID NO: 732097 - DNA, 22 bp, Homo sapiens
taaaactaaggcttttatttct

SEQ ID NO: 732098 - DNA, 17 bp, Homo sapiens
taaaactatttaaaatt

SEQ ID NO: 732099 - DNA, 21 bp, Homo sapiens
taaaactatttaaaattggca

SEQ ID NO: 732100 - DNA, 16 bp, Homo sapiens
taaaactcactgtgat

SEQ ID NO: 732101 - DNA, 18 bp, Homo sapiens
taaaactcagttaaaatg

SEQ ID NO: 732102 - DNA, 15 bp, Homo sapiens
taaaactctgggtct

SEQ ID NO: 732103 - DNA, 13 bp, Homo sapiens
taaaactgaaata

SEQ ID NO: 732104 - DNA, 14 bp, Homo sapiens
taaaactgaaataa

SEQ ID NO: 732105 - DNA, 15 bp, Homo sapiens
taaaactgaaataaa

SEQ ID NO: 732106 - DNA, 19 bp, Homo sapiens
taaaactgagtccatgaaa

SEQ ID NO: 732107 - DNA, 23 bp, Homo sapiens
taaaactgcgaggacatcaaagt

SEQ ID NO: 732108 - DNA, 13 bp, Homo sapiens
taaaactgctttt

SEQ ID NO: 732109 - DNA, 16 bp, Homo sapiens
taaaactggcatctga

SEQ ID NO: 732110 - DNA, 13 bp, Homo sapiens
taaaactgggttg

SEQ ID NO: 732111 - DNA, 13 bp, Homo sapiens
taaaactgtactt

SEQ ID NO: 732112 - DNA, 20 bp, Homo sapiens
taaaactgtgactaggcata

SEQ ID NO: 732113 - DNA, 14 bp, Homo sapiens
taaaactgtgtaaa

SEQ ID NO: 732114 - DNA, 14 bp, Homo sapiens
taaaacttggatgg

SEQ ID NO: 732115 - DNA, 18 bp, Homo sapiens
taaaacttggatggactt

SEQ ID NO: 732116 - DNA, 19 bp, Homo sapiens
taaaacttggatggacttg

SEQ ID NO: 732117 - DNA, 17 bp, Homo sapiens
taaaactttaaaaggca

SEQ ID NO: 732118 - DNA, 17 bp, Homo sapiens
taaaactttattttata

SEQ ID NO: 732119 - DNA, 14 bp, Homo sapiens
taaaactttccaaa

SEQ ID NO: 732120 - DNA, 14 bp, Homo sapiens
tgtttgtctgatgt

SEQ ID NO: 732121 - DNA, 15 bp, Homo sapiens
tgtttgtctggattg

SEQ ID NO: 732122 - DNA, 19 bp, Homo sapiens
tgtttgtctgtcttcatag

SEQ ID NO: 732123 - DNA, 19 bp, Homo sapiens
tgtttgtcttttaatgctt

SEQ ID NO: 732124 - DNA, 15 bp, Homo sapiens
tgtttgtgcaaacat

SEQ ID NO: 732125 - DNA, 17 bp, Homo sapiens
tgtttgtgcaaacataa

SEQ ID NO: 732126 - DNA, 21 bp, Homo sapiens
tgtttgtgcaaacataatacc

SEQ ID NO: 732127 - DNA, 13 bp, Homo sapiens
tgtttgtgctgtg

SEQ ID NO: 732128 - DNA, 12 bp, Homo sapiens
tgtttgtggcct

SEQ ID NO: 732129 - DNA, 21 bp, Homo sapiens
tgtttgttaaaactggcatct

SEQ ID NO: 732130 - DNA, 14 bp, Homo sapiens
tgtttgttctgttt

SEQ ID NO: 732131 - DNA, 23 bp, Homo sapiens
tgtttgttgccccattcctaaga

SEQ ID NO: 732132 - DNA, 15 bp, Homo sapiens
tgtttgttgtagatt

SEQ ID NO: 732133 - DNA, 16 bp, Homo sapiens
tgtttgttgtcagctg

SEQ ID NO: 732134 - DNA, 17 bp, Homo sapiens
tgtttgttgtcagctga

SEQ ID NO: 732135 - DNA, 12 bp, Homo sapiens
tgtttgtttaag

SEQ ID NO: 732136 - DNA, 15 bp, Homo sapiens
tgtttgtttctttgt

SEQ ID NO: 732137 - DNA, 13 bp, Homo sapiens
tgtttgtttgtct

SEQ ID NO: 732138 - DNA, 15 bp, Homo sapiens
tgttttaaaaaaact

SEQ ID NO: 732139 - DNA, 15 bp, Homo sapiens
tgttttaaaatgcag

SEQ ID NO: 732140 - DNA, 14 bp, Homo sapiens
tgttttaaatgtac

SEQ ID NO: 732141 - DNA, 23 bp, Homo sapiens
tgttttaaatgtacagacatatt

SEQ ID NO: 732142 - DNA, 16 bp, Homo sapiens
tgttttaataacttat

SEQ ID NO: 732143 - DNA, 13 bp, Homo sapiens
tgttttaattgta

SEQ ID NO: 732144 - DNA, 22 bp, Homo sapiens
tgttttaatttaaacacctcct

SEQ ID NO: 732145 - DNA, 23 bp, Homo sapiens
tgttttaatttaaacacctcctc

SEQ ID NO: 732146 - DNA, 21 bp, Homo sapiens
tgttttacaatagttctgtgg

SEQ ID NO: 732147 - DNA, 13 bp, Homo sapiens
tgttttacaatgt

SEQ ID NO: 732148 - DNA, 20 bp, Homo sapiens
tgttttacgcaaggaaggac

SEQ ID NO: 732149 - DNA, 14 bp, Homo sapiens
tgttttacgtgcaa

SEQ ID NO: 732150 - DNA, 16 bp, Homo sapiens
tgttttactaaagaaa

SEQ ID NO: 732151 - DNA, 13 bp, Homo sapiens
tgttttactcttt

SEQ ID NO: 732152 - DNA, 13 bp, Homo sapiens
tgttttagaaatt

SEQ ID NO: 732153 - DNA, 21 bp, Homo sapiens
tgttttagtgtttatgtttaa

SEQ ID NO: 732154 - DNA, 23 bp, Homo sapiens
tgttttatcatgacatgttatat

SEQ ID NO: 732155 - DNA, 17 bp, Homo sapiens
tgttttatcttttaagt

SEQ ID NO: 732156 - DNA, 14 bp, Homo sapiens
tgttttatgttgat

SEQ ID NO: 732157 - DNA, 22 bp, Homo sapiens
tgttttattggggaattaaata

SEQ ID NO: 732158 - DNA, 14 bp, Homo sapiens
tgttttatttccta

SEQ ID NO: 732159 - DNA, 23 bp, Homo sapiens
tgttttattttttattgttttca

SEQ ID NO: 732160 - DNA, 21 bp, Homo sapiens
tgttttcaataacaaagcaca

SEQ ID NO: 732161 - DNA, 18 bp, Homo sapiens
tgttttcaattttaaaca

SEQ ID NO: 732162 - DNA, 14 bp, Homo sapiens
tgttttcacttgta

SEQ ID NO: 732163 - DNA, 15 bp, Homo sapiens
tgttttcacttgtat

SEQ ID NO: 732164 - DNA, 15 bp, Homo sapiens
tgttttcagtgtaca

SEQ ID NO: 732165 - DNA, 17 bp, Homo sapiens
tgttttcagtgtacatg

SEQ ID NO: 732166 - DNA, 22 bp, Homo sapiens
tgttttcatcatttcagccaaa

SEQ ID NO: 732167 - DNA, 13 bp, Homo sapiens
ttaaaaatatttc

SEQ ID NO: 732168 - DNA, 14 bp, Homo sapiens
ttaaaaatctcaaa

SEQ ID NO: 732169 - DNA, 15 bp, Homo sapiens
ttaaaaatctcaaat

SEQ ID NO: 732170 - DNA, 20 bp, Homo sapiens
ttaaaaatctcaaatttcta

SEQ ID NO: 732171 - DNA, 16 bp, Homo sapiens
ttaaaaatgaaaatta

SEQ ID NO: 732172 - DNA, 20 bp, Homo sapiens
ttaaaaatggtatcaaaatt

SEQ ID NO: 732173 - DNA, 14 bp, Homo sapiens
ttaaaaatgtaaat

SEQ ID NO: 732174 - DNA, 16 bp, Homo sapiens
ttaaaaatgtaaatat

SEQ ID NO: 732175 - DNA, 17 bp, Homo sapiens
ttaaaaatgtaaatatt

SEQ ID NO: 732176 - DNA, 19 bp, Homo sapiens
ttaaaaatgtaaatattct

SEQ ID NO: 732177 - DNA, 17 bp, Homo sapiens
ttaaaaattacctttaa

SEQ ID NO: 732178 - DNA, 14 bp, Homo sapiens
ttaaaaattgttat

SEQ ID NO: 732179 - DNA, 13 bp, Homo sapiens
ttaaaacaaaaga

SEQ ID NO: 732180 - DNA, 20 bp, Homo sapiens
ttaaaacaaaagggtgtata

SEQ ID NO: 732181 - DNA, 19 bp, Homo sapiens
ttaaaacaaatatacattt

SEQ ID NO: 732182 - DNA, 14 bp, Homo sapiens
ttaaaacaaccagt

SEQ ID NO: 732183 - DNA, 10 bp, Homo sapiens
ttaaaacaag

SEQ ID NO: 732184 - DNA, 21 bp, Homo sapiens
ttaaaacaattttttttttcc

SEQ ID NO: 732185 - DNA, 21 bp, Homo sapiens
ttaaaacagacactggcatgg

SEQ ID NO: 732186 - DNA, 13 bp, Homo sapiens
ttaaaacatattt

SEQ ID NO: 732187 - DNA, 19 bp, Homo sapiens
ttaaaacatatttcatttt

SEQ ID NO: 732188 - DNA, 15 bp, Homo sapiens
ttaaaacattaaaat

SEQ ID NO: 732189 - DNA, 12 bp, Homo sapiens
ttaaaacatttt

SEQ ID NO: 732190 - DNA, 13 bp, Homo sapiens
ttaaaacattttt

SEQ ID NO: 732191 - DNA, 15 bp, Homo sapiens
ttaaaaccacagctg

SEQ ID NO: 732192 - DNA, 23 bp, Homo sapiens
ttaaaacctgggtatgttcctaa

SEQ ID NO: 732193 - DNA, 21 bp, Homo sapiens
ttaaaactcagaatataacat

SEQ ID NO: 732194 - DNA, 11 bp, Homo sapiens
ttaaaactgag

SEQ ID NO: 732195 - DNA, 12 bp, Homo sapiens
ttaaaactgagt

SEQ ID NO: 732196 - DNA, 12 bp, Homo sapiens
ttaaaactgctt

SEQ ID NO: 732197 - DNA, 15 bp, Homo sapiens
ttaaaactgtattta

SEQ ID NO: 732198 - DNA, 12 bp, Homo sapiens
ttaaaagaaata

SEQ ID NO: 732199 - DNA, 20 bp, Homo sapiens
ttaaaagaaatatacagttt

SEQ ID NO: 732200 - DNA, 12 bp, Homo sapiens
ttaaaagacaag

SEQ ID NO: 732201 - DNA, 23 bp, Homo sapiens
ttaaaagacatttttatttagtt

SEQ ID NO: 732202 - DNA, 12 bp, Homo sapiens
ttaaaagactcc

SEQ ID NO: 732203 - DNA, 11 bp, Homo sapiens
ttaaaagagag

SEQ ID NO: 732204 - DNA, 21 bp, Homo sapiens
ttaaaagaggagaaaatttat

SEQ ID NO: 732205 - DNA, 17 bp, Homo sapiens
ttaaaagatacagttac

SEQ ID NO: 732206 - DNA, 19 bp, Homo sapiens
ttaaaagcaaaaagatgta

SEQ ID NO: 732207 - DNA, 15 bp, Homo sapiens
ttaaaagcacaatca

SEQ ID NO: 732208 - DNA, 14 bp, Homo sapiens
ttaaaagcatgaaa

SEQ ID NO: 732209 - DNA, 11 bp, Homo sapiens
ttaaaagccac

SEQ ID NO: 732210 - DNA, 13 bp, Homo sapiens
ttaaaagcctgct

SEQ ID NO: 732211 - DNA, 16 bp, Homo sapiens
ttaaaagctatcttca

SEQ ID NO: 732212 - DNA, 19 bp, Homo sapiens
ttaaaagctatcttcatgt

SEQ ID NO: 732213 - DNA, 21 bp, Homo sapiens
ttaaaagctatcttcatgtaa

SEQ ID NO: 732214 - DNA, 23 bp, Homo sapiens
ttaaaagctatcttcatgtaaat

SEQ ID NO: 732215 - DNA, 14 bp, Homo sapiens
ttaaaagtgtattt

SEQ ID NO: 732216 - DNA, 18 bp, Homo sapiens
ttaaaagtgtattttatt

SEQ ID NO: 732217 - DNA, 20 bp, Homo sapiens
ttaaaataaaacaagcctta

SEQ ID NO: 732218 - DNA, 15 bp, Homo sapiens
ttaaaataaaatgaa

SEQ ID NO: 732219 - DNA, 20 bp, Homo sapiens
ttaaaataaaatgaaaattg

SEQ ID NO: 732220 - DNA, 15 bp, Homo sapiens
ttaaaataagtctga

SEQ ID NO: 732221 - DNA, 15 bp, Homo sapiens
ttaaaataattatat

SEQ ID NO: 732222 - DNA, 15 bp, Homo sapiens
ttaaaatacaagact

SEQ ID NO: 732223 - DNA, 12 bp, Homo sapiens
ttaaaatagaaa

SEQ ID NO: 732224 - DNA, 15 bp, Homo sapiens
ttaaaatagaaataa

SEQ ID NO: 732225 - DNA, 22 bp, Homo sapiens
ttaaaatagcaaaagaagaagt

SEQ ID NO: 732226 - DNA, 14 bp, Homo sapiens
ttaaaatagcatac

SEQ ID NO: 732227 - DNA, 18 bp, Homo sapiens
ttaaaatagcatactgtg

SEQ ID NO: 732228 - DNA, 20 bp, Homo sapiens
ttaaaatagcgttcttgtaa

SEQ ID NO: 732229 - DNA, 22 bp, Homo sapiens
ttaaaatagcgttcttgtaatt

SEQ ID NO: 732230 - DNA, 12 bp, Homo sapiens
ttaaaatataat

SEQ ID NO: 732231 - DNA, 17 bp, Homo sapiens
ttaaaatatagagacag

SEQ ID NO: 732232 - DNA, 20 bp, Homo sapiens
ttaaaatatatgtatttaaa

SEQ ID NO: 732233 - DNA, 22 bp, Homo sapiens
ttaaaatatatgttctgcaaga

SEQ ID NO: 732234 - DNA, 23 bp, Homo sapiens
ttaaaatatatgttctgcaagaa

SEQ ID NO: 732235 - DNA, 12 bp, Homo sapiens
ttaaaatatatt

SEQ ID NO: 732236 - DNA, 16 bp, Homo sapiens
ttaaaatatcctgtaa

SEQ ID NO: 732237 - DNA, 18 bp, Homo sapiens
ttaaaatatcctgtaact

SEQ ID NO: 732238 - DNA, 19 bp, Homo sapiens
ttaaaatatctctaaaata

SEQ ID NO: 732239 - DNA, 14 bp, Homo sapiens
ttaaaatatgtgaa

SEQ ID NO: 732240 - DNA, 17 bp, Homo sapiens
ttaaaatatgtgaagtt

SEQ ID NO: 732241 - DNA, 16 bp, Homo sapiens
ttaaaatatttaactt

SEQ ID NO: 732242 - DNA, 18 bp, Homo sapiens
ttaaaatatttaactttt

SEQ ID NO: 732243 - DNA, 19 bp, Homo sapiens
ttaaaatatttaacttttt

SEQ ID NO: 732244 - DNA, 16 bp, Homo sapiens
ttaaaatccagtatta

SEQ ID NO: 732245 - DNA, 17 bp, Homo sapiens
ttaaaatctctaataga

SEQ ID NO: 732246 - DNA, 21 bp, Homo sapiens
ttaaaatctgagggaaatgtt

SEQ ID NO: 732247 - DNA, 11 bp, Homo sapiens
ttaaaatctta

SEQ ID NO: 732248 - DNA, 18 bp, Homo sapiens
ttaaaatgacaaagccat

SEQ ID NO: 732249 - DNA, 18 bp, Homo sapiens
ttaaaatgattgtaaaat

SEQ ID NO: 732250 - DNA, 19 bp, Homo sapiens
ttaaaatgcaggtgaactt

SEQ ID NO: 732251 - DNA, 22 bp, Homo sapiens
ttaaaatggaaaattttctcct

SEQ ID NO: 732252 - DNA, 18 bp, Homo sapiens
ttaaaatggttatgtgca

SEQ ID NO: 732253 - DNA, 13 bp, Homo sapiens
taaaatatttaac

SEQ ID NO: 732254 - DNA, 12 bp, Homo sapiens
taaaatatttat

SEQ ID NO: 732255 - DNA, 14 bp, Homo sapiens
taaaatattttgaa

SEQ ID NO: 732256 - DNA, 20 bp, Homo sapiens
taaaatattttgaatcaata

SEQ ID NO: 732257 - DNA, 16 bp, Homo sapiens
taaaatattttggatg

SEQ ID NO: 732258 - DNA, 17 bp, Homo sapiens
taaaatcaagttttaag

SEQ ID NO: 732259 - DNA, 14 bp, Homo sapiens
taaaatcacatttt

SEQ ID NO: 732260 - DNA, 18 bp, Homo sapiens
taaaatcacttcagatct

SEQ ID NO: 732261 - DNA, 20 bp, Homo sapiens
taaaatccaaaatgaatgca

SEQ ID NO: 732262 - DNA, 19 bp, Homo sapiens
taaaatccaatattgtaat

SEQ ID NO: 732263 - DNA, 19 bp, Homo sapiens
taaaatccacagctatatc

SEQ ID NO: 732264 - DNA, 18 bp, Homo sapiens
taaaatccatagatttat

SEQ ID NO: 732265 - DNA, 15 bp, Homo sapiens
taaaatccattttag

SEQ ID NO: 732266 - DNA, 16 bp, Homo sapiens
taaaatctaaaatttc

SEQ ID NO: 732267 - DNA, 21 bp, Homo sapiens
taaaatctaaaatttcataat

SEQ ID NO: 732268 - DNA, 17 bp, Homo sapiens
taaaatctgagggaaat

SEQ ID NO: 732269 - DNA, 22 bp, Homo sapiens
taaaatctgagggaaatgtttt

SEQ ID NO: 732270 - DNA, 15 bp, Homo sapiens
taaaatctgatttaa

SEQ ID NO: 732271 - DNA, 21 bp, Homo sapiens
taaaatctgatttaatgtttt

SEQ ID NO: 732272 - DNA, 23 bp, Homo sapiens
taaaatctggaaatctgttttgt

SEQ ID NO: 732273 - DNA, 13 bp, Homo sapiens
taaaatctgtcac

SEQ ID NO: 732274 - DNA, 14 bp, Homo sapiens
taaaatgaaattac

SEQ ID NO: 732275 - DNA, 12 bp, Homo sapiens
taaaatgaacat

SEQ ID NO: 732276 - DNA, 14 bp, Homo sapiens
taaaatgaataatt

SEQ ID NO: 732277 - DNA, 12 bp, Homo sapiens
taaaatgacaaa

SEQ ID NO: 732278 - DNA, 19 bp, Homo sapiens
taaaatgacaaagccattc

SEQ ID NO: 732279 - DNA, 23 bp, Homo sapiens
taaaatgacaataactaaagcta

SEQ ID NO: 732280 - DNA, 17 bp, Homo sapiens
taaaatgaggacatgtt

SEQ ID NO: 732281 - DNA, 23 bp, Homo sapiens
taaaatgagtttgtattattaca

SEQ ID NO: 732282 - DNA, 14 bp, Homo sapiens
taaaatgattgtaa

SEQ ID NO: 732283 - DNA, 20 bp, Homo sapiens
taaaatgattgtaaaatagc

SEQ ID NO: 732284 - DNA, 22 bp, Homo sapiens
taaaatgattgtaaaatagctt

SEQ ID NO: 732285 - DNA, 17 bp, Homo sapiens
taaaatgattttatctg

SEQ ID NO: 732286 - DNA, 18 bp, Homo sapiens
taaaatgattttatctgt

SEQ ID NO: 732287 - DNA, 14 bp, Homo sapiens
taaaatgcaaatga

SEQ ID NO: 732288 - DNA, 19 bp, Homo sapiens
taaaatgcaaatgaatcat

SEQ ID NO: 732289 - DNA, 20 bp, Homo sapiens
taaaatgcaaatgaatcatt

SEQ ID NO: 732290 - DNA, 22 bp, Homo sapiens
ttaaatactgtgcagaataatg

SEQ ID NO: 732291 - DNA, 14 bp, Homo sapiens
ttaaatagcctaaa

SEQ ID NO: 732292 - DNA, 17 bp, Homo sapiens
ttaaatagcctaaatga

SEQ ID NO: 732293 - DNA, 12 bp, Homo sapiens
ttaaatagtgtg

SEQ ID NO: 732294 - DNA, 16 bp, Homo sapiens
ttaaatataaatagct

SEQ ID NO: 732295 - DNA, 19 bp, Homo sapiens
ttaaatataattctgtaaa

SEQ ID NO: 732296 - DNA, 17 bp, Homo sapiens
ttaaatatatgtatgta

SEQ ID NO: 732297 - DNA, 18 bp, Homo sapiens
ttaaatatatgtatgtaa

SEQ ID NO: 732298 - DNA, 19 bp, Homo sapiens
ttaaatatatgtatgtaaa

SEQ ID NO: 732299 - DNA, 20 bp, Homo sapiens
ttaaatatgtatatgacatt

SEQ ID NO: 732300 - DNA, 21 bp, Homo sapiens
ttaaatatgttagcaaagagt

SEQ ID NO: 732301 - DNA, 12 bp, Homo sapiens
ttaaatatttgt

SEQ ID NO: 732302 - DNA, 14 bp, Homo sapiens
ttaaatatttgtga

SEQ ID NO: 732303 - DNA, 13 bp, Homo sapiens
ttaaatattttct

SEQ ID NO: 732304 - DNA, 13 bp, Homo sapiens
ttaaatcaaggaa

SEQ ID NO: 732305 - DNA, 16 bp, Homo sapiens
ttaaatcatgtatgtt

SEQ ID NO: 732306 - DNA, 12 bp, Homo sapiens
ttaaatcatttg

SEQ ID NO: 732307 - DNA, 22 bp, Homo sapiens
ttaaatcatttggttaaatcat

SEQ ID NO: 732308 - DNA, 15 bp, Homo sapiens
ttaaatcatttttat

SEQ ID NO: 732309 - DNA, 15 bp, Homo sapiens
ttaaatccaataaaa

SEQ ID NO: 732310 - DNA, 20 bp, Homo sapiens
ttaaatctaaacaaaaaata

SEQ ID NO: 732311 - DNA, 18 bp, Homo sapiens
ttaaatctgtttttctaa

SEQ ID NO: 732312 - DNA, 15 bp, Homo sapiens
ttaaatgaaagcatg

SEQ ID NO: 732313 - DNA, 12 bp, Homo sapiens
ttaaatgaaagg

SEQ ID NO: 732314 - DNA, 23 bp, Homo sapiens
ttaaatgaaaggagtttaaaaac

SEQ ID NO: 732315 - DNA, 12 bp, Homo sapiens
ttaaatgacttt

SEQ ID NO: 732316 - DNA, 15 bp, Homo sapiens
ttaaatgacttttct

SEQ ID NO: 732317 - DNA, 17 bp, Homo sapiens
ttaaatgacttttctta

SEQ ID NO: 732318 - DNA, 18 bp, Homo sapiens
ttaaatgacttttcttaa

SEQ ID NO: 732319 - DNA, 15 bp, Homo sapiens
ttaaatgagttactt

SEQ ID NO: 732320 - DNA, 13 bp, Homo sapiens
ttaaatgattcca

SEQ ID NO: 732321 - DNA, 14 bp, Homo sapiens
ttaaatgattccaa

SEQ ID NO: 732322 - DNA, 16 bp, Homo sapiens
ttaaatgatttaaatt

SEQ ID NO: 732323 - DNA, 17 bp, Homo sapiens
ttaaatgcaataatttt

SEQ ID NO: 732324 - DNA, 19 bp, Homo sapiens
ttaaatgcaataattttac

SEQ ID NO: 732325 - DNA, 16 bp, Homo sapiens
ttaaatgcacctggaa

SEQ ID NO: 732326 - DNA, 16 bp, Homo sapiens
ttaaatgcatgtctta

SEQ ID NO: 732327 - DNA, 21 bp, Homo sapiens
ttaaatgccaaaatgtactta

SEQ ID NO: 732328 - DNA, 22 bp, Homo sapiens
ttaaatgccaaaatgtacttaa

SEQ ID NO: 732329 - DNA, 14 bp, Homo sapiens
ttaaatgccttgta

SEQ ID NO: 732330 - DNA, 16 bp, Homo sapiens
ttaaatgccttgtata

SEQ ID NO: 732331 - DNA, 20 bp, Homo sapiens
ttaaatgccttgtataaaat

SEQ ID NO: 732332 - DNA, 20 bp, Homo sapiens
ttaaatgctcattttctggt

SEQ ID NO: 732333 - DNA, 15 bp, Homo sapiens
ttaaatgctctctca

SEQ ID NO: 732334 - DNA, 21 bp, Homo sapiens
ttaaatgggtagagaaacact

SEQ ID NO: 732335 - DNA, 14 bp, Homo sapiens
ttaaatgtaaaatt

SEQ ID NO: 732336 - DNA, 16 bp, Homo sapiens
ttaaatgtaaataatc

SEQ ID NO: 732337 - DNA, 16 bp, Homo sapiens
ttaaatgtgaattttt

SEQ ID NO: 732338 - DNA, 11 bp, Homo sapiens
ttaaatgtgtt

SEQ ID NO: 732339 - DNA, 20 bp, Homo sapiens
ttaaatgttatgactatgta

SEQ ID NO: 732340 - DNA, 17 bp, Homo sapiens
ttaaatgtttatactgt

SEQ ID NO: 732341 - DNA, 15 bp, Homo sapiens
ttaaattagaaaata

SEQ ID NO: 732342 - DNA, 14 bp, Homo sapiens
ttaaattagaatga

SEQ ID NO: 732343 - DNA, 21 bp, Homo sapiens
ttaaattataacttaaaatat

SEQ ID NO: 732344 - DNA, 18 bp, Homo sapiens
ttaaattatactgtagct

SEQ ID NO: 732345 - DNA, 16 bp, Homo sapiens
ttaaattattgcttaa

SEQ ID NO: 732346 - DNA, 19 bp, Homo sapiens
ttaaattcccgttttgtca

SEQ ID NO: 732347 - DNA, 23 bp, Homo sapiens
ttaaattctccagttttttgtta

SEQ ID NO: 732348 - DNA, 13 bp, Homo sapiens
ttaaattcttgca

SEQ ID NO: 732349 - DNA, 15 bp, Homo sapiens
ttaaattcttttgag

SEQ ID NO: 732350 - DNA, 21 bp, Homo sapiens
ttaaattgtgattgttttatt

SEQ ID NO: 732351 - DNA, 17 bp, Homo sapiens
ttaaattgtttcatatc

SEQ ID NO: 732352 - DNA, 18 bp, Homo sapiens
ttaaatttcttatgtgac

SEQ ID NO: 732353 - DNA, 16 bp, Homo sapiens
ttaaattttacccttt

SEQ ID NO: 732354 - DNA, 23 bp, Homo sapiens
ttaaattttaccctttagactgt

SEQ ID NO: 732355 - DNA, 12 bp, Homo sapiens
ttaaattttatt

SEQ ID NO: 732356 - DNA, 22 bp, Homo sapiens
ttaaattttatttttattactt

SEQ ID NO: 732357 - DNA, 16 bp, Homo sapiens
ttaaatttttgtcatt

SEQ ID NO: 732358 - DNA, 14 bp, Homo sapiens
ttaaattttttggc

SEQ ID NO: 732359 - DNA, 16 bp, Homo sapiens
ttaaattttttttaca

SEQ ID NO: 732360 - DNA, 17 bp, Homo sapiens
ttaaattttttttacat

SEQ ID NO: 732361 - DNA, 18 bp, Homo sapiens
ttaaattttttttacatt

SEQ ID NO: 732362 - DNA, 19 bp, Homo sapiens
ttaaattttttttacattt

SEQ ID NO: 732363 - DNA, 14 bp, Homo sapiens
ttaacaaaaaatgt

SEQ ID NO: 732364 - DNA, 19 bp, Homo sapiens
ttaacaaaaagtgcttcat

SEQ ID NO: 732365 - DNA, 16 bp, Homo sapiens
ttaacaaaagttccct

SEQ ID NO: 732366 - DNA, 22 bp, Homo sapiens
ttaacaaacatcactctgctgc

SEQ ID NO: 732367 - DNA, 14 bp, Homo sapiens
ttaacaaatctaat

SEQ ID NO: 732368 - DNA, 19 bp, Homo sapiens
ttaacaagaggggaaaaca

SEQ ID NO: 732369 - DNA, 20 bp, Homo sapiens
ttaacaaggaatgcctgtgc

SEQ ID NO: 732370 - DNA, 18 bp, Homo sapiens
ttaacaataactactgtg

SEQ ID NO: 732371 - DNA, 23 bp, Homo sapiens
ttaacaataactactgtgttcct

SEQ ID NO: 732372 - DNA, 15 bp, Homo sapiens
ttaacaatgcctatt

SEQ ID NO: 732373 - DNA, 18 bp, Homo sapiens
ttaacaatgtctgaaaag

SEQ ID NO: 732374 - DNA, 16 bp, Homo sapiens
ttaacaattccaaagg

SEQ ID NO: 732375 - DNA, 13 bp, Homo sapiens
ttaacaattgtct

SEQ ID NO: 732376 - DNA, 15 bp, Homo sapiens
ttaacaatttctgtc

SEQ ID NO: 732377 - DNA, 16 bp, Homo sapiens
ttaacacagccttcct

SEQ ID NO: 732378 - DNA, 17 bp, Homo sapiens
ttaacacagtgtttcaa

SEQ ID NO: 732379 - DNA, 19 bp, Homo sapiens
ttaacacagtgtttcaatt

SEQ ID NO: 732380 - DNA, 20 bp, Homo sapiens
ttaacacagtgtttcaattc

SEQ ID NO: 732381 - DNA, 15 bp, Homo sapiens
ttaacacttctgtat

SEQ ID NO: 732382 - DNA, 20 bp, Homo sapiens
ttaacacttctgtatgcatc

SEQ ID NO: 732383 - DNA, 14 bp, Homo sapiens
ttaacactttgtat

SEQ ID NO: 732384 - DNA, 21 bp, Homo sapiens
ttaacagaaactttcaaaagg

SEQ ID NO: 732385 - DNA, 16 bp, Homo sapiens
ttaacagaaatgtaca

SEQ ID NO: 732386 - DNA, 20 bp, Homo sapiens
ttaacagaaatgtacagcaa

SEQ ID NO: 732387 - DNA, 17 bp, Homo sapiens
taaactgtattaaatct

SEQ ID NO: 732388 - DNA, 17 bp, Homo sapiens
taaactgtgtattccaa

SEQ ID NO: 732389 - DNA, 22 bp, Homo sapiens
taaactgtgtggactgtgatgc

SEQ ID NO: 732390 - DNA, 13 bp, Homo sapiens
taaactgtgttta

SEQ ID NO: 732391 - DNA, 15 bp, Homo sapiens
taaactgttaaacaa

SEQ ID NO: 732392 - DNA, 14 bp, Homo sapiens
taaactgttaactt

SEQ ID NO: 732393 - DNA, 21 bp, Homo sapiens
taaactgttaacttattcaaa

SEQ ID NO: 732394 - DNA, 20 bp, Homo sapiens
taaactgttagcactgttga

SEQ ID NO: 732395 - DNA, 20 bp, Homo sapiens
taaactgttgttttgtatga

SEQ ID NO: 732396 - DNA, 16 bp, Homo sapiens
taaactgttttcaagt

SEQ ID NO: 732397 - DNA, 18 bp, Homo sapiens
taaacttaatctaaatgg

SEQ ID NO: 732398 - DNA, 14 bp, Homo sapiens
taaacttcacctac

SEQ ID NO: 732399 - DNA, 11 bp, Homo sapiens
taaacttccaa

SEQ ID NO: 732400 - DNA, 17 bp, Homo sapiens
taaacttccaaagaaag

SEQ ID NO: 732401 - DNA, 14 bp, Homo sapiens
taaacttccaaagc

SEQ ID NO: 732402 - DNA, 16 bp, Homo sapiens
taaacttcttaacatg

SEQ ID NO: 732403 - DNA, 13 bp, Homo sapiens
taaacttgaaata

SEQ ID NO: 732404 - DNA, 15 bp, Homo sapiens
taaacttgaaatata

SEQ ID NO: 732405 - DNA, 16 bp, Homo sapiens
taaacttgtaaagaca

SEQ ID NO: 732406 - DNA, 14 bp, Homo sapiens
taaacttgtgtatt

SEQ ID NO: 732407 - DNA, 22 bp, Homo sapiens
taaactttaccttttttataca

SEQ ID NO: 732408 - DNA, 15 bp, Homo sapiens
taaactttatcactt

SEQ ID NO: 732409 - DNA, 22 bp, Homo sapiens
taaactttatttgtaaaccatt

SEQ ID NO: 732410 - DNA, 18 bp, Homo sapiens
taaactttctccatttaa

SEQ ID NO: 732411 - DNA, 17 bp, Homo sapiens
taaacttttaattcatt

SEQ ID NO: 732412 - DNA, 15 bp, Homo sapiens
taaactttttaaaat

SEQ ID NO: 732413 - DNA, 15 bp, Homo sapiens
taaataactggaaaa

SEQ ID NO: 732414 - DNA, 16 bp, Homo sapiens
taaataagaaactttt

SEQ ID NO: 732415 - DNA, 11 bp, Homo sapiens
taaataagaga

SEQ ID NO: 732416 - DNA, 18 bp, Homo sapiens
taaataatgaataaactg

SEQ ID NO: 732417 - DNA, 19 bp, Homo sapiens
taaataatgaataaactga

SEQ ID NO: 732418 - DNA, 10 bp, Homo sapiens
taaataattt

SEQ ID NO: 732419 - DNA, 22 bp, Homo sapiens
taaataatttcctacacaaatg

SEQ ID NO: 732420 - DNA, 14 bp, Homo sapiens
taaataattttaat

SEQ ID NO: 732421 - DNA, 23 bp, Homo sapiens
taaataattttctaagacagttt

SEQ ID NO: 732422 - DNA, 19 bp, Homo sapiens
taaatacacatagcatgta

SEQ ID NO: 732423 - DNA, 16 bp, Homo sapiens
taaatacagacactaa

SEQ ID NO: 732424 - DNA, 22 bp, Homo sapiens
taaatacagacactaagttata

SEQ ID NO: 732425 - DNA, 22 bp, Homo sapiens
taaatacagataattcatttgt

SEQ ID NO: 732426 - DNA, 17 bp, Homo sapiens
taaatacagcatacttc

SEQ ID NO: 732427 - DNA, 13 bp, Homo sapiens
taaatacaggaaa

SEQ ID NO: 732428 - DNA, 15 bp, Homo sapiens
taaatacaggaaaca

SEQ ID NO: 732429 - DNA, 16 bp, Homo sapiens
taaatacaggaaacag

SEQ ID NO: 732430 - DNA, 17 bp, Homo sapiens
taaatacaggaaacagt

SEQ ID NO: 732431 - DNA, 16 bp, Homo sapiens
taaatacatgcatata

SEQ ID NO: 732432 - DNA, 15 bp, Homo sapiens
taaatactggactca

SEQ ID NO: 732433 - DNA, 18 bp, Homo sapiens
taaatactggactcagga

SEQ ID NO: 732434 - DNA, 20 bp, Homo sapiens
taaatactggtgcacttctt

SEQ ID NO: 732435 - DNA, 17 bp, Homo sapiens
taaatactgtgaaatac

SEQ ID NO: 732436 - DNA, 13 bp, Homo sapiens
taaatactgtgca

SEQ ID NO: 732437 - DNA, 15 bp, Homo sapiens
taaatactgtgcaga

SEQ ID NO: 732438 - DNA, 20 bp, Homo sapiens
taaatactgtgcagaataat

SEQ ID NO: 732439 - DNA, 22 bp, Homo sapiens
taaatactgtgcagaataatgg

SEQ ID NO: 732440 - DNA, 18 bp, Homo sapiens
taaatacttgcagttgtg

SEQ ID NO: 732441 - DNA, 13 bp, Homo sapiens
taaatactttttc

SEQ ID NO: 732442 - DNA, 21 bp, Homo sapiens
taaatagaaagagttctatgg

SEQ ID NO: 732443 - DNA, 15 bp, Homo sapiens
taaatagacacgcac

SEQ ID NO: 732444 - DNA, 18 bp, Homo sapiens
taaatagagtttgctatt

SEQ ID NO: 732445 - DNA, 14 bp, Homo sapiens
taaatagcataaaa

SEQ ID NO: 732446 - DNA, 14 bp, Homo sapiens
taaatagcctaaat

SEQ ID NO: 732447 - DNA, 15 bp, Homo sapiens
taaatagctatatcc

SEQ ID NO: 732448 - DNA, 17 bp, Homo sapiens
taaatagctatatccat

SEQ ID NO: 732449 - DNA, 15 bp, Homo sapiens
taaataggaaagttt

SEQ ID NO: 732450 - DNA, 17 bp, Homo sapiens
taaataggatcctggag

SEQ ID NO: 732451 - DNA, 22 bp, Homo sapiens
taaataggttcttcttgttctg

SEQ ID NO: 732452 - DNA, 12 bp, Homo sapiens
taaatagtattt

SEQ ID NO: 732453 - DNA, 13 bp, Homo sapiens
taaatagtatttc

SEQ ID NO: 732454 - DNA, 23 bp, Homo sapiens
taaatagtgtcatataaactcat

SEQ ID NO: 732455 - DNA, 13 bp, Homo sapiens
taaatataattct

SEQ ID NO: 732456 - DNA, 18 bp, Homo sapiens
taaatataattctgtaaa

SEQ ID NO: 732457 - DNA, 18 bp, Homo sapiens
taaatatatataaaccta

SEQ ID NO: 732458 - DNA, 14 bp, Homo sapiens
taaatatatctacc

SEQ ID NO: 732459 - DNA, 13 bp, Homo sapiens
taaatatatgtat

SEQ ID NO: 732460 - DNA, 19 bp, Homo sapiens
taaatatatgtatgtaaaa

SEQ ID NO: 732461 - DNA, 20 bp, Homo sapiens
taaatatatgtatgtaaaaa

SEQ ID NO: 732462 - DNA, 16 bp, Homo sapiens
taaatatatgtctgat

SEQ ID NO: 732463 - DNA, 20 bp, Homo sapiens
taaatatatgtctgataatg

SEQ ID NO: 732464 - DNA, 17 bp, Homo sapiens
taaatatatttaagata

SEQ ID NO: 732465 - DNA, 22 bp, Homo sapiens
taaatatatttaagataattat

SEQ ID NO: 732466 - DNA, 18 bp, Homo sapiens
taaatatcagtattctga

SEQ ID NO: 732467 - DNA, 18 bp, Homo sapiens
taaatatccaaagactgt

SEQ ID NO: 732468 - DNA, 22 bp, Homo sapiens
taaatatccaaagactgtactg

SEQ ID NO: 732469 - DNA, 18 bp, Homo sapiens
taaatatccacagtactc

SEQ ID NO: 732470 - DNA, 14 bp, Homo sapiens
taaatatcccagag

SEQ ID NO: 732471 - DNA, 21 bp, Homo sapiens
taaatatggactgctcaggaa

SEQ ID NO: 732472 - DNA, 23 bp, Homo sapiens
taaatatggactgctcaggaaac

SEQ ID NO: 732473 - DNA, 16 bp, Homo sapiens
taaatatgtgaagaaa

SEQ ID NO: 732474 - DNA, 21 bp, Homo sapiens
taaatatgttagcaaagagtt

SEQ ID NO: 732475 - DNA, 17 bp, Homo sapiens
taaatatgtttcacaca

SEQ ID NO: 732476 - DNA, 23 bp, Homo sapiens
taaatattctacacatgtaaaat

SEQ ID NO: 732477 - DNA, 13 bp, Homo sapiens
taaatattcttgt

SEQ ID NO: 732478 - DNA, 21 bp, Homo sapiens
taaatattgggattgggggga

SEQ ID NO: 732479 - DNA, 16 bp, Homo sapiens
taaatatttactcttt

SEQ ID NO: 732480 - DNA, 16 bp, Homo sapiens
taaatatttatgctta

SEQ ID NO: 732481 - DNA, 17 bp, Homo sapiens
taaatatttatttatgt

SEQ ID NO: 732482 - DNA, 20 bp, Homo sapiens
taaatatttgttacttttag

SEQ ID NO: 732483 - DNA, 18 bp, Homo sapiens
taaatattttcaaagaga

SEQ ID NO: 732484 - DNA, 15 bp, Homo sapiens
taaatattttcaaga

SEQ ID NO: 732485 - DNA, 13 bp, Homo sapiens
taaatattttcta

SEQ ID NO: 732486 - DNA, 22 bp, Homo sapiens
taaatcaaccacctatttttga

SEQ ID NO: 732487 - DNA, 22 bp, Homo sapiens
taaatcaagagtgaacatgtac

SEQ ID NO: 732488 - DNA, 12 bp, Homo sapiens
taaatcaaggaa

SEQ ID NO: 732489 - DNA, 14 bp, Homo sapiens
taaatcacagaaaa

SEQ ID NO: 732490 - DNA, 19 bp, Homo sapiens
taaatcacagaaaatttaa

SEQ ID NO: 732491 - DNA, 16 bp, Homo sapiens
taaatcacgctttttg

SEQ ID NO: 732492 - DNA, 21 bp, Homo sapiens
taaatcacgctttttgaaaaa

SEQ ID NO: 732493 - DNA, 17 bp, Homo sapiens
taaatcagaaagtaaca

SEQ ID NO: 732494 - DNA, 17 bp, Homo sapiens
taaatcagtaagaggtg

SEQ ID NO: 732495 - DNA, 22 bp, Homo sapiens
taaatcagtatgtttttacata

SEQ ID NO: 732496 - DNA, 14 bp, Homo sapiens
taaatcagtatttt

SEQ ID NO: 732497 - DNA, 17 bp, Homo sapiens
taaatcataaagtcagt

SEQ ID NO: 732498 - DNA, 14 bp, Homo sapiens
taaatcatcctcat

SEQ ID NO: 732499 - DNA, 15 bp, Homo sapiens
taaatcatgtatgtt

SEQ ID NO: 732500 - DNA, 19 bp, Homo sapiens
taaatcatgtatgttatga

SEQ ID NO: 732501 - DNA, 23 bp, Homo sapiens
taaatcatgtatgttatgatatt

SEQ ID NO: 732502 - DNA, 22 bp, Homo sapiens
taaatcatgttgttgtgtgtat

SEQ ID NO: 732503 - DNA, 21 bp, Homo sapiens
taaatcattagagcttaaatt

SEQ ID NO: 732504 - DNA, 14 bp, Homo sapiens
taaatccaataaaa

SEQ ID NO: 732505 - DNA, 13 bp, Homo sapiens
taaatccaatatc

SEQ ID NO: 732506 - DNA, 23 bp, Homo sapiens
taaatcccatttctaaaaaccac

SEQ ID NO: 732507 - DNA, 18 bp, Homo sapiens
taaatcctgccatttaaa

SEQ ID NO: 732508 - DNA, 14 bp, Homo sapiens
taaatccttcgtcc

SEQ ID NO: 732509 - DNA, 17 bp, Homo sapiens
taaatcctttttcttta

SEQ ID NO: 732510 - DNA, 19 bp, Homo sapiens
taaatcctttttctttata

SEQ ID NO: 732511 - DNA, 18 bp, Homo sapiens
taaatctaaacaaaaaat

SEQ ID NO: 732512 - DNA, 16 bp, Homo sapiens
taaatctagacattct

SEQ ID NO: 732513 - DNA, 17 bp, Homo sapiens
taaatctaggatgtgat

SEQ ID NO: 732514 - DNA, 15 bp, Homo sapiens
taaatctccaaaata

SEQ ID NO: 732515 - DNA, 20 bp, Homo sapiens
taaatctccaaaataaaact

SEQ ID NO: 732516 - DNA, 22 bp, Homo sapiens
taaatctccaaaataaaacttt

SEQ ID NO: 732517 - DNA, 16 bp, Homo sapiens
taaatctccaagacct

SEQ ID NO: 732518 - DNA, 15 bp, Homo sapiens
taaatctcttctttg

SEQ ID NO: 732519 - DNA, 13 bp, Homo sapiens
taaatctgaagaa

SEQ ID NO: 732520 - DNA, 15 bp, Homo sapiens
taaatctgtgatgat

SEQ ID NO: 732521 - DNA, 20 bp, Homo sapiens
taaatctgttgccaagctgg

SEQ ID NO: 732522 - DNA, 14 bp, Homo sapiens
ttaatattgagaat

SEQ ID NO: 732523 - DNA, 17 bp, Homo sapiens
ttaatattgagaatcag

SEQ ID NO: 732524 - DNA, 22 bp, Homo sapiens
ttaatattgatatgcttataca

SEQ ID NO: 732525 - DNA, 15 bp, Homo sapiens
ttaatatttaaacag

SEQ ID NO: 732526 - DNA, 12 bp, Homo sapiens
ttaatatttcct

SEQ ID NO: 732527 - DNA, 12 bp, Homo sapiens
ttaatatttctt

SEQ ID NO: 732528 - DNA, 14 bp, Homo sapiens
ttaatatttcttca

SEQ ID NO: 732529 - DNA, 16 bp, Homo sapiens
ttaatattttgtattt

SEQ ID NO: 732530 - DNA, 10 bp, Homo sapiens
ttaatcaaag

SEQ ID NO: 732531 - DNA, 14 bp, Homo sapiens
ttaatcaaaggcat

SEQ ID NO: 732532 - DNA, 18 bp, Homo sapiens
ttaatcaaaggcatatct

SEQ ID NO: 732533 - DNA, 16 bp, Homo sapiens
ttaatcaagagaaact

SEQ ID NO: 732534 - DNA, 17 bp, Homo sapiens
ttaatcaagagaaactt

SEQ ID NO: 732535 - DNA, 19 bp, Homo sapiens
taaattgcagaattcaaaa

SEQ ID NO: 732536 - DNA, 15 bp, Homo sapiens
taaattgcctgattt

SEQ ID NO: 732537 - DNA, 17 bp, Homo sapiens
taaattgctaatgttgc

SEQ ID NO: 732538 - DNA, 23 bp, Homo sapiens
taaattgcttttgttgtgacttt

SEQ ID NO: 732539 - DNA, 14 bp, Homo sapiens
taaattggaaacat

SEQ ID NO: 732540 - DNA, 17 bp, Homo sapiens
taaattggcatggaaat

SEQ ID NO: 732541 - DNA, 15 bp, Homo sapiens
taaattggtcatggt

SEQ ID NO: 732542 - DNA, 19 bp, Homo sapiens
taaattgtacattttgtaa

SEQ ID NO: 732543 - DNA, 22 bp, Homo sapiens
taaattgtagggctttagcttt

SEQ ID NO: 732544 - DNA, 23 bp, Homo sapiens
taaattgtagggctttagctttc

SEQ ID NO: 732545 - DNA, 17 bp, Homo sapiens
taaattgtgattgtttt

SEQ ID NO: 732546 - DNA, 17 bp, Homo sapiens
taaattgtttcatatct

SEQ ID NO: 732547 - DNA, 22 bp, Homo sapiens
taaatttaagcttaagccataa

SEQ ID NO: 732548 - DNA, 22 bp, Homo sapiens
taaatttaagtaagttttataa

SEQ ID NO: 732549 - DNA, 23 bp, Homo sapiens
taaatttaagtaagttttataag

SEQ ID NO: 732550 - DNA, 15 bp, Homo sapiens
taaatttaatgctgc

SEQ ID NO: 732551 - DNA, 16 bp, Homo sapiens
taaatttaatgctgcc

SEQ ID NO: 732552 - DNA, 10 bp, Homo sapiens
taaatttagc

SEQ ID NO: 732553 - DNA, 16 bp, Homo sapiens
taaatttatatacttt

SEQ ID NO: 732554 - DNA, 12 bp, Homo sapiens
taaatttattaa

SEQ ID NO: 732555 - DNA, 15 bp, Homo sapiens
taaatttatttactg

SEQ ID NO: 732556 - DNA, 15 bp, Homo sapiens
taaatttattttctt

SEQ ID NO: 732557 - DNA, 15 bp, Homo sapiens
taaatttcaaatgca

SEQ ID NO: 732558 - DNA, 20 bp, Homo sapiens
taaatttcccagttaaagat

SEQ ID NO: 732559 - DNA, 20 bp, Homo sapiens
taaatttcgcttcttagaac

SEQ ID NO: 732560 - DNA, 20 bp, Homo sapiens
taaatttctatttttatctg

SEQ ID NO: 732561 - DNA, 15 bp, Homo sapiens
taaatttcttatgtg

SEQ ID NO: 732562 - DNA, 18 bp, Homo sapiens
taaatttcttatgtgaca

SEQ ID NO: 732563 - DNA, 22 bp, Homo sapiens
taaatttcttatgtgacattaa

SEQ ID NO: 732564 - DNA, 18 bp, Homo sapiens
taaatttgacttttctgt

SEQ ID NO: 732565 - DNA, 22 bp, Homo sapiens
taaatttggtgccgatgttgaa

SEQ ID NO: 732566 - DNA, 17 bp, Homo sapiens
taaatttgtttaattaa

SEQ ID NO: 732567 - DNA, 19 bp, Homo sapiens
taaatttgtttaattaaat

SEQ ID NO: 732568 - DNA, 14 bp, Homo sapiens
taaattttaaaaag

SEQ ID NO: 732569 - DNA, 17 bp, Homo sapiens
taaattttaactaaatt

SEQ ID NO: 732570 - DNA, 18 bp, Homo sapiens
taaattttagagcatacc

SEQ ID NO: 732571 - DNA, 18 bp, Homo sapiens
taaattttcaaatcctta

SEQ ID NO: 732572 - DNA, 13 bp, Homo sapiens
taaattttgtaat

SEQ ID NO: 732573 - DNA, 17 bp, Homo sapiens
taaattttgtttcagaa

SEQ ID NO: 732574 - DNA, 13 bp, Homo sapiens
taaatttttcata

SEQ ID NO: 732575 - DNA, 18 bp, Homo sapiens
taaatttttgaaaaatat

SEQ ID NO: 732576 - DNA, 13 bp, Homo sapiens
taaatttttgtca

SEQ ID NO: 732577 - DNA, 15 bp, Homo sapiens
taaatttttgtcatt

SEQ ID NO: 732578 - DNA, 16 bp, Homo sapiens
taaatttttttcctta

SEQ ID NO: 732579 - DNA, 18 bp, Homo sapiens
taacaaaaactacacata

SEQ ID NO: 732580 - DNA, 22 bp, Homo sapiens
taacaaaacactcggcatttca

SEQ ID NO: 732581 - DNA, 19 bp, Homo sapiens
taacaaaatgtatgtctgg

SEQ ID NO: 732582 - DNA, 21 bp, Homo sapiens
taacaaacatcactctgctgc

SEQ ID NO: 732583 - DNA, 17 bp, Homo sapiens
taacaaaccaacatctt

SEQ ID NO: 732584 - DNA, 20 bp, Homo sapiens
taacaaactacatgtaatcc

SEQ ID NO: 732585 - DNA, 20 bp, Homo sapiens
taacaaagcacataactgga

SEQ ID NO: 732586 - DNA, 21 bp, Homo sapiens
taacaaataaaaaagctcttt

SEQ ID NO: 732587 - DNA, 18 bp, Homo sapiens
taacaaatctaatctctt

SEQ ID NO: 732588 - DNA, 17 bp, Homo sapiens
taacaaatttttcaaat

SEQ ID NO: 732589 - DNA, 23 bp, Homo sapiens
taacaacccacaccgtcttcctt

SEQ ID NO: 732590 - DNA, 15 bp, Homo sapiens
taacaagaggggaaa

SEQ ID NO: 732591 - DNA, 12 bp, Homo sapiens
taacaaggaatg

SEQ ID NO: 732592 - DNA, 22 bp, Homo sapiens
taacaaggaatgcctgtgccaa

SEQ ID NO: 732593 - DNA, 18 bp, Homo sapiens
taacaaggagatttctta

SEQ ID NO: 732594 - DNA, 23 bp, Homo sapiens
taacaaggagatttcttagttca

SEQ ID NO: 732595 - DNA, 23 bp, Homo sapiens
taacaaggagctcaccctgcccg

SEQ ID NO: 732596 - DNA, 12 bp, Homo sapiens
taacaaggtgtc

SEQ ID NO: 732597 - DNA, 19 bp, Homo sapiens
taacaaggtgtcttttcca

SEQ ID NO: 732598 - DNA, 17 bp, Homo sapiens
taacaataactactgtg

SEQ ID NO: 732599 - DNA, 18 bp, Homo sapiens
taacaataactactgtgt

SEQ ID NO: 732600 - DNA, 20 bp, Homo sapiens
taacaatacaaatggatttt

SEQ ID NO: 732601 - DNA, 21 bp, Homo sapiens
taacaatacatgagaaagatg

SEQ ID NO: 732602 - DNA, 14 bp, Homo sapiens
taacaatcagctcc

SEQ ID NO: 732603 - DNA, 21 bp, Homo sapiens
taacaatgcctattgtaatat

SEQ ID NO: 732604 - DNA, 14 bp, Homo sapiens
taacaattaattgt

SEQ ID NO: 732605 - DNA, 20 bp, Homo sapiens
taacaattcagtaacaaagg

SEQ ID NO: 732606 - DNA, 16 bp, Homo sapiens
taacaattgtcttaaa

SEQ ID NO: 732607 - DNA, 18 bp, Homo sapiens
taacaattgtgtagcctt

SEQ ID NO: 732608 - DNA, 19 bp, Homo sapiens
taacaattgtgtagccttt

SEQ ID NO: 732609 - DNA, 20 bp, Homo sapiens
taacaattgtgtagcctttt

SEQ ID NO: 732610 - DNA, 18 bp, Homo sapiens
taacacaagtcctgtgaa

SEQ ID NO: 732611 - DNA, 15 bp, Homo sapiens
taacacagccttcct

SEQ ID NO: 732612 - DNA, 17 bp, Homo sapiens
taacacagtgtttcaat

SEQ ID NO: 732613 - DNA, 22 bp, Homo sapiens
taacacatagcgccgtgctgta

SEQ ID NO: 732614 - DNA, 22 bp, Homo sapiens
taacacattctttataaaatgt

SEQ ID NO: 732615 - DNA, 17 bp, Homo sapiens
taacacatttttaaagt

SEQ ID NO: 732616 - DNA, 14 bp, Homo sapiens
taacactacagagt

SEQ ID NO: 732617 - DNA, 16 bp, Homo sapiens
taacactataaaggtt

SEQ ID NO: 732618 - DNA, 13 bp, Homo sapiens
taacactggcccc

SEQ ID NO: 732619 - DNA, 15 bp, Homo sapiens
taacactggccccta

SEQ ID NO: 732620 - DNA, 20 bp, Homo sapiens
taacactgtgatttatcttt

SEQ ID NO: 732621 - DNA, 14 bp, Homo sapiens
taacacttaaattt

SEQ ID NO: 732622 - DNA, 20 bp, Homo sapiens
taacacttctgtatgcatca

SEQ ID NO: 732623 - DNA, 23 bp, Homo sapiens
taacactttagttatattcactg

SEQ ID NO: 732624 - DNA, 12 bp, Homo sapiens
taacactttgta

SEQ ID NO: 732625 - DNA, 18 bp, Homo sapiens
taacactttgtattactt

SEQ ID NO: 732626 - DNA, 22 bp, Homo sapiens
taacactttgtattacttaggt

SEQ ID NO: 732627 - DNA, 17 bp, Homo sapiens
taacagaaattgtatat

SEQ ID NO: 732628 - DNA, 18 bp, Homo sapiens
taacagataagcaagaga

SEQ ID NO: 732629 - DNA, 13 bp, Homo sapiens
taacagatacatt

SEQ ID NO: 732630 - DNA, 16 bp, Homo sapiens
taacagatcctttcaa

SEQ ID NO: 732631 - DNA, 21 bp, Homo sapiens
taacagcaacagcaagaaata

SEQ ID NO: 732632 - DNA, 20 bp, Homo sapiens
taacagccctcctctgcact

SEQ ID NO: 732633 - DNA, 12 bp, Homo sapiens
taacagctgaat

SEQ ID NO: 732634 - DNA, 15 bp, Homo sapiens
taacagctgaggtct

SEQ ID NO: 732635 - DNA, 12 bp, Homo sapiens
taacagctgcaa

SEQ ID NO: 732636 - DNA, 14 bp, Homo sapiens
taacaggatgaaag

SEQ ID NO: 732637 - DNA, 15 bp, Homo sapiens
taacaggcatttgtt

SEQ ID NO: 732638 - DNA, 17 bp, Homo sapiens
taacaggctgatttgga

SEQ ID NO: 732639 - DNA, 18 bp, Homo sapiens
taacaggctgatttggag

SEQ ID NO: 732640 - DNA, 15 bp, Homo sapiens
taacaggtctcctct

SEQ ID NO: 732641 - DNA, 18 bp, Homo sapiens
taacaggtctcctcttaa

SEQ ID NO: 732642 - DNA, 13 bp, Homo sapiens
taacagtatttct

SEQ ID NO: 732643 - DNA, 13 bp, Homo sapiens
taacagtcattta

SEQ ID NO: 732644 - DNA, 14 bp, Homo sapiens
taacagtcatttaa

SEQ ID NO: 732645 - DNA, 18 bp, Homo sapiens
taacagtcatttaaaaaa

SEQ ID NO: 732646 - DNA, 14 bp, Homo sapiens
taacagtccttgct

SEQ ID NO: 732647 - DNA, 18 bp, Homo sapiens
taacagtctaaaaattga

SEQ ID NO: 732648 - DNA, 16 bp, Homo sapiens
taacagttatattttt

SEQ ID NO: 732649 - DNA, 20 bp, Homo sapiens
taacagttatatttttgtgt

SEQ ID NO: 732650 - DNA, 22 bp, Homo sapiens
taacagttatatttttgtgttt

SEQ ID NO: 732651 - DNA, 20 bp, Homo sapiens
taacagtttgcctgctgtat

SEQ ID NO: 732652 - DNA, 23 bp, Homo sapiens
taacagtttgcctgctgtattta

SEQ ID NO: 732653 - DNA, 15 bp, Homo sapiens
taacagttttccatg

SEQ ID NO: 732654 - DNA, 20 bp, Homo sapiens
ttacataagataaatgtgct

SEQ ID NO: 732655 - DNA, 18 bp, Homo sapiens
ttacataaggatgacttt

SEQ ID NO: 732656 - DNA, 22 bp, Homo sapiens
ttacataatcaaagctacctgt

SEQ ID NO: 732657 - DNA, 17 bp, Homo sapiens
taactagaattagtatg

SEQ ID NO: 732658 - DNA, 18 bp, Homo sapiens
taactagaattagtatgt

SEQ ID NO: 732659 - DNA, 21 bp, Homo sapiens
taactagaattagtatgtctg

SEQ ID NO: 732660 - DNA, 14 bp, Homo sapiens
ttacgatctgtttc

SEQ ID NO: 732661 - DNA, 17 bp, Homo sapiens
ttacgatttcactagga

SEQ ID NO: 732662 - DNA, 16 bp, Homo sapiens
ttacgcaaggaaggac

SEQ ID NO: 732663 - DNA, 20 bp, Homo sapiens
ttacgcacacgtacttaaat

SEQ ID NO: 732664 - DNA, 13 bp, Homo sapiens
ttacgctttgatt

SEQ ID NO: 732665 - DNA, 15 bp, Homo sapiens
ttacgctttgattca

SEQ ID NO: 732666 - DNA, 16 bp, Homo sapiens
ttacgctttgattcat

SEQ ID NO: 732667 - DNA, 20 bp, Homo sapiens
ttacggagggaggacatcat

SEQ ID NO: 732668 - DNA, 21 bp, Homo sapiens
ttacggagggaggacatcata

SEQ ID NO: 732669 - DNA, 17 bp, Homo sapiens
ttacggatttattatat

SEQ ID NO: 732670 - DNA, 20 bp, Homo sapiens
ttacggtccatgcctttaat

SEQ ID NO: 732671 - DNA, 13 bp, Homo sapiens
ttacgtaaaacat

SEQ ID NO: 732672 - DNA, 14 bp, Homo sapiens
ttacgtactgtaac

SEQ ID NO: 732673 - DNA, 16 bp, Homo sapiens
ttacgtactgtaactg

SEQ ID NO: 732674 - DNA, 19 bp, Homo sapiens
ttacgtactgtaactgctc

SEQ ID NO: 732675 - DNA, 15 bp, Homo sapiens
ttacgtgagccaggt

SEQ ID NO: 732676 - DNA, 15 bp, Homo sapiens
ttacgtgcaaacaac

SEQ ID NO: 732677 - DNA, 20 bp, Homo sapiens
ttacgtgcaaacaacctgaa

SEQ ID NO: 732678 - DNA, 17 bp, Homo sapiens
ttacgtgcatttaaact

SEQ ID NO: 732679 - DNA, 17 bp, Homo sapiens
ttacgtttgttattcct

SEQ ID NO: 732680 - DNA, 13 bp, Homo sapiens
ttactaaacattt

SEQ ID NO: 732681 - DNA, 16 bp, Homo sapiens
ttactaaacattttgt

SEQ ID NO: 732682 - DNA, 15 bp, Homo sapiens
ttactaaagaaagat

SEQ ID NO: 732683 - DNA, 14 bp, Homo sapiens
ttactaacactggc

SEQ ID NO: 732684 - DNA, 22 bp, Homo sapiens
ttactaagaagaaaattgctgt

SEQ ID NO: 732685 - DNA, 16 bp, Homo sapiens
ttactaagatgaaatt

SEQ ID NO: 732686 - DNA, 19 bp, Homo sapiens
ttactaagatgaaattgcc

SEQ ID NO: 732687 - DNA, 17 bp, Homo sapiens
ttactaagccacaagaa

SEQ ID NO: 732688 - DNA, 18 bp, Homo sapiens
ttactaagccacaagaaa

SEQ ID NO: 732689 - DNA, 22 bp, Homo sapiens
ttactaagctttgccagctgct

SEQ ID NO: 732690 - DNA, 14 bp, Homo sapiens
ttactaataaattg

SEQ ID NO: 732691 - DNA, 18 bp, Homo sapiens
ttactaattctatttctc

SEQ ID NO: 732692 - DNA, 14 bp, Homo sapiens
ttactaccctcacc

SEQ ID NO: 732693 - DNA, 22 bp, Homo sapiens
ttactaccctcaccctttacct

SEQ ID NO: 732694 - DNA, 17 bp, Homo sapiens
ttactactgagggaaat

SEQ ID NO: 732695 - DNA, 19 bp, Homo sapiens
ttactactgattttaaaat

SEQ ID NO: 732696 - DNA, 13 bp, Homo sapiens
ttactactgtgga

SEQ ID NO: 732697 - DNA, 22 bp, Homo sapiens
ttactagaaggcgtccatgttt

SEQ ID NO: 732698 - DNA, 16 bp, Homo sapiens
ttactagggatccctc

SEQ ID NO: 732699 - DNA, 23 bp, Homo sapiens
ttactagggatccctcatctgtc

SEQ ID NO: 732700 - DNA, 16 bp, Homo sapiens
ttactaggtaacttca

SEQ ID NO: 732701 - DNA, 17 bp, Homo sapiens
ttactaggtaacttcat

SEQ ID NO: 732702 - DNA, 16 bp, Homo sapiens
ttactaggtgacatgt

SEQ ID NO: 732703 - DNA, 19 bp, Homo sapiens
ttactagtagccaaaagga

SEQ ID NO: 732704 - DNA, 18 bp, Homo sapiens
ttactataaaaatcatgt

SEQ ID NO: 732705 - DNA, 17 bp, Homo sapiens
ttactatagcaaagtag

SEQ ID NO: 732706 - DNA, 18 bp, Homo sapiens
ttactatagtctcttgtt

SEQ ID NO: 732707 - DNA, 17 bp, Homo sapiens
ttactatgtatgttttt

SEQ ID NO: 732708 - DNA, 14 bp, Homo sapiens
ttactattaagcag

SEQ ID NO: 732709 - DNA, 19 bp, Homo sapiens
ttactattaagcagtaaaa

SEQ ID NO: 732710 - DNA, 21 bp, Homo sapiens
ttactattccctttgacttca

SEQ ID NO: 732711 - DNA, 21 bp, Homo sapiens
ttactattcttggttcttatt

SEQ ID NO: 732712 - DNA, 14 bp, Homo sapiens
ttactatttaaaga

SEQ ID NO: 732713 - DNA, 12 bp, Homo sapiens
ttactatttctt

SEQ ID NO: 732714 - DNA, 17 bp, Homo sapiens
ttactattttctacaat

SEQ ID NO: 732715 - DNA, 20 bp, Homo sapiens
ttactcaaagtctaacatat

SEQ ID NO: 732716 - DNA, 21 bp, Homo sapiens
ttactcagcagcagagagccc

SEQ ID NO: 732717 - DNA, 13 bp, Homo sapiens
ttactcagccctg

SEQ ID NO: 732718 - DNA, 22 bp, Homo sapiens
ttactcagccctgggccccacc

SEQ ID NO: 732719 - DNA, 18 bp, Homo sapiens
ttactcagggctcctccc

SEQ ID NO: 732720 - DNA, 19 bp, Homo sapiens
ttactcagggctcctccca

SEQ ID NO: 732721 - DNA, 21 bp, Homo sapiens
ttactcagggctcctcccagc

SEQ ID NO: 732722 - DNA, 13 bp, Homo sapiens
ttactcaggggat

SEQ ID NO: 732723 - DNA, 17 bp, Homo sapiens
ttactcagtgactgttg

SEQ ID NO: 732724 - DNA, 20 bp, Homo sapiens
ttactcagtgttagagaaat

SEQ ID NO: 732725 - DNA, 23 bp, Homo sapiens
ttactcccccaccactcaggcca

SEQ ID NO: 732726 - DNA, 19 bp, Homo sapiens
ttactcccttcctggcctc

SEQ ID NO: 732727 - DNA, 19 bp, Homo sapiens
ttactcccttctcgtgttt

SEQ ID NO: 732728 - DNA, 16 bp, Homo sapiens
ttactcccttctgtag

SEQ ID NO: 732729 - DNA, 12 bp, Homo sapiens
ttactcctcctc

SEQ ID NO: 732730 - DNA, 14 bp, Homo sapiens
ttactctaaataga

SEQ ID NO: 732731 - DNA, 20 bp, Homo sapiens
ttactctaaatagaaatata

SEQ ID NO: 732732 - DNA, 13 bp, Homo sapiens
ttactctgaaggg

SEQ ID NO: 732733 - DNA, 22 bp, Homo sapiens
ttactctgaagggcatcatgca

SEQ ID NO: 732734 - DNA, 15 bp, Homo sapiens
ttactctgagcccag

SEQ ID NO: 732735 - DNA, 14 bp, Homo sapiens
ttactctgcctaca

SEQ ID NO: 732736 - DNA, 20 bp, Homo sapiens
ttactctggtggattgttct

SEQ ID NO: 732737 - DNA, 20 bp, Homo sapiens
ttactctgtctcccaggctg

SEQ ID NO: 732738 - DNA, 16 bp, Homo sapiens
ttactctgtgtttaaa

SEQ ID NO: 732739 - DNA, 18 bp, Homo sapiens
ttactcttcctctaacat

SEQ ID NO: 732740 - DNA, 14 bp, Homo sapiens
ttactctttgcaaa

SEQ ID NO: 732741 - DNA, 20 bp, Homo sapiens
ttactgaaggtaaaattgaa

SEQ ID NO: 732742 - DNA, 16 bp, Homo sapiens
ttactgaataatatca

SEQ ID NO: 732743 - DNA, 22 bp, Homo sapiens
ttactgaataatatcaaataaa

SEQ ID NO: 732744 - DNA, 12 bp, Homo sapiens
ttactgaccatg

SEQ ID NO: 732745 - DNA, 20 bp, Homo sapiens
ttactgagatgttttaccat

SEQ ID NO: 732746 - DNA, 19 bp, Homo sapiens
ttactgagcttctctgtga

SEQ ID NO: 732747 - DNA, 20 bp, Homo sapiens
ttactgaggggattctctac

SEQ ID NO: 732748 - DNA, 13 bp, Homo sapiens
ttactgatcatgc

SEQ ID NO: 732749 - DNA, 14 bp, Homo sapiens
ttactgatcatgca

SEQ ID NO: 732750 - DNA, 15 bp, Homo sapiens
ttactgatcatgcat

SEQ ID NO: 732751 - DNA, 16 bp, Homo sapiens
ttactgatcatgcatt

SEQ ID NO: 732752 - DNA, 13 bp, Homo sapiens
ttactgattattt

SEQ ID NO: 732753 - DNA, 16 bp, Homo sapiens
ttactgcagcctgggc

SEQ ID NO: 732754 - DNA, 23 bp, Homo sapiens
ttactgcagcctgggctccctct

SEQ ID NO: 732755 - DNA, 19 bp, Homo sapiens
ttactgccggtttgaaaat

SEQ ID NO: 732756 - DNA, 17 bp, Homo sapiens
ttactgctaagtatttc

SEQ ID NO: 732757 - DNA, 18 bp, Homo sapiens
ttactgctgattcttgta

SEQ ID NO: 732758 - DNA, 21 bp, Homo sapiens
ttactgctgattcttgtaaat

SEQ ID NO: 732759 - DNA, 22 bp, Homo sapiens
ttactgctgattcttgtaaatc

SEQ ID NO: 732760 - DNA, 17 bp, Homo sapiens
ttactgctgctgtgctt

SEQ ID NO: 732761 - DNA, 19 bp, Homo sapiens
ttactgcttcccattgagt

SEQ ID NO: 732762 - DNA, 19 bp, Homo sapiens
ttactgctttaatcagaaa

SEQ ID NO: 732763 - DNA, 22 bp, Homo sapiens
ttactggatctcttaagacagc

SEQ ID NO: 732764 - DNA, 18 bp, Homo sapiens
ttactggcctttttcatt

SEQ ID NO: 732765 - DNA, 17 bp, Homo sapiens
ttactggtccaaaagat

SEQ ID NO: 732766 - DNA, 20 bp, Homo sapiens
ttactggtgatgttgaaata

SEQ ID NO: 732767 - DNA, 14 bp, Homo sapiens
ttactgtatataaa

SEQ ID NO: 732768 - DNA, 14 bp, Homo sapiens
ttactgtatatgta

SEQ ID NO: 732769 - DNA, 23 bp, Homo sapiens
ttactgtcaaggctgcttagaat

SEQ ID NO: 732770 - DNA, 15 bp, Homo sapiens
ttactgtcaataaac

SEQ ID NO: 732771 - DNA, 23 bp, Homo sapiens
ttactgtctggttttaacaattt

SEQ ID NO: 732772 - DNA, 17 bp, Homo sapiens
ttactgttagaattctt

SEQ ID NO: 732773 - DNA, 16 bp, Homo sapiens
ttactgttgcatttac

SEQ ID NO: 732774 - DNA, 19 bp, Homo sapiens
ttactgttttgggcctcca

SEQ ID NO: 732775 - DNA, 20 bp, Homo sapiens
ttacttaacatatctgatat

SEQ ID NO: 732776 - DNA, 16 bp, Homo sapiens
ttacttaatcaaaact

SEQ ID NO: 732777 - DNA, 20 bp, Homo sapiens
ttacttagaggaaataagaa

SEQ ID NO: 732778 - DNA, 18 bp, Homo sapiens
ttacttagcaagacctga

SEQ ID NO: 732779 - DNA, 15 bp, Homo sapiens
ttagattccaggatc

SEQ ID NO: 732780 - DNA, 13 bp, Homo sapiens
ttagattgagaaa

SEQ ID NO: 732781 - DNA, 12 bp, Homo sapiens
ttagattgcaaa

SEQ ID NO: 732782 - DNA, 14 bp, Homo sapiens
ttagatttcatagt

SEQ ID NO: 732783 - DNA, 20 bp, Homo sapiens
ttagatttcatagttcagaa

SEQ ID NO: 732784 - DNA, 22 bp, Homo sapiens
ttagatttcatagttcagaatt

SEQ ID NO: 732785 - DNA, 21 bp, Homo sapiens
ttagattttattttactattg

SEQ ID NO: 732786 - DNA, 16 bp, Homo sapiens
ttagcaaactgatgct

SEQ ID NO: 732787 - DNA, 19 bp, Homo sapiens
ttagcaaactgatgctgag

SEQ ID NO: 732788 - DNA, 14 bp, Homo sapiens
ttagcacagagagg

SEQ ID NO: 732789 - DNA, 16 bp, Homo sapiens
ttagcacagagaggga

SEQ ID NO: 732790 - DNA, 17 bp, Homo sapiens
taactttaaacatctag

SEQ ID NO: 732791 - DNA, 15 bp, Homo sapiens
taactttaagtttca

SEQ ID NO: 732792 - DNA, 16 bp, Homo sapiens
taactttaagtttcag

SEQ ID NO: 732793 - DNA, 21 bp, Homo sapiens
taactttagaaataaacctta

SEQ ID NO: 732794 - DNA, 15 bp, Homo sapiens
taactttatcacatt

SEQ ID NO: 732795 - DNA, 14 bp, Homo sapiens
taactttattgcat

SEQ ID NO: 732796 - DNA, 13 bp, Homo sapiens
taactttcagaag

SEQ ID NO: 732797 - DNA, 13 bp, Homo sapiens
taactttgaaagt

SEQ ID NO: 732798 - DNA, 19 bp, Homo sapiens
taacttttataaactttac

SEQ ID NO: 732799 - DNA, 20 bp, Homo sapiens
taacttttataaactttacc

SEQ ID NO: 732800 - DNA, 16 bp, Homo sapiens
taacttttgtgaatta

SEQ ID NO: 732801 - DNA, 20 bp, Homo sapiens
taacttttttgtgtatgtac

SEQ ID NO: 732802 - DNA, 16 bp, Homo sapiens
taactttttttcagtt

SEQ ID NO: 732803 - DNA, 16 bp, Homo sapiens
taagaaaaaattcttt

SEQ ID NO: 732804 - DNA, 23 bp, Homo sapiens
taagaaaaaattctttcacttga

SEQ ID NO: 732805 - DNA, 13 bp, Homo sapiens
taagaaaaacttt

SEQ ID NO: 732806 - DNA, 23 bp, Homo sapiens
taagaaaacaaaatctaaaacaa

SEQ ID NO: 732807 - DNA, 18 bp, Homo sapiens
taagaaaagagatatttt

SEQ ID NO: 732808 - DNA, 16 bp, Homo sapiens
taagaaaagatgtaga

SEQ ID NO: 732809 - DNA, 14 bp, Homo sapiens
taagaaaagatttt

SEQ ID NO: 732810 - DNA, 19 bp, Homo sapiens
taagaaaagattttaatca

SEQ ID NO: 732811 - DNA, 14 bp, Homo sapiens
taagaaaagctgat

SEQ ID NO: 732812 - DNA, 16 bp, Homo sapiens
taagaaaagtaatgaa

SEQ ID NO: 732813 - DNA, 17 bp, Homo sapiens
taagaaaagtaatgaag

SEQ ID NO: 732814 - DNA, 22 bp, Homo sapiens
taagaaaatattttgtctaaaa

SEQ ID NO: 732815 - DNA, 23 bp, Homo sapiens
taagaaaatattttgtctaaaat

SEQ ID NO: 732816 - DNA, 13 bp, Homo sapiens
taagaaaatttac

SEQ ID NO: 732817 - DNA, 20 bp, Homo sapiens
taagaaacaactctttgaga

SEQ ID NO: 732818 - DNA, 21 bp, Homo sapiens
taagaaacaactctttgagaa

SEQ ID NO: 732819 - DNA, 21 bp, Homo sapiens
taagaaacacagggttttgta

SEQ ID NO: 732820 - DNA, 23 bp, Homo sapiens
taagaaacacagggttttgtatt

SEQ ID NO: 732821 - DNA, 20 bp, Homo sapiens
taagaaactatgaagatctg

SEQ ID NO: 732822 - DNA, 19 bp, Homo sapiens
taagaaacttttttattta

SEQ ID NO: 732823 - DNA, 20 bp, Homo sapiens
taagaaacttttttatttaa

SEQ ID NO: 732824 - DNA, 22 bp, Homo sapiens
taagaaagtgaagcaaatcaga

SEQ ID NO: 732825 - DNA, 19 bp, Homo sapiens
taagaaatactcatgtgca

SEQ ID NO: 732826 - DNA, 16 bp, Homo sapiens
taagaaatactgtaca

SEQ ID NO: 732827 - DNA, 15 bp, Homo sapiens
taagaaatatctgtg

SEQ ID NO: 732828 - DNA, 14 bp, Homo sapiens
taagaaatgaacaa

SEQ ID NO: 732829 - DNA, 16 bp, Homo sapiens
taagaaatgaacaaaa

SEQ ID NO: 732830 - DNA, 18 bp, Homo sapiens
taagaacaaaagcgaccc

SEQ ID NO: 732831 - DNA, 23 bp, Homo sapiens
taagaaccaaaaaaaaaaaagga

SEQ ID NO: 732832 - DNA, 15 bp, Homo sapiens
taagaacccagggtg

SEQ ID NO: 732833 - DNA, 13 bp, Homo sapiens
taagaacccctct

SEQ ID NO: 732834 - DNA, 17 bp, Homo sapiens
taagaaccttaatgaca

SEQ ID NO: 732835 - DNA, 23 bp, Homo sapiens
taagaaccttaatgacaacactt

SEQ ID NO: 732836 - DNA, 22 bp, Homo sapiens
taagaaccttattttgataaaa

SEQ ID NO: 732837 - DNA, 18 bp, Homo sapiens
taagaactgcttcatgtg

SEQ ID NO: 732838 - DNA, 12 bp, Homo sapiens
taagaactgtac

SEQ ID NO: 732839 - DNA, 15 bp, Homo sapiens
taagaagacatgaca

SEQ ID NO: 732840 - DNA, 14 bp, Homo sapiens
taagaagacatttt

SEQ ID NO: 732841 - DNA, 14 bp, Homo sapiens
taagaagagactgg

SEQ ID NO: 732842 - DNA, 22 bp, Homo sapiens
taagaagcctataagaggaatt

SEQ ID NO: 732843 - DNA, 17 bp, Homo sapiens
taagaaggcaatattaa

SEQ ID NO: 732844 - DNA, 18 bp, Homo sapiens
taagaagggggagtgaaa

SEQ ID NO: 732845 - DNA, 23 bp, Homo sapiens
taagaagggggagtgaaacagag

SEQ ID NO: 732846 - DNA, 15 bp, Homo sapiens
taagaagttactttt

SEQ ID NO: 732847 - DNA, 21 bp, Homo sapiens
taagaagttattttcttgttt

SEQ ID NO: 732848 - DNA, 15 bp, Homo sapiens
taagaagttgtttga

SEQ ID NO: 732849 - DNA, 13 bp, Homo sapiens
taagaagtttgtg

SEQ ID NO: 732850 - DNA, 21 bp, Homo sapiens
taagaagttttaaaaagccag

SEQ ID NO: 732851 - DNA, 16 bp, Homo sapiens
taagaataaaatgttg

SEQ ID NO: 732852 - DNA, 18 bp, Homo sapiens
taagaataacaagaagcc

SEQ ID NO: 732853 - DNA, 18 bp, Homo sapiens
taagaatagtagatgtgg

SEQ ID NO: 732854 - DNA, 17 bp, Homo sapiens
taagaatagttctaaaa

SEQ ID NO: 732855 - DNA, 19 bp, Homo sapiens
taagaatatctgtaatggt

SEQ ID NO: 732856 - DNA, 15 bp, Homo sapiens
taagaatgctggttt

SEQ ID NO: 732857 - DNA, 22 bp, Homo sapiens
taagaatgctggttttcctaaa

SEQ ID NO: 732858 - DNA, 23 bp, Homo sapiens
taagaatgctggttttcctaaat

SEQ ID NO: 732859 - DNA, 17 bp, Homo sapiens
taagaatggttgcctta

SEQ ID NO: 732860 - DNA, 14 bp, Homo sapiens
taagaattcaaact

SEQ ID NO: 732861 - DNA, 20 bp, Homo sapiens
taagaattctggtgtttaca

SEQ ID NO: 732862 - DNA, 13 bp, Homo sapiens
taagaattgtttt

SEQ ID NO: 732863 - DNA, 20 bp, Homo sapiens
taagaattgtttttgaattt

SEQ ID NO: 732864 - DNA, 23 bp, Homo sapiens
taagaatttgaggtctacattct

SEQ ID NO: 732865 - DNA, 15 bp, Homo sapiens
taagaattttgcttt

SEQ ID NO: 732866 - DNA, 19 bp, Homo sapiens
taagaattttgttttactt

SEQ ID NO: 732867 - DNA, 22 bp, Homo sapiens
taagaattttgttttacttttt

SEQ ID NO: 732868 - DNA, 23 bp, Homo sapiens
taagacacaaatgcatgaacaag

SEQ ID NO: 732869 - DNA, 20 bp, Homo sapiens
taagacactgaaaaatctaa

SEQ ID NO: 732870 - DNA, 12 bp, Homo sapiens
taagacactgtg

SEQ ID NO: 732871 - DNA, 13 bp, Homo sapiens
taagacacttaga

SEQ ID NO: 732872 - DNA, 23 bp, Homo sapiens
taagacagtgtacaaaactgtaa

SEQ ID NO: 732873 - DNA, 16 bp, Homo sapiens
taagacatgatttcct

SEQ ID NO: 732874 - DNA, 19 bp, Homo sapiens
taagacatgcttacttttt

SEQ ID NO: 732875 - DNA, 21 bp, Homo sapiens
taagacatgcttactttttaa

SEQ ID NO: 732876 - DNA, 23 bp, Homo sapiens
taagacatgcttactttttaatt

SEQ ID NO: 732877 - DNA, 17 bp, Homo sapiens
taagacatttgtttgct

SEQ ID NO: 732878 - DNA, 20 bp, Homo sapiens
taagacatttgtttgctgta

SEQ ID NO: 732879 - DNA, 16 bp, Homo sapiens
taagaccactacagtc

SEQ ID NO: 732880 - DNA, 14 bp, Homo sapiens
taagaccagcctgg

SEQ ID NO: 732881 - DNA, 19 bp, Homo sapiens
taagaccataacagccaac

SEQ ID NO: 732882 - DNA, 21 bp, Homo sapiens
taagaccgtgtcccaaggagc

SEQ ID NO: 732883 - DNA, 22 bp, Homo sapiens
taagaccgtgtcccaaggagct

SEQ ID NO: 732884 - DNA, 17 bp, Homo sapiens
taagacgtatgtaacat

SEQ ID NO: 732885 - DNA, 22 bp, Homo sapiens
taagacgttggaaggaaatcta

SEQ ID NO: 732886 - DNA, 15 bp, Homo sapiens
taagactaactcaag

SEQ ID NO: 732887 - DNA, 15 bp, Homo sapiens
taagactataaataa

SEQ ID NO: 732888 - DNA, 17 bp, Homo sapiens
taagactataaataaaa

SEQ ID NO: 732889 - DNA, 16 bp, Homo sapiens
taagactcacttacat

SEQ ID NO: 732890 - DNA, 22 bp, Homo sapiens
taagactcccgccccgggctgg

SEQ ID NO: 732891 - DNA, 16 bp, Homo sapiens
taagactgccttcagt

SEQ ID NO: 732892 - DNA, 18 bp, Homo sapiens
taagagaaagaaaatgaa

SEQ ID NO: 732893 - DNA, 14 bp, Homo sapiens
taagagaagtagaa

SEQ ID NO: 732894 - DNA, 18 bp, Homo sapiens
taagagaagtagaaatca

SEQ ID NO: 732895 - DNA, 15 bp, Homo sapiens
taagagacagtttcg

SEQ ID NO: 732896 - DNA, 15 bp, Homo sapiens
taagagcaccttcct

SEQ ID NO: 732897 - DNA, 14 bp, Homo sapiens
taagagcatgattt

SEQ ID NO: 732898 - DNA, 22 bp, Homo sapiens
taagagccatataagtttgaag

SEQ ID NO: 732899 - DNA, 20 bp, Homo sapiens
taagagctagcgctgccgca

SEQ ID NO: 732900 - DNA, 16 bp, Homo sapiens
taagctggagctcttg

SEQ ID NO: 732901 - DNA, 21 bp, Homo sapiens
taagctgggaaaaaagttttg

SEQ ID NO: 732902 - DNA, 22 bp, Homo sapiens
taagctgttcctgttcagtaat

SEQ ID NO: 732903 - DNA, 17 bp, Homo sapiens
taagctttgccagctgc

SEQ ID NO: 732904 - DNA, 18 bp, Homo sapiens
taagctttgccagctgct

SEQ ID NO: 732905 - DNA, 21 bp, Homo sapiens
taagctttgccagctgctgct

SEQ ID NO: 732906 - DNA, 17 bp, Homo sapiens
taaggaaaaaaagacaa

SEQ ID NO: 732907 - DNA, 20 bp, Homo sapiens
taaggaaacacttctattta

SEQ ID NO: 732908 - DNA, 19 bp, Homo sapiens
taaggaaactttatttaaa

SEQ ID NO: 732909 - DNA, 21 bp, Homo sapiens
taaggaaactttatttaaatg

SEQ ID NO: 732910 - DNA, 14 bp, Homo sapiens
taaggaaatacttt

SEQ ID NO: 732911 - DNA, 19 bp, Homo sapiens
taaggaaccttccttcctg

SEQ ID NO: 732912 - DNA, 15 bp, Homo sapiens
taaggaagagggctg

SEQ ID NO: 732913 - DNA, 14 bp, Homo sapiens
taaggaatatggga

SEQ ID NO: 732914 - DNA, 22 bp, Homo sapiens
taaggaatctgaaagtatattt

SEQ ID NO: 732915 - DNA, 19 bp, Homo sapiens
taaggaatgtagctggttt

SEQ ID NO: 732916 - DNA, 16 bp, Homo sapiens
taaggaatttcctccc

SEQ ID NO: 732917 - DNA, 18 bp, Homo sapiens
taaggaattttgtctcac

SEQ ID NO: 732918 - DNA, 18 bp, Homo sapiens
taaggacaaaaatgaact

SEQ ID NO: 732919 - DNA, 18 bp, Homo sapiens
taaggacatttcccaggg

SEQ ID NO: 732920 - DNA, 21 bp, Homo sapiens
ttagtatggttctcagatctt

SEQ ID NO: 732921 - DNA, 13 bp, Homo sapiens
ttagtatgtctgt

SEQ ID NO: 732922 - DNA, 15 bp, Homo sapiens
ttagtatgtctgttt

SEQ ID NO: 732923 - DNA, 22 bp, Homo sapiens
ttagtatgtctgtttttgtatc

SEQ ID NO: 732924 - DNA, 17 bp, Homo sapiens
ttagtattcattctgca

SEQ ID NO: 732925 - DNA, 12 bp, Homo sapiens
ttagtattgttg

SEQ ID NO: 732926 - DNA, 17 bp, Homo sapiens
ttagtattgttgtcctt

SEQ ID NO: 732927 - DNA, 18 bp, Homo sapiens
ttagtattgttgtccttt

SEQ ID NO: 732928 - DNA, 14 bp, Homo sapiens
ttagtatttctcag

SEQ ID NO: 732929 - DNA, 13 bp, Homo sapiens
ttagtcatgtgac

SEQ ID NO: 732930 - DNA, 23 bp, Homo sapiens
ttagtcattgatagaactacttt

SEQ ID NO: 732931 - DNA, 15 bp, Homo sapiens
ttagtccccatcccg

SEQ ID NO: 732932 - DNA, 18 bp, Homo sapiens
ttagtctctaaagagttt

SEQ ID NO: 732933 - DNA, 22 bp, Homo sapiens
ttagtctcttgtattaaactct

SEQ ID NO: 732934 - DNA, 13 bp, Homo sapiens
ttagtcttctcat

SEQ ID NO: 732935 - DNA, 11 bp, Homo sapiens
ttagtgactgt

SEQ ID NO: 732936 - DNA, 21 bp, Homo sapiens
ttagtgattctgatttcagtt

SEQ ID NO: 732937 - DNA, 14 bp, Homo sapiens
ttagtgccagaatt

SEQ ID NO: 732938 - DNA, 14 bp, Homo sapiens
ttagtgctggtcct

SEQ ID NO: 732939 - DNA, 15 bp, Homo sapiens
ttagtgcttaacatt

SEQ ID NO: 732940 - DNA, 16 bp, Homo sapiens
ttagtggctcaacatt

SEQ ID NO: 732941 - DNA, 16 bp, Homo sapiens
ttagtgggccagggct

SEQ ID NO: 732942 - DNA, 19 bp, Homo sapiens
ttagtggtcataaaataga

SEQ ID NO: 732943 - DNA, 13 bp, Homo sapiens
ttagtgtatccat

SEQ ID NO: 732944 - DNA, 23 bp, Homo sapiens
ttagtgtcacttacctagattta

SEQ ID NO: 732945 - DNA, 22 bp, Homo sapiens
ttagtgtccccccttgaagcaa

SEQ ID NO: 732946 - DNA, 19 bp, Homo sapiens
ttagtgtgacagtttccaa

SEQ ID NO: 732947 - DNA, 17 bp, Homo sapiens
ttagtgtgtgtgcagag

SEQ ID NO: 732948 - DNA, 16 bp, Homo sapiens
ttagtgtgtgtgcatg

SEQ ID NO: 732949 - DNA, 19 bp, Homo sapiens
ttagtgttaaaaatctagt

SEQ ID NO: 732950 - DNA, 18 bp, Homo sapiens
ttagtgttaatgactctt

SEQ ID NO: 732951 - DNA, 16 bp, Homo sapiens
ttagtgtttttttatt

SEQ ID NO: 732952 - DNA, 14 bp, Homo sapiens
ttagttaactgaat

SEQ ID NO: 732953 - DNA, 19 bp, Homo sapiens
ttagttaccgagacatgaa

SEQ ID NO: 732954 - DNA, 13 bp, Homo sapiens
ttagttaccttat

SEQ ID NO: 732955 - DNA, 16 bp, Homo sapiens
ttagttaccttatagt

SEQ ID NO: 732956 - DNA, 20 bp, Homo sapiens
ttagttaccttatagttact

SEQ ID NO: 732957 - DNA, 21 bp, Homo sapiens
ttagttaccttatagttactg

SEQ ID NO: 732958 - DNA, 18 bp, Homo sapiens
ttagttacgtataatgct

SEQ ID NO: 732959 - DNA, 16 bp, Homo sapiens
ttagttatagatgtct

SEQ ID NO: 732960 - DNA, 23 bp, Homo sapiens
ttagttatagtgtttaactggca

SEQ ID NO: 732961 - DNA, 13 bp, Homo sapiens
ttagttatagttt

SEQ ID NO: 732962 - DNA, 15 bp, Homo sapiens
ttagttatagtttca

SEQ ID NO: 732963 - DNA, 20 bp, Homo sapiens
ttagttccagtttctccttg

SEQ ID NO: 732964 - DNA, 21 bp, Homo sapiens
ttagttctcactgttccctct

SEQ ID NO: 732965 - DNA, 14 bp, Homo sapiens
ttagttcttgaatt

SEQ ID NO: 732966 - DNA, 17 bp, Homo sapiens
ttagttcttgaattgtt

SEQ ID NO: 732967 - DNA, 13 bp, Homo sapiens
ttagttgaaaaat

SEQ ID NO: 732968 - DNA, 19 bp, Homo sapiens
ttagttgacaacctagaat

SEQ ID NO: 732969 - DNA, 13 bp, Homo sapiens
ttagttgctgtat

SEQ ID NO: 732970 - DNA, 22 bp, Homo sapiens
ttagttgggatgccaatttcct

SEQ ID NO: 732971 - DNA, 13 bp, Homo sapiens
ttagtttaaaatg

SEQ ID NO: 732972 - DNA, 17 bp, Homo sapiens
ttagtttacaatcagcc

SEQ ID NO: 732973 - DNA, 17 bp, Homo sapiens
ttagtttcaagagtcta

SEQ ID NO: 732974 - DNA, 21 bp, Homo sapiens
ttagtttcaagagtctaaacc

SEQ ID NO: 732975 - DNA, 11 bp, Homo sapiens
ttagtttcctt

SEQ ID NO: 732976 - DNA, 14 bp, Homo sapiens
ttagtttctttggg

SEQ ID NO: 732977 - DNA, 16 bp, Homo sapiens
ttagtttgcctgcagt

SEQ ID NO: 732978 - DNA, 15 bp, Homo sapiens
ttagtttgtatatat

SEQ ID NO: 732979 - DNA, 22 bp, Homo sapiens
ttagtttgtatgccaagtgaga

SEQ ID NO: 732980 - DNA, 17 bp, Homo sapiens
ttagttttatggcatga

SEQ ID NO: 732981 - DNA, 13 bp, Homo sapiens
ttagtttttcatt

SEQ ID NO: 732982 - DNA, 16 bp, Homo sapiens
ttagtttttcattaaa

SEQ ID NO: 732983 - DNA, 18 bp, Homo sapiens
ttagtttttgtaatttat

SEQ ID NO: 732984 - DNA, 19 bp, Homo sapiens
ttagttttttttgtttgcc

SEQ ID NO: 732985 - DNA, 17 bp, Homo sapiens
ttataaaaaatgtaaca

SEQ ID NO: 732986 - DNA, 14 bp, Homo sapiens
ttataaaaacactt

SEQ ID NO: 732987 - DNA, 17 bp, Homo sapiens
ttataaaaacacttata

SEQ ID NO: 732988 - DNA, 18 bp, Homo sapiens
ttataaaaatataaattg

SEQ ID NO: 732989 - DNA, 19 bp, Homo sapiens
ttataaaaatataaattgt

SEQ ID NO: 732990 - DNA, 17 bp, Homo sapiens
ttataaaacaatgactt

SEQ ID NO: 732991 - DNA, 18 bp, Homo sapiens
ttataaaacaatgacttt

SEQ ID NO: 732992 - DNA, 22 bp, Homo sapiens
ttataaaaccatcaaaaatatt

SEQ ID NO: 732993 - DNA, 17 bp, Homo sapiens
ttataaaactatgtgtt

SEQ ID NO: 732994 - DNA, 20 bp, Homo sapiens
ttataaaagctcagatgaca

SEQ ID NO: 732995 - DNA, 16 bp, Homo sapiens
ttataaaagtgttcat

SEQ ID NO: 732996 - DNA, 13 bp, Homo sapiens
ttataaaataaca

SEQ ID NO: 732997 - DNA, 21 bp, Homo sapiens
ttataaaatgggaagactgag

SEQ ID NO: 732998 - DNA, 18 bp, Homo sapiens
ttataaaatgtataaatt

SEQ ID NO: 732999 - DNA, 14 bp, Homo sapiens
ttataaaattaaaa

SEQ ID NO: 733000 - DNA, 15 bp, Homo sapiens
ttataaacacattga

SEQ ID NO: 733001 - DNA, 19 bp, Homo sapiens
ttataaacagacaatatgt

SEQ ID NO: 733002 - DNA, 23 bp, Homo sapiens
ttataaacagacaatatgtgagt

SEQ ID NO: 733003 - DNA, 17 bp, Homo sapiens
ttataaaccttcagaag

SEQ ID NO: 733004 - DNA, 17 bp, Homo sapiens
ttataaactttaccttt

SEQ ID NO: 733005 - DNA, 18 bp, Homo sapiens
ttataaactttacctttt

SEQ ID NO: 733006 - DNA, 23 bp, Homo sapiens
ttataaagataaaatatcctcag

SEQ ID NO: 733007 - DNA, 15 bp, Homo sapiens
ttataaagtagaaat

SEQ ID NO: 733008 - DNA, 18 bp, Homo sapiens
ttataaataaaatcatgt

SEQ ID NO: 733009 - DNA, 19 bp, Homo sapiens
ttataaataaactgttgct

SEQ ID NO: 733010 - DNA, 21 bp, Homo sapiens
ttataaatattaggcataaat

SEQ ID NO: 733011 - DNA, 14 bp, Homo sapiens
ttataaatgctatt

SEQ ID NO: 733012 - DNA, 23 bp, Homo sapiens
ttataaatgtaccagagagagtt

SEQ ID NO: 733013 - DNA, 23 bp, Homo sapiens
ttataaatgtgtttatagctcat

SEQ ID NO: 733014 - DNA, 11 bp, Homo sapiens
ttataaattaa

SEQ ID NO: 733015 - DNA, 12 bp, Homo sapiens
ttataaattaaa

SEQ ID NO: 733016 - DNA, 17 bp, Homo sapiens
ttataacagcaaatgaa

SEQ ID NO: 733017 - DNA, 13 bp, Homo sapiens
ttataacagttat

SEQ ID NO: 733018 - DNA, 23 bp, Homo sapiens
ttataacctagttaaagaaagga

SEQ ID NO: 733019 - DNA, 15 bp, Homo sapiens
ttataacctggcaaa

SEQ ID NO: 733020 - DNA, 21 bp, Homo sapiens
ttataacctggcaaaatcttg

SEQ ID NO: 733021 - DNA, 21 bp, Homo sapiens
ttataaccttaatttattatt

SEQ ID NO: 733022 - DNA, 16 bp, Homo sapiens
ttatattcacagtttt

SEQ ID NO: 733023 - DNA, 22 bp, Homo sapiens
ttatattccaaggaaaattgaa

SEQ ID NO: 733024 - DNA, 13 bp, Homo sapiens
ttatattctaata

SEQ ID NO: 733025 - DNA, 12 bp, Homo sapiens
ttatattgcctt

SEQ ID NO: 733026 - DNA, 23 bp, Homo sapiens
ttatattggtgcgtttttacagt

SEQ ID NO: 733027 - DNA, 24 bp, Homo sapiens
ttatattgtaagaaatactgtaca

SEQ ID NO: 733028 - DNA, 16 bp, Homo sapiens
ttatattgtatattct

SEQ ID NO: 733029 - DNA, 15 bp, Homo sapiens
ttatattgttttctc

SEQ ID NO: 733030 - DNA, 19 bp, Homo sapiens
ttatatttagttatagttt

SEQ ID NO: 733031 - DNA, 21 bp, Homo sapiens
ttatatttcagatgtaatgtt

SEQ ID NO: 733032 - DNA, 22 bp, Homo sapiens
ttatatttcagatgtaatgttt

SEQ ID NO: 733033 - DNA, 14 bp, Homo sapiens
ttatatttccttta

SEQ ID NO: 733034 - DNA, 21 bp, Homo sapiens
ttatatttcctttatgtgaat

SEQ ID NO: 733035 - DNA, 17 bp, Homo sapiens
ttatatttctacagaga

SEQ ID NO: 733036 - DNA, 12 bp, Homo sapiens
ttatatttgcat

SEQ ID NO: 733037 - DNA, 17 bp, Homo sapiens
ttatatttggaaagaga

SEQ ID NO: 733038 - DNA, 18 bp, Homo sapiens
ttatatttgtgctatagt

SEQ ID NO: 733039 - DNA, 14 bp, Homo sapiens
ttatatttgtgtat

SEQ ID NO: 733040 - DNA, 15 bp, Homo sapiens
ttatattttatgaac

SEQ ID NO: 733041 - DNA, 20 bp, Homo sapiens
ttatattttatgaacattgt

SEQ ID NO: 733042 - DNA, 21 bp, Homo sapiens
ttatattttgattttacatgc

SEQ ID NO: 733043 - DNA, 23 bp, Homo sapiens
ttatatttttgtgttttcttgta

SEQ ID NO: 733044 - DNA, 14 bp, Homo sapiens
ttatcaaaaagtat

SEQ ID NO: 733045 - DNA, 15 bp, Homo sapiens
ttatcaaaactttct

SEQ ID NO: 733046 - DNA, 20 bp, Homo sapiens
ttatcaaaatagtctaaggc

SEQ ID NO: 733047 - DNA, 23 bp, Homo sapiens
ttatcaaaatagtctaaggccat

SEQ ID NO: 733048 - DNA, 18 bp, Homo sapiens
ttatcaaaccctagcctt

SEQ ID NO: 733049 - DNA, 21 bp, Homo sapiens
ttatcaaaccctagccttgct

SEQ ID NO: 733050 - DNA, 11 bp, Homo sapiens
ttatcaagtgt

SEQ ID NO: 733051 - DNA, 17 bp, Homo sapiens
ttatcaatatctaatat

SEQ ID NO: 733052 - DNA, 20 bp, Homo sapiens
taaggacctttttaaagaga

SEQ ID NO: 733053 - DNA, 22 bp, Homo sapiens
taaggacctttttaaagagata

SEQ ID NO: 733054 - DNA, 13 bp, Homo sapiens
taaggactgtaaa

SEQ ID NO: 733055 - DNA, 20 bp, Homo sapiens
taaggagcatcagccagtga

SEQ ID NO: 733056 - DNA, 15 bp, Homo sapiens
taaggagcatgattt

SEQ ID NO: 733057 - DNA, 15 bp, Homo sapiens
taaggagggagaaag

SEQ ID NO: 733058 - DNA, 19 bp, Homo sapiens
taaggagggagaaaggaga

SEQ ID NO: 733059 - DNA, 20 bp, Homo sapiens
taaggaggggaaaaaaatgt

SEQ ID NO: 733060 - DNA, 17 bp, Homo sapiens
taaggagttaaatcttc

SEQ ID NO: 733061 - DNA, 15 bp, Homo sapiens
taaggataaatcata

SEQ ID NO: 733062 - DNA, 22 bp, Homo sapiens
taaggataaatcataaagtcag

SEQ ID NO: 733063 - DNA, 17 bp, Homo sapiens
taaggataatgaaataa

SEQ ID NO: 733064 - DNA, 12 bp, Homo sapiens
taaggatgactt

SEQ ID NO: 733065 - DNA, 13 bp, Homo sapiens
taaggatgacttt

SEQ ID NO: 733066 - DNA, 20 bp, Homo sapiens
taaggatgagggaagcgaag

SEQ ID NO: 733067 - DNA, 20 bp, Homo sapiens
taaggatgcttgtacataat

SEQ ID NO: 733068 - DNA, 20 bp, Homo sapiens
taaggatgtcacagggccaa

SEQ ID NO: 733069 - DNA, 14 bp, Homo sapiens
taaggcaagccagt

SEQ ID NO: 733070 - DNA, 17 bp, Homo sapiens
taaggcacagtgggagc

SEQ ID NO: 733071 - DNA, 23 bp, Homo sapiens
taaggcacagtgggagctgagct

SEQ ID NO: 733072 - DNA, 21 bp, Homo sapiens
taaggcagattttacagagcg

SEQ ID NO: 733073 - DNA, 18 bp, Homo sapiens
taaggcatgcgaaatgtt

SEQ ID NO: 733074 - DNA, 21 bp, Homo sapiens
taaggccacgtatagtcctag

SEQ ID NO: 733075 - DNA, 20 bp, Homo sapiens
taaggccagaaactcctttt

SEQ ID NO: 733076 - DNA, 17 bp, Homo sapiens
taaggccagggcctctc

SEQ ID NO: 733077 - DNA, 14 bp, Homo sapiens
taaggcctaaggaa

SEQ ID NO: 733078 - DNA, 16 bp, Homo sapiens
taaggcctgccctccc

SEQ ID NO: 733079 - DNA, 16 bp, Homo sapiens
taaggcctgtgggggg

SEQ ID NO: 733080 - DNA, 21 bp, Homo sapiens
taaggctgcaaggtttaggct

SEQ ID NO: 733081 - DNA, 17 bp, Homo sapiens
taagggaaaagataaag

SEQ ID NO: 733082 - DNA, 16 bp, Homo sapiens
taagggaagatcactg

SEQ ID NO: 733083 - DNA, 19 bp, Homo sapiens
taagggacttaacttgttt

SEQ ID NO: 733084 - DNA, 13 bp, Homo sapiens
taagggcagccct

SEQ ID NO: 733085 - DNA, 14 bp, Homo sapiens
taagggcagccctc

SEQ ID NO: 733086 - DNA, 14 bp, Homo sapiens
taagggcagtgccc

SEQ ID NO: 733087 - DNA, 23 bp, Homo sapiens
taagggcagtgcccatgtgtaca

SEQ ID NO: 733088 - DNA, 22 bp, Homo sapiens
taagggctggtctctgctgaag

SEQ ID NO: 733089 - DNA, 16 bp, Homo sapiens
taagggtaggatgttg

SEQ ID NO: 733090 - DNA, 17 bp, Homo sapiens
taagggtggaaaaatgc

SEQ ID NO: 733091 - DNA, 18 bp, Homo sapiens
taaggtacaagaagcatt

SEQ ID NO: 733092 - DNA, 23 bp, Homo sapiens
taaggtatttcgaaactgccaag

SEQ ID NO: 733093 - DNA, 19 bp, Homo sapiens
taaggtccaacaagaatgc

SEQ ID NO: 733094 - DNA, 14 bp, Homo sapiens
taaggtctaactgt

SEQ ID NO: 733095 - DNA, 17 bp, Homo sapiens
taaggtcttcttgtgtc

SEQ ID NO: 733096 - DNA, 20 bp, Homo sapiens
taaggtcttcttgtgtcctg

SEQ ID NO: 733097 - DNA, 18 bp, Homo sapiens
taaggtctttcagtactt

SEQ ID NO: 733098 - DNA, 21 bp, Homo sapiens
taaggtctttgtaaaatcttg

SEQ ID NO: 733099 - DNA, 18 bp, Homo sapiens
taaggtgatatatttaaa

SEQ ID NO: 733100 - DNA, 20 bp, Homo sapiens
taaggtgatatatttaaaaa

SEQ ID NO: 733101 - DNA, 13 bp, Homo sapiens
taaggtgccttct

SEQ ID NO: 733102 - DNA, 22 bp, Homo sapiens
taaggtgggtccaggaaggcag

SEQ ID NO: 733103 - DNA, 23 bp, Homo sapiens
taaggttgaaaagacaatagccc

SEQ ID NO: 733104 - DNA, 14 bp, Homo sapiens
taaggtttcaatgc

SEQ ID NO: 733105 - DNA, 22 bp, Homo sapiens
taaggtttcgtttctgtataca

SEQ ID NO: 733106 - DNA, 18 bp, Homo sapiens
taagtaaaaatatgtcat

SEQ ID NO: 733107 - DNA, 16 bp, Homo sapiens
taagtaaatacaattt

SEQ ID NO: 733108 - DNA, 20 bp, Homo sapiens
taagtaacttcacattaaaa

SEQ ID NO: 733109 - DNA, 14 bp, Homo sapiens
taagtaagaaaata

SEQ ID NO: 733110 - DNA, 15 bp, Homo sapiens
taagtaagaaaatat

SEQ ID NO: 733111 - DNA, 18 bp, Homo sapiens
taagtaagtttcttcctg

SEQ ID NO: 733112 - DNA, 23 bp, Homo sapiens
taagtaattgcctacaataaaaa

SEQ ID NO: 733113 - DNA, 23 bp, Homo sapiens
taagtaatttagaagatattatt

SEQ ID NO: 733114 - DNA, 15 bp, Homo sapiens
taagtaccaatggga

SEQ ID NO: 733115 - DNA, 18 bp, Homo sapiens
taagtaccaatgggaagc

SEQ ID NO: 733116 - DNA, 17 bp, Homo sapiens
taagtactatgtatcaa

SEQ ID NO: 733117 - DNA, 19 bp, Homo sapiens
taagtactatgtatcaatg

SEQ ID NO: 733118 - DNA, 22 bp, Homo sapiens
taagtacttccacttgtgtata

SEQ ID NO: 733119 - DNA, 15 bp, Homo sapiens
taagtagtaaatcag

SEQ ID NO: 733120 - DNA, 18 bp, Homo sapiens
taagtagttggtttgtat

SEQ ID NO: 733121 - DNA, 12 bp, Homo sapiens
taagtatatagt

SEQ ID NO: 733122 - DNA, 21 bp, Homo sapiens
taagtatctgggattattctt

SEQ ID NO: 733123 - DNA, 18 bp, Homo sapiens
taagtatggaatattcat

SEQ ID NO: 733124 - DNA, 17 bp, Homo sapiens
taagtattatgtctctt

SEQ ID NO: 733125 - DNA, 19 bp, Homo sapiens
taagtattcttatttaatg

SEQ ID NO: 733126 - DNA, 21 bp, Homo sapiens
taagtattcttatttaatgaa

SEQ ID NO: 733127 - DNA, 11 bp, Homo sapiens
taagtattgca

SEQ ID NO: 733128 - DNA, 10 bp, Homo sapiens
taagtattta

SEQ ID NO: 733129 - DNA, 14 bp, Homo sapiens
taagtatttataat

SEQ ID NO: 733130 - DNA, 17 bp, Homo sapiens
taagtatttatatattt

SEQ ID NO: 733131 - DNA, 14 bp, Homo sapiens
taagtcaagcacat

SEQ ID NO: 733132 - DNA, 20 bp, Homo sapiens
taagtcaagcacatgtaata

SEQ ID NO: 733133 - DNA, 21 bp, Homo sapiens
taagtcaagcacatgtaataa

SEQ ID NO: 733134 - DNA, 22 bp, Homo sapiens
taagtcaagcacatgtaataaa

SEQ ID NO: 733135 - DNA, 20 bp, Homo sapiens
taagtcacccagagcacagg

SEQ ID NO: 733136 - DNA, 13 bp, Homo sapiens
taagtcagaacag

SEQ ID NO: 733137 - DNA, 23 bp, Homo sapiens
taagtcagggaagagcagtgctg

SEQ ID NO: 733138 - DNA, 18 bp, Homo sapiens
taagtcaggtaatatacc

SEQ ID NO: 733139 - DNA, 20 bp, Homo sapiens
taagtcaggtaatatacctg

SEQ ID NO: 733140 - DNA, 12 bp, Homo sapiens
taagtcatcatt

SEQ ID NO: 733141 - DNA, 18 bp, Homo sapiens
taagtcatgtatgtttct

SEQ ID NO: 733142 - DNA, 16 bp, Homo sapiens
taagtcattttcatgt

SEQ ID NO: 733143 - DNA, 23 bp, Homo sapiens
ttatgagaaattagtcacttaaa

SEQ ID NO: 733144 - DNA, 16 bp, Homo sapiens
ttatgagatactttgc

SEQ ID NO: 733145 - DNA, 19 bp, Homo sapiens
ttatgagatctaatgtgaa

SEQ ID NO: 733146 - DNA, 16 bp, Homo sapiens
ttatgagcgtcactgc

SEQ ID NO: 733147 - DNA, 19 bp, Homo sapiens
ttatgaggatataatgtgt

SEQ ID NO: 733148 - DNA, 21 bp, Homo sapiens
ttatgagtttttgatagcttt

SEQ ID NO: 733149 - DNA, 14 bp, Homo sapiens
ttatgatatttctt

SEQ ID NO: 733150 - DNA, 13 bp, Homo sapiens
ttatgatctggcc

SEQ ID NO: 733151 - DNA, 21 bp, Homo sapiens
ttatgatctggcccttgctta

SEQ ID NO: 733152 - DNA, 17 bp, Homo sapiens
ttatgatgcatacagtt

SEQ ID NO: 733153 - DNA, 19 bp, Homo sapiens
ttatgatgttagaagaaga

SEQ ID NO: 733154 - DNA, 15 bp, Homo sapiens
ttatgattgttatgt

SEQ ID NO: 733155 - DNA, 16 bp, Homo sapiens
ttatgatttccttcaa

SEQ ID NO: 733156 - DNA, 20 bp, Homo sapiens
ttatgcaattaggtttttcc

SEQ ID NO: 733157 - DNA, 23 bp, Homo sapiens
ttatgcagacagtctgttatgca

SEQ ID NO: 733158 - DNA, 14 bp, Homo sapiens
ttatgcatagataa

SEQ ID NO: 733159 - DNA, 16 bp, Homo sapiens
ttatgcatgaagtaat

SEQ ID NO: 733160 - DNA, 22 bp, Homo sapiens
ttatgcatgaagtaatatgcac

SEQ ID NO: 733161 - DNA, 13 bp, Homo sapiens
ttatgcatttcat

SEQ ID NO: 733162 - DNA, 14 bp, Homo sapiens
ttatgcatttcatt

SEQ ID NO: 733163 - DNA, 13 bp, Homo sapiens
ttatgccaccccc

SEQ ID NO: 733164 - DNA, 17 bp, Homo sapiens
ttatgccatgatttttg

SEQ ID NO: 733165 - DNA, 14 bp, Homo sapiens
ttatgctcagggtc

SEQ ID NO: 733166 - DNA, 19 bp, Homo sapiens
ttatgctctcactgtttgt

SEQ ID NO: 733167 - DNA, 13 bp, Homo sapiens
ttatgctgctgtg

SEQ ID NO: 733168 - DNA, 18 bp, Homo sapiens
ttatgctgtagtcttacc

SEQ ID NO: 733169 - DNA, 20 bp, Homo sapiens
ttatgctgtattttaacact

SEQ ID NO: 733170 - DNA, 22 bp, Homo sapiens
ttatgctgtattttaacacttt

SEQ ID NO: 733171 - DNA, 19 bp, Homo sapiens
ttatgcttaaaatatgtat

SEQ ID NO: 733172 - DNA, 21 bp, Homo sapiens
ttatgcttccacaggcaaaac

SEQ ID NO: 733173 - DNA, 12 bp, Homo sapiens
ttatgctttgaa

SEQ ID NO: 733174 - DNA, 15 bp, Homo sapiens
ttatgctttgaactt

SEQ ID NO: 733175 - DNA, 16 bp, Homo sapiens
ttatgctttgaacttt

SEQ ID NO: 733176 - DNA, 13 bp, Homo sapiens
ttatggaaaactg

SEQ ID NO: 733177 - DNA, 17 bp, Homo sapiens
ttatggaattaaccatt

SEQ ID NO: 733178 - DNA, 14 bp, Homo sapiens
ttatggaattgatt

SEQ ID NO: 733179 - DNA, 14 bp, Homo sapiens
taagtgtaaataga

SEQ ID NO: 733180 - DNA, 12 bp, Homo sapiens
taagtgtacaat

SEQ ID NO: 733181 - DNA, 18 bp, Homo sapiens
taagtgtacatatgtgct

SEQ ID NO: 733182 - DNA, 14 bp, Homo sapiens
taagtgtagctcaa

SEQ ID NO: 733183 - DNA, 18 bp, Homo sapiens
taagtgtatttttcaata

SEQ ID NO: 733184 - DNA, 21 bp, Homo sapiens
taagtgtgagtaagagctggt

SEQ ID NO: 733185 - DNA, 14 bp, Homo sapiens
taagtgtgccaaat

SEQ ID NO: 733186 - DNA, 18 bp, Homo sapiens
taagtgtgccaaatcagt

SEQ ID NO: 733187 - DNA, 22 bp, Homo sapiens
taagtgttcgtctttagttttg

SEQ ID NO: 733188 - DNA, 14 bp, Homo sapiens
taagtgttggaaaa

SEQ ID NO: 733189 - DNA, 22 bp, Homo sapiens
taagttaaaggcagtccagagc

SEQ ID NO: 733190 - DNA, 19 bp, Homo sapiens
taagttaataatgtattgt

SEQ ID NO: 733191 - DNA, 21 bp, Homo sapiens
taagttaatgtatataaaaat

SEQ ID NO: 733192 - DNA, 21 bp, Homo sapiens
taagttacacatttttcagat

SEQ ID NO: 733193 - DNA, 20 bp, Homo sapiens
taagttattaagaggtaaga

SEQ ID NO: 733194 - DNA, 12 bp, Homo sapiens
taagttattacc

SEQ ID NO: 733195 - DNA, 16 bp, Homo sapiens
taagttcacattagaa

SEQ ID NO: 733196 - DNA, 17 bp, Homo sapiens
taagttccactgagctc

SEQ ID NO: 733197 - DNA, 19 bp, Homo sapiens
taagttccactgagctcca

SEQ ID NO: 733198 - DNA, 13 bp, Homo sapiens
taagttctaagtt

SEQ ID NO: 733199 - DNA, 12 bp, Homo sapiens
taagttcttatg

SEQ ID NO: 733200 - DNA, 20 bp, Homo sapiens
taagttgagatagttttcat

SEQ ID NO: 733201 - DNA, 21 bp, Homo sapiens
taagttgagatagttttcatc

SEQ ID NO: 733202 - DNA, 18 bp, Homo sapiens
taagttgtaccaaaacat

SEQ ID NO: 733203 - DNA, 15 bp, Homo sapiens
taagttgtattaaaa

SEQ ID NO: 733204 - DNA, 17 bp, Homo sapiens
taagttgtattaaaaat

SEQ ID NO: 733205 - DNA, 22 bp, Homo sapiens
taagttgtcaaagaagcttcca

SEQ ID NO: 733206 - DNA, 19 bp, Homo sapiens
taagtttacctatgtaaca

SEQ ID NO: 733207 - DNA, 17 bp, Homo sapiens
taagtttatccaaatct

SEQ ID NO: 733208 - DNA, 17 bp, Homo sapiens
taagtttattttttcta

SEQ ID NO: 733209 - DNA, 17 bp, Homo sapiens
taagtttctctgcagaa

SEQ ID NO: 733210 - DNA, 16 bp, Homo sapiens
taagtttctcttcacc

SEQ ID NO: 733211 - DNA, 16 bp, Homo sapiens
taagttttagaatctt

SEQ ID NO: 733212 - DNA, 20 bp, Homo sapiens
taagttttagaatcttttaa

SEQ ID NO: 733213 - DNA, 21 bp, Homo sapiens
taagttttagaatcttttaaa

SEQ ID NO: 733214 - DNA, 12 bp, Homo sapiens
taagttttgaca

SEQ ID NO: 733215 - DNA, 16 bp, Homo sapiens
taagttttgtgtgtat

SEQ ID NO: 733216 - DNA, 20 bp, Homo sapiens
taagtttttatggcttttgt

SEQ ID NO: 733217 - DNA, 14 bp, Homo sapiens
taagtttttcactt

SEQ ID NO: 733218 - DNA, 17 bp, Homo sapiens
taagtttttctttaata

SEQ ID NO: 733219 - DNA, 19 bp, Homo sapiens
taagtttttctttaatatg

SEQ ID NO: 733220 - DNA, 16 bp, Homo sapiens
taataaaaaaagaaag

SEQ ID NO: 733221 - DNA, 13 bp, Homo sapiens
taataaaaaacaa

SEQ ID NO: 733222 - DNA, 20 bp, Homo sapiens
taataaaaaatggaaagaat

SEQ ID NO: 733223 - DNA, 21 bp, Homo sapiens
taataaaaaatggaaagaatc

SEQ ID NO: 733224 - DNA, 13 bp, Homo sapiens
taataaaaattat

SEQ ID NO: 733225 - DNA, 13 bp, Homo sapiens
taataaaaattgt

SEQ ID NO: 733226 - DNA, 14 bp, Homo sapiens
taataaaaattgta

SEQ ID NO: 733227 - DNA, 11 bp, Homo sapiens
taataaaacaa

SEQ ID NO: 733228 - DNA, 20 bp, Homo sapiens
taataaaactgcacagtgct

SEQ ID NO: 733229 - DNA, 19 bp, Homo sapiens
taataaaactttatgtact

SEQ ID NO: 733230 - DNA, 14 bp, Homo sapiens
taataaaagaacat

SEQ ID NO: 733231 - DNA, 13 bp, Homo sapiens
taataaaaggaaa

SEQ ID NO: 733232 - DNA, 12 bp, Homo sapiens
taataaaagtga

SEQ ID NO: 733233 - DNA, 12 bp, Homo sapiens
taataaaatgca

SEQ ID NO: 733234 - DNA, 14 bp, Homo sapiens
taataaaatgcaaa

SEQ ID NO: 733235 - DNA, 22 bp, Homo sapiens
taataaaatgcaaatgaatcat

SEQ ID NO: 733236 - DNA, 17 bp, Homo sapiens
taataaactgtattaaa

SEQ ID NO: 733237 - DNA, 15 bp, Homo sapiens
taataaactgtgttt

SEQ ID NO: 733238 - DNA, 14 bp, Homo sapiens
taataaagaaatat

SEQ ID NO: 733239 - DNA, 17 bp, Homo sapiens
taataaagaaatattta

SEQ ID NO: 733240 - DNA, 21 bp, Homo sapiens
taataaagaaatatttaccta

SEQ ID NO: 733241 - DNA, 20 bp, Homo sapiens
taataaagaattaacagaga

SEQ ID NO: 733242 - DNA, 13 bp, Homo sapiens
taataaagacagg

SEQ ID NO: 733243 - DNA, 14 bp, Homo sapiens
taataaagatgctc

SEQ ID NO: 733244 - DNA, 16 bp, Homo sapiens
taataaaggactgtaa

SEQ ID NO: 733245 - DNA, 20 bp, Homo sapiens
taataaaggactgtaatctt

SEQ ID NO: 733246 - DNA, 18 bp, Homo sapiens
taataaaggccacaggag

SEQ ID NO: 733247 - DNA, 16 bp, Homo sapiens
taataaagtagcaaaa

SEQ ID NO: 733248 - DNA, 22 bp, Homo sapiens
taataaagtattccaccttaaa

SEQ ID NO: 733249 - DNA, 12 bp, Homo sapiens
taataaagttgt

SEQ ID NO: 733250 - DNA, 16 bp, Homo sapiens
taataaagttgtttta

SEQ ID NO: 733251 - DNA, 14 bp, Homo sapiens
taataaatacacaa

SEQ ID NO: 733252 - DNA, 17 bp, Homo sapiens
taataaatatactatga

SEQ ID NO: 733253 - DNA, 13 bp, Homo sapiens
taataaatatgtt

SEQ ID NO: 733254 - DNA, 15 bp, Homo sapiens
taataaatctggtag

SEQ ID NO: 733255 - DNA, 19 bp, Homo sapiens
taataaatgacaaatgtat

SEQ ID NO: 733256 - DNA, 14 bp, Homo sapiens
taataaatgccctc

SEQ ID NO: 733257 - DNA, 18 bp, Homo sapiens
taataaatgccctcttct

SEQ ID NO: 733258 - DNA, 21 bp, Homo sapiens
taataaattaaacatgctgtt

SEQ ID NO: 733259 - DNA, 15 bp, Homo sapiens
taataaattcaaaac

SEQ ID NO: 733260 - DNA, 17 bp, Homo sapiens
taataaattcatcagaa

SEQ ID NO: 733261 - DNA, 13 bp, Homo sapiens
taataaattgctt

SEQ ID NO: 733262 - DNA, 17 bp, Homo sapiens
taataacagctccttta

SEQ ID NO: 733263 - DNA, 17 bp, Homo sapiens
taataacgtgaaactta

SEQ ID NO: 733264 - DNA, 12 bp, Homo sapiens
taataactgaac

SEQ ID NO: 733265 - DNA, 13 bp, Homo sapiens
taataactgtgta

SEQ ID NO: 733266 - DNA, 13 bp, Homo sapiens
ttattactgttta

SEQ ID NO: 733267 - DNA, 14 bp, Homo sapiens
ttattacttctgtt

SEQ ID NO: 733268 - DNA, 10 bp, Homo sapiens
ttattagaac

SEQ ID NO: 733269 - DNA, 13 bp, Homo sapiens
ttattagaacatt

SEQ ID NO: 733270 - DNA, 20 bp, Homo sapiens
ttattagcaaggctgggtaa

SEQ ID NO: 733271 - DNA, 23 bp, Homo sapiens
ttattagggagaaaattcaattg

SEQ ID NO: 733272 - DNA, 13 bp, Homo sapiens
ttattataaaaat

SEQ ID NO: 733273 - DNA, 12 bp, Homo sapiens
ttattataaact

SEQ ID NO: 733274 - DNA, 13 bp, Homo sapiens
ttattatataaat

SEQ ID NO: 733275 - DNA, 16 bp, Homo sapiens
ttattatattcagagt

SEQ ID NO: 733276 - DNA, 17 bp, Homo sapiens
ttattatatttgacatg

SEQ ID NO: 733277 - DNA, 22 bp, Homo sapiens
ttattatatttgacatgggtat

SEQ ID NO: 733278 - DNA, 16 bp, Homo sapiens
ttattatctaaagtgt

SEQ ID NO: 733279 - DNA, 22 bp, Homo sapiens
ttattatctaaagtgtgttgtt

SEQ ID NO: 733280 - DNA, 12 bp, Homo sapiens
ttattatgcatg

SEQ ID NO: 733281 - DNA, 13 bp, Homo sapiens
ttattatgcatga

SEQ ID NO: 733282 - DNA, 14 bp, Homo sapiens
ttattattcctagt

SEQ ID NO: 733283 - DNA, 16 bp, Homo sapiens
ttattattgaaattgt

SEQ ID NO: 733284 - DNA, 15 bp, Homo sapiens
ttattattgctgaag

SEQ ID NO: 733285 - DNA, 13 bp, Homo sapiens
ttattatttctgt

SEQ ID NO: 733286 - DNA, 13 bp, Homo sapiens
ttattcaaagaga

SEQ ID NO: 733287 - DNA, 14 bp, Homo sapiens
ttattcaaagagaa

SEQ ID NO: 733288 - DNA, 20 bp, Homo sapiens
ttattcaaagagaaaacatc

SEQ ID NO: 733289 - DNA, 23 bp, Homo sapiens
ttattcaaagagaaaacatctca

SEQ ID NO: 733290 - DNA, 15 bp, Homo sapiens
ttattcaaatgaagg

SEQ ID NO: 733291 - DNA, 17 bp, Homo sapiens
ttattcaagaatgaaaa

SEQ ID NO: 733292 - DNA, 17 bp, Homo sapiens
ttattcaatttatttga

SEQ ID NO: 733293 - DNA, 19 bp, Homo sapiens
ttattcactgtaagtttat

SEQ ID NO: 733294 - DNA, 18 bp, Homo sapiens
ttattcagaactatttaa

SEQ ID NO: 733295 - DNA, 17 bp, Homo sapiens
ttattcagctagaattt

SEQ ID NO: 733296 - DNA, 15 bp, Homo sapiens
ttattcagcttcatt

SEQ ID NO: 733297 - DNA, 18 bp, Homo sapiens
ttattcagtagtttgagg

SEQ ID NO: 733298 - DNA, 21 bp, Homo sapiens
ttattcagtgaatttgtccat

SEQ ID NO: 733299 - DNA, 22 bp, Homo sapiens
ttattcataatgaattataaca

SEQ ID NO: 733300 - DNA, 22 bp, Homo sapiens
ttattcatgccatctgttttca

SEQ ID NO: 733301 - DNA, 16 bp, Homo sapiens
ttattcattattcctc

SEQ ID NO: 733302 - DNA, 13 bp, Homo sapiens
ttattcatttaaa

SEQ ID NO: 733303 - DNA, 18 bp, Homo sapiens
ttattcatttaaaatgat

SEQ ID NO: 733304 - DNA, 20 bp, Homo sapiens
ttattcatttaaaatgatta

SEQ ID NO: 733305 - DNA, 15 bp, Homo sapiens
ttattcatttggtga

SEQ ID NO: 733306 - DNA, 22 bp, Homo sapiens
ttattccaagggaatattgcca

SEQ ID NO: 733307 - DNA, 20 bp, Homo sapiens
ttattcccaagtatgcctta

SEQ ID NO: 733308 - DNA, 13 bp, Homo sapiens
ttattccgagaat

SEQ ID NO: 733309 - DNA, 15 bp, Homo sapiens
taatacttaaataaa

SEQ ID NO: 733310 - DNA, 17 bp, Homo sapiens
taatacttcatttggtg

SEQ ID NO: 733311 - DNA, 14 bp, Homo sapiens
taatagaataaagg

SEQ ID NO: 733312 - DNA, 21 bp, Homo sapiens
taatagaatataattatcgga

SEQ ID NO: 733313 - DNA, 16 bp, Homo sapiens
taatagaatgataaat

SEQ ID NO: 733314 - DNA, 19 bp, Homo sapiens
taatagactgagtcagatg

SEQ ID NO: 733315 - DNA, 16 bp, Homo sapiens
taatagacttctctta

SEQ ID NO: 733316 - DNA, 19 bp, Homo sapiens
taatagacttctcttacat

SEQ ID NO: 733317 - DNA, 21 bp, Homo sapiens
taatagatgtttgatagattt

SEQ ID NO: 733318 - DNA, 13 bp, Homo sapiens
taatagcaaagaa

SEQ ID NO: 733319 - DNA, 18 bp, Homo sapiens
taatagcactaaccaatg

SEQ ID NO: 733320 - DNA, 23 bp, Homo sapiens
taatagcactaaccaatgccttt

SEQ ID NO: 733321 - DNA, 14 bp, Homo sapiens
taatagcagccttt

SEQ ID NO: 733322 - DNA, 15 bp, Homo sapiens
taatagcagcctttc

SEQ ID NO: 733323 - DNA, 22 bp, Homo sapiens
taatagcgggttactttcacat

SEQ ID NO: 733324 - DNA, 15 bp, Homo sapiens
taataggcattttaa

SEQ ID NO: 733325 - DNA, 18 bp, Homo sapiens
taatagggaaaattctaa

SEQ ID NO: 733326 - DNA, 17 bp, Homo sapiens
taataggtagtttggat

SEQ ID NO: 733327 - DNA, 13 bp, Homo sapiens
taatagtgctttt

SEQ ID NO: 733328 - DNA, 19 bp, Homo sapiens
taatagttagccctcagtc

SEQ ID NO: 733329 - DNA, 19 bp, Homo sapiens
taatagtttacatgtagta

SEQ ID NO: 733330 - DNA, 14 bp, Homo sapiens
taatagtttatctt

SEQ ID NO: 733331 - DNA, 23 bp, Homo sapiens
taatagtttgaacagatatgttt

SEQ ID NO: 733332 - DNA, 13 bp, Homo sapiens
taatagtttgtct

SEQ ID NO: 733333 - DNA, 17 bp, Homo sapiens
taatagtttgtctattt

SEQ ID NO: 733334 - DNA, 21 bp, Homo sapiens
taatagtttttcactttgtgt

SEQ ID NO: 733335 - DNA, 21 bp, Homo sapiens
taatataaagtagtcctgtga

SEQ ID NO: 733336 - DNA, 13 bp, Homo sapiens
taatataaattca

SEQ ID NO: 733337 - DNA, 21 bp, Homo sapiens
taatataaattcactttcatt

SEQ ID NO: 733338 - DNA, 13 bp, Homo sapiens
taatataaattta

SEQ ID NO: 733339 - DNA, 19 bp, Homo sapiens
taatataaatttaagcaaa

SEQ ID NO: 733340 - DNA, 17 bp, Homo sapiens
taatataacttgaaaat

SEQ ID NO: 733341 - DNA, 16 bp, Homo sapiens
taatataccccaaatt

SEQ ID NO: 733342 - DNA, 19 bp, Homo sapiens
taatataccccaaattgtg

SEQ ID NO: 733343 - DNA, 15 bp, Homo sapiens
taatatataaacaat

SEQ ID NO: 733344 - DNA, 16 bp, Homo sapiens
taatatatatgaataa

SEQ ID NO: 733345 - DNA, 13 bp, Homo sapiens
taatatatcaata

SEQ ID NO: 733346 - DNA, 12 bp, Homo sapiens
taatatattaaa

SEQ ID NO: 733347 - DNA, 16 bp, Homo sapiens
taatatattgtacaaa

SEQ ID NO: 733348 - DNA, 13 bp, Homo sapiens
taatatattttct

SEQ ID NO: 733349 - DNA, 22 bp, Homo sapiens
taatatcaaaacaagtactggt

SEQ ID NO: 733350 - DNA, 16 bp, Homo sapiens
taatatcaaataaaat

SEQ ID NO: 733351 - DNA, 16 bp, Homo sapiens
taatatcaactctgaa

SEQ ID NO: 733352 - DNA, 14 bp, Homo sapiens
taatatcactcatt

SEQ ID NO: 733353 - DNA, 23 bp, Homo sapiens
taatatcccactgggagaaagga

SEQ ID NO: 733354 - DNA, 15 bp, Homo sapiens
taatatcctaaacat

SEQ ID NO: 733355 - DNA, 22 bp, Homo sapiens
taatatcttgctggattaatgt

SEQ ID NO: 733356 - DNA, 15 bp, Homo sapiens
taatatctttctgca

SEQ ID NO: 733357 - DNA, 22 bp, Homo sapiens
taatatctttctgcacacaaat

SEQ ID NO: 733358 - DNA, 16 bp, Homo sapiens
taatatgaaaacttat

SEQ ID NO: 733359 - DNA, 15 bp, Homo sapiens
taatatgagcttcaa

SEQ ID NO: 733360 - DNA, 22 bp, Homo sapiens
taatatgagcttcaatataaga

SEQ ID NO: 733361 - DNA, 16 bp, Homo sapiens
taatatgcacacattt

SEQ ID NO: 733362 - DNA, 16 bp, Homo sapiens
taatatggcaaaaatg

SEQ ID NO: 733363 - DNA, 19 bp, Homo sapiens
taatatgggcattgtagtt

SEQ ID NO: 733364 - DNA, 20 bp, Homo sapiens
taatatgttaacctcagtgt

SEQ ID NO: 733365 - DNA, 23 bp, Homo sapiens
taatatgttaacctcagtgtcat

SEQ ID NO: 733366 - DNA, 12 bp, Homo sapiens
taatatgtttag

SEQ ID NO: 733367 - DNA, 14 bp, Homo sapiens
taatatgtttagtt

SEQ ID NO: 733368 - DNA, 22 bp, Homo sapiens
taatattaaaaatatggaactt

SEQ ID NO: 733369 - DNA, 14 bp, Homo sapiens
taatattaactttt

SEQ ID NO: 733370 - DNA, 17 bp, Homo sapiens
taatattaacttttaat

SEQ ID NO: 733371 - DNA, 20 bp, Homo sapiens
taatattaacttttaatggt

SEQ ID NO: 733372 - DNA, 20 bp, Homo sapiens
taatattaaggaagacaatg

SEQ ID NO: 733373 - DNA, 18 bp, Homo sapiens
taatattagtgattctga

SEQ ID NO: 733374 - DNA, 23 bp, Homo sapiens
taatattagttggctttcataaa

SEQ ID NO: 733375 - DNA, 11 bp, Homo sapiens
taatattatta

SEQ ID NO: 733376 - DNA, 20 bp, Homo sapiens
taatattatttatctaaagt

SEQ ID NO: 733377 - DNA, 18 bp, Homo sapiens
taatattcagccagctta

SEQ ID NO: 733378 - DNA, 21 bp, Homo sapiens
taatattcagccagcttaaac

SEQ ID NO: 733379 - DNA, 23 bp, Homo sapiens
taatattccagaagaacaacttt

SEQ ID NO: 733380 - DNA, 17 bp, Homo sapiens
taatattcctatatgta

SEQ ID NO: 733381 - DNA, 22 bp, Homo sapiens
taatattcttttgtttccatgg

SEQ ID NO: 733382 - DNA, 14 bp, Homo sapiens
taatattgagaatc

SEQ ID NO: 733383 - DNA, 21 bp, Homo sapiens
taatattgatatgcttataca

SEQ ID NO: 733384 - DNA, 12 bp, Homo sapiens
taatattgtaaa

SEQ ID NO: 733385 - DNA, 12 bp, Homo sapiens
taatatttctta

SEQ ID NO: 733386 - DNA, 17 bp, Homo sapiens
taatatttcttaatttg

SEQ ID NO: 733387 - DNA, 14 bp, Homo sapiens
taatatttgctgac

SEQ ID NO: 733388 - DNA, 18 bp, Homo sapiens
ttatttaatgaaagactg

SEQ ID NO: 733389 - DNA, 12 bp, Homo sapiens
ttatttaatgtt

SEQ ID NO: 733390 - DNA, 11 bp, Homo sapiens
ttatttacaag

SEQ ID NO: 733391 - DNA, 21 bp, Homo sapiens
ttatttacactggtctaatgt

SEQ ID NO: 733392 - DNA, 15 bp, Homo sapiens
ttatttacagatgaa

SEQ ID NO: 733393 - DNA, 20 bp, Homo sapiens
ttatttacagatgaatgtat

SEQ ID NO: 733394 - DNA, 16 bp, Homo sapiens
ttatttacatttaata

SEQ ID NO: 733395 - DNA, 18 bp, Homo sapiens
ttatttacgcttttattg

SEQ ID NO: 733396 - DNA, 15 bp, Homo sapiens
ttatttactgctagt

SEQ ID NO: 733397 - DNA, 12 bp, Homo sapiens
ttatttagagat

SEQ ID NO: 733398 - DNA, 21 bp, Homo sapiens
ttatttagggaactgcttgac

SEQ ID NO: 733399 - DNA, 20 bp, Homo sapiens
ttatttagttgaaaaatcta

SEQ ID NO: 733400 - DNA, 20 bp, Homo sapiens
ttatttatcaaaatgtagct

SEQ ID NO: 733401 - DNA, 18 bp, Homo sapiens
ttatttatcagtgacaga

SEQ ID NO: 733402 - DNA, 23 bp, Homo sapiens
ttatttatgcgtaatttaatggg

SEQ ID NO: 733403 - DNA, 13 bp, Homo sapiens
ttatttattaaga

SEQ ID NO: 733404 - DNA, 17 bp, Homo sapiens
ttatttattcagcttca

SEQ ID NO: 733405 - DNA, 15 bp, Homo sapiens
ttatttattgttaaa

SEQ ID NO: 733406 - DNA, 13 bp, Homo sapiens
ttatttatttaat

SEQ ID NO: 733407 - DNA, 12 bp, Homo sapiens
ttatttatttct

SEQ ID NO: 733408 - DNA, 23 bp, Homo sapiens
ttatttcaaaatatacattcaaa

SEQ ID NO: 733409 - DNA, 14 bp, Homo sapiens
ttatttcacttgat

SEQ ID NO: 733410 - DNA, 13 bp, Homo sapiens
ttatttcagtgtg

SEQ ID NO: 733411 - DNA, 15 bp, Homo sapiens
ttatttcataccatt

SEQ ID NO: 733412 - DNA, 20 bp, Homo sapiens
ttatttcatcatattataca

SEQ ID NO: 733413 - DNA, 11 bp, Homo sapiens
ttatttcatga

SEQ ID NO: 733414 - DNA, 17 bp, Homo sapiens
ttatttccaaataaaat

SEQ ID NO: 733415 - DNA, 18 bp, Homo sapiens
ttatttccagtgttctat

SEQ ID NO: 733416 - DNA, 10 bp, Homo sapiens
ttatttccta

SEQ ID NO: 733417 - DNA, 17 bp, Homo sapiens
ttatttcctatcataaa

SEQ ID NO: 733418 - DNA, 18 bp, Homo sapiens
ttatttctagctttttaa

SEQ ID NO: 733419 - DNA, 18 bp, Homo sapiens
ttatttctagtccaaaat

SEQ ID NO: 733420 - DNA, 22 bp, Homo sapiens
ttatttctagtccaaaattaca

SEQ ID NO: 733421 - DNA, 11 bp, Homo sapiens
ttatttctcat

SEQ ID NO: 733422 - DNA, 19 bp, Homo sapiens
ttatttctcgggtgcattt

SEQ ID NO: 733423 - DNA, 14 bp, Homo sapiens
ttatttctgtattt

SEQ ID NO: 733424 - DNA, 15 bp, Homo sapiens
ttatttcttctctta

SEQ ID NO: 733425 - DNA, 14 bp, Homo sapiens
ttatttctttatta

SEQ ID NO: 733426 - DNA, 15 bp, Homo sapiens
ttatttcttttactt

SEQ ID NO: 733427 - DNA, 12 bp, Homo sapiens
ttatttgatatc

SEQ ID NO: 733428 - DNA, 16 bp, Homo sapiens
ttatttgcatgttatg

SEQ ID NO: 733429 - DNA, 18 bp, Homo sapiens
ttatttgccagagccaaa

SEQ ID NO: 733430 - DNA, 19 bp, Homo sapiens
ttatttgctaagcatattt

SEQ ID NO: 733431 - DNA, 16 bp, Homo sapiens
ttatttggaaatttta

SEQ ID NO: 733432 - DNA, 21 bp, Homo sapiens
ttatttggagcctgccaagag

SEQ ID NO: 733433 - DNA, 21 bp, Homo sapiens
ttatttgtaaaccattgtaac

SEQ ID NO: 733434 - DNA, 16 bp, Homo sapiens
ttatttgtaatagatg

SEQ ID NO: 733435 - DNA, 15 bp, Homo sapiens
ttatttgtctgtaaa

SEQ ID NO: 733436 - DNA, 22 bp, Homo sapiens
ttatttgtcttaaaaaatgtga

SEQ ID NO: 733437 - DNA, 19 bp, Homo sapiens
taatcccagcactttggga

SEQ ID NO: 733438 - DNA, 17 bp, Homo sapiens
taatcccattgcaaaca

SEQ ID NO: 733439 - DNA, 13 bp, Homo sapiens
taatcccatttcc

SEQ ID NO: 733440 - DNA, 21 bp, Homo sapiens
taatcccctgcactaggcagg

SEQ ID NO: 733441 - DNA, 17 bp, Homo sapiens
taatccctgctttttgt

SEQ ID NO: 733442 - DNA, 14 bp, Homo sapiens
taatccctgggcat

SEQ ID NO: 733443 - DNA, 20 bp, Homo sapiens
taatccttctagtttcccac

SEQ ID NO: 733444 - DNA, 15 bp, Homo sapiens
taatccttgataata

SEQ ID NO: 733445 - DNA, 18 bp, Homo sapiens
taatcctttgttttctga

SEQ ID NO: 733446 - DNA, 16 bp, Homo sapiens
taatcgtgtcccctat

SEQ ID NO: 733447 - DNA, 22 bp, Homo sapiens
taatcgtgtgccatggatctga

SEQ ID NO: 733448 - DNA, 20 bp, Homo sapiens
taatctagtttacagaaaaa

SEQ ID NO: 733449 - DNA, 15 bp, Homo sapiens
taatctatattaaat

SEQ ID NO: 733450 - DNA, 16 bp, Homo sapiens
taatctatattaaatg

SEQ ID NO: 733451 - DNA, 22 bp, Homo sapiens
taatctatgtgtttctgtaaca

SEQ ID NO: 733452 - DNA, 19 bp, Homo sapiens
taatctattgggttcatta

SEQ ID NO: 733453 - DNA, 22 bp, Homo sapiens
taatctattgggttcattattg

SEQ ID NO: 733454 - DNA, 19 bp, Homo sapiens
taatctatttctatgagaa

SEQ ID NO: 733455 - DNA, 21 bp, Homo sapiens
taatctcaaagagattcgaat

SEQ ID NO: 733456 - DNA, 16 bp, Homo sapiens
taatctcaaaggagaa

SEQ ID NO: 733457 - DNA, 16 bp, Homo sapiens
taatctcagtgctttc

SEQ ID NO: 733458 - DNA, 13 bp, Homo sapiens
taatctccacagt

SEQ ID NO: 733459 - DNA, 21 bp, Homo sapiens
taatctcctctgctcattaaa

SEQ ID NO: 733460 - DNA, 22 bp, Homo sapiens
taatctcctctgctcattaaac

SEQ ID NO: 733461 - DNA, 20 bp, Homo sapiens
taatctctctgcagctgccg

SEQ ID NO: 733462 - DNA, 17 bp, Homo sapiens
taatctctgtaaagcta

SEQ ID NO: 733463 - DNA, 15 bp, Homo sapiens
taatctcttattcta

SEQ ID NO: 733464 - DNA, 21 bp, Homo sapiens
taatctgaataaagtgtaaca

SEQ ID NO: 733465 - DNA, 16 bp, Homo sapiens
taatctgcctggtttt

SEQ ID NO: 733466 - DNA, 19 bp, Homo sapiens
taatctggaaggcccctcc

SEQ ID NO: 733467 - DNA, 15 bp, Homo sapiens
taatctggactcctc

SEQ ID NO: 733468 - DNA, 20 bp, Homo sapiens
taatctggactcctctgtcc

SEQ ID NO: 733469 - DNA, 18 bp, Homo sapiens
taatctgtcaaaacactg

SEQ ID NO: 733470 - DNA, 19 bp, Homo sapiens
taatctgtcaaaacactgt

SEQ ID NO: 733471 - DNA, 20 bp, Homo sapiens
taatctgtcaaaacactgtg

SEQ ID NO: 733472 - DNA, 22 bp, Homo sapiens
taatctgtcaaaacactgtgga

SEQ ID NO: 733473 - DNA, 14 bp, Homo sapiens
taatctgtgtacaa

SEQ ID NO: 733474 - DNA, 13 bp, Homo sapiens
taatctgttatgt

SEQ ID NO: 733475 - DNA, 20 bp, Homo sapiens
taatctgtttgtgcaaacat

SEQ ID NO: 733476 - DNA, 20 bp, Homo sapiens
taatcttaggggagagcttt

SEQ ID NO: 733477 - DNA, 13 bp, Homo sapiens
taatcttagtgta

SEQ ID NO: 733478 - DNA, 15 bp, Homo sapiens
taatcttagtgtatg

SEQ ID NO: 733479 - DNA, 18 bp, Homo sapiens
taatcttagtgtatgatt

SEQ ID NO: 733480 - DNA, 15 bp, Homo sapiens
taatcttataattgt

SEQ ID NO: 733481 - DNA, 22 bp, Homo sapiens
taatcttataattgttctcaga

SEQ ID NO: 733482 - DNA, 15 bp, Homo sapiens
taatcttatacaaca

SEQ ID NO: 733483 - DNA, 13 bp, Homo sapiens
taatcttattagg

SEQ ID NO: 733484 - DNA, 22 bp, Homo sapiens
taatcttattcattttctctaa

SEQ ID NO: 733485 - DNA, 15 bp, Homo sapiens
taatcttatttagga

SEQ ID NO: 733486 - DNA, 15 bp, Homo sapiens
taatcttcaggtgaa

SEQ ID NO: 733487 - DNA, 17 bp, Homo sapiens
taatcttgctttcttta

SEQ ID NO: 733488 - DNA, 22 bp, Homo sapiens
taatcttgctttctttagaatt

SEQ ID NO: 733489 - DNA, 18 bp, Homo sapiens
taatcttggcttcttaaa

SEQ ID NO: 733490 - DNA, 23 bp, Homo sapiens
taatcttggcttcttaaaaactg

SEQ ID NO: 733491 - DNA, 16 bp, Homo sapiens
taatctttcaaaccag

SEQ ID NO: 733492 - DNA, 17 bp, Homo sapiens
taatctttcacttgaaa

SEQ ID NO: 733493 - DNA, 20 bp, Homo sapiens
taatctttcacttgaaagat

SEQ ID NO: 733494 - DNA, 13 bp, Homo sapiens
taatctttttctc

SEQ ID NO: 733495 - DNA, 20 bp, Homo sapiens
taatgaaaaacaaaaagcta

SEQ ID NO: 733496 - DNA, 14 bp, Homo sapiens
taatgaaaaataca

SEQ ID NO: 733497 - DNA, 16 bp, Homo sapiens
taatgaaaacaatgca

SEQ ID NO: 733498 - DNA, 16 bp, Homo sapiens
taatgaaaaggaagtt

SEQ ID NO: 733499 - DNA, 14 bp, Homo sapiens
taatgaaaatgtca

SEQ ID NO: 733500 - DNA, 23 bp, Homo sapiens
taatgaaacaaagagttcaagaa

SEQ ID NO: 733501 - DNA, 20 bp, Homo sapiens
taatgaaacaccttctctgg

SEQ ID NO: 733502 - DNA, 18 bp, Homo sapiens
taatgaaagactgtacaa

SEQ ID NO: 733503 - DNA, 17 bp, Homo sapiens
taatgaaataatcagtg

SEQ ID NO: 733504 - DNA, 19 bp, Homo sapiens
taatgaaatgataaagact

SEQ ID NO: 733505 - DNA, 16 bp, Homo sapiens
taatgaaatgtttact

SEQ ID NO: 733506 - DNA, 14 bp, Homo sapiens
taatgaacaaaatt

SEQ ID NO: 733507 - DNA, 16 bp, Homo sapiens
taatgaagaaagtgga

SEQ ID NO: 733508 - DNA, 14 bp, Homo sapiens
taatgaagaatcac

SEQ ID NO: 733509 - DNA, 16 bp, Homo sapiens
taatgaattataacag

SEQ ID NO: 733510 - DNA, 16 bp, Homo sapiens
ttcaaaatcagttttt

SEQ ID NO: 733511 - DNA, 17 bp, Homo sapiens
ttcaaaatgttctattt

SEQ ID NO: 733512 - DNA, 20 bp, Homo sapiens
ttcaaaatgttctatttaac

SEQ ID NO: 733513 - DNA, 18 bp, Homo sapiens
ttcaaaattaatagcttt

SEQ ID NO: 733514 - DNA, 15 bp, Homo sapiens
ttcaaacattttgta

SEQ ID NO: 733515 - DNA, 22 bp, Homo sapiens
ttcaaacattttgtatcaagga

SEQ ID NO: 733516 - DNA, 20 bp, Homo sapiens
ttcaaaccaatttcttcctt

SEQ ID NO: 733517 - DNA, 23 bp, Homo sapiens
ttcaaaccaatttcttccttcca

SEQ ID NO: 733518 - DNA, 17 bp, Homo sapiens
ttcaaactactgtacat

SEQ ID NO: 733519 - DNA, 20 bp, Homo sapiens
ttcaaactactgtacatttt

SEQ ID NO: 733520 - DNA, 19 bp, Homo sapiens
ttcaaactgagtaaattgg

SEQ ID NO: 733521 - DNA, 15 bp, Homo sapiens
ttcaaagactgtgaa

SEQ ID NO: 733522 - DNA, 21 bp, Homo sapiens
ttcaaagagatgggccttttc

SEQ ID NO: 733523 - DNA, 18 bp, Homo sapiens
ttcaaagaggtgaacatt

SEQ ID NO: 733524 - DNA, 23 bp, Homo sapiens
ttcaaagcatggacatttagaag

SEQ ID NO: 733525 - DNA, 23 bp, Homo sapiens
ttcaaagccaagtttatatacaa

SEQ ID NO: 733526 - DNA, 13 bp, Homo sapiens
ttcaaagccagcg

SEQ ID NO: 733527 - DNA, 20 bp, Homo sapiens
ttcaaagccctgcctctgtg

SEQ ID NO: 733528 - DNA, 22 bp, Homo sapiens
ttcaaagctaaaaaattgttaa

SEQ ID NO: 733529 - DNA, 18 bp, Homo sapiens
ttcaaagctgaatatttt

SEQ ID NO: 733530 - DNA, 20 bp, Homo sapiens
ttcaaagctgtgtgtttgga

SEQ ID NO: 733531 - DNA, 23 bp, Homo sapiens
ttcaaagctgtgtgtttggaaga

SEQ ID NO: 733532 - DNA, 17 bp, Homo sapiens
ttcaaagcttaaaaaga

SEQ ID NO: 733533 - DNA, 23 bp, Homo sapiens
ttcaaataaagaaatttggtacc

SEQ ID NO: 733534 - DNA, 11 bp, Homo sapiens
ttcaaataatc

SEQ ID NO: 733535 - DNA, 13 bp, Homo sapiens
ttcaaatcagtga

SEQ ID NO: 733536 - DNA, 12 bp, Homo sapiens
ttcaaatgtacc

SEQ ID NO: 733537 - DNA, 11 bp, Homo sapiens
ttcaaatgtgc

SEQ ID NO: 733538 - DNA, 14 bp, Homo sapiens
ttcaaatgtgctgt

SEQ ID NO: 733539 - DNA, 17 bp, Homo sapiens
ttcaaatgttttaaagt

SEQ ID NO: 733540 - DNA, 19 bp, Homo sapiens
ttcaaattagaagacattt

SEQ ID NO: 733541 - DNA, 15 bp, Homo sapiens
ttcaaattgctgctt

SEQ ID NO: 733542 - DNA, 18 bp, Homo sapiens
ttcaaattgctgcttgga

SEQ ID NO: 733543 - DNA, 17 bp, Homo sapiens
ttcaaattggtctgaaa

SEQ ID NO: 733544 - DNA, 13 bp, Homo sapiens
ttcaaatttcaca

SEQ ID NO: 733545 - DNA, 12 bp, Homo sapiens
ttcaaatttgta

SEQ ID NO: 733546 - DNA, 14 bp, Homo sapiens
ttcaaatttgtaca

SEQ ID NO: 733547 - DNA, 12 bp, Homo sapiens
ttcaacaaacat

SEQ ID NO: 733548 - DNA, 20 bp, Homo sapiens
ttcaacaaacatttgctgaa

SEQ ID NO: 733549 - DNA, 19 bp, Homo sapiens
ttcaacactgaaaaaatac

SEQ ID NO: 733550 - DNA, 23 bp, Homo sapiens
ttcaacagaccccctctagaaat

SEQ ID NO: 733551 - DNA, 23 bp, Homo sapiens
ttcaacagatgaccgtgtacaat

SEQ ID NO: 733552 - DNA, 16 bp, Homo sapiens
ttcaacatcaatgttc

SEQ ID NO: 733553 - DNA, 17 bp, Homo sapiens
ttcaacatgttatttgt

SEQ ID NO: 733554 - DNA, 19 bp, Homo sapiens
ttcaaccactgtaaaatga

SEQ ID NO: 733555 - DNA, 16 bp, Homo sapiens
ttcaaccataaaagaa

SEQ ID NO: 733556 - DNA, 19 bp, Homo sapiens
ttcaacctggtggcaccag

SEQ ID NO: 733557 - DNA, 19 bp, Homo sapiens
ttcaacgcagccctgcttt

SEQ ID NO: 733558 - DNA, 20 bp, Homo sapiens
ttcaacgcagccctgctttg

SEQ ID NO: 733559 - DNA, 16 bp, Homo sapiens
ttcaacggaaagtgct

SEQ ID NO: 733560 - DNA, 19 bp, Homo sapiens
ttcaactggttagtgtgaa

SEQ ID NO: 733561 - DNA, 23 bp, Homo sapiens
ttcaactgtgctcttgttttgtc

SEQ ID NO: 733562 - DNA, 16 bp, Homo sapiens
ttcaacttttctaaga

SEQ ID NO: 733563 - DNA, 14 bp, Homo sapiens
ttcaagaaaatctt

SEQ ID NO: 733564 - DNA, 14 bp, Homo sapiens
taatgcttttatat

SEQ ID NO: 733565 - DNA, 14 bp, Homo sapiens
taatgctttttaga

SEQ ID NO: 733566 - DNA, 19 bp, Homo sapiens
taatgctttttagaaagca

SEQ ID NO: 733567 - DNA, 14 bp, Homo sapiens
taatggaaaaatag

SEQ ID NO: 733568 - DNA, 18 bp, Homo sapiens
taatggaaacattacagt

SEQ ID NO: 733569 - DNA, 17 bp, Homo sapiens
taatggacagattaata

SEQ ID NO: 733570 - DNA, 23 bp, Homo sapiens
taatggacatgagataatgttag

SEQ ID NO: 733571 - DNA, 14 bp, Homo sapiens
taatggactgtgaa

SEQ ID NO: 733572 - DNA, 15 bp, Homo sapiens
taatggatatttctc

SEQ ID NO: 733573 - DNA, 22 bp, Homo sapiens
taatggattataatcagaatgg

SEQ ID NO: 733574 - DNA, 14 bp, Homo sapiens
taatggatttttga

SEQ ID NO: 733575 - DNA, 17 bp, Homo sapiens
taatggcagctagtgcc

SEQ ID NO: 733576 - DNA, 20 bp, Homo sapiens
taatggcagctagtgccttt

SEQ ID NO: 733577 - DNA, 15 bp, Homo sapiens
taatggcagttatat

SEQ ID NO: 733578 - DNA, 16 bp, Homo sapiens
taatggcatgtcagac

SEQ ID NO: 733579 - DNA, 17 bp, Homo sapiens
taatggccggctggaaa

SEQ ID NO: 733580 - DNA, 23 bp, Homo sapiens
taatggccggctggaaatgctgg

SEQ ID NO: 733581 - DNA, 14 bp, Homo sapiens
taatgggcctgccc

SEQ ID NO: 733582 - DNA, 18 bp, Homo sapiens
taatgggggtagcagctg

SEQ ID NO: 733583 - DNA, 15 bp, Homo sapiens
taatggggtcctggc

SEQ ID NO: 733584 - DNA, 17 bp, Homo sapiens
taatggggtcctggcca

SEQ ID NO: 733585 - DNA, 17 bp, Homo sapiens
taatggggtctgtaaat

SEQ ID NO: 733586 - DNA, 19 bp, Homo sapiens
taatggtactgactttgct

SEQ ID NO: 733587 - DNA, 22 bp, Homo sapiens
taatggtatcatattaacatat

SEQ ID NO: 733588 - DNA, 20 bp, Homo sapiens
taatggtatcctactgagca

SEQ ID NO: 733589 - DNA, 22 bp, Homo sapiens
taatggttaagaactgtgaaat

SEQ ID NO: 733590 - DNA, 14 bp, Homo sapiens
taatggttgtgaaa

SEQ ID NO: 733591 - DNA, 15 bp, Homo sapiens
taatggttgtgaaat

SEQ ID NO: 733592 - DNA, 21 bp, Homo sapiens
taatggttgtgaaatgtaaca

SEQ ID NO: 733593 - DNA, 22 bp, Homo sapiens
taatggtttttatttctcgggt

SEQ ID NO: 733594 - DNA, 17 bp, Homo sapiens
taatgtaaaatgttgaa

SEQ ID NO: 733595 - DNA, 19 bp, Homo sapiens
taatgtaaagaacttaaat

SEQ ID NO: 733596 - DNA, 17 bp, Homo sapiens
taatgtaagctctactg

SEQ ID NO: 733597 - DNA, 18 bp, Homo sapiens
taatgtactgatttcagt

SEQ ID NO: 733598 - DNA, 18 bp, Homo sapiens
taatgtactgtacataaa

SEQ ID NO: 733599 - DNA, 19 bp, Homo sapiens
taatgtactgtacataaat

SEQ ID NO: 733600 - DNA, 21 bp, Homo sapiens
taatgtactgtacataaattc

SEQ ID NO: 733601 - DNA, 16 bp, Homo sapiens
taatgtaggactgtat

SEQ ID NO: 733602 - DNA, 17 bp, Homo sapiens
taatgtaggactgtata

SEQ ID NO: 733603 - DNA, 17 bp, Homo sapiens
taatgtagggttatatt

SEQ ID NO: 733604 - DNA, 22 bp, Homo sapiens
taatgtagggttatatttggga

SEQ ID NO: 733605 - DNA, 16 bp, Homo sapiens
taatgtatataaaaat

SEQ ID NO: 733606 - DNA, 14 bp, Homo sapiens
taatgtatatttgc

SEQ ID NO: 733607 - DNA, 18 bp, Homo sapiens
taatgtatatttgctgca

SEQ ID NO: 733608 - DNA, 15 bp, Homo sapiens
taatgtatctatttg

SEQ ID NO: 733609 - DNA, 21 bp, Homo sapiens
taatgtatctatttgtacaat

SEQ ID NO: 733610 - DNA, 16 bp, Homo sapiens
taatgtatgttaccaa

SEQ ID NO: 733611 - DNA, 14 bp, Homo sapiens
taatgtatttgaaa

SEQ ID NO: 733612 - DNA, 17 bp, Homo sapiens
taatgtatttgaaaatt

SEQ ID NO: 733613 - DNA, 16 bp, Homo sapiens
taatgtattttcagct

SEQ ID NO: 733614 - DNA, 21 bp, Homo sapiens
taatgtattttcagctcaatt

SEQ ID NO: 733615 - DNA, 21 bp, Homo sapiens
taatgtcaccaccttcccagc

SEQ ID NO: 733616 - DNA, 11 bp, Homo sapiens
taatgtcactg

SEQ ID NO: 733617 - DNA, 11 bp, Homo sapiens
taatgtcagac

SEQ ID NO: 733618 - DNA, 17 bp, Homo sapiens
taatgtcataaagtgag

SEQ ID NO: 733619 - DNA, 18 bp, Homo sapiens
taatgtccctttcagaga

SEQ ID NO: 733620 - DNA, 16 bp, Homo sapiens
taatgtctcactgttc

SEQ ID NO: 733621 - DNA, 22 bp, Homo sapiens
taatgtctcactgttctgcaaa

SEQ ID NO: 733622 - DNA, 17 bp, Homo sapiens
taatgtctgtttattaa

SEQ ID NO: 733623 - DNA, 17 bp, Homo sapiens
taatgtcttcatttcat

SEQ ID NO: 733624 - DNA, 13 bp, Homo sapiens
taatgtgaaaatc

SEQ ID NO: 733625 - DNA, 16 bp, Homo sapiens
taatgtgaaaatcatc

SEQ ID NO: 733626 - DNA, 22 bp, Homo sapiens
taatgtgaaactggattaaact

SEQ ID NO: 733627 - DNA, 16 bp, Homo sapiens
taatgtgaaggcccaa

SEQ ID NO: 733628 - DNA, 11 bp, Homo sapiens
taatgtgaatt

SEQ ID NO: 733629 - DNA, 21 bp, Homo sapiens
taatgtgaatttttgcctatc

SEQ ID NO: 733630 - DNA, 20 bp, Homo sapiens
taatgtgacagtgttcagta

SEQ ID NO: 733631 - DNA, 23 bp, Homo sapiens
taatgtgaggaactcacatactg

SEQ ID NO: 733632 - DNA, 12 bp, Homo sapiens
ttcaatctctgg

SEQ ID NO: 733633 - DNA, 13 bp, Homo sapiens
ttcaatctctgtt

SEQ ID NO: 733634 - DNA, 17 bp, Homo sapiens
ttcaatctctgttctgc

SEQ ID NO: 733635 - DNA, 15 bp, Homo sapiens
ttcaatctgtaaact

SEQ ID NO: 733636 - DNA, 18 bp, Homo sapiens
ttcaatctgtaaactgtg

SEQ ID NO: 733637 - DNA, 16 bp, Homo sapiens
ttcaatgatagtaaga

SEQ ID NO: 733638 - DNA, 23 bp, Homo sapiens
ttcaatgcatacaataaaagagc

SEQ ID NO: 733639 - DNA, 17 bp, Homo sapiens
ttcaatgggctcttcca

SEQ ID NO: 733640 - DNA, 17 bp, Homo sapiens
ttcaatggttgggacaa

SEQ ID NO: 733641 - DNA, 19 bp, Homo sapiens
ttcaatgtcagcctttgtt

SEQ ID NO: 733642 - DNA, 17 bp, Homo sapiens
ttcaatgtgattcttct

SEQ ID NO: 733643 - DNA, 16 bp, Homo sapiens
ttcaatgtgcataatg

SEQ ID NO: 733644 - DNA, 15 bp, Homo sapiens
ttcaattcaaagctg

SEQ ID NO: 733645 - DNA, 15 bp, Homo sapiens
ttcaattcctggccc

SEQ ID NO: 733646 - DNA, 16 bp, Homo sapiens
ttcaattcctggccct

SEQ ID NO: 733647 - DNA, 22 bp, Homo sapiens
ttcaattctgtaattacatatt

SEQ ID NO: 733648 - DNA, 15 bp, Homo sapiens
ttcaattgcatctcc

SEQ ID NO: 733649 - DNA, 19 bp, Homo sapiens
ttcaattgcatctcccaga

SEQ ID NO: 733650 - DNA, 14 bp, Homo sapiens
ttcaattgtaaatt

SEQ ID NO: 733651 - DNA, 20 bp, Homo sapiens
ttcaattgtattttatatga

SEQ ID NO: 733652 - DNA, 20 bp, Homo sapiens
ttcaatttggatatttggag

SEQ ID NO: 733653 - DNA, 17 bp, Homo sapiens
ttcaattttaaacatat

SEQ ID NO: 733654 - DNA, 21 bp, Homo sapiens
ttcacaaaaggcatctgaact

SEQ ID NO: 733655 - DNA, 22 bp, Homo sapiens
ttcacaacagcctgacaacatt

SEQ ID NO: 733656 - DNA, 20 bp, Homo sapiens
ttcacaacctcaccaaacta

SEQ ID NO: 733657 - DNA, 14 bp, Homo sapiens
ttcacaagcctcct

SEQ ID NO: 733658 - DNA, 20 bp, Homo sapiens
ttcacaagcctcctgtacct

SEQ ID NO: 733659 - DNA, 13 bp, Homo sapiens
ttcacaagctaac

SEQ ID NO: 733660 - DNA, 15 bp, Homo sapiens
ttcacacaactactt

SEQ ID NO: 733661 - DNA, 21 bp, Homo sapiens
ttcacacacaggcaactgagg

SEQ ID NO: 733662 - DNA, 20 bp, Homo sapiens
ttcacacctcacgctctgga

SEQ ID NO: 733663 - DNA, 14 bp, Homo sapiens
ttcacacctgactc

SEQ ID NO: 733664 - DNA, 21 bp, Homo sapiens
ttcacacctgactctgaaatc

SEQ ID NO: 733665 - DNA, 13 bp, Homo sapiens
ttcacagaaaata

SEQ ID NO: 733666 - DNA, 16 bp, Homo sapiens
ttcacagagcacgcct

SEQ ID NO: 733667 - DNA, 17 bp, Homo sapiens
ttcacagctcctcccac

SEQ ID NO: 733668 - DNA, 16 bp, Homo sapiens
ttcacaggcagtgcat

SEQ ID NO: 733669 - DNA, 17 bp, Homo sapiens
ttcacaggtggacaaat

SEQ ID NO: 733670 - DNA, 23 bp, Homo sapiens
ttcacagtacccaaactgctttt

SEQ ID NO: 733671 - DNA, 18 bp, Homo sapiens
ttcacagtagagccagct

SEQ ID NO: 733672 - DNA, 19 bp, Homo sapiens
ttcacagtagagccagctt

SEQ ID NO: 733673 - DNA, 20 bp, Homo sapiens
ttcacagtagagccagcttg

SEQ ID NO: 733674 - DNA, 20 bp, Homo sapiens
ttcacagtgcccaagagtgg

SEQ ID NO: 733675 - DNA, 12 bp, Homo sapiens
ttcacagtgttt

SEQ ID NO: 733676 - DNA, 20 bp, Homo sapiens
ttcacagttctgtaatgtag

SEQ ID NO: 733677 - DNA, 15 bp, Homo sapiens
ttcacataccctccc

SEQ ID NO: 733678 - DNA, 17 bp, Homo sapiens
ttcacatagatgtccct

SEQ ID NO: 733679 - DNA, 18 bp, Homo sapiens
ttcacatctaacctcatc

SEQ ID NO: 733680 - DNA, 19 bp, Homo sapiens
ttcacatctaacctcatct

SEQ ID NO: 733681 - DNA, 20 bp, Homo sapiens
ttcacatctaacctcatctt

SEQ ID NO: 733682 - DNA, 20 bp, Homo sapiens
ttcacatctctggaaattta

SEQ ID NO: 733683 - DNA, 16 bp, Homo sapiens
ttcacattaggctgtt

SEQ ID NO: 733684 - DNA, 14 bp, Homo sapiens
ttcacattattctg

SEQ ID NO: 733685 - DNA, 15 bp, Homo sapiens
ttcacattcttggct

SEQ ID NO: 733686 - DNA, 16 bp, Homo sapiens
ttcacattcttggctt

SEQ ID NO: 733687 - DNA, 17 bp, Homo sapiens
ttcacattgtgtgaata

SEQ ID NO: 733688 - DNA, 17 bp, Homo sapiens
ttcacattgttaagaaa

SEQ ID NO: 733689 - DNA, 19 bp, Homo sapiens
ttcacattgtttgctgcta

SEQ ID NO: 733690 - DNA, 20 bp, Homo sapiens
ttcacattgtttgctgctat

SEQ ID NO: 733691 - DNA, 16 bp, Homo sapiens
taattacgtttaaagt

SEQ ID NO: 733692 - DNA, 22 bp, Homo sapiens
taattacgtttaaagtgcagtc

SEQ ID NO: 733693 - DNA, 14 bp, Homo sapiens
taattagaaatcaa

SEQ ID NO: 733694 - DNA, 21 bp, Homo sapiens
taattagagaactggaggaac

SEQ ID NO: 733695 - DNA, 14 bp, Homo sapiens
taattagatccatt

SEQ ID NO: 733696 - DNA, 23 bp, Homo sapiens
taattagatccattaatttaaat

SEQ ID NO: 733697 - DNA, 21 bp, Homo sapiens
taattaggcaaggctatgtga

SEQ ID NO: 733698 - DNA, 22 bp, Homo sapiens
taattaggcaaggctatgtgat

SEQ ID NO: 733699 - DNA, 14 bp, Homo sapiens
taattagtgccact

SEQ ID NO: 733700 - DNA, 14 bp, Homo sapiens
taattatatttcta

SEQ ID NO: 733701 - DNA, 20 bp, Homo sapiens
taattatcagttggtttgga

SEQ ID NO: 733702 - DNA, 19 bp, Homo sapiens
taattatcggaagcagtgc

SEQ ID NO: 733703 - DNA, 21 bp, Homo sapiens
taattatcggaagcagtgcct

SEQ ID NO: 733704 - DNA, 19 bp, Homo sapiens
taattatcgggaacagtgt

SEQ ID NO: 733705 - DNA, 23 bp, Homo sapiens
taattatcgggaacagtgtttcc

SEQ ID NO: 733706 - DNA, 13 bp, Homo sapiens
taattatgacagt

SEQ ID NO: 733707 - DNA, 16 bp, Homo sapiens
taattattataaaaat

SEQ ID NO: 733708 - DNA, 18 bp, Homo sapiens
taattattataaaaatat

SEQ ID NO: 733709 - DNA, 12 bp, Homo sapiens
taattattattc

SEQ ID NO: 733710 - DNA, 14 bp, Homo sapiens
taattattatttat

SEQ ID NO: 733711 - DNA, 22 bp, Homo sapiens
taattattatttatatatgtat

SEQ ID NO: 733712 - DNA, 17 bp, Homo sapiens
taattattatttccagt

SEQ ID NO: 733713 - DNA, 17 bp, Homo sapiens
taattattatttgtgtt

SEQ ID NO: 733714 - DNA, 14 bp, Homo sapiens
taattatttaaata

SEQ ID NO: 733715 - DNA, 19 bp, Homo sapiens
taattatttatatttcctg

SEQ ID NO: 733716 - DNA, 17 bp, Homo sapiens
taattatttattacata

SEQ ID NO: 733717 - DNA, 12 bp, Homo sapiens
taattcaaagca

SEQ ID NO: 733718 - DNA, 21 bp, Homo sapiens
taattcaaagcaccaaaataa

SEQ ID NO: 733719 - DNA, 20 bp, Homo sapiens
taattcaaggaatttcttaa

SEQ ID NO: 733720 - DNA, 17 bp, Homo sapiens
taattcaaggagaatat

SEQ ID NO: 733721 - DNA, 19 bp, Homo sapiens
taattcacagaatagcaca

SEQ ID NO: 733722 - DNA, 21 bp, Homo sapiens
taattcacagaatagcacaaa

SEQ ID NO: 733723 - DNA, 17 bp, Homo sapiens
taattcaccaaagtatt

SEQ ID NO: 733724 - DNA, 16 bp, Homo sapiens
taattcacctatgtta

SEQ ID NO: 733725 - DNA, 19 bp, Homo sapiens
taattcacctcagcctgga

SEQ ID NO: 733726 - DNA, 19 bp, Homo sapiens
taattcagcactgatttca

SEQ ID NO: 733727 - DNA, 19 bp, Homo sapiens
taattcagcgttatttaag

SEQ ID NO: 733728 - DNA, 14 bp, Homo sapiens
taattcaggttttt

SEQ ID NO: 733729 - DNA, 14 bp, Homo sapiens
taattcatttgtat

SEQ ID NO: 733730 - DNA, 16 bp, Homo sapiens
taattcatttgtattg

SEQ ID NO: 733731 - DNA, 19 bp, Homo sapiens
taattccaatatgatgact

SEQ ID NO: 733732 - DNA, 20 bp, Homo sapiens
taattccacaggtcatcaga

SEQ ID NO: 733733 - DNA, 18 bp, Homo sapiens
taattcccattttgcaaa

SEQ ID NO: 733734 - DNA, 20 bp, Homo sapiens
taattccctatcttttagtt

SEQ ID NO: 733735 - DNA, 21 bp, Homo sapiens
taattcctatatcctgtgact

SEQ ID NO: 733736 - DNA, 19 bp, Homo sapiens
taattcctcaacgtattgt

SEQ ID NO: 733737 - DNA, 22 bp, Homo sapiens
taattccttctgcctaacttgt

SEQ ID NO: 733738 - DNA, 11 bp, Homo sapiens
taattctaaat

SEQ ID NO: 733739 - DNA, 15 bp, Homo sapiens
taattctatgcctgt

SEQ ID NO: 733740 - DNA, 13 bp, Homo sapiens
taattctatttct

SEQ ID NO: 733741 - DNA, 14 bp, Homo sapiens
taattctatttctc

SEQ ID NO: 733742 - DNA, 16 bp, Homo sapiens
taattctatttctcta

SEQ ID NO: 733743 - DNA, 17 bp, Homo sapiens
taattctcatttgttct

SEQ ID NO: 733744 - DNA, 22 bp, Homo sapiens
taattctccctaaggaatctga

SEQ ID NO: 733745 - DNA, 15 bp, Homo sapiens
taattctccttccca

SEQ ID NO: 733746 - DNA, 13 bp, Homo sapiens
taattctctgcaa

SEQ ID NO: 733747 - DNA, 13 bp, Homo sapiens
taattctgaaaca

SEQ ID NO: 733748 - DNA, 13 bp, Homo sapiens
taattcttccaaa

SEQ ID NO: 733749 - DNA, 15 bp, Homo sapiens
taattcttctgtcct

SEQ ID NO: 733750 - DNA, 15 bp, Homo sapiens
taattcttttctgag

SEQ ID NO: 733751 - DNA, 12 bp, Homo sapiens
taattgaagaac

SEQ ID NO: 733752 - DNA, 16 bp, Homo sapiens
taattgaagaactgca

SEQ ID NO: 733753 - DNA, 22 bp, Homo sapiens
taattgacaggattattggaaa

SEQ ID NO: 733754 - DNA, 12 bp, Homo sapiens
ttcactgctgct

SEQ ID NO: 733755 - DNA, 18 bp, Homo sapiens
ttcactgctgctcctctt

SEQ ID NO: 733756 - DNA, 21 bp, Homo sapiens
ttcactgctgctcctctttcc

SEQ ID NO: 733757 - DNA, 15 bp, Homo sapiens
ttcactgctggctgc

SEQ ID NO: 733758 - DNA, 17 bp, Homo sapiens
ttcactgctggctgcct

SEQ ID NO: 733759 - DNA, 19 bp, Homo sapiens
ttcactggggcatgagatt

SEQ ID NO: 733760 - DNA, 20 bp, Homo sapiens
ttcactgtaagactcattcc

SEQ ID NO: 733761 - DNA, 18 bp, Homo sapiens
ttcactgtactgcatgtg

SEQ ID NO: 733762 - DNA, 22 bp, Homo sapiens
ttcactgtactgcatgtgactt

SEQ ID NO: 733763 - DNA, 11 bp, Homo sapiens
ttcactgtata

SEQ ID NO: 733764 - DNA, 13 bp, Homo sapiens
ttcactgtatata

SEQ ID NO: 733765 - DNA, 15 bp, Homo sapiens
ttcactgtatataaa

SEQ ID NO: 733766 - DNA, 19 bp, Homo sapiens
ttcactgtatataaacata

SEQ ID NO: 733767 - DNA, 22 bp, Homo sapiens
ttcactgtatataaacatattt

SEQ ID NO: 733768 - DNA, 19 bp, Homo sapiens
ttcactgtctttaattctg

SEQ ID NO: 733769 - DNA, 22 bp, Homo sapiens
ttcacttaaagactgtctcaaa

SEQ ID NO: 733770 - DNA, 13 bp, Homo sapiens
ttcacttcaaagc

SEQ ID NO: 733771 - DNA, 20 bp, Homo sapiens
ttcacttcgggctgtgtaaa

SEQ ID NO: 733772 - DNA, 13 bp, Homo sapiens
ttcacttcttcct

SEQ ID NO: 733773 - DNA, 17 bp, Homo sapiens
ttcacttctttgcagag

SEQ ID NO: 733774 - DNA, 21 bp, Homo sapiens
ttcacttgccatgcaggaaga

SEQ ID NO: 733775 - DNA, 12 bp, Homo sapiens
ttcacttgtatt

SEQ ID NO: 733776 - DNA, 13 bp, Homo sapiens
ttcacttgtattg

SEQ ID NO: 733777 - DNA, 21 bp, Homo sapiens
ttcacttgtattgactttatg

SEQ ID NO: 733778 - DNA, 14 bp, Homo sapiens
ttcacttgtctcct

SEQ ID NO: 733779 - DNA, 15 bp, Homo sapiens
ttcacttgtcttgct

SEQ ID NO: 733780 - DNA, 16 bp, Homo sapiens
ttcactttattgctat

SEQ ID NO: 733781 - DNA, 14 bp, Homo sapiens
ttcactttcatttt

SEQ ID NO: 733782 - DNA, 15 bp, Homo sapiens
ttcactttcattttt

SEQ ID NO: 733783 - DNA, 14 bp, Homo sapiens
ttcactttgaaaaa

SEQ ID NO: 733784 - DNA, 22 bp, Homo sapiens
ttcactttgctctcaattaaag

SEQ ID NO: 733785 - DNA, 13 bp, Homo sapiens
ttcacttttgttc

SEQ ID NO: 733786 - DNA, 17 bp, Homo sapiens
ttcacttttgttctgct

SEQ ID NO: 733787 - DNA, 13 bp, Homo sapiens
ttcacttttttct

SEQ ID NO: 733788 - DNA, 14 bp, Homo sapiens
ttcagaaaaagaaa

SEQ ID NO: 733789 - DNA, 16 bp, Homo sapiens
ttcagaaaaagaaatg

SEQ ID NO: 733790 - DNA, 23 bp, Homo sapiens
ttcagaaaacccttttctacagt

SEQ ID NO: 733791 - DNA, 17 bp, Homo sapiens
ttcagaaacagggcagc

SEQ ID NO: 733792 - DNA, 18 bp, Homo sapiens
ttcagaaagacagtgact

SEQ ID NO: 733793 - DNA, 15 bp, Homo sapiens
ttcagaaatgctgcc

SEQ ID NO: 733794 - DNA, 16 bp, Homo sapiens
ttcagaaatgctgcct

SEQ ID NO: 733795 - DNA, 20 bp, Homo sapiens
ttcagaaatgctgcctgcct

SEQ ID NO: 733796 - DNA, 15 bp, Homo sapiens
ttcagaaattaaaat

SEQ ID NO: 733797 - DNA, 23 bp, Homo sapiens
ttcagaaattccaactcctgatg

SEQ ID NO: 733798 - DNA, 21 bp, Homo sapiens
ttcagaaattggaacagaatg

SEQ ID NO: 733799 - DNA, 22 bp, Homo sapiens
ttcagaacacacagactttctg

SEQ ID NO: 733800 - DNA, 13 bp, Homo sapiens
ttcagaacagagg

SEQ ID NO: 733801 - DNA, 19 bp, Homo sapiens
ttcagaacctcttccccag

SEQ ID NO: 733802 - DNA, 17 bp, Homo sapiens
ttcagaactaaattttt

SEQ ID NO: 733803 - DNA, 21 bp, Homo sapiens
ttcagaactaaatttttcata

SEQ ID NO: 733804 - DNA, 16 bp, Homo sapiens
ttcagaactatttaaa

SEQ ID NO: 733805 - DNA, 21 bp, Homo sapiens
ttcagaactatttaaaataaa

SEQ ID NO: 733806 - DNA, 22 bp, Homo sapiens
ttcagaactatttaaaataaag

SEQ ID NO: 733807 - DNA, 19 bp, Homo sapiens
ttcagaactgcccttgctg

SEQ ID NO: 733808 - DNA, 11 bp, Homo sapiens
ttcagaagacc

SEQ ID NO: 733809 - DNA, 18 bp, Homo sapiens
ttcagaaggagaaggaaa

SEQ ID NO: 733810 - DNA, 19 bp, Homo sapiens
ttcagaaggttattttctt

SEQ ID NO: 733811 - DNA, 15 bp, Homo sapiens
ttcagaagtgattta

SEQ ID NO: 733812 - DNA, 16 bp, Homo sapiens
ttcagaataagcttcc

SEQ ID NO: 733813 - DNA, 16 bp, Homo sapiens
ttcagaatctttgtta

SEQ ID NO: 733814 - DNA, 17 bp, Homo sapiens
ttcagaattaaactttt

SEQ ID NO: 733815 - DNA, 13 bp, Homo sapiens
ttcagaatttagt

SEQ ID NO: 733816 - DNA, 15 bp, Homo sapiens
ttcagaatttagtgt

SEQ ID NO: 733817 - DNA, 14 bp, Homo sapiens
ttcagacacagctc

SEQ ID NO: 733818 - DNA, 24 bp, Homo sapiens
ttcagacacagctcttccagggca

SEQ ID NO: 733819 - DNA, 16 bp, Homo sapiens
taatttatagcaagat

SEQ ID NO: 733820 - DNA, 21 bp, Homo sapiens
taatttatagcaagatattga

SEQ ID NO: 733821 - DNA, 13 bp, Homo sapiens
taatttattaatc

SEQ ID NO: 733822 - DNA, 17 bp, Homo sapiens
taatttattaattgctt

SEQ ID NO: 733823 - DNA, 18 bp, Homo sapiens
taatttattaattgcttt

SEQ ID NO: 733824 - DNA, 13 bp, Homo sapiens
taatttattatta

SEQ ID NO: 733825 - DNA, 12 bp, Homo sapiens
taatttatttat

SEQ ID NO: 733826 - DNA, 19 bp, Homo sapiens
taatttatttattaagatg

SEQ ID NO: 733827 - DNA, 19 bp, Homo sapiens
taatttatttccactaaaa

SEQ ID NO: 733828 - DNA, 21 bp, Homo sapiens
taatttattttgctccctctg

SEQ ID NO: 733829 - DNA, 22 bp, Homo sapiens
taatttattttgctccctctgt

SEQ ID NO: 733830 - DNA, 19 bp, Homo sapiens
taatttcaaaatacatttg

SEQ ID NO: 733831 - DNA, 21 bp, Homo sapiens
taatttcaggaaaatgtattg

SEQ ID NO: 733832 - DNA, 22 bp, Homo sapiens
taatttcaggaggaatactgaa

SEQ ID NO: 733833 - DNA, 23 bp, Homo sapiens
taatttcaggaggaatactgaac

SEQ ID NO: 733834 - DNA, 20 bp, Homo sapiens
taatttcagggaaattaatc

SEQ ID NO: 733835 - DNA, 12 bp, Homo sapiens
taatttcagggt

SEQ ID NO: 733836 - DNA, 15 bp, Homo sapiens
taatttcagtgtaaa

SEQ ID NO: 733837 - DNA, 15 bp, Homo sapiens
taatttccaggaaaa

SEQ ID NO: 733838 - DNA, 20 bp, Homo sapiens
taatttccttctgttaagaa

SEQ ID NO: 733839 - DNA, 21 bp, Homo sapiens
taatttcctttttgacactga

SEQ ID NO: 733840 - DNA, 13 bp, Homo sapiens
taatttcgcctta

SEQ ID NO: 733841 - DNA, 16 bp, Homo sapiens
taatttcgccttaaac

SEQ ID NO: 733842 - DNA, 21 bp, Homo sapiens
taatttctactctgtcttaaa

SEQ ID NO: 733843 - DNA, 20 bp, Homo sapiens
taatttctagaaacaaacat

SEQ ID NO: 733844 - DNA, 12 bp, Homo sapiens
taatttctatta

SEQ ID NO: 733845 - DNA, 13 bp, Homo sapiens
taatttctcctcc

SEQ ID NO: 733846 - DNA, 14 bp, Homo sapiens
taatttctcctccc

SEQ ID NO: 733847 - DNA, 18 bp, Homo sapiens
taatttctgcctttcccc

SEQ ID NO: 733848 - DNA, 24 bp, Homo sapiens
taatttcttcatgtgatgtcatga

SEQ ID NO: 733849 - DNA, 16 bp, Homo sapiens
taatttcttctttaga

SEQ ID NO: 733850 - DNA, 17 bp, Homo sapiens
taatttgaatgtatttg

SEQ ID NO: 733851 - DNA, 12 bp, Homo sapiens
taatttgaattg

SEQ ID NO: 733852 - DNA, 15 bp, Homo sapiens
taatttgacttgaat

SEQ ID NO: 733853 - DNA, 19 bp, Homo sapiens
taatttgaggtgaaattca

SEQ ID NO: 733854 - DNA, 14 bp, Homo sapiens
taatttgagtgtat

SEQ ID NO: 733855 - DNA, 16 bp, Homo sapiens
taatttgagtgtatat

SEQ ID NO: 733856 - DNA, 17 bp, Homo sapiens
taatttgagtgtatata

SEQ ID NO: 733857 - DNA, 16 bp, Homo sapiens
taatttgatgaaagct

SEQ ID NO: 733858 - DNA, 19 bp, Homo sapiens
taatttgatgaaagctgat

SEQ ID NO: 733859 - DNA, 13 bp, Homo sapiens
taatttgcactga

SEQ ID NO: 733860 - DNA, 13 bp, Homo sapiens
taatttgcttcct

SEQ ID NO: 733861 - DNA, 15 bp, Homo sapiens
taatttggataataa

SEQ ID NO: 733862 - DNA, 22 bp, Homo sapiens
taatttgggtgactagaacaac

SEQ ID NO: 733863 - DNA, 14 bp, Homo sapiens
taatttgtaaactt

SEQ ID NO: 733864 - DNA, 17 bp, Homo sapiens
taatttgtaaacttctg

SEQ ID NO: 733865 - DNA, 20 bp, Homo sapiens
taatttgtaaacttctgaag

SEQ ID NO: 733866 - DNA, 16 bp, Homo sapiens
taatttgtaaagttgg

SEQ ID NO: 733867 - DNA, 13 bp, Homo sapiens
taatttgtaaatg

SEQ ID NO: 733868 - DNA, 13 bp, Homo sapiens
taatttgtacagg

SEQ ID NO: 733869 - DNA, 20 bp, Homo sapiens
taatttgtacaggggccatg

SEQ ID NO: 733870 - DNA, 22 bp, Homo sapiens
taatttgtatgctaaatgagga

SEQ ID NO: 733871 - DNA, 17 bp, Homo sapiens
taatttgtcttagttga

SEQ ID NO: 733872 - DNA, 14 bp, Homo sapiens
taatttgtgaattt

SEQ ID NO: 733873 - DNA, 14 bp, Homo sapiens
taatttgtgataca

SEQ ID NO: 733874 - DNA, 21 bp, Homo sapiens
taatttgttggggctttacat

SEQ ID NO: 733875 - DNA, 12 bp, Homo sapiens
taatttgtttcc

SEQ ID NO: 733876 - DNA, 19 bp, Homo sapiens
taattttaaataatttcta

SEQ ID NO: 733877 - DNA, 13 bp, Homo sapiens
ttcagccttggga

SEQ ID NO: 733878 - DNA, 23 bp, Homo sapiens
ttcagcgaagtctcatgggaagc

SEQ ID NO: 733879 - DNA, 14 bp, Homo sapiens
ttcagctaagctag

SEQ ID NO: 733880 - DNA, 14 bp, Homo sapiens
ttcagctagaattt

SEQ ID NO: 733881 - DNA, 19 bp, Homo sapiens
ttcagctagcttttaggaa

SEQ ID NO: 733882 - DNA, 20 bp, Homo sapiens
ttcagctagcttttaggaaa

SEQ ID NO: 733883 - DNA, 21 bp, Homo sapiens
ttcagctcatttaatcccagg

SEQ ID NO: 733884 - DNA, 21 bp, Homo sapiens
ttcagctcctgagtagctggg

SEQ ID NO: 733885 - DNA, 15 bp, Homo sapiens
ttcagctctgaaaga

SEQ ID NO: 733886 - DNA, 24 bp, Homo sapiens
ttcagctctgcaagaattgaagca

SEQ ID NO: 733887 - DNA, 18 bp, Homo sapiens
ttcagctcttaaaaagac

SEQ ID NO: 733888 - DNA, 17 bp, Homo sapiens
ttcagctctttccaaat

SEQ ID NO: 733889 - DNA, 13 bp, Homo sapiens
ttcagctcttttt

SEQ ID NO: 733890 - DNA, 17 bp, Homo sapiens
ttcagctgacttttctg

SEQ ID NO: 733891 - DNA, 17 bp, Homo sapiens
ttcagctgcctgaaaca

SEQ ID NO: 733892 - DNA, 16 bp, Homo sapiens
ttcagctgcttctctt

SEQ ID NO: 733893 - DNA, 21 bp, Homo sapiens
ttcagctggttgaggtttcaa

SEQ ID NO: 733894 - DNA, 22 bp, Homo sapiens
ttcagcttcgtttattttcaag

SEQ ID NO: 733895 - DNA, 18 bp, Homo sapiens
ttcaggaaaattgaatgc

SEQ ID NO: 733896 - DNA, 23 bp, Homo sapiens
ttcaggaacaagtaatgtattag

SEQ ID NO: 733897 - DNA, 21 bp, Homo sapiens
ttcaggacttaacggctccag

SEQ ID NO: 733898 - DNA, 16 bp, Homo sapiens
ttcaggactttgtgag

SEQ ID NO: 733899 - DNA, 14 bp, Homo sapiens
ttcaggagcgcaag

SEQ ID NO: 733900 - DNA, 15 bp, Homo sapiens
ttcaggaggaatact

SEQ ID NO: 733901 - DNA, 16 bp, Homo sapiens
ttcaggcttttatgag

SEQ ID NO: 733902 - DNA, 16 bp, Homo sapiens
ttcagggacctcaggg

SEQ ID NO: 733903 - DNA, 21 bp, Homo sapiens
ttcagggagggttagcctgca

SEQ ID NO: 733904 - DNA, 17 bp, Homo sapiens
ttcaggggaagagaaga

SEQ ID NO: 733905 - DNA, 17 bp, Homo sapiens
ttcaggggactcagccc

SEQ ID NO: 733906 - DNA, 19 bp, Homo sapiens
ttcaggggactcagccctg

SEQ ID NO: 733907 - DNA, 20 bp, Homo sapiens
ttcaggggactcagccctga

SEQ ID NO: 733908 - DNA, 23 bp, Homo sapiens
ttcaggggactcagccctgaggt

SEQ ID NO: 733909 - DNA, 18 bp, Homo sapiens
ttcaggggctccctgcct

SEQ ID NO: 733910 - DNA, 15 bp, Homo sapiens
ttcaggggctttggg

SEQ ID NO: 733911 - DNA, 22 bp, Homo sapiens
ttcaggggggttgtgaggcctg

SEQ ID NO: 733912 - DNA, 11 bp, Homo sapiens
ttcaggtacag

SEQ ID NO: 733913 - DNA, 15 bp, Homo sapiens
ttcaggtaggccctt

SEQ ID NO: 733914 - DNA, 20 bp, Homo sapiens
ttcaggtaggcccttgtcct

SEQ ID NO: 733915 - DNA, 15 bp, Homo sapiens
ttcaggtccaggcca

SEQ ID NO: 733916 - DNA, 13 bp, Homo sapiens
ttcaggttttcag

SEQ ID NO: 733917 - DNA, 16 bp, Homo sapiens
ttcaggtttttccttt

SEQ ID NO: 733918 - DNA, 17 bp, Homo sapiens
ttcagtaaataatgaaa

SEQ ID NO: 733919 - DNA, 14 bp, Homo sapiens
ttcagtaagccgtg

SEQ ID NO: 733920 - DNA, 23 bp, Homo sapiens
ttcagtaagtctcataggttaaa

SEQ ID NO: 733921 - DNA, 14 bp, Homo sapiens
ttcagtaataactc

SEQ ID NO: 733922 - DNA, 16 bp, Homo sapiens
ttcagtacaacccata

SEQ ID NO: 733923 - DNA, 23 bp, Homo sapiens
ttcagtactctacaattcctctg

SEQ ID NO: 733924 - DNA, 21 bp, Homo sapiens
ttcagtacttttttaaatatt

SEQ ID NO: 733925 - DNA, 16 bp, Homo sapiens
ttcagtagaattttag

SEQ ID NO: 733926 - DNA, 17 bp, Homo sapiens
ttcagtagaattttagt

SEQ ID NO: 733927 - DNA, 15 bp, Homo sapiens
ttcagtagatttcct

SEQ ID NO: 733928 - DNA, 16 bp, Homo sapiens
ttcagtaggaacaagc

SEQ ID NO: 733929 - DNA, 19 bp, Homo sapiens
ttcagtaggatttatgtat

SEQ ID NO: 733930 - DNA, 19 bp, Homo sapiens
ttcagtataaattatctta

SEQ ID NO: 733931 - DNA, 16 bp, Homo sapiens
ttcagtatactgtgtg

SEQ ID NO: 733932 - DNA, 21 bp, Homo sapiens
ttcagtatgtgtcaactgaga

SEQ ID NO: 733933 - DNA, 22 bp, Homo sapiens
ttcagtatgtgtcaactgagag

SEQ ID NO: 733934 - DNA, 17 bp, Homo sapiens
ttcagtatgttgtcaaa

SEQ ID NO: 733935 - DNA, 14 bp, Homo sapiens
ttcagtattttcca

SEQ ID NO: 733936 - DNA, 15 bp, Homo sapiens
ttcagtattttccag

SEQ ID NO: 733937 - DNA, 18 bp, Homo sapiens
ttcagtattttccagcct

SEQ ID NO: 733938 - DNA, 17 bp, Homo sapiens
ttcagtattttggagaa

SEQ ID NO: 733939 - DNA, 19 bp, Homo sapiens
ttcagtcccctctctctgg

SEQ ID NO: 733940 - DNA, 17 bp, Homo sapiens
ttcagtctctgaataca

SEQ ID NO: 733941 - DNA, 20 bp, Homo sapiens
ttcagtctgaatgctgccac

SEQ ID NO: 733942 - DNA, 14 bp, Homo sapiens
ttcagtctgctcca

SEQ ID NO: 733943 - DNA, 16 bp, Homo sapiens
ttcagtctgctccacc

SEQ ID NO: 733944 - DNA, 19 bp, Homo sapiens
ttcagtgaaaagattttat

SEQ ID NO: 733945 - DNA, 13 bp, Homo sapiens
ttcagtgaatttg

SEQ ID NO: 733946 - DNA, 17 bp, Homo sapiens
ttcagtgagcccctccc

SEQ ID NO: 733947 - DNA, 23 bp, Homo sapiens
gtcccatggacactccagtgcca

SEQ ID NO: 733948 - DNA, 17 bp, Homo sapiens
gtcccatggctgaagct

SEQ ID NO: 733949 - DNA, 13 bp, Homo sapiens
gtcccattctaga

SEQ ID NO: 733950 - DNA, 15 bp, Homo sapiens
gtcccattttcccct

SEQ ID NO: 733951 - DNA, 19 bp, Homo sapiens
gtcccattttccccttcct

SEQ ID NO: 733952 - DNA, 22 bp, Homo sapiens
gtccccaaccgtgtctgtctgg

SEQ ID NO: 733953 - DNA, 16 bp, Homo sapiens
gtccccaatgaatata

SEQ ID NO: 733954 - DNA, 14 bp, Homo sapiens
gtccccacagactg

SEQ ID NO: 733955 - DNA, 17 bp, Homo sapiens
gtccccacccctgcccc

SEQ ID NO: 733956 - DNA, 18 bp, Homo sapiens
gtccccaccctccactca

SEQ ID NO: 733957 - DNA, 15 bp, Homo sapiens
gtccccacctgggac

SEQ ID NO: 733958 - DNA, 23 bp, Homo sapiens
gtccccacgaggggacccatggg

SEQ ID NO: 733959 - DNA, 15 bp, Homo sapiens
gtccccactcacccc

SEQ ID NO: 733960 - DNA, 19 bp, Homo sapiens
gtccccagaccaaccctgg

SEQ ID NO: 733961 - DNA, 20 bp, Homo sapiens
gtccccagaccaaccctggg

SEQ ID NO: 733962 - DNA, 13 bp, Homo sapiens
gtccccagcattg

SEQ ID NO: 733963 - DNA, 13 bp, Homo sapiens
gtccccagccctg

SEQ ID NO: 733964 - DNA, 17 bp, Homo sapiens
gtccccagccctgggct

SEQ ID NO: 733965 - DNA, 17 bp, Homo sapiens
gtccccagccctgtcct

SEQ ID NO: 733966 - DNA, 19 bp, Homo sapiens
gtccccagccctgtcctgg

SEQ ID NO: 733967 - DNA, 13 bp, Homo sapiens
gtccccaggccca

SEQ ID NO: 733968 - DNA, 12 bp, Homo sapiens
gtccccaggcct

SEQ ID NO: 733969 - DNA, 18 bp, Homo sapiens
gtccccaggcctggctcc

SEQ ID NO: 733970 - DNA, 16 bp, Homo sapiens
gtccccagggcccctc

SEQ ID NO: 733971 - DNA, 19 bp, Homo sapiens
gtccccaggtcctgtctct

SEQ ID NO: 733972 - DNA, 18 bp, Homo sapiens
gtccccagtccccagccc

SEQ ID NO: 733973 - DNA, 20 bp, Homo sapiens
gtccccatcatcccagctgc

SEQ ID NO: 733974 - DNA, 13 bp, Homo sapiens
gtccccatcccca

SEQ ID NO: 733975 - DNA, 21 bp, Homo sapiens
gtccccatccccaccagctcg

SEQ ID NO: 733976 - DNA, 19 bp, Homo sapiens
gtccccatggcaccctgct

SEQ ID NO: 733977 - DNA, 12 bp, Homo sapiens
gtccccatggct

SEQ ID NO: 733978 - DNA, 14 bp, Homo sapiens
gtccccatttctgc

SEQ ID NO: 733979 - DNA, 18 bp, Homo sapiens
gtccccatttctgcctcg

SEQ ID NO: 733980 - DNA, 19 bp, Homo sapiens
gtcccccaactctgagccc

SEQ ID NO: 733981 - DNA, 15 bp, Homo sapiens
gtcccccactctctc

SEQ ID NO: 733982 - DNA, 16 bp, Homo sapiens
gtcccccactctctca

SEQ ID NO: 733983 - DNA, 18 bp, Homo sapiens
gtcccccactctctcacc

SEQ ID NO: 733984 - DNA, 22 bp, Homo sapiens
gtcccccactctctcacccacc

SEQ ID NO: 733985 - DNA, 23 bp, Homo sapiens
gtcccccactctctcacccacca

SEQ ID NO: 733986 - DNA, 11 bp, Homo sapiens
gtcccccagca

SEQ ID NO: 733987 - DNA, 16 bp, Homo sapiens
gtcccccagctctggt

SEQ ID NO: 733988 - DNA, 13 bp, Homo sapiens
gtcccccaggctg

SEQ ID NO: 733989 - DNA, 14 bp, Homo sapiens
gtcccccaggctgg

SEQ ID NO: 733990 - DNA, 22 bp, Homo sapiens
gtcccccatccccatcctccag

SEQ ID NO: 733991 - DNA, 22 bp, Homo sapiens
gtccccccaccgctcagtgtca

SEQ ID NO: 733992 - DNA, 18 bp, Homo sapiens
gtccccccccaggccctc

SEQ ID NO: 733993 - DNA, 22 bp, Homo sapiens
gtcccccgaccaatccccagcc

SEQ ID NO: 733994 - DNA, 19 bp, Homo sapiens
gtcccccgactgcctgtct

SEQ ID NO: 733995 - DNA, 15 bp, Homo sapiens
gtccccctacccacc

SEQ ID NO: 733996 - DNA, 16 bp, Homo sapiens
gtccccctacccaccg

SEQ ID NO: 733997 - DNA, 20 bp, Homo sapiens
gtccccctcccctcccagtc

SEQ ID NO: 733998 - DNA, 23 bp, Homo sapiens
gtccccctcccctcccagtcctc

SEQ ID NO: 733999 - DNA, 15 bp, Homo sapiens
gtccccctccctgcc

SEQ ID NO: 734000 - DNA, 18 bp, Homo sapiens
gtccccctccctgcccaa

SEQ ID NO: 734001 - DNA, 15 bp, Homo sapiens
gtccccgctggctca

SEQ ID NO: 734002 - DNA, 15 bp, Homo sapiens
gtccccgtgccccgc

SEQ ID NO: 734003 - DNA, 14 bp, Homo sapiens
gtcccctatcctcc

SEQ ID NO: 734004 - DNA, 15 bp, Homo sapiens
gtcccctatcctccc

SEQ ID NO: 734005 - DNA, 23 bp, Homo sapiens
gtcccctcactctgtcagccagc

SEQ ID NO: 734006 - DNA, 15 bp, Homo sapiens
gtcccctcccatctg

SEQ ID NO: 734007 - DNA, 17 bp, Homo sapiens
gtcccctcccatctggg

SEQ ID NO: 734008 - DNA, 19 bp, Homo sapiens
gtcccctcccatctgggag

SEQ ID NO: 734009 - DNA, 20 bp, Homo sapiens
gtcccctccccagctccctt

SEQ ID NO: 734010 - DNA, 12 bp, Homo sapiens
gtcccctccctc

SEQ ID NO: 734011 - DNA, 17 bp, Homo sapiens
gtcccctccctcgtggg

SEQ ID NO: 734012 - DNA, 17 bp, Homo sapiens
gtcccctccgccgtgcc

SEQ ID NO: 734013 - DNA, 13 bp, Homo sapiens
gtcccctctcccc

SEQ ID NO: 734014 - DNA, 23 bp, Homo sapiens
gtcccctctgtcatcactccctg

SEQ ID NO: 734015 - DNA, 17 bp, Homo sapiens
gtcccctgacctgtcca

SEQ ID NO: 734016 - DNA, 12 bp, Homo sapiens
gtcccctgcagc

SEQ ID NO: 734017 - DNA, 14 bp, Homo sapiens
gtcccctgcagcct

SEQ ID NO: 734018 - DNA, 16 bp, Homo sapiens
gtcccctgcagcctgg

SEQ ID NO: 734019 - DNA, 19 bp, Homo sapiens
gtcccctgcagcctgggtc

SEQ ID NO: 734020 - DNA, 24 bp, Homo sapiens
gtcccctgccaccgactgcccagc

SEQ ID NO: 734021 - DNA, 12 bp, Homo sapiens
gtcccctgcggg

SEQ ID NO: 734022 - DNA, 20 bp, Homo sapiens
gtcccctgctactcctgtgc

SEQ ID NO: 734023 - DNA, 12 bp, Homo sapiens
gtcccctgtccc

SEQ ID NO: 734024 - DNA, 13 bp, Homo sapiens
gtcccctgtccca

SEQ ID NO: 734025 - DNA, 12 bp, Homo sapiens
gtcccctgttga

SEQ ID NO: 734026 - DNA, 15 bp, Homo sapiens
gtccccttcccctgc

SEQ ID NO: 734027 - DNA, 21 bp, Homo sapiens
gtccccttcctgttcttcctt

SEQ ID NO: 734028 - DNA, 22 bp, Homo sapiens
gtcccctttcatcggtgcctgg

SEQ ID NO: 734029 - DNA, 23 bp, Homo sapiens
gtcccctttcatcggtgcctggt

SEQ ID NO: 734030 - DNA, 14 bp, Homo sapiens
gtcccctttcctct

SEQ ID NO: 734031 - DNA, 22 bp, Homo sapiens
gtcccctttgtattccttaaat

SEQ ID NO: 734032 - DNA, 15 bp, Homo sapiens
gtcccgaatccacag

SEQ ID NO: 734033 - DNA, 14 bp, Homo sapiens
gtcccgcactctgc

SEQ ID NO: 734034 - DNA, 22 bp, Homo sapiens
gtcccgcgcttcgaactccagg

SEQ ID NO: 734035 - DNA, 14 bp, Homo sapiens
gtcccgctgcctcc

SEQ ID NO: 734036 - DNA, 22 bp, Homo sapiens
gtcccgcttagttcttgaattg

SEQ ID NO: 734037 - DNA, 23 bp, Homo sapiens
gtcccgggaatgaccgctctccc

SEQ ID NO: 734038 - DNA, 22 bp, Homo sapiens
gtcccggggccagcacttccat

SEQ ID NO: 734039 - DNA, 15 bp, Homo sapiens
gtcccggggctccac

SEQ ID NO: 734040 - DNA, 19 bp, Homo sapiens
gtcccgtcgtgcagtcagg

SEQ ID NO: 734041 - DNA, 22 bp, Homo sapiens
gtccctaagtaagtttcttcct

SEQ ID NO: 734042 - DNA, 21 bp, Homo sapiens
gtccctaccccatggtgctag

SEQ ID NO: 734043 - DNA, 21 bp, Homo sapiens
gtccctaccgagtctcttctc

SEQ ID NO: 734044 - DNA, 22 bp, Homo sapiens
gtccctaccgagtctcttctcc

SEQ ID NO: 734045 - DNA, 19 bp, Homo sapiens
gtccctatagtttcaccac

SEQ ID NO: 734046 - DNA, 22 bp, Homo sapiens
gtccctatctattaaagtgact

SEQ ID NO: 734047 - DNA, 13 bp, Homo sapiens
gtccctccctgcc

SEQ ID NO: 734048 - DNA, 17 bp, Homo sapiens
gtccctccgagcttggg

SEQ ID NO: 734049 - DNA, 17 bp, Homo sapiens
gtccctcctaacaagtg

SEQ ID NO: 734050 - DNA, 18 bp, Homo sapiens
gtccctcctctcacctct

SEQ ID NO: 734051 - DNA, 14 bp, Homo sapiens
gtccctcggagctg

SEQ ID NO: 734052 - DNA, 19 bp, Homo sapiens
gtccctcggagctgccagc

SEQ ID NO: 734053 - DNA, 13 bp, Homo sapiens
gtccctctcagat

SEQ ID NO: 734054 - DNA, 14 bp, Homo sapiens
gtccctctcaggca

SEQ ID NO: 734055 - DNA, 16 bp, Homo sapiens
gtccctctcaggcatg

SEQ ID NO: 734056 - DNA, 21 bp, Homo sapiens
gtccctctcggaaggctggct

SEQ ID NO: 734057 - DNA, 12 bp, Homo sapiens
gtccctctgtgt

SEQ ID NO: 734058 - DNA, 16 bp, Homo sapiens
gtccctcttctctcct

SEQ ID NO: 734059 - DNA, 22 bp, Homo sapiens
tgggaaggacttggcgcgccct

SEQ ID NO: 734060 - DNA, 12 bp, Homo sapiens
tgggaaggaggg

SEQ ID NO: 734061 - DNA, 23 bp, Homo sapiens
tgggaaggaggggagcctttggg

SEQ ID NO: 734062 - DNA, 18 bp, Homo sapiens
tgggaaggcgagtctggg

SEQ ID NO: 734063 - DNA, 22 bp, Homo sapiens
tgggaagggagagttctttgct

SEQ ID NO: 734064 - DNA, 22 bp, Homo sapiens
tgggaaggggacccccgccccc

SEQ ID NO: 734065 - DNA, 22 bp, Homo sapiens
tgggaaggggatggacaccccc

SEQ ID NO: 734066 - DNA, 21 bp, Homo sapiens
tgggaaggttagaaaggcagc

SEQ ID NO: 734067 - DNA, 15 bp, Homo sapiens
tgggaagtgaagact

SEQ ID NO: 734068 - DNA, 19 bp, Homo sapiens
tgggaagtgtgtttagaag

SEQ ID NO: 734069 - DNA, 16 bp, Homo sapiens
gtccctgccccgcccc

SEQ ID NO: 734070 - DNA, 17 bp, Homo sapiens
gtccctgccccgccccc

SEQ ID NO: 734071 - DNA, 18 bp, Homo sapiens
gtccctgccccgcccccc

SEQ ID NO: 734072 - DNA, 21 bp, Homo sapiens
gtccctgccccgccccccaga

SEQ ID NO: 734073 - DNA, 12 bp, Homo sapiens
gtccctgctagt

SEQ ID NO: 734074 - DNA, 13 bp, Homo sapiens
gtccctgctcccc

SEQ ID NO: 734075 - DNA, 18 bp, Homo sapiens
gtccctgggccagggtct

SEQ ID NO: 734076 - DNA, 15 bp, Homo sapiens
gtccctggggctagg

SEQ ID NO: 734077 - DNA, 20 bp, Homo sapiens
gtccctgggggaagccctgg

SEQ ID NO: 734078 - DNA, 22 bp, Homo sapiens
gtccctgggggaagccctggat

SEQ ID NO: 734079 - DNA, 23 bp, Homo sapiens
gtccctgggggaagccctggatt

SEQ ID NO: 734080 - DNA, 24 bp, Homo sapiens
gtccctggtccctcgtccacaggg

SEQ ID NO: 734081 - DNA, 15 bp, Homo sapiens
gtccctgtagctcag

SEQ ID NO: 734082 - DNA, 18 bp, Homo sapiens
gtccctgtagctcagtca

SEQ ID NO: 734083 - DNA, 15 bp, Homo sapiens
gtccctgtccccagg

SEQ ID NO: 734084 - DNA, 16 bp, Homo sapiens
gtccctgtcccccagc

SEQ ID NO: 734085 - DNA, 20 bp, Homo sapiens
gtccctgtcccccagcatcg

SEQ ID NO: 734086 - DNA, 20 bp, Homo sapiens
gtccctgtccctctagtgcc

SEQ ID NO: 734087 - DNA, 15 bp, Homo sapiens
gtccctgttttctga

SEQ ID NO: 734088 - DNA, 17 bp, Homo sapiens
gtccctgttttctgagc

SEQ ID NO: 734089 - DNA, 17 bp, Homo sapiens
gtcccttccaagctgtg

SEQ ID NO: 734090 - DNA, 17 bp, Homo sapiens
gtcccttccatgccctg

SEQ ID NO: 734091 - DNA, 18 bp, Homo sapiens
gtcccttccatgccctgg

SEQ ID NO: 734092 - DNA, 19 bp, Homo sapiens
gtcccttccatgccctggg

SEQ ID NO: 734093 - DNA, 21 bp, Homo sapiens
gtcccttccatgccctgggat

SEQ ID NO: 734094 - DNA, 13 bp, Homo sapiens
gtcccttcccctc

SEQ ID NO: 734095 - DNA, 14 bp, Homo sapiens
gtcccttcccctcc

SEQ ID NO: 734096 - DNA, 19 bp, Homo sapiens
gtcccttcccctccctggc

SEQ ID NO: 734097 - DNA, 20 bp, Homo sapiens
gtcccttcccgacccagcca

SEQ ID NO: 734098 - DNA, 21 bp, Homo sapiens
gtcccttcccgacccagccag

SEQ ID NO: 734099 - DNA, 23 bp, Homo sapiens
gtcccttcccgacccagccagct

SEQ ID NO: 734100 - DNA, 21 bp, Homo sapiens
gtcccttcctattctcctgcc

SEQ ID NO: 734101 - DNA, 12 bp, Homo sapiens
gtcccttccttt

SEQ ID NO: 734102 - DNA, 15 bp, Homo sapiens
gtcccttcctttctc

SEQ ID NO: 734103 - DNA, 19 bp, Homo sapiens
gtcccttctcttaatttaa

SEQ ID NO: 734104 - DNA, 14 bp, Homo sapiens
gtcccttgagacct

SEQ ID NO: 734105 - DNA, 21 bp, Homo sapiens
gtcccttgagacctcagccat

SEQ ID NO: 734106 - DNA, 22 bp, Homo sapiens
gtcccttgagacctcagccatg

SEQ ID NO: 734107 - DNA, 18 bp, Homo sapiens
gtcccttgatgcacagag

SEQ ID NO: 734108 - DNA, 23 bp, Homo sapiens
gtcccttgatgcacagagaagct

SEQ ID NO: 734109 - DNA, 23 bp, Homo sapiens
gtcccttgatgggtgctgccctc

SEQ ID NO: 734110 - DNA, 21 bp, Homo sapiens
gtcccttgcttagcctgtgct

SEQ ID NO: 734111 - DNA, 17 bp, Homo sapiens
gtccctttcagagacag

SEQ ID NO: 734112 - DNA, 17 bp, Homo sapiens
gtccctttcttggccag

SEQ ID NO: 734113 - DNA, 15 bp, Homo sapiens
gtcccttttctttga

SEQ ID NO: 734114 - DNA, 13 bp, Homo sapiens
gtccgagctttga

SEQ ID NO: 734115 - DNA, 15 bp, Homo sapiens
gtccgcaccagctgc

SEQ ID NO: 734116 - DNA, 18 bp, Homo sapiens
gtccgcaccagctgctct

SEQ ID NO: 734117 - DNA, 19 bp, Homo sapiens
gtccgcaccagctgctctg

SEQ ID NO: 734118 - DNA, 14 bp, Homo sapiens
gtccgccatccagg

SEQ ID NO: 734119 - DNA, 15 bp, Homo sapiens
gtccgccatccaggg

SEQ ID NO: 734120 - DNA, 17 bp, Homo sapiens
gtccgccatccagggtc

SEQ ID NO: 734121 - DNA, 22 bp, Homo sapiens
gtccgccatccagggtctggca

SEQ ID NO: 734122 - DNA, 23 bp, Homo sapiens
gtccgccatccagggtctggcag

SEQ ID NO: 734123 - DNA, 12 bp, Homo sapiens
gtccgccctgct

SEQ ID NO: 734124 - DNA, 18 bp, Homo sapiens
gtccgccctgctcctccc

SEQ ID NO: 734125 - DNA, 19 bp, Homo sapiens
gtccgccttaatctggaag

SEQ ID NO: 734126 - DNA, 13 bp, Homo sapiens
gtccggcccagtg

SEQ ID NO: 734127 - DNA, 20 bp, Homo sapiens
gtccggcccagtgccagctc

SEQ ID NO: 734128 - DNA, 21 bp, Homo sapiens
gtccggcccagtgccagctcc

SEQ ID NO: 734129 - DNA, 22 bp, Homo sapiens
gtccggcgccccgcacccccgc

SEQ ID NO: 734130 - DNA, 23 bp, Homo sapiens
gtccggcgccccgcacccccgcc

SEQ ID NO: 734131 - DNA, 15 bp, Homo sapiens
gtccgtccagagccg

SEQ ID NO: 734132 - DNA, 12 bp, Homo sapiens
gtccgtctgtct

SEQ ID NO: 734133 - DNA, 13 bp, Homo sapiens
gtccgtctgtctc

SEQ ID NO: 734134 - DNA, 23 bp, Homo sapiens
gtccgtctgtctcgatgcctgat

SEQ ID NO: 734135 - DNA, 15 bp, Homo sapiens
gtccgtgcccaggcc

SEQ ID NO: 734136 - DNA, 19 bp, Homo sapiens
gtccgtgctgacagctgct

SEQ ID NO: 734137 - DNA, 22 bp, Homo sapiens
gtccgtgggccgtatctgtcac

SEQ ID NO: 734138 - DNA, 14 bp, Homo sapiens
gtcctaaatgcaaa

SEQ ID NO: 734139 - DNA, 15 bp, Homo sapiens
gtcctaaatgcaaag

SEQ ID NO: 734140 - DNA, 22 bp, Homo sapiens
gtcctaacctcgggcctgctgc

SEQ ID NO: 734141 - DNA, 14 bp, Homo sapiens
gtcctaagaaagag

SEQ ID NO: 734142 - DNA, 13 bp, Homo sapiens
gtcctaagagatt

SEQ ID NO: 734143 - DNA, 18 bp, Homo sapiens
gtcctaaggaaccttcct

SEQ ID NO: 734144 - DNA, 14 bp, Homo sapiens
gtcctaaggcccat

SEQ ID NO: 734145 - DNA, 19 bp, Homo sapiens
gtcctaattcttctgtcct

SEQ ID NO: 734146 - DNA, 21 bp, Homo sapiens
gtcctacagtgactccctggg

SEQ ID NO: 734147 - DNA, 18 bp, Homo sapiens
gtcctacccatccccgca

SEQ ID NO: 734148 - DNA, 18 bp, Homo sapiens
gtcctagccactcaggag

SEQ ID NO: 734149 - DNA, 16 bp, Homo sapiens
gtcctagctcttacac

SEQ ID NO: 734150 - DNA, 20 bp, Homo sapiens
gtcctatggacaacttattt

SEQ ID NO: 734151 - DNA, 16 bp, Homo sapiens
gtcctcaccctgtggg

SEQ ID NO: 734152 - DNA, 18 bp, Homo sapiens
gtcctcacggtgcctttt

SEQ ID NO: 734153 - DNA, 18 bp, Homo sapiens
gtcctcagagcaggggcc

SEQ ID NO: 734154 - DNA, 13 bp, Homo sapiens
gtcctcagctgct

SEQ ID NO: 734155 - DNA, 15 bp, Homo sapiens
gtcctcaggtacagc

SEQ ID NO: 734156 - DNA, 14 bp, Homo sapiens
gtcctcaggtcagc

SEQ ID NO: 734157 - DNA, 20 bp, Homo sapiens
gtcctcaggtcagctgggag

SEQ ID NO: 734158 - DNA, 21 bp, Homo sapiens
gtcctcaggtcagctgggagc

SEQ ID NO: 734159 - DNA, 15 bp, Homo sapiens
gtcctcaggtggcca

SEQ ID NO: 734160 - DNA, 17 bp, Homo sapiens
gtcctcaggtggccatg

SEQ ID NO: 734161 - DNA, 23 bp, Homo sapiens
gtcctcaggtggccatgcctcag

SEQ ID NO: 734162 - DNA, 13 bp, Homo sapiens
gtcctcatggaga

SEQ ID NO: 734163 - DNA, 22 bp, Homo sapiens
gtcctccaacaccaagcacagc

SEQ ID NO: 734164 - DNA, 14 bp, Homo sapiens
gtcctccagaagcc

SEQ ID NO: 734165 - DNA, 18 bp, Homo sapiens
gtcctccagaagcctctg

SEQ ID NO: 734166 - DNA, 19 bp, Homo sapiens
gtcctccagaagcctctgg

SEQ ID NO: 734167 - DNA, 14 bp, Homo sapiens
gtcctccaggagct

SEQ ID NO: 734168 - DNA, 21 bp, Homo sapiens
gtcctccatccacgtggcctc

SEQ ID NO: 734169 - DNA, 14 bp, Homo sapiens
gtcctcccacagac

SEQ ID NO: 734170 - DNA, 17 bp, Homo sapiens
gtcctcccatcccctca

SEQ ID NO: 734171 - DNA, 21 bp, Homo sapiens
gtcctccccctgccagtgcct

SEQ ID NO: 734172 - DNA, 22 bp, Homo sapiens
gtcctccccctgccagtgcctt

SEQ ID NO: 734173 - DNA, 15 bp, Homo sapiens
gtcctccccttgggc

SEQ ID NO: 734174 - DNA, 19 bp, Homo sapiens
gtcctccccttgggcggct

SEQ ID NO: 734175 - DNA, 22 bp, Homo sapiens
gtcctcccgagctcctcttcca

SEQ ID NO: 734176 - DNA, 15 bp, Homo sapiens
gtcctcccgggccct

SEQ ID NO: 734177 - DNA, 12 bp, Homo sapiens
gtcctccctcag

SEQ ID NO: 734178 - DNA, 16 bp, Homo sapiens
gtcctccctcagcctc

SEQ ID NO: 734179 - DNA, 17 bp, Homo sapiens
gtcctccctcagcctcc

SEQ ID NO: 734180 - DNA, 21 bp, Homo sapiens
gtcctccctcagcctcccctt

SEQ ID NO: 734181 - DNA, 20 bp, Homo sapiens
gtcctccctgatcccacccc

SEQ ID NO: 734182 - DNA, 18 bp, Homo sapiens
gtcctccgccttaccagg

SEQ ID NO: 734183 - DNA, 21 bp, Homo sapiens
gtcctcctcacctcatgccca

SEQ ID NO: 734184 - DNA, 22 bp, Homo sapiens
gtcctcctcggatcaccgagag

SEQ ID NO: 734185 - DNA, 22 bp, Homo sapiens
tgggaggcggagagtacagtga

SEQ ID NO: 734186 - DNA, 13 bp, Homo sapiens
tgggaggctgagg

SEQ ID NO: 734187 - DNA, 14 bp, Homo sapiens
tgggaggctgaggc

SEQ ID NO: 734188 - DNA, 17 bp, Homo sapiens
tgggaggctgaggcagg

SEQ ID NO: 734189 - DNA, 15 bp, Homo sapiens
tgggaggctgaggcg

SEQ ID NO: 734190 - DNA, 14 bp, Homo sapiens
gtcctcctctgagg

SEQ ID NO: 734191 - DNA, 18 bp, Homo sapiens
gtcctcctctgaggaagc

SEQ ID NO: 734192 - DNA, 13 bp, Homo sapiens
gtcctcctctgtg

SEQ ID NO: 734193 - DNA, 19 bp, Homo sapiens
gtcctcctggaagggacct

SEQ ID NO: 734194 - DNA, 23 bp, Homo sapiens
gtcctctcagttctctcccttcc

SEQ ID NO: 734195 - DNA, 13 bp, Homo sapiens
gtcctctccccct

SEQ ID NO: 734196 - DNA, 14 bp, Homo sapiens
gtcctctccccctt

SEQ ID NO: 734197 - DNA, 15 bp, Homo sapiens
gtcctctcccccttc

SEQ ID NO: 734198 - DNA, 22 bp, Homo sapiens
gtcctctcccccttcagctcct

SEQ ID NO: 734199 - DNA, 16 bp, Homo sapiens
gtcctctcgagcccag

SEQ ID NO: 734200 - DNA, 17 bp, Homo sapiens
gtcctctcgagcccaga

SEQ ID NO: 734201 - DNA, 17 bp, Homo sapiens
gtcctctgaatgaacct

SEQ ID NO: 734202 - DNA, 13 bp, Homo sapiens
gtcctctgcctgg

SEQ ID NO: 734203 - DNA, 15 bp, Homo sapiens
gtcctctgcctgggc

SEQ ID NO: 734204 - DNA, 15 bp, Homo sapiens
gtcctctgctccagc

SEQ ID NO: 734205 - DNA, 18 bp, Homo sapiens
gtcctctgctccagcaac

SEQ ID NO: 734206 - DNA, 21 bp, Homo sapiens
gtcctctgctccagcaactgc

SEQ ID NO: 734207 - DNA, 13 bp, Homo sapiens
gtcctctggagcc

SEQ ID NO: 734208 - DNA, 18 bp, Homo sapiens
gtcctctggagccctaac

SEQ ID NO: 734209 - DNA, 21 bp, Homo sapiens
gtcctctggatggcaccagag

SEQ ID NO: 734210 - DNA, 18 bp, Homo sapiens
gtcctctgtcagtcacag

SEQ ID NO: 734211 - DNA, 17 bp, Homo sapiens
gtcctcttcaagtactg

SEQ ID NO: 734212 - DNA, 18 bp, Homo sapiens
gtcctcttccaccacaga

SEQ ID NO: 734213 - DNA, 13 bp, Homo sapiens
gtcctcttctggg

SEQ ID NO: 734214 - DNA, 21 bp, Homo sapiens
gtcctctttactcccttcctg

SEQ ID NO: 734215 - DNA, 19 bp, Homo sapiens
gtcctcttttcctggcagc

SEQ ID NO: 734216 - DNA, 21 bp, Homo sapiens
gtcctcttttcctggcagctg

SEQ ID NO: 734217 - DNA, 23 bp, Homo sapiens
gtcctcttttcctggcagctgct

SEQ ID NO: 734218 - DNA, 19 bp, Homo sapiens
gtcctgaaccgactgaccc

SEQ ID NO: 734219 - DNA, 15 bp, Homo sapiens
gtcctgaccaccctc

SEQ ID NO: 734220 - DNA, 16 bp, Homo sapiens
gtcctgaccaccctcc

SEQ ID NO: 734221 - DNA, 21 bp, Homo sapiens
gtcctgaccaccctcccctct

SEQ ID NO: 734222 - DNA, 17 bp, Homo sapiens
gtcctgacgccctgcgt

SEQ ID NO: 734223 - DNA, 16 bp, Homo sapiens
gtcctgaggagaggag

SEQ ID NO: 734224 - DNA, 14 bp, Homo sapiens
gtcctgaggagccc

SEQ ID NO: 734225 - DNA, 21 bp, Homo sapiens
gtcctgagggtccccacctgg

SEQ ID NO: 734226 - DNA, 17 bp, Homo sapiens
gtcctgatcagagccgt

SEQ ID NO: 734227 - DNA, 15 bp, Homo sapiens
gtcctgatctgtgat

SEQ ID NO: 734228 - DNA, 13 bp, Homo sapiens
gtcctgcagagga

SEQ ID NO: 734229 - DNA, 16 bp, Homo sapiens
gtcctgcagaggacca

SEQ ID NO: 734230 - DNA, 20 bp, Homo sapiens
gtcctgcagaggaccacagt

SEQ ID NO: 734231 - DNA, 23 bp, Homo sapiens
gtcctgcagcaaacactccaccc

SEQ ID NO: 734232 - DNA, 18 bp, Homo sapiens
gtcctgcagcctgcagga

SEQ ID NO: 734233 - DNA, 18 bp, Homo sapiens
gtcctgcagtcccacact

SEQ ID NO: 734234 - DNA, 14 bp, Homo sapiens
gtcctgccagctgc

SEQ ID NO: 734235 - DNA, 15 bp, Homo sapiens
gtcctgcccaatgcc

SEQ ID NO: 734236 - DNA, 16 bp, Homo sapiens
gtcctgcccaatgcct

SEQ ID NO: 734237 - DNA, 15 bp, Homo sapiens
gtcctgcccacccta

SEQ ID NO: 734238 - DNA, 19 bp, Homo sapiens
gtcctgcccaccctaccag

SEQ ID NO: 734239 - DNA, 14 bp, Homo sapiens
gtcctgcccatgcc

SEQ ID NO: 734240 - DNA, 16 bp, Homo sapiens
gtcctgcccatgtgtc

SEQ ID NO: 734241 - DNA, 15 bp, Homo sapiens
gtcctgcctcagcct

SEQ ID NO: 734242 - DNA, 12 bp, Homo sapiens
gtcctgcctcct

SEQ ID NO: 734243 - DNA, 17 bp, Homo sapiens
gtcctgcctgcaatatt

SEQ ID NO: 734244 - DNA, 14 bp, Homo sapiens
gtcctgcctggcca

SEQ ID NO: 734245 - DNA, 16 bp, Homo sapiens
gtcctgcctgtctgcc

SEQ ID NO: 734246 - DNA, 21 bp, Homo sapiens
gtcctgcctgtctgccccagc

SEQ ID NO: 734247 - DNA, 22 bp, Homo sapiens
gtcctgcctgtggcgccgtctc

SEQ ID NO: 734248 - DNA, 17 bp, Homo sapiens
gtcctgcgttcagcccc

SEQ ID NO: 734249 - DNA, 18 bp, Homo sapiens
gtcctgcgttcagcccct

SEQ ID NO: 734250 - DNA, 19 bp, Homo sapiens
gtcctgcgttcagcccctg

SEQ ID NO: 734251 - DNA, 17 bp, Homo sapiens
gtcctgctctcttcagg

SEQ ID NO: 734252 - DNA, 20 bp, Homo sapiens
gtcctgctctcttcaggagg

SEQ ID NO: 734253 - DNA, 21 bp, Homo sapiens
gtcctgctctcttcaggaggc

SEQ ID NO: 734254 - DNA, 14 bp, Homo sapiens
gtcctgctggagtg

SEQ ID NO: 734255 - DNA, 20 bp, Homo sapiens
gtcctggacaccgggccagt

SEQ ID NO: 734256 - DNA, 19 bp, Homo sapiens
gtcctggacacctcccagg

SEQ ID NO: 734257 - DNA, 22 bp, Homo sapiens
gtcctggacacctcccagggga

SEQ ID NO: 734258 - DNA, 19 bp, Homo sapiens
gtcctggagcagaccaccc

SEQ ID NO: 734259 - DNA, 19 bp, Homo sapiens
gtcctggatgatactaata

SEQ ID NO: 734260 - DNA, 17 bp, Homo sapiens
gtcctggatgttgtgtg

SEQ ID NO: 734261 - DNA, 13 bp, Homo sapiens
gtcctggcagctg

SEQ ID NO: 734262 - DNA, 15 bp, Homo sapiens
gtcctggcccttcag

SEQ ID NO: 734263 - DNA, 23 bp, Homo sapiens
gtcctggcccttcagtctgctcc

SEQ ID NO: 734264 - DNA, 22 bp, Homo sapiens
gtcctggccttgtgtcactggc

SEQ ID NO: 734265 - DNA, 15 bp, Homo sapiens
gtcctggctacatcc

SEQ ID NO: 734266 - DNA, 17 bp, Homo sapiens
gtcctggctacatccca

SEQ ID NO: 734267 - DNA, 20 bp, Homo sapiens
gtcctggctacatcccagcc

SEQ ID NO: 734268 - DNA, 21 bp, Homo sapiens
gtcctggctacatcccagcct

SEQ ID NO: 734269 - DNA, 22 bp, Homo sapiens
gtcctggctacatcccagcctg

SEQ ID NO: 734270 - DNA, 19 bp, Homo sapiens
gtcctggctcctgaggggc

SEQ ID NO: 734271 - DNA, 20 bp, Homo sapiens
gtcctgggagaacctcaggc

SEQ ID NO: 734272 - DNA, 11 bp, Homo sapiens
gtcctgggcag

SEQ ID NO: 734273 - DNA, 13 bp, Homo sapiens
gtcctgggcaggt

SEQ ID NO: 734274 - DNA, 15 bp, Homo sapiens
gtcctgggcaggtgg

SEQ ID NO: 734275 - DNA, 16 bp, Homo sapiens
gtcctgggcgccctgg

SEQ ID NO: 734276 - DNA, 19 bp, Homo sapiens
gtcctgggcgccctggaag

SEQ ID NO: 734277 - DNA, 23 bp, Homo sapiens
gtcctgggcgccctggaagccgg

SEQ ID NO: 734278 - DNA, 17 bp, Homo sapiens
gtcctggggctctgtgc

SEQ ID NO: 734279 - DNA, 14 bp, Homo sapiens
gtcctgggggcagg

SEQ ID NO: 734280 - DNA, 16 bp, Homo sapiens
gtcctggtacagcagg

SEQ ID NO: 734281 - DNA, 23 bp, Homo sapiens
gtcctggtgccctggatgcccag

SEQ ID NO: 734282 - DNA, 16 bp, Homo sapiens
gtcctggtgctctctg

SEQ ID NO: 734283 - DNA, 18 bp, Homo sapiens
gtcctggtgctctctgcc

SEQ ID NO: 734284 - DNA, 19 bp, Homo sapiens
gtcctgtagcacgctgcct

SEQ ID NO: 734285 - DNA, 17 bp, Homo sapiens
gtcctgtcactgatgga

SEQ ID NO: 734286 - DNA, 11 bp, Homo sapiens
gtcctgtccca

SEQ ID NO: 734287 - DNA, 23 bp, Homo sapiens
gtcctgtctgtccttctgaagtg

SEQ ID NO: 734288 - DNA, 18 bp, Homo sapiens
gtcctgtgaatgccactg

SEQ ID NO: 734289 - DNA, 18 bp, Homo sapiens
gtcctgtgctttctgcat

SEQ ID NO: 734290 - DNA, 22 bp, Homo sapiens
gtcctgttcagaaaggggctct

SEQ ID NO: 734291 - DNA, 17 bp, Homo sapiens
gtcctgttttcttaggc

SEQ ID NO: 734292 - DNA, 15 bp, Homo sapiens
gtccttagaacattt

SEQ ID NO: 734293 - DNA, 17 bp, Homo sapiens
gtccttagaacatttta

SEQ ID NO: 734294 - DNA, 17 bp, Homo sapiens
gtccttagactccttct

SEQ ID NO: 734295 - DNA, 23 bp, Homo sapiens
gtccttagactccttctccccaa

SEQ ID NO: 734296 - DNA, 15 bp, Homo sapiens
gtccttagtggaggg

SEQ ID NO: 734297 - DNA, 22 bp, Homo sapiens
gtccttatgttaagccctggca

SEQ ID NO: 734298 - DNA, 19 bp, Homo sapiens
gtccttattatcccagctt

SEQ ID NO: 734299 - DNA, 18 bp, Homo sapiens
gtccttatttatttaact

SEQ ID NO: 734300 - DNA, 13 bp, Homo sapiens
gtccttcagagct

SEQ ID NO: 734301 - DNA, 14 bp, Homo sapiens
gtccttcagagctc

SEQ ID NO: 734302 - DNA, 14 bp, Homo sapiens
gtccttccacctcg

SEQ ID NO: 734303 - DNA, 13 bp, Homo sapiens
gtccttccccttc

SEQ ID NO: 734304 - DNA, 17 bp, Homo sapiens
gtccttccccttccccg

SEQ ID NO: 734305 - DNA, 18 bp, Homo sapiens
gtccttccctgatggcct

SEQ ID NO: 734306 - DNA, 16 bp, Homo sapiens
gtccttcctctcaagc

SEQ ID NO: 734307 - DNA, 21 bp, Homo sapiens
gtccttctagcttttctcttt

SEQ ID NO: 734308 - DNA, 15 bp, Homo sapiens
gtccttctcattcat

SEQ ID NO: 734309 - DNA, 14 bp, Homo sapiens
gtccttgaaaatat

SEQ ID NO: 734310 - DNA, 15 bp, Homo sapiens
gtccttgaacccaac

SEQ ID NO: 734311 - DNA, 14 bp, Homo sapiens
gtccttgaactgag

SEQ ID NO: 734312 - DNA, 17 bp, Homo sapiens
tgggcctccttcccatg

SEQ ID NO: 734313 - DNA, 14 bp, Homo sapiens
tgggcctctcctgc

SEQ ID NO: 734314 - DNA, 13 bp, Homo sapiens
tgggcctctctgg

SEQ ID NO: 734315 - DNA, 14 bp, Homo sapiens
tgggcctctctggg

SEQ ID NO: 734316 - DNA, 19 bp, Homo sapiens
gtccttgatgccagagggc

SEQ ID NO: 734317 - DNA, 15 bp, Homo sapiens
gtccttgcagacaga

SEQ ID NO: 734318 - DNA, 16 bp, Homo sapiens
gtccttgccccactcc

SEQ ID NO: 734319 - DNA, 12 bp, Homo sapiens
gtccttgcctga

SEQ ID NO: 734320 - DNA, 19 bp, Homo sapiens
gtccttgcctgaactccag

SEQ ID NO: 734321 - DNA, 21 bp, Homo sapiens
gtccttgcctgaactccagag

SEQ ID NO: 734322 - DNA, 13 bp, Homo sapiens
gtccttggagtga

SEQ ID NO: 734323 - DNA, 15 bp, Homo sapiens
gtccttggccccctt

SEQ ID NO: 734324 - DNA, 20 bp, Homo sapiens
gtccttggctggactgtaga

SEQ ID NO: 734325 - DNA, 14 bp, Homo sapiens
gtccttggtgtgac

SEQ ID NO: 734326 - DNA, 22 bp, Homo sapiens
gtccttggtgtgaccctctgaa

SEQ ID NO: 734327 - DNA, 22 bp, Homo sapiens
gtccttggttgggtcaaggaca

SEQ ID NO: 734328 - DNA, 23 bp, Homo sapiens
gtccttgtatgaataaaaggctg

SEQ ID NO: 734329 - DNA, 21 bp, Homo sapiens
gtccttgtctctgggccactt

SEQ ID NO: 734330 - DNA, 19 bp, Homo sapiens
gtcctttaggcagcctgcc

SEQ ID NO: 734331 - DNA, 14 bp, Homo sapiens
gtcctttcccacca

SEQ ID NO: 734332 - DNA, 18 bp, Homo sapiens
gtcctttcccaccattcc

SEQ ID NO: 734333 - DNA, 20 bp, Homo sapiens
gtcctttcccaccattcctg

SEQ ID NO: 734334 - DNA, 11 bp, Homo sapiens
gtcctttccct

SEQ ID NO: 734335 - DNA, 21 bp, Homo sapiens
gtcctttggggcatagatcag

SEQ ID NO: 734336 - DNA, 15 bp, Homo sapiens
gtccttttcagaagt

SEQ ID NO: 734337 - DNA, 21 bp, Homo sapiens
gtccttttcataggtctgaaa

SEQ ID NO: 734338 - DNA, 23 bp, Homo sapiens
gtccttttctcccatttcttgct

SEQ ID NO: 734339 - DNA, 17 bp, Homo sapiens
gtccttttgacactgct

SEQ ID NO: 734340 - DNA, 19 bp, Homo sapiens
gtccttttgacactgctct

SEQ ID NO: 734341 - DNA, 12 bp, Homo sapiens
gtccttttggtt

SEQ ID NO: 734342 - DNA, 19 bp, Homo sapiens
gtcctttttcactttgaaa

SEQ ID NO: 734343 - DNA, 12 bp, Homo sapiens
gtcgagacactt

SEQ ID NO: 734344 - DNA, 14 bp, Homo sapiens
gtcgagagggctgt

SEQ ID NO: 734345 - DNA, 13 bp, Homo sapiens
gtcgagcactcta

SEQ ID NO: 734346 - DNA, 14 bp, Homo sapiens
gtcgaggggctctc

SEQ ID NO: 734347 - DNA, 19 bp, Homo sapiens
gtcgaggggctctcagctc

SEQ ID NO: 734348 - DNA, 15 bp, Homo sapiens
gtcgagtcaaaatgt

SEQ ID NO: 734349 - DNA, 14 bp, Homo sapiens
gtcgataatcagag

SEQ ID NO: 734350 - DNA, 13 bp, Homo sapiens
gtcgatgcacagt

SEQ ID NO: 734351 - DNA, 13 bp, Homo sapiens
gtcgccaggctag

SEQ ID NO: 734352 - DNA, 22 bp, Homo sapiens
gtcgccagtcactgctgcaagg

SEQ ID NO: 734353 - DNA, 21 bp, Homo sapiens
gtcgcccacccagctggtcct

SEQ ID NO: 734354 - DNA, 20 bp, Homo sapiens
gtcgcccaggctggagtgca

SEQ ID NO: 734355 - DNA, 16 bp, Homo sapiens
gtcgccccaggccctc

SEQ ID NO: 734356 - DNA, 18 bp, Homo sapiens
gtcgcccgctgagctgag

SEQ ID NO: 734357 - DNA, 21 bp, Homo sapiens
gtcgcccgctgagctgagtgg

SEQ ID NO: 734358 - DNA, 21 bp, Homo sapiens
gtcgcctgtaatgccagcgct

SEQ ID NO: 734359 - DNA, 16 bp, Homo sapiens
gtcgcgcgtctcccat

SEQ ID NO: 734360 - DNA, 20 bp, Homo sapiens
gtcgcgcgtctcccatcctg

SEQ ID NO: 734361 - DNA, 14 bp, Homo sapiens
gtcgctcaggctgg

SEQ ID NO: 734362 - DNA, 14 bp, Homo sapiens
gtcgctcagtctgt

SEQ ID NO: 734363 - DNA, 21 bp, Homo sapiens
gtcgctcatgtgtgcaacagg

SEQ ID NO: 734364 - DNA, 13 bp, Homo sapiens
gtcggaagcctgt

SEQ ID NO: 734365 - DNA, 15 bp, Homo sapiens
gtcggaagcctgtcc

SEQ ID NO: 734366 - DNA, 16 bp, Homo sapiens
gtcggaagcctgtcct

SEQ ID NO: 734367 - DNA, 16 bp, Homo sapiens
gtcggactgcccccag

SEQ ID NO: 734368 - DNA, 17 bp, Homo sapiens
gtcggactgcccccaga

SEQ ID NO: 734369 - DNA, 19 bp, Homo sapiens
gtcggagaggctgtctggg

SEQ ID NO: 734370 - DNA, 14 bp, Homo sapiens
gtcggagctgcctg

SEQ ID NO: 734371 - DNA, 16 bp, Homo sapiens
gtcggcatgccaggac

SEQ ID NO: 734372 - DNA, 16 bp, Homo sapiens
gtcggccagaggggct

SEQ ID NO: 734373 - DNA, 14 bp, Homo sapiens
gtcggctgaccatg

SEQ ID NO: 734374 - DNA, 17 bp, Homo sapiens
gtcggctgaccatgctc

SEQ ID NO: 734375 - DNA, 18 bp, Homo sapiens
gtcgggagttcgagacca

SEQ ID NO: 734376 - DNA, 22 bp, Homo sapiens
gtcgggatatttgggtgcagag

SEQ ID NO: 734377 - DNA, 14 bp, Homo sapiens
gtcgggcaccagcc

SEQ ID NO: 734378 - DNA, 21 bp, Homo sapiens
gtcgggcccttcttgctgccc

SEQ ID NO: 734379 - DNA, 23 bp, Homo sapiens
gtcgggcgtgggtctctggggac

SEQ ID NO: 734380 - DNA, 14 bp, Homo sapiens
gtcgggggctgagg

SEQ ID NO: 734381 - DNA, 15 bp, Homo sapiens
gtcggggttggggtg

SEQ ID NO: 734382 - DNA, 14 bp, Homo sapiens
gtcgggttttcaat

SEQ ID NO: 734383 - DNA, 14 bp, Homo sapiens
gtcgtaaagatttg

SEQ ID NO: 734384 - DNA, 19 bp, Homo sapiens
gtcgtcactaatacacagt

SEQ ID NO: 734385 - DNA, 17 bp, Homo sapiens
gtcgtcatcagatgctt

SEQ ID NO: 734386 - DNA, 13 bp, Homo sapiens
gtcgtgcctgtgt

SEQ ID NO: 734387 - DNA, 17 bp, Homo sapiens
gtcgtgcctgtgtccat

SEQ ID NO: 734388 - DNA, 13 bp, Homo sapiens
gtcgtggagccat

SEQ ID NO: 734389 - DNA, 19 bp, Homo sapiens
gtcgtgggccagtccccga

SEQ ID NO: 734390 - DNA, 21 bp, Homo sapiens
gtcgtggggtgtgctgggagc

SEQ ID NO: 734391 - DNA, 19 bp, Homo sapiens
gtcgtgttttcaaggaaga

SEQ ID NO: 734392 - DNA, 19 bp, Homo sapiens
gtctaaaaagacctggcct

SEQ ID NO: 734393 - DNA, 20 bp, Homo sapiens
gtctaaaaagacctggcctt

SEQ ID NO: 734394 - DNA, 17 bp, Homo sapiens
gtctaaagccttaacta

SEQ ID NO: 734395 - DNA, 23 bp, Homo sapiens
gtctaaagccttaactaagactc

SEQ ID NO: 734396 - DNA, 21 bp, Homo sapiens
gtctaaagctggtttaatgtt

SEQ ID NO: 734397 - DNA, 18 bp, Homo sapiens
gtctaaagttactactga

SEQ ID NO: 734398 - DNA, 23 bp, Homo sapiens
gtctaaatatttccttaaactgt

SEQ ID NO: 734399 - DNA, 12 bp, Homo sapiens
gtctaacagttt

SEQ ID NO: 734400 - DNA, 17 bp, Homo sapiens
gtctaactgtggaatat

SEQ ID NO: 734401 - DNA, 21 bp, Homo sapiens
gtctaaggagcgctagtgcct

SEQ ID NO: 734402 - DNA, 23 bp, Homo sapiens
gtctaaggagcgctagtgccttg

SEQ ID NO: 734403 - DNA, 23 bp, Homo sapiens
gtctaatctagtgacacctcagt

SEQ ID NO: 734404 - DNA, 20 bp, Homo sapiens
gtctaatgattcaaatgttt

SEQ ID NO: 734405 - DNA, 22 bp, Homo sapiens
gtctaatgtttgtgagaagctt

SEQ ID NO: 734406 - DNA, 22 bp, Homo sapiens
gtctaattgcatctcaaaatta

SEQ ID NO: 734407 - DNA, 17 bp, Homo sapiens
gtctacacaccctgcat

SEQ ID NO: 734408 - DNA, 12 bp, Homo sapiens
gtctacagaaaa

SEQ ID NO: 734409 - DNA, 17 bp, Homo sapiens
gtctacagttgtcctga

SEQ ID NO: 734410 - DNA, 14 bp, Homo sapiens
gtctacattaaaca

SEQ ID NO: 734411 - DNA, 15 bp, Homo sapiens
gtctacattaaacaa

SEQ ID NO: 734412 - DNA, 15 bp, Homo sapiens
gtctaccctgtcctt

SEQ ID NO: 734413 - DNA, 17 bp, Homo sapiens
gtctacctcatctctga

SEQ ID NO: 734414 - DNA, 14 bp, Homo sapiens
gtctacctggcaga

SEQ ID NO: 734415 - DNA, 22 bp, Homo sapiens
gtctagagtcatgtgagcctcg

SEQ ID NO: 734416 - DNA, 16 bp, Homo sapiens
gtctagatggctcctc

SEQ ID NO: 734417 - DNA, 17 bp, Homo sapiens
gtctagatggctcctct

SEQ ID NO: 734418 - DNA, 18 bp, Homo sapiens
gtctagccactccctccc

SEQ ID NO: 734419 - DNA, 13 bp, Homo sapiens
gtctaggagctgg

SEQ ID NO: 734420 - DNA, 21 bp, Homo sapiens
gtctaggagctgggaggaaaa

SEQ ID NO: 734421 - DNA, 23 bp, Homo sapiens
gtctaggcaggacctgtggccaa

SEQ ID NO: 734422 - DNA, 15 bp, Homo sapiens
gtctaggtctcctca

SEQ ID NO: 734423 - DNA, 16 bp, Homo sapiens
gtctaggtctcctcag

SEQ ID NO: 734424 - DNA, 14 bp, Homo sapiens
gtctagtcttctgg

SEQ ID NO: 734425 - DNA, 13 bp, Homo sapiens
gtctagtgtctgg

SEQ ID NO: 734426 - DNA, 12 bp, Homo sapiens
gtctataaaata

SEQ ID NO: 734427 - DNA, 17 bp, Homo sapiens
gtctataaaataaactt

SEQ ID NO: 734428 - DNA, 18 bp, Homo sapiens
gtctataaaataaacttc

SEQ ID NO: 734429 - DNA, 21 bp, Homo sapiens
gtctataaaataaacttctta

SEQ ID NO: 734430 - DNA, 13 bp, Homo sapiens
gtctataaagcat

SEQ ID NO: 734431 - DNA, 20 bp, Homo sapiens
gtctataaagcatttaaccc

SEQ ID NO: 734432 - DNA, 20 bp, Homo sapiens
gtctataatcccagcacttt

SEQ ID NO: 734433 - DNA, 20 bp, Homo sapiens
gtctataatggaaacattta

SEQ ID NO: 734434 - DNA, 16 bp, Homo sapiens
gtctctatattatgtc

SEQ ID NO: 734435 - DNA, 20 bp, Homo sapiens
gtctctatattatgtcttct

SEQ ID NO: 734436 - DNA, 13 bp, Homo sapiens
gtctctcccaccc

SEQ ID NO: 734437 - DNA, 16 bp, Homo sapiens
gtctctccccctctgt

SEQ ID NO: 734438 - DNA, 17 bp, Homo sapiens
gtctctccccctctgtc

SEQ ID NO: 734439 - DNA, 21 bp, Homo sapiens
gtctctccccctctgtcttct

SEQ ID NO: 734440 - DNA, 20 bp, Homo sapiens
gtctctccccggtaatgtca

SEQ ID NO: 734441 - DNA, 15 bp, Homo sapiens
gtctctcccttccag

SEQ ID NO: 734442 - DNA, 14 bp, Homo sapiens
gtctctcctagccc

SEQ ID NO: 734443 - DNA, 17 bp, Homo sapiens
gtctctcctagcccctc

SEQ ID NO: 734444 - DNA, 18 bp, Homo sapiens
gtctctcctagcccctct

SEQ ID NO: 734445 - DNA, 19 bp, Homo sapiens
gtctctcctagcccctctc

SEQ ID NO: 734446 - DNA, 21 bp, Homo sapiens
tgggctggggccacctttgtg

SEQ ID NO: 734447 - DNA, 18 bp, Homo sapiens
tgggctggggcctcagac

SEQ ID NO: 734448 - DNA, 12 bp, Homo sapiens
tgggctggggct

SEQ ID NO: 734449 - DNA, 17 bp, Homo sapiens
tgggctggggctgctcc

SEQ ID NO: 734450 - DNA, 20 bp, Homo sapiens
tgggctggggctgctcccct

SEQ ID NO: 734451 - DNA, 14 bp, Homo sapiens
tgggctggtatctc

SEQ ID NO: 734452 - DNA, 15 bp, Homo sapiens
tgggctggtattctc

SEQ ID NO: 734453 - DNA, 16 bp, Homo sapiens
tgggctggtattctct

SEQ ID NO: 734454 - DNA, 14 bp, Homo sapiens
tgggctggtgcccc

SEQ ID NO: 734455 - DNA, 18 bp, Homo sapiens
tgggctggtgccccacag

SEQ ID NO: 734456 - DNA, 20 bp, Homo sapiens
tgggctggtgccccacagct

SEQ ID NO: 734457 - DNA, 16 bp, Homo sapiens
tgggctgtccagcctt

SEQ ID NO: 734458 - DNA, 16 bp, Homo sapiens
tgggctgtctgtcacc

SEQ ID NO: 734459 - DNA, 15 bp, Homo sapiens
tgggctgtgagtgta

SEQ ID NO: 734460 - DNA, 12 bp, Homo sapiens
tgggctgtgcta

SEQ ID NO: 734461 - DNA, 21 bp, Homo sapiens
tgggctgtgtcctaaggccca

SEQ ID NO: 734462 - DNA, 17 bp, Homo sapiens
tgggctgttggcactca

SEQ ID NO: 734463 - DNA, 22 bp, Homo sapiens
tgggcttaaggcctaaggaagc

SEQ ID NO: 734464 - DNA, 19 bp, Homo sapiens
tgggcttagtatttctcag

SEQ ID NO: 734465 - DNA, 13 bp, Homo sapiens
tgggcttatatct

SEQ ID NO: 734466 - DNA, 14 bp, Homo sapiens
tgggcttcagcact

SEQ ID NO: 734467 - DNA, 21 bp, Homo sapiens
tgggcttcctgcccttccctc

SEQ ID NO: 734468 - DNA, 19 bp, Homo sapiens
tgggcttcctgctgggact

SEQ ID NO: 734469 - DNA, 12 bp, Homo sapiens
tgggcttctgtt

SEQ ID NO: 734470 - DNA, 16 bp, Homo sapiens
tgggcttctgttctct

SEQ ID NO: 734471 - DNA, 14 bp, Homo sapiens
tgggcttcttcctc

SEQ ID NO: 734472 - DNA, 16 bp, Homo sapiens
tgggcttcttcctcct

SEQ ID NO: 734473 - DNA, 11 bp, Homo sapiens
tgggcttgagc

SEQ ID NO: 734474 - DNA, 16 bp, Homo sapiens
tgggcttggcctgctg

SEQ ID NO: 734475 - DNA, 17 bp, Homo sapiens
tgggcttggcctgctgt

SEQ ID NO: 734476 - DNA, 13 bp, Homo sapiens
tgggcttggctct

SEQ ID NO: 734477 - DNA, 21 bp, Homo sapiens
tgggcttgtctgtagatttta

SEQ ID NO: 734478 - DNA, 22 bp, Homo sapiens
tgggcttgtgatttccatttct

SEQ ID NO: 734479 - DNA, 16 bp, Homo sapiens
tgggctttaaaagaaa

SEQ ID NO: 734480 - DNA, 18 bp, Homo sapiens
tgggctttctccggggtc

SEQ ID NO: 734481 - DNA, 14 bp, Homo sapiens
tgggctttctcctg

SEQ ID NO: 734482 - DNA, 24 bp, Homo sapiens
tgggctttctcctggagatagctg

SEQ ID NO: 734483 - DNA, 22 bp, Homo sapiens
tgggcttttgttctgaggggtg

SEQ ID NO: 734484 - DNA, 15 bp, Homo sapiens
tggggaaaaaaaaga

SEQ ID NO: 734485 - DNA, 14 bp, Homo sapiens
tggggaaaatggcc

SEQ ID NO: 734486 - DNA, 21 bp, Homo sapiens
tggggaaacaacatttatatg

SEQ ID NO: 734487 - DNA, 21 bp, Homo sapiens
tggggaaaccctggagccatc

SEQ ID NO: 734488 - DNA, 19 bp, Homo sapiens
tggggaaaggaggtggggg

SEQ ID NO: 734489 - DNA, 11 bp, Homo sapiens
tggggaaaggg

SEQ ID NO: 734490 - DNA, 21 bp, Homo sapiens
tggggaaaggggtcggctgac

SEQ ID NO: 734491 - DNA, 19 bp, Homo sapiens
tggggaacaggtcttgggg

SEQ ID NO: 734492 - DNA, 16 bp, Homo sapiens
tggggaagactgtggc

SEQ ID NO: 734493 - DNA, 17 bp, Homo sapiens
tggggaagactgtggct

SEQ ID NO: 734494 - DNA, 22 bp, Homo sapiens
tggggaagaggactgtgtgaga

SEQ ID NO: 734495 - DNA, 19 bp, Homo sapiens
tggggaagaggatgagcag

SEQ ID NO: 734496 - DNA, 11 bp, Homo sapiens
tggggaaggag

SEQ ID NO: 734497 - DNA, 15 bp, Homo sapiens
tggggaaggagccag

SEQ ID NO: 734498 - DNA, 16 bp, Homo sapiens
tggggaaggagccagt

SEQ ID NO: 734499 - DNA, 14 bp, Homo sapiens
tggggaaggcaaga

SEQ ID NO: 734500 - DNA, 15 bp, Homo sapiens
tggggaaggcagagg

SEQ ID NO: 734501 - DNA, 17 bp, Homo sapiens
tggggaaggcagaggct

SEQ ID NO: 734502 - DNA, 22 bp, Homo sapiens
tggggaaggcagaggctggcac

SEQ ID NO: 734503 - DNA, 16 bp, Homo sapiens
tggggaagggcctgcc

SEQ ID NO: 734504 - DNA, 15 bp, Homo sapiens
tggggaagggtgggg

SEQ ID NO: 734505 - DNA, 20 bp, Homo sapiens
tggggaaggttatcagtgct

SEQ ID NO: 734506 - DNA, 17 bp, Homo sapiens
tggggaatgctcccagc

SEQ ID NO: 734507 - DNA, 17 bp, Homo sapiens
tggggaattaaatagtg

SEQ ID NO: 734508 - DNA, 14 bp, Homo sapiens
tggggaatttcctc

SEQ ID NO: 734509 - DNA, 16 bp, Homo sapiens
tggggaatttcctcta

SEQ ID NO: 734510 - DNA, 18 bp, Homo sapiens
tggggacacagcagtgag

SEQ ID NO: 734511 - DNA, 17 bp, Homo sapiens
tggggacagagccaccc

SEQ ID NO: 734512 - DNA, 20 bp, Homo sapiens
tggggacagagccaccccat

SEQ ID NO: 734513 - DNA, 14 bp, Homo sapiens
tggggacagcttcc

SEQ ID NO: 734514 - DNA, 15 bp, Homo sapiens
tggggacagggaggg

SEQ ID NO: 734515 - DNA, 23 bp, Homo sapiens
tggggacagggagggggacctgt

SEQ ID NO: 734516 - DNA, 18 bp, Homo sapiens
tggggacatctctttgaa

SEQ ID NO: 734517 - DNA, 18 bp, Homo sapiens
tggggaccaaaggtcagg

SEQ ID NO: 734518 - DNA, 21 bp, Homo sapiens
tggggacccaggctccgccct

SEQ ID NO: 734519 - DNA, 21 bp, Homo sapiens
tggggacgtgaacgttttaat

SEQ ID NO: 734520 - DNA, 19 bp, Homo sapiens
tggggactcgggggctggt

SEQ ID NO: 734521 - DNA, 14 bp, Homo sapiens
tggggactctgccg

SEQ ID NO: 734522 - DNA, 14 bp, Homo sapiens
tggggactctggca

SEQ ID NO: 734523 - DNA, 17 bp, Homo sapiens
tggggactctggcacag

SEQ ID NO: 734524 - DNA, 16 bp, Homo sapiens
tggggacttgtgtctg

SEQ ID NO: 734525 - DNA, 21 bp, Homo sapiens
tggggactttatttatttcta

SEQ ID NO: 734526 - DNA, 11 bp, Homo sapiens
tggggagaaat

SEQ ID NO: 734527 - DNA, 19 bp, Homo sapiens
tggggagaaataaattttg

SEQ ID NO: 734528 - DNA, 16 bp, Homo sapiens
tggggagaaataattg

SEQ ID NO: 734529 - DNA, 14 bp, Homo sapiens
tggggagaggcact

SEQ ID NO: 734530 - DNA, 20 bp, Homo sapiens
tggggagagggatttccctg

SEQ ID NO: 734531 - DNA, 16 bp, Homo sapiens
tggggagatgggggct

SEQ ID NO: 734532 - DNA, 16 bp, Homo sapiens
tggggagcaggaggcc

SEQ ID NO: 734533 - DNA, 23 bp, Homo sapiens
tggggagcaggaggccaataaaa

SEQ ID NO: 734534 - DNA, 22 bp, Homo sapiens
tggggagcagttttcccctggc

SEQ ID NO: 734535 - DNA, 19 bp, Homo sapiens
tggggagcccgtctcagtg

SEQ ID NO: 734536 - DNA, 14 bp, Homo sapiens
tggggagccctcag

SEQ ID NO: 734537 - DNA, 16 bp, Homo sapiens
tggggagccctcaggc

SEQ ID NO: 734538 - DNA, 24 bp, Homo sapiens
tggggagccctcaggctccccaga

SEQ ID NO: 734539 - DNA, 16 bp, Homo sapiens
tggggagctcctggcc

SEQ ID NO: 734540 - DNA, 12 bp, Homo sapiens
tggggaggacaa

SEQ ID NO: 734541 - DNA, 15 bp, Homo sapiens
tggggaggaggaagc

SEQ ID NO: 734542 - DNA, 16 bp, Homo sapiens
tggggaggcagcagag

SEQ ID NO: 734543 - DNA, 18 bp, Homo sapiens
tggggaggcagcagagcg

SEQ ID NO: 734544 - DNA, 13 bp, Homo sapiens
tggggaggcaggc

SEQ ID NO: 734545 - DNA, 17 bp, Homo sapiens
tggggaggcccaaatga

SEQ ID NO: 734546 - DNA, 17 bp, Homo sapiens
tggggagggccgtaccc

SEQ ID NO: 734547 - DNA, 21 bp, Homo sapiens
tggggagggccgtaccccacc

SEQ ID NO: 734548 - DNA, 19 bp, Homo sapiens
tggggaggggggcgggtga

SEQ ID NO: 734549 - DNA, 19 bp, Homo sapiens
tggggaggtgctgggggag

SEQ ID NO: 734550 - DNA, 24 bp, Homo sapiens
tggggaggtgctgggggagccctg

SEQ ID NO: 734551 - DNA, 18 bp, Homo sapiens
tggggaggtgggaggcca

SEQ ID NO: 734552 - DNA, 16 bp, Homo sapiens
tggggagtgggacaga

SEQ ID NO: 734553 - DNA, 19 bp, Homo sapiens
tggggagtgggacagagtc

SEQ ID NO: 734554 - DNA, 23 bp, Homo sapiens
tggggagtgggtggcaggtgggg

SEQ ID NO: 734555 - DNA, 18 bp, Homo sapiens
tggggataataatactga

SEQ ID NO: 734556 - DNA, 22 bp, Homo sapiens
gtctgccgcccacctcgctccc

SEQ ID NO: 734557 - DNA, 24 bp, Homo sapiens
gtctgcgtgggtttttgtatccag

SEQ ID NO: 734558 - DNA, 15 bp, Homo sapiens
gtctgctaggcgctg

SEQ ID NO: 734559 - DNA, 23 bp, Homo sapiens
gtctgctcagacagaacccctac

SEQ ID NO: 734560 - DNA, 11 bp, Homo sapiens
gtctgctctgc

SEQ ID NO: 734561 - DNA, 12 bp, Homo sapiens
gtctgctctgct

SEQ ID NO: 734562 - DNA, 14 bp, Homo sapiens
gtctgctctgctgc

SEQ ID NO: 734563 - DNA, 21 bp, Homo sapiens
gtctgctctgctgctctgacc

SEQ ID NO: 734564 - DNA, 17 bp, Homo sapiens
gtctgctcttctgtgcc

SEQ ID NO: 734565 - DNA, 16 bp, Homo sapiens
gtctgctgccctccat

SEQ ID NO: 734566 - DNA, 19 bp, Homo sapiens
gtctgctgccgcaggagca

SEQ ID NO: 734567 - DNA, 14 bp, Homo sapiens
gtctgctgtagaaa

SEQ ID NO: 734568 - DNA, 17 bp, Homo sapiens
gtctgcttaaagcttcc

SEQ ID NO: 734569 - DNA, 19 bp, Homo sapiens
gtctgcttaaagcttccct

SEQ ID NO: 734570 - DNA, 17 bp, Homo sapiens
gtctgcttctgtccagg

SEQ ID NO: 734571 - DNA, 17 bp, Homo sapiens
gtctggaaaacagaaac

SEQ ID NO: 734572 - DNA, 10 bp, Homo sapiens
gtctggaaag

SEQ ID NO: 734573 - DNA, 15 bp, Homo sapiens
gtctggacctccatc

SEQ ID NO: 734574 - DNA, 20 bp, Homo sapiens
tggggcaatagggttaaatg

SEQ ID NO: 734575 - DNA, 15 bp, Homo sapiens
tggggcacagtccag

SEQ ID NO: 734576 - DNA, 13 bp, Homo sapiens
tggggcagaagag

SEQ ID NO: 734577 - DNA, 21 bp, Homo sapiens
tggggcagaggggcagccgct

SEQ ID NO: 734578 - DNA, 10 bp, Homo sapiens
tggggcagca

SEQ ID NO: 734579 - DNA, 19 bp, Homo sapiens
tggggcagcacacctctgg

SEQ ID NO: 734580 - DNA, 13 bp, Homo sapiens
tggggcagcactc

SEQ ID NO: 734581 - DNA, 23 bp, Homo sapiens
tggggcaggagtgccaggaccag

SEQ ID NO: 734582 - DNA, 23 bp, Homo sapiens
tggggcaggctctctcctctctc

SEQ ID NO: 734583 - DNA, 13 bp, Homo sapiens
tggggcaggggcc

SEQ ID NO: 734584 - DNA, 16 bp, Homo sapiens
tggggcaggggcctgg

SEQ ID NO: 734585 - DNA, 18 bp, Homo sapiens
tggggcaggggcctgggc

SEQ ID NO: 734586 - DNA, 19 bp, Homo sapiens
tggggcaggggcctgggcc

SEQ ID NO: 734587 - DNA, 20 bp, Homo sapiens
tggggcaggggcctgggccg

SEQ ID NO: 734588 - DNA, 11 bp, Homo sapiens
tggggcagtgg

SEQ ID NO: 734589 - DNA, 14 bp, Homo sapiens
tggggcatcctgga

SEQ ID NO: 734590 - DNA, 17 bp, Homo sapiens
tggggcatcctggatga

SEQ ID NO: 734591 - DNA, 22 bp, Homo sapiens
tggggcatgacctcagtcaggc

SEQ ID NO: 734592 - DNA, 23 bp, Homo sapiens
tggggcatggttccttccctggg

SEQ ID NO: 734593 - DNA, 14 bp, Homo sapiens
tggggcatgtcctt

SEQ ID NO: 734594 - DNA, 16 bp, Homo sapiens
tggggcatgtgtgcct

SEQ ID NO: 734595 - DNA, 18 bp, Homo sapiens
tggggccagaggctggga

SEQ ID NO: 734596 - DNA, 12 bp, Homo sapiens
tggggccaggac

SEQ ID NO: 734597 - DNA, 15 bp, Homo sapiens
tggggccagggcaga

SEQ ID NO: 734598 - DNA, 15 bp, Homo sapiens
tggggccaggtcacc

SEQ ID NO: 734599 - DNA, 14 bp, Homo sapiens
tggggccatgcctc

SEQ ID NO: 734600 - DNA, 20 bp, Homo sapiens
tggggccatgcctcctcagg

SEQ ID NO: 734601 - DNA, 12 bp, Homo sapiens
tggggccccatc

SEQ ID NO: 734602 - DNA, 20 bp, Homo sapiens
tggggccccatcagctgcca

SEQ ID NO: 734603 - DNA, 21 bp, Homo sapiens
tggggcccctttttactcccc

SEQ ID NO: 734604 - DNA, 20 bp, Homo sapiens
tggggccctctatgctggct

SEQ ID NO: 734605 - DNA, 19 bp, Homo sapiens
tggggccctgcccctagga

SEQ ID NO: 734606 - DNA, 17 bp, Homo sapiens
tggggcccttgggccac

SEQ ID NO: 734607 - DNA, 13 bp, Homo sapiens
tggggccgcctgc

SEQ ID NO: 734608 - DNA, 14 bp, Homo sapiens
tggggccgcctgcc

SEQ ID NO: 734609 - DNA, 15 bp, Homo sapiens
tggggccgcctgccc

SEQ ID NO: 734610 - DNA, 18 bp, Homo sapiens
tggggccgcctgccctgc

SEQ ID NO: 734611 - DNA, 23 bp, Homo sapiens
tggggccgcctgccctgccttgc

SEQ ID NO: 734612 - DNA, 22 bp, Homo sapiens
tggggcctagcgatctctcctg

SEQ ID NO: 734613 - DNA, 20 bp, Homo sapiens
tggggcctcaatctaaggcc

SEQ ID NO: 734614 - DNA, 22 bp, Homo sapiens
tggggcctcagaccccctcagc

SEQ ID NO: 734615 - DNA, 14 bp, Homo sapiens
tggggcctcagacg

SEQ ID NO: 734616 - DNA, 16 bp, Homo sapiens
tggggcctcagcctgg

SEQ ID NO: 734617 - DNA, 18 bp, Homo sapiens
tggggcctcagcctgggg

SEQ ID NO: 734618 - DNA, 23 bp, Homo sapiens
tggggcctcagcctggggctctc

SEQ ID NO: 734619 - DNA, 14 bp, Homo sapiens
tggggcctccagaa

SEQ ID NO: 734620 - DNA, 20 bp, Homo sapiens
tggggcctccagaactcact

SEQ ID NO: 734621 - DNA, 22 bp, Homo sapiens
tggggcctccagaagctgctcc

SEQ ID NO: 734622 - DNA, 13 bp, Homo sapiens
tggggcctgactg

SEQ ID NO: 734623 - DNA, 17 bp, Homo sapiens
tggggcctggacctgcc

SEQ ID NO: 734624 - DNA, 19 bp, Homo sapiens
tggggcctggacctgcctc

SEQ ID NO: 734625 - DNA, 12 bp, Homo sapiens
tggggcctggct

SEQ ID NO: 734626 - DNA, 20 bp, Homo sapiens
tggggcctggcttgctccag

SEQ ID NO: 734627 - DNA, 21 bp, Homo sapiens
tggggcctggcttgctccagg

SEQ ID NO: 734628 - DNA, 12 bp, Homo sapiens
tggggcctgtgg

SEQ ID NO: 734629 - DNA, 14 bp, Homo sapiens
tggggcctgtggaa

SEQ ID NO: 734630 - DNA, 16 bp, Homo sapiens
tggggcctgtggaatg

SEQ ID NO: 734631 - DNA, 22 bp, Homo sapiens
tggggcctgtggaatgagtgtg

SEQ ID NO: 734632 - DNA, 14 bp, Homo sapiens
tggggccttggcct

SEQ ID NO: 734633 - DNA, 12 bp, Homo sapiens
tggggccttggt

SEQ ID NO: 734634 - DNA, 20 bp, Homo sapiens
tggggcgggcagccaggctg

SEQ ID NO: 734635 - DNA, 16 bp, Homo sapiens
tggggctaaatgaagt

SEQ ID NO: 734636 - DNA, 23 bp, Homo sapiens
tggggctacagaatagggtggca

SEQ ID NO: 734637 - DNA, 22 bp, Homo sapiens
tggggctcaagcagttctccca

SEQ ID NO: 734638 - DNA, 14 bp, Homo sapiens
tggggctcccgccc

SEQ ID NO: 734639 - DNA, 23 bp, Homo sapiens
tggggctcctttctccagccagc

SEQ ID NO: 734640 - DNA, 17 bp, Homo sapiens
tggggctcgccatgccg

SEQ ID NO: 734641 - DNA, 18 bp, Homo sapiens
tggggctcgccccaccca

SEQ ID NO: 734642 - DNA, 13 bp, Homo sapiens
tggggctctggga

SEQ ID NO: 734643 - DNA, 15 bp, Homo sapiens
tggggctctgtgcag

SEQ ID NO: 734644 - DNA, 17 bp, Homo sapiens
tggggctctgtgcaggg

SEQ ID NO: 734645 - DNA, 11 bp, Homo sapiens
tggggctgaac

SEQ ID NO: 734646 - DNA, 13 bp, Homo sapiens
tggggctgcaggc

SEQ ID NO: 734647 - DNA, 21 bp, Homo sapiens
tggggctgcaggcaggcggct

SEQ ID NO: 734648 - DNA, 20 bp, Homo sapiens
tggggctgccatagggtctg

SEQ ID NO: 734649 - DNA, 20 bp, Homo sapiens
tggggctgccggatctgggc

SEQ ID NO: 734650 - DNA, 12 bp, Homo sapiens
tggggctgctcc

SEQ ID NO: 734651 - DNA, 13 bp, Homo sapiens
tggggctgctccc

SEQ ID NO: 734652 - DNA, 16 bp, Homo sapiens
tggggctgctccccta

SEQ ID NO: 734653 - DNA, 19 bp, Homo sapiens
tggggctgctcctccaggg

SEQ ID NO: 734654 - DNA, 15 bp, Homo sapiens
tggggctgggcaccg

SEQ ID NO: 734655 - DNA, 16 bp, Homo sapiens
tggggctggttctgta

SEQ ID NO: 734656 - DNA, 18 bp, Homo sapiens
tggggcttacagaaatga

SEQ ID NO: 734657 - DNA, 22 bp, Homo sapiens
tggggcttatgggtggctttca

SEQ ID NO: 734658 - DNA, 21 bp, Homo sapiens
tggggcttcaccagtctgtct

SEQ ID NO: 734659 - DNA, 13 bp, Homo sapiens
tgggggaaaaaaa

SEQ ID NO: 734660 - DNA, 22 bp, Homo sapiens
tgggggaagattttatgcacag

SEQ ID NO: 734661 - DNA, 20 bp, Homo sapiens
tgggggaaggcgctgggtgc

SEQ ID NO: 734662 - DNA, 20 bp, Homo sapiens
tgggggacccaggtgggact

SEQ ID NO: 734663 - DNA, 14 bp, Homo sapiens
tgggggactgggag

SEQ ID NO: 734664 - DNA, 21 bp, Homo sapiens
tgggggactgggagtcagagc

SEQ ID NO: 734665 - DNA, 19 bp, Homo sapiens
tgggggagaaaaaatcact

SEQ ID NO: 734666 - DNA, 14 bp, Homo sapiens
tgggggagagggtg

SEQ ID NO: 734667 - DNA, 14 bp, Homo sapiens
tgggggaggcaggg

SEQ ID NO: 734668 - DNA, 18 bp, Homo sapiens
tgggggaggccaccccaa

SEQ ID NO: 734669 - DNA, 21 bp, Homo sapiens
tgggggagtagatctttctag

SEQ ID NO: 734670 - DNA, 21 bp, Homo sapiens
tgggggatcacagcctctgaa

SEQ ID NO: 734671 - DNA, 20 bp, Homo sapiens
tgggggatgactagaggcag

SEQ ID NO: 734672 - DNA, 15 bp, Homo sapiens
tgggggatgcttcat

SEQ ID NO: 734673 - DNA, 18 bp, Homo sapiens
tgggggatgggccagggt

SEQ ID NO: 734674 - DNA, 21 bp, Homo sapiens
tgggggatgggccagggttta

SEQ ID NO: 734675 - DNA, 23 bp, Homo sapiens
tgggggcacagctgtctgccagg

SEQ ID NO: 734676 - DNA, 16 bp, Homo sapiens
tgggggcagagggcag

SEQ ID NO: 734677 - DNA, 21 bp, Homo sapiens
tgggggcaggaaagccacatc

SEQ ID NO: 734678 - DNA, 18 bp, Homo sapiens
gtcttatctgttcagtgt

SEQ ID NO: 734679 - DNA, 21 bp, Homo sapiens
gtcttatcttctgcagtgagt

SEQ ID NO: 734680 - DNA, 16 bp, Homo sapiens
gtcttatgattttatt

SEQ ID NO: 734681 - DNA, 20 bp, Homo sapiens
gtcttatgattttattacag

SEQ ID NO: 734682 - DNA, 16 bp, Homo sapiens
gtcttatggtccagaa

SEQ ID NO: 734683 - DNA, 20 bp, Homo sapiens
gtcttatggtccagaaactc

SEQ ID NO: 734684 - DNA, 22 bp, Homo sapiens
gtcttatgtaaagtatgttttt

SEQ ID NO: 734685 - DNA, 23 bp, Homo sapiens
gtcttatgtaaagtatgttttta

SEQ ID NO: 734686 - DNA, 19 bp, Homo sapiens
gtcttatgtgaaaaattaa

SEQ ID NO: 734687 - DNA, 20 bp, Homo sapiens
gtcttatgtgaaaaattaac

SEQ ID NO: 734688 - DNA, 22 bp, Homo sapiens
gtcttatgtgaaaaattaactt

SEQ ID NO: 734689 - DNA, 14 bp, Homo sapiens
gtcttcaagggctt

SEQ ID NO: 734690 - DNA, 15 bp, Homo sapiens
gtcttcaatctctgt

SEQ ID NO: 734691 - DNA, 20 bp, Homo sapiens
gtcttcaatctctgttctgc

SEQ ID NO: 734692 - DNA, 19 bp, Homo sapiens
gtcttcactttcctcagtt

SEQ ID NO: 734693 - DNA, 17 bp, Homo sapiens
gtcttcagacccagaga

SEQ ID NO: 734694 - DNA, 18 bp, Homo sapiens
gtcttcagacccagagaa

SEQ ID NO: 734695 - DNA, 22 bp, Homo sapiens
gtcttcagacccagagaaggac

SEQ ID NO: 734696 - DNA, 18 bp, Homo sapiens
gtcttcagcacattccac

SEQ ID NO: 734697 - DNA, 12 bp, Homo sapiens
gtcttcagccta

SEQ ID NO: 734698 - DNA, 16 bp, Homo sapiens
gtcttcagcctccctc

SEQ ID NO: 734699 - DNA, 18 bp, Homo sapiens
gtcttcagcctccctcag

SEQ ID NO: 734700 - DNA, 13 bp, Homo sapiens
gtcttcagggctc

SEQ ID NO: 734701 - DNA, 22 bp, Homo sapiens
gtcttcagtggaacacaaatga

SEQ ID NO: 734702 - DNA, 23 bp, Homo sapiens
tggggggacagagactcagatga

SEQ ID NO: 734703 - DNA, 15 bp, Homo sapiens
tggggggaggaagca

SEQ ID NO: 734704 - DNA, 11 bp, Homo sapiens
tggggggaggg

SEQ ID NO: 734705 - DNA, 14 bp, Homo sapiens
tggggggccacccg

SEQ ID NO: 734706 - DNA, 14 bp, Homo sapiens
tggggggccgggca

SEQ ID NO: 734707 - DNA, 16 bp, Homo sapiens
tggggggcgggccagg

SEQ ID NO: 734708 - DNA, 14 bp, Homo sapiens
tgggggggctgcct

SEQ ID NO: 734709 - DNA, 16 bp, Homo sapiens
tgggggggctgccttt

SEQ ID NO: 734710 - DNA, 18 bp, Homo sapiens
tgggggtagagctgatcc

SEQ ID NO: 734711 - DNA, 21 bp, Homo sapiens
tgggggtagagctgatccaga

SEQ ID NO: 734712 - DNA, 11 bp, Homo sapiens
tgggggtcaga

SEQ ID NO: 734713 - DNA, 13 bp, Homo sapiens
tgggggtcagaag

SEQ ID NO: 734714 - DNA, 18 bp, Homo sapiens
tgggggtcagtgctgcct

SEQ ID NO: 734715 - DNA, 18 bp, Homo sapiens
tgggggtggaggcttcct

SEQ ID NO: 734716 - DNA, 15 bp, Homo sapiens
tgggggtggcaggca

SEQ ID NO: 734717 - DNA, 19 bp, Homo sapiens
tgggggtggccatccctgg

SEQ ID NO: 734718 - DNA, 18 bp, Homo sapiens
tgggggtgggcagcagca

SEQ ID NO: 734719 - DNA, 21 bp, Homo sapiens
tgggggtgggctgctggccat

SEQ ID NO: 734720 - DNA, 12 bp, Homo sapiens
tgggggtggggg

SEQ ID NO: 734721 - DNA, 15 bp, Homo sapiens
tgggggttctggcag

SEQ ID NO: 734722 - DNA, 16 bp, Homo sapiens
tgggggttctggcagg

SEQ ID NO: 734723 - DNA, 18 bp, Homo sapiens
tgggggttctggcaggac

SEQ ID NO: 734724 - DNA, 12 bp, Homo sapiens
tgggggttttta

SEQ ID NO: 734725 - DNA, 15 bp, Homo sapiens
tggggtaagccagag

SEQ ID NO: 734726 - DNA, 16 bp, Homo sapiens
tggggtacatttctct

SEQ ID NO: 734727 - DNA, 16 bp, Homo sapiens
tggggtagaaacattg

SEQ ID NO: 734728 - DNA, 17 bp, Homo sapiens
tggggtagactgaggga

SEQ ID NO: 734729 - DNA, 13 bp, Homo sapiens
tggggtagggctg

SEQ ID NO: 734730 - DNA, 16 bp, Homo sapiens
tggggtagggctgact

SEQ ID NO: 734731 - DNA, 18 bp, Homo sapiens
tggggtcagccagggcca

SEQ ID NO: 734732 - DNA, 20 bp, Homo sapiens
tggggtcagccccaagggct

SEQ ID NO: 734733 - DNA, 22 bp, Homo sapiens
tggggtcagccccaagggctgg

SEQ ID NO: 734734 - DNA, 13 bp, Homo sapiens
tggggtcaggaac

SEQ ID NO: 734735 - DNA, 14 bp, Homo sapiens
tggggtcaggtgcc

SEQ ID NO: 734736 - DNA, 15 bp, Homo sapiens
tggggtcaggtgcca

SEQ ID NO: 734737 - DNA, 21 bp, Homo sapiens
tggggtcaggtgccactgacc

SEQ ID NO: 734738 - DNA, 20 bp, Homo sapiens
tggggtcatgaagggctgga

SEQ ID NO: 734739 - DNA, 19 bp, Homo sapiens
tggggtccctccaccccac

SEQ ID NO: 734740 - DNA, 21 bp, Homo sapiens
tggggtcctagcccagtgctt

SEQ ID NO: 734741 - DNA, 20 bp, Homo sapiens
tggggtcctggagcagacca

SEQ ID NO: 734742 - DNA, 22 bp, Homo sapiens
tggggtccttttttatacagga

SEQ ID NO: 734743 - DNA, 21 bp, Homo sapiens
tggggtctcacagtgttgccc

SEQ ID NO: 734744 - DNA, 21 bp, Homo sapiens
tggggtctccctctcctgcct

SEQ ID NO: 734745 - DNA, 22 bp, Homo sapiens
tggggtctccctctcctgccta

SEQ ID NO: 734746 - DNA, 12 bp, Homo sapiens
tggggtctctct

SEQ ID NO: 734747 - DNA, 14 bp, Homo sapiens
tggggtctctctcc

SEQ ID NO: 734748 - DNA, 15 bp, Homo sapiens
tggggtctctctccc

SEQ ID NO: 734749 - DNA, 14 bp, Homo sapiens
tggggtctgacccc

SEQ ID NO: 734750 - DNA, 14 bp, Homo sapiens
tggggtctggcagc

SEQ ID NO: 734751 - DNA, 14 bp, Homo sapiens
tggggtctgggagg

SEQ ID NO: 734752 - DNA, 15 bp, Homo sapiens
tggggtctgggaggg

SEQ ID NO: 734753 - DNA, 19 bp, Homo sapiens
tggggtctgggcagtgcca

SEQ ID NO: 734754 - DNA, 22 bp, Homo sapiens
tggggtctgggcagtgccacag

SEQ ID NO: 734755 - DNA, 17 bp, Homo sapiens
tggggtctgtgactgga

SEQ ID NO: 734756 - DNA, 19 bp, Homo sapiens
tggggtgaatacttatttt

SEQ ID NO: 734757 - DNA, 17 bp, Homo sapiens
tggggtgaggaccactc

SEQ ID NO: 734758 - DNA, 19 bp, Homo sapiens
tggggtgagggacagagcc

SEQ ID NO: 734759 - DNA, 20 bp, Homo sapiens
tggggtgagggacagagccc

SEQ ID NO: 734760 - DNA, 16 bp, Homo sapiens
tggggtgcactcgcca

SEQ ID NO: 734761 - DNA, 23 bp, Homo sapiens
tggggtgcatcctcctcagcccc

SEQ ID NO: 734762 - DNA, 13 bp, Homo sapiens
tggggtggagcac

SEQ ID NO: 734763 - DNA, 15 bp, Homo sapiens
tggggtggagcactg

SEQ ID NO: 734764 - DNA, 19 bp, Homo sapiens
tggggtggcacctgtttcc

SEQ ID NO: 734765 - DNA, 15 bp, Homo sapiens
tggggtggccagggc

SEQ ID NO: 734766 - DNA, 16 bp, Homo sapiens
tggggtggcctggccc

SEQ ID NO: 734767 - DNA, 12 bp, Homo sapiens
tggggtgggagg

SEQ ID NO: 734768 - DNA, 19 bp, Homo sapiens
tggggtgggagggcgtcag

SEQ ID NO: 734769 - DNA, 20 bp, Homo sapiens
tggggtgggaggtcttgcta

SEQ ID NO: 734770 - DNA, 23 bp, Homo sapiens
tggggtgggagtaacagggcaga

SEQ ID NO: 734771 - DNA, 13 bp, Homo sapiens
tggggtgggctgg

SEQ ID NO: 734772 - DNA, 13 bp, Homo sapiens
tggggtgggggcc

SEQ ID NO: 734773 - DNA, 23 bp, Homo sapiens
tggggtgggggtgggcagcagca

SEQ ID NO: 734774 - DNA, 16 bp, Homo sapiens
tggggtgtttgggagg

SEQ ID NO: 734775 - DNA, 18 bp, Homo sapiens
tggggttatctctgtgtt

SEQ ID NO: 734776 - DNA, 15 bp, Homo sapiens
tggggttcagcccct

SEQ ID NO: 734777 - DNA, 17 bp, Homo sapiens
tggggttcagcccctcc

SEQ ID NO: 734778 - DNA, 21 bp, Homo sapiens
tggggttcagcccctcctctg

SEQ ID NO: 734779 - DNA, 22 bp, Homo sapiens
tggggttcagcccctcctctgc

SEQ ID NO: 734780 - DNA, 19 bp, Homo sapiens
tggggttcataggggcagg

SEQ ID NO: 734781 - DNA, 20 bp, Homo sapiens
tggggttcctgctgtggggc

SEQ ID NO: 734782 - DNA, 14 bp, Homo sapiens
tggggttcgtggaa

SEQ ID NO: 734783 - DNA, 16 bp, Homo sapiens
tggggttgcaaccact

SEQ ID NO: 734784 - DNA, 18 bp, Homo sapiens
tggggttggctgggccca

SEQ ID NO: 734785 - DNA, 14 bp, Homo sapiens
tggggttgtgttgt

SEQ ID NO: 734786 - DNA, 20 bp, Homo sapiens
tggggttgttgtctcatttt

SEQ ID NO: 734787 - DNA, 23 bp, Homo sapiens
tggggtttgggcccctcagagcc

SEQ ID NO: 734788 - DNA, 12 bp, Homo sapiens
tggggttttgta

SEQ ID NO: 734789 - DNA, 18 bp, Homo sapiens
tggggtttttattatttt

SEQ ID NO: 734790 - DNA, 19 bp, Homo sapiens
tggggttttttttttctga

SEQ ID NO: 734791 - DNA, 17 bp, Homo sapiens
tgggtaacttagaagga

SEQ ID NO: 734792 - DNA, 23 bp, Homo sapiens
tgggtaatccaggcacagctgag

SEQ ID NO: 734793 - DNA, 16 bp, Homo sapiens
tgggtaatttataaag

SEQ ID NO: 734794 - DNA, 17 bp, Homo sapiens
tgggtacccaagtgaag

SEQ ID NO: 734795 - DNA, 21 bp, Homo sapiens
tgggtaggagcccttctcttt

SEQ ID NO: 734796 - DNA, 22 bp, Homo sapiens
tgggtaggagcccttctctttg

SEQ ID NO: 734797 - DNA, 19 bp, Homo sapiens
tgggtatcccctgcctcct

SEQ ID NO: 734798 - DNA, 23 bp, Homo sapiens
tgggtatcccctgcctcctgcca

SEQ ID NO: 734799 - DNA, 15 bp, Homo sapiens
tgggtatgttcctaa

SEQ ID NO: 734800 - DNA, 22 bp, Homo sapiens
gtctttgtgggagggtaagaca

SEQ ID NO: 734801 - DNA, 13 bp, Homo sapiens
gtctttgtgtatg

SEQ ID NO: 734802 - DNA, 14 bp, Homo sapiens
gtctttgtgtgtta

SEQ ID NO: 734803 - DNA, 13 bp, Homo sapiens
gtcttttaaaatg

SEQ ID NO: 734804 - DNA, 17 bp, Homo sapiens
gtcttttaatgcttcat

SEQ ID NO: 734805 - DNA, 21 bp, Homo sapiens
gtcttttaccctgtgtcagag

SEQ ID NO: 734806 - DNA, 11 bp, Homo sapiens
gtcttttcatc

SEQ ID NO: 734807 - DNA, 16 bp, Homo sapiens
gtcttttcccatttat

SEQ ID NO: 734808 - DNA, 23 bp, Homo sapiens
gtcttttctgtcaccaaatttgt

SEQ ID NO: 734809 - DNA, 13 bp, Homo sapiens
gtcttttgctttt

SEQ ID NO: 734810 - DNA, 16 bp, Homo sapiens
gtctttttatgcattt

SEQ ID NO: 734811 - DNA, 16 bp, Homo sapiens
gtctttttcctactcc

SEQ ID NO: 734812 - DNA, 23 bp, Homo sapiens
gtctttttcctactccgttcctg

SEQ ID NO: 734813 - DNA, 13 bp, Homo sapiens
gtctttttctctt

SEQ ID NO: 734814 - DNA, 15 bp, Homo sapiens
gtctttttctcttct

SEQ ID NO: 734815 - DNA, 15 bp, Homo sapiens
gtctttttgtttggg

SEQ ID NO: 734816 - DNA, 15 bp, Homo sapiens
gtctttttttgtata

SEQ ID NO: 734817 - DNA, 16 bp, Homo sapiens
gtctttttttgtatag

SEQ ID NO: 734818 - DNA, 15 bp, Homo sapiens
gtcttttttttcctg

SEQ ID NO: 734819 - DNA, 14 bp, Homo sapiens
gtgaaaaaaagaaa

SEQ ID NO: 734820 - DNA, 20 bp, Homo sapiens
gtgaaaaatcttaagtacca

SEQ ID NO: 734821 - DNA, 15 bp, Homo sapiens
gtgaaaacggagctg

SEQ ID NO: 734822 - DNA, 13 bp, Homo sapiens
gtgaaaatagtgt

SEQ ID NO: 734823 - DNA, 22 bp, Homo sapiens
gtgaaaatagtgtaagaactgt

SEQ ID NO: 734824 - DNA, 16 bp, Homo sapiens
gtgaaaatgttttatt

SEQ ID NO: 734825 - DNA, 19 bp, Homo sapiens
gtgaaacaatgttgtccaa

SEQ ID NO: 734826 - DNA, 16 bp, Homo sapiens
gtgaaacacatgccag

SEQ ID NO: 734827 - DNA, 13 bp, Homo sapiens
gtgaaacagagaa

SEQ ID NO: 734828 - DNA, 19 bp, Homo sapiens
gtgaaacagagaaagaaaa

SEQ ID NO: 734829 - DNA, 16 bp, Homo sapiens
tgggtcggccctgccc

SEQ ID NO: 734830 - DNA, 18 bp, Homo sapiens
tgggtctcactcctgagt

SEQ ID NO: 734831 - DNA, 17 bp, Homo sapiens
tgggtctcactctctgg

SEQ ID NO: 734832 - DNA, 22 bp, Homo sapiens
tgggtctcgctttgttgcccag

SEQ ID NO: 734833 - DNA, 12 bp, Homo sapiens
tgggtctctggg

SEQ ID NO: 734834 - DNA, 14 bp, Homo sapiens
tgggtctctgggga

SEQ ID NO: 734835 - DNA, 15 bp, Homo sapiens
tgggtctctggggac

SEQ ID NO: 734836 - DNA, 14 bp, Homo sapiens
tgggtctgagctgg

SEQ ID NO: 734837 - DNA, 15 bp, Homo sapiens
tgggtctgagctgga

SEQ ID NO: 734838 - DNA, 16 bp, Homo sapiens
tgggtctgagctggac

SEQ ID NO: 734839 - DNA, 21 bp, Homo sapiens
tgggtctgatattaatcaaaa

SEQ ID NO: 734840 - DNA, 13 bp, Homo sapiens
tgggtctgccctg

SEQ ID NO: 734841 - DNA, 18 bp, Homo sapiens
tgggtctgccctgcccat

SEQ ID NO: 734842 - DNA, 18 bp, Homo sapiens
tgggtctggatgggagga

SEQ ID NO: 734843 - DNA, 24 bp, Homo sapiens
tgggtctgggatatggctgcccag

SEQ ID NO: 734844 - DNA, 14 bp, Homo sapiens
tgggtcttccaggg

SEQ ID NO: 734845 - DNA, 22 bp, Homo sapiens
tgggtcttgttttttttttcca

SEQ ID NO: 734846 - DNA, 17 bp, Homo sapiens
tgggtctttttctcttc

SEQ ID NO: 734847 - DNA, 18 bp, Homo sapiens
tgggtgacaagagcctga

SEQ ID NO: 734848 - DNA, 12 bp, Homo sapiens
tgggtgacattt

SEQ ID NO: 734849 - DNA, 14 bp, Homo sapiens
tgggtgagagagac

SEQ ID NO: 734850 - DNA, 14 bp, Homo sapiens
tgggtgaggaaatc

SEQ ID NO: 734851 - DNA, 20 bp, Homo sapiens
tgggtgattcctaagccact

SEQ ID NO: 734852 - DNA, 15 bp, Homo sapiens
tgggtgcagctgggc

SEQ ID NO: 734853 - DNA, 13 bp, Homo sapiens
tgggtgcctcctg

SEQ ID NO: 734854 - DNA, 16 bp, Homo sapiens
tgggtgcctcctgcag

SEQ ID NO: 734855 - DNA, 18 bp, Homo sapiens
tgggtgctgataattgtg

SEQ ID NO: 734856 - DNA, 17 bp, Homo sapiens
tgggtggaaactaagac

SEQ ID NO: 734857 - DNA, 19 bp, Homo sapiens
tgggtggaaccaggaacct

SEQ ID NO: 734858 - DNA, 20 bp, Homo sapiens
tgggtggcaccagcagcctg

SEQ ID NO: 734859 - DNA, 20 bp, Homo sapiens
tgggtggccatcctacccag

SEQ ID NO: 734860 - DNA, 21 bp, Homo sapiens
tgggtggccatcctacccagc

SEQ ID NO: 734861 - DNA, 23 bp, Homo sapiens
tgggtggccatcctacccagcgt

SEQ ID NO: 734862 - DNA, 18 bp, Homo sapiens
tgggtggctcactactga

SEQ ID NO: 734863 - DNA, 13 bp, Homo sapiens
tgggtggctttca

SEQ ID NO: 734864 - DNA, 14 bp, Homo sapiens
tgggtggctttcaa

SEQ ID NO: 734865 - DNA, 12 bp, Homo sapiens
tgggtgggagag

SEQ ID NO: 734866 - DNA, 19 bp, Homo sapiens
tgggtgggagtgtgtctgc

SEQ ID NO: 734867 - DNA, 21 bp, Homo sapiens
tgggtgggattttttcccttt

SEQ ID NO: 734868 - DNA, 14 bp, Homo sapiens
tgggtgggcaggga

SEQ ID NO: 734869 - DNA, 18 bp, Homo sapiens
tgggtgggcagggagggg

SEQ ID NO: 734870 - DNA, 20 bp, Homo sapiens
tgggtgggcagggaggggct

SEQ ID NO: 734871 - DNA, 13 bp, Homo sapiens
tgggtgggccctg

SEQ ID NO: 734872 - DNA, 16 bp, Homo sapiens
tgggtgggcctgactg

SEQ ID NO: 734873 - DNA, 17 bp, Homo sapiens
tgggtggggaggccctg

SEQ ID NO: 734874 - DNA, 21 bp, Homo sapiens
tgggtgggggctgtggccctg

SEQ ID NO: 734875 - DNA, 22 bp, Homo sapiens
tgggtgggggctgtggccctgc

SEQ ID NO: 734876 - DNA, 13 bp, Homo sapiens
tgggtgggtgggc

SEQ ID NO: 734877 - DNA, 14 bp, Homo sapiens
tgggtgggtggtgg

SEQ ID NO: 734878 - DNA, 16 bp, Homo sapiens
tgggtgggtggtgggg

SEQ ID NO: 734879 - DNA, 22 bp, Homo sapiens
tgggtggtaccctctggagggg

SEQ ID NO: 734880 - DNA, 22 bp, Homo sapiens
tgggtgtaacaggtctcctctt

SEQ ID NO: 734881 - DNA, 22 bp, Homo sapiens
tgggtgtagatttctgacatca

SEQ ID NO: 734882 - DNA, 15 bp, Homo sapiens
tgggtgtattctctg

SEQ ID NO: 734883 - DNA, 14 bp, Homo sapiens
tgggtgtcatttca

SEQ ID NO: 734884 - DNA, 21 bp, Homo sapiens
tgggtgtccgccatccagggt

SEQ ID NO: 734885 - DNA, 22 bp, Homo sapiens
tgggtgtccgccatccagggtc

SEQ ID NO: 734886 - DNA, 19 bp, Homo sapiens
tgggtgtcctgcctgtctg

SEQ ID NO: 734887 - DNA, 17 bp, Homo sapiens
tgggtgtggccagcaca

SEQ ID NO: 734888 - DNA, 23 bp, Homo sapiens
tgggtgtggccagcacaccaagt

SEQ ID NO: 734889 - DNA, 21 bp, Homo sapiens
tgggtgtgtgcgcctgagtga

SEQ ID NO: 734890 - DNA, 16 bp, Homo sapiens
tgggtgtgtggcctcc

SEQ ID NO: 734891 - DNA, 15 bp, Homo sapiens
tgggtgttcctggca

SEQ ID NO: 734892 - DNA, 19 bp, Homo sapiens
tgggtgttcctggcagttt

SEQ ID NO: 734893 - DNA, 15 bp, Homo sapiens
tgggtgttctttcct

SEQ ID NO: 734894 - DNA, 17 bp, Homo sapiens
tgggtgttctttcctgc

SEQ ID NO: 734895 - DNA, 16 bp, Homo sapiens
tgggtgttgaccactc

SEQ ID NO: 734896 - DNA, 22 bp, Homo sapiens
tgggtgttgaccactccagaga

SEQ ID NO: 734897 - DNA, 14 bp, Homo sapiens
tgggtgttgctgtt

SEQ ID NO: 734898 - DNA, 15 bp, Homo sapiens
tgggtgttgctgttt

SEQ ID NO: 734899 - DNA, 21 bp, Homo sapiens
tgggtgtttattacaagtggc

SEQ ID NO: 734900 - DNA, 14 bp, Homo sapiens
tgggtgtttccaga

SEQ ID NO: 734901 - DNA, 16 bp, Homo sapiens
tgggttaatggctagt

SEQ ID NO: 734902 - DNA, 18 bp, Homo sapiens
tgggttatttttattaaa

SEQ ID NO: 734903 - DNA, 20 bp, Homo sapiens
tgggttatttttattaaatg

SEQ ID NO: 734904 - DNA, 24 bp, Homo sapiens
tgggttcaggggactcagccctga

SEQ ID NO: 734905 - DNA, 20 bp, Homo sapiens
tgggttcattattggaatta

SEQ ID NO: 734906 - DNA, 19 bp, Homo sapiens
tgggttcgttggggacatg

SEQ ID NO: 734907 - DNA, 12 bp, Homo sapiens
tgggttctttct

SEQ ID NO: 734908 - DNA, 17 bp, Homo sapiens
tgggttctttggaagga

SEQ ID NO: 734909 - DNA, 19 bp, Homo sapiens
tgggttgcgtcctgacggc

SEQ ID NO: 734910 - DNA, 13 bp, Homo sapiens
tgggttggaggga

SEQ ID NO: 734911 - DNA, 22 bp, Homo sapiens
tgggttggagggaaccaccagc

SEQ ID NO: 734912 - DNA, 19 bp, Homo sapiens
tgggttggtgcacagtgat

SEQ ID NO: 734913 - DNA, 20 bp, Homo sapiens
tgggttggtgcacagtgatt

SEQ ID NO: 734914 - DNA, 16 bp, Homo sapiens
tgggttggtgcttcta

SEQ ID NO: 734915 - DNA, 19 bp, Homo sapiens
tgggtttcaagaaaatctt

SEQ ID NO: 734916 - DNA, 23 bp, Homo sapiens
tgggtttcaagaaaatctttgtt

SEQ ID NO: 734917 - DNA, 22 bp, Homo sapiens
tgggtttcacaagtgaaaaaca

SEQ ID NO: 734918 - DNA, 16 bp, Homo sapiens
tgggtttcatatttct

SEQ ID NO: 734919 - DNA, 12 bp, Homo sapiens
tgggtttcatgt

SEQ ID NO: 734920 - DNA, 14 bp, Homo sapiens
tgggtttctctgtg

SEQ ID NO: 734921 - DNA, 21 bp, Homo sapiens
tgggtttctctgtgctctgaa

SEQ ID NO: 734922 - DNA, 18 bp, Homo sapiens
gtgaattaggctgtaact

SEQ ID NO: 734923 - DNA, 14 bp, Homo sapiens
gtgaattattgaca

SEQ ID NO: 734924 - DNA, 23 bp, Homo sapiens
gtgaattgcctgcagagagaagc

SEQ ID NO: 734925 - DNA, 19 bp, Homo sapiens
gtgaattgtcttttagaca

SEQ ID NO: 734926 - DNA, 17 bp, Homo sapiens
gtgaatttcaacttttg

SEQ ID NO: 734927 - DNA, 18 bp, Homo sapiens
gtgaatttgaatgaaaaa

SEQ ID NO: 734928 - DNA, 12 bp, Homo sapiens
gtgaattttcaa

SEQ ID NO: 734929 - DNA, 11 bp, Homo sapiens
gtgaattttta

SEQ ID NO: 734930 - DNA, 17 bp, Homo sapiens
gtgaatttttaagctgc

SEQ ID NO: 734931 - DNA, 16 bp, Homo sapiens
gtgaatttttctctaa

SEQ ID NO: 734932 - DNA, 13 bp, Homo sapiens
gtgacaaaaaatt

SEQ ID NO: 734933 - DNA, 17 bp, Homo sapiens
gtgacaaaatgggagga

SEQ ID NO: 734934 - DNA, 19 bp, Homo sapiens
gtgacaaaatgggaggagg

SEQ ID NO: 734935 - DNA, 20 bp, Homo sapiens
gtgacaaaatgggaggagga

SEQ ID NO: 734936 - DNA, 17 bp, Homo sapiens
gtgacaaaattcatttg

SEQ ID NO: 734937 - DNA, 16 bp, Homo sapiens
gtgacaaagactcctc

SEQ ID NO: 734938 - DNA, 20 bp, Homo sapiens
gtgacaaagactcctctggg

SEQ ID NO: 734939 - DNA, 19 bp, Homo sapiens
gtgacaaagatggctcaga

SEQ ID NO: 734940 - DNA, 14 bp, Homo sapiens
gtgacaaaggatga

SEQ ID NO: 734941 - DNA, 18 bp, Homo sapiens
gtgacaaaggatgaagaa

SEQ ID NO: 734942 - DNA, 13 bp, Homo sapiens
gtgacaagcgtca

SEQ ID NO: 734943 - DNA, 18 bp, Homo sapiens
gtgacaagcgtcacttct

SEQ ID NO: 734944 - DNA, 13 bp, Homo sapiens
gtgacaaggcccc

SEQ ID NO: 734945 - DNA, 17 bp, Homo sapiens
gtgacaaggccccagag

SEQ ID NO: 734946 - DNA, 19 bp, Homo sapiens
gtgacaaggccccagagac

SEQ ID NO: 734947 - DNA, 15 bp, Homo sapiens
gtgacaagtgaagaa

SEQ ID NO: 734948 - DNA, 19 bp, Homo sapiens
gtgacaattctgtttttaa

SEQ ID NO: 734949 - DNA, 14 bp, Homo sapiens
gtgacacaggtcag

SEQ ID NO: 734950 - DNA, 23 bp, Homo sapiens
gtgacacaggtcagggctcagag

SEQ ID NO: 734951 - DNA, 21 bp, Homo sapiens
gtgacacttcagagagctggt

SEQ ID NO: 734952 - DNA, 19 bp, Homo sapiens
gtgacagactcctgaggac

SEQ ID NO: 734953 - DNA, 22 bp, Homo sapiens
gtgacagactcctgaggacagc

SEQ ID NO: 734954 - DNA, 17 bp, Homo sapiens
gtgacagagttcactat

SEQ ID NO: 734955 - DNA, 17 bp, Homo sapiens
gtgacagcgatggcagg

SEQ ID NO: 734956 - DNA, 16 bp, Homo sapiens
tggtaagcagaggctt

SEQ ID NO: 734957 - DNA, 17 bp, Homo sapiens
tggtaagcgatttgaaa

SEQ ID NO: 734958 - DNA, 15 bp, Homo sapiens
tggtaagctctggct

SEQ ID NO: 734959 - DNA, 19 bp, Homo sapiens
tggtaaggcctctggactg

SEQ ID NO: 734960 - DNA, 18 bp, Homo sapiens
tggtaagtgaatttatga

SEQ ID NO: 734961 - DNA, 17 bp, Homo sapiens
tggtaatctttacctgt

SEQ ID NO: 734962 - DNA, 20 bp, Homo sapiens
tggtaatgacagatgcaagt

SEQ ID NO: 734963 - DNA, 20 bp, Homo sapiens
tggtaatgatgttgataatt

SEQ ID NO: 734964 - DNA, 21 bp, Homo sapiens
tggtaatgatgttgataattt

SEQ ID NO: 734965 - DNA, 13 bp, Homo sapiens
tggtacaaatgtg

SEQ ID NO: 734966 - DNA, 16 bp, Homo sapiens
tggtacaaggtggaga

SEQ ID NO: 734967 - DNA, 14 bp, Homo sapiens
tggtacagcagggt

SEQ ID NO: 734968 - DNA, 20 bp, Homo sapiens
tggtacaggaaggcttgcag

SEQ ID NO: 734969 - DNA, 21 bp, Homo sapiens
tggtacaggaaggcttgcagt

SEQ ID NO: 734970 - DNA, 17 bp, Homo sapiens
tggtacatacacaccag

SEQ ID NO: 734971 - DNA, 23 bp, Homo sapiens
tggtacataggcttctattacct

SEQ ID NO: 734972 - DNA, 14 bp, Homo sapiens
tggtacccagccat

SEQ ID NO: 734973 - DNA, 22 bp, Homo sapiens
tggtacccagccatctgcccag

SEQ ID NO: 734974 - DNA, 15 bp, Homo sapiens
tggtacccccccttt

SEQ ID NO: 734975 - DNA, 18 bp, Homo sapiens
tggtacccccccttttct

SEQ ID NO: 734976 - DNA, 18 bp, Homo sapiens
tggtaccttcagccctgg

SEQ ID NO: 734977 - DNA, 19 bp, Homo sapiens
tggtacctttctagcctta

SEQ ID NO: 734978 - DNA, 20 bp, Homo sapiens
tggtacctttctagccttag

SEQ ID NO: 734979 - DNA, 16 bp, Homo sapiens
tggtactaccccagcc

SEQ ID NO: 734980 - DNA, 20 bp, Homo sapiens
tggtactataaaagctttct

SEQ ID NO: 734981 - DNA, 14 bp, Homo sapiens
tggtactgctgagg

SEQ ID NO: 734982 - DNA, 17 bp, Homo sapiens
tggtactgctgtcttcc

SEQ ID NO: 734983 - DNA, 18 bp, Homo sapiens
tggtactgtagcagggga

SEQ ID NO: 734984 - DNA, 17 bp, Homo sapiens
tggtacttcctttctcc

SEQ ID NO: 734985 - DNA, 22 bp, Homo sapiens
tggtacttgagggatgcccgct

SEQ ID NO: 734986 - DNA, 19 bp, Homo sapiens
tggtacttttatgatgtat

SEQ ID NO: 734987 - DNA, 20 bp, Homo sapiens
tggtacttttgagtgtgtgt

SEQ ID NO: 734988 - DNA, 13 bp, Homo sapiens
tggtagaagccag

SEQ ID NO: 734989 - DNA, 18 bp, Homo sapiens
tggtagaattgggaagct

SEQ ID NO: 734990 - DNA, 15 bp, Homo sapiens
tggtagactaggttt

SEQ ID NO: 734991 - DNA, 13 bp, Homo sapiens
tggtagagattca

SEQ ID NO: 734992 - DNA, 22 bp, Homo sapiens
tggtagcacatgtctgtcctca

SEQ ID NO: 734993 - DNA, 23 bp, Homo sapiens
tggtagcacatgtctgtcctcag

SEQ ID NO: 734994 - DNA, 14 bp, Homo sapiens
tggtagcagcaggc

SEQ ID NO: 734995 - DNA, 15 bp, Homo sapiens
tggtagcagcaggct

SEQ ID NO: 734996 - DNA, 12 bp, Homo sapiens
tggtagcatttt

SEQ ID NO: 734997 - DNA, 21 bp, Homo sapiens
tggtagctgaggggacgggca

SEQ ID NO: 734998 - DNA, 20 bp, Homo sapiens
tggtaggaatgcttccgaga

SEQ ID NO: 734999 - DNA, 22 bp, Homo sapiens
tggtaggaccaagcatcttggg

SEQ ID NO: 735000 - DNA, 23 bp, Homo sapiens
tggtaggggagggcaggcttggg

SEQ ID NO: 735001 - DNA, 17 bp, Homo sapiens
tggtaggggcagggagg

SEQ ID NO: 735002 - DNA, 13 bp, Homo sapiens
tggtagggtggga

SEQ ID NO: 735003 - DNA, 19 bp, Homo sapiens
tggtagggtgggagtggtt

SEQ ID NO: 735004 - DNA, 21 bp, Homo sapiens
tggtaggtagtgattaactgt

SEQ ID NO: 735005 - DNA, 12 bp, Homo sapiens
tggtagtgcccc

SEQ ID NO: 735006 - DNA, 14 bp, Homo sapiens
tggtagttctgtgc

SEQ ID NO: 735007 - DNA, 15 bp, Homo sapiens
tggtagttttttcat

SEQ ID NO: 735008 - DNA, 16 bp, Homo sapiens
tggtagttttttcatc

SEQ ID NO: 735009 - DNA, 17 bp, Homo sapiens
tggtataaacaggagac

SEQ ID NO: 735010 - DNA, 15 bp, Homo sapiens
tggtataatgtttaa

SEQ ID NO: 735011 - DNA, 19 bp, Homo sapiens
tggtataatgtttaaatca

SEQ ID NO: 735012 - DNA, 13 bp, Homo sapiens
tggtataattatg

SEQ ID NO: 735013 - DNA, 14 bp, Homo sapiens
tggtataattgaaa

SEQ ID NO: 735014 - DNA, 14 bp, Homo sapiens
tggtatagaaatgc

SEQ ID NO: 735015 - DNA, 16 bp, Homo sapiens
tggtatagaaatgctg

SEQ ID NO: 735016 - DNA, 16 bp, Homo sapiens
tggtatcaaaattaca

SEQ ID NO: 735017 - DNA, 15 bp, Homo sapiens
tggtatccacagtta

SEQ ID NO: 735018 - DNA, 22 bp, Homo sapiens
tggtatcctgtgacatgtaaca

SEQ ID NO: 735019 - DNA, 13 bp, Homo sapiens
tggtatctcagaa

SEQ ID NO: 735020 - DNA, 23 bp, Homo sapiens
tggtatgaaataaattctgactt

SEQ ID NO: 735021 - DNA, 15 bp, Homo sapiens
tggtatgagctgagg

SEQ ID NO: 735022 - DNA, 14 bp, Homo sapiens
tggtatgctggcca

SEQ ID NO: 735023 - DNA, 19 bp, Homo sapiens
tggtatgctggccagcacc

SEQ ID NO: 735024 - DNA, 21 bp, Homo sapiens
tggtatgctggccagcaccct

SEQ ID NO: 735025 - DNA, 22 bp, Homo sapiens
tggtatgctggccagcaccctc

SEQ ID NO: 735026 - DNA, 18 bp, Homo sapiens
tggtatgtaatttatgca

SEQ ID NO: 735027 - DNA, 20 bp, Homo sapiens
tggtatgtaatttatgcaag

SEQ ID NO: 735028 - DNA, 15 bp, Homo sapiens
tggtatgtctcttta

SEQ ID NO: 735029 - DNA, 13 bp, Homo sapiens
tggtatgtctgcc

SEQ ID NO: 735030 - DNA, 14 bp, Homo sapiens
tggtatgtgccagg

SEQ ID NO: 735031 - DNA, 15 bp, Homo sapiens
tggtatgtgccaggc

SEQ ID NO: 735032 - DNA, 20 bp, Homo sapiens
tggtatgtgccaggcttgcc

SEQ ID NO: 735033 - DNA, 15 bp, Homo sapiens
tggtatgttgggata

SEQ ID NO: 735034 - DNA, 14 bp, Homo sapiens
tggtattctctcta

SEQ ID NO: 735035 - DNA, 23 bp, Homo sapiens
tggtattggctagaggttcaaag

SEQ ID NO: 735036 - DNA, 13 bp, Homo sapiens
tggtattgtaaaa

SEQ ID NO: 735037 - DNA, 15 bp, Homo sapiens
tggtatttcccctgt

SEQ ID NO: 735038 - DNA, 13 bp, Homo sapiens
tggtatttctaat

SEQ ID NO: 735039 - DNA, 17 bp, Homo sapiens
tggtattttcaatagcc

SEQ ID NO: 735040 - DNA, 21 bp, Homo sapiens
tggtcaaacaaactctctgaa

SEQ ID NO: 735041 - DNA, 14 bp, Homo sapiens
tggtcaaaccgcac

SEQ ID NO: 735042 - DNA, 17 bp, Homo sapiens
tggtcaaaccgcactca

SEQ ID NO: 735043 - DNA, 13 bp, Homo sapiens
tggtcaaactttt

SEQ ID NO: 735044 - DNA, 15 bp, Homo sapiens
gtgactttttagcca

SEQ ID NO: 735045 - DNA, 20 bp, Homo sapiens
gtgactttttagccagtgac

SEQ ID NO: 735046 - DNA, 17 bp, Homo sapiens
gtgagaaaaagctcctg

SEQ ID NO: 735047 - DNA, 22 bp, Homo sapiens
gtgagaaaaagctcctgtcctc

SEQ ID NO: 735048 - DNA, 15 bp, Homo sapiens
gtgagaaaactgtga

SEQ ID NO: 735049 - DNA, 15 bp, Homo sapiens
gtgagaaatttaaac

SEQ ID NO: 735050 - DNA, 16 bp, Homo sapiens
gtgagaagctgaggcc

SEQ ID NO: 735051 - DNA, 14 bp, Homo sapiens
gtgagaatcctgcc

SEQ ID NO: 735052 - DNA, 19 bp, Homo sapiens
gtgagaattaagttttaaa

SEQ ID NO: 735053 - DNA, 16 bp, Homo sapiens
gtgagacagtgggaaa

SEQ ID NO: 735054 - DNA, 20 bp, Homo sapiens
gtgagacccagccctcatcc

SEQ ID NO: 735055 - DNA, 17 bp, Homo sapiens
gtgagacccccacacct

SEQ ID NO: 735056 - DNA, 20 bp, Homo sapiens
gtgagaccccgcactgcaga

SEQ ID NO: 735057 - DNA, 15 bp, Homo sapiens
gtgagaccctcgcag

SEQ ID NO: 735058 - DNA, 23 bp, Homo sapiens
gtgagagacattaactcattaga

SEQ ID NO: 735059 - DNA, 14 bp, Homo sapiens
gtgagagaggaggc

SEQ ID NO: 735060 - DNA, 21 bp, Homo sapiens
gtgagagaggaggcctggacc

SEQ ID NO: 735061 - DNA, 16 bp, Homo sapiens
gtgagagccagcagca

SEQ ID NO: 735062 - DNA, 21 bp, Homo sapiens
gtgagagcccagtcattgtac

SEQ ID NO: 735063 - DNA, 18 bp, Homo sapiens
gtgagagcgaggctgagc

SEQ ID NO: 735064 - DNA, 15 bp, Homo sapiens
gtgagaggggagggc

SEQ ID NO: 735065 - DNA, 18 bp, Homo sapiens
gtgagaggggagggctcc

SEQ ID NO: 735066 - DNA, 23 bp, Homo sapiens
gtgagatcctctttactctgggc

SEQ ID NO: 735067 - DNA, 15 bp, Homo sapiens
gtgagatgcagctgg

SEQ ID NO: 735068 - DNA, 22 bp, Homo sapiens
gtgagatttccttatcacagaa

SEQ ID NO: 735069 - DNA, 15 bp, Homo sapiens
gtgagcaaccagctg

SEQ ID NO: 735070 - DNA, 20 bp, Homo sapiens
gtgagcaaccagctggaagg

SEQ ID NO: 735071 - DNA, 14 bp, Homo sapiens
gtgagcacagccta

SEQ ID NO: 735072 - DNA, 12 bp, Homo sapiens
gtgagcagaaca

SEQ ID NO: 735073 - DNA, 14 bp, Homo sapiens
gtgagcagctactg

SEQ ID NO: 735074 - DNA, 16 bp, Homo sapiens
gtgagcagctactgta

SEQ ID NO: 735075 - DNA, 19 bp, Homo sapiens
gtgagcagggtcaagcctc

SEQ ID NO: 735076 - DNA, 13 bp, Homo sapiens
gtgagcagggtgg

SEQ ID NO: 735077 - DNA, 13 bp, Homo sapiens
gtgagcatcctgc

SEQ ID NO: 735078 - DNA, 14 bp, Homo sapiens
gtgagcatcctgca

SEQ ID NO: 735079 - DNA, 18 bp, Homo sapiens
gtgagcatcttgccagcc

SEQ ID NO: 735080 - DNA, 15 bp, Homo sapiens
gtgagccaccgctgc

SEQ ID NO: 735081 - DNA, 19 bp, Homo sapiens
gtgagccaccgtgcctggc

SEQ ID NO: 735082 - DNA, 18 bp, Homo sapiens
gtgagccactgcgcccag

SEQ ID NO: 735083 - DNA, 16 bp, Homo sapiens
tggtccaaaaaaagga

SEQ ID NO: 735084 - DNA, 21 bp, Homo sapiens
tggtccaaaaaaaggaaaaat

SEQ ID NO: 735085 - DNA, 23 bp, Homo sapiens
tggtccaaaagattgctgaaatt

SEQ ID NO: 735086 - DNA, 13 bp, Homo sapiens
tggtccactgtgt

SEQ ID NO: 735087 - DNA, 21 bp, Homo sapiens
tggtccagaaactcctgtttc

SEQ ID NO: 735088 - DNA, 21 bp, Homo sapiens
tggtccagaccagccctgcag

SEQ ID NO: 735089 - DNA, 14 bp, Homo sapiens
tggtccagctctga

SEQ ID NO: 735090 - DNA, 16 bp, Homo sapiens
tggtccagctctgaca

SEQ ID NO: 735091 - DNA, 23 bp, Homo sapiens
tggtccagctctgacatcccttc

SEQ ID NO: 735092 - DNA, 18 bp, Homo sapiens
tggtccatgctgatgatt

SEQ ID NO: 735093 - DNA, 18 bp, Homo sapiens
tggtcccaagacagtgag

SEQ ID NO: 735094 - DNA, 14 bp, Homo sapiens
tggtcccaggaagc

SEQ ID NO: 735095 - DNA, 17 bp, Homo sapiens
tggtcccaggaagcagg

SEQ ID NO: 735096 - DNA, 21 bp, Homo sapiens
tggtcccaggaagcagggaga

SEQ ID NO: 735097 - DNA, 15 bp, Homo sapiens
tggtcccatccaggc

SEQ ID NO: 735098 - DNA, 17 bp, Homo sapiens
tggtcccatccaggcag

SEQ ID NO: 735099 - DNA, 18 bp, Homo sapiens
tggtcccatccaggcagt

SEQ ID NO: 735100 - DNA, 13 bp, Homo sapiens
tggtcccatcctc

SEQ ID NO: 735101 - DNA, 20 bp, Homo sapiens
tggtccccactgctgagctg

SEQ ID NO: 735102 - DNA, 13 bp, Homo sapiens
tggtcccctccct

SEQ ID NO: 735103 - DNA, 15 bp, Homo sapiens
tggtcccctccctcg

SEQ ID NO: 735104 - DNA, 18 bp, Homo sapiens
tggtcccctccctcgtgg

SEQ ID NO: 735105 - DNA, 23 bp, Homo sapiens
tggtccctcgtccacaggggcag

SEQ ID NO: 735106 - DNA, 14 bp, Homo sapiens
tggtccctctcaga

SEQ ID NO: 735107 - DNA, 21 bp, Homo sapiens
tggtccctcttctctcctcag

SEQ ID NO: 735108 - DNA, 13 bp, Homo sapiens
tggtccctgagga

SEQ ID NO: 735109 - DNA, 13 bp, Homo sapiens
tggtccctgggag

SEQ ID NO: 735110 - DNA, 14 bp, Homo sapiens
tggtccctgggagg

SEQ ID NO: 735111 - DNA, 19 bp, Homo sapiens
tggtccctgggaggaaatt

SEQ ID NO: 735112 - DNA, 11 bp, Homo sapiens
tggtccctggt

SEQ ID NO: 735113 - DNA, 16 bp, Homo sapiens
tggtcccttaaggcac

SEQ ID NO: 735114 - DNA, 15 bp, Homo sapiens
tggtccggtgtcctt

SEQ ID NO: 735115 - DNA, 18 bp, Homo sapiens
tggtccgtgcccaggccc

SEQ ID NO: 735116 - DNA, 22 bp, Homo sapiens
tggtcctgactcaacatgttac

SEQ ID NO: 735117 - DNA, 12 bp, Homo sapiens
tggtcctggcct

SEQ ID NO: 735118 - DNA, 12 bp, Homo sapiens
tggtcctggctg

SEQ ID NO: 735119 - DNA, 16 bp, Homo sapiens
tggtcctggctgcact

SEQ ID NO: 735120 - DNA, 19 bp, Homo sapiens
tggtcctggctgcactctt

SEQ ID NO: 735121 - DNA, 20 bp, Homo sapiens
tggtcctgtgtgcagtgaag

SEQ ID NO: 735122 - DNA, 15 bp, Homo sapiens
tggtccttaatccca

SEQ ID NO: 735123 - DNA, 12 bp, Homo sapiens
tggtccttattt

SEQ ID NO: 735124 - DNA, 13 bp, Homo sapiens
tggtccttattta

SEQ ID NO: 735125 - DNA, 20 bp, Homo sapiens
tggtcctttacactcaggct

SEQ ID NO: 735126 - DNA, 12 bp, Homo sapiens
tggtcctttggg

SEQ ID NO: 735127 - DNA, 17 bp, Homo sapiens
tggtcgaggagtaacaa

SEQ ID NO: 735128 - DNA, 18 bp, Homo sapiens
tggtcgagtctttgtgtg

SEQ ID NO: 735129 - DNA, 13 bp, Homo sapiens
tggtcgcccagga

SEQ ID NO: 735130 - DNA, 14 bp, Homo sapiens
tggtcggaaaacat

SEQ ID NO: 735131 - DNA, 17 bp, Homo sapiens
tggtcggaaaacatgct

SEQ ID NO: 735132 - DNA, 23 bp, Homo sapiens
tggtctaacactggcatgttcaa

SEQ ID NO: 735133 - DNA, 20 bp, Homo sapiens
tggtctaatgattcaaatgt

SEQ ID NO: 735134 - DNA, 21 bp, Homo sapiens
tggtctaatgattcaaatgtt

SEQ ID NO: 735135 - DNA, 14 bp, Homo sapiens
tggtctaatgtttg

SEQ ID NO: 735136 - DNA, 22 bp, Homo sapiens
tggtctataaaataaacttctt

SEQ ID NO: 735137 - DNA, 17 bp, Homo sapiens
tggtctcaaactcctga

SEQ ID NO: 735138 - DNA, 18 bp, Homo sapiens
tggtctcaaactcctgac

SEQ ID NO: 735139 - DNA, 22 bp, Homo sapiens
tggtctcaaactcctgacctca

SEQ ID NO: 735140 - DNA, 15 bp, Homo sapiens
tggtctcccttctct

SEQ ID NO: 735141 - DNA, 20 bp, Homo sapiens
tggtctcgaactcctgacct

SEQ ID NO: 735142 - DNA, 17 bp, Homo sapiens
tggtctcgatctcctga

SEQ ID NO: 735143 - DNA, 15 bp, Homo sapiens
tggtctctctccctc

SEQ ID NO: 735144 - DNA, 17 bp, Homo sapiens
tggtctctctccctctg

SEQ ID NO: 735145 - DNA, 21 bp, Homo sapiens
tggtctctctccctctgtctt

SEQ ID NO: 735146 - DNA, 14 bp, Homo sapiens
tggtctctgctggg

SEQ ID NO: 735147 - DNA, 18 bp, Homo sapiens
tggtctcttcctgtctgg

SEQ ID NO: 735148 - DNA, 12 bp, Homo sapiens
tggtctgaatgt

SEQ ID NO: 735149 - DNA, 19 bp, Homo sapiens
tggtctgaatgttctgaca

SEQ ID NO: 735150 - DNA, 16 bp, Homo sapiens
tggtctgagcaccccc

SEQ ID NO: 735151 - DNA, 20 bp, Homo sapiens
tggtctgagcaccccctcat

SEQ ID NO: 735152 - DNA, 11 bp, Homo sapiens
tggtctgctgt

SEQ ID NO: 735153 - DNA, 21 bp, Homo sapiens
tggtctgcttaaagcttccct

SEQ ID NO: 735154 - DNA, 12 bp, Homo sapiens
tggtctggaaac

SEQ ID NO: 735155 - DNA, 16 bp, Homo sapiens
tggtctgggacttcct

SEQ ID NO: 735156 - DNA, 19 bp, Homo sapiens
tggtctgggacttccttgc

SEQ ID NO: 735157 - DNA, 16 bp, Homo sapiens
tggtctggttgggcag

SEQ ID NO: 735158 - DNA, 14 bp, Homo sapiens
tggtctgtctggat

SEQ ID NO: 735159 - DNA, 20 bp, Homo sapiens
tggtctgtggagatggactc

SEQ ID NO: 735160 - DNA, 14 bp, Homo sapiens
tggtcttaaatgct

SEQ ID NO: 735161 - DNA, 20 bp, Homo sapiens
tggtcttaaggaacatctct

SEQ ID NO: 735162 - DNA, 18 bp, Homo sapiens
tggtcttcagcctccctc

SEQ ID NO: 735163 - DNA, 22 bp, Homo sapiens
tggtcttccttctaccccaagg

SEQ ID NO: 735164 - DNA, 19 bp, Homo sapiens
tggtcttctctacagttca

SEQ ID NO: 735165 - DNA, 17 bp, Homo sapiens
tggtcttgagatgtctt

SEQ ID NO: 735166 - DNA, 14 bp, Homo sapiens
tggtctttctggag

SEQ ID NO: 735167 - DNA, 11 bp, Homo sapiens
tggtctttgct

SEQ ID NO: 735168 - DNA, 13 bp, Homo sapiens
tggtctttgctcc

SEQ ID NO: 735169 - DNA, 14 bp, Homo sapiens
tggtctttgctcca

SEQ ID NO: 735170 - DNA, 14 bp, Homo sapiens
tggtctttgtttga

SEQ ID NO: 735171 - DNA, 21 bp, Homo sapiens
tggtctttgtttgaggcctga

SEQ ID NO: 735172 - DNA, 16 bp, Homo sapiens
tggtcttttataattc

SEQ ID NO: 735173 - DNA, 14 bp, Homo sapiens
tggtcttttggtta

SEQ ID NO: 735174 - DNA, 18 bp, Homo sapiens
tggtgaaataataaaatg

SEQ ID NO: 735175 - DNA, 20 bp, Homo sapiens
tggtgaaataataaaatgca

SEQ ID NO: 735176 - DNA, 23 bp, Homo sapiens
tggtgaaataataaaatgcaaat

SEQ ID NO: 735177 - DNA, 19 bp, Homo sapiens
tggtgaaatttattagtta

SEQ ID NO: 735178 - DNA, 16 bp, Homo sapiens
tggtgaacactgtgac

SEQ ID NO: 735179 - DNA, 11 bp, Homo sapiens
tggtgaacagt

SEQ ID NO: 735180 - DNA, 21 bp, Homo sapiens
tggtgaagtgtggctggtgtc

SEQ ID NO: 735181 - DNA, 20 bp, Homo sapiens
tggtgaattttcaaggcctt

SEQ ID NO: 735182 - DNA, 14 bp, Homo sapiens
tggtgacacctccc

SEQ ID NO: 735183 - DNA, 17 bp, Homo sapiens
tggtgacacctccccct

SEQ ID NO: 735184 - DNA, 14 bp, Homo sapiens
tggtgacattgaaa

SEQ ID NO: 735185 - DNA, 14 bp, Homo sapiens
tggtgactttgggg

SEQ ID NO: 735186 - DNA, 20 bp, Homo sapiens
tggtgactttggggacaggg

SEQ ID NO: 735187 - DNA, 18 bp, Homo sapiens
tggtgagagtcaaagctg

SEQ ID NO: 735188 - DNA, 18 bp, Homo sapiens
tggtgagccggtcaggca

SEQ ID NO: 735189 - DNA, 17 bp, Homo sapiens
tggtgagcgatcattta

SEQ ID NO: 735190 - DNA, 19 bp, Homo sapiens
tggtgagcgatcatttatt

SEQ ID NO: 735191 - DNA, 15 bp, Homo sapiens
tggtgagctgggaag

SEQ ID NO: 735192 - DNA, 15 bp, Homo sapiens
tggtgaggcccagcc

SEQ ID NO: 735193 - DNA, 18 bp, Homo sapiens
tggtgaggcccagcctgt

SEQ ID NO: 735194 - DNA, 14 bp, Homo sapiens
tggtgaggtgtgga

SEQ ID NO: 735195 - DNA, 17 bp, Homo sapiens
tggtgaggttgtggaga

SEQ ID NO: 735196 - DNA, 17 bp, Homo sapiens
tggtgatcaattaaatg

SEQ ID NO: 735197 - DNA, 19 bp, Homo sapiens
tggtgatccaaacaaaatg

SEQ ID NO: 735198 - DNA, 21 bp, Homo sapiens
tggtgatctcccaagctatct

SEQ ID NO: 735199 - DNA, 15 bp, Homo sapiens
tggtgatctgtagac

SEQ ID NO: 735200 - DNA, 18 bp, Homo sapiens
tggtgatctgtagacttc

SEQ ID NO: 735201 - DNA, 21 bp, Homo sapiens
tggtgatctgtagacttctgg

SEQ ID NO: 735202 - DNA, 19 bp, Homo sapiens
tggtgatgtccaaaagata

SEQ ID NO: 735203 - DNA, 15 bp, Homo sapiens
tggtgatgtgcctgt

SEQ ID NO: 735204 - DNA, 13 bp, Homo sapiens
tggtgcaaaaaaa

SEQ ID NO: 735205 - DNA, 16 bp, Homo sapiens
tggtgcaaattcagaa

SEQ ID NO: 735206 - DNA, 22 bp, Homo sapiens
tggtgcaagttgaggacttctt

SEQ ID NO: 735207 - DNA, 17 bp, Homo sapiens
tggtgcaatcacagctc

SEQ ID NO: 735208 - DNA, 13 bp, Homo sapiens
gtgagccactgct

SEQ ID NO: 735209 - DNA, 15 bp, Homo sapiens
gtgagccatgcctcc

SEQ ID NO: 735210 - DNA, 17 bp, Homo sapiens
gtgagccctctagggca

SEQ ID NO: 735211 - DNA, 18 bp, Homo sapiens
gtgagccgcatcttctcc

SEQ ID NO: 735212 - DNA, 17 bp, Homo sapiens
gtgagcctcctgtgcct

SEQ ID NO: 735213 - DNA, 18 bp, Homo sapiens
gtgagcctcctgtgcctg

SEQ ID NO: 735214 - DNA, 20 bp, Homo sapiens
gtgagcctcctgtgcctggc

SEQ ID NO: 735215 - DNA, 21 bp, Homo sapiens
gtgagcctcctgtgcctggcc

SEQ ID NO: 735216 - DNA, 15 bp, Homo sapiens
gtgagcctgggcagc

SEQ ID NO: 735217 - DNA, 16 bp, Homo sapiens
gtgagcggagatcgca

SEQ ID NO: 735218 - DNA, 15 bp, Homo sapiens
gtgagcgtggccttg

SEQ ID NO: 735219 - DNA, 16 bp, Homo sapiens
gtgagcgtggccttgg

SEQ ID NO: 735220 - DNA, 13 bp, Homo sapiens
gtgagctgcccgg

SEQ ID NO: 735221 - DNA, 22 bp, Homo sapiens
gtgagctgcccggcgcctgccc

SEQ ID NO: 735222 - DNA, 23 bp, Homo sapiens
gtgagctgcccggcgcctgccct

SEQ ID NO: 735223 - DNA, 16 bp, Homo sapiens
gtgagctgggaagctg

SEQ ID NO: 735224 - DNA, 23 bp, Homo sapiens
gtgagctggggactcagggaccg

SEQ ID NO: 735225 - DNA, 21 bp, Homo sapiens
gtgaggaaagtgcgttctccc

SEQ ID NO: 735226 - DNA, 22 bp, Homo sapiens
gtgaggaaccctgatctctcag

SEQ ID NO: 735227 - DNA, 20 bp, Homo sapiens
gtgaggaatgctctgtgcca

SEQ ID NO: 735228 - DNA, 16 bp, Homo sapiens
gtgaggaccactcctg

SEQ ID NO: 735229 - DNA, 17 bp, Homo sapiens
gtgaggactcggccact

SEQ ID NO: 735230 - DNA, 18 bp, Homo sapiens
gtgaggagctgctggctt

SEQ ID NO: 735231 - DNA, 14 bp, Homo sapiens
gtgaggaggaaaag

SEQ ID NO: 735232 - DNA, 15 bp, Homo sapiens
gtgaggaggaaaagg

SEQ ID NO: 735233 - DNA, 21 bp, Homo sapiens
gtgaggataacacaagtaaaa

SEQ ID NO: 735234 - DNA, 14 bp, Homo sapiens
gtgaggattccaaa

SEQ ID NO: 735235 - DNA, 23 bp, Homo sapiens
gtgaggcaatgggagctgaggcc

SEQ ID NO: 735236 - DNA, 22 bp, Homo sapiens
gtgaggcattcggggaagctgc

SEQ ID NO: 735237 - DNA, 11 bp, Homo sapiens
gtgaggcccaa

SEQ ID NO: 735238 - DNA, 14 bp, Homo sapiens
gtgaggcccaagga

SEQ ID NO: 735239 - DNA, 14 bp, Homo sapiens
gtgaggcccagcct

SEQ ID NO: 735240 - DNA, 15 bp, Homo sapiens
gtgaggcccagcctg

SEQ ID NO: 735241 - DNA, 15 bp, Homo sapiens
gtgaggcccagggag

SEQ ID NO: 735242 - DNA, 16 bp, Homo sapiens
gtgaggcctggccagg

SEQ ID NO: 735243 - DNA, 12 bp, Homo sapiens
gtgaggctgtgt

SEQ ID NO: 735244 - DNA, 17 bp, Homo sapiens
gtgaggcttctaataaa

SEQ ID NO: 735245 - DNA, 15 bp, Homo sapiens
gtgagggcagcactg

SEQ ID NO: 735246 - DNA, 14 bp, Homo sapiens
gtgaggggctgtga

SEQ ID NO: 735247 - DNA, 22 bp, Homo sapiens
gtgaggggggggtgggtgagag

SEQ ID NO: 735248 - DNA, 23 bp, Homo sapiens
gtgagggtcctgcagcctgcagg

SEQ ID NO: 735249 - DNA, 14 bp, Homo sapiens
gtgaggtggcccag

SEQ ID NO: 735250 - DNA, 16 bp, Homo sapiens
gtgagtaagagctggt

SEQ ID NO: 735251 - DNA, 21 bp, Homo sapiens
gtgagtagtcttatgtaaagt

SEQ ID NO: 735252 - DNA, 14 bp, Homo sapiens
gtgagtcacctgct

SEQ ID NO: 735253 - DNA, 12 bp, Homo sapiens
gtgagtcagcac

SEQ ID NO: 735254 - DNA, 23 bp, Homo sapiens
gtgagtcagcaccttggcccagg

SEQ ID NO: 735255 - DNA, 18 bp, Homo sapiens
gtgagtcccctactccct

SEQ ID NO: 735256 - DNA, 16 bp, Homo sapiens
gtgagtcgtttcccct

SEQ ID NO: 735257 - DNA, 17 bp, Homo sapiens
gtgagtctggtggagga

SEQ ID NO: 735258 - DNA, 22 bp, Homo sapiens
gtgagtctggtggaggagctga

SEQ ID NO: 735259 - DNA, 20 bp, Homo sapiens
gtgagtcttggcggcagcag

SEQ ID NO: 735260 - DNA, 20 bp, Homo sapiens
gtgagtgccatgctttttgg

SEQ ID NO: 735261 - DNA, 13 bp, Homo sapiens
gtgagtgcctttt

SEQ ID NO: 735262 - DNA, 17 bp, Homo sapiens
gtgagtgccttttgcag

SEQ ID NO: 735263 - DNA, 14 bp, Homo sapiens
gtgagtggcagcca

SEQ ID NO: 735264 - DNA, 20 bp, Homo sapiens
gtgagtggcagccatgcctc

SEQ ID NO: 735265 - DNA, 15 bp, Homo sapiens
gtgagtggcctgcta

SEQ ID NO: 735266 - DNA, 16 bp, Homo sapiens
gtgagtgtaagtgtga

SEQ ID NO: 735267 - DNA, 20 bp, Homo sapiens
gtgagtgtgaatataaatgt

SEQ ID NO: 735268 - DNA, 13 bp, Homo sapiens
gtgagtgtgacag

SEQ ID NO: 735269 - DNA, 20 bp, Homo sapiens
gtgagtgtgacagggccagt

SEQ ID NO: 735270 - DNA, 22 bp, Homo sapiens
gtgagtgtgtccaagtgtgtgt

SEQ ID NO: 735271 - DNA, 23 bp, Homo sapiens
gtgagtgtgtccaagtgtgtgtg

SEQ ID NO: 735272 - DNA, 11 bp, Homo sapiens
gtgagtgtgtg

SEQ ID NO: 735273 - DNA, 18 bp, Homo sapiens
gtgagtgtgtgaagccgc

SEQ ID NO: 735274 - DNA, 13 bp, Homo sapiens
gtgagtgtgtgca

SEQ ID NO: 735275 - DNA, 15 bp, Homo sapiens
gtgagtgtgtgcaag

SEQ ID NO: 735276 - DNA, 14 bp, Homo sapiens
gtgagtgtgtgtgc

SEQ ID NO: 735277 - DNA, 17 bp, Homo sapiens
gtgagtttgagctgcct

SEQ ID NO: 735278 - DNA, 18 bp, Homo sapiens
gtgagtttggtctggact

SEQ ID NO: 735279 - DNA, 13 bp, Homo sapiens
gtgataaaatttt

SEQ ID NO: 735280 - DNA, 21 bp, Homo sapiens
gtgataagggaaaagataaag

SEQ ID NO: 735281 - DNA, 22 bp, Homo sapiens
gtgataaggggccttgctctga

SEQ ID NO: 735282 - DNA, 19 bp, Homo sapiens
gtgataatattgtttccct

SEQ ID NO: 735283 - DNA, 20 bp, Homo sapiens
gtgatacccatagcttccat

SEQ ID NO: 735284 - DNA, 18 bp, Homo sapiens
gtgatagctaacatttta

SEQ ID NO: 735285 - DNA, 17 bp, Homo sapiens
gtgatagttcaccccct

SEQ ID NO: 735286 - DNA, 13 bp, Homo sapiens
gtgatatatttaa

SEQ ID NO: 735287 - DNA, 21 bp, Homo sapiens
gtgatatcacctctcttcagc

SEQ ID NO: 735288 - DNA, 14 bp, Homo sapiens
gtgcacagaaaacc

SEQ ID NO: 735289 - DNA, 16 bp, Homo sapiens
gtgcacagtccacagc

SEQ ID NO: 735290 - DNA, 13 bp, Homo sapiens
gtgcacagtgatt

SEQ ID NO: 735291 - DNA, 14 bp, Homo sapiens
gtgcacagtggctt

SEQ ID NO: 735292 - DNA, 18 bp, Homo sapiens
gtgcacccactcaccagg

SEQ ID NO: 735293 - DNA, 23 bp, Homo sapiens
gtgcacctaccccttggaaatgt

SEQ ID NO: 735294 - DNA, 15 bp, Homo sapiens
gtgcacgcctgagcg

SEQ ID NO: 735295 - DNA, 15 bp, Homo sapiens
gtgcacgtggagagc

SEQ ID NO: 735296 - DNA, 16 bp, Homo sapiens
gtgcacgtggagagct

SEQ ID NO: 735297 - DNA, 21 bp, Homo sapiens
gtgcacgtggcatgtggcctg

SEQ ID NO: 735298 - DNA, 18 bp, Homo sapiens
gtgcacgttgcttcaggc

SEQ ID NO: 735299 - DNA, 13 bp, Homo sapiens
gtgcactccagct

SEQ ID NO: 735300 - DNA, 13 bp, Homo sapiens
gtgcactcgccat

SEQ ID NO: 735301 - DNA, 13 bp, Homo sapiens
gtgcactctgcta

SEQ ID NO: 735302 - DNA, 20 bp, Homo sapiens
gtgcactctgctaatcatgt

SEQ ID NO: 735303 - DNA, 13 bp, Homo sapiens
gtgcactgacagc

SEQ ID NO: 735304 - DNA, 13 bp, Homo sapiens
gtgcactgggcag

SEQ ID NO: 735305 - DNA, 20 bp, Homo sapiens
gtgcactgtgaatcctggca

SEQ ID NO: 735306 - DNA, 22 bp, Homo sapiens
gtgcacttagtagtttttacaa

SEQ ID NO: 735307 - DNA, 19 bp, Homo sapiens
gtgcactttctaatgtttc

SEQ ID NO: 735308 - DNA, 18 bp, Homo sapiens
gtgcacttttttatgaag

SEQ ID NO: 735309 - DNA, 18 bp, Homo sapiens
gtgcagaaaagctcagag

SEQ ID NO: 735310 - DNA, 19 bp, Homo sapiens
gtgcagaaaagctcagagt

SEQ ID NO: 735311 - DNA, 16 bp, Homo sapiens
gtgcagaacacctggc

SEQ ID NO: 735312 - DNA, 12 bp, Homo sapiens
gtgcagaataat

SEQ ID NO: 735313 - DNA, 17 bp, Homo sapiens
gtgcagacccagtccca

SEQ ID NO: 735314 - DNA, 23 bp, Homo sapiens
gtgcagaccctgaacccacacct

SEQ ID NO: 735315 - DNA, 16 bp, Homo sapiens
gtgcagagccttctca

SEQ ID NO: 735316 - DNA, 23 bp, Homo sapiens
gtgcagaggaagtggaaggcatc

SEQ ID NO: 735317 - DNA, 12 bp, Homo sapiens
gtgcagaggctg

SEQ ID NO: 735318 - DNA, 13 bp, Homo sapiens
gtgcagaggctgt

SEQ ID NO: 735319 - DNA, 17 bp, Homo sapiens
gtgcagaggtttcttga

SEQ ID NO: 735320 - DNA, 21 bp, Homo sapiens
gtgcagatgctgctgaagaga

SEQ ID NO: 735321 - DNA, 18 bp, Homo sapiens
gtgcagcagcccagcttc

SEQ ID NO: 735322 - DNA, 19 bp, Homo sapiens
gtgcagcagcccagcttcc

SEQ ID NO: 735323 - DNA, 16 bp, Homo sapiens
gtgcagccccagggcc

SEQ ID NO: 735324 - DNA, 21 bp, Homo sapiens
gtgcagcccgtgtggcccctt

SEQ ID NO: 735325 - DNA, 13 bp, Homo sapiens
gtgcagcccttcc

SEQ ID NO: 735326 - DNA, 17 bp, Homo sapiens
gtgcagccgctgagcga

SEQ ID NO: 735327 - DNA, 13 bp, Homo sapiens
gtgcagccttccc

SEQ ID NO: 735328 - DNA, 13 bp, Homo sapiens
gtgcagccttctc

SEQ ID NO: 735329 - DNA, 15 bp, Homo sapiens
gtgcagcgacccttg

SEQ ID NO: 735330 - DNA, 17 bp, Homo sapiens
gtgcagcgacccttggt

SEQ ID NO: 735331 - DNA, 23 bp, Homo sapiens
gtgcagctgattttaacaataac

SEQ ID NO: 735332 - DNA, 16 bp, Homo sapiens
gtgcagctgggtgggg

SEQ ID NO: 735333 - DNA, 14 bp, Homo sapiens
gtgcagcttcgagg

SEQ ID NO: 735334 - DNA, 20 bp, Homo sapiens
gtgcagcttcgaggacagga

SEQ ID NO: 735335 - DNA, 20 bp, Homo sapiens
gtgcagggagggcagttttc

SEQ ID NO: 735336 - DNA, 20 bp, Homo sapiens
gtgcagggtgtgtactgcac

SEQ ID NO: 735337 - DNA, 15 bp, Homo sapiens
gtgcagtacaggcaa

SEQ ID NO: 735338 - DNA, 14 bp, Homo sapiens
gtgcagtcactgga

SEQ ID NO: 735339 - DNA, 12 bp, Homo sapiens
tggttatgaact

SEQ ID NO: 735340 - DNA, 14 bp, Homo sapiens
tggttatggagagg

SEQ ID NO: 735341 - DNA, 19 bp, Homo sapiens
tggttattctaagcccttt

SEQ ID NO: 735342 - DNA, 15 bp, Homo sapiens
tggttattggttttt

SEQ ID NO: 735343 - DNA, 22 bp, Homo sapiens
tggttatttagggaactgcttg

SEQ ID NO: 735344 - DNA, 15 bp, Homo sapiens
tggttatttctctga

SEQ ID NO: 735345 - DNA, 21 bp, Homo sapiens
tggttattttaaatataaata

SEQ ID NO: 735346 - DNA, 15 bp, Homo sapiens
tggttcacactgacc

SEQ ID NO: 735347 - DNA, 21 bp, Homo sapiens
tggttcagccttcgtgtggct

SEQ ID NO: 735348 - DNA, 16 bp, Homo sapiens
tggttcagctaagcta

SEQ ID NO: 735349 - DNA, 12 bp, Homo sapiens
tggttccagggt

SEQ ID NO: 735350 - DNA, 21 bp, Homo sapiens
tggttccagggtccctctgtg

SEQ ID NO: 735351 - DNA, 16 bp, Homo sapiens
tggttcccaataaaag

SEQ ID NO: 735352 - DNA, 18 bp, Homo sapiens
tggttcccctgttcactc

SEQ ID NO: 735353 - DNA, 16 bp, Homo sapiens
tggttcctaagcctgt

SEQ ID NO: 735354 - DNA, 12 bp, Homo sapiens
tggttcctggga

SEQ ID NO: 735355 - DNA, 14 bp, Homo sapiens
tggttcctgtttga

SEQ ID NO: 735356 - DNA, 22 bp, Homo sapiens
tggttcctgtttgaaactaaaa

SEQ ID NO: 735357 - DNA, 13 bp, Homo sapiens
tggttccttgggg

SEQ ID NO: 735358 - DNA, 16 bp, Homo sapiens
tggttcctttcatctc

SEQ ID NO: 735359 - DNA, 14 bp, Homo sapiens
tggttctcatttgg

SEQ ID NO: 735360 - DNA, 19 bp, Homo sapiens
tggttctccaagaaactga

SEQ ID NO: 735361 - DNA, 19 bp, Homo sapiens
tggttctccttcctcagcc

SEQ ID NO: 735362 - DNA, 17 bp, Homo sapiens
tggttctggccacccca

SEQ ID NO: 735363 - DNA, 14 bp, Homo sapiens
tggttcttaaatgt

SEQ ID NO: 735364 - DNA, 14 bp, Homo sapiens
tggttcttcccctc

SEQ ID NO: 735365 - DNA, 19 bp, Homo sapiens
tggttcttcctttccctgg

SEQ ID NO: 735366 - DNA, 21 bp, Homo sapiens
tggttcttggtagagattcat

SEQ ID NO: 735367 - DNA, 22 bp, Homo sapiens
tggttcttttttcagttatttt

SEQ ID NO: 735368 - DNA, 15 bp, Homo sapiens
tggttgactgggttt

SEQ ID NO: 735369 - DNA, 12 bp, Homo sapiens
tggttgaggaaa

SEQ ID NO: 735370 - DNA, 18 bp, Homo sapiens
tggttgaggggcctggag

SEQ ID NO: 735371 - DNA, 15 bp, Homo sapiens
tggttgaggtggaag

SEQ ID NO: 735372 - DNA, 16 bp, Homo sapiens
tggttgatggaaaata

SEQ ID NO: 735373 - DNA, 21 bp, Homo sapiens
tggttgatggaaaataaacat

SEQ ID NO: 735374 - DNA, 16 bp, Homo sapiens
tggttgatggttttgc

SEQ ID NO: 735375 - DNA, 15 bp, Homo sapiens
tggttgattgtttaa

SEQ ID NO: 735376 - DNA, 15 bp, Homo sapiens
tggttgccaccccaa

SEQ ID NO: 735377 - DNA, 14 bp, Homo sapiens
tggttgcctctctt

SEQ ID NO: 735378 - DNA, 21 bp, Homo sapiens
tggttgcctctcttgcccctt

SEQ ID NO: 735379 - DNA, 12 bp, Homo sapiens
tggttgcttcag

SEQ ID NO: 735380 - DNA, 22 bp, Homo sapiens
tggttgctttctattatcatgg

SEQ ID NO: 735381 - DNA, 14 bp, Homo sapiens
tggttggagagccc

SEQ ID NO: 735382 - DNA, 12 bp, Homo sapiens
tggttggataag

SEQ ID NO: 735383 - DNA, 15 bp, Homo sapiens
tggttgtgaaatgta

SEQ ID NO: 735384 - DNA, 13 bp, Homo sapiens
tggttgtgccttt

SEQ ID NO: 735385 - DNA, 16 bp, Homo sapiens
tggttgtgccttttgt

SEQ ID NO: 735386 - DNA, 15 bp, Homo sapiens
tggttgtgtctgctt

SEQ ID NO: 735387 - DNA, 21 bp, Homo sapiens
tggttgttagttatagatgtc

SEQ ID NO: 735388 - DNA, 22 bp, Homo sapiens
tggttgttgcaccatctgcttg

SEQ ID NO: 735389 - DNA, 20 bp, Homo sapiens
tggttgtttttgttctttgt

SEQ ID NO: 735390 - DNA, 22 bp, Homo sapiens
tggttgtttttgttctttgtgt

SEQ ID NO: 735391 - DNA, 16 bp, Homo sapiens
tggtttaaaaagtttc

SEQ ID NO: 735392 - DNA, 19 bp, Homo sapiens
tggtttaaagaaagtgtat

SEQ ID NO: 735393 - DNA, 15 bp, Homo sapiens
tggtttacaggccct

SEQ ID NO: 735394 - DNA, 19 bp, Homo sapiens
tggtttacaggccctgctc

SEQ ID NO: 735395 - DNA, 18 bp, Homo sapiens
tggtttagggttaagacg

SEQ ID NO: 735396 - DNA, 14 bp, Homo sapiens
tggtttattttcac

SEQ ID NO: 735397 - DNA, 17 bp, Homo sapiens
tggtttcaccttccctc

SEQ ID NO: 735398 - DNA, 20 bp, Homo sapiens
tggtttcagatgtgcaataa

SEQ ID NO: 735399 - DNA, 13 bp, Homo sapiens
tggtttcagccaa

SEQ ID NO: 735400 - DNA, 15 bp, Homo sapiens
tggtttccaaagaat

SEQ ID NO: 735401 - DNA, 16 bp, Homo sapiens
tggtttccaatgtgtt

SEQ ID NO: 735402 - DNA, 17 bp, Homo sapiens
tggtttcccaagagcta

SEQ ID NO: 735403 - DNA, 19 bp, Homo sapiens
tggtttcccctgcactccc

SEQ ID NO: 735404 - DNA, 15 bp, Homo sapiens
tggtttcctttctca

SEQ ID NO: 735405 - DNA, 21 bp, Homo sapiens
tggtttcggaaaaaaaaaaag

SEQ ID NO: 735406 - DNA, 14 bp, Homo sapiens
tggtttctacttcc

SEQ ID NO: 735407 - DNA, 18 bp, Homo sapiens
tggtttctacttcccctg

SEQ ID NO: 735408 - DNA, 12 bp, Homo sapiens
tggtttctccag

SEQ ID NO: 735409 - DNA, 23 bp, Homo sapiens
tggtttgaagaatgttaagactt

SEQ ID NO: 735410 - DNA, 21 bp, Homo sapiens
tggtttgagacactggtttac

SEQ ID NO: 735411 - DNA, 16 bp, Homo sapiens
gtgccaggaccagtca

SEQ ID NO: 735412 - DNA, 17 bp, Homo sapiens
gtgccaggactccccag

SEQ ID NO: 735413 - DNA, 21 bp, Homo sapiens
gtgccaggactccccaggcca

SEQ ID NO: 735414 - DNA, 23 bp, Homo sapiens
gtgccaggactccccaggccagg

SEQ ID NO: 735415 - DNA, 17 bp, Homo sapiens
gtgccaggaggcggcag

SEQ ID NO: 735416 - DNA, 22 bp, Homo sapiens
gtgccaggagggcacagcaggg

SEQ ID NO: 735417 - DNA, 20 bp, Homo sapiens
gtgccaggcagatcctctgg

SEQ ID NO: 735418 - DNA, 14 bp, Homo sapiens
gtgccaggcttgcc

SEQ ID NO: 735419 - DNA, 15 bp, Homo sapiens
gtgccaggcttgcct

SEQ ID NO: 735420 - DNA, 22 bp, Homo sapiens
gtgccaggcttgcctgggctgg

SEQ ID NO: 735421 - DNA, 17 bp, Homo sapiens
gtgccagggtgggctgg

SEQ ID NO: 735422 - DNA, 16 bp, Homo sapiens
gtgccaggtctgggtg

SEQ ID NO: 735423 - DNA, 16 bp, Homo sapiens
gtgccagtattttaaa

SEQ ID NO: 735424 - DNA, 13 bp, Homo sapiens
gtgccatgctggg

SEQ ID NO: 735425 - DNA, 23 bp, Homo sapiens
gtgccatgctgggccactgggga

SEQ ID NO: 735426 - DNA, 19 bp, Homo sapiens
gtgccatggccccccactc

SEQ ID NO: 735427 - DNA, 18 bp, Homo sapiens
gtgccattactactgtac

SEQ ID NO: 735428 - DNA, 18 bp, Homo sapiens
gtgccattatatttgcat

SEQ ID NO: 735429 - DNA, 11 bp, Homo sapiens
gtgccattcca

SEQ ID NO: 735430 - DNA, 21 bp, Homo sapiens
gtgccattccactccactcag

SEQ ID NO: 735431 - DNA, 14 bp, Homo sapiens
gtgccattcccagc

SEQ ID NO: 735432 - DNA, 19 bp, Homo sapiens
gtgccattgtactccagcc

SEQ ID NO: 735433 - DNA, 21 bp, Homo sapiens
gtgccattgtactccagcctg

SEQ ID NO: 735434 - DNA, 17 bp, Homo sapiens
gtgcccaaaagccatgt

SEQ ID NO: 735435 - DNA, 17 bp, Homo sapiens
gtgcccaagtgggcagt

SEQ ID NO: 735436 - DNA, 19 bp, Homo sapiens
gtgcccaagtgggcagtca

SEQ ID NO: 735437 - DNA, 15 bp, Homo sapiens
gtgcccaccgccctc

SEQ ID NO: 735438 - DNA, 19 bp, Homo sapiens
gtgcccacggtctgagcta

SEQ ID NO: 735439 - DNA, 19 bp, Homo sapiens
gtgcccagaacttccctga

SEQ ID NO: 735440 - DNA, 16 bp, Homo sapiens
gtgcccagaataagtt

SEQ ID NO: 735441 - DNA, 13 bp, Homo sapiens
gtgcccagcagag

SEQ ID NO: 735442 - DNA, 12 bp, Homo sapiens
gtgcccagcagg

SEQ ID NO: 735443 - DNA, 15 bp, Homo sapiens
gtgcccagcaggccc

SEQ ID NO: 735444 - DNA, 16 bp, Homo sapiens
gtgcccagcaggccca

SEQ ID NO: 735445 - DNA, 18 bp, Homo sapiens
gtgcccagcccggacctt

SEQ ID NO: 735446 - DNA, 18 bp, Homo sapiens
gtgcccaggcccttggct

SEQ ID NO: 735447 - DNA, 17 bp, Homo sapiens
gtgccccacagctacct

SEQ ID NO: 735448 - DNA, 22 bp, Homo sapiens
gtgccccacagctacctgagac

SEQ ID NO: 735449 - DNA, 13 bp, Homo sapiens
gtgccccacctcc

SEQ ID NO: 735450 - DNA, 14 bp, Homo sapiens
gtgccccacctccc

SEQ ID NO: 735451 - DNA, 16 bp, Homo sapiens
gtgccccacctcccca

SEQ ID NO: 735452 - DNA, 18 bp, Homo sapiens
gtgccccacctcccgccc

SEQ ID NO: 735453 - DNA, 20 bp, Homo sapiens
gtgccccacctcccgccctc

SEQ ID NO: 735454 - DNA, 21 bp, Homo sapiens
gtgccccacctcccgccctca

SEQ ID NO: 735455 - DNA, 17 bp, Homo sapiens
gtgccccacttctggcc

SEQ ID NO: 735456 - DNA, 19 bp, Homo sapiens
gtgccccacttctggccac

SEQ ID NO: 735457 - DNA, 21 bp, Homo sapiens
gtgccccacttctggccacat

SEQ ID NO: 735458 - DNA, 12 bp, Homo sapiens
gtgccccagact

SEQ ID NO: 735459 - DNA, 23 bp, Homo sapiens
gtgccccagactgagctctccag

SEQ ID NO: 735460 - DNA, 15 bp, Homo sapiens
gtgccccagctgcca

SEQ ID NO: 735461 - DNA, 17 bp, Homo sapiens
gtgccccagctgccagg

SEQ ID NO: 735462 - DNA, 13 bp, Homo sapiens
gtgccccagggag

SEQ ID NO: 735463 - DNA, 13 bp, Homo sapiens
gtgcccccctcct

SEQ ID NO: 735464 - DNA, 14 bp, Homo sapiens
gtgccccctctacc

SEQ ID NO: 735465 - DNA, 16 bp, Homo sapiens
gtgccccgcctccccg

SEQ ID NO: 735466 - DNA, 20 bp, Homo sapiens
gtgcccctgctgcctcccca

SEQ ID NO: 735467 - DNA, 13 bp, Homo sapiens
tgtaaacatttat

SEQ ID NO: 735468 - DNA, 14 bp, Homo sapiens
tgtaaaccaaatac

SEQ ID NO: 735469 - DNA, 23 bp, Homo sapiens
tgtaaaccacaaggctgttgcat

SEQ ID NO: 735470 - DNA, 23 bp, Homo sapiens
tgtaaaccacataatttttgtac

SEQ ID NO: 735471 - DNA, 16 bp, Homo sapiens
tgtaaaccacatgaac

SEQ ID NO: 735472 - DNA, 16 bp, Homo sapiens
tgtaaactcaaaactt

SEQ ID NO: 735473 - DNA, 21 bp, Homo sapiens
tgtaaactcaaaacttaacat

SEQ ID NO: 735474 - DNA, 22 bp, Homo sapiens
tgtaaactcaaaacttaacata

SEQ ID NO: 735475 - DNA, 20 bp, Homo sapiens
tgtaaactcaaaatatttgt

SEQ ID NO: 735476 - DNA, 21 bp, Homo sapiens
tgtaaactcgggggtgctggg

SEQ ID NO: 735477 - DNA, 22 bp, Homo sapiens
tgtaaactctatcagcattgtt

SEQ ID NO: 735478 - DNA, 14 bp, Homo sapiens
tgtaaactgccata

SEQ ID NO: 735479 - DNA, 20 bp, Homo sapiens
tgtaaactgtatcaaatctg

SEQ ID NO: 735480 - DNA, 13 bp, Homo sapiens
tgtaaacttctga

SEQ ID NO: 735481 - DNA, 14 bp, Homo sapiens
tgtaaacttctgaa

SEQ ID NO: 735482 - DNA, 15 bp, Homo sapiens
tgtaaactttttcaa

SEQ ID NO: 735483 - DNA, 19 bp, Homo sapiens
tgtaaactttttcaatggt

SEQ ID NO: 735484 - DNA, 13 bp, Homo sapiens
tgtaaactttttg

SEQ ID NO: 735485 - DNA, 22 bp, Homo sapiens
tgtaaagatttgttgacagcaa

SEQ ID NO: 735486 - DNA, 18 bp, Homo sapiens
tgtaaagccaacaccctg

SEQ ID NO: 735487 - DNA, 20 bp, Homo sapiens
tgtaaagctaaaataaagaa

SEQ ID NO: 735488 - DNA, 21 bp, Homo sapiens
tgtaaagctaaaataaagaaa

SEQ ID NO: 735489 - DNA, 16 bp, Homo sapiens
tgtaaaggagtcaaaa

SEQ ID NO: 735490 - DNA, 21 bp, Homo sapiens
tgtaaaggagtcaaaactaca

SEQ ID NO: 735491 - DNA, 16 bp, Homo sapiens
tgtaaagtaagacatc

SEQ ID NO: 735492 - DNA, 19 bp, Homo sapiens
tgtaaagtaggaaaaataa

SEQ ID NO: 735493 - DNA, 18 bp, Homo sapiens
tgtaaagtatgtaaacag

SEQ ID NO: 735494 - DNA, 17 bp, Homo sapiens
tgtaaagtatgtgagta

SEQ ID NO: 735495 - DNA, 21 bp, Homo sapiens
tgtaaagtatgtttttacatt

SEQ ID NO: 735496 - DNA, 20 bp, Homo sapiens
tgtaaagtcggtgattatat

SEQ ID NO: 735497 - DNA, 19 bp, Homo sapiens
tgtaaataaaactatttat

SEQ ID NO: 735498 - DNA, 12 bp, Homo sapiens
tgtaaataagag

SEQ ID NO: 735499 - DNA, 16 bp, Homo sapiens
tgtaaataagagttgc

SEQ ID NO: 735500 - DNA, 17 bp, Homo sapiens
tgtaaataatttgcact

SEQ ID NO: 735501 - DNA, 15 bp, Homo sapiens
tgtaaataattttct

SEQ ID NO: 735502 - DNA, 21 bp, Homo sapiens
tgtaaatacacatagcatgta

SEQ ID NO: 735503 - DNA, 12 bp, Homo sapiens
tgtaaatacacc

SEQ ID NO: 735504 - DNA, 19 bp, Homo sapiens
tgtaaatactcatgaatga

SEQ ID NO: 735505 - DNA, 17 bp, Homo sapiens
tgtaaatactggactca

SEQ ID NO: 735506 - DNA, 20 bp, Homo sapiens
tgtaaatactggactcagga

SEQ ID NO: 735507 - DNA, 24 bp, Homo sapiens
tgtaaatactggactcaggaactt

SEQ ID NO: 735508 - DNA, 21 bp, Homo sapiens
tgtaaatagaagagtttaaaa

SEQ ID NO: 735509 - DNA, 18 bp, Homo sapiens
tgtaaataggatttttag

SEQ ID NO: 735510 - DNA, 18 bp, Homo sapiens
tgtaaataggttcttctt

SEQ ID NO: 735511 - DNA, 15 bp, Homo sapiens
tgtaaatagtgattt

SEQ ID NO: 735512 - DNA, 13 bp, Homo sapiens
tgtaaatatataa

SEQ ID NO: 735513 - DNA, 14 bp, Homo sapiens
tgtaaatatataaa

SEQ ID NO: 735514 - DNA, 16 bp, Homo sapiens
tgtaaatatataaata

SEQ ID NO: 735515 - DNA, 21 bp, Homo sapiens
tgtaaatatataaatatatat

SEQ ID NO: 735516 - DNA, 22 bp, Homo sapiens
tgtaaatatatgtctgataatg

SEQ ID NO: 735517 - DNA, 16 bp, Homo sapiens
tgtaaatatccctccc

SEQ ID NO: 735518 - DNA, 17 bp, Homo sapiens
tgtaaatatgtttgtgc

SEQ ID NO: 735519 - DNA, 22 bp, Homo sapiens
tgtaaatatgttttttagatca

SEQ ID NO: 735520 - DNA, 16 bp, Homo sapiens
tgtaaatattctatat

SEQ ID NO: 735521 - DNA, 20 bp, Homo sapiens
tgtaaatattctatatgaat

SEQ ID NO: 735522 - DNA, 20 bp, Homo sapiens
tgtaaatattcttgtccaca

SEQ ID NO: 735523 - DNA, 18 bp, Homo sapiens
tgtaaatatttactcttt

SEQ ID NO: 735524 - DNA, 13 bp, Homo sapiens
tgtaaatatttat

SEQ ID NO: 735525 - DNA, 20 bp, Homo sapiens
tgtaaatattttaaagaatt

SEQ ID NO: 735526 - DNA, 15 bp, Homo sapiens
tgtaaatatttttcc

SEQ ID NO: 735527 - DNA, 16 bp, Homo sapiens
tgtaaatcaaatttga

SEQ ID NO: 735528 - DNA, 18 bp, Homo sapiens
tgtaaatcctagacttga

SEQ ID NO: 735529 - DNA, 16 bp, Homo sapiens
tgtaaatcctgccatt

SEQ ID NO: 735530 - DNA, 12 bp, Homo sapiens
tgtaaatccttt

SEQ ID NO: 735531 - DNA, 19 bp, Homo sapiens
tgtaaatcctttttcttta

SEQ ID NO: 735532 - DNA, 16 bp, Homo sapiens
tgtaaatctgaagaaa

SEQ ID NO: 735533 - DNA, 12 bp, Homo sapiens
gtgcctgagagt

SEQ ID NO: 735534 - DNA, 18 bp, Homo sapiens
gtgcctgcagcgcctccc

SEQ ID NO: 735535 - DNA, 16 bp, Homo sapiens
gtgcctgcaggggagc

SEQ ID NO: 735536 - DNA, 14 bp, Homo sapiens
gtgcctgccactct

SEQ ID NO: 735537 - DNA, 21 bp, Homo sapiens
gtgcctgccactctctgggac

SEQ ID NO: 735538 - DNA, 14 bp, Homo sapiens
gtgcctgctagagc

SEQ ID NO: 735539 - DNA, 18 bp, Homo sapiens
gtgcctgctagagcaacc

SEQ ID NO: 735540 - DNA, 23 bp, Homo sapiens
gtgcctgctagagcaacccctgt

SEQ ID NO: 735541 - DNA, 16 bp, Homo sapiens
gtgcctgctcagcagc

SEQ ID NO: 735542 - DNA, 18 bp, Homo sapiens
gtgcctgctcagcagcca

SEQ ID NO: 735543 - DNA, 15 bp, Homo sapiens
gtgcctgctcaggtg

SEQ ID NO: 735544 - DNA, 17 bp, Homo sapiens
gtgcctgctcctgtact

SEQ ID NO: 735545 - DNA, 20 bp, Homo sapiens
gtgcctgcttctgtgtacca

SEQ ID NO: 735546 - DNA, 15 bp, Homo sapiens
gtgcctggaggtgtg

SEQ ID NO: 735547 - DNA, 21 bp, Homo sapiens
gtgcctggagttgactgactg

SEQ ID NO: 735548 - DNA, 23 bp, Homo sapiens
gtgcctggatgggggtgcaggca

SEQ ID NO: 735549 - DNA, 14 bp, Homo sapiens
gtgcctggccagat

SEQ ID NO: 735550 - DNA, 17 bp, Homo sapiens
gtgcctggccccagcct

SEQ ID NO: 735551 - DNA, 22 bp, Homo sapiens
gtgcctggccccagcctgggcc

SEQ ID NO: 735552 - DNA, 18 bp, Homo sapiens
gtgcctggcgcccctgcc

SEQ ID NO: 735553 - DNA, 19 bp, Homo sapiens
gtgcctgggccctgggctg

SEQ ID NO: 735554 - DNA, 16 bp, Homo sapiens
gtgcctgggggagttt

SEQ ID NO: 735555 - DNA, 21 bp, Homo sapiens
gtgcctgggtggggctgctcc

SEQ ID NO: 735556 - DNA, 18 bp, Homo sapiens
gtgcctggtgttctgaag

SEQ ID NO: 735557 - DNA, 13 bp, Homo sapiens
gtgcctggtttga

SEQ ID NO: 735558 - DNA, 21 bp, Homo sapiens
gtgcctgtagtcccagctact

SEQ ID NO: 735559 - DNA, 15 bp, Homo sapiens
gtgcctgtgaggcag

SEQ ID NO: 735560 - DNA, 14 bp, Homo sapiens
gtgcctgtggcaga

SEQ ID NO: 735561 - DNA, 12 bp, Homo sapiens
gtgcctgtgtcc

SEQ ID NO: 735562 - DNA, 14 bp, Homo sapiens
gtgccttacctcct

SEQ ID NO: 735563 - DNA, 19 bp, Homo sapiens
gtgccttactgactgtagc

SEQ ID NO: 735564 - DNA, 16 bp, Homo sapiens
gtgccttaggggaacc

SEQ ID NO: 735565 - DNA, 15 bp, Homo sapiens
gtgccttcagctcta

SEQ ID NO: 735566 - DNA, 22 bp, Homo sapiens
gtgccttccataattatgacag

SEQ ID NO: 735567 - DNA, 13 bp, Homo sapiens
gtgccttgcccac

SEQ ID NO: 735568 - DNA, 16 bp, Homo sapiens
gtgccttgtccaggaa

SEQ ID NO: 735569 - DNA, 20 bp, Homo sapiens
gtgcctttatctcagccatc

SEQ ID NO: 735570 - DNA, 17 bp, Homo sapiens
gtgcctttgcaaatcag

SEQ ID NO: 735571 - DNA, 18 bp, Homo sapiens
gtgccttttatagctatt

SEQ ID NO: 735572 - DNA, 14 bp, Homo sapiens
gtgccttttggaac

SEQ ID NO: 735573 - DNA, 19 bp, Homo sapiens
gtgccttttgtaggctgtt

SEQ ID NO: 735574 - DNA, 14 bp, Homo sapiens
gtgcgagcacacac

SEQ ID NO: 735575 - DNA, 12 bp, Homo sapiens
gtgcgagctgcc

SEQ ID NO: 735576 - DNA, 13 bp, Homo sapiens
gtgcgcccagggc

SEQ ID NO: 735577 - DNA, 15 bp, Homo sapiens
gtgcgcgtgagtgtg

SEQ ID NO: 735578 - DNA, 20 bp, Homo sapiens
gtgcgcgtgagtgtgtgagc

SEQ ID NO: 735579 - DNA, 18 bp, Homo sapiens
gtgcgctcttggtccctg

SEQ ID NO: 735580 - DNA, 15 bp, Homo sapiens
gtgcggaccaccctc

SEQ ID NO: 735581 - DNA, 19 bp, Homo sapiens
gtgcggcggtcccagctcc

SEQ ID NO: 735582 - DNA, 23 bp, Homo sapiens
gtgcgtctctctttctccctcac

SEQ ID NO: 735583 - DNA, 21 bp, Homo sapiens
gtgcgtctctgtcgtggacac

SEQ ID NO: 735584 - DNA, 15 bp, Homo sapiens
gtgcgtgaaacacac

SEQ ID NO: 735585 - DNA, 21 bp, Homo sapiens
gtgcgtgaaacacaccaggct

SEQ ID NO: 735586 - DNA, 13 bp, Homo sapiens
gtgcgtgaatgta

SEQ ID NO: 735587 - DNA, 22 bp, Homo sapiens
gtgcgtgccgtgtgagtgtgac

SEQ ID NO: 735588 - DNA, 21 bp, Homo sapiens
gtgcgtggaatgcccttcact

SEQ ID NO: 735589 - DNA, 16 bp, Homo sapiens
gtgcgtggctgtggca

SEQ ID NO: 735590 - DNA, 13 bp, Homo sapiens
gtgcgtgtgtcca

SEQ ID NO: 735591 - DNA, 19 bp, Homo sapiens
gtgcgtgttcagcagaacc

SEQ ID NO: 735592 - DNA, 19 bp, Homo sapiens
gtgctaaaaaattaaacca

SEQ ID NO: 735593 - DNA, 16 bp, Homo sapiens
gtgctaaaaatgaaaa

SEQ ID NO: 735594 - DNA, 20 bp, Homo sapiens
gtgctaaagccaaccagcct

SEQ ID NO: 735595 - DNA, 22 bp, Homo sapiens
tgtaacttattccaagtgcatt

SEQ ID NO: 735596 - DNA, 22 bp, Homo sapiens
tgtaacttcctgctgcaccctg

SEQ ID NO: 735597 - DNA, 24 bp, Homo sapiens
tgtaacttgaacctatgaagcaat

SEQ ID NO: 735598 - DNA, 16 bp, Homo sapiens
tgtaacttgcttaaat

SEQ ID NO: 735599 - DNA, 22 bp, Homo sapiens
tgtaacttgcttaaatttctta

SEQ ID NO: 735600 - DNA, 18 bp, Homo sapiens
tgtaactttaaacatcta

SEQ ID NO: 735601 - DNA, 18 bp, Homo sapiens
tgtaactttcataccact

SEQ ID NO: 735602 - DNA, 19 bp, Homo sapiens
tgtaactttcataccactt

SEQ ID NO: 735603 - DNA, 23 bp, Homo sapiens
tgtaactttccactcttcctgta

SEQ ID NO: 735604 - DNA, 15 bp, Homo sapiens
tgtaacttttgtaag

SEQ ID NO: 735605 - DNA, 13 bp, Homo sapiens
tgtaagaaaacaa

SEQ ID NO: 735606 - DNA, 15 bp, Homo sapiens
tgtaagaaaacaaaa

SEQ ID NO: 735607 - DNA, 18 bp, Homo sapiens
tgtaagaaaagctgatga

SEQ ID NO: 735608 - DNA, 17 bp, Homo sapiens
tgtaagaaatacagact

SEQ ID NO: 735609 - DNA, 18 bp, Homo sapiens
tgtaagaaatactgtaca

SEQ ID NO: 735610 - DNA, 21 bp, Homo sapiens
tgtaagaacaactacctgagc

SEQ ID NO: 735611 - DNA, 16 bp, Homo sapiens
tgtaagaacaatgcca

SEQ ID NO: 735612 - DNA, 15 bp, Homo sapiens
tgtaagaactgtaca

SEQ ID NO: 735613 - DNA, 19 bp, Homo sapiens
tgtaagaactgtacattgt

SEQ ID NO: 735614 - DNA, 21 bp, Homo sapiens
tgtaagaactgtacattgtga

SEQ ID NO: 735615 - DNA, 19 bp, Homo sapiens
tgtaagaagagactgggaa

SEQ ID NO: 735616 - DNA, 16 bp, Homo sapiens
tgtaagcaacttgctt

SEQ ID NO: 735617 - DNA, 18 bp, Homo sapiens
tgtaagcactctggatga

SEQ ID NO: 735618 - DNA, 20 bp, Homo sapiens
tgtaagcatactttgtaaat

SEQ ID NO: 735619 - DNA, 14 bp, Homo sapiens
tgtaagcctgcaag

SEQ ID NO: 735620 - DNA, 15 bp, Homo sapiens
tgtaagcctgcaagc

SEQ ID NO: 735621 - DNA, 18 bp, Homo sapiens
tgtaaggactgtaaacat

SEQ ID NO: 735622 - DNA, 22 bp, Homo sapiens
tgtaaggagtttttttgtcaga

SEQ ID NO: 735623 - DNA, 21 bp, Homo sapiens
tgtaaggatccggaaagaaga

SEQ ID NO: 735624 - DNA, 14 bp, Homo sapiens
tgtaaggcatgaag

SEQ ID NO: 735625 - DNA, 12 bp, Homo sapiens
tgtaagggcagt

SEQ ID NO: 735626 - DNA, 23 bp, Homo sapiens
tgtaaggtcttcttgtgtcctga

SEQ ID NO: 735627 - DNA, 15 bp, Homo sapiens
tgtaaggtctttgta

SEQ ID NO: 735628 - DNA, 19 bp, Homo sapiens
tgtaaggttgtgcagggtg

SEQ ID NO: 735629 - DNA, 21 bp, Homo sapiens
tgtaagtaccctgatgccttt

SEQ ID NO: 735630 - DNA, 16 bp, Homo sapiens
tgtaagtgaaattaag

SEQ ID NO: 735631 - DNA, 18 bp, Homo sapiens
tgtaagtgagagagacaa

SEQ ID NO: 735632 - DNA, 16 bp, Homo sapiens
tgtaagttatttcttg

SEQ ID NO: 735633 - DNA, 22 bp, Homo sapiens
tgtaagttatttcttgtttgtt

SEQ ID NO: 735634 - DNA, 19 bp, Homo sapiens
tgtaagttgagtggaatgt

SEQ ID NO: 735635 - DNA, 21 bp, Homo sapiens
tgtaataaaacttatgctagt

SEQ ID NO: 735636 - DNA, 13 bp, Homo sapiens
tgtaataaacttt

SEQ ID NO: 735637 - DNA, 16 bp, Homo sapiens
tgtaataaaggtcttt

SEQ ID NO: 735638 - DNA, 14 bp, Homo sapiens
tgtaataaatatgt

SEQ ID NO: 735639 - DNA, 13 bp, Homo sapiens
tgtaataaattca

SEQ ID NO: 735640 - DNA, 13 bp, Homo sapiens
tgtaataagaaag

SEQ ID NO: 735641 - DNA, 23 bp, Homo sapiens
tgtaataagaaagtataaagtca

SEQ ID NO: 735642 - DNA, 20 bp, Homo sapiens
tgtaataagcacttgcctgg

SEQ ID NO: 735643 - DNA, 14 bp, Homo sapiens
tgtaataatagact

SEQ ID NO: 735644 - DNA, 14 bp, Homo sapiens
tgtaataatgttat

SEQ ID NO: 735645 - DNA, 14 bp, Homo sapiens
tgtaatactggaat

SEQ ID NO: 735646 - DNA, 20 bp, Homo sapiens
tgtaatactggaataatttg

SEQ ID NO: 735647 - DNA, 20 bp, Homo sapiens
tgtaatacttaaataaacat

SEQ ID NO: 735648 - DNA, 16 bp, Homo sapiens
tgtaatagaaaactga

SEQ ID NO: 735649 - DNA, 20 bp, Homo sapiens
tgtaatagggaaaattctaa

SEQ ID NO: 735650 - DNA, 14 bp, Homo sapiens
tgtaatagttcagt

SEQ ID NO: 735651 - DNA, 16 bp, Homo sapiens
tgtaatataaagtatt

SEQ ID NO: 735652 - DNA, 21 bp, Homo sapiens
tgtaatataaagtattcaaca

SEQ ID NO: 735653 - DNA, 19 bp, Homo sapiens
tgtaatataaatttaagca

SEQ ID NO: 735654 - DNA, 13 bp, Homo sapiens
tgtaatattgtaa

SEQ ID NO: 735655 - DNA, 12 bp, Homo sapiens
gtgctgccatgc

SEQ ID NO: 735656 - DNA, 16 bp, Homo sapiens
gtgctgccatgccact

SEQ ID NO: 735657 - DNA, 17 bp, Homo sapiens
gtgctgccatgccactg

SEQ ID NO: 735658 - DNA, 13 bp, Homo sapiens
gtgctgccccttg

SEQ ID NO: 735659 - DNA, 17 bp, Homo sapiens
gtgctgccccttgcaag

SEQ ID NO: 735660 - DNA, 19 bp, Homo sapiens
gtgctgccccttgcaagcc

SEQ ID NO: 735661 - DNA, 22 bp, Homo sapiens
gtgctgccccttgcaagccata

SEQ ID NO: 735662 - DNA, 23 bp, Homo sapiens
gtgctgccccttgcaagccataa

SEQ ID NO: 735663 - DNA, 19 bp, Homo sapiens
gtgctgcccgtcttcagcc

SEQ ID NO: 735664 - DNA, 11 bp, Homo sapiens
gtgctgccctg

SEQ ID NO: 735665 - DNA, 16 bp, Homo sapiens
gtgctgccctgaagaa

SEQ ID NO: 735666 - DNA, 14 bp, Homo sapiens
gtgctgccctgtgt

SEQ ID NO: 735667 - DNA, 11 bp, Homo sapiens
gtgctgcctct

SEQ ID NO: 735668 - DNA, 13 bp, Homo sapiens
gtgctgcctgtcc

SEQ ID NO: 735669 - DNA, 16 bp, Homo sapiens
gtgctgcgcctgcagg

SEQ ID NO: 735670 - DNA, 17 bp, Homo sapiens
gtgctgctctagggcag

SEQ ID NO: 735671 - DNA, 16 bp, Homo sapiens
gtgctgctgtgtgctt

SEQ ID NO: 735672 - DNA, 16 bp, Homo sapiens
gtgctgcttccctctg

SEQ ID NO: 735673 - DNA, 18 bp, Homo sapiens
gtgctgcttgtgcctccc

SEQ ID NO: 735674 - DNA, 13 bp, Homo sapiens
gtgctggaagtct

SEQ ID NO: 735675 - DNA, 20 bp, Homo sapiens
gtgctggaggattttccagt

SEQ ID NO: 735676 - DNA, 15 bp, Homo sapiens
gtgctggcaaccact

SEQ ID NO: 735677 - DNA, 12 bp, Homo sapiens
gtgctggccccc

SEQ ID NO: 735678 - DNA, 14 bp, Homo sapiens
gtgctggccttggt

SEQ ID NO: 735679 - DNA, 20 bp, Homo sapiens
gtgctggccttggtatgtgc

SEQ ID NO: 735680 - DNA, 15 bp, Homo sapiens
gtgctggctgcccag

SEQ ID NO: 735681 - DNA, 13 bp, Homo sapiens
gtgctgggaaatg

SEQ ID NO: 735682 - DNA, 21 bp, Homo sapiens
gtgctgggaaatgcagaaatc

SEQ ID NO: 735683 - DNA, 18 bp, Homo sapiens
gtgctgggaagggagggt

SEQ ID NO: 735684 - DNA, 17 bp, Homo sapiens
gtgctgggactgagcca

SEQ ID NO: 735685 - DNA, 19 bp, Homo sapiens
gtgctgggactgagccagt

SEQ ID NO: 735686 - DNA, 18 bp, Homo sapiens
gtgctgggaggagggaga

SEQ ID NO: 735687 - DNA, 20 bp, Homo sapiens
gtgctgggataactggccag

SEQ ID NO: 735688 - DNA, 20 bp, Homo sapiens
gtgctgggatgacaggtgtg

SEQ ID NO: 735689 - DNA, 18 bp, Homo sapiens
gtgctgggcactgctcca

SEQ ID NO: 735690 - DNA, 15 bp, Homo sapiens
gtgctgggcagcccg

SEQ ID NO: 735691 - DNA, 19 bp, Homo sapiens
gtgctgggctggactggcc

SEQ ID NO: 735692 - DNA, 15 bp, Homo sapiens
gtgctggggcacggc

SEQ ID NO: 735693 - DNA, 12 bp, Homo sapiens
gtgctggggcca

SEQ ID NO: 735694 - DNA, 21 bp, Homo sapiens
gtgctgggggaatgagcccag

SEQ ID NO: 735695 - DNA, 23 bp, Homo sapiens
gtgctgggggaatgagcccagag

SEQ ID NO: 735696 - DNA, 15 bp, Homo sapiens
gtgctgggggcacag

SEQ ID NO: 735697 - DNA, 16 bp, Homo sapiens
gtgctgggggcacagc

SEQ ID NO: 735698 - DNA, 18 bp, Homo sapiens
gtgctggtagctgagggg

SEQ ID NO: 735699 - DNA, 17 bp, Homo sapiens
gtgctggtatccacagt

SEQ ID NO: 735700 - DNA, 22 bp, Homo sapiens
gtgctggtcagagagacctcat

SEQ ID NO: 735701 - DNA, 18 bp, Homo sapiens
gtgctggtcctaggtcct

SEQ ID NO: 735702 - DNA, 18 bp, Homo sapiens
gtgctggtgaacactgtg

SEQ ID NO: 735703 - DNA, 19 bp, Homo sapiens
gtgctggtgaacactgtga

SEQ ID NO: 735704 - DNA, 19 bp, Homo sapiens
gtgctggtgggtctgagct

SEQ ID NO: 735705 - DNA, 16 bp, Homo sapiens
gtgctggtgtcctgac

SEQ ID NO: 735706 - DNA, 19 bp, Homo sapiens
gtgctggtgtcctgaccac

SEQ ID NO: 735707 - DNA, 23 bp, Homo sapiens
gtgctggtgtcctgaccaccctc

SEQ ID NO: 735708 - DNA, 14 bp, Homo sapiens
gtgctgtaaataag

SEQ ID NO: 735709 - DNA, 16 bp, Homo sapiens
gtgctgtatggcccag

SEQ ID NO: 735710 - DNA, 20 bp, Homo sapiens
gtgctgtatggcccaggcag

SEQ ID NO: 735711 - DNA, 21 bp, Homo sapiens
gtgctgtatggcccaggcagc

SEQ ID NO: 735712 - DNA, 22 bp, Homo sapiens
gtgctgtatggcccaggcagcc

SEQ ID NO: 735713 - DNA, 21 bp, Homo sapiens
gtgctgtcgggaccacatctg

SEQ ID NO: 735714 - DNA, 12 bp, Homo sapiens
gtgctgtgaaaa

SEQ ID NO: 735715 - DNA, 16 bp, Homo sapiens
gtgctgtgagggaggg

SEQ ID NO: 735716 - DNA, 12 bp, Homo sapiens
gtgctgtgcctg

SEQ ID NO: 735717 - DNA, 14 bp, Homo sapiens
gtgctgtgcctgct

SEQ ID NO: 735718 - DNA, 16 bp, Homo sapiens
gtgctgtgcctgctag

SEQ ID NO: 735719 - DNA, 18 bp, Homo sapiens
gtgctgtgcctgctagag

SEQ ID NO: 735720 - DNA, 20 bp, Homo sapiens
gtgctgtggccaggcctgca

SEQ ID NO: 735721 - DNA, 18 bp, Homo sapiens
gtgctgtggccagggtga

SEQ ID NO: 735722 - DNA, 18 bp, Homo sapiens
tgtacaattgatcttttt

SEQ ID NO: 735723 - DNA, 15 bp, Homo sapiens
tgtacaattttaaag

SEQ ID NO: 735724 - DNA, 16 bp, Homo sapiens
tgtacacattcctgca

SEQ ID NO: 735725 - DNA, 22 bp, Homo sapiens
tgtacaccccaggacagtttat

SEQ ID NO: 735726 - DNA, 15 bp, Homo sapiens
tgtacactgaatatt

SEQ ID NO: 735727 - DNA, 20 bp, Homo sapiens
tgtacactgaatatttatat

SEQ ID NO: 735728 - DNA, 21 bp, Homo sapiens
tgtacactgaatatttatatt

SEQ ID NO: 735729 - DNA, 22 bp, Homo sapiens
tgtacactggatatgttgttaa

SEQ ID NO: 735730 - DNA, 18 bp, Homo sapiens
tgtacagaacacaaatgt

SEQ ID NO: 735731 - DNA, 15 bp, Homo sapiens
tgtacagaagagcaa

SEQ ID NO: 735732 - DNA, 18 bp, Homo sapiens
tgtacagaattctgctac

SEQ ID NO: 735733 - DNA, 18 bp, Homo sapiens
tgtacagactgttttact

SEQ ID NO: 735734 - DNA, 20 bp, Homo sapiens
tgtacagactgttttactgt

SEQ ID NO: 735735 - DNA, 14 bp, Homo sapiens
tgtacagagactct

SEQ ID NO: 735736 - DNA, 16 bp, Homo sapiens
tgtacagagctttctt

SEQ ID NO: 735737 - DNA, 17 bp, Homo sapiens
tgtacagagtggcccct

SEQ ID NO: 735738 - DNA, 20 bp, Homo sapiens
tgtacagcattaaaatttta

SEQ ID NO: 735739 - DNA, 20 bp, Homo sapiens
tgtacaggaagtagttctaa

SEQ ID NO: 735740 - DNA, 18 bp, Homo sapiens
tgtacaggggccatgccc

SEQ ID NO: 735741 - DNA, 18 bp, Homo sapiens
tgtacagtaatatgttta

SEQ ID NO: 735742 - DNA, 21 bp, Homo sapiens
tgtacagtaatatgtttaatg

SEQ ID NO: 735743 - DNA, 14 bp, Homo sapiens
tgtacagtagattt

SEQ ID NO: 735744 - DNA, 14 bp, Homo sapiens
tgtacagtctgtca

SEQ ID NO: 735745 - DNA, 16 bp, Homo sapiens
tgtacagtctgtcatg

SEQ ID NO: 735746 - DNA, 17 bp, Homo sapiens
tgtacagtgtctgtgcc

SEQ ID NO: 735747 - DNA, 14 bp, Homo sapiens
tgtacagtgttacc

SEQ ID NO: 735748 - DNA, 21 bp, Homo sapiens
tgtacagttatctaagttaat

SEQ ID NO: 735749 - DNA, 11 bp, Homo sapiens
tgtacataaaa

SEQ ID NO: 735750 - DNA, 18 bp, Homo sapiens
tgtacataaactgtcact

SEQ ID NO: 735751 - DNA, 16 bp, Homo sapiens
tgtacataaattccag

SEQ ID NO: 735752 - DNA, 18 bp, Homo sapiens
tgtacataactgaaaatg

SEQ ID NO: 735753 - DNA, 19 bp, Homo sapiens
tgtacataatgcgtgcata

SEQ ID NO: 735754 - DNA, 20 bp, Homo sapiens
tgtacataatgcgtgcatac

SEQ ID NO: 735755 - DNA, 13 bp, Homo sapiens
tgtacatacattg

SEQ ID NO: 735756 - DNA, 15 bp, Homo sapiens
tgtacatactggcct

SEQ ID NO: 735757 - DNA, 17 bp, Homo sapiens
tgtacatactggcctct

SEQ ID NO: 735758 - DNA, 13 bp, Homo sapiens
tgtacatatgtaa

SEQ ID NO: 735759 - DNA, 16 bp, Homo sapiens
tgtacatatgtaaaat

SEQ ID NO: 735760 - DNA, 15 bp, Homo sapiens
tgtacatatgtgctg

SEQ ID NO: 735761 - DNA, 18 bp, Homo sapiens
tgtacatatttgtggaat

SEQ ID NO: 735762 - DNA, 15 bp, Homo sapiens
tgtacatcatgttat

SEQ ID NO: 735763 - DNA, 20 bp, Homo sapiens
tgtacatcatgttattttat

SEQ ID NO: 735764 - DNA, 13 bp, Homo sapiens
tgtacatcccaaa

SEQ ID NO: 735765 - DNA, 18 bp, Homo sapiens
tgtacatctattttggat

SEQ ID NO: 735766 - DNA, 21 bp, Homo sapiens
tgtacatctattttggattgt

SEQ ID NO: 735767 - DNA, 14 bp, Homo sapiens
tgtacatctggcct

SEQ ID NO: 735768 - DNA, 14 bp, Homo sapiens
tgtacatgaaaaca

SEQ ID NO: 735769 - DNA, 18 bp, Homo sapiens
tgtacatgaaaacacatt

SEQ ID NO: 735770 - DNA, 18 bp, Homo sapiens
tgtacatgacatcaaaat

SEQ ID NO: 735771 - DNA, 14 bp, Homo sapiens
tgtacatgcattca

SEQ ID NO: 735772 - DNA, 19 bp, Homo sapiens
tgtacatggcagagtttgt

SEQ ID NO: 735773 - DNA, 14 bp, Homo sapiens
tgtacatgttcttg

SEQ ID NO: 735774 - DNA, 15 bp, Homo sapiens
tgtacattctgccta

SEQ ID NO: 735775 - DNA, 15 bp, Homo sapiens
tgtacattcttccat

SEQ ID NO: 735776 - DNA, 17 bp, Homo sapiens
tgtacattgtgagctct

SEQ ID NO: 735777 - DNA, 14 bp, Homo sapiens
tgtacatttaaaat

SEQ ID NO: 735778 - DNA, 23 bp, Homo sapiens
tgcaggtggggtgatggccagag

SEQ ID NO: 735779 - DNA, 20 bp, Homo sapiens
tgcaggtggtgtcgggccct

SEQ ID NO: 735780 - DNA, 14 bp, Homo sapiens
tgcaggtttctcct

SEQ ID NO: 735781 - DNA, 21 bp, Homo sapiens
tgcaggtttgtaatgcaaaag

SEQ ID NO: 735782 - DNA, 15 bp, Homo sapiens
tgcaggtttgttaca

SEQ ID NO: 735783 - DNA, 15 bp, Homo sapiens
tgcagtaaaacacat

SEQ ID NO: 735784 - DNA, 16 bp, Homo sapiens
tgcagtagagtcatct

SEQ ID NO: 735785 - DNA, 15 bp, Homo sapiens
tgcagtagtctctgt

SEQ ID NO: 735786 - DNA, 18 bp, Homo sapiens
tgcagtagtctctgtgct

SEQ ID NO: 735787 - DNA, 23 bp, Homo sapiens
tgcagtatttttaaatatgtata

SEQ ID NO: 735788 - DNA, 16 bp, Homo sapiens
tgcagtcactgtgatt

SEQ ID NO: 735789 - DNA, 21 bp, Homo sapiens
tgcagtcagtcatgatggcac

SEQ ID NO: 735790 - DNA, 17 bp, Homo sapiens
tgcagtcagtgtttctt

SEQ ID NO: 735791 - DNA, 17 bp, Homo sapiens
tgcagtccatttcctaa

SEQ ID NO: 735792 - DNA, 14 bp, Homo sapiens
tgcagtcctccggg

SEQ ID NO: 735793 - DNA, 15 bp, Homo sapiens
tgcagtcctccgggg

SEQ ID NO: 735794 - DNA, 22 bp, Homo sapiens
tgcagtcctgatcagagccgtg

SEQ ID NO: 735795 - DNA, 16 bp, Homo sapiens
tgcagtcggcatgcca

SEQ ID NO: 735796 - DNA, 17 bp, Homo sapiens
tgcagtcggcatgccag

SEQ ID NO: 735797 - DNA, 16 bp, Homo sapiens
tgcagtcttgtagcta

SEQ ID NO: 735798 - DNA, 14 bp, Homo sapiens
tgcagtgaatttga

SEQ ID NO: 735799 - DNA, 18 bp, Homo sapiens
tgcagtgacgtgcacctg

SEQ ID NO: 735800 - DNA, 19 bp, Homo sapiens
tgcagtgacgtgcacctgt

SEQ ID NO: 735801 - DNA, 22 bp, Homo sapiens
tgcagtgacgtgcacctgtact

SEQ ID NO: 735802 - DNA, 17 bp, Homo sapiens
tgcagtgagcagggtgg

SEQ ID NO: 735803 - DNA, 23 bp, Homo sapiens
tgcagtgaggggccctccatgcg

SEQ ID NO: 735804 - DNA, 16 bp, Homo sapiens
tgcagtgatacatgta

SEQ ID NO: 735805 - DNA, 18 bp, Homo sapiens
tgcagtgatacatgtact

SEQ ID NO: 735806 - DNA, 21 bp, Homo sapiens
tgcagtgatgcaatcttggct

SEQ ID NO: 735807 - DNA, 23 bp, Homo sapiens
tgcagtgatggcgcgggaggcac

SEQ ID NO: 735808 - DNA, 16 bp, Homo sapiens
tgcagtgctcattcat

SEQ ID NO: 735809 - DNA, 16 bp, Homo sapiens
tgcagtggcttttcat

SEQ ID NO: 735810 - DNA, 14 bp, Homo sapiens
tgcagtgtgaaaag

SEQ ID NO: 735811 - DNA, 12 bp, Homo sapiens
tgcagtgtggag

SEQ ID NO: 735812 - DNA, 15 bp, Homo sapiens
tgcagtgtggagttc

SEQ ID NO: 735813 - DNA, 21 bp, Homo sapiens
tgcagtgtggagttcaccttg

SEQ ID NO: 735814 - DNA, 15 bp, Homo sapiens
tgcagtgttagtatt

SEQ ID NO: 735815 - DNA, 14 bp, Homo sapiens
tgcagttaccacag

SEQ ID NO: 735816 - DNA, 20 bp, Homo sapiens
tgcagttcccccaacctcag

SEQ ID NO: 735817 - DNA, 14 bp, Homo sapiens
tgcagttcctgagt

SEQ ID NO: 735818 - DNA, 14 bp, Homo sapiens
tgcagttctgagca

SEQ ID NO: 735819 - DNA, 12 bp, Homo sapiens
tgcagtttatca

SEQ ID NO: 735820 - DNA, 14 bp, Homo sapiens
tgcagtttcatgta

SEQ ID NO: 735821 - DNA, 14 bp, Homo sapiens
tgcagtttcctgga

SEQ ID NO: 735822 - DNA, 18 bp, Homo sapiens
tgcagtttcttgtgtaga

SEQ ID NO: 735823 - DNA, 14 bp, Homo sapiens
tgcagtttggccct

SEQ ID NO: 735824 - DNA, 17 bp, Homo sapiens
tgcagtttgggagacat

SEQ ID NO: 735825 - DNA, 21 bp, Homo sapiens
tgcagtttggtgtgtcctccg

SEQ ID NO: 735826 - DNA, 14 bp, Homo sapiens
tgcagttttaagaa

SEQ ID NO: 735827 - DNA, 15 bp, Homo sapiens
tgcagttttgacatt

SEQ ID NO: 735828 - DNA, 14 bp, Homo sapiens
tgcagttttgtaag

SEQ ID NO: 735829 - DNA, 19 bp, Homo sapiens
tgcagtttttataatagat

SEQ ID NO: 735830 - DNA, 16 bp, Homo sapiens
tgcagtttttcccaag

SEQ ID NO: 735831 - DNA, 15 bp, Homo sapiens
tgcataaaaaaatga

SEQ ID NO: 735832 - DNA, 17 bp, Homo sapiens
tgcataacaattcctct

SEQ ID NO: 735833 - DNA, 19 bp, Homo sapiens
tgcataacctttacactcc

SEQ ID NO: 735834 - DNA, 23 bp, Homo sapiens
tgcataagattaaaggaaggaaa

SEQ ID NO: 735835 - DNA, 22 bp, Homo sapiens
tgcataagtgaaaatcttacaa

SEQ ID NO: 735836 - DNA, 14 bp, Homo sapiens
tgcataagttaact

SEQ ID NO: 735837 - DNA, 17 bp, Homo sapiens
tgcataatagctacagt

SEQ ID NO: 735838 - DNA, 18 bp, Homo sapiens
tgcataatgataaaataa

SEQ ID NO: 735839 - DNA, 14 bp, Homo sapiens
tgcatacaataaaa

SEQ ID NO: 735840 - DNA, 16 bp, Homo sapiens
tgcatacaataaaaga

SEQ ID NO: 735841 - DNA, 14 bp, Homo sapiens
tgcataccactttt

SEQ ID NO: 735842 - DNA, 16 bp, Homo sapiens
tgcataccacttttgt

SEQ ID NO: 735843 - DNA, 22 bp, Homo sapiens
tgcataccacttttgttcttgg

SEQ ID NO: 735844 - DNA, 22 bp, Homo sapiens
tgcatacggctatattggttta

SEQ ID NO: 735845 - DNA, 14 bp, Homo sapiens
tgcatactgttgat

SEQ ID NO: 735846 - DNA, 19 bp, Homo sapiens
tgcatactgttgatacaaa

SEQ ID NO: 735847 - DNA, 21 bp, Homo sapiens
tgcatactgttgatacaaacc

SEQ ID NO: 735848 - DNA, 22 bp, Homo sapiens
tgcatacttacctagtgaaact

SEQ ID NO: 735849 - DNA, 21 bp, Homo sapiens
tgcatactttgacaaggaaaa

SEQ ID NO: 735850 - DNA, 19 bp, Homo sapiens
tgcatactttttaaatgta

SEQ ID NO: 735851 - DNA, 22 bp, Homo sapiens
tgcatactttttaaatgtaaag

SEQ ID NO: 735852 - DNA, 23 bp, Homo sapiens
tgcatactttttaaatgtaaaga

SEQ ID NO: 735853 - DNA, 22 bp, Homo sapiens
tgcatagcagatggtttccaca

SEQ ID NO: 735854 - DNA, 14 bp, Homo sapiens
tgcatagcgtcctg

SEQ ID NO: 735855 - DNA, 18 bp, Homo sapiens
tgcatagcgtcctgccct

SEQ ID NO: 735856 - DNA, 20 bp, Homo sapiens
tgcatagcgtcctgccctgc

SEQ ID NO: 735857 - DNA, 21 bp, Homo sapiens
tgcatagcgtcctgccctgcc

SEQ ID NO: 735858 - DNA, 20 bp, Homo sapiens
tgcataggagtttggaggaa

SEQ ID NO: 735859 - DNA, 14 bp, Homo sapiens
tgcataggattcca

SEQ ID NO: 735860 - DNA, 21 bp, Homo sapiens
tgcatagtattccattgtgtg

SEQ ID NO: 735861 - DNA, 16 bp, Homo sapiens
tgcatagtcccagcta

SEQ ID NO: 735862 - DNA, 20 bp, Homo sapiens
tgcatagtcccagctaccca

SEQ ID NO: 735863 - DNA, 14 bp, Homo sapiens
tgcatataacttat

SEQ ID NO: 735864 - DNA, 15 bp, Homo sapiens
tgcatataacttata

SEQ ID NO: 735865 - DNA, 21 bp, Homo sapiens
tgcatataacttatattgtaa

SEQ ID NO: 735866 - DNA, 16 bp, Homo sapiens
tgcatataatgaataa

SEQ ID NO: 735867 - DNA, 14 bp, Homo sapiens
tgcatatagaaaac

SEQ ID NO: 735868 - DNA, 19 bp, Homo sapiens
tgcatatagatttagtttt

SEQ ID NO: 735869 - DNA, 23 bp, Homo sapiens
tgcatatagatttagttttgtaa

SEQ ID NO: 735870 - DNA, 18 bp, Homo sapiens
tgcatatcattaaacaaa

SEQ ID NO: 735871 - DNA, 17 bp, Homo sapiens
tgcatatcctgagccat

SEQ ID NO: 735872 - DNA, 13 bp, Homo sapiens
tgcatatctgcct

SEQ ID NO: 735873 - DNA, 15 bp, Homo sapiens
tgcatatgaaatcct

SEQ ID NO: 735874 - DNA, 14 bp, Homo sapiens
tgcatatgcaatgt

SEQ ID NO: 735875 - DNA, 18 bp, Homo sapiens
tgcatatgttaaagctta

SEQ ID NO: 735876 - DNA, 23 bp, Homo sapiens
tgcatatgttaaagcttattttt

SEQ ID NO: 735877 - DNA, 15 bp, Homo sapiens
tgcatattctattgt

SEQ ID NO: 735878 - DNA, 18 bp, Homo sapiens
tgcatattctattgtatt

SEQ ID NO: 735879 - DNA, 15 bp, Homo sapiens
ggggctttgggccca

SEQ ID NO: 735880 - DNA, 19 bp, Homo sapiens
gggggaaaaaaaaaaaaga

SEQ ID NO: 735881 - DNA, 15 bp, Homo sapiens
gggggaaagagggag

SEQ ID NO: 735882 - DNA, 14 bp, Homo sapiens
gggggaaggcgctg

SEQ ID NO: 735883 - DNA, 12 bp, Homo sapiens
gggggaatgagc

SEQ ID NO: 735884 - DNA, 16 bp, Homo sapiens
gggggaatgagcccag

SEQ ID NO: 735885 - DNA, 21 bp, Homo sapiens
gggggaatgagcccagagaac

SEQ ID NO: 735886 - DNA, 10 bp, Homo sapiens
gggggagccc

SEQ ID NO: 735887 - DNA, 21 bp, Homo sapiens
gggggagcccagtgaagcctc

SEQ ID NO: 735888 - DNA, 12 bp, Homo sapiens
gggggaggggcc

SEQ ID NO: 735889 - DNA, 12 bp, Homo sapiens
gggggaggggga

SEQ ID NO: 735890 - DNA, 14 bp, Homo sapiens
gggggagtctttgc

SEQ ID NO: 735891 - DNA, 13 bp, Homo sapiens
gggggcacagctg

SEQ ID NO: 735892 - DNA, 12 bp, Homo sapiens
gggggcagaggg

SEQ ID NO: 735893 - DNA, 13 bp, Homo sapiens
gggggcagagggc

SEQ ID NO: 735894 - DNA, 18 bp, Homo sapiens
gggggcagctgtcctgaa

SEQ ID NO: 735895 - DNA, 19 bp, Homo sapiens
gggggccaaagaaggcagg

SEQ ID NO: 735896 - DNA, 14 bp, Homo sapiens
gggggccaaggtcc

SEQ ID NO: 735897 - DNA, 13 bp, Homo sapiens
gggggccacctgc

SEQ ID NO: 735898 - DNA, 14 bp, Homo sapiens
gggggccacctgcc

SEQ ID NO: 735899 - DNA, 14 bp, Homo sapiens
gggggccagctggg

SEQ ID NO: 735900 - DNA, 18 bp, Homo sapiens
gggggccccgccagggct

SEQ ID NO: 735901 - DNA, 14 bp, Homo sapiens
gggggccgggcagg

SEQ ID NO: 735902 - DNA, 20 bp, Homo sapiens
gggggccgggcaggtcctgc

SEQ ID NO: 735903 - DNA, 23 bp, Homo sapiens
gggggccgggcaggtcctgccca

SEQ ID NO: 735904 - DNA, 12 bp, Homo sapiens
gggggcctgcaa

SEQ ID NO: 735905 - DNA, 18 bp, Homo sapiens
gggggccttgcggaagcc

SEQ ID NO: 735906 - DNA, 21 bp, Homo sapiens
gggggccttgcggaagccata

SEQ ID NO: 735907 - DNA, 22 bp, Homo sapiens
gggggcgctcaggacccaggcc

SEQ ID NO: 735908 - DNA, 18 bp, Homo sapiens
gggggctagggagacgcc

SEQ ID NO: 735909 - DNA, 20 bp, Homo sapiens
gggggctcggggaggcagag

SEQ ID NO: 735910 - DNA, 12 bp, Homo sapiens
gggggctctcca

SEQ ID NO: 735911 - DNA, 13 bp, Homo sapiens
gggggctgcacgg

SEQ ID NO: 735912 - DNA, 12 bp, Homo sapiens
gggggctgcctt

SEQ ID NO: 735913 - DNA, 12 bp, Homo sapiens
ggggggccaccc

SEQ ID NO: 735914 - DNA, 12 bp, Homo sapiens
ggggggctgcct

SEQ ID NO: 735915 - DNA, 23 bp, Homo sapiens
gggggtcagaagaagtgggagca

SEQ ID NO: 735916 - DNA, 20 bp, Homo sapiens
gggggtcaggcagccagtga

SEQ ID NO: 735917 - DNA, 16 bp, Homo sapiens
gggggtccacccagca

SEQ ID NO: 735918 - DNA, 15 bp, Homo sapiens
gggggtcggaagcct

SEQ ID NO: 735919 - DNA, 19 bp, Homo sapiens
gggggtcggaagcctgtcc

SEQ ID NO: 735920 - DNA, 21 bp, Homo sapiens
gggggtgcaaagactctgagc

SEQ ID NO: 735921 - DNA, 12 bp, Homo sapiens
gggggtggccat

SEQ ID NO: 735922 - DNA, 23 bp, Homo sapiens
gggggtggccgctgagtggcagg

SEQ ID NO: 735923 - DNA, 22 bp, Homo sapiens
ggggtaaagtatcacttttctg

SEQ ID NO: 735924 - DNA, 15 bp, Homo sapiens
ggggtaagccagagc

SEQ ID NO: 735925 - DNA, 17 bp, Homo sapiens
ggggtacacagtgagag

SEQ ID NO: 735926 - DNA, 19 bp, Homo sapiens
ggggtacatttctctgagc

SEQ ID NO: 735927 - DNA, 20 bp, Homo sapiens
ggggtacatttctctgagca

SEQ ID NO: 735928 - DNA, 20 bp, Homo sapiens
ggggtagaccttgagggtgg

SEQ ID NO: 735929 - DNA, 21 bp, Homo sapiens
ggggtagctagcgtgtgccag

SEQ ID NO: 735930 - DNA, 20 bp, Homo sapiens
ggggtcaggtgccactgacc

SEQ ID NO: 735931 - DNA, 23 bp, Homo sapiens
ggggtcaggtgtcaggcccgtcg

SEQ ID NO: 735932 - DNA, 17 bp, Homo sapiens
ggggtcatgaagggctg

SEQ ID NO: 735933 - DNA, 21 bp, Homo sapiens
ggggtcatgccctcctctccc

SEQ ID NO: 735934 - DNA, 13 bp, Homo sapiens
ggggtccaccagt

SEQ ID NO: 735935 - DNA, 18 bp, Homo sapiens
ggggtccacccagcaaag

SEQ ID NO: 735936 - DNA, 13 bp, Homo sapiens
ggggtccagggct

SEQ ID NO: 735937 - DNA, 18 bp, Homo sapiens
ggggtccatccccttccc

SEQ ID NO: 735938 - DNA, 23 bp, Homo sapiens
ggggtccccatcatcccagctgc

SEQ ID NO: 735939 - DNA, 18 bp, Homo sapiens
ggggtccctccaccccac

SEQ ID NO: 735940 - DNA, 20 bp, Homo sapiens
ggggtcctcctcgctcctcc

SEQ ID NO: 735941 - DNA, 19 bp, Homo sapiens
ggggtcctggagcagacca

SEQ ID NO: 735942 - DNA, 19 bp, Homo sapiens
ggggtctccctctcctgcc

SEQ ID NO: 735943 - DNA, 13 bp, Homo sapiens
ggggtctccctgg

SEQ ID NO: 735944 - DNA, 21 bp, Homo sapiens
ggggtctccctggctccctcc

SEQ ID NO: 735945 - DNA, 12 bp, Homo sapiens
ggggtctcctgg

SEQ ID NO: 735946 - DNA, 18 bp, Homo sapiens
ggggtctctctccctacc

SEQ ID NO: 735947 - DNA, 17 bp, Homo sapiens
ggggtctgggcagtgcc

SEQ ID NO: 735948 - DNA, 18 bp, Homo sapiens
ggggtctgggcagtgcca

SEQ ID NO: 735949 - DNA, 22 bp, Homo sapiens
ggggtctgggcagtgccacagc

SEQ ID NO: 735950 - DNA, 18 bp, Homo sapiens
ggggtctgtgctgtgcct

SEQ ID NO: 735951 - DNA, 22 bp, Homo sapiens
ggggtgagaccctcgcagacct

SEQ ID NO: 735952 - DNA, 14 bp, Homo sapiens
ggggtgagtcccct

SEQ ID NO: 735953 - DNA, 21 bp, Homo sapiens
ggggtgatggccagaggaatg

SEQ ID NO: 735954 - DNA, 18 bp, Homo sapiens
ggggtgatttcagagagg

SEQ ID NO: 735955 - DNA, 13 bp, Homo sapiens
ggggtgccccctc

SEQ ID NO: 735956 - DNA, 14 bp, Homo sapiens
ggggtgctggggcc

SEQ ID NO: 735957 - DNA, 18 bp, Homo sapiens
ggggtgctggggccaggg

SEQ ID NO: 735958 - DNA, 14 bp, Homo sapiens
ggggtggccagggc

SEQ ID NO: 735959 - DNA, 15 bp, Homo sapiens
ggggtggccagggct

SEQ ID NO: 735960 - DNA, 19 bp, Homo sapiens
ggggtgggagggcgtcagg

SEQ ID NO: 735961 - DNA, 16 bp, Homo sapiens
ggggtgggctggagtc

SEQ ID NO: 735962 - DNA, 12 bp, Homo sapiens
ggggtggggtgg

SEQ ID NO: 735963 - DNA, 18 bp, Homo sapiens
ggggtgtccgagaggctg

SEQ ID NO: 735964 - DNA, 16 bp, Homo sapiens
ggggtgttcttcttgg

SEQ ID NO: 735965 - DNA, 13 bp, Homo sapiens
ggggttacaaact

SEQ ID NO: 735966 - DNA, 17 bp, Homo sapiens
ggggttacaaactgcaa

SEQ ID NO: 735967 - DNA, 19 bp, Homo sapiens
ggggttagagccaagctgc

SEQ ID NO: 735968 - DNA, 15 bp, Homo sapiens
ggggttatctctgtg

SEQ ID NO: 735969 - DNA, 16 bp, Homo sapiens
ggggttcagcccctcc

SEQ ID NO: 735970 - DNA, 15 bp, Homo sapiens
tgcgtccccactccc

SEQ ID NO: 735971 - DNA, 18 bp, Homo sapiens
tgcgtccctccgagcttg

SEQ ID NO: 735972 - DNA, 22 bp, Homo sapiens
tgcgtcctcctcacctcatgcc

SEQ ID NO: 735973 - DNA, 18 bp, Homo sapiens
tgcgtcctgacgccctgc

SEQ ID NO: 735974 - DNA, 19 bp, Homo sapiens
tgcgtcctgcagaggacca

SEQ ID NO: 735975 - DNA, 17 bp, Homo sapiens
tgcgtctctctttctcc

SEQ ID NO: 735976 - DNA, 22 bp, Homo sapiens
tgcgtctctctttctccctcac

SEQ ID NO: 735977 - DNA, 19 bp, Homo sapiens
tgcgtcttccgcccctgcc

SEQ ID NO: 735978 - DNA, 16 bp, Homo sapiens
tgcgtcttggtgtaat

SEQ ID NO: 735979 - DNA, 12 bp, Homo sapiens
tgcgtgaatgta

SEQ ID NO: 735980 - DNA, 14 bp, Homo sapiens
tgcgtgacaataaa

SEQ ID NO: 735981 - DNA, 17 bp, Homo sapiens
tgcgtgacaataaaaca

SEQ ID NO: 735982 - DNA, 22 bp, Homo sapiens
tgcgtgacaataaaacattaat

SEQ ID NO: 735983 - DNA, 15 bp, Homo sapiens
tgcgtgcataccact

SEQ ID NO: 735984 - DNA, 18 bp, Homo sapiens
tgcgtgccgcctgctcct

SEQ ID NO: 735985 - DNA, 23 bp, Homo sapiens
tgcgtgccgcctgctcctcactg

SEQ ID NO: 735986 - DNA, 23 bp, Homo sapiens
tgcgtgccgggagaggactctgc

SEQ ID NO: 735987 - DNA, 23 bp, Homo sapiens
tgcgtgccgtgtgagtgtgacag

SEQ ID NO: 735988 - DNA, 17 bp, Homo sapiens
tgcgtggacagtcaggg

SEQ ID NO: 735989 - DNA, 24 bp, Homo sapiens
tgcgtggccacgggggcagtgtga

SEQ ID NO: 735990 - DNA, 15 bp, Homo sapiens
tgcgtggctgtggca

SEQ ID NO: 735991 - DNA, 14 bp, Homo sapiens
tgcgtggtgtggcc

SEQ ID NO: 735992 - DNA, 15 bp, Homo sapiens
tgcgtgtgtcaggga

SEQ ID NO: 735993 - DNA, 18 bp, Homo sapiens
tgcgtgtgtgtgtgtttg

SEQ ID NO: 735994 - DNA, 20 bp, Homo sapiens
tgcgtgttagtgtgtgtgca

SEQ ID NO: 735995 - DNA, 13 bp, Homo sapiens
tgcgttcagcccc

SEQ ID NO: 735996 - DNA, 13 bp, Homo sapiens
tgcgttctcccag

SEQ ID NO: 735997 - DNA, 15 bp, Homo sapiens
tgcgttctcccagca

SEQ ID NO: 735998 - DNA, 14 bp, Homo sapiens
tgcgttggagccac

SEQ ID NO: 735999 - DNA, 19 bp, Homo sapiens
tgcgttggagccactcctg

SEQ ID NO: 736000 - DNA, 21 bp, Homo sapiens
tgctaaaaaattaaaccaagc

SEQ ID NO: 736001 - DNA, 19 bp, Homo sapiens
gggtgcagctgggtggggc

SEQ ID NO: 736002 - DNA, 23 bp, Homo sapiens
gggtgcatcctcctcagccccca

SEQ ID NO: 736003 - DNA, 19 bp, Homo sapiens
gggtgccccccacccccag

SEQ ID NO: 736004 - DNA, 14 bp, Homo sapiens
gggtgccctctgct

SEQ ID NO: 736005 - DNA, 11 bp, Homo sapiens
gggtgccctga

SEQ ID NO: 736006 - DNA, 18 bp, Homo sapiens
gggtgcctcagagcaggc

SEQ ID NO: 736007 - DNA, 20 bp, Homo sapiens
gggtgcctcccacacttgct

SEQ ID NO: 736008 - DNA, 19 bp, Homo sapiens
gggtgcgtctccagtcatc

SEQ ID NO: 736009 - DNA, 19 bp, Homo sapiens
gggtgctagggacatggga

SEQ ID NO: 736010 - DNA, 18 bp, Homo sapiens
gggtgctctggtctgacc

SEQ ID NO: 736011 - DNA, 15 bp, Homo sapiens
gggtgctgggaggag

SEQ ID NO: 736012 - DNA, 18 bp, Homo sapiens
gggtgctgggaggaggga

SEQ ID NO: 736013 - DNA, 17 bp, Homo sapiens
gggtgctggggccaggg

SEQ ID NO: 736014 - DNA, 21 bp, Homo sapiens
gggtgcttttatagaggctag

SEQ ID NO: 736015 - DNA, 23 bp, Homo sapiens
gggtggaccaggcctggagggca

SEQ ID NO: 736016 - DNA, 23 bp, Homo sapiens
gggtggagactgcttcccatcct

SEQ ID NO: 736017 - DNA, 16 bp, Homo sapiens
gggtggaggcttcctg

SEQ ID NO: 736018 - DNA, 17 bp, Homo sapiens
gggtggatcacgaggtc

SEQ ID NO: 736019 - DNA, 19 bp, Homo sapiens
gggtggcaccagcagcctg

SEQ ID NO: 736020 - DNA, 16 bp, Homo sapiens
gggtggcacctcctga

SEQ ID NO: 736021 - DNA, 14 bp, Homo sapiens
gggtggcaggtcac

SEQ ID NO: 736022 - DNA, 21 bp, Homo sapiens
gggtggccatcctacccagcg

SEQ ID NO: 736023 - DNA, 17 bp, Homo sapiens
gggtggccgctgagtgg

SEQ ID NO: 736024 - DNA, 23 bp, Homo sapiens
gggtggctttcaaggctggggca

SEQ ID NO: 736025 - DNA, 15 bp, Homo sapiens
gggtgggaagaaaga

SEQ ID NO: 736026 - DNA, 12 bp, Homo sapiens
gggtgggaagag

SEQ ID NO: 736027 - DNA, 17 bp, Homo sapiens
gggtgggaaggggatgg

SEQ ID NO: 736028 - DNA, 22 bp, Homo sapiens
gggtgggaccaatgtccttgtg

SEQ ID NO: 736029 - DNA, 19 bp, Homo sapiens
gggtgggagagcccagcca

SEQ ID NO: 736030 - DNA, 20 bp, Homo sapiens
gggtgggattttttcccttt

SEQ ID NO: 736031 - DNA, 15 bp, Homo sapiens
gggtgggcagggagg

SEQ ID NO: 736032 - DNA, 15 bp, Homo sapiens
gggtgggccactctc

SEQ ID NO: 736033 - DNA, 14 bp, Homo sapiens
gggtgggccagcat

SEQ ID NO: 736034 - DNA, 13 bp, Homo sapiens
gggtgggccaggc

SEQ ID NO: 736035 - DNA, 14 bp, Homo sapiens
gggtgggccaggct

SEQ ID NO: 736036 - DNA, 17 bp, Homo sapiens
gggtgggcccagaactg

SEQ ID NO: 736037 - DNA, 15 bp, Homo sapiens
gggtgggcctggcct

SEQ ID NO: 736038 - DNA, 12 bp, Homo sapiens
gggtgggctgga

SEQ ID NO: 736039 - DNA, 11 bp, Homo sapiens
gggtggggagg

SEQ ID NO: 736040 - DNA, 18 bp, Homo sapiens
gggtggggaggccctgcc

SEQ ID NO: 736041 - DNA, 22 bp, Homo sapiens
gggtggggcagcacacctctgg

SEQ ID NO: 736042 - DNA, 12 bp, Homo sapiens
gggtggggctgc

SEQ ID NO: 736043 - DNA, 16 bp, Homo sapiens
gggtgggggccacctg

SEQ ID NO: 736044 - DNA, 21 bp, Homo sapiens
gggtgggggccacctgcctgc

SEQ ID NO: 736045 - DNA, 14 bp, Homo sapiens
gggtgggggccagg

SEQ ID NO: 736046 - DNA, 15 bp, Homo sapiens
gggtgggggctgtgg

SEQ ID NO: 736047 - DNA, 21 bp, Homo sapiens
gggtggggtcatgccctcctc

SEQ ID NO: 736048 - DNA, 16 bp, Homo sapiens
gggtggtctgagcacc

SEQ ID NO: 736049 - DNA, 12 bp, Homo sapiens
gggtggtgctgg

SEQ ID NO: 736050 - DNA, 15 bp, Homo sapiens
gggtggtggcctggt

SEQ ID NO: 736051 - DNA, 13 bp, Homo sapiens
gggtggtggggag

SEQ ID NO: 736052 - DNA, 16 bp, Homo sapiens
gggtggtgggtgctgg

SEQ ID NO: 736053 - DNA, 10 bp, Homo sapiens
gggtggttcc

SEQ ID NO: 736054 - DNA, 18 bp, Homo sapiens
gggtgtaacaggtctcct

SEQ ID NO: 736055 - DNA, 15 bp, Homo sapiens
gggtgtaacttcctg

SEQ ID NO: 736056 - DNA, 16 bp, Homo sapiens
gggtgtaacttcctgc

SEQ ID NO: 736057 - DNA, 23 bp, Homo sapiens
gggtgtatttattttcctcccca

SEQ ID NO: 736058 - DNA, 15 bp, Homo sapiens
gggtgtcagaagctg

SEQ ID NO: 736059 - DNA, 17 bp, Homo sapiens
gggtgtccgagaggctg

SEQ ID NO: 736060 - DNA, 22 bp, Homo sapiens
gggtgtcctgcctgtctgcccc

SEQ ID NO: 736061 - DNA, 23 bp, Homo sapiens
gggtgtctccctcgggggctctt

SEQ ID NO: 736062 - DNA, 21 bp, Homo sapiens
gggtgtgactcgggagctgca

SEQ ID NO: 736063 - DNA, 23 bp, Homo sapiens
gggtgtgactcgggagctgcaca

SEQ ID NO: 736064 - DNA, 12 bp, Homo sapiens
gggtgtggccag

SEQ ID NO: 736065 - DNA, 11 bp, Homo sapiens
gggtgtggcct

SEQ ID NO: 736066 - DNA, 11 bp, Homo sapiens
gggtgtgtgcg

SEQ ID NO: 736067 - DNA, 14 bp, Homo sapiens
gggtgttctttcct

SEQ ID NO: 736068 - DNA, 21 bp, Homo sapiens
gggtgttctttcctgccctgt

SEQ ID NO: 736069 - DNA, 22 bp, Homo sapiens
gggttaagaaaagagatatttt

SEQ ID NO: 736070 - DNA, 16 bp, Homo sapiens
gggttaagaagacttt

SEQ ID NO: 736071 - DNA, 18 bp, Homo sapiens
gggttaagtctcctgtct

SEQ ID NO: 736072 - DNA, 14 bp, Homo sapiens
gggttacctccctc

SEQ ID NO: 736073 - DNA, 19 bp, Homo sapiens
gggttagagccaagctgca

SEQ ID NO: 736074 - DNA, 16 bp, Homo sapiens
gggttagcctgcaccg

SEQ ID NO: 736075 - DNA, 18 bp, Homo sapiens
gggttatgtatcagaaga

SEQ ID NO: 736076 - DNA, 16 bp, Homo sapiens
gggttcaaaatgtctg

SEQ ID NO: 736077 - DNA, 22 bp, Homo sapiens
gggttcaagcaatcctcctacc

SEQ ID NO: 736078 - DNA, 19 bp, Homo sapiens
gggttcagcccctcctctg

SEQ ID NO: 736079 - DNA, 16 bp, Homo sapiens
gggttcataggggcag

SEQ ID NO: 736080 - DNA, 20 bp, Homo sapiens
gggttcataggtcactggct

SEQ ID NO: 736081 - DNA, 13 bp, Homo sapiens
gggttcatttgtg

SEQ ID NO: 736082 - DNA, 22 bp, Homo sapiens
gggttccccacacagggcactg

SEQ ID NO: 736083 - DNA, 21 bp, Homo sapiens
gggttccctcctagctctccc

SEQ ID NO: 736084 - DNA, 22 bp, Homo sapiens
gggttccctcctagctctccca

SEQ ID NO: 736085 - DNA, 17 bp, Homo sapiens
gggttcctcaaattttt

SEQ ID NO: 736086 - DNA, 16 bp, Homo sapiens
gggttcctgctgtggg

SEQ ID NO: 736087 - DNA, 19 bp, Homo sapiens
gggttccttcctctgagcc

SEQ ID NO: 736088 - DNA, 21 bp, Homo sapiens
gggttccttcctctgagcctt

SEQ ID NO: 736089 - DNA, 17 bp, Homo sapiens
gggttcggttgcagggc

SEQ ID NO: 736090 - DNA, 18 bp, Homo sapiens
gggttcgtggaaagggtg

SEQ ID NO: 736091 - DNA, 14 bp, Homo sapiens
gggttctctacagg

SEQ ID NO: 736092 - DNA, 14 bp, Homo sapiens
gggttctgccctgc

SEQ ID NO: 736093 - DNA, 21 bp, Homo sapiens
gggttctgccctgcctgagga

SEQ ID NO: 736094 - DNA, 14 bp, Homo sapiens
gggttctggcagga

SEQ ID NO: 736095 - DNA, 17 bp, Homo sapiens
gggttctggcaggacct

SEQ ID NO: 736096 - DNA, 23 bp, Homo sapiens
gggttgaaaattcaaaaagtgtt

SEQ ID NO: 736097 - DNA, 20 bp, Homo sapiens
gggttgaagacggaaaacaa

SEQ ID NO: 736098 - DNA, 17 bp, Homo sapiens
gggttgaaggcagtctg

SEQ ID NO: 736099 - DNA, 14 bp, Homo sapiens
gggttgagagccag

SEQ ID NO: 736100 - DNA, 21 bp, Homo sapiens
gggttgagcagggatcctggt

SEQ ID NO: 736101 - DNA, 18 bp, Homo sapiens
gggttgatctcttagaag

SEQ ID NO: 736102 - DNA, 17 bp, Homo sapiens
gggttggcttccctggc

SEQ ID NO: 736103 - DNA, 19 bp, Homo sapiens
tgctcccattcctccctcc

SEQ ID NO: 736104 - DNA, 16 bp, Homo sapiens
tgctccccaacacctg

SEQ ID NO: 736105 - DNA, 17 bp, Homo sapiens
tgctccccaacacctgc

SEQ ID NO: 736106 - DNA, 19 bp, Homo sapiens
tgctccccacagcgtccct

SEQ ID NO: 736107 - DNA, 16 bp, Homo sapiens
tgctcccccaccccct

SEQ ID NO: 736108 - DNA, 21 bp, Homo sapiens
tgctcccccaccccctcccca

SEQ ID NO: 736109 - DNA, 20 bp, Homo sapiens
tgctcccccatcctcccctt

SEQ ID NO: 736110 - DNA, 13 bp, Homo sapiens
tgctcccctaacc

SEQ ID NO: 736111 - DNA, 15 bp, Homo sapiens
tgctcccctgccaca

SEQ ID NO: 736112 - DNA, 18 bp, Homo sapiens
tgctccctaagccagcct

SEQ ID NO: 736113 - DNA, 15 bp, Homo sapiens
tgctccctcacatgt

SEQ ID NO: 736114 - DNA, 17 bp, Homo sapiens
tgctccctcccctgccc

SEQ ID NO: 736115 - DNA, 20 bp, Homo sapiens
tgctccctcccctgccctgg

SEQ ID NO: 736116 - DNA, 14 bp, Homo sapiens
tgctccctctgtca

SEQ ID NO: 736117 - DNA, 13 bp, Homo sapiens
tgctccctctgtt

SEQ ID NO: 736118 - DNA, 14 bp, Homo sapiens
tgctccctctgtta

SEQ ID NO: 736119 - DNA, 15 bp, Homo sapiens
tgctccctctgttag

SEQ ID NO: 736120 - DNA, 12 bp, Homo sapiens
tgctccctgtgt

SEQ ID NO: 736121 - DNA, 17 bp, Homo sapiens
tgctccctgtgtccacc

SEQ ID NO: 736122 - DNA, 17 bp, Homo sapiens
tgctccgaggactggac

SEQ ID NO: 736123 - DNA, 12 bp, Homo sapiens
ggtattttcaat

SEQ ID NO: 736124 - DNA, 20 bp, Homo sapiens
ggtattttcccccttttctg

SEQ ID NO: 736125 - DNA, 22 bp, Homo sapiens
ggtcaaaagagccctggctctg

SEQ ID NO: 736126 - DNA, 18 bp, Homo sapiens
ggtcaacagctatgctgg

SEQ ID NO: 736127 - DNA, 17 bp, Homo sapiens
ggtcaagaaaggagggg

SEQ ID NO: 736128 - DNA, 21 bp, Homo sapiens
ggtcaagaaaggaggggagaa

SEQ ID NO: 736129 - DNA, 17 bp, Homo sapiens
ggtcaagaccagcctgg

SEQ ID NO: 736130 - DNA, 13 bp, Homo sapiens
ggtcaagcccaga

SEQ ID NO: 736131 - DNA, 23 bp, Homo sapiens
ggtcaaggcagtagaactccagg

SEQ ID NO: 736132 - DNA, 21 bp, Homo sapiens
ggtcaagggcttactatttct

SEQ ID NO: 736133 - DNA, 20 bp, Homo sapiens
ggtcaagtaagaagacatga

SEQ ID NO: 736134 - DNA, 13 bp, Homo sapiens
ggtcaataaagca

SEQ ID NO: 736135 - DNA, 16 bp, Homo sapiens
ggtcaataaagcagag

SEQ ID NO: 736136 - DNA, 17 bp, Homo sapiens
ggtcaataaagcagagc

SEQ ID NO: 736137 - DNA, 17 bp, Homo sapiens
ggtcaatcctgtgggtg

SEQ ID NO: 736138 - DNA, 22 bp, Homo sapiens
ggtcacagaaaggcaggtttca

SEQ ID NO: 736139 - DNA, 17 bp, Homo sapiens
ggtcacattcaggaaga

SEQ ID NO: 736140 - DNA, 16 bp, Homo sapiens
ggtcaccaaggcagtg

SEQ ID NO: 736141 - DNA, 20 bp, Homo sapiens
ggtcaccaaggcagtgcatg

SEQ ID NO: 736142 - DNA, 19 bp, Homo sapiens
ggtcaccagctgctgtgcc

SEQ ID NO: 736143 - DNA, 23 bp, Homo sapiens
ggtcaccgcggacgtgctggcct

SEQ ID NO: 736144 - DNA, 17 bp, Homo sapiens
ggtcaccttgcactcct

SEQ ID NO: 736145 - DNA, 20 bp, Homo sapiens
ggtcaccttgcactcctcac

SEQ ID NO: 736146 - DNA, 20 bp, Homo sapiens
ggtcactaaccaacaaggtt

SEQ ID NO: 736147 - DNA, 17 bp, Homo sapiens
ggtcactccaccatccc

SEQ ID NO: 736148 - DNA, 12 bp, Homo sapiens
ggtcactccagt

SEQ ID NO: 736149 - DNA, 13 bp, Homo sapiens
ggtcactctgccc

SEQ ID NO: 736150 - DNA, 14 bp, Homo sapiens
ggtcactctgccct

SEQ ID NO: 736151 - DNA, 18 bp, Homo sapiens
ggtcactctgccctctgc

SEQ ID NO: 736152 - DNA, 24 bp, Homo sapiens
ggtcactctgccctctgctgctgc

SEQ ID NO: 736153 - DNA, 16 bp, Homo sapiens
ggtcactggctctcca

SEQ ID NO: 736154 - DNA, 17 bp, Homo sapiens
ggtcactggctctccaa

SEQ ID NO: 736155 - DNA, 18 bp, Homo sapiens
ggtcactggtcagggcag

SEQ ID NO: 736156 - DNA, 23 bp, Homo sapiens
ggtcactggtcagggcagtggcc

SEQ ID NO: 736157 - DNA, 13 bp, Homo sapiens
ggtcactgtcact

SEQ ID NO: 736158 - DNA, 12 bp, Homo sapiens
ggtcactgtcct

SEQ ID NO: 736159 - DNA, 19 bp, Homo sapiens
ggtcagaagaagtgggagc

SEQ ID NO: 736160 - DNA, 17 bp, Homo sapiens
ggtcagactgaaacgcc

SEQ ID NO: 736161 - DNA, 15 bp, Homo sapiens
ggtcagaggagggca

SEQ ID NO: 736162 - DNA, 14 bp, Homo sapiens
ggtcagaggagtga

SEQ ID NO: 736163 - DNA, 19 bp, Homo sapiens
ggtcagagtggcgtgagct

SEQ ID NO: 736164 - DNA, 15 bp, Homo sapiens
ggtcagccattttta

SEQ ID NO: 736165 - DNA, 18 bp, Homo sapiens
ggtcagccatttttaatg

SEQ ID NO: 736166 - DNA, 14 bp, Homo sapiens
ggtcagccccaagg

SEQ ID NO: 736167 - DNA, 14 bp, Homo sapiens
ggtcagccctagga

SEQ ID NO: 736168 - DNA, 13 bp, Homo sapiens
ggtcagcgagaag

SEQ ID NO: 736169 - DNA, 17 bp, Homo sapiens
ggtcaggagatcgagac

SEQ ID NO: 736170 - DNA, 14 bp, Homo sapiens
ggtcaggcagccag

SEQ ID NO: 736171 - DNA, 13 bp, Homo sapiens
ggtcaggctccat

SEQ ID NO: 736172 - DNA, 17 bp, Homo sapiens
ggtcagggaccaaggac

SEQ ID NO: 736173 - DNA, 15 bp, Homo sapiens
ggtcagggcagtggc

SEQ ID NO: 736174 - DNA, 13 bp, Homo sapiens
ggtcagggccaga

SEQ ID NO: 736175 - DNA, 15 bp, Homo sapiens
ggtcaggtgtcaggc

SEQ ID NO: 736176 - DNA, 15 bp, Homo sapiens
ggtcaggtttaacat

SEQ ID NO: 736177 - DNA, 16 bp, Homo sapiens
ggtcagtagtcacaaa

SEQ ID NO: 736178 - DNA, 20 bp, Homo sapiens
ggtcagtagtttcatgtttt

SEQ ID NO: 736179 - DNA, 21 bp, Homo sapiens
ggtcagtctaacagtttgcct

SEQ ID NO: 736180 - DNA, 19 bp, Homo sapiens
ggtcagtgaggcccaggga

SEQ ID NO: 736181 - DNA, 12 bp, Homo sapiens
ggtcataaaata

SEQ ID NO: 736182 - DNA, 13 bp, Homo sapiens
ggtcataaaatag

SEQ ID NO: 736183 - DNA, 14 bp, Homo sapiens
ggtcatcagggagg

SEQ ID NO: 736184 - DNA, 21 bp, Homo sapiens
ggtcatctgaccttcaccttg

SEQ ID NO: 736185 - DNA, 18 bp, Homo sapiens
ggtcatgcagttcctggc

SEQ ID NO: 736186 - DNA, 16 bp, Homo sapiens
ggtcatgccctcctct

SEQ ID NO: 736187 - DNA, 17 bp, Homo sapiens
ggtcatgccctcctctc

SEQ ID NO: 736188 - DNA, 20 bp, Homo sapiens
ggtcatgccctcctctccca

SEQ ID NO: 736189 - DNA, 22 bp, Homo sapiens
ggtcatgcttttgccactttgg

SEQ ID NO: 736190 - DNA, 15 bp, Homo sapiens
ggtcatgtgtgcatg

SEQ ID NO: 736191 - DNA, 16 bp, Homo sapiens
ggtcatgtgtgcatgt

SEQ ID NO: 736192 - DNA, 13 bp, Homo sapiens
ggtcattgaggga

SEQ ID NO: 736193 - DNA, 17 bp, Homo sapiens
ggtcattggtctccgag

SEQ ID NO: 736194 - DNA, 16 bp, Homo sapiens
ggtcatttgaatgaga

SEQ ID NO: 736195 - DNA, 22 bp, Homo sapiens
ggtcattttttaaatccagccc

SEQ ID NO: 736196 - DNA, 19 bp, Homo sapiens
ggtccaaaaaaaggaaaaa

SEQ ID NO: 736197 - DNA, 20 bp, Homo sapiens
ggtccaaaaaaaggaaaaat

SEQ ID NO: 736198 - DNA, 18 bp, Homo sapiens
ggtccaaacccttcaact

SEQ ID NO: 736199 - DNA, 18 bp, Homo sapiens
ggtccaattagtttcctt

SEQ ID NO: 736200 - DNA, 15 bp, Homo sapiens
ggtccaccagtgtgt

SEQ ID NO: 736201 - DNA, 16 bp, Homo sapiens
ggtccaccagtgtgtg

SEQ ID NO: 736202 - DNA, 22 bp, Homo sapiens
ggtccaccagtgtgtgggggag

SEQ ID NO: 736203 - DNA, 18 bp, Homo sapiens
ggtccaccggcccctggc

SEQ ID NO: 736204 - DNA, 20 bp, Homo sapiens
ggtccaccggcccctggcag

SEQ ID NO: 736205 - DNA, 10 bp, Homo sapiens
ggtccactgt

SEQ ID NO: 736206 - DNA, 18 bp, Homo sapiens
ggtccagaaactcctgtt

SEQ ID NO: 736207 - DNA, 20 bp, Homo sapiens
ggtccagagaccacaccact

SEQ ID NO: 736208 - DNA, 14 bp, Homo sapiens
ggtccagctctgac

SEQ ID NO: 736209 - DNA, 16 bp, Homo sapiens
ggtccagctctggagg

SEQ ID NO: 736210 - DNA, 18 bp, Homo sapiens
ggtccagctggcctggac

SEQ ID NO: 736211 - DNA, 20 bp, Homo sapiens
ggtccagctggcctggacag

SEQ ID NO: 736212 - DNA, 15 bp, Homo sapiens
ggtccaggaaggcag

SEQ ID NO: 736213 - DNA, 17 bp, Homo sapiens
ggtccaggaaggcagct

SEQ ID NO: 736214 - DNA, 18 bp, Homo sapiens
ggtccaggaaggcagctg

SEQ ID NO: 736215 - DNA, 19 bp, Homo sapiens
ggtccaggaaggcagctgc

SEQ ID NO: 736216 - DNA, 16 bp, Homo sapiens
ggtccaggagagcctg

SEQ ID NO: 736217 - DNA, 18 bp, Homo sapiens
ggtccaggagagcctggg

SEQ ID NO: 736218 - DNA, 22 bp, Homo sapiens
ggtccaggccagtgggcctggt

SEQ ID NO: 736219 - DNA, 13 bp, Homo sapiens
ggtccaggcccgt

SEQ ID NO: 736220 - DNA, 15 bp, Homo sapiens
ggtccaggcccgtgg

SEQ ID NO: 736221 - DNA, 16 bp, Homo sapiens
ggtccagggagcaggc

SEQ ID NO: 736222 - DNA, 21 bp, Homo sapiens
ggtccagggcctgacaccccc

SEQ ID NO: 736223 - DNA, 12 bp, Homo sapiens
ggtccagggctg

SEQ ID NO: 736224 - DNA, 13 bp, Homo sapiens
ggtccagggttga

SEQ ID NO: 736225 - DNA, 23 bp, Homo sapiens
ggtccagtgcattttgtttctgt

SEQ ID NO: 736226 - DNA, 23 bp, Homo sapiens
ggtccatccccttcccccatccc

SEQ ID NO: 736227 - DNA, 14 bp, Homo sapiens
ggtcccaagacagt

SEQ ID NO: 736228 - DNA, 23 bp, Homo sapiens
ggtcccaagacagtgagacagtc

SEQ ID NO: 736229 - DNA, 23 bp, Homo sapiens
ggtcccaattcggggcctgctgg

SEQ ID NO: 736230 - DNA, 12 bp, Homo sapiens
ggtcccaccccc

SEQ ID NO: 736231 - DNA, 14 bp, Homo sapiens
ggtcccagccccag

SEQ ID NO: 736232 - DNA, 21 bp, Homo sapiens
ggtcccagccccaggcctggc

SEQ ID NO: 736233 - DNA, 15 bp, Homo sapiens
ggtcccagcgagcca

SEQ ID NO: 736234 - DNA, 17 bp, Homo sapiens
ggtcccagcgagccaca

SEQ ID NO: 736235 - DNA, 18 bp, Homo sapiens
ggtcccagcgagccacag

SEQ ID NO: 736236 - DNA, 12 bp, Homo sapiens
ggtcccagctcc

SEQ ID NO: 736237 - DNA, 16 bp, Homo sapiens
tgctgatggcttgaca

SEQ ID NO: 736238 - DNA, 24 bp, Homo sapiens
tgctgatggcttgacatgtgcaat

SEQ ID NO: 736239 - DNA, 19 bp, Homo sapiens
tgctgatgggaaggagggg

SEQ ID NO: 736240 - DNA, 13 bp, Homo sapiens
tgctgatgtttac

SEQ ID NO: 736241 - DNA, 15 bp, Homo sapiens
tgctgattcaaacca

SEQ ID NO: 736242 - DNA, 17 bp, Homo sapiens
tgctgattctcccgttc

SEQ ID NO: 736243 - DNA, 21 bp, Homo sapiens
tgctgattcttgtaaatcttt

SEQ ID NO: 736244 - DNA, 17 bp, Homo sapiens
tgctgcaacaaaatgta

SEQ ID NO: 736245 - DNA, 15 bp, Homo sapiens
ggtgataagggaaaa

SEQ ID NO: 736246 - DNA, 14 bp, Homo sapiens
ggtgataaggggcc

SEQ ID NO: 736247 - DNA, 16 bp, Homo sapiens
ggtgatagcattgctt

SEQ ID NO: 736248 - DNA, 19 bp, Homo sapiens
tgctgtctctgctcgccct

SEQ ID NO: 736249 - DNA, 15 bp, Homo sapiens
tgctgtcttctggac

SEQ ID NO: 736250 - DNA, 17 bp, Homo sapiens
tgctgtcttgccccagt

SEQ ID NO: 736251 - DNA, 12 bp, Homo sapiens
tgctgtctttgt

SEQ ID NO: 736252 - DNA, 23 bp, Homo sapiens
tgctgtctttgtggactgtgggt

SEQ ID NO: 736253 - DNA, 18 bp, Homo sapiens
tgctgtcttttgttctct

SEQ ID NO: 736254 - DNA, 12 bp, Homo sapiens
tgctgtgaaaaa

SEQ ID NO: 736255 - DNA, 16 bp, Homo sapiens
tgctgtgaactttcat

SEQ ID NO: 736256 - DNA, 16 bp, Homo sapiens
tgctgtgaatctgaaa

SEQ ID NO: 736257 - DNA, 18 bp, Homo sapiens
tgctgtgaccatttataa

SEQ ID NO: 736258 - DNA, 18 bp, Homo sapiens
tgctgtgaggctgtcctg

SEQ ID NO: 736259 - DNA, 17 bp, Homo sapiens
tgctgtgagggagggga

SEQ ID NO: 736260 - DNA, 18 bp, Homo sapiens
tgctgtgagggaggggaa

SEQ ID NO: 736261 - DNA, 15 bp, Homo sapiens
tgctgtgccaggagg

SEQ ID NO: 736262 - DNA, 14 bp, Homo sapiens
tgctgtgccccacc

SEQ ID NO: 736263 - DNA, 18 bp, Homo sapiens
tgctgtgccgtgtccaag

SEQ ID NO: 736264 - DNA, 11 bp, Homo sapiens
tgctgtgcctg

SEQ ID NO: 736265 - DNA, 13 bp, Homo sapiens
tgctgtgcctgct

SEQ ID NO: 736266 - DNA, 15 bp, Homo sapiens
tgctgtgcctgctag

SEQ ID NO: 736267 - DNA, 16 bp, Homo sapiens
tgctgtgctctgggga

SEQ ID NO: 736268 - DNA, 13 bp, Homo sapiens
tgctgtgctggga

SEQ ID NO: 736269 - DNA, 15 bp, Homo sapiens
tgctgtgctgggagg

SEQ ID NO: 736270 - DNA, 19 bp, Homo sapiens
tgctgtgcttttgatctct

SEQ ID NO: 736271 - DNA, 13 bp, Homo sapiens
tgctgtggccagg

SEQ ID NO: 736272 - DNA, 14 bp, Homo sapiens
tgctgtggccaggc

SEQ ID NO: 736273 - DNA, 17 bp, Homo sapiens
tgctgtggccagggtga

SEQ ID NO: 736274 - DNA, 23 bp, Homo sapiens
tgctgtggccagggtgagagctg

SEQ ID NO: 736275 - DNA, 12 bp, Homo sapiens
tgctgtggcccc

SEQ ID NO: 736276 - DNA, 19 bp, Homo sapiens
tgctgtggccccctgtccc

SEQ ID NO: 736277 - DNA, 15 bp, Homo sapiens
tgctgtggcctgggc

SEQ ID NO: 736278 - DNA, 21 bp, Homo sapiens
tgctgtgggcagcaccctccc

SEQ ID NO: 736279 - DNA, 20 bp, Homo sapiens
tgctgtggggtatacagcat

SEQ ID NO: 736280 - DNA, 22 bp, Homo sapiens
tgctgtggggtatacagcattg

SEQ ID NO: 736281 - DNA, 23 bp, Homo sapiens
tgctgtggtctataaaataaact

SEQ ID NO: 736282 - DNA, 16 bp, Homo sapiens
tgctgtggtgtgtccc

SEQ ID NO: 736283 - DNA, 12 bp, Homo sapiens
tgctgtgtaaaa

SEQ ID NO: 736284 - DNA, 17 bp, Homo sapiens
tgctgtgtgaccctggg

SEQ ID NO: 736285 - DNA, 21 bp, Homo sapiens
tgctgtgtgctttttttgtgt

SEQ ID NO: 736286 - DNA, 22 bp, Homo sapiens
tgctgttaactgcaaccttgtt

SEQ ID NO: 736287 - DNA, 22 bp, Homo sapiens
tgctgttctcttgggaactgaa

SEQ ID NO: 736288 - DNA, 16 bp, Homo sapiens
tgctgttcttcacttc

SEQ ID NO: 736289 - DNA, 22 bp, Homo sapiens
tgctgttcttgaagctgggctg

SEQ ID NO: 736290 - DNA, 16 bp, Homo sapiens
tgctgttgaggtggct

SEQ ID NO: 736291 - DNA, 19 bp, Homo sapiens
tgctgttgggtttttgctg

SEQ ID NO: 736292 - DNA, 21 bp, Homo sapiens
tgctgttgggtttttgctgtt

SEQ ID NO: 736293 - DNA, 22 bp, Homo sapiens
tgctgttgggtttttgctgttt

SEQ ID NO: 736294 - DNA, 14 bp, Homo sapiens
tgctgttggtcatg

SEQ ID NO: 736295 - DNA, 14 bp, Homo sapiens
tgctgttgtaaaca

SEQ ID NO: 736296 - DNA, 18 bp, Homo sapiens
tgctgttgtgaagctaat

SEQ ID NO: 736297 - DNA, 22 bp, Homo sapiens
tgctgttgtgaagctaatgtca

SEQ ID NO: 736298 - DNA, 23 bp, Homo sapiens
tgctgtttaaagtcacatccctg

SEQ ID NO: 736299 - DNA, 17 bp, Homo sapiens
tgctgtttagcttcctc

SEQ ID NO: 736300 - DNA, 23 bp, Homo sapiens
tgctgtttattaatcttagtgta

SEQ ID NO: 736301 - DNA, 13 bp, Homo sapiens
tgctgtttgacaa

SEQ ID NO: 736302 - DNA, 20 bp, Homo sapiens
tgctgtttgttccaggctca

SEQ ID NO: 736303 - DNA, 16 bp, Homo sapiens
tgctgttttcctccct

SEQ ID NO: 736304 - DNA, 17 bp, Homo sapiens
tgctgttttcctccctt

SEQ ID NO: 736305 - DNA, 19 bp, Homo sapiens
tgctgttttcctcccttct

SEQ ID NO: 736306 - DNA, 16 bp, Homo sapiens
tgctgttttgttctgt

SEQ ID NO: 736307 - DNA, 18 bp, Homo sapiens
tgctgttttgttctgtgg

SEQ ID NO: 736308 - DNA, 15 bp, Homo sapiens
tgcttaaaaatactt

SEQ ID NO: 736309 - DNA, 17 bp, Homo sapiens
tgcttaaaaatcattga

SEQ ID NO: 736310 - DNA, 19 bp, Homo sapiens
tgcttaaaaatcattgatt

SEQ ID NO: 736311 - DNA, 18 bp, Homo sapiens
tgcttaaaaggttgcata

SEQ ID NO: 736312 - DNA, 19 bp, Homo sapiens
tgcttaaacacaagaagga

SEQ ID NO: 736313 - DNA, 20 bp, Homo sapiens
tgcttaaactaaataatgaa

SEQ ID NO: 736314 - DNA, 15 bp, Homo sapiens
tgcttaaagttgtaa

SEQ ID NO: 736315 - DNA, 13 bp, Homo sapiens
tgcttaaatcagt

SEQ ID NO: 736316 - DNA, 21 bp, Homo sapiens
tgcttaaatcagttggagttt

SEQ ID NO: 736317 - DNA, 13 bp, Homo sapiens
tgcttaaatttct

SEQ ID NO: 736318 - DNA, 15 bp, Homo sapiens
tgcttaaatttctta

SEQ ID NO: 736319 - DNA, 16 bp, Homo sapiens
tgcttaaattttaact

SEQ ID NO: 736320 - DNA, 14 bp, Homo sapiens
tgcttaacataccc

SEQ ID NO: 736321 - DNA, 13 bp, Homo sapiens
tgcttaacttcac

SEQ ID NO: 736322 - DNA, 19 bp, Homo sapiens
tgcttaacttcacatattg

SEQ ID NO: 736323 - DNA, 16 bp, Homo sapiens
tgcttaagcagaagca

SEQ ID NO: 736324 - DNA, 20 bp, Homo sapiens
tgcttaataaaagaacatgc

SEQ ID NO: 736325 - DNA, 23 bp, Homo sapiens
tgcttaataaaagaacatgcttg

SEQ ID NO: 736326 - DNA, 20 bp, Homo sapiens
tgcttacacatctcagaccc

SEQ ID NO: 736327 - DNA, 11 bp, Homo sapiens
tgcttacagta

SEQ ID NO: 736328 - DNA, 20 bp, Homo sapiens
tgcttacattttaatagaga

SEQ ID NO: 736329 - DNA, 20 bp, Homo sapiens
tgcttacatttttacaataa

SEQ ID NO: 736330 - DNA, 13 bp, Homo sapiens
tgcttacccttca

SEQ ID NO: 736331 - DNA, 14 bp, Homo sapiens
tgcttacctctcag

SEQ ID NO: 736332 - DNA, 15 bp, Homo sapiens
tgcttactcttgctt

SEQ ID NO: 736333 - DNA, 19 bp, Homo sapiens
tgcttactttttaattttt

SEQ ID NO: 736334 - DNA, 17 bp, Homo sapiens
tgcttagacataacaaa

SEQ ID NO: 736335 - DNA, 19 bp, Homo sapiens
tgcttagagtgcccagcag

SEQ ID NO: 736336 - DNA, 19 bp, Homo sapiens
tgcttagcctgtgctggac

SEQ ID NO: 736337 - DNA, 16 bp, Homo sapiens
tgcttagctgccttga

SEQ ID NO: 736338 - DNA, 19 bp, Homo sapiens
tgcttagctgccttgagct

SEQ ID NO: 736339 - DNA, 16 bp, Homo sapiens
tgcttagcttatcttt

SEQ ID NO: 736340 - DNA, 23 bp, Homo sapiens
tgcttagcttatctttctttcca

SEQ ID NO: 736341 - DNA, 14 bp, Homo sapiens
tgcttaggatgtgt

SEQ ID NO: 736342 - DNA, 23 bp, Homo sapiens
tgcttaggatgtttttcatgaaa

SEQ ID NO: 736343 - DNA, 20 bp, Homo sapiens
tgcttagtatggttctcaga

SEQ ID NO: 736344 - DNA, 21 bp, Homo sapiens
tgcttagtatggttctcagat

SEQ ID NO: 736345 - DNA, 14 bp, Homo sapiens
tgcttagtcactgc

SEQ ID NO: 736346 - DNA, 15 bp, Homo sapiens
tgcttagtcactgcc

SEQ ID NO: 736347 - DNA, 16 bp, Homo sapiens
tgcttagttggctttg

SEQ ID NO: 736348 - DNA, 14 bp, Homo sapiens
tgcttataaactgg

SEQ ID NO: 736349 - DNA, 19 bp, Homo sapiens
tgcttataacctagttaaa

SEQ ID NO: 736350 - DNA, 18 bp, Homo sapiens
tgcttatgaatatttata

SEQ ID NO: 736351 - DNA, 21 bp, Homo sapiens
tgcttatgacatcacttgtac

SEQ ID NO: 736352 - DNA, 15 bp, Homo sapiens
tgcttattgttccaa

SEQ ID NO: 736353 - DNA, 21 bp, Homo sapiens
tgcttattgttccaagacatt

SEQ ID NO: 736354 - DNA, 14 bp, Homo sapiens
tgcttcaaaccctc

SEQ ID NO: 736355 - DNA, 20 bp, Homo sapiens
tgcttcaaattcaaggcctt

SEQ ID NO: 736356 - DNA, 16 bp, Homo sapiens
tgcttcaagagaaaat

SEQ ID NO: 736357 - DNA, 23 bp, Homo sapiens
tgcttcaagagaaaatgcggtta

SEQ ID NO: 736358 - DNA, 22 bp, Homo sapiens
tgcttcaagtgttgctcttgga

SEQ ID NO: 736359 - DNA, 15 bp, Homo sapiens
tgcttcaattaaaat

SEQ ID NO: 736360 - DNA, 17 bp, Homo sapiens
tgcttcaattaaaatta

SEQ ID NO: 736361 - DNA, 18 bp, Homo sapiens
tgcttcaattaaaattac

SEQ ID NO: 736362 - DNA, 22 bp, Homo sapiens
tgcttcacagtagagccagctt

SEQ ID NO: 736363 - DNA, 23 bp, Homo sapiens
tgcttcactcatgcaaactgctt

SEQ ID NO: 736364 - DNA, 21 bp, Homo sapiens
tgcttcactttccttctctgt

SEQ ID NO: 736365 - DNA, 22 bp, Homo sapiens
tgcttcactttgccttctggtt

SEQ ID NO: 736366 - DNA, 14 bp, Homo sapiens
tgcttcagagtttg

SEQ ID NO: 736367 - DNA, 23 bp, Homo sapiens
ggtgtcaaacattcgtgagctgg

SEQ ID NO: 736368 - DNA, 17 bp, Homo sapiens
ggtgtcaccctgcagag

SEQ ID NO: 736369 - DNA, 21 bp, Homo sapiens
ggtgtcagaagctgggaacgt

SEQ ID NO: 736370 - DNA, 20 bp, Homo sapiens
ggtgtcagcccctcttccct

SEQ ID NO: 736371 - DNA, 22 bp, Homo sapiens
ggtgtcaggcccgtcggagctg

SEQ ID NO: 736372 - DNA, 18 bp, Homo sapiens
ggtgtcaggtcccagcga

SEQ ID NO: 736373 - DNA, 20 bp, Homo sapiens
ggtgtccaccatccccagct

SEQ ID NO: 736374 - DNA, 12 bp, Homo sapiens
ggtgtccagggt

SEQ ID NO: 736375 - DNA, 20 bp, Homo sapiens
ggtgtccccaacgtcccctc

SEQ ID NO: 736376 - DNA, 16 bp, Homo sapiens
ggtgtccccttcccct

SEQ ID NO: 736377 - DNA, 16 bp, Homo sapiens
ggtgtccgagaggctg

SEQ ID NO: 736378 - DNA, 23 bp, Homo sapiens
tgcttcagcctgaggctgagact

SEQ ID NO: 736379 - DNA, 21 bp, Homo sapiens
tgcttcagtcatcagccagca

SEQ ID NO: 736380 - DNA, 22 bp, Homo sapiens
tgcttcatagtattggagcaca

SEQ ID NO: 736381 - DNA, 19 bp, Homo sapiens
tgcttcattcaatattgac

SEQ ID NO: 736382 - DNA, 15 bp, Homo sapiens
tgcttccaattttct

SEQ ID NO: 736383 - DNA, 19 bp, Homo sapiens
tgcttccatggcttcctga

SEQ ID NO: 736384 - DNA, 11 bp, Homo sapiens
tgcttccatta

SEQ ID NO: 736385 - DNA, 18 bp, Homo sapiens
tgcttcccatcctaccct

SEQ ID NO: 736386 - DNA, 15 bp, Homo sapiens
tgcttcccattgagt

SEQ ID NO: 736387 - DNA, 17 bp, Homo sapiens
tgcttcccattgtggct

SEQ ID NO: 736388 - DNA, 20 bp, Homo sapiens
tgcttcccattgtggctcct

SEQ ID NO: 736389 - DNA, 14 bp, Homo sapiens
tgcttcccccaccc

SEQ ID NO: 736390 - DNA, 21 bp, Homo sapiens
tgcttcccccacccctccacg

SEQ ID NO: 736391 - DNA, 15 bp, Homo sapiens
tgcttccgccactca

SEQ ID NO: 736392 - DNA, 15 bp, Homo sapiens
tgcttcctcccaaca

SEQ ID NO: 736393 - DNA, 13 bp, Homo sapiens
tgcttcctcctgg

SEQ ID NO: 736394 - DNA, 15 bp, Homo sapiens
tgcttcctcctggaa

SEQ ID NO: 736395 - DNA, 23 bp, Homo sapiens
tgcttcctgattaccagtctgat

SEQ ID NO: 736396 - DNA, 12 bp, Homo sapiens
tgcttccttcag

SEQ ID NO: 736397 - DNA, 18 bp, Homo sapiens
tgcttcctttctctcctg

SEQ ID NO: 736398 - DNA, 13 bp, Homo sapiens
tgcttcgggccct

SEQ ID NO: 736399 - DNA, 18 bp, Homo sapiens
tgcttcgggcccttccca

SEQ ID NO: 736400 - DNA, 17 bp, Homo sapiens
tgcttctaagtaaatac

SEQ ID NO: 736401 - DNA, 18 bp, Homo sapiens
tgcttctaagtaaataca

SEQ ID NO: 736402 - DNA, 23 bp, Homo sapiens
tgcttctacggccatgagactga

SEQ ID NO: 736403 - DNA, 12 bp, Homo sapiens
tgcttctacttt

SEQ ID NO: 736404 - DNA, 14 bp, Homo sapiens
tgcttctactttca

SEQ ID NO: 736405 - DNA, 23 bp, Homo sapiens
tgcttctactttcatcttaaact

SEQ ID NO: 736406 - DNA, 20 bp, Homo sapiens
tgcttctagaaactctggct

SEQ ID NO: 736407 - DNA, 23 bp, Homo sapiens
tgcttctagaaactctggctcag

SEQ ID NO: 736408 - DNA, 21 bp, Homo sapiens
tgcttctcaccacgggaaagc

SEQ ID NO: 736409 - DNA, 21 bp, Homo sapiens
tgcttctcagatttctgagga

SEQ ID NO: 736410 - DNA, 12 bp, Homo sapiens
tgcttctcccat

SEQ ID NO: 736411 - DNA, 17 bp, Homo sapiens
tgcttctcccatttcct

SEQ ID NO: 736412 - DNA, 20 bp, Homo sapiens
tgcttctcccatttcctgat

SEQ ID NO: 736413 - DNA, 15 bp, Homo sapiens
tgcttctccccccat

SEQ ID NO: 736414 - DNA, 11 bp, Homo sapiens
tgcttctcccg

SEQ ID NO: 736415 - DNA, 17 bp, Homo sapiens
tgcttctcggccagccc

SEQ ID NO: 736416 - DNA, 19 bp, Homo sapiens
tgcttctcggggtccagtg

SEQ ID NO: 736417 - DNA, 20 bp, Homo sapiens
tgcttctcggggtccagtgc

SEQ ID NO: 736418 - DNA, 10 bp, Homo sapiens
tgcttctcta

SEQ ID NO: 736419 - DNA, 16 bp, Homo sapiens
tgcttctctacagact

SEQ ID NO: 736420 - DNA, 21 bp, Homo sapiens
tgcttctctagctctctaggc

SEQ ID NO: 736421 - DNA, 15 bp, Homo sapiens
tgcttctctccttgc

SEQ ID NO: 736422 - DNA, 12 bp, Homo sapiens
tgcttctctgac

SEQ ID NO: 736423 - DNA, 13 bp, Homo sapiens
tgcttctctgact

SEQ ID NO: 736424 - DNA, 22 bp, Homo sapiens
tgcttctctgacttctgcctgg

SEQ ID NO: 736425 - DNA, 15 bp, Homo sapiens
tgcttctctttgtgc

SEQ ID NO: 736426 - DNA, 16 bp, Homo sapiens
tgcttctctttgtgca

SEQ ID NO: 736427 - DNA, 14 bp, Homo sapiens
tgcttctgaatcac

SEQ ID NO: 736428 - DNA, 15 bp, Homo sapiens
tgcttctgctccagc

SEQ ID NO: 736429 - DNA, 17 bp, Homo sapiens
tgcttctgctccagccc

SEQ ID NO: 736430 - DNA, 18 bp, Homo sapiens
tgcttctgtccaggacat

SEQ ID NO: 736431 - DNA, 17 bp, Homo sapiens
tgcttcttactgataat

SEQ ID NO: 736432 - DNA, 13 bp, Homo sapiens
tgcttcttgcttc

SEQ ID NO: 736433 - DNA, 15 bp, Homo sapiens
tgcttctttctagaa

SEQ ID NO: 736434 - DNA, 19 bp, Homo sapiens
tgcttctttgcctccctca

SEQ ID NO: 736435 - DNA, 16 bp, Homo sapiens
tgcttgaaattactgt

SEQ ID NO: 736436 - DNA, 21 bp, Homo sapiens
tgcttgaaattactgtgtaaa

SEQ ID NO: 736437 - DNA, 19 bp, Homo sapiens
tgcttgaccgtactctcac

SEQ ID NO: 736438 - DNA, 13 bp, Homo sapiens
tgcttgactctca

SEQ ID NO: 736439 - DNA, 20 bp, Homo sapiens
tgcttgagcaataaagtgga

SEQ ID NO: 736440 - DNA, 21 bp, Homo sapiens
tgcttgagcaataaagtggaa

SEQ ID NO: 736441 - DNA, 21 bp, Homo sapiens
tgcttgagccaggaggcctgc

SEQ ID NO: 736442 - DNA, 13 bp, Homo sapiens
tgcttgagcccag

SEQ ID NO: 736443 - DNA, 12 bp, Homo sapiens
tgcttgaggaaa

SEQ ID NO: 736444 - DNA, 16 bp, Homo sapiens
tgcttgaggaaaacaa

SEQ ID NO: 736445 - DNA, 21 bp, Homo sapiens
tgcttgaggcaactcatctta

SEQ ID NO: 736446 - DNA, 21 bp, Homo sapiens
tgcttgatatgtaagtacttc

SEQ ID NO: 736447 - DNA, 18 bp, Homo sapiens
tgcttgatgaagcaagga

SEQ ID NO: 736448 - DNA, 20 bp, Homo sapiens
tgcttgatgaagcaaggaag

SEQ ID NO: 736449 - DNA, 22 bp, Homo sapiens
tgcttgcaatctaatctgaact

SEQ ID NO: 736450 - DNA, 16 bp, Homo sapiens
tgcttgcatcctattt

SEQ ID NO: 736451 - DNA, 18 bp, Homo sapiens
tgcttgccaaagtacaga

SEQ ID NO: 736452 - DNA, 21 bp, Homo sapiens
tgcttgccaaggcagaggcct

SEQ ID NO: 736453 - DNA, 14 bp, Homo sapiens
tgcttgcctagggc

SEQ ID NO: 736454 - DNA, 15 bp, Homo sapiens
tgcttgcctgatata

SEQ ID NO: 736455 - DNA, 19 bp, Homo sapiens
tgcttgcggcaaaaggaaa

SEQ ID NO: 736456 - DNA, 15 bp, Homo sapiens
tgcttgctttgaagt

SEQ ID NO: 736457 - DNA, 15 bp, Homo sapiens
tgcttgcttttgcct

SEQ ID NO: 736458 - DNA, 22 bp, Homo sapiens
tgcttggaacatactgttcact

SEQ ID NO: 736459 - DNA, 13 bp, Homo sapiens
tgcttggaagcca

SEQ ID NO: 736460 - DNA, 16 bp, Homo sapiens
tgcttggccaggattt

SEQ ID NO: 736461 - DNA, 22 bp, Homo sapiens
tgcttgggaccagaagtgtttc

SEQ ID NO: 736462 - DNA, 14 bp, Homo sapiens
tgcttgggacgtgt

SEQ ID NO: 736463 - DNA, 13 bp, Homo sapiens
tgcttgggctgac

SEQ ID NO: 736464 - DNA, 22 bp, Homo sapiens
tgcttggggaatgttgttttct

SEQ ID NO: 736465 - DNA, 12 bp, Homo sapiens
tgcttggggcta

SEQ ID NO: 736466 - DNA, 17 bp, Homo sapiens
tgcttggggctatttgt

SEQ ID NO: 736467 - DNA, 16 bp, Homo sapiens
tgcttggtctgtttga

SEQ ID NO: 736468 - DNA, 15 bp, Homo sapiens
tgcttggtgcacaga

SEQ ID NO: 736469 - DNA, 22 bp, Homo sapiens
tgcttggtggggctcgtggcct

SEQ ID NO: 736470 - DNA, 18 bp, Homo sapiens
tgcttgtaacaagaaaac

SEQ ID NO: 736471 - DNA, 20 bp, Homo sapiens
tgcttgtaacaagaaaacat

SEQ ID NO: 736472 - DNA, 12 bp, Homo sapiens
tgcttgtacata

SEQ ID NO: 736473 - DNA, 13 bp, Homo sapiens
tgcttgtacataa

SEQ ID NO: 736474 - DNA, 14 bp, Homo sapiens
tgcttgtacataat

SEQ ID NO: 736475 - DNA, 18 bp, Homo sapiens
tgcttgtcctgctctctt

SEQ ID NO: 736476 - DNA, 20 bp, Homo sapiens
tgcttgtgcctcccttccca

SEQ ID NO: 736477 - DNA, 22 bp, Homo sapiens
tgcttgtgcctcccttcccagt

SEQ ID NO: 736478 - DNA, 23 bp, Homo sapiens
tgcttgtgcctcccttcccagtg

SEQ ID NO: 736479 - DNA, 17 bp, Homo sapiens
tgcttgttagagagaaa

SEQ ID NO: 736480 - DNA, 22 bp, Homo sapiens
tgcttgttgggattcctgaccc

SEQ ID NO: 736481 - DNA, 21 bp, Homo sapiens
tgctttaaagggcctgcctgg

SEQ ID NO: 736482 - DNA, 15 bp, Homo sapiens
tgctttaattaatta

SEQ ID NO: 736483 - DNA, 23 bp, Homo sapiens
tgctttagcgattgattgatgta

SEQ ID NO: 736484 - DNA, 17 bp, Homo sapiens
tgctttaggctcacggc

SEQ ID NO: 736485 - DNA, 16 bp, Homo sapiens
tgctttatcttttcat

SEQ ID NO: 736486 - DNA, 14 bp, Homo sapiens
tgctttattccaga

SEQ ID NO: 736487 - DNA, 15 bp, Homo sapiens
tgctttattccagaa

SEQ ID NO: 736488 - DNA, 15 bp, Homo sapiens
tgctttattttccct

SEQ ID NO: 736489 - DNA, 18 bp, Homo sapiens
tggaaactctttaacttc

SEQ ID NO: 736490 - DNA, 15 bp, Homo sapiens
tggaaacttttgtta

SEQ ID NO: 736491 - DNA, 15 bp, Homo sapiens
tggaaagatgttaag

SEQ ID NO: 736492 - DNA, 20 bp, Homo sapiens
tggaaagatgttaagcattt

SEQ ID NO: 736493 - DNA, 12 bp, Homo sapiens
tggaaagcaaag

SEQ ID NO: 736494 - DNA, 20 bp, Homo sapiens
tggaaagcagagcctcctgg

SEQ ID NO: 736495 - DNA, 22 bp, Homo sapiens
tggaaagcagagcctcctggga

SEQ ID NO: 736496 - DNA, 12 bp, Homo sapiens
tggaaagcctct

SEQ ID NO: 736497 - DNA, 17 bp, Homo sapiens
tggaaaggctcagtctc

SEQ ID NO: 736498 - DNA, 21 bp, Homo sapiens
tggaaaggctcagtctcagga

SEQ ID NO: 736499 - DNA, 23 bp, Homo sapiens
tggaaaggctcagtctcaggagc

SEQ ID NO: 736500 - DNA, 14 bp, Homo sapiens
tggaaaggggagag

SEQ ID NO: 736501 - DNA, 15 bp, Homo sapiens
tggaaaggggagagc

SEQ ID NO: 736502 - DNA, 19 bp, Homo sapiens
tggaaaggggagagcctgc

SEQ ID NO: 736503 - DNA, 22 bp, Homo sapiens
tggaaaggggagagcctgctgg

SEQ ID NO: 736504 - DNA, 17 bp, Homo sapiens
tggaaaggggggagctg

SEQ ID NO: 736505 - DNA, 19 bp, Homo sapiens
tggaaaggtgtgagactgg

SEQ ID NO: 736506 - DNA, 19 bp, Homo sapiens
tggaaagtacactctgctg

SEQ ID NO: 736507 - DNA, 20 bp, Homo sapiens
tggaaagtacactctgctgt

SEQ ID NO: 736508 - DNA, 15 bp, Homo sapiens
ggttcccccagccct

SEQ ID NO: 736509 - DNA, 14 bp, Homo sapiens
ggttcccctggcct

SEQ ID NO: 736510 - DNA, 17 bp, Homo sapiens
ggttcccgtttctccac

SEQ ID NO: 736511 - DNA, 21 bp, Homo sapiens
ggttccctcctagctctccca

SEQ ID NO: 736512 - DNA, 13 bp, Homo sapiens
ggttccctctgag

SEQ ID NO: 736513 - DNA, 16 bp, Homo sapiens
ggttccctgttcttcc

SEQ ID NO: 736514 - DNA, 17 bp, Homo sapiens
ggttccctttccttcca

SEQ ID NO: 736515 - DNA, 21 bp, Homo sapiens
ggttccgcactttccacttct

SEQ ID NO: 736516 - DNA, 19 bp, Homo sapiens
ggttccgcctccaggggca

SEQ ID NO: 736517 - DNA, 15 bp, Homo sapiens
ggttccgcttggagc

SEQ ID NO: 736518 - DNA, 21 bp, Homo sapiens
ggttccgcttggagcagaggg

SEQ ID NO: 736519 - DNA, 19 bp, Homo sapiens
ggttcctcaaattttttga

SEQ ID NO: 736520 - DNA, 16 bp, Homo sapiens
ggttcctcctctccta

SEQ ID NO: 736521 - DNA, 18 bp, Homo sapiens
ggttcctctgcctgcccc

SEQ ID NO: 736522 - DNA, 12 bp, Homo sapiens
ggttcctgctgt

SEQ ID NO: 736523 - DNA, 14 bp, Homo sapiens
ggttcctgctgtgg

SEQ ID NO: 736524 - DNA, 11 bp, Homo sapiens
ggttcctggga

SEQ ID NO: 736525 - DNA, 17 bp, Homo sapiens
ggttcctggggccgcct

SEQ ID NO: 736526 - DNA, 19 bp, Homo sapiens
ggttccttcctctgagcct

SEQ ID NO: 736527 - DNA, 13 bp, Homo sapiens
ggttcgagactcc

SEQ ID NO: 736528 - DNA, 14 bp, Homo sapiens
ggttcgaggggaaa

SEQ ID NO: 736529 - DNA, 14 bp, Homo sapiens
ggttcgttggggac

SEQ ID NO: 736530 - DNA, 15 bp, Homo sapiens
ggttcgttggggaca

SEQ ID NO: 736531 - DNA, 23 bp, Homo sapiens
ggttctaggcatctctgtacttt

SEQ ID NO: 736532 - DNA, 23 bp, Homo sapiens
ggttctagtctcctttgcactga

SEQ ID NO: 736533 - DNA, 14 bp, Homo sapiens
ggttctataataag

SEQ ID NO: 736534 - DNA, 12 bp, Homo sapiens
ggttctatttta

SEQ ID NO: 736535 - DNA, 12 bp, Homo sapiens
ggttctcaatga

SEQ ID NO: 736536 - DNA, 18 bp, Homo sapiens
ggttctcaggtgttgcca

SEQ ID NO: 736537 - DNA, 22 bp, Homo sapiens
ggttctcattaggttttgcttg

SEQ ID NO: 736538 - DNA, 21 bp, Homo sapiens
ggttctccgttagctcctgtg

SEQ ID NO: 736539 - DNA, 12 bp, Homo sapiens
ggttctctacag

SEQ ID NO: 736540 - DNA, 19 bp, Homo sapiens
ggttctgccctgcctgagg

SEQ ID NO: 736541 - DNA, 23 bp, Homo sapiens
ggttctgccctgcctgaggagga

SEQ ID NO: 736542 - DNA, 12 bp, Homo sapiens
ggttctggcagg

SEQ ID NO: 736543 - DNA, 12 bp, Homo sapiens
ggttctggctgc

SEQ ID NO: 736544 - DNA, 16 bp, Homo sapiens
ggttctgggcctctga

SEQ ID NO: 736545 - DNA, 18 bp, Homo sapiens
ggttcttacttttcctgg

SEQ ID NO: 736546 - DNA, 13 bp, Homo sapiens
ggttcttcatgat

SEQ ID NO: 736547 - DNA, 13 bp, Homo sapiens
ggttcttcccctc

SEQ ID NO: 736548 - DNA, 17 bp, Homo sapiens
ggttcttcctttccctg

SEQ ID NO: 736549 - DNA, 21 bp, Homo sapiens
ggttcttcctttccctggagc

SEQ ID NO: 736550 - DNA, 15 bp, Homo sapiens
ggttctttggaagga

SEQ ID NO: 736551 - DNA, 15 bp, Homo sapiens
ggttctttgttttaa

SEQ ID NO: 736552 - DNA, 20 bp, Homo sapiens
ggttcttttttcagttattt

SEQ ID NO: 736553 - DNA, 16 bp, Homo sapiens
ggttgaactctggtgg

SEQ ID NO: 736554 - DNA, 21 bp, Homo sapiens
ggttgaagaaaggaacctggg

SEQ ID NO: 736555 - DNA, 16 bp, Homo sapiens
ggttgaagccatgtct

SEQ ID NO: 736556 - DNA, 15 bp, Homo sapiens
ggttgaaggcagtct

SEQ ID NO: 736557 - DNA, 23 bp, Homo sapiens
ggttgacctgtttctctttgtct

SEQ ID NO: 736558 - DNA, 22 bp, Homo sapiens
ggttgacctttaaatgcaacag

SEQ ID NO: 736559 - DNA, 11 bp, Homo sapiens
ggttgaggaaa

SEQ ID NO: 736560 - DNA, 18 bp, Homo sapiens
ggttgaggggctcctgga

SEQ ID NO: 736561 - DNA, 19 bp, Homo sapiens
ggttgatggaaaataaaca

SEQ ID NO: 736562 - DNA, 20 bp, Homo sapiens
ggttgcaaaacggatgagtt

SEQ ID NO: 736563 - DNA, 13 bp, Homo sapiens
ggttgcagggctg

SEQ ID NO: 736564 - DNA, 15 bp, Homo sapiens
ggttgcagggctgca

SEQ ID NO: 736565 - DNA, 21 bp, Homo sapiens
ggttgcgtcctgacggcgccc

SEQ ID NO: 736566 - DNA, 21 bp, Homo sapiens
ggttgctgttttcctcccttc

SEQ ID NO: 736567 - DNA, 15 bp, Homo sapiens
ggttgcttaattcct

SEQ ID NO: 736568 - DNA, 11 bp, Homo sapiens
ggttgcttctg

SEQ ID NO: 736569 - DNA, 22 bp, Homo sapiens
ggttggaactttagggggtggg

SEQ ID NO: 736570 - DNA, 16 bp, Homo sapiens
ggttggacagccccct

SEQ ID NO: 736571 - DNA, 14 bp, Homo sapiens
ggttggagcccagg

SEQ ID NO: 736572 - DNA, 10 bp, Homo sapiens
ggttggccag

SEQ ID NO: 736573 - DNA, 12 bp, Homo sapiens
ggttggccagga

SEQ ID NO: 736574 - DNA, 18 bp, Homo sapiens
ggttggcccttgtctttt

SEQ ID NO: 736575 - DNA, 15 bp, Homo sapiens
ggttggctgggccca

SEQ ID NO: 736576 - DNA, 17 bp, Homo sapiens
ggttgggacaatggcaa

SEQ ID NO: 736577 - DNA, 19 bp, Homo sapiens
ggttggggcaaagcctcct

SEQ ID NO: 736578 - DNA, 18 bp, Homo sapiens
ggttggggcttcacagcc

SEQ ID NO: 736579 - DNA, 16 bp, Homo sapiens
ggttgggggaatgcac

SEQ ID NO: 736580 - DNA, 16 bp, Homo sapiens
ggttggtagggtggga

SEQ ID NO: 736581 - DNA, 17 bp, Homo sapiens
ggttggtgcacagtgat

SEQ ID NO: 736582 - DNA, 13 bp, Homo sapiens
ggttggttccttg

SEQ ID NO: 736583 - DNA, 15 bp, Homo sapiens
ggttggttttatttg

SEQ ID NO: 736584 - DNA, 19 bp, Homo sapiens
ggttgtaaatgctcgtgtg

SEQ ID NO: 736585 - DNA, 14 bp, Homo sapiens
ggttgtgaaatgta

SEQ ID NO: 736586 - DNA, 21 bp, Homo sapiens
ggttgtgaggcctggccaggc

SEQ ID NO: 736587 - DNA, 14 bp, Homo sapiens
ggttgtgcagggtg

SEQ ID NO: 736588 - DNA, 13 bp, Homo sapiens
ggttgtggggagg

SEQ ID NO: 736589 - DNA, 18 bp, Homo sapiens
ggttgtggggaggctgca

SEQ ID NO: 736590 - DNA, 22 bp, Homo sapiens
ggttgttaggcttttctgcctg

SEQ ID NO: 736591 - DNA, 21 bp, Homo sapiens
ggttgttgcaccatctgcttg

SEQ ID NO: 736592 - DNA, 14 bp, Homo sapiens
ggttgtttccagga

SEQ ID NO: 736593 - DNA, 18 bp, Homo sapiens
ggttgtttccaggagaaa

SEQ ID NO: 736594 - DNA, 14 bp, Homo sapiens
ggttgtttctgttc

SEQ ID NO: 736595 - DNA, 23 bp, Homo sapiens
ggttgtttttgttctttgtgttt

SEQ ID NO: 736596 - DNA, 18 bp, Homo sapiens
ggtttaaagaaagtgtat

SEQ ID NO: 736597 - DNA, 14 bp, Homo sapiens
ggtttaaagtttga

SEQ ID NO: 736598 - DNA, 16 bp, Homo sapiens
ggtttaagtagatttc

SEQ ID NO: 736599 - DNA, 17 bp, Homo sapiens
ggtttacctagagaaca

SEQ ID NO: 736600 - DNA, 18 bp, Homo sapiens
ggtttactcactgctgca

SEQ ID NO: 736601 - DNA, 14 bp, Homo sapiens
ggtttatgactttg

SEQ ID NO: 736602 - DNA, 22 bp, Homo sapiens
ggtttattcccaagtatgcctt

SEQ ID NO: 736603 - DNA, 17 bp, Homo sapiens
ggtttatttttctgtta

SEQ ID NO: 736604 - DNA, 18 bp, Homo sapiens
ggtttcaagaatatggag

SEQ ID NO: 736605 - DNA, 21 bp, Homo sapiens
ggtttcaattcagattgtctt

SEQ ID NO: 736606 - DNA, 13 bp, Homo sapiens
ggtttcaccatgt

SEQ ID NO: 736607 - DNA, 13 bp, Homo sapiens
ggtttcaccttcc

SEQ ID NO: 736608 - DNA, 14 bp, Homo sapiens
ggtttcagaaatgt

SEQ ID NO: 736609 - DNA, 19 bp, Homo sapiens
ggtttcagatgtgcaataa

SEQ ID NO: 736610 - DNA, 10 bp, Homo sapiens
ggtttcagtg

SEQ ID NO: 736611 - DNA, 15 bp, Homo sapiens
ggtttcatgttctgt

SEQ ID NO: 736612 - DNA, 16 bp, Homo sapiens
gtaaagctagaaatga

SEQ ID NO: 736613 - DNA, 16 bp, Homo sapiens
gtaaagcttgtctgat

SEQ ID NO: 736614 - DNA, 16 bp, Homo sapiens
gtaaagtatgtaaaca

SEQ ID NO: 736615 - DNA, 15 bp, Homo sapiens
gtaaagtatgtatta

SEQ ID NO: 736616 - DNA, 17 bp, Homo sapiens
gtaaagtgataatttct

SEQ ID NO: 736617 - DNA, 18 bp, Homo sapiens
gtaaagtgataatttctg

SEQ ID NO: 736618 - DNA, 14 bp, Homo sapiens
gtaaataaaaagaa

SEQ ID NO: 736619 - DNA, 15 bp, Homo sapiens
gtaaataaaatgtgt

SEQ ID NO: 736620 - DNA, 20 bp, Homo sapiens
gtaaataaaatgtgtacagt

SEQ ID NO: 736621 - DNA, 23 bp, Homo sapiens
gtaaataaaatgtgtacagtgaa

SEQ ID NO: 736622 - DNA, 14 bp, Homo sapiens
gtaaataaaccact

SEQ ID NO: 736623 - DNA, 13 bp, Homo sapiens
gtaaataaagccc

SEQ ID NO: 736624 - DNA, 18 bp, Homo sapiens
gtaaataaccacaaggtc

SEQ ID NO: 736625 - DNA, 20 bp, Homo sapiens
gtaaataactggaaaacaga

SEQ ID NO: 736626 - DNA, 16 bp, Homo sapiens
gtaaataagagatttg

SEQ ID NO: 736627 - DNA, 11 bp, Homo sapiens
gtaaataattt

SEQ ID NO: 736628 - DNA, 17 bp, Homo sapiens
gtaaatacatgcatata

SEQ ID NO: 736629 - DNA, 16 bp, Homo sapiens
gtaaatacccatatgt

SEQ ID NO: 736630 - DNA, 17 bp, Homo sapiens
gtaaatactcatgaatg

SEQ ID NO: 736631 - DNA, 14 bp, Homo sapiens
gtaaatactggact

SEQ ID NO: 736632 - DNA, 17 bp, Homo sapiens
gtaaatactggactcag

SEQ ID NO: 736633 - DNA, 19 bp, Homo sapiens
gtaaatactggactcagga

SEQ ID NO: 736634 - DNA, 22 bp, Homo sapiens
gtaaatactggactcaggaact

SEQ ID NO: 736635 - DNA, 16 bp, Homo sapiens
gtaaatacttgcagtt

SEQ ID NO: 736636 - DNA, 19 bp, Homo sapiens
gtaaatactttgtcctaag

SEQ ID NO: 736637 - DNA, 14 bp, Homo sapiens
gtaaataggaattg

SEQ ID NO: 736638 - DNA, 17 bp, Homo sapiens
gtaaataggttcttctt

SEQ ID NO: 736639 - DNA, 16 bp, Homo sapiens
tggaataatttgtaaa

SEQ ID NO: 736640 - DNA, 17 bp, Homo sapiens
tggaataatttgtaaat

SEQ ID NO: 736641 - DNA, 19 bp, Homo sapiens
tggaataatttgtaaatga

SEQ ID NO: 736642 - DNA, 15 bp, Homo sapiens
tggaatacagtgtta

SEQ ID NO: 736643 - DNA, 22 bp, Homo sapiens
tggaatacagtgttattttctt

SEQ ID NO: 736644 - DNA, 12 bp, Homo sapiens
tggaatactttt

SEQ ID NO: 736645 - DNA, 20 bp, Homo sapiens
tggaatataaatagctgaaa

SEQ ID NO: 736646 - DNA, 21 bp, Homo sapiens
tggaatataaggaaagcaata

SEQ ID NO: 736647 - DNA, 13 bp, Homo sapiens
tggaatattcatt

SEQ ID NO: 736648 - DNA, 14 bp, Homo sapiens
tggaatattcattt

SEQ ID NO: 736649 - DNA, 23 bp, Homo sapiens
tggaatattcccctatctctaga

SEQ ID NO: 736650 - DNA, 21 bp, Homo sapiens
tggaatcaggaatattttcca

SEQ ID NO: 736651 - DNA, 14 bp, Homo sapiens
tggaatcagtattt

SEQ ID NO: 736652 - DNA, 23 bp, Homo sapiens
tggaatcagtatttccttccact

SEQ ID NO: 736653 - DNA, 16 bp, Homo sapiens
tggaatcatactgcct

SEQ ID NO: 736654 - DNA, 19 bp, Homo sapiens
tggaatcatactgcctact

SEQ ID NO: 736655 - DNA, 18 bp, Homo sapiens
tggaatcccactgtatga

SEQ ID NO: 736656 - DNA, 16 bp, Homo sapiens
tggaatctaacgggca

SEQ ID NO: 736657 - DNA, 22 bp, Homo sapiens
tggaatctaagctgtttgccaa

SEQ ID NO: 736658 - DNA, 18 bp, Homo sapiens
tggaatctacaagccaaa

SEQ ID NO: 736659 - DNA, 12 bp, Homo sapiens
tggaatctcatg

SEQ ID NO: 736660 - DNA, 17 bp, Homo sapiens
tggaatctggagaccag

SEQ ID NO: 736661 - DNA, 18 bp, Homo sapiens
tggaatctggagaccagg

SEQ ID NO: 736662 - DNA, 23 bp, Homo sapiens
tggaatcttcacctcagagtgga

SEQ ID NO: 736663 - DNA, 14 bp, Homo sapiens
tggaatgactgaaa

SEQ ID NO: 736664 - DNA, 15 bp, Homo sapiens
tggaatgagggaggc

SEQ ID NO: 736665 - DNA, 17 bp, Homo sapiens
tggaatgagtgtgcatg

SEQ ID NO: 736666 - DNA, 16 bp, Homo sapiens
tggaatgctgggtatg

SEQ ID NO: 736667 - DNA, 22 bp, Homo sapiens
tggaatggtacatgtcttccat

SEQ ID NO: 736668 - DNA, 16 bp, Homo sapiens
tggaatggtttgggaa

SEQ ID NO: 736669 - DNA, 14 bp, Homo sapiens
tggaatgtgcccct

SEQ ID NO: 736670 - DNA, 21 bp, Homo sapiens
tggaatgtggcccctgaacaa

SEQ ID NO: 736671 - DNA, 15 bp, Homo sapiens
tggaatgttggataa

SEQ ID NO: 736672 - DNA, 16 bp, Homo sapiens
tggaatgttggataag

SEQ ID NO: 736673 - DNA, 21 bp, Homo sapiens
tggaatgttggataaggaatt

SEQ ID NO: 736674 - DNA, 17 bp, Homo sapiens
tggaattaacctggtgc

SEQ ID NO: 736675 - DNA, 16 bp, Homo sapiens
tggaattagagggcct

SEQ ID NO: 736676 - DNA, 23 bp, Homo sapiens
tggaattattttgaatgtcacaa

SEQ ID NO: 736677 - DNA, 18 bp, Homo sapiens
tggaattcagcaccctgg

SEQ ID NO: 736678 - DNA, 19 bp, Homo sapiens
tggaattcagcaccctggg

SEQ ID NO: 736679 - DNA, 21 bp, Homo sapiens
tggaattcagcaccctgggtg

SEQ ID NO: 736680 - DNA, 16 bp, Homo sapiens
tggaattcagcagttt

SEQ ID NO: 736681 - DNA, 18 bp, Homo sapiens
tggaattcagcagtttta

SEQ ID NO: 736682 - DNA, 22 bp, Homo sapiens
tggaattcagtgacaaaatggg

SEQ ID NO: 736683 - DNA, 18 bp, Homo sapiens
tggaattccaacttgaag

SEQ ID NO: 736684 - DNA, 14 bp, Homo sapiens
tggaattcttcctc

SEQ ID NO: 736685 - DNA, 18 bp, Homo sapiens
tggaattcttcctcctct

SEQ ID NO: 736686 - DNA, 18 bp, Homo sapiens
tggaattgaactctctgc

SEQ ID NO: 736687 - DNA, 20 bp, Homo sapiens
tggaattgatttgcattgaa

SEQ ID NO: 736688 - DNA, 17 bp, Homo sapiens
tggaattgggagcttgg

SEQ ID NO: 736689 - DNA, 14 bp, Homo sapiens
tggaattggtgtat

SEQ ID NO: 736690 - DNA, 16 bp, Homo sapiens
tggaattggtgtatat

SEQ ID NO: 736691 - DNA, 21 bp, Homo sapiens
tggaatttctagtatgagact

SEQ ID NO: 736692 - DNA, 15 bp, Homo sapiens
tggaatttctggcct

SEQ ID NO: 736693 - DNA, 19 bp, Homo sapiens
tggaatttctggcctccta

SEQ ID NO: 736694 - DNA, 17 bp, Homo sapiens
tggaatttgcctgctgg

SEQ ID NO: 736695 - DNA, 23 bp, Homo sapiens
tggaattttgcaaagatttaatc

SEQ ID NO: 736696 - DNA, 13 bp, Homo sapiens
tggaatttttctg

SEQ ID NO: 736697 - DNA, 16 bp, Homo sapiens
tggaatttttctgtac

SEQ ID NO: 736698 - DNA, 18 bp, Homo sapiens
tggacaaaattaatacat

SEQ ID NO: 736699 - DNA, 21 bp, Homo sapiens
tggacaaatcacatattttaa

SEQ ID NO: 736700 - DNA, 23 bp, Homo sapiens
tggacaaatcacatattttaaaa

SEQ ID NO: 736701 - DNA, 21 bp, Homo sapiens
tggacaaatgtatagaataaa

SEQ ID NO: 736702 - DNA, 20 bp, Homo sapiens
tggacaacagctctcgttct

SEQ ID NO: 736703 - DNA, 22 bp, Homo sapiens
tggacaacttatttaaaaatat

SEQ ID NO: 736704 - DNA, 17 bp, Homo sapiens
tggacaatataaactga

SEQ ID NO: 736705 - DNA, 16 bp, Homo sapiens
tggacaatcttatgtt

SEQ ID NO: 736706 - DNA, 21 bp, Homo sapiens
tggacacaaattttcaagttt

SEQ ID NO: 736707 - DNA, 20 bp, Homo sapiens
tggacacattggaatgcctt

SEQ ID NO: 736708 - DNA, 21 bp, Homo sapiens
tggacaccaggagtccctggt

SEQ ID NO: 736709 - DNA, 12 bp, Homo sapiens
tggacaccccca

SEQ ID NO: 736710 - DNA, 15 bp, Homo sapiens
tggacacccccagct

SEQ ID NO: 736711 - DNA, 20 bp, Homo sapiens
tggacaccccttatccagga

SEQ ID NO: 736712 - DNA, 22 bp, Homo sapiens
tggacaccccttatccaggact

SEQ ID NO: 736713 - DNA, 23 bp, Homo sapiens
tggacaccccttatccaggactc

SEQ ID NO: 736714 - DNA, 14 bp, Homo sapiens
tggacacctcccag

SEQ ID NO: 736715 - DNA, 16 bp, Homo sapiens
tggacacctcccaggg

SEQ ID NO: 736716 - DNA, 19 bp, Homo sapiens
tggacacctcccaggggac

SEQ ID NO: 736717 - DNA, 21 bp, Homo sapiens
tggacacctcccaggggactg

SEQ ID NO: 736718 - DNA, 18 bp, Homo sapiens
tggacaccttgtgtttag

SEQ ID NO: 736719 - DNA, 16 bp, Homo sapiens
tggacacgagccacaa

SEQ ID NO: 736720 - DNA, 22 bp, Homo sapiens
tggacacgcgtgattgaccctt

SEQ ID NO: 736721 - DNA, 16 bp, Homo sapiens
tggacactacacccag

SEQ ID NO: 736722 - DNA, 20 bp, Homo sapiens
tggacactacacccagcaat

SEQ ID NO: 736723 - DNA, 16 bp, Homo sapiens
tggacactccagggac

SEQ ID NO: 736724 - DNA, 21 bp, Homo sapiens
tggacactccagtgccagcaa

SEQ ID NO: 736725 - DNA, 16 bp, Homo sapiens
tggacactgccaagag

SEQ ID NO: 736726 - DNA, 21 bp, Homo sapiens
tggacactgccttagcctctt

SEQ ID NO: 736727 - DNA, 20 bp, Homo sapiens
tggacactttgaaatgtgtt

SEQ ID NO: 736728 - DNA, 20 bp, Homo sapiens
tggacagacactgttgcaaa

SEQ ID NO: 736729 - DNA, 15 bp, Homo sapiens
tggacagagaagggc

SEQ ID NO: 736730 - DNA, 19 bp, Homo sapiens
tggacagatggacgcaggc

SEQ ID NO: 736731 - DNA, 15 bp, Homo sapiens
tggacagatggccca

SEQ ID NO: 736732 - DNA, 16 bp, Homo sapiens
tggacagattaatatt

SEQ ID NO: 736733 - DNA, 14 bp, Homo sapiens
tggactcagggcag

SEQ ID NO: 736734 - DNA, 20 bp, Homo sapiens
tggactcagggcagcgccag

SEQ ID NO: 736735 - DNA, 16 bp, Homo sapiens
tggactcctcccacaa

SEQ ID NO: 736736 - DNA, 22 bp, Homo sapiens
tggactctaagctggagctctt

SEQ ID NO: 736737 - DNA, 14 bp, Homo sapiens
tggactctcaggga

SEQ ID NO: 736738 - DNA, 13 bp, Homo sapiens
tggactctgcatc

SEQ ID NO: 736739 - DNA, 14 bp, Homo sapiens
tggactctgcatcc

SEQ ID NO: 736740 - DNA, 14 bp, Homo sapiens
tggactctgcccca

SEQ ID NO: 736741 - DNA, 17 bp, Homo sapiens
tggactgaagcctgcag

SEQ ID NO: 736742 - DNA, 18 bp, Homo sapiens
tggactgaagcctgcagg

SEQ ID NO: 736743 - DNA, 22 bp, Homo sapiens
tggactgacagcatgtgccctc

SEQ ID NO: 736744 - DNA, 17 bp, Homo sapiens
tggactgagctggggga

SEQ ID NO: 736745 - DNA, 19 bp, Homo sapiens
tggactgagtgggaagccc

SEQ ID NO: 736746 - DNA, 13 bp, Homo sapiens
tggactgcagaag

SEQ ID NO: 736747 - DNA, 12 bp, Homo sapiens
tggactgcatgg

SEQ ID NO: 736748 - DNA, 21 bp, Homo sapiens
tggactgcatggggaggcagc

SEQ ID NO: 736749 - DNA, 20 bp, Homo sapiens
tggactgcatttaaatttga

SEQ ID NO: 736750 - DNA, 15 bp, Homo sapiens
tggactgcgctggac

SEQ ID NO: 736751 - DNA, 23 bp, Homo sapiens
tggactggaggcccctggagcca

SEQ ID NO: 736752 - DNA, 22 bp, Homo sapiens
tggactggaggtgggcatgcca

SEQ ID NO: 736753 - DNA, 12 bp, Homo sapiens
tggactggccat

SEQ ID NO: 736754 - DNA, 20 bp, Homo sapiens
tggactggccatttttctgg

SEQ ID NO: 736755 - DNA, 16 bp, Homo sapiens
tggactgtgaatttca

SEQ ID NO: 736756 - DNA, 17 bp, Homo sapiens
tggactgtgaatttcaa

SEQ ID NO: 736757 - DNA, 15 bp, Homo sapiens
tggactgtgatgcca

SEQ ID NO: 736758 - DNA, 16 bp, Homo sapiens
tggactgtgcctcagg

SEQ ID NO: 736759 - DNA, 23 bp, Homo sapiens
tggactgtgcctcaggccagggc

SEQ ID NO: 736760 - DNA, 17 bp, Homo sapiens
tggactgttttctctcg

SEQ ID NO: 736761 - DNA, 16 bp, Homo sapiens
tggacttaaagaaaaa

SEQ ID NO: 736762 - DNA, 19 bp, Homo sapiens
tggacttaagcatctggct

SEQ ID NO: 736763 - DNA, 17 bp, Homo sapiens
tggacttacaaaatgcc

SEQ ID NO: 736764 - DNA, 18 bp, Homo sapiens
tggacttcacataagctc

SEQ ID NO: 736765 - DNA, 17 bp, Homo sapiens
tggacttcagtgtgtgt

SEQ ID NO: 736766 - DNA, 15 bp, Homo sapiens
tggacttcctggggc

SEQ ID NO: 736767 - DNA, 14 bp, Homo sapiens
tggacttgcctctg

SEQ ID NO: 736768 - DNA, 18 bp, Homo sapiens
tggacttggagctgcaca

SEQ ID NO: 736769 - DNA, 19 bp, Homo sapiens
gtaaggctgtgtaagattt

SEQ ID NO: 736770 - DNA, 13 bp, Homo sapiens
gtaaggtctttgt

SEQ ID NO: 736771 - DNA, 14 bp, Homo sapiens
gtaaggtctttgta

SEQ ID NO: 736772 - DNA, 16 bp, Homo sapiens
gtaaggtctttgtaaa

SEQ ID NO: 736773 - DNA, 13 bp, Homo sapiens
gtaaggtgcagtt

SEQ ID NO: 736774 - DNA, 12 bp, Homo sapiens
gtaaggtgcctt

SEQ ID NO: 736775 - DNA, 17 bp, Homo sapiens
gtaaggtgcttggagtt

SEQ ID NO: 736776 - DNA, 15 bp, Homo sapiens
gtaaggttgtgcagg

SEQ ID NO: 736777 - DNA, 18 bp, Homo sapiens
gtaagtaccactcaggcc

SEQ ID NO: 736778 - DNA, 13 bp, Homo sapiens
gtaagtacttcca

SEQ ID NO: 736779 - DNA, 12 bp, Homo sapiens
gtaagtcttttt

SEQ ID NO: 736780 - DNA, 22 bp, Homo sapiens
gtaagtcttttttttttccaaa

SEQ ID NO: 736781 - DNA, 15 bp, Homo sapiens
gtaagtgtacaattg

SEQ ID NO: 736782 - DNA, 23 bp, Homo sapiens
gtaagtgtgttcattaatgttta

SEQ ID NO: 736783 - DNA, 16 bp, Homo sapiens
gtaagtgttctcatga

SEQ ID NO: 736784 - DNA, 14 bp, Homo sapiens
gtaagttactgggc

SEQ ID NO: 736785 - DNA, 23 bp, Homo sapiens
gtaagttgaatggcctgccttga

SEQ ID NO: 736786 - DNA, 15 bp, Homo sapiens
gtaagtttatccaaa

SEQ ID NO: 736787 - DNA, 12 bp, Homo sapiens
gtaagtttattt

SEQ ID NO: 736788 - DNA, 13 bp, Homo sapiens
gtaagttttttga

SEQ ID NO: 736789 - DNA, 20 bp, Homo sapiens
gtaataaaattcaacaaaca

SEQ ID NO: 736790 - DNA, 17 bp, Homo sapiens
gtaataaagtatataat

SEQ ID NO: 736791 - DNA, 23 bp, Homo sapiens
gtaataaatctaggatgtgatga

SEQ ID NO: 736792 - DNA, 18 bp, Homo sapiens
gtaataacattttataca

SEQ ID NO: 736793 - DNA, 12 bp, Homo sapiens
gtaataagaaag

SEQ ID NO: 736794 - DNA, 13 bp, Homo sapiens
gtaataagaaagt

SEQ ID NO: 736795 - DNA, 22 bp, Homo sapiens
gtaatacaaactaatttagtaa

SEQ ID NO: 736796 - DNA, 17 bp, Homo sapiens
gtaatactggaataatt

SEQ ID NO: 736797 - DNA, 18 bp, Homo sapiens
gtaatactggaataattt

SEQ ID NO: 736798 - DNA, 14 bp, Homo sapiens
gtaatacttttgta

SEQ ID NO: 736799 - DNA, 20 bp, Homo sapiens
gtaatacttttgtaatctat

SEQ ID NO: 736800 - DNA, 17 bp, Homo sapiens
gtaataggaccagagcg

SEQ ID NO: 736801 - DNA, 13 bp, Homo sapiens
gtaataggcattt

SEQ ID NO: 736802 - DNA, 22 bp, Homo sapiens
gtaatagttcagtagaattacc

SEQ ID NO: 736803 - DNA, 14 bp, Homo sapiens
gtaatagtttatct

SEQ ID NO: 736804 - DNA, 15 bp, Homo sapiens
gtaatatagaaaaaa

SEQ ID NO: 736805 - DNA, 12 bp, Homo sapiens
gtaatatattgt

SEQ ID NO: 736806 - DNA, 19 bp, Homo sapiens
gtaatattgtaaatactgg

SEQ ID NO: 736807 - DNA, 21 bp, Homo sapiens
gtaatatttacaatgtattaa

SEQ ID NO: 736808 - DNA, 21 bp, Homo sapiens
gtaatatttacataaagactg

SEQ ID NO: 736809 - DNA, 22 bp, Homo sapiens
gtaatatttacataaagactgt

SEQ ID NO: 736810 - DNA, 16 bp, Homo sapiens
gtaatatttgaatttt

SEQ ID NO: 736811 - DNA, 18 bp, Homo sapiens
gtaatattttactttgag

SEQ ID NO: 736812 - DNA, 13 bp, Homo sapiens
gtaatattttcca

SEQ ID NO: 736813 - DNA, 16 bp, Homo sapiens
gtaatcaatatcccaa

SEQ ID NO: 736814 - DNA, 16 bp, Homo sapiens
gtaatcagctctcctg

SEQ ID NO: 736815 - DNA, 11 bp, Homo sapiens
gtaatcaggca

SEQ ID NO: 736816 - DNA, 22 bp, Homo sapiens
gtaatcatttcttgggccctcc

SEQ ID NO: 736817 - DNA, 18 bp, Homo sapiens
gtaatccaggcacagctg

SEQ ID NO: 736818 - DNA, 14 bp, Homo sapiens
gtaatcccagcact

SEQ ID NO: 736819 - DNA, 21 bp, Homo sapiens
gtaatcccagctactcaggag

SEQ ID NO: 736820 - DNA, 18 bp, Homo sapiens
gtaatccctgctttttgt

SEQ ID NO: 736821 - DNA, 23 bp, Homo sapiens
gtaatcctagcactttgggaggc

SEQ ID NO: 736822 - DNA, 22 bp, Homo sapiens
gtaatcctcaagaaataaaagg

SEQ ID NO: 736823 - DNA, 17 bp, Homo sapiens
gtaatcgcttaaagatg

SEQ ID NO: 736824 - DNA, 14 bp, Homo sapiens
gtaatctaatagaa

SEQ ID NO: 736825 - DNA, 20 bp, Homo sapiens
gtaatctatgtgtttctgta

SEQ ID NO: 736826 - DNA, 23 bp, Homo sapiens
gtaatctatgtgtttctgtaaca

SEQ ID NO: 736827 - DNA, 22 bp, Homo sapiens
gtaatctattcctgtaaataag

SEQ ID NO: 736828 - DNA, 13 bp, Homo sapiens
gtaatctttaaac

SEQ ID NO: 736829 - DNA, 17 bp, Homo sapiens
gtaatctttacctgtat

SEQ ID NO: 736830 - DNA, 14 bp, Homo sapiens
gtaatgaaatgttt

SEQ ID NO: 736831 - DNA, 15 bp, Homo sapiens
gtaatgaagaatcac

SEQ ID NO: 736832 - DNA, 18 bp, Homo sapiens
gtaatgacttagaaactg

SEQ ID NO: 736833 - DNA, 15 bp, Homo sapiens
gtaatgatactgtgt

SEQ ID NO: 736834 - DNA, 17 bp, Homo sapiens
gtaatgcactgttttta

SEQ ID NO: 736835 - DNA, 16 bp, Homo sapiens
gtaatgcactttggga

SEQ ID NO: 736836 - DNA, 16 bp, Homo sapiens
gtaatgcattaataaa

SEQ ID NO: 736837 - DNA, 14 bp, Homo sapiens
gtaatgctgcactt

SEQ ID NO: 736838 - DNA, 16 bp, Homo sapiens
gtaatggcagttatat

SEQ ID NO: 736839 - DNA, 17 bp, Homo sapiens
gtaatgggtaattctga

SEQ ID NO: 736840 - DNA, 23 bp, Homo sapiens
gtaatgggtacaatgaagaagtt

SEQ ID NO: 736841 - DNA, 19 bp, Homo sapiens
gtaatggtactgactttgc

SEQ ID NO: 736842 - DNA, 21 bp, Homo sapiens
gtaatgtagggttatatttgg

SEQ ID NO: 736843 - DNA, 16 bp, Homo sapiens
gtaatgtcactgtttt

SEQ ID NO: 736844 - DNA, 12 bp, Homo sapiens
gtaatgtcagac

SEQ ID NO: 736845 - DNA, 14 bp, Homo sapiens
gtaatgtgaataaa

SEQ ID NO: 736846 - DNA, 16 bp, Homo sapiens
gtaatgtgaataaatt

SEQ ID NO: 736847 - DNA, 18 bp, Homo sapiens
gtaatgtgtggtggcctc

SEQ ID NO: 736848 - DNA, 20 bp, Homo sapiens
gtaatgttaatgttatatca

SEQ ID NO: 736849 - DNA, 13 bp, Homo sapiens
gtaatgttactga

SEQ ID NO: 736850 - DNA, 17 bp, Homo sapiens
gtaatgttactgatcat

SEQ ID NO: 736851 - DNA, 13 bp, Homo sapiens
gtaattaaaagac

SEQ ID NO: 736852 - DNA, 19 bp, Homo sapiens
gtaattaaaagactccaca

SEQ ID NO: 736853 - DNA, 18 bp, Homo sapiens
gtaattaaaagcaaatca

SEQ ID NO: 736854 - DNA, 21 bp, Homo sapiens
gtaattaaaagcaaatcattt

SEQ ID NO: 736855 - DNA, 16 bp, Homo sapiens
gtaattaaactgttaa

SEQ ID NO: 736856 - DNA, 17 bp, Homo sapiens
tggagggatgcccccag

SEQ ID NO: 736857 - DNA, 22 bp, Homo sapiens
tggagggatgcccccaggcagc

SEQ ID NO: 736858 - DNA, 20 bp, Homo sapiens
tggagggcacttcaggtccg

SEQ ID NO: 736859 - DNA, 21 bp, Homo sapiens
tggagggcacttcctccacag

SEQ ID NO: 736860 - DNA, 13 bp, Homo sapiens
tggagggctcagg

SEQ ID NO: 736861 - DNA, 20 bp, Homo sapiens
tggagggcttggcccagcgc

SEQ ID NO: 736862 - DNA, 13 bp, Homo sapiens
tggaggggcagag

SEQ ID NO: 736863 - DNA, 20 bp, Homo sapiens
tggaggggcagcctgtgcct

SEQ ID NO: 736864 - DNA, 11 bp, Homo sapiens
tggaggggtgt

SEQ ID NO: 736865 - DNA, 18 bp, Homo sapiens
tggaggggtgtggcagtg

SEQ ID NO: 736866 - DNA, 19 bp, Homo sapiens
tggaggggtgtggcagtgg

SEQ ID NO: 736867 - DNA, 23 bp, Homo sapiens
tggaggggtgtggctccttccca

SEQ ID NO: 736868 - DNA, 16 bp, Homo sapiens
tggagggtctgggggc

SEQ ID NO: 736869 - DNA, 20 bp, Homo sapiens
tggagggtctgggggcagct

SEQ ID NO: 736870 - DNA, 22 bp, Homo sapiens
tggagggtctgggggcagctgt

SEQ ID NO: 736871 - DNA, 18 bp, Homo sapiens
tggaggtactgagacagg

SEQ ID NO: 736872 - DNA, 21 bp, Homo sapiens
tggaggtagttgggtagaaaa

SEQ ID NO: 736873 - DNA, 15 bp, Homo sapiens
tggaggtatttgaaa

SEQ ID NO: 736874 - DNA, 18 bp, Homo sapiens
tggaggtcacattcagga

SEQ ID NO: 736875 - DNA, 22 bp, Homo sapiens
tggaggtcacattcaggaagat

SEQ ID NO: 736876 - DNA, 20 bp, Homo sapiens
tggaggtgagatcacagcct

SEQ ID NO: 736877 - DNA, 22 bp, Homo sapiens
tggaggtgagatcacagcctcc

SEQ ID NO: 736878 - DNA, 18 bp, Homo sapiens
tggaggtgctggtagctg

SEQ ID NO: 736879 - DNA, 23 bp, Homo sapiens
tggaggtggaaaagcaacattca

SEQ ID NO: 736880 - DNA, 13 bp, Homo sapiens
tggaggtgggcat

SEQ ID NO: 736881 - DNA, 14 bp, Homo sapiens
tggaggtgggctga

SEQ ID NO: 736882 - DNA, 18 bp, Homo sapiens
tggaggttctcagagcca

SEQ ID NO: 736883 - DNA, 17 bp, Homo sapiens
tggaggttgaagccaag

SEQ ID NO: 736884 - DNA, 18 bp, Homo sapiens
tggaggttgaagccaagt

SEQ ID NO: 736885 - DNA, 14 bp, Homo sapiens
tggagtaattgcac

SEQ ID NO: 736886 - DNA, 16 bp, Homo sapiens
tggagtaattgcacat

SEQ ID NO: 736887 - DNA, 15 bp, Homo sapiens
tggagtactatattt

SEQ ID NO: 736888 - DNA, 16 bp, Homo sapiens
tggagtataatattca

SEQ ID NO: 736889 - DNA, 14 bp, Homo sapiens
tggagtatatgtca

SEQ ID NO: 736890 - DNA, 11 bp, Homo sapiens
tggagtattta

SEQ ID NO: 736891 - DNA, 15 bp, Homo sapiens
tggagtccagctcta

SEQ ID NO: 736892 - DNA, 18 bp, Homo sapiens
tggagtccagctctacta

SEQ ID NO: 736893 - DNA, 15 bp, Homo sapiens
tggagtcccacccgg

SEQ ID NO: 736894 - DNA, 14 bp, Homo sapiens
tggagtcccctcac

SEQ ID NO: 736895 - DNA, 15 bp, Homo sapiens
tggagtcctctccag

SEQ ID NO: 736896 - DNA, 23 bp, Homo sapiens
tggagtcctctccagagaggctc

SEQ ID NO: 736897 - DNA, 19 bp, Homo sapiens
tggagtctatgcttaaaaa

SEQ ID NO: 736898 - DNA, 15 bp, Homo sapiens
tggagtctccagatg

SEQ ID NO: 736899 - DNA, 13 bp, Homo sapiens
tggagtctccagt

SEQ ID NO: 736900 - DNA, 16 bp, Homo sapiens
tggagtcttgtgccaa

SEQ ID NO: 736901 - DNA, 21 bp, Homo sapiens
tggagtcttttctgttattgt

SEQ ID NO: 736902 - DNA, 20 bp, Homo sapiens
gtaccccagcctcgttggag

SEQ ID NO: 736903 - DNA, 19 bp, Homo sapiens
gtaccctctcagctccagg

SEQ ID NO: 736904 - DNA, 17 bp, Homo sapiens
gtacctagctggctctg

SEQ ID NO: 736905 - DNA, 14 bp, Homo sapiens
gtacctataaagta

SEQ ID NO: 736906 - DNA, 18 bp, Homo sapiens
gtacctatagaaatagaa

SEQ ID NO: 736907 - DNA, 13 bp, Homo sapiens
gtacctatttctg

SEQ ID NO: 736908 - DNA, 16 bp, Homo sapiens
gtacctatttctgatg

SEQ ID NO: 736909 - DNA, 21 bp, Homo sapiens
gtacctatttctgatgatgtc

SEQ ID NO: 736910 - DNA, 14 bp, Homo sapiens
gtacctcaaagtaa

SEQ ID NO: 736911 - DNA, 18 bp, Homo sapiens
gtacctccagtcacactc

SEQ ID NO: 736912 - DNA, 15 bp, Homo sapiens
gtacctcccctgcct

SEQ ID NO: 736913 - DNA, 17 bp, Homo sapiens
gtacctcccctgccttg

SEQ ID NO: 736914 - DNA, 18 bp, Homo sapiens
gtacctcccctgccttgc

SEQ ID NO: 736915 - DNA, 16 bp, Homo sapiens
gtacctcctctcagtg

SEQ ID NO: 736916 - DNA, 18 bp, Homo sapiens
gtacctcctctcagtgtt

SEQ ID NO: 736917 - DNA, 22 bp, Homo sapiens
gtacctctcaagctagtgtttc

SEQ ID NO: 736918 - DNA, 18 bp, Homo sapiens
gtacctctgtatagaaat

SEQ ID NO: 736919 - DNA, 22 bp, Homo sapiens
gtacctcttgagccttgaactt

SEQ ID NO: 736920 - DNA, 14 bp, Homo sapiens
gtacctgaaaagta

SEQ ID NO: 736921 - DNA, 15 bp, Homo sapiens
gtacctgatgtacct

SEQ ID NO: 736922 - DNA, 17 bp, Homo sapiens
gtacctgcccccaatcc

SEQ ID NO: 736923 - DNA, 12 bp, Homo sapiens
gtacctgctgcc

SEQ ID NO: 736924 - DNA, 12 bp, Homo sapiens
gtacctgggaaa

SEQ ID NO: 736925 - DNA, 22 bp, Homo sapiens
gtacctgggaaaggacccaccc

SEQ ID NO: 736926 - DNA, 16 bp, Homo sapiens
gtaccttcagccctgg

SEQ ID NO: 736927 - DNA, 17 bp, Homo sapiens
gtaccttcagccctggc

SEQ ID NO: 736928 - DNA, 16 bp, Homo sapiens
gtaccttcatgtgatt

SEQ ID NO: 736929 - DNA, 22 bp, Homo sapiens
gtaccttccatacacagaggag

SEQ ID NO: 736930 - DNA, 14 bp, Homo sapiens
gtaccttgaacact

SEQ ID NO: 736931 - DNA, 13 bp, Homo sapiens
gtacctttgtcac

SEQ ID NO: 736932 - DNA, 21 bp, Homo sapiens
gtaccttttgaggagccccag

SEQ ID NO: 736933 - DNA, 23 bp, Homo sapiens
gtaccttttgaggagccccagct

SEQ ID NO: 736934 - DNA, 13 bp, Homo sapiens
gtacgcccaggac

SEQ ID NO: 736935 - DNA, 15 bp, Homo sapiens
gtacgcccaggacag

SEQ ID NO: 736936 - DNA, 20 bp, Homo sapiens
gtacgcccaggacagctggt

SEQ ID NO: 736937 - DNA, 15 bp, Homo sapiens
gtacggcaaccacat

SEQ ID NO: 736938 - DNA, 20 bp, Homo sapiens
gtacggcaaccacatgtccc

SEQ ID NO: 736939 - DNA, 16 bp, Homo sapiens
gtacgtactgcatttg

SEQ ID NO: 736940 - DNA, 12 bp, Homo sapiens
gtacgtcccagc

SEQ ID NO: 736941 - DNA, 14 bp, Homo sapiens
gtacgttgtgcatt

SEQ ID NO: 736942 - DNA, 14 bp, Homo sapiens
gtacgtttgtatgt

SEQ ID NO: 736943 - DNA, 16 bp, Homo sapiens
gtactaagccaggagg

SEQ ID NO: 736944 - DNA, 12 bp, Homo sapiens
gtactaatctga

SEQ ID NO: 736945 - DNA, 14 bp, Homo sapiens
gtactacgcaagcc

SEQ ID NO: 736946 - DNA, 15 bp, Homo sapiens
gtactactagatgtc

SEQ ID NO: 736947 - DNA, 14 bp, Homo sapiens
gtactagagatatt

SEQ ID NO: 736948 - DNA, 21 bp, Homo sapiens
gtactagagatattttgtaaa

SEQ ID NO: 736949 - DNA, 21 bp, Homo sapiens
gtactaggttggacagccccc

SEQ ID NO: 736950 - DNA, 16 bp, Homo sapiens
gtactagttacacatc

SEQ ID NO: 736951 - DNA, 13 bp, Homo sapiens
gtactagttttag

SEQ ID NO: 736952 - DNA, 15 bp, Homo sapiens
gtactatgtatcaat

SEQ ID NO: 736953 - DNA, 16 bp, Homo sapiens
gtactatgttaataac

SEQ ID NO: 736954 - DNA, 14 bp, Homo sapiens
gtactcacttttca

SEQ ID NO: 736955 - DNA, 15 bp, Homo sapiens
gtactcagagcagag

SEQ ID NO: 736956 - DNA, 16 bp, Homo sapiens
gtactcagagcagagc

SEQ ID NO: 736957 - DNA, 17 bp, Homo sapiens
gtactcagagcagagca

SEQ ID NO: 736958 - DNA, 21 bp, Homo sapiens
gtactcagtatagcattgaac

SEQ ID NO: 736959 - DNA, 14 bp, Homo sapiens
gtactcattaaaaa

SEQ ID NO: 736960 - DNA, 16 bp, Homo sapiens
gtactccagcctgggt

SEQ ID NO: 736961 - DNA, 16 bp, Homo sapiens
gtactcctgcaaaatt

SEQ ID NO: 736962 - DNA, 15 bp, Homo sapiens
gtactcggcttcctg

SEQ ID NO: 736963 - DNA, 19 bp, Homo sapiens
gtactcgttggatgtctgt

SEQ ID NO: 736964 - DNA, 18 bp, Homo sapiens
gtactctaatcagtcctt

SEQ ID NO: 736965 - DNA, 16 bp, Homo sapiens
gtactctcacatgtgg

SEQ ID NO: 736966 - DNA, 11 bp, Homo sapiens
gtactctccta

SEQ ID NO: 736967 - DNA, 23 bp, Homo sapiens
gtactctcctagagacagaagca

SEQ ID NO: 736968 - DNA, 14 bp, Homo sapiens
gtactcttgctgat

SEQ ID NO: 736969 - DNA, 22 bp, Homo sapiens
gtactgaaagccttagggaagc

SEQ ID NO: 736970 - DNA, 19 bp, Homo sapiens
gtactgaatttttttgtaa

SEQ ID NO: 736971 - DNA, 14 bp, Homo sapiens
gtactgactttgct

SEQ ID NO: 736972 - DNA, 12 bp, Homo sapiens
gtactgagattt

SEQ ID NO: 736973 - DNA, 14 bp, Homo sapiens
gtactgatttcagt

SEQ ID NO: 736974 - DNA, 22 bp, Homo sapiens
gtactgcatttgccccttgagc

SEQ ID NO: 736975 - DNA, 21 bp, Homo sapiens
gtactgcccaaataggaggaa

SEQ ID NO: 736976 - DNA, 12 bp, Homo sapiens
gtactggaataa

SEQ ID NO: 736977 - DNA, 14 bp, Homo sapiens
gtactggcatggta

SEQ ID NO: 736978 - DNA, 12 bp, Homo sapiens
gtactggccagt

SEQ ID NO: 736979 - DNA, 18 bp, Homo sapiens
gtagcaatggccagagcc

SEQ ID NO: 736980 - DNA, 12 bp, Homo sapiens
gtagcaatgtgc

SEQ ID NO: 736981 - DNA, 20 bp, Homo sapiens
gtagcacatgtctgtcctca

SEQ ID NO: 736982 - DNA, 12 bp, Homo sapiens
gtagcacgctgc

SEQ ID NO: 736983 - DNA, 17 bp, Homo sapiens
gtagcagcaggctcagg

SEQ ID NO: 736984 - DNA, 11 bp, Homo sapiens
gtagcagctgg

SEQ ID NO: 736985 - DNA, 12 bp, Homo sapiens
gtagcagctgga

SEQ ID NO: 736986 - DNA, 13 bp, Homo sapiens
gtagcagctggac

SEQ ID NO: 736987 - DNA, 14 bp, Homo sapiens
gtagcagctggact

SEQ ID NO: 736988 - DNA, 12 bp, Homo sapiens
gtagcaggggaa

SEQ ID NO: 736989 - DNA, 18 bp, Homo sapiens
gtagcataactgtagctc

SEQ ID NO: 736990 - DNA, 13 bp, Homo sapiens
gtagcatacattt

SEQ ID NO: 736991 - DNA, 20 bp, Homo sapiens
gtagcatgggtccaagagac

SEQ ID NO: 736992 - DNA, 21 bp, Homo sapiens
gtagcatgttgagccaggcct

SEQ ID NO: 736993 - DNA, 15 bp, Homo sapiens
gtagcattgaaaaat

SEQ ID NO: 736994 - DNA, 15 bp, Homo sapiens
gtagcattgttccac

SEQ ID NO: 736995 - DNA, 16 bp, Homo sapiens
gtagcattgttccaca

SEQ ID NO: 736996 - DNA, 21 bp, Homo sapiens
gtagcattttcctgtttactg

SEQ ID NO: 736997 - DNA, 19 bp, Homo sapiens
gtagccaaggtgggctgag

SEQ ID NO: 736998 - DNA, 15 bp, Homo sapiens
gtagccacagctgct

SEQ ID NO: 736999 - DNA, 13 bp, Homo sapiens
gtagccagctgtg

SEQ ID NO: 737000 - DNA, 23 bp, Homo sapiens
gtagccagggtgtggccctgcca

SEQ ID NO: 737001 - DNA, 17 bp, Homo sapiens
gtagccagttaaggaaa

SEQ ID NO: 737002 - DNA, 18 bp, Homo sapiens
gtagccagttaaggaaag

SEQ ID NO: 737003 - DNA, 20 bp, Homo sapiens
gtagccagttaaggaaagaa

SEQ ID NO: 737004 - DNA, 23 bp, Homo sapiens
gtagccatcccatgaacacactg

SEQ ID NO: 737005 - DNA, 23 bp, Homo sapiens
gtagccatgatttgtcccagcct

SEQ ID NO: 737006 - DNA, 22 bp, Homo sapiens
gtagccatggctcaggcaagcc

SEQ ID NO: 737007 - DNA, 13 bp, Homo sapiens
gtagccatggctg

SEQ ID NO: 737008 - DNA, 17 bp, Homo sapiens
gtagcccatccttccct

SEQ ID NO: 737009 - DNA, 15 bp, Homo sapiens
gtagccccagtgaca

SEQ ID NO: 737010 - DNA, 23 bp, Homo sapiens
gtagcctaaaacgaatggtcttt

SEQ ID NO: 737011 - DNA, 15 bp, Homo sapiens
gtagcctaaagggca

SEQ ID NO: 737012 - DNA, 22 bp, Homo sapiens
gtagcctggatattattcttgt

SEQ ID NO: 737013 - DNA, 22 bp, Homo sapiens
gtagccttgatttgttcttaca

SEQ ID NO: 737014 - DNA, 15 bp, Homo sapiens
gtagccttgcccgga

SEQ ID NO: 737015 - DNA, 23 bp, Homo sapiens
gtagccttgcccggattctggga

SEQ ID NO: 737016 - DNA, 15 bp, Homo sapiens
gtagcgaccccagac

SEQ ID NO: 737017 - DNA, 16 bp, Homo sapiens
gtagcgaccccagact

SEQ ID NO: 737018 - DNA, 15 bp, Homo sapiens
gtagcgagctgctct

SEQ ID NO: 737019 - DNA, 21 bp, Homo sapiens
gtagcggaaaagttgtcttaa

SEQ ID NO: 737020 - DNA, 16 bp, Homo sapiens
gtagcgtcctgaggaa

SEQ ID NO: 737021 - DNA, 17 bp, Homo sapiens
gtagcgttttttaaatg

SEQ ID NO: 737022 - DNA, 18 bp, Homo sapiens
gtagctagcgtgtgccag

SEQ ID NO: 737023 - DNA, 21 bp, Homo sapiens
gtagctagcgtgtgccaggca

SEQ ID NO: 737024 - DNA, 12 bp, Homo sapiens
gtagctattttt

SEQ ID NO: 737025 - DNA, 15 bp, Homo sapiens
gtagctatttttctt

SEQ ID NO: 737026 - DNA, 17 bp, Homo sapiens
gtagctcaagtttaaaa

SEQ ID NO: 737027 - DNA, 10 bp, Homo sapiens
gtagctcagt

SEQ ID NO: 737028 - DNA, 11 bp, Homo sapiens
gtagctcagtc

SEQ ID NO: 737029 - DNA, 23 bp, Homo sapiens
gtagctcctcaactcacctaatg

SEQ ID NO: 737030 - DNA, 12 bp, Homo sapiens
gtagctcctgga

SEQ ID NO: 737031 - DNA, 22 bp, Homo sapiens
gtagctctaggagggctggcaa

SEQ ID NO: 737032 - DNA, 17 bp, Homo sapiens
gtagctgagctgtgaca

SEQ ID NO: 737033 - DNA, 13 bp, Homo sapiens
gtagctgctacct

SEQ ID NO: 737034 - DNA, 14 bp, Homo sapiens
tggatgctgagctg

SEQ ID NO: 737035 - DNA, 18 bp, Homo sapiens
tggatggaacgggcatgg

SEQ ID NO: 737036 - DNA, 12 bp, Homo sapiens
tggatggacaga

SEQ ID NO: 737037 - DNA, 14 bp, Homo sapiens
tggatggacttgta

SEQ ID NO: 737038 - DNA, 14 bp, Homo sapiens
tggatggcagactc

SEQ ID NO: 737039 - DNA, 16 bp, Homo sapiens
tggatggccccagcac

SEQ ID NO: 737040 - DNA, 17 bp, Homo sapiens
tggatggccccagcaca

SEQ ID NO: 737041 - DNA, 21 bp, Homo sapiens
tggatggccccagcacagctt

SEQ ID NO: 737042 - DNA, 19 bp, Homo sapiens
tggatggcccctccttgca

SEQ ID NO: 737043 - DNA, 13 bp, Homo sapiens
tggatggcttcta

SEQ ID NO: 737044 - DNA, 17 bp, Homo sapiens
tggatgggagtgagaca

SEQ ID NO: 737045 - DNA, 17 bp, Homo sapiens
tggatgggagtgggcac

SEQ ID NO: 737046 - DNA, 23 bp, Homo sapiens
tggatgggagtgggcacctcaga

SEQ ID NO: 737047 - DNA, 18 bp, Homo sapiens
tggatgggcattgggctg

SEQ ID NO: 737048 - DNA, 23 bp, Homo sapiens
tggatgggcattgggctgacacc

SEQ ID NO: 737049 - DNA, 21 bp, Homo sapiens
tggatggggctggcatgtttt

SEQ ID NO: 737050 - DNA, 20 bp, Homo sapiens
tggatgggggtgcaggcagc

SEQ ID NO: 737051 - DNA, 17 bp, Homo sapiens
tggatgggtggatggcc

SEQ ID NO: 737052 - DNA, 12 bp, Homo sapiens
tggatggtttgt

SEQ ID NO: 737053 - DNA, 13 bp, Homo sapiens
tggatgtcattgt

SEQ ID NO: 737054 - DNA, 18 bp, Homo sapiens
tggatgtcccctgtccca

SEQ ID NO: 737055 - DNA, 14 bp, Homo sapiens
tggatgtgtggggc

SEQ ID NO: 737056 - DNA, 15 bp, Homo sapiens
tggatgtgttcattc

SEQ ID NO: 737057 - DNA, 15 bp, Homo sapiens
tggatgttactctct

SEQ ID NO: 737058 - DNA, 21 bp, Homo sapiens
tggatgttagcctgcaaacaa

SEQ ID NO: 737059 - DNA, 19 bp, Homo sapiens
tggatgttatgaacagctg

SEQ ID NO: 737060 - DNA, 17 bp, Homo sapiens
tggatgttgtaaataaa

SEQ ID NO: 737061 - DNA, 13 bp, Homo sapiens
tggattaaaacaa

SEQ ID NO: 737062 - DNA, 14 bp, Homo sapiens
tggattaaatacat

SEQ ID NO: 737063 - DNA, 18 bp, Homo sapiens
tggattaaggaagactga

SEQ ID NO: 737064 - DNA, 19 bp, Homo sapiens
tggattaatgttttgtaca

SEQ ID NO: 737065 - DNA, 19 bp, Homo sapiens
tggattataaaaaatgtaa

SEQ ID NO: 737066 - DNA, 22 bp, Homo sapiens
tggattatgttgacattttctt

SEQ ID NO: 737067 - DNA, 13 bp, Homo sapiens
tggattattcatt

SEQ ID NO: 737068 - DNA, 16 bp, Homo sapiens
tggattattcatttaa

SEQ ID NO: 737069 - DNA, 13 bp, Homo sapiens
tggattcagcctt

SEQ ID NO: 737070 - DNA, 14 bp, Homo sapiens
tggattcagccttc

SEQ ID NO: 737071 - DNA, 13 bp, Homo sapiens
tggattcatttcc

SEQ ID NO: 737072 - DNA, 20 bp, Homo sapiens
tggattcatttcctgccctt

SEQ ID NO: 737073 - DNA, 20 bp, Homo sapiens
tggattcccccccctttcct

SEQ ID NO: 737074 - DNA, 21 bp, Homo sapiens
tggattcccccccctttccta

SEQ ID NO: 737075 - DNA, 19 bp, Homo sapiens
tggattcccttttgactct

SEQ ID NO: 737076 - DNA, 23 bp, Homo sapiens
tggattcctaaatattttcaaga

SEQ ID NO: 737077 - DNA, 13 bp, Homo sapiens
tggattctcagat

SEQ ID NO: 737078 - DNA, 19 bp, Homo sapiens
tggattctcagatatttat

SEQ ID NO: 737079 - DNA, 17 bp, Homo sapiens
tggattctccctgggcc

SEQ ID NO: 737080 - DNA, 21 bp, Homo sapiens
tggattctcttagctactgta

SEQ ID NO: 737081 - DNA, 14 bp, Homo sapiens
tggattctgaatct

SEQ ID NO: 737082 - DNA, 20 bp, Homo sapiens
tggattctgaggccctgccc

SEQ ID NO: 737083 - DNA, 23 bp, Homo sapiens
tggattctgggaggcaagaaaag

SEQ ID NO: 737084 - DNA, 18 bp, Homo sapiens
tggattcttttcatcaaa

SEQ ID NO: 737085 - DNA, 17 bp, Homo sapiens
tggattgcacgtggcct

SEQ ID NO: 737086 - DNA, 14 bp, Homo sapiens
tggattgccacagc

SEQ ID NO: 737087 - DNA, 19 bp, Homo sapiens
tggattgcgcctttgtatt

SEQ ID NO: 737088 - DNA, 16 bp, Homo sapiens
tggatttaaaagcctg

SEQ ID NO: 737089 - DNA, 20 bp, Homo sapiens
tggatttaaaagcctgctca

SEQ ID NO: 737090 - DNA, 15 bp, Homo sapiens
tggatttaacagaaa

SEQ ID NO: 737091 - DNA, 20 bp, Homo sapiens
tggatttaacagaaatgtac

SEQ ID NO: 737092 - DNA, 24 bp, Homo sapiens
tggatttaacagaaatgtacagca

SEQ ID NO: 737093 - DNA, 20 bp, Homo sapiens
tggatttagaaaaaaacatg

SEQ ID NO: 737094 - DNA, 15 bp, Homo sapiens
tggatttagtttcag

SEQ ID NO: 737095 - DNA, 20 bp, Homo sapiens
tggatttataaatgctattt

SEQ ID NO: 737096 - DNA, 23 bp, Homo sapiens
tggatttatagtatgtgactttt

SEQ ID NO: 737097 - DNA, 15 bp, Homo sapiens
tggatttctttgaaa

SEQ ID NO: 737098 - DNA, 19 bp, Homo sapiens
tggatttctttgaaaaaaa

SEQ ID NO: 737099 - DNA, 14 bp, Homo sapiens
tggatttgacattg

SEQ ID NO: 737100 - DNA, 23 bp, Homo sapiens
tggatttgattcattttcctgtt

SEQ ID NO: 737101 - DNA, 17 bp, Homo sapiens
tggcagcccggctgctg

SEQ ID NO: 737102 - DNA, 14 bp, Homo sapiens
tggcagccgagctc

SEQ ID NO: 737103 - DNA, 17 bp, Homo sapiens
tggcagccgtcccaggc

SEQ ID NO: 737104 - DNA, 20 bp, Homo sapiens
tggcagccgtcccaggccac

SEQ ID NO: 737105 - DNA, 18 bp, Homo sapiens
tggcagccgtgccttcag

SEQ ID NO: 737106 - DNA, 22 bp, Homo sapiens
tggcagccgtgccttcagctct

SEQ ID NO: 737107 - DNA, 19 bp, Homo sapiens
tggcagcctcccatccagg

SEQ ID NO: 737108 - DNA, 20 bp, Homo sapiens
tggcagctagactggagtga

SEQ ID NO: 737109 - DNA, 16 bp, Homo sapiens
tggcagctagtgcctt

SEQ ID NO: 737110 - DNA, 16 bp, Homo sapiens
tggcagctcaaagact

SEQ ID NO: 737111 - DNA, 14 bp, Homo sapiens
tggcagctcctctc

SEQ ID NO: 737112 - DNA, 18 bp, Homo sapiens
tggcagctcctctccttg

SEQ ID NO: 737113 - DNA, 23 bp, Homo sapiens
tggcagctcctctccttgggctc

SEQ ID NO: 737114 - DNA, 13 bp, Homo sapiens
tggcagctctcca

SEQ ID NO: 737115 - DNA, 16 bp, Homo sapiens
tggcagctgccccagg

SEQ ID NO: 737116 - DNA, 16 bp, Homo sapiens
tggcagctgcccctcc

SEQ ID NO: 737117 - DNA, 20 bp, Homo sapiens
tggcagctgcccctcctgga

SEQ ID NO: 737118 - DNA, 13 bp, Homo sapiens
tggcagctgctgt

SEQ ID NO: 737119 - DNA, 14 bp, Homo sapiens
tggcagctgctgtg

SEQ ID NO: 737120 - DNA, 15 bp, Homo sapiens
tggcagctgctgtgg

SEQ ID NO: 737121 - DNA, 18 bp, Homo sapiens
tggcagctggaccatctc

SEQ ID NO: 737122 - DNA, 13 bp, Homo sapiens
tggcagctgtccc

SEQ ID NO: 737123 - DNA, 14 bp, Homo sapiens
tggcagctgtcccc

SEQ ID NO: 737124 - DNA, 21 bp, Homo sapiens
tggcaggacacacatggtgag

SEQ ID NO: 737125 - DNA, 19 bp, Homo sapiens
tggcaggacacatcccggc

SEQ ID NO: 737126 - DNA, 16 bp, Homo sapiens
tggcaggactcctggc

SEQ ID NO: 737127 - DNA, 21 bp, Homo sapiens
tggcaggactcctggcagggc

SEQ ID NO: 737128 - DNA, 19 bp, Homo sapiens
tggcaggcacacagcagcc

SEQ ID NO: 737129 - DNA, 12 bp, Homo sapiens
tggcaggcccac

SEQ ID NO: 737130 - DNA, 16 bp, Homo sapiens
tggcaggcccactccc

SEQ ID NO: 737131 - DNA, 18 bp, Homo sapiens
tggcaggcccactcccca

SEQ ID NO: 737132 - DNA, 14 bp, Homo sapiens
tggcaggctgggtg

SEQ ID NO: 737133 - DNA, 13 bp, Homo sapiens
tggcaggcttccc

SEQ ID NO: 737134 - DNA, 19 bp, Homo sapiens
tggcagggccacctgcagg

SEQ ID NO: 737135 - DNA, 17 bp, Homo sapiens
tggcagggccagggcaa

SEQ ID NO: 737136 - DNA, 18 bp, Homo sapiens
tggcagggccagggcaat

SEQ ID NO: 737137 - DNA, 14 bp, Homo sapiens
tggcagggcctcat

SEQ ID NO: 737138 - DNA, 17 bp, Homo sapiens
tggcagggctcacactc

SEQ ID NO: 737139 - DNA, 18 bp, Homo sapiens
tggcagggctcacactcc

SEQ ID NO: 737140 - DNA, 18 bp, Homo sapiens
tggcagggggccccgcca

SEQ ID NO: 737141 - DNA, 17 bp, Homo sapiens
tggcagggtgggatgga

SEQ ID NO: 737142 - DNA, 15 bp, Homo sapiens
tggcaggtcactgtc

SEQ ID NO: 737143 - DNA, 16 bp, Homo sapiens
tggcaggtcactgtca

SEQ ID NO: 737144 - DNA, 17 bp, Homo sapiens
tggcaggtcactgtcac

SEQ ID NO: 737145 - DNA, 18 bp, Homo sapiens
tggcaggtgggctgcctg

SEQ ID NO: 737146 - DNA, 18 bp, Homo sapiens
tggcagtccgtgggacgg

SEQ ID NO: 737147 - DNA, 14 bp, Homo sapiens
tggcagtgactttg

SEQ ID NO: 737148 - DNA, 20 bp, Homo sapiens
tggcagtgactttgtataga

SEQ ID NO: 737149 - DNA, 15 bp, Homo sapiens
tggcagtgcaatgct

SEQ ID NO: 737150 - DNA, 22 bp, Homo sapiens
tggcagtggctctcagagcagc

SEQ ID NO: 737151 - DNA, 12 bp, Homo sapiens
tggcagtggttt

SEQ ID NO: 737152 - DNA, 21 bp, Homo sapiens
tggcagtgttttggttcagac

SEQ ID NO: 737153 - DNA, 23 bp, Homo sapiens
tggcagttaattggatgttcact

SEQ ID NO: 737154 - DNA, 16 bp, Homo sapiens
tggcagtttatattta

SEQ ID NO: 737155 - DNA, 13 bp, Homo sapiens
tggcatacaaaat

SEQ ID NO: 737156 - DNA, 21 bp, Homo sapiens
tggcatacaaaatatttaagt

SEQ ID NO: 737157 - DNA, 22 bp, Homo sapiens
tggcatacgcctgtagtcctag

SEQ ID NO: 737158 - DNA, 15 bp, Homo sapiens
tggcatagctctggg

SEQ ID NO: 737159 - DNA, 21 bp, Homo sapiens
tggcatatttatattgtatat

SEQ ID NO: 737160 - DNA, 23 bp, Homo sapiens
tggcatcaagaggtgggagggcc

SEQ ID NO: 737161 - DNA, 18 bp, Homo sapiens
tggcatcaggtctgggca

SEQ ID NO: 737162 - DNA, 15 bp, Homo sapiens
tggcatcctgtgaag

SEQ ID NO: 737163 - DNA, 21 bp, Homo sapiens
tggcatcgcaccattctgact

SEQ ID NO: 737164 - DNA, 19 bp, Homo sapiens
gtataatctcctctgctca

SEQ ID NO: 737165 - DNA, 21 bp, Homo sapiens
gtataatctttctatagccaa

SEQ ID NO: 737166 - DNA, 23 bp, Homo sapiens
gtataatggttgactgggtttct

SEQ ID NO: 737167 - DNA, 16 bp, Homo sapiens
gtataatgtgtctgtg

SEQ ID NO: 737168 - DNA, 14 bp, Homo sapiens
gtataatgtttaaa

SEQ ID NO: 737169 - DNA, 16 bp, Homo sapiens
gtataatgtttaaatc

SEQ ID NO: 737170 - DNA, 18 bp, Homo sapiens
gtataatgtttattaaat

SEQ ID NO: 737171 - DNA, 15 bp, Homo sapiens
gtataattaacttaa

SEQ ID NO: 737172 - DNA, 18 bp, Homo sapiens
gtataattggatttccta

SEQ ID NO: 737173 - DNA, 22 bp, Homo sapiens
gtataatttgaggtgaaattca

SEQ ID NO: 737174 - DNA, 14 bp, Homo sapiens
gtatacaagtactg

SEQ ID NO: 737175 - DNA, 16 bp, Homo sapiens
gtataccaatgtgttt

SEQ ID NO: 737176 - DNA, 23 bp, Homo sapiens
gtataccaatgtgttttctgtag

SEQ ID NO: 737177 - DNA, 15 bp, Homo sapiens
gtatactatagtacc

SEQ ID NO: 737178 - DNA, 16 bp, Homo sapiens
gtatactcctgtcacc

SEQ ID NO: 737179 - DNA, 12 bp, Homo sapiens
gtatactgtaaa

SEQ ID NO: 737180 - DNA, 17 bp, Homo sapiens
gtatactgtaaaagtta

SEQ ID NO: 737181 - DNA, 13 bp, Homo sapiens
gtatactgtgtgg

SEQ ID NO: 737182 - DNA, 18 bp, Homo sapiens
gtatacttaaaatgacaa

SEQ ID NO: 737183 - DNA, 21 bp, Homo sapiens
gtatacttccttacttttaag

SEQ ID NO: 737184 - DNA, 15 bp, Homo sapiens
gtatagaccaaagca

SEQ ID NO: 737185 - DNA, 18 bp, Homo sapiens
gtatagatgcaagatatt

SEQ ID NO: 737186 - DNA, 15 bp, Homo sapiens
gtatagatggccaaa

SEQ ID NO: 737187 - DNA, 17 bp, Homo sapiens
gtataggccatctgtaa

SEQ ID NO: 737188 - DNA, 19 bp, Homo sapiens
gtatagtactggcatggta

SEQ ID NO: 737189 - DNA, 14 bp, Homo sapiens
gtatagtagaaaga

SEQ ID NO: 737190 - DNA, 21 bp, Homo sapiens
gtatagtattggaaaataaaa

SEQ ID NO: 737191 - DNA, 18 bp, Homo sapiens
gtatagtgcctaaaattg

SEQ ID NO: 737192 - DNA, 16 bp, Homo sapiens
gtatagtgtaaaataa

SEQ ID NO: 737193 - DNA, 17 bp, Homo sapiens
gtatagtgttcacaaac

SEQ ID NO: 737194 - DNA, 22 bp, Homo sapiens
gtatagttatatgtacagttta

SEQ ID NO: 737195 - DNA, 13 bp, Homo sapiens
gtatataataact

SEQ ID NO: 737196 - DNA, 17 bp, Homo sapiens
gtatataataactttat

SEQ ID NO: 737197 - DNA, 22 bp, Homo sapiens
gtatataataactttattgcat

SEQ ID NO: 737198 - DNA, 17 bp, Homo sapiens
gtatataatcatgctca

SEQ ID NO: 737199 - DNA, 19 bp, Homo sapiens
gtatataatttactttgta

SEQ ID NO: 737200 - DNA, 23 bp, Homo sapiens
gtatatacacccaagatgggcat

SEQ ID NO: 737201 - DNA, 11 bp, Homo sapiens
gtatatacatt

SEQ ID NO: 737202 - DNA, 12 bp, Homo sapiens
gtatatactttg

SEQ ID NO: 737203 - DNA, 12 bp, Homo sapiens
gtatatactttt

SEQ ID NO: 737204 - DNA, 20 bp, Homo sapiens
gtatatagtatatttatact

SEQ ID NO: 737205 - DNA, 23 bp, Homo sapiens
gtatatataaacagaactccctt

SEQ ID NO: 737206 - DNA, 10 bp, Homo sapiens
gtatatatat

SEQ ID NO: 737207 - DNA, 23 bp, Homo sapiens
gtatatatatatagtaactactt

SEQ ID NO: 737208 - DNA, 18 bp, Homo sapiens
gtatatatatatatatgt

SEQ ID NO: 737209 - DNA, 19 bp, Homo sapiens
gtatatatatatatattga

SEQ ID NO: 737210 - DNA, 20 bp, Homo sapiens
gtatatatatgccatgatgg

SEQ ID NO: 737211 - DNA, 22 bp, Homo sapiens
gtatatatatttatatatatga

SEQ ID NO: 737212 - DNA, 11 bp, Homo sapiens
gtatatatctt

SEQ ID NO: 737213 - DNA, 21 bp, Homo sapiens
gtatatatcttataactgttt

SEQ ID NO: 737214 - DNA, 12 bp, Homo sapiens
gtatatatgtgt

SEQ ID NO: 737215 - DNA, 19 bp, Homo sapiens
gtatatatgtgtgtttaaa

SEQ ID NO: 737216 - DNA, 14 bp, Homo sapiens
gtatatattcccaa

SEQ ID NO: 737217 - DNA, 21 bp, Homo sapiens
gtatatattttatatgttcat

SEQ ID NO: 737218 - DNA, 20 bp, Homo sapiens
gtatatcattctacagaata

SEQ ID NO: 737219 - DNA, 18 bp, Homo sapiens
gtatatcctatataggaa

SEQ ID NO: 737220 - DNA, 12 bp, Homo sapiens
gtatatcgttat

SEQ ID NO: 737221 - DNA, 17 bp, Homo sapiens
gtatatgattctctgtg

SEQ ID NO: 737222 - DNA, 17 bp, Homo sapiens
gtatatgcacaaaacta

SEQ ID NO: 737223 - DNA, 19 bp, Homo sapiens
gtatgctttccctgaggaa

SEQ ID NO: 737224 - DNA, 16 bp, Homo sapiens
gtatggaagttttcct

SEQ ID NO: 737225 - DNA, 17 bp, Homo sapiens
gtatggaagttttccta

SEQ ID NO: 737226 - DNA, 13 bp, Homo sapiens
gtatggccatgcc

SEQ ID NO: 737227 - DNA, 15 bp, Homo sapiens
gtatggcccaggcag

SEQ ID NO: 737228 - DNA, 16 bp, Homo sapiens
gtatggcccaggcagc

SEQ ID NO: 737229 - DNA, 14 bp, Homo sapiens
gtatgggggaaggc

SEQ ID NO: 737230 - DNA, 13 bp, Homo sapiens
gtatggtctaaca

SEQ ID NO: 737231 - DNA, 14 bp, Homo sapiens
gtatggttctcaga

SEQ ID NO: 737232 - DNA, 16 bp, Homo sapiens
gtatggttgtatacac

SEQ ID NO: 737233 - DNA, 14 bp, Homo sapiens
gtatgtaaacagga

SEQ ID NO: 737234 - DNA, 16 bp, Homo sapiens
gtatgtaatatttaca

SEQ ID NO: 737235 - DNA, 15 bp, Homo sapiens
gtatgtaatttatgc

SEQ ID NO: 737236 - DNA, 23 bp, Homo sapiens
gtatgtacaatacaatgtacaat

SEQ ID NO: 737237 - DNA, 23 bp, Homo sapiens
gtatgtatataatcatgctcatg

SEQ ID NO: 737238 - DNA, 22 bp, Homo sapiens
gtatgtattattattaaagaaa

SEQ ID NO: 737239 - DNA, 13 bp, Homo sapiens
gtatgtattattt

SEQ ID NO: 737240 - DNA, 20 bp, Homo sapiens
gtatgtcagtggtttctact

SEQ ID NO: 737241 - DNA, 23 bp, Homo sapiens
gtatgtcagtggtttctacttcc

SEQ ID NO: 737242 - DNA, 17 bp, Homo sapiens
gtatgtccttcagctga

SEQ ID NO: 737243 - DNA, 13 bp, Homo sapiens
gtatgtctgccat

SEQ ID NO: 737244 - DNA, 19 bp, Homo sapiens
gtatgtgacttttctgatt

SEQ ID NO: 737245 - DNA, 14 bp, Homo sapiens
gtatgtgatggact

SEQ ID NO: 737246 - DNA, 12 bp, Homo sapiens
gtatgtgccagg

SEQ ID NO: 737247 - DNA, 19 bp, Homo sapiens
gtatgtgccaggcttgcct

SEQ ID NO: 737248 - DNA, 20 bp, Homo sapiens
gtatgtgctatacacacaca

SEQ ID NO: 737249 - DNA, 17 bp, Homo sapiens
gtatgtgtatgtgtgtg

SEQ ID NO: 737250 - DNA, 14 bp, Homo sapiens
gtatgtgtggctgt

SEQ ID NO: 737251 - DNA, 16 bp, Homo sapiens
gtatgtgtggctgtgg

SEQ ID NO: 737252 - DNA, 13 bp, Homo sapiens
gtatgtgtgtaga

SEQ ID NO: 737253 - DNA, 17 bp, Homo sapiens
gtatgtgtgtgagtgtg

SEQ ID NO: 737254 - DNA, 18 bp, Homo sapiens
gtatgttaagctctttat

SEQ ID NO: 737255 - DNA, 21 bp, Homo sapiens
gtatgttatgatattgtttaa

SEQ ID NO: 737256 - DNA, 22 bp, Homo sapiens
gtatgttcctaaggtcatttct

SEQ ID NO: 737257 - DNA, 13 bp, Homo sapiens
gtatgttgtacat

SEQ ID NO: 737258 - DNA, 16 bp, Homo sapiens
gtatgttgtacatact

SEQ ID NO: 737259 - DNA, 16 bp, Homo sapiens
gtatgttgtcaaagag

SEQ ID NO: 737260 - DNA, 17 bp, Homo sapiens
gtatgttgtcaaagaga

SEQ ID NO: 737261 - DNA, 21 bp, Homo sapiens
gtatgttgtccaattgttgac

SEQ ID NO: 737262 - DNA, 19 bp, Homo sapiens
gtatgtttaatctgttatg

SEQ ID NO: 737263 - DNA, 17 bp, Homo sapiens
gtatgtttctctttgat

SEQ ID NO: 737264 - DNA, 20 bp, Homo sapiens
gtatgtttgctgattattta

SEQ ID NO: 737265 - DNA, 16 bp, Homo sapiens
gtatgttttagcatgt

SEQ ID NO: 737266 - DNA, 15 bp, Homo sapiens
gtatgttttatatca

SEQ ID NO: 737267 - DNA, 17 bp, Homo sapiens
gtatgttttatatcaaa

SEQ ID NO: 737268 - DNA, 15 bp, Homo sapiens
gtatgtttttacatt

SEQ ID NO: 737269 - DNA, 20 bp, Homo sapiens
gtatgtttttacattatgca

SEQ ID NO: 737270 - DNA, 13 bp, Homo sapiens
gtattaaatctta

SEQ ID NO: 737271 - DNA, 13 bp, Homo sapiens
gtattaaatgcca

SEQ ID NO: 737272 - DNA, 15 bp, Homo sapiens
gtattaagaaaggaa

SEQ ID NO: 737273 - DNA, 13 bp, Homo sapiens
gtattaagccaat

SEQ ID NO: 737274 - DNA, 19 bp, Homo sapiens
gtattaagcccacagtata

SEQ ID NO: 737275 - DNA, 15 bp, Homo sapiens
gtattaataaaaaga

SEQ ID NO: 737276 - DNA, 13 bp, Homo sapiens
gtattaatcttgt

SEQ ID NO: 737277 - DNA, 16 bp, Homo sapiens
gtattacatgactgtt

SEQ ID NO: 737278 - DNA, 14 bp, Homo sapiens
gtattactgctgct

SEQ ID NO: 737279 - DNA, 18 bp, Homo sapiens
gtattacttaggttattt

SEQ ID NO: 737280 - DNA, 20 bp, Homo sapiens
gtattacttaggttattttg

SEQ ID NO: 737281 - DNA, 13 bp, Homo sapiens
gtattaggaaaat

SEQ ID NO: 737282 - DNA, 17 bp, Homo sapiens
gtattagttaaaacaca

SEQ ID NO: 737283 - DNA, 13 bp, Homo sapiens
gtattataattgt

SEQ ID NO: 737284 - DNA, 14 bp, Homo sapiens
gtattatacctttt

SEQ ID NO: 737285 - DNA, 21 bp, Homo sapiens
gtattatcacatcaagcatgc

SEQ ID NO: 737286 - DNA, 13 bp, Homo sapiens
gtattatctaaat

SEQ ID NO: 737287 - DNA, 16 bp, Homo sapiens
gtattatctaaatgaa

SEQ ID NO: 737288 - DNA, 16 bp, Homo sapiens
gtattatgtctcttct

SEQ ID NO: 737289 - DNA, 18 bp, Homo sapiens
gtattatgtgcctaattt

SEQ ID NO: 737290 - DNA, 13 bp, Homo sapiens
gtattattacaaa

SEQ ID NO: 737291 - DNA, 15 bp, Homo sapiens
gtattattctgcagc

SEQ ID NO: 737292 - DNA, 16 bp, Homo sapiens
gtattattctgcagca

SEQ ID NO: 737293 - DNA, 17 bp, Homo sapiens
gtattattctgttttgc

SEQ ID NO: 737294 - DNA, 16 bp, Homo sapiens
gtattatttacattta

SEQ ID NO: 737295 - DNA, 20 bp, Homo sapiens
ggccagtgatgatgttttga

SEQ ID NO: 737296 - DNA, 22 bp, Homo sapiens
ggccagtgcagtttggtgtgtc

SEQ ID NO: 737297 - DNA, 16 bp, Homo sapiens
ggccagtgctgcttct

SEQ ID NO: 737298 - DNA, 23 bp, Homo sapiens
ggccagtggcccccgggcctgca

SEQ ID NO: 737299 - DNA, 14 bp, Homo sapiens
ggccagtgggcctg

SEQ ID NO: 737300 - DNA, 14 bp, Homo sapiens
ggccagtggggcct

SEQ ID NO: 737301 - DNA, 17 bp, Homo sapiens
ggccagtggggcctgtg

SEQ ID NO: 737302 - DNA, 21 bp, Homo sapiens
ggccagtgtcattttattttt

SEQ ID NO: 737303 - DNA, 18 bp, Homo sapiens
ggccagtgttgtgggctt

SEQ ID NO: 737304 - DNA, 14 bp, Homo sapiens
ggccagtgtttaaa

SEQ ID NO: 737305 - DNA, 16 bp, Homo sapiens
ggccagttgatctgct

SEQ ID NO: 737306 - DNA, 20 bp, Homo sapiens
ggccagttgatctgctctgt

SEQ ID NO: 737307 - DNA, 15 bp, Homo sapiens
ggccagtttctctgc

SEQ ID NO: 737308 - DNA, 16 bp, Homo sapiens
ggccagttttctggta

SEQ ID NO: 737309 - DNA, 17 bp, Homo sapiens
ggccataattatgaaaa

SEQ ID NO: 737310 - DNA, 14 bp, Homo sapiens
ggccatactgcctt

SEQ ID NO: 737311 - DNA, 18 bp, Homo sapiens
ggccatagaggcccaggc

SEQ ID NO: 737312 - DNA, 19 bp, Homo sapiens
ggccatatatgctgtattt

SEQ ID NO: 737313 - DNA, 15 bp, Homo sapiens
ggccatcactcagcc

SEQ ID NO: 737314 - DNA, 21 bp, Homo sapiens
ggccatcactcagcccctacc

SEQ ID NO: 737315 - DNA, 14 bp, Homo sapiens
ggccatcagggccc

SEQ ID NO: 737316 - DNA, 22 bp, Homo sapiens
ggccatcagggccctgccccag

SEQ ID NO: 737317 - DNA, 14 bp, Homo sapiens
ggccatcagggtgg

SEQ ID NO: 737318 - DNA, 14 bp, Homo sapiens
ggccatccctgggc

SEQ ID NO: 737319 - DNA, 18 bp, Homo sapiens
ggccatgaatctctgcct

SEQ ID NO: 737320 - DNA, 22 bp, Homo sapiens
ggccatgaatctctgcctctcc

SEQ ID NO: 737321 - DNA, 17 bp, Homo sapiens
ggccatgagctccagac

SEQ ID NO: 737322 - DNA, 14 bp, Homo sapiens
ggccatgcagacct

SEQ ID NO: 737323 - DNA, 18 bp, Homo sapiens
ggccatgcaggaggtgga

SEQ ID NO: 737324 - DNA, 13 bp, Homo sapiens
ggccatgccccac

SEQ ID NO: 737325 - DNA, 23 bp, Homo sapiens
ggccatgccccacccccctcctc

SEQ ID NO: 737326 - DNA, 17 bp, Homo sapiens
ggccatgcctcctcagg

SEQ ID NO: 737327 - DNA, 18 bp, Homo sapiens
ggccatgcctcctcagga

SEQ ID NO: 737328 - DNA, 14 bp, Homo sapiens
ggccatgcctgccc

SEQ ID NO: 737329 - DNA, 16 bp, Homo sapiens
ggccatgctcaacccc

SEQ ID NO: 737330 - DNA, 20 bp, Homo sapiens
ggccatgctcaacccccctc

SEQ ID NO: 737331 - DNA, 22 bp, Homo sapiens
ggccatgctcaacccccctccc

SEQ ID NO: 737332 - DNA, 21 bp, Homo sapiens
ggccatgctgtccctgcactg

SEQ ID NO: 737333 - DNA, 23 bp, Homo sapiens
ggccatggctttcatcctgtgtc

SEQ ID NO: 737334 - DNA, 14 bp, Homo sapiens
ggccatggtggagg

SEQ ID NO: 737335 - DNA, 16 bp, Homo sapiens
ggccatggtggagggc

SEQ ID NO: 737336 - DNA, 17 bp, Homo sapiens
ggccatggtggagggca

SEQ ID NO: 737337 - DNA, 22 bp, Homo sapiens
ggccatggtggagggcacttca

SEQ ID NO: 737338 - DNA, 16 bp, Homo sapiens
ggccatgtcacctggc

SEQ ID NO: 737339 - DNA, 13 bp, Homo sapiens
ggccatgtccaaa

SEQ ID NO: 737340 - DNA, 23 bp, Homo sapiens
ggccatgtgagccaccgctgcca

SEQ ID NO: 737341 - DNA, 13 bp, Homo sapiens
ggccatgtggcct

SEQ ID NO: 737342 - DNA, 17 bp, Homo sapiens
ggccatgtggcctgccc

SEQ ID NO: 737343 - DNA, 19 bp, Homo sapiens
ggccatgtggcctgcccag

SEQ ID NO: 737344 - DNA, 20 bp, Homo sapiens
ggccatgtggcctgcccagc

SEQ ID NO: 737345 - DNA, 20 bp, Homo sapiens
ggccattctgccgccccctc

SEQ ID NO: 737346 - DNA, 13 bp, Homo sapiens
ggccattgggttt

SEQ ID NO: 737347 - DNA, 15 bp, Homo sapiens
ggccatttctaaata

SEQ ID NO: 737348 - DNA, 16 bp, Homo sapiens
ggccatttctaaataa

SEQ ID NO: 737349 - DNA, 18 bp, Homo sapiens
ggccatttgctagttctg

SEQ ID NO: 737350 - DNA, 15 bp, Homo sapiens
ggcccaaaggcccag

SEQ ID NO: 737351 - DNA, 14 bp, Homo sapiens
ggcccaagaactgc

SEQ ID NO: 737352 - DNA, 23 bp, Homo sapiens
ggcccaagaactgcagatagccc

SEQ ID NO: 737353 - DNA, 16 bp, Homo sapiens
ggcccaagccccatct

SEQ ID NO: 737354 - DNA, 18 bp, Homo sapiens
ggcccaagccccatctca

SEQ ID NO: 737355 - DNA, 14 bp, Homo sapiens
ggcccaaggagctt

SEQ ID NO: 737356 - DNA, 21 bp, Homo sapiens
ggcccaaggagcttacccaag

SEQ ID NO: 737357 - DNA, 22 bp, Homo sapiens
ggcccaaggagcttacccaagc

SEQ ID NO: 737358 - DNA, 21 bp, Homo sapiens
ggcccaaggagggtccaggcg

SEQ ID NO: 737359 - DNA, 19 bp, Homo sapiens
ggcccaagggatggcacca

SEQ ID NO: 737360 - DNA, 21 bp, Homo sapiens
ggcccaagggatggcaccact

SEQ ID NO: 737361 - DNA, 19 bp, Homo sapiens
ggcccaagttgcagtgagc

SEQ ID NO: 737362 - DNA, 14 bp, Homo sapiens
ggcccacagctccc

SEQ ID NO: 737363 - DNA, 20 bp, Homo sapiens
ggcccacagctcccacccca

SEQ ID NO: 737364 - DNA, 21 bp, Homo sapiens
ggcccaccagggactgcagct

SEQ ID NO: 737365 - DNA, 22 bp, Homo sapiens
ggcccaccagggactgcagctg

SEQ ID NO: 737366 - DNA, 20 bp, Homo sapiens
ggcccaccccccagcctcca

SEQ ID NO: 737367 - DNA, 14 bp, Homo sapiens
ggcccaccctctgc

SEQ ID NO: 737368 - DNA, 15 bp, Homo sapiens
ggcccaccctctgcc

SEQ ID NO: 737369 - DNA, 20 bp, Homo sapiens
ggcccaccctctgcccaggg

SEQ ID NO: 737370 - DNA, 23 bp, Homo sapiens
ggcccaccctctgcccagggagt

SEQ ID NO: 737371 - DNA, 14 bp, Homo sapiens
ggcccacctggcca

SEQ ID NO: 737372 - DNA, 15 bp, Homo sapiens
ggcccacgaggagca

SEQ ID NO: 737373 - DNA, 19 bp, Homo sapiens
ggcccacgaggagcagcag

SEQ ID NO: 737374 - DNA, 20 bp, Homo sapiens
ggcccacgcgcttccctggg

SEQ ID NO: 737375 - DNA, 17 bp, Homo sapiens
ggcccactagagggccc

SEQ ID NO: 737376 - DNA, 18 bp, Homo sapiens
ggcccactagagggccca

SEQ ID NO: 737377 - DNA, 13 bp, Homo sapiens
ggcccactcccca

SEQ ID NO: 737378 - DNA, 19 bp, Homo sapiens
ggcccactccccagcccca

SEQ ID NO: 737379 - DNA, 23 bp, Homo sapiens
ggcccactgtgcctcagagacca

SEQ ID NO: 737380 - DNA, 16 bp, Homo sapiens
ggcccagaactgcccc

SEQ ID NO: 737381 - DNA, 18 bp, Homo sapiens
ggcccagaactgccccca

SEQ ID NO: 737382 - DNA, 17 bp, Homo sapiens
ggcccagaagtttccct

SEQ ID NO: 737383 - DNA, 16 bp, Homo sapiens
ggcccagagacccctt

SEQ ID NO: 737384 - DNA, 12 bp, Homo sapiens
ggcccagagccc

SEQ ID NO: 737385 - DNA, 14 bp, Homo sapiens
tgataaggggcctt

SEQ ID NO: 737386 - DNA, 22 bp, Homo sapiens
tgataaggggccttgctctgag

SEQ ID NO: 737387 - DNA, 14 bp, Homo sapiens
tgataagtagcatg

SEQ ID NO: 737388 - DNA, 19 bp, Homo sapiens
tgataagttcctttccttt

SEQ ID NO: 737389 - DNA, 13 bp, Homo sapiens
tgataatacttga

SEQ ID NO: 737390 - DNA, 14 bp, Homo sapiens
tgataatacttgac

SEQ ID NO: 737391 - DNA, 21 bp, Homo sapiens
tgataataggtgggggaaaat

SEQ ID NO: 737392 - DNA, 14 bp, Homo sapiens
tgataatatatatt

SEQ ID NO: 737393 - DNA, 18 bp, Homo sapiens
tgataatatattgctaaa

SEQ ID NO: 737394 - DNA, 21 bp, Homo sapiens
tgataatatattgtgttgact

SEQ ID NO: 737395 - DNA, 13 bp, Homo sapiens
tgataatcatttt

SEQ ID NO: 737396 - DNA, 19 bp, Homo sapiens
tgataatcattttgagttt

SEQ ID NO: 737397 - DNA, 18 bp, Homo sapiens
tgataatctggtgacaaa

SEQ ID NO: 737398 - DNA, 13 bp, Homo sapiens
tgataatcttcag

SEQ ID NO: 737399 - DNA, 14 bp, Homo sapiens
tgataatcttcagg

SEQ ID NO: 737400 - DNA, 22 bp, Homo sapiens
tgataatcttcaggtgaacact

SEQ ID NO: 737401 - DNA, 21 bp, Homo sapiens
tgataatgatttgctctttga

SEQ ID NO: 737402 - DNA, 15 bp, Homo sapiens
tgataattctcagta

SEQ ID NO: 737403 - DNA, 23 bp, Homo sapiens
tgataattttatttataaactag

SEQ ID NO: 737404 - DNA, 13 bp, Homo sapiens
tgataattttgct

SEQ ID NO: 737405 - DNA, 18 bp, Homo sapiens
tgatacaaaccactgtga

SEQ ID NO: 737406 - DNA, 19 bp, Homo sapiens
tgatacaaagtacagaaaa

SEQ ID NO: 737407 - DNA, 17 bp, Homo sapiens
tgatacaagattagaag

SEQ ID NO: 737408 - DNA, 18 bp, Homo sapiens
tgatacaatgctgtgccc

SEQ ID NO: 737409 - DNA, 12 bp, Homo sapiens
tgatacacagta

SEQ ID NO: 737410 - DNA, 17 bp, Homo sapiens
tgatacacagtaattgt

SEQ ID NO: 737411 - DNA, 20 bp, Homo sapiens
tgatacacagtaattgtgac

SEQ ID NO: 737412 - DNA, 15 bp, Homo sapiens
tgatacagaactctt

SEQ ID NO: 737413 - DNA, 16 bp, Homo sapiens
tgatacaggcaattca

SEQ ID NO: 737414 - DNA, 16 bp, Homo sapiens
tgatacataaaaatta

SEQ ID NO: 737415 - DNA, 16 bp, Homo sapiens
tgatacatccaaagca

SEQ ID NO: 737416 - DNA, 22 bp, Homo sapiens
tgatacatccaaagcagacagc

SEQ ID NO: 737417 - DNA, 16 bp, Homo sapiens
tgatacattcaaattt

SEQ ID NO: 737418 - DNA, 15 bp, Homo sapiens
tgatacatttacata

SEQ ID NO: 737419 - DNA, 14 bp, Homo sapiens
tgatacatttttgt

SEQ ID NO: 737420 - DNA, 19 bp, Homo sapiens
tgataccacctttactgtg

SEQ ID NO: 737421 - DNA, 17 bp, Homo sapiens
tgataccagaagggaaa

SEQ ID NO: 737422 - DNA, 17 bp, Homo sapiens
tgatacccaacagttta

SEQ ID NO: 737423 - DNA, 20 bp, Homo sapiens
tgatacccaacagtttattt

SEQ ID NO: 737424 - DNA, 19 bp, Homo sapiens
tgataccgaattgtgactc

SEQ ID NO: 737425 - DNA, 12 bp, Homo sapiens
tgataccttagg

SEQ ID NO: 737426 - DNA, 12 bp, Homo sapiens
tgataccttcaa

SEQ ID NO: 737427 - DNA, 13 bp, Homo sapiens
tgataccttcaat

SEQ ID NO: 737428 - DNA, 15 bp, Homo sapiens
tgatacgtacagcca

SEQ ID NO: 737429 - DNA, 17 bp, Homo sapiens
tgatactaaaagttctt

SEQ ID NO: 737430 - DNA, 16 bp, Homo sapiens
tgatactacaactttt

SEQ ID NO: 737431 - DNA, 13 bp, Homo sapiens
tgatactgatgcc

SEQ ID NO: 737432 - DNA, 14 bp, Homo sapiens
tgatactgtttctt

SEQ ID NO: 737433 - DNA, 15 bp, Homo sapiens
tgatactgtttcttg

SEQ ID NO: 737434 - DNA, 13 bp, Homo sapiens
tgatacttcaggt

SEQ ID NO: 737435 - DNA, 18 bp, Homo sapiens
tgatacttcaggtgcttt

SEQ ID NO: 737436 - DNA, 20 bp, Homo sapiens
tgatacttcaggtgcttttg

SEQ ID NO: 737437 - DNA, 13 bp, Homo sapiens
tgatacttcattt

SEQ ID NO: 737438 - DNA, 14 bp, Homo sapiens
tgatacttgaattt

SEQ ID NO: 737439 - DNA, 20 bp, Homo sapiens
tgatacttgaattttttgaa

SEQ ID NO: 737440 - DNA, 14 bp, Homo sapiens
tgatactttagcca

SEQ ID NO: 737441 - DNA, 18 bp, Homo sapiens
tgatactttagccatcat

SEQ ID NO: 737442 - DNA, 21 bp, Homo sapiens
tgatagaactttgccagtctt

SEQ ID NO: 737443 - DNA, 16 bp, Homo sapiens
tgatagaatgatgttt

SEQ ID NO: 737444 - DNA, 19 bp, Homo sapiens
tgatagactttgtgaatct

SEQ ID NO: 737445 - DNA, 15 bp, Homo sapiens
tgatagccagacacg

SEQ ID NO: 737446 - DNA, 17 bp, Homo sapiens
tgatagcttacactgag

SEQ ID NO: 737447 - DNA, 20 bp, Homo sapiens
tgatagcttacactgaggac

SEQ ID NO: 737448 - DNA, 15 bp, Homo sapiens
tgatagggaactggg

SEQ ID NO: 737449 - DNA, 12 bp, Homo sapiens
tgatagtccttt

SEQ ID NO: 737450 - DNA, 14 bp, Homo sapiens
tgatagttgaatgt

SEQ ID NO: 737451 - DNA, 20 bp, Homo sapiens
tgatataaaggaccctgttt

SEQ ID NO: 737452 - DNA, 16 bp, Homo sapiens
tgatataactttagaa

SEQ ID NO: 737453 - DNA, 14 bp, Homo sapiens
tgatatacaaagtg

SEQ ID NO: 737454 - DNA, 15 bp, Homo sapiens
tgatatacacagtgg

SEQ ID NO: 737455 - DNA, 19 bp, Homo sapiens
tgatatacacagtggcaaa

SEQ ID NO: 737456 - DNA, 14 bp, Homo sapiens
tgatatacattgtg

SEQ ID NO: 737457 - DNA, 18 bp, Homo sapiens
tgatatacattgtgtgaa

SEQ ID NO: 737458 - DNA, 15 bp, Homo sapiens
tgatataccaaatta

SEQ ID NO: 737459 - DNA, 16 bp, Homo sapiens
tgatataccaaattaa

SEQ ID NO: 737460 - DNA, 20 bp, Homo sapiens
tgatataccaaattaaaaaa

SEQ ID NO: 737461 - DNA, 18 bp, Homo sapiens
tgatatactccaggactt

SEQ ID NO: 737462 - DNA, 16 bp, Homo sapiens
tgatatagaaagctgt

SEQ ID NO: 737463 - DNA, 22 bp, Homo sapiens
tgatatagtgctgtttaagcta

SEQ ID NO: 737464 - DNA, 19 bp, Homo sapiens
tgatatataagtgtacata

SEQ ID NO: 737465 - DNA, 21 bp, Homo sapiens
tgatatatgtgtttttcacat

SEQ ID NO: 737466 - DNA, 14 bp, Homo sapiens
tgatatatttaaaa

SEQ ID NO: 737467 - DNA, 18 bp, Homo sapiens
tgatatcacctctcttca

SEQ ID NO: 737468 - DNA, 14 bp, Homo sapiens
tgatatccttctag

SEQ ID NO: 737469 - DNA, 14 bp, Homo sapiens
tgatatctatatat

SEQ ID NO: 737470 - DNA, 15 bp, Homo sapiens
tgatatgaccaaaat

SEQ ID NO: 737471 - DNA, 19 bp, Homo sapiens
tgatatgcagttttcctta

SEQ ID NO: 737472 - DNA, 19 bp, Homo sapiens
tgatatgcatttcctgctg

SEQ ID NO: 737473 - DNA, 18 bp, Homo sapiens
tgatatgggtagtatttt

SEQ ID NO: 737474 - DNA, 20 bp, Homo sapiens
tgatatgtatccatcaggat

SEQ ID NO: 737475 - DNA, 18 bp, Homo sapiens
tgatattaaagatttctt

SEQ ID NO: 737476 - DNA, 13 bp, Homo sapiens
tgatattaaagga

SEQ ID NO: 737477 - DNA, 14 bp, Homo sapiens
tgatattaaatttc

SEQ ID NO: 737478 - DNA, 18 bp, Homo sapiens
tgatattatttcttctct

SEQ ID NO: 737479 - DNA, 16 bp, Homo sapiens
tgatattcaaggcttt

SEQ ID NO: 737480 - DNA, 22 bp, Homo sapiens
tgatattcaaggctttaaaagt

SEQ ID NO: 737481 - DNA, 16 bp, Homo sapiens
tgatattccatgaatg

SEQ ID NO: 737482 - DNA, 18 bp, Homo sapiens
tgatattccatgaatgta

SEQ ID NO: 737483 - DNA, 19 bp, Homo sapiens
tgatattccatgaatgtat

SEQ ID NO: 737484 - DNA, 18 bp, Homo sapiens
tgatattccccatttcct

SEQ ID NO: 737485 - DNA, 22 bp, Homo sapiens
tgatattctaagaaatatctgt

SEQ ID NO: 737486 - DNA, 20 bp, Homo sapiens
tgatattctgttgctttaca

SEQ ID NO: 737487 - DNA, 16 bp, Homo sapiens
tgatattgctgaagaa

SEQ ID NO: 737488 - DNA, 19 bp, Homo sapiens
tgatattgtttgctgttgg

SEQ ID NO: 737489 - DNA, 15 bp, Homo sapiens
tgatatttaggtttt

SEQ ID NO: 737490 - DNA, 13 bp, Homo sapiens
tgatatttatttc

SEQ ID NO: 737491 - DNA, 17 bp, Homo sapiens
tgatatttctagcttat

SEQ ID NO: 737492 - DNA, 19 bp, Homo sapiens
tgatattttacctcttatt

SEQ ID NO: 737493 - DNA, 21 bp, Homo sapiens
tgatattttcaacgcagccct

SEQ ID NO: 737494 - DNA, 23 bp, Homo sapiens
tgatattttcaacgcagccctgc

SEQ ID NO: 737495 - DNA, 20 bp, Homo sapiens
tgatattttctgtgcctgaa

SEQ ID NO: 737496 - DNA, 16 bp, Homo sapiens
tgatattttgtacttt

SEQ ID NO: 737497 - DNA, 19 bp, Homo sapiens
tgatatttttatgtgcagc

SEQ ID NO: 737498 - DNA, 14 bp, Homo sapiens
tgatatttttccat

SEQ ID NO: 737499 - DNA, 23 bp, Homo sapiens
tgatcaaaacctgtgccaggctg

SEQ ID NO: 737500 - DNA, 17 bp, Homo sapiens
tgatcaaattcattttt

SEQ ID NO: 737501 - DNA, 15 bp, Homo sapiens
tgatcaactcttcga

SEQ ID NO: 737502 - DNA, 16 bp, Homo sapiens
tgatcaagatattaaa

SEQ ID NO: 737503 - DNA, 14 bp, Homo sapiens
tgatcaagtggttt

SEQ ID NO: 737504 - DNA, 18 bp, Homo sapiens
tgatcaataaaatgtgat

SEQ ID NO: 737505 - DNA, 15 bp, Homo sapiens
tgatcaattaaatgt

SEQ ID NO: 737506 - DNA, 16 bp, Homo sapiens
tgatcaattttgactt

SEQ ID NO: 737507 - DNA, 13 bp, Homo sapiens
tgatcacacagtg

SEQ ID NO: 737508 - DNA, 14 bp, Homo sapiens
tgatcacacagtgt

SEQ ID NO: 737509 - DNA, 12 bp, Homo sapiens
tgatcacaggag

SEQ ID NO: 737510 - DNA, 17 bp, Homo sapiens
tgatcacatctaaagct

SEQ ID NO: 737511 - DNA, 13 bp, Homo sapiens
ggcccagagccct

SEQ ID NO: 737512 - DNA, 20 bp, Homo sapiens
ggcccagagtttacattcta

SEQ ID NO: 737513 - DNA, 14 bp, Homo sapiens
ggcccagccaggag

SEQ ID NO: 737514 - DNA, 18 bp, Homo sapiens
ggcccagccaggagcaga

SEQ ID NO: 737515 - DNA, 14 bp, Homo sapiens
ggcccagcccagag

SEQ ID NO: 737516 - DNA, 12 bp, Homo sapiens
ggcccagcccct

SEQ ID NO: 737517 - DNA, 17 bp, Homo sapiens
ggcccagcccctccacg

SEQ ID NO: 737518 - DNA, 17 bp, Homo sapiens
ggcccagcctgtcctgg

SEQ ID NO: 737519 - DNA, 22 bp, Homo sapiens
ggcccagcctgtcctggtacag

SEQ ID NO: 737520 - DNA, 14 bp, Homo sapiens
ggcccagctgctcc

SEQ ID NO: 737521 - DNA, 23 bp, Homo sapiens
ggcccagctgctcccctggagga

SEQ ID NO: 737522 - DNA, 21 bp, Homo sapiens
ggcccagctgggctctgccac

SEQ ID NO: 737523 - DNA, 17 bp, Homo sapiens
ggcccaggaccagctgg

SEQ ID NO: 737524 - DNA, 18 bp, Homo sapiens
ggcccaggaccagctggg

SEQ ID NO: 737525 - DNA, 22 bp, Homo sapiens
ggcccaggaccatcatcctact

SEQ ID NO: 737526 - DNA, 21 bp, Homo sapiens
ggcccaggatatttctgagag

SEQ ID NO: 737527 - DNA, 22 bp, Homo sapiens
ggcccaggcaccaccaggagca

SEQ ID NO: 737528 - DNA, 11 bp, Homo sapiens
ggcccaggcag

SEQ ID NO: 737529 - DNA, 21 bp, Homo sapiens
ggcccaggcagacaaccttgt

SEQ ID NO: 737530 - DNA, 22 bp, Homo sapiens
ggcccaggcagacaaccttgtc

SEQ ID NO: 737531 - DNA, 18 bp, Homo sapiens
ggcccaggcaggtctgca

SEQ ID NO: 737532 - DNA, 15 bp, Homo sapiens
ggcccaggccagccc

SEQ ID NO: 737533 - DNA, 17 bp, Homo sapiens
ggcccaggccagccccc

SEQ ID NO: 737534 - DNA, 22 bp, Homo sapiens
ggcccaggccatgtggcctgcc

SEQ ID NO: 737535 - DNA, 12 bp, Homo sapiens
ggcccaggcccc

SEQ ID NO: 737536 - DNA, 19 bp, Homo sapiens
ggcccaggccgggaagagc

SEQ ID NO: 737537 - DNA, 22 bp, Homo sapiens
ggcccaggccgggaagagccac

SEQ ID NO: 737538 - DNA, 17 bp, Homo sapiens
ggcccaggcctggagcg

SEQ ID NO: 737539 - DNA, 19 bp, Homo sapiens
ggcccaggcctggagcgtt

SEQ ID NO: 737540 - DNA, 21 bp, Homo sapiens
ggccccttgctgatgctcctc

SEQ ID NO: 737541 - DNA, 19 bp, Homo sapiens
ggcccctttttactcccct

SEQ ID NO: 737542 - DNA, 17 bp, Homo sapiens
ggcccgacagcctggca

SEQ ID NO: 737543 - DNA, 15 bp, Homo sapiens
ggcccgacaggtggg

SEQ ID NO: 737544 - DNA, 22 bp, Homo sapiens
ggcccgacaggtgggcctggga

SEQ ID NO: 737545 - DNA, 12 bp, Homo sapiens
ggcccgcccctc

SEQ ID NO: 737546 - DNA, 14 bp, Homo sapiens
ggcccgcctgccca

SEQ ID NO: 737547 - DNA, 15 bp, Homo sapiens
ggcccgcctgcccag

SEQ ID NO: 737548 - DNA, 23 bp, Homo sapiens
ggcccgcctggcagaactgagct

SEQ ID NO: 737549 - DNA, 14 bp, Homo sapiens
ggcccgcggcctgc

SEQ ID NO: 737550 - DNA, 16 bp, Homo sapiens
ggcccgcggcctgcac

SEQ ID NO: 737551 - DNA, 15 bp, Homo sapiens
ggcccgcgggcacag

SEQ ID NO: 737552 - DNA, 19 bp, Homo sapiens
ggcccgcgggcacagccag

SEQ ID NO: 737553 - DNA, 20 bp, Homo sapiens
ggcccgcgggcacagccagc

SEQ ID NO: 737554 - DNA, 15 bp, Homo sapiens
ggcccggagcagcag

SEQ ID NO: 737555 - DNA, 22 bp, Homo sapiens
ggcccggagtaatcaggcagcc

SEQ ID NO: 737556 - DNA, 14 bp, Homo sapiens
ggcccggccacacc

SEQ ID NO: 737557 - DNA, 18 bp, Homo sapiens
ggcccggccacacccagc

SEQ ID NO: 737558 - DNA, 20 bp, Homo sapiens
ggcccggccagccatgtctg

SEQ ID NO: 737559 - DNA, 23 bp, Homo sapiens
ggcccggcgcggtggctcacgcc

SEQ ID NO: 737560 - DNA, 14 bp, Homo sapiens
ggcccgggcaccca

SEQ ID NO: 737561 - DNA, 13 bp, Homo sapiens
ggcccgggcaggc

SEQ ID NO: 737562 - DNA, 14 bp, Homo sapiens
ggcccgggcaggcc

SEQ ID NO: 737563 - DNA, 16 bp, Homo sapiens
ggcccgggcaggccag

SEQ ID NO: 737564 - DNA, 13 bp, Homo sapiens
ggcccggggctgg

SEQ ID NO: 737565 - DNA, 18 bp, Homo sapiens
ggcccgtcggagctgcct

SEQ ID NO: 737566 - DNA, 19 bp, Homo sapiens
ggcccgtcggagctgcctg

SEQ ID NO: 737567 - DNA, 22 bp, Homo sapiens
ggcccgtcggagctgcctgcag

SEQ ID NO: 737568 - DNA, 16 bp, Homo sapiens
ggcccgttgaggatga

SEQ ID NO: 737569 - DNA, 20 bp, Homo sapiens
ggcccgttgaggatgaggcc

SEQ ID NO: 737570 - DNA, 23 bp, Homo sapiens
ggccctaagaggtttttcctctt

SEQ ID NO: 737571 - DNA, 18 bp, Homo sapiens
ggccctcactaagccccg

SEQ ID NO: 737572 - DNA, 16 bp, Homo sapiens
ggccctcactgagcct

SEQ ID NO: 737573 - DNA, 20 bp, Homo sapiens
ggccctcagcatatttgtat

SEQ ID NO: 737574 - DNA, 14 bp, Homo sapiens
ggccctccatgcgc

SEQ ID NO: 737575 - DNA, 17 bp, Homo sapiens
ggccctccatgggctag

SEQ ID NO: 737576 - DNA, 12 bp, Homo sapiens
ggccctccctct

SEQ ID NO: 737577 - DNA, 13 bp, Homo sapiens
ggccctccctcta

SEQ ID NO: 737578 - DNA, 21 bp, Homo sapiens
ggccctccctctactcttcct

SEQ ID NO: 737579 - DNA, 19 bp, Homo sapiens
ggccctccctgactccctg

SEQ ID NO: 737580 - DNA, 22 bp, Homo sapiens
ggccctccctgactccctgtgg

SEQ ID NO: 737581 - DNA, 15 bp, Homo sapiens
ggccctcccttggaa

SEQ ID NO: 737582 - DNA, 16 bp, Homo sapiens
ggccctcctaccctgc

SEQ ID NO: 737583 - DNA, 14 bp, Homo sapiens
ggccctcctgtgct

SEQ ID NO: 737584 - DNA, 18 bp, Homo sapiens
ggccctccttccctcctg

SEQ ID NO: 737585 - DNA, 16 bp, Homo sapiens
ggccctcgctgccagc

SEQ ID NO: 737586 - DNA, 22 bp, Homo sapiens
ggccctcgctgccagctctgta

SEQ ID NO: 737587 - DNA, 13 bp, Homo sapiens
ggccctcggagct

SEQ ID NO: 737588 - DNA, 20 bp, Homo sapiens
ggccctcggagctggctgtg

SEQ ID NO: 737589 - DNA, 14 bp, Homo sapiens
ggccctctatgctg

SEQ ID NO: 737590 - DNA, 14 bp, Homo sapiens
ggccctctctctgg

SEQ ID NO: 737591 - DNA, 16 bp, Homo sapiens
ggccctctgcctgcac

SEQ ID NO: 737592 - DNA, 20 bp, Homo sapiens
ggccctctgcctgcactccc

SEQ ID NO: 737593 - DNA, 14 bp, Homo sapiens
ggccctctggagtg

SEQ ID NO: 737594 - DNA, 17 bp, Homo sapiens
ggccctcttgccagcct

SEQ ID NO: 737595 - DNA, 18 bp, Homo sapiens
ggccctcttgccagcctc

SEQ ID NO: 737596 - DNA, 20 bp, Homo sapiens
ggccctcttgccagcctcct

SEQ ID NO: 737597 - DNA, 22 bp, Homo sapiens
ggccctcttgccagcctccttg

SEQ ID NO: 737598 - DNA, 19 bp, Homo sapiens
ggccctcttgcgggcctgg

SEQ ID NO: 737599 - DNA, 14 bp, Homo sapiens
ggccctctttccct

SEQ ID NO: 737600 - DNA, 15 bp, Homo sapiens
ggccctctttccctg

SEQ ID NO: 737601 - DNA, 17 bp, Homo sapiens
ggccctctttccctgcg

SEQ ID NO: 737602 - DNA, 14 bp, Homo sapiens
ggccctgaaccacg

SEQ ID NO: 737603 - DNA, 20 bp, Homo sapiens
ggccctgaaccacgaggctg

SEQ ID NO: 737604 - DNA, 19 bp, Homo sapiens
ggccctgactcctctggct

SEQ ID NO: 737605 - DNA, 21 bp, Homo sapiens
ggccctgactgtcagggaggg

SEQ ID NO: 737606 - DNA, 17 bp, Homo sapiens
ggccctgacttctggag

SEQ ID NO: 737607 - DNA, 18 bp, Homo sapiens
ggccctgacttctggaga

SEQ ID NO: 737608 - DNA, 12 bp, Homo sapiens
ggccctgagcca

SEQ ID NO: 737609 - DNA, 21 bp, Homo sapiens
ggccctgagctcggtggaccc

SEQ ID NO: 737610 - DNA, 16 bp, Homo sapiens
ggccctgaggtgtggg

SEQ ID NO: 737611 - DNA, 18 bp, Homo sapiens
ggccctgaggtgtggggg

SEQ ID NO: 737612 - DNA, 19 bp, Homo sapiens
ggccctgcaaaaggactct

SEQ ID NO: 737613 - DNA, 22 bp, Homo sapiens
ggccctgcaaaaggactctcag

SEQ ID NO: 737614 - DNA, 20 bp, Homo sapiens
ggccctgcacagacctggag

SEQ ID NO: 737615 - DNA, 23 bp, Homo sapiens
ggccctgcacaggtggctgtttc

SEQ ID NO: 737616 - DNA, 16 bp, Homo sapiens
ggccctgcagccagct

SEQ ID NO: 737617 - DNA, 12 bp, Homo sapiens
ggccctgcagga

SEQ ID NO: 737618 - DNA, 14 bp, Homo sapiens
ggccctgccacgtc

SEQ ID NO: 737619 - DNA, 21 bp, Homo sapiens
ggccctgccagtggggaagga

SEQ ID NO: 737620 - DNA, 20 bp, Homo sapiens
ggccctgccatcttcccagc

SEQ ID NO: 737621 - DNA, 11 bp, Homo sapiens
ggccctgcccg

SEQ ID NO: 737622 - DNA, 19 bp, Homo sapiens
ggccctgcccggggagctg

SEQ ID NO: 737623 - DNA, 17 bp, Homo sapiens
ggccctgcccttggcac

SEQ ID NO: 737624 - DNA, 18 bp, Homo sapiens
ggccctgcccttggcacc

SEQ ID NO: 737625 - DNA, 20 bp, Homo sapiens
ggccctgcccttggcaccac

SEQ ID NO: 737626 - DNA, 21 bp, Homo sapiens
ggccctgcctgacccatccct

SEQ ID NO: 737627 - DNA, 22 bp, Homo sapiens
ggccctgcctgacccatccctt

SEQ ID NO: 737628 - DNA, 14 bp, Homo sapiens
ggccctgccttctt

SEQ ID NO: 737629 - DNA, 18 bp, Homo sapiens
ggccctgcgtcggccctg

SEQ ID NO: 737630 - DNA, 17 bp, Homo sapiens
ggccctgctcctgcagc

SEQ ID NO: 737631 - DNA, 21 bp, Homo sapiens
ggccctgctcctgcagcatgg

SEQ ID NO: 737632 - DNA, 18 bp, Homo sapiens
ggccctgcttcctgcttg

SEQ ID NO: 737633 - DNA, 14 bp, Homo sapiens
ggccctggaagagt

SEQ ID NO: 737634 - DNA, 12 bp, Homo sapiens
ggccctggagcc

SEQ ID NO: 737635 - DNA, 13 bp, Homo sapiens
ggccctggagcca

SEQ ID NO: 737636 - DNA, 15 bp, Homo sapiens
ggccctggagccagg

SEQ ID NO: 737637 - DNA, 16 bp, Homo sapiens
ggccctggagccaggg

SEQ ID NO: 737638 - DNA, 21 bp, Homo sapiens
ggccctggagccagggcagag

SEQ ID NO: 737639 - DNA, 23 bp, Homo sapiens
ggccctggagccagggcagagga

SEQ ID NO: 737640 - DNA, 12 bp, Homo sapiens
ggccctggaggg

SEQ ID NO: 737641 - DNA, 23 bp, Homo sapiens
tgatgaacatattcatgaaatgt

SEQ ID NO: 737642 - DNA, 13 bp, Homo sapiens
tgatgaactttct

SEQ ID NO: 737643 - DNA, 18 bp, Homo sapiens
tgatgaagaaaagtgggc

SEQ ID NO: 737644 - DNA, 20 bp, Homo sapiens
tgatgaagaaaagtgggcca

SEQ ID NO: 737645 - DNA, 24 bp, Homo sapiens
tgatgaagcaaggaagatatacat

SEQ ID NO: 737646 - DNA, 16 bp, Homo sapiens
tgatgaatcaatgaaa

SEQ ID NO: 737647 - DNA, 22 bp, Homo sapiens
tgatgaatcaatgaaaaatgta

SEQ ID NO: 737648 - DNA, 22 bp, Homo sapiens
tgatgaatcagtcctagaatgt

SEQ ID NO: 737649 - DNA, 17 bp, Homo sapiens
tgatgaatgtactatgt

SEQ ID NO: 737650 - DNA, 15 bp, Homo sapiens
tgatgacagagcgag

SEQ ID NO: 737651 - DNA, 16 bp, Homo sapiens
tgatgactcaaggcca

SEQ ID NO: 737652 - DNA, 13 bp, Homo sapiens
tgatgactgctga

SEQ ID NO: 737653 - DNA, 15 bp, Homo sapiens
tgatgacttgctgtc

SEQ ID NO: 737654 - DNA, 19 bp, Homo sapiens
tgatgacttgctgtccagg

SEQ ID NO: 737655 - DNA, 18 bp, Homo sapiens
tgatgagacagtgaagta

SEQ ID NO: 737656 - DNA, 19 bp, Homo sapiens
tgatgagacagtgaagtaa

SEQ ID NO: 737657 - DNA, 23 bp, Homo sapiens
tgatgagagaatggagacagagt

SEQ ID NO: 737658 - DNA, 22 bp, Homo sapiens
tgatgaggcctcttggacctct

SEQ ID NO: 737659 - DNA, 13 bp, Homo sapiens
tgatgaggtattt

SEQ ID NO: 737660 - DNA, 19 bp, Homo sapiens
tgatgaggtattttttcct

SEQ ID NO: 737661 - DNA, 13 bp, Homo sapiens
tgatgatcaaaac

SEQ ID NO: 737662 - DNA, 21 bp, Homo sapiens
tgatgtcatatcatttcactg

SEQ ID NO: 737663 - DNA, 13 bp, Homo sapiens
tgatgtccagaag

SEQ ID NO: 737664 - DNA, 19 bp, Homo sapiens
tgatgtcccaacttgtaaa

SEQ ID NO: 737665 - DNA, 11 bp, Homo sapiens
tgatgtcccag

SEQ ID NO: 737666 - DNA, 21 bp, Homo sapiens
tgatgtctacagaaaatgctg

SEQ ID NO: 737667 - DNA, 14 bp, Homo sapiens
tgatgtgaaaagca

SEQ ID NO: 737668 - DNA, 22 bp, Homo sapiens
tgatgtgaagataatttgcata

SEQ ID NO: 737669 - DNA, 14 bp, Homo sapiens
tgatgtgacttttt

SEQ ID NO: 737670 - DNA, 23 bp, Homo sapiens
tgatgtgactttttttggtataa

SEQ ID NO: 737671 - DNA, 23 bp, Homo sapiens
tgatgtgcaaaaccttttactgg

SEQ ID NO: 737672 - DNA, 13 bp, Homo sapiens
tgatgtgccacta

SEQ ID NO: 737673 - DNA, 18 bp, Homo sapiens
tgatgtggacatatgtat

SEQ ID NO: 737674 - DNA, 23 bp, Homo sapiens
tgatgtgttgtgatagctaacat

SEQ ID NO: 737675 - DNA, 20 bp, Homo sapiens
tgatgttaacccattccagt

SEQ ID NO: 737676 - DNA, 23 bp, Homo sapiens
tgatgttcagagtggctcactgg

SEQ ID NO: 737677 - DNA, 17 bp, Homo sapiens
tgatgttccacctgcca

SEQ ID NO: 737678 - DNA, 18 bp, Homo sapiens
tgatgttgaaatatgcat

SEQ ID NO: 737679 - DNA, 22 bp, Homo sapiens
tgatgttgaaatatgcatacta

SEQ ID NO: 737680 - DNA, 18 bp, Homo sapiens
tgatgttgataatttcag

SEQ ID NO: 737681 - DNA, 17 bp, Homo sapiens
tgatgtttagaaaagta

SEQ ID NO: 737682 - DNA, 19 bp, Homo sapiens
tgatgtttgcccaaaattt

SEQ ID NO: 737683 - DNA, 13 bp, Homo sapiens
tgatgtttgctct

SEQ ID NO: 737684 - DNA, 19 bp, Homo sapiens
tgatgttttacgtgcaaac

SEQ ID NO: 737685 - DNA, 14 bp, Homo sapiens
tgatgttttgatat

SEQ ID NO: 737686 - DNA, 16 bp, Homo sapiens
tgatgttttgatattt

SEQ ID NO: 737687 - DNA, 15 bp, Homo sapiens
tgatgttttgttcaa

SEQ ID NO: 737688 - DNA, 19 bp, Homo sapiens
tgattaaaaataccttcta

SEQ ID NO: 737689 - DNA, 11 bp, Homo sapiens
tgattaaaatc

SEQ ID NO: 737690 - DNA, 22 bp, Homo sapiens
tgattaaagatgagctttgtct

SEQ ID NO: 737691 - DNA, 21 bp, Homo sapiens
tgattaaagcagtaatatttt

SEQ ID NO: 737692 - DNA, 12 bp, Homo sapiens
tgattaaagtgc

SEQ ID NO: 737693 - DNA, 15 bp, Homo sapiens
tgattaaatatttga

SEQ ID NO: 737694 - DNA, 22 bp, Homo sapiens
tgattaaatgtctgacacatta

SEQ ID NO: 737695 - DNA, 20 bp, Homo sapiens
tgattaaccacttcagctga

SEQ ID NO: 737696 - DNA, 12 bp, Homo sapiens
tgattaatcaaa

SEQ ID NO: 737697 - DNA, 21 bp, Homo sapiens
tgattaatgttttcattatgt

SEQ ID NO: 737698 - DNA, 22 bp, Homo sapiens
tgattaatttctgccatttcat

SEQ ID NO: 737699 - DNA, 20 bp, Homo sapiens
tgattacataatcaaagcta

SEQ ID NO: 737700 - DNA, 20 bp, Homo sapiens
tgattacatagatcagccat

SEQ ID NO: 737701 - DNA, 16 bp, Homo sapiens
tgattaccagtctgat

SEQ ID NO: 737702 - DNA, 19 bp, Homo sapiens
tgattaccagtctgattat

SEQ ID NO: 737703 - DNA, 20 bp, Homo sapiens
tgattacctgctgcatgaaa

SEQ ID NO: 737704 - DNA, 13 bp, Homo sapiens
tgattactgtcaa

SEQ ID NO: 737705 - DNA, 21 bp, Homo sapiens
tgattagaaggcaagtttcta

SEQ ID NO: 737706 - DNA, 13 bp, Homo sapiens
tgattagacagaa

SEQ ID NO: 737707 - DNA, 14 bp, Homo sapiens
tgattagataaaga

SEQ ID NO: 737708 - DNA, 15 bp, Homo sapiens
tgattagataaagat

SEQ ID NO: 737709 - DNA, 21 bp, Homo sapiens
tgattaggttatggtttaatg

SEQ ID NO: 737710 - DNA, 14 bp, Homo sapiens
tgattataaatgtt

SEQ ID NO: 737711 - DNA, 21 bp, Homo sapiens
tgattatagaaggctgtctta

SEQ ID NO: 737712 - DNA, 13 bp, Homo sapiens
tgattatcttcag

SEQ ID NO: 737713 - DNA, 14 bp, Homo sapiens
tgattatcttcagc

SEQ ID NO: 737714 - DNA, 17 bp, Homo sapiens
tgattattacttctgtt

SEQ ID NO: 737715 - DNA, 20 bp, Homo sapiens
tgattattacttctgtttct

SEQ ID NO: 737716 - DNA, 20 bp, Homo sapiens
tgattattatgtttattaca

SEQ ID NO: 737717 - DNA, 17 bp, Homo sapiens
tgattattcaacacatt

SEQ ID NO: 737718 - DNA, 18 bp, Homo sapiens
tgattattctgattccac

SEQ ID NO: 737719 - DNA, 13 bp, Homo sapiens
tgattatttatga

SEQ ID NO: 737720 - DNA, 16 bp, Homo sapiens
tgattatttatgacct

SEQ ID NO: 737721 - DNA, 14 bp, Homo sapiens
tgattatttgcatg

SEQ ID NO: 737722 - DNA, 13 bp, Homo sapiens
tgattcaaaatat

SEQ ID NO: 737723 - DNA, 14 bp, Homo sapiens
tgattcaaaatatt

SEQ ID NO: 737724 - DNA, 18 bp, Homo sapiens
tgattcaaattgctgctt

SEQ ID NO: 737725 - DNA, 23 bp, Homo sapiens
tgattcaacacttaagtctcaga

SEQ ID NO: 737726 - DNA, 12 bp, Homo sapiens
tgattcaacagg

SEQ ID NO: 737727 - DNA, 13 bp, Homo sapiens
tgattcaacctga

SEQ ID NO: 737728 - DNA, 23 bp, Homo sapiens
tgattcaatctgtaaactgtgta

SEQ ID NO: 737729 - DNA, 16 bp, Homo sapiens
tgattcacatctcatt

SEQ ID NO: 737730 - DNA, 13 bp, Homo sapiens
tgattcacctctt

SEQ ID NO: 737731 - DNA, 19 bp, Homo sapiens
tgattcagaaaatgttctg

SEQ ID NO: 737732 - DNA, 14 bp, Homo sapiens
tgattcagctctgc

SEQ ID NO: 737733 - DNA, 24 bp, Homo sapiens
tgattcagtgttaaatgtgatgaa

SEQ ID NO: 737734 - DNA, 17 bp, Homo sapiens
tgattcataataaatat

SEQ ID NO: 737735 - DNA, 14 bp, Homo sapiens
tgattcattttcct

SEQ ID NO: 737736 - DNA, 18 bp, Homo sapiens
tgattcattttcctgttc

SEQ ID NO: 737737 - DNA, 11 bp, Homo sapiens
tgattccaaat

SEQ ID NO: 737738 - DNA, 19 bp, Homo sapiens
tgattccactacacctggc

SEQ ID NO: 737739 - DNA, 22 bp, Homo sapiens
tgattccactacacctggctga

SEQ ID NO: 737740 - DNA, 23 bp, Homo sapiens
tgattccactacacctggctgag

SEQ ID NO: 737741 - DNA, 20 bp, Homo sapiens
tgattccattccatggaaat

SEQ ID NO: 737742 - DNA, 20 bp, Homo sapiens
tgattcctttaaaatatatg

SEQ ID NO: 737743 - DNA, 14 bp, Homo sapiens
tgattccttttgat

SEQ ID NO: 737744 - DNA, 20 bp, Homo sapiens
tgattccttttgatggggag

SEQ ID NO: 737745 - DNA, 18 bp, Homo sapiens
tgattcgaatgacactgt

SEQ ID NO: 737746 - DNA, 19 bp, Homo sapiens
tgattctaatgtcttcatt

SEQ ID NO: 737747 - DNA, 20 bp, Homo sapiens
tgattctagtacataattga

SEQ ID NO: 737748 - DNA, 23 bp, Homo sapiens
tgattctagtacataattgatta

SEQ ID NO: 737749 - DNA, 16 bp, Homo sapiens
tgattctattatatat

SEQ ID NO: 737750 - DNA, 12 bp, Homo sapiens
tgattctcaggg

SEQ ID NO: 737751 - DNA, 16 bp, Homo sapiens
tgattctcctgcctca

SEQ ID NO: 737752 - DNA, 19 bp, Homo sapiens
tgattctctacatgctctt

SEQ ID NO: 737753 - DNA, 20 bp, Homo sapiens
tgattctgaaatttttttcc

SEQ ID NO: 737754 - DNA, 15 bp, Homo sapiens
tgattctgatttcag

SEQ ID NO: 737755 - DNA, 22 bp, Homo sapiens
tgattctgatttcagtttttca

SEQ ID NO: 737756 - DNA, 17 bp, Homo sapiens
tgattctgcttttacca

SEQ ID NO: 737757 - DNA, 15 bp, Homo sapiens
tgattctgtgtgttt

SEQ ID NO: 737758 - DNA, 21 bp, Homo sapiens
tgattcttctcttgtgatttg

SEQ ID NO: 737759 - DNA, 16 bp, Homo sapiens
tgattcttgattcctg

SEQ ID NO: 737760 - DNA, 12 bp, Homo sapiens
tgattcttgtaa

SEQ ID NO: 737761 - DNA, 14 bp, Homo sapiens
tgattcttgtaaat

SEQ ID NO: 737762 - DNA, 17 bp, Homo sapiens
tgattcttgtaaatctt

SEQ ID NO: 737763 - DNA, 17 bp, Homo sapiens
tgattgaaccagctcat

SEQ ID NO: 737764 - DNA, 22 bp, Homo sapiens
tgattgaatctgattggacatt

SEQ ID NO: 737765 - DNA, 12 bp, Homo sapiens
tgattgacagct

SEQ ID NO: 737766 - DNA, 15 bp, Homo sapiens
tgattgcacagaatt

SEQ ID NO: 737767 - DNA, 15 bp, Homo sapiens
tgattgcacattgtt

SEQ ID NO: 737768 - DNA, 12 bp, Homo sapiens
tgattgctttgc

SEQ ID NO: 737769 - DNA, 19 bp, Homo sapiens
tgattggaatttctggcct

SEQ ID NO: 737770 - DNA, 16 bp, Homo sapiens
tgattggaccaggcca

SEQ ID NO: 737771 - DNA, 17 bp, Homo sapiens
ggcctcaatctaaggcc

SEQ ID NO: 737772 - DNA, 20 bp, Homo sapiens
ggcctcaatctaaggccttc

SEQ ID NO: 737773 - DNA, 19 bp, Homo sapiens
ggcctcaccaggcccacga

SEQ ID NO: 737774 - DNA, 18 bp, Homo sapiens
ggcctcaccgagtggggg

SEQ ID NO: 737775 - DNA, 19 bp, Homo sapiens
ggcctcaccgagtgggggc

SEQ ID NO: 737776 - DNA, 15 bp, Homo sapiens
ggcctcacctctacc

SEQ ID NO: 737777 - DNA, 23 bp, Homo sapiens
ggcctcacctgcccctctgttct

SEQ ID NO: 737778 - DNA, 22 bp, Homo sapiens
ggcctcacgggaccgtcagcat

SEQ ID NO: 737779 - DNA, 16 bp, Homo sapiens
ggcctcagagcctgac

SEQ ID NO: 737780 - DNA, 15 bp, Homo sapiens
ggcctcagccagaga

SEQ ID NO: 737781 - DNA, 17 bp, Homo sapiens
ggcctcagccagagaag

SEQ ID NO: 737782 - DNA, 20 bp, Homo sapiens
ggcctcagccagagaagcta

SEQ ID NO: 737783 - DNA, 13 bp, Homo sapiens
ggcctcagccctc

SEQ ID NO: 737784 - DNA, 14 bp, Homo sapiens
ggcctgccgggctg

SEQ ID NO: 737785 - DNA, 11 bp, Homo sapiens
ggcctgcctgc

SEQ ID NO: 737786 - DNA, 18 bp, Homo sapiens
ggcctgccttgaagccac

SEQ ID NO: 737787 - DNA, 16 bp, Homo sapiens
ggcctgcgcccagagc

SEQ ID NO: 737788 - DNA, 17 bp, Homo sapiens
ggcctgcgcccagagct

SEQ ID NO: 737789 - DNA, 21 bp, Homo sapiens
ggcctgcgcccagagctggcc

SEQ ID NO: 737790 - DNA, 22 bp, Homo sapiens
ggcctgcgcccagagctggcct

SEQ ID NO: 737791 - DNA, 21 bp, Homo sapiens
ggcctgcgtctccatatgtgt

SEQ ID NO: 737792 - DNA, 18 bp, Homo sapiens
ggcctgctcccagcagcc

SEQ ID NO: 737793 - DNA, 13 bp, Homo sapiens
ggcctgctgccag

SEQ ID NO: 737794 - DNA, 18 bp, Homo sapiens
ggcctgctgccagtgcag

SEQ ID NO: 737795 - DNA, 19 bp, Homo sapiens
ggcctgctgccagtgcagc

SEQ ID NO: 737796 - DNA, 21 bp, Homo sapiens
ggcctgctgccagtgcagcca

SEQ ID NO: 737797 - DNA, 18 bp, Homo sapiens
ggcctgctggaggcctca

SEQ ID NO: 737798 - DNA, 20 bp, Homo sapiens
ggcctgctggaggcctcagg

SEQ ID NO: 737799 - DNA, 23 bp, Homo sapiens
ggcctgctggagttccggcctgg

SEQ ID NO: 737800 - DNA, 15 bp, Homo sapiens
ggcctgctggcatca

SEQ ID NO: 737801 - DNA, 16 bp, Homo sapiens
ggcctgctggcatcag

SEQ ID NO: 737802 - DNA, 21 bp, Homo sapiens
ggcctgctggcatcaggtctg

SEQ ID NO: 737803 - DNA, 23 bp, Homo sapiens
ggcctgctgggaaccccgcagcc

SEQ ID NO: 737804 - DNA, 19 bp, Homo sapiens
ggcctgctgggctctccac

SEQ ID NO: 737805 - DNA, 22 bp, Homo sapiens
ggcctgctgggctctccacctc

SEQ ID NO: 737806 - DNA, 24 bp, Homo sapiens
ggcctgcttttccaggatcctgca

SEQ ID NO: 737807 - DNA, 15 bp, Homo sapiens
ggcctggacccctgg

SEQ ID NO: 737808 - DNA, 16 bp, Homo sapiens
ggcctggacctgggat

SEQ ID NO: 737809 - DNA, 14 bp, Homo sapiens
ggcctggagatcct

SEQ ID NO: 737810 - DNA, 13 bp, Homo sapiens
ggcctggaggctc

SEQ ID NO: 737811 - DNA, 21 bp, Homo sapiens
ggcctggatctccccactcta

SEQ ID NO: 737812 - DNA, 20 bp, Homo sapiens
ggcctggattcatttcctgc

SEQ ID NO: 737813 - DNA, 22 bp, Homo sapiens
ggcctggattcatttcctgccc

SEQ ID NO: 737814 - DNA, 17 bp, Homo sapiens
ggcctggcatctgtgtg

SEQ ID NO: 737815 - DNA, 18 bp, Homo sapiens
ggcctggcatctgtgtgc

SEQ ID NO: 737816 - DNA, 15 bp, Homo sapiens
ggcctggcattcttg

SEQ ID NO: 737817 - DNA, 16 bp, Homo sapiens
ggcctggccacctctc

SEQ ID NO: 737818 - DNA, 14 bp, Homo sapiens
ggcctggccaggag

SEQ ID NO: 737819 - DNA, 15 bp, Homo sapiens
ggcctggccaggagc

SEQ ID NO: 737820 - DNA, 18 bp, Homo sapiens
ggcctggccaggagctct

SEQ ID NO: 737821 - DNA, 15 bp, Homo sapiens
ggcctggcctgagct

SEQ ID NO: 737822 - DNA, 17 bp, Homo sapiens
ggcctggcctgagctgg

SEQ ID NO: 737823 - DNA, 13 bp, Homo sapiens
ggcctggctcccc

SEQ ID NO: 737824 - DNA, 17 bp, Homo sapiens
ggcctggctccccgagg

SEQ ID NO: 737825 - DNA, 24 bp, Homo sapiens
ggcctggctccccgagggctcaga

SEQ ID NO: 737826 - DNA, 16 bp, Homo sapiens
ggcctggcttgctcca

SEQ ID NO: 737827 - DNA, 19 bp, Homo sapiens
ggcctggcttgctccaggg

SEQ ID NO: 737828 - DNA, 22 bp, Homo sapiens
ggcctgggacccagctactctg

SEQ ID NO: 737829 - DNA, 17 bp, Homo sapiens
ggcctgggacttccatg

SEQ ID NO: 737830 - DNA, 21 bp, Homo sapiens
ggcctgggagggttcccctgg

SEQ ID NO: 737831 - DNA, 23 bp, Homo sapiens
ggcctgggagggttcccctggcc

SEQ ID NO: 737832 - DNA, 22 bp, Homo sapiens
ggcctgggatctggcacactcc

SEQ ID NO: 737833 - DNA, 13 bp, Homo sapiens
ggcctgggcagga

SEQ ID NO: 737834 - DNA, 16 bp, Homo sapiens
ggcctgggcaggaccc

SEQ ID NO: 737835 - DNA, 17 bp, Homo sapiens
ggcctgggcaggaccct

SEQ ID NO: 737836 - DNA, 15 bp, Homo sapiens
ggcctgggccgctgc

SEQ ID NO: 737837 - DNA, 14 bp, Homo sapiens
ggcctgggcctgct

SEQ ID NO: 737838 - DNA, 15 bp, Homo sapiens
ggcctgggctggcct

SEQ ID NO: 737839 - DNA, 15 bp, Homo sapiens
ggcctggggaggccc

SEQ ID NO: 737840 - DNA, 16 bp, Homo sapiens
ggcctggggctccttt

SEQ ID NO: 737841 - DNA, 23 bp, Homo sapiens
ggcctggggctcctttctccagc

SEQ ID NO: 737842 - DNA, 14 bp, Homo sapiens
ggcctggggtgcat

SEQ ID NO: 737843 - DNA, 21 bp, Homo sapiens
ggcctggggtgcatcctcctc

SEQ ID NO: 737844 - DNA, 22 bp, Homo sapiens
ggcctggggtgggacagggagg

SEQ ID NO: 737845 - DNA, 14 bp, Homo sapiens
ggcctgggtctgtg

SEQ ID NO: 737846 - DNA, 19 bp, Homo sapiens
ggcctgggtctgtgtctct

SEQ ID NO: 737847 - DNA, 22 bp, Homo sapiens
ggcctggtagcacatgtctgtc

SEQ ID NO: 737848 - DNA, 11 bp, Homo sapiens
ggcctggtccc

SEQ ID NO: 737849 - DNA, 22 bp, Homo sapiens
ggcctgtaatcagctctcctgg

SEQ ID NO: 737850 - DNA, 17 bp, Homo sapiens
ggcctgtagagttgctg

SEQ ID NO: 737851 - DNA, 20 bp, Homo sapiens
ggcctgtcagctaaagaagt

SEQ ID NO: 737852 - DNA, 18 bp, Homo sapiens
ggcctgtccaacacatct

SEQ ID NO: 737853 - DNA, 19 bp, Homo sapiens
ggcctgtccacctgtgctg

SEQ ID NO: 737854 - DNA, 19 bp, Homo sapiens
ggcctgtctcatccccagg

SEQ ID NO: 737855 - DNA, 23 bp, Homo sapiens
ggcctgtctcatccccaggggtc

SEQ ID NO: 737856 - DNA, 17 bp, Homo sapiens
ggcctgtctgcgtgggt

SEQ ID NO: 737857 - DNA, 19 bp, Homo sapiens
ggcctgtgagtctcccctt

SEQ ID NO: 737858 - DNA, 17 bp, Homo sapiens
ggcctgtgcactgggca

SEQ ID NO: 737859 - DNA, 18 bp, Homo sapiens
ggcctgtgcactgggcag

SEQ ID NO: 737860 - DNA, 19 bp, Homo sapiens
ggcctgtgcactgggcagg

SEQ ID NO: 737861 - DNA, 23 bp, Homo sapiens
ggcctgtgcactgggcaggttcc

SEQ ID NO: 737862 - DNA, 18 bp, Homo sapiens
ggcctgtgcagcagccca

SEQ ID NO: 737863 - DNA, 20 bp, Homo sapiens
ggcctgtgcagcagcccagc

SEQ ID NO: 737864 - DNA, 13 bp, Homo sapiens
ggcctgtgctctg

SEQ ID NO: 737865 - DNA, 16 bp, Homo sapiens
ggcctgtggaatgagt

SEQ ID NO: 737866 - DNA, 18 bp, Homo sapiens
ggcctgtggcctgtgtcc

SEQ ID NO: 737867 - DNA, 17 bp, Homo sapiens
ggcctgtgggagcctgc

SEQ ID NO: 737868 - DNA, 19 bp, Homo sapiens
ggcctgtgggcctcacctg

SEQ ID NO: 737869 - DNA, 18 bp, Homo sapiens
ggcctgtgggtctctgaa

SEQ ID NO: 737870 - DNA, 17 bp, Homo sapiens
ggcctgtgtccagcagc

SEQ ID NO: 737871 - DNA, 18 bp, Homo sapiens
ggcctgtgtccagcagct

SEQ ID NO: 737872 - DNA, 22 bp, Homo sapiens
ggcctgtgtccagcagctgcgg

SEQ ID NO: 737873 - DNA, 14 bp, Homo sapiens
ggcctgtgtgtggg

SEQ ID NO: 737874 - DNA, 23 bp, Homo sapiens
ggcctgttccccaaatggccatt

SEQ ID NO: 737875 - DNA, 12 bp, Homo sapiens
ggcctgttcctt

SEQ ID NO: 737876 - DNA, 24 bp, Homo sapiens
ggcctgttgctatagagcctacct

SEQ ID NO: 737877 - DNA, 21 bp, Homo sapiens
ggcctgtttctgcagcccttg

SEQ ID NO: 737878 - DNA, 20 bp, Homo sapiens
ggcctgtttgaaagtaaaaa

SEQ ID NO: 737879 - DNA, 12 bp, Homo sapiens
ggcctgtttgat

SEQ ID NO: 737880 - DNA, 22 bp, Homo sapiens
ggcctgtttgatgtatgtgtga

SEQ ID NO: 737881 - DNA, 18 bp, Homo sapiens
ggcctgtttggcctctct

SEQ ID NO: 737882 - DNA, 23 bp, Homo sapiens
ggccttaaaaggggcccaagccc

SEQ ID NO: 737883 - DNA, 15 bp, Homo sapiens
ggccttaaagaggga

SEQ ID NO: 737884 - DNA, 13 bp, Homo sapiens
ggccttaatttcc

SEQ ID NO: 737885 - DNA, 16 bp, Homo sapiens
ggccttaatttccttt

SEQ ID NO: 737886 - DNA, 19 bp, Homo sapiens
ggccttacatctggctgga

SEQ ID NO: 737887 - DNA, 16 bp, Homo sapiens
ggccttagtgggccag

SEQ ID NO: 737888 - DNA, 22 bp, Homo sapiens
ggccttatcgggctccagccat

SEQ ID NO: 737889 - DNA, 20 bp, Homo sapiens
ggccttcacaatctgtcagt

SEQ ID NO: 737890 - DNA, 23 bp, Homo sapiens
ggccttcagacacatgctatgtt

SEQ ID NO: 737891 - DNA, 19 bp, Homo sapiens
ggccttcagtttatttcca

SEQ ID NO: 737892 - DNA, 14 bp, Homo sapiens
ggccttccagctgc

SEQ ID NO: 737893 - DNA, 15 bp, Homo sapiens
ggccttccagctgct

SEQ ID NO: 737894 - DNA, 14 bp, Homo sapiens
ggccttccccagca

SEQ ID NO: 737895 - DNA, 19 bp, Homo sapiens
ggccttccccttttgcctg

SEQ ID NO: 737896 - DNA, 19 bp, Homo sapiens
ggccttcctcgttgggccg

SEQ ID NO: 737897 - DNA, 20 bp, Homo sapiens
ggccttcctcgttgggccgc

SEQ ID NO: 737898 - DNA, 18 bp, Homo sapiens
ggccttctcttgaggcct

SEQ ID NO: 737899 - DNA, 20 bp, Homo sapiens
ggccttctcttgaggcctgt

SEQ ID NO: 737900 - DNA, 23 bp, Homo sapiens
tgcaaaattgttttcacttgtat

SEQ ID NO: 737901 - DNA, 16 bp, Homo sapiens
tgcaaaatttccagta

SEQ ID NO: 737902 - DNA, 15 bp, Homo sapiens
tgcaaacaacctgaa

SEQ ID NO: 737903 - DNA, 18 bp, Homo sapiens
tgcaaacaacctgaatct

SEQ ID NO: 737904 - DNA, 16 bp, Homo sapiens
tgcaaacaatgaagaa

SEQ ID NO: 737905 - DNA, 17 bp, Homo sapiens
ggccttgcggaagccat

SEQ ID NO: 737906 - DNA, 12 bp, Homo sapiens
ggccttgctctg

SEQ ID NO: 737907 - DNA, 14 bp, Homo sapiens
ggccttgctctgag

SEQ ID NO: 737908 - DNA, 12 bp, Homo sapiens
ggccttgctggg

SEQ ID NO: 737909 - DNA, 23 bp, Homo sapiens
ggccttgctggggtccagggctg

SEQ ID NO: 737910 - DNA, 14 bp, Homo sapiens
ggccttgctttgtc

SEQ ID NO: 737911 - DNA, 15 bp, Homo sapiens
ggccttggctgggcc

SEQ ID NO: 737912 - DNA, 14 bp, Homo sapiens
ggccttgggaggac

SEQ ID NO: 737913 - DNA, 21 bp, Homo sapiens
ggccttgggccggtgctgggg

SEQ ID NO: 737914 - DNA, 16 bp, Homo sapiens
ggccttggggtggggg

SEQ ID NO: 737915 - DNA, 18 bp, Homo sapiens
ggccttggtatgtgccag

SEQ ID NO: 737916 - DNA, 21 bp, Homo sapiens
ggccttggtatgtgccaggct

SEQ ID NO: 737917 - DNA, 18 bp, Homo sapiens
ggccttgtcatcctccct

SEQ ID NO: 737918 - DNA, 21 bp, Homo sapiens
ggccttgtcatcctcccttgc

SEQ ID NO: 737919 - DNA, 22 bp, Homo sapiens
ggccttgtcctacgtccaaggt

SEQ ID NO: 737920 - DNA, 17 bp, Homo sapiens
ggccttgtgtgtcaggc

SEQ ID NO: 737921 - DNA, 21 bp, Homo sapiens
ggcctttatctcaacggaagc

SEQ ID NO: 737922 - DNA, 16 bp, Homo sapiens
ggcctttcagtcccaa

SEQ ID NO: 737923 - DNA, 23 bp, Homo sapiens
ggcctttcagtgtagcgggagga

SEQ ID NO: 737924 - DNA, 23 bp, Homo sapiens
ggcctttccagagaactgcagac

SEQ ID NO: 737925 - DNA, 12 bp, Homo sapiens
ggcctttccttc

SEQ ID NO: 737926 - DNA, 20 bp, Homo sapiens
ggcctttccttccctctctg

SEQ ID NO: 737927 - DNA, 21 bp, Homo sapiens
ggcctttccttccctctctga

SEQ ID NO: 737928 - DNA, 20 bp, Homo sapiens
ggcctttctcctccccacct

SEQ ID NO: 737929 - DNA, 14 bp, Homo sapiens
ggcctttcttctgt

SEQ ID NO: 737930 - DNA, 16 bp, Homo sapiens
ggcctttggaggggaa

SEQ ID NO: 737931 - DNA, 17 bp, Homo sapiens
ggcctttggaggggaaa

SEQ ID NO: 737932 - DNA, 23 bp, Homo sapiens
ggcctttgtgctgcgcctgcagg

SEQ ID NO: 737933 - DNA, 15 bp, Homo sapiens
ggccttttccaaatg

SEQ ID NO: 737934 - DNA, 16 bp, Homo sapiens
ggcctttttctgagat

SEQ ID NO: 737935 - DNA, 21 bp, Homo sapiens
ggcctttttttatagctggaa

SEQ ID NO: 737936 - DNA, 16 bp, Homo sapiens
ggcgaaggccattggg

SEQ ID NO: 737937 - DNA, 23 bp, Homo sapiens
ggcgacaagagtgagactccacc

SEQ ID NO: 737938 - DNA, 15 bp, Homo sapiens
ggcgacactcagggc

SEQ ID NO: 737939 - DNA, 23 bp, Homo sapiens
ggcgacagagcgagagtctgtct

SEQ ID NO: 737940 - DNA, 17 bp, Homo sapiens
ggcgaccaccgcccctg

SEQ ID NO: 737941 - DNA, 14 bp, Homo sapiens
ggcgactctgcaga

SEQ ID NO: 737942 - DNA, 17 bp, Homo sapiens
ggcgagccgcgggcgct

SEQ ID NO: 737943 - DNA, 22 bp, Homo sapiens
ggcgaggccggagagctggtga

SEQ ID NO: 737944 - DNA, 21 bp, Homo sapiens
ggcgaggggagggtggcaggt

SEQ ID NO: 737945 - DNA, 22 bp, Homo sapiens
ggcgagggggccggggggaggg

SEQ ID NO: 737946 - DNA, 14 bp, Homo sapiens
ggcgagtctgggga

SEQ ID NO: 737947 - DNA, 16 bp, Homo sapiens
ggcgagtgccaggact

SEQ ID NO: 737948 - DNA, 13 bp, Homo sapiens
ggcgatggggact

SEQ ID NO: 737949 - DNA, 14 bp, Homo sapiens
ggcgcaagcctgta

SEQ ID NO: 737950 - DNA, 22 bp, Homo sapiens
ggcgcaagcctgtaatcccagc

SEQ ID NO: 737951 - DNA, 15 bp, Homo sapiens
ggcgcagccaaggcc

SEQ ID NO: 737952 - DNA, 14 bp, Homo sapiens
ggcgcaggcccagt

SEQ ID NO: 737953 - DNA, 15 bp, Homo sapiens
ggcgcaggtgggctg

SEQ ID NO: 737954 - DNA, 20 bp, Homo sapiens
ggcgcaggtgggctggactt

SEQ ID NO: 737955 - DNA, 23 bp, Homo sapiens
ggcgcatgcatgggaggaattca

SEQ ID NO: 737956 - DNA, 17 bp, Homo sapiens
ggcgccaccaccacctg

SEQ ID NO: 737957 - DNA, 15 bp, Homo sapiens
ggcgccaccatcctg

SEQ ID NO: 737958 - DNA, 17 bp, Homo sapiens
ggcgccaggacagcagc

SEQ ID NO: 737959 - DNA, 20 bp, Homo sapiens
ggcgcccattcgtctgtccc

SEQ ID NO: 737960 - DNA, 21 bp, Homo sapiens
ggcgcccattcgtctgtccca

SEQ ID NO: 737961 - DNA, 15 bp, Homo sapiens
ggcgcccccgcccca

SEQ ID NO: 737962 - DNA, 18 bp, Homo sapiens
ggcgcccccgccccaggc

SEQ ID NO: 737963 - DNA, 19 bp, Homo sapiens
ggcgcccccgccccaggct

SEQ ID NO: 737964 - DNA, 21 bp, Homo sapiens
ggcgcccccgccccaggcttc

SEQ ID NO: 737965 - DNA, 14 bp, Homo sapiens
ggcgccctgcctcc

SEQ ID NO: 737966 - DNA, 16 bp, Homo sapiens
ggcgccctgcctcctg

SEQ ID NO: 737967 - DNA, 19 bp, Homo sapiens
ggcgccctgcctcctggag

SEQ ID NO: 737968 - DNA, 19 bp, Homo sapiens
ggcgccgcaaaccacactg

SEQ ID NO: 737969 - DNA, 22 bp, Homo sapiens
ggcgccgcaaaccacactggac

SEQ ID NO: 737970 - DNA, 19 bp, Homo sapiens
ggcgccggcgggcgggccg

SEQ ID NO: 737971 - DNA, 14 bp, Homo sapiens
ggcgcctggaggga

SEQ ID NO: 737972 - DNA, 23 bp, Homo sapiens
ggcgcctggagggatgcccccag

SEQ ID NO: 737973 - DNA, 13 bp, Homo sapiens
ggcgcgaccctcc

SEQ ID NO: 737974 - DNA, 22 bp, Homo sapiens
ggcgcgcacctgtaatcccagc

SEQ ID NO: 737975 - DNA, 20 bp, Homo sapiens
ggcgcgtctgccccaccctc

SEQ ID NO: 737976 - DNA, 11 bp, Homo sapiens
ggcgctcagga

SEQ ID NO: 737977 - DNA, 15 bp, Homo sapiens
ggcgctcaggaccca

SEQ ID NO: 737978 - DNA, 18 bp, Homo sapiens
ggcgctcaggacccaggc

SEQ ID NO: 737979 - DNA, 20 bp, Homo sapiens
ggcgctcaggacccaggccc

SEQ ID NO: 737980 - DNA, 12 bp, Homo sapiens
ggcgctgcaggt

SEQ ID NO: 737981 - DNA, 12 bp, Homo sapiens
ggcgctggccca

SEQ ID NO: 737982 - DNA, 13 bp, Homo sapiens
ggcgctggcccag

SEQ ID NO: 737983 - DNA, 16 bp, Homo sapiens
ggcgctggcccagccg

SEQ ID NO: 737984 - DNA, 15 bp, Homo sapiens
ggcgctgggtgcctg

SEQ ID NO: 737985 - DNA, 23 bp, Homo sapiens
ggcgctgtgcggcctcaccaggc

SEQ ID NO: 737986 - DNA, 19 bp, Homo sapiens
ggcgcttggatctggggtg

SEQ ID NO: 737987 - DNA, 22 bp, Homo sapiens
ggcggaaagcctgtaagcctgc

SEQ ID NO: 737988 - DNA, 21 bp, Homo sapiens
ggcggaccttgtagtgagccg

SEQ ID NO: 737989 - DNA, 19 bp, Homo sapiens
ggcggagagtacagtgagc

SEQ ID NO: 737990 - DNA, 14 bp, Homo sapiens
ggcggagctggccc

SEQ ID NO: 737991 - DNA, 23 bp, Homo sapiens
ggcggagctggccccgccgcctg

SEQ ID NO: 737992 - DNA, 21 bp, Homo sapiens
ggcggaggctgtgctccgcca

SEQ ID NO: 737993 - DNA, 16 bp, Homo sapiens
ggcggatcacaaggtc

SEQ ID NO: 737994 - DNA, 20 bp, Homo sapiens
ggcggatcatctaattctct

SEQ ID NO: 737995 - DNA, 21 bp, Homo sapiens
ggcggatccgcggggaccctg

SEQ ID NO: 737996 - DNA, 21 bp, Homo sapiens
ggcggcacgccaacagccccc

SEQ ID NO: 737997 - DNA, 13 bp, Homo sapiens
ggcggcagacaca

SEQ ID NO: 737998 - DNA, 20 bp, Homo sapiens
ggcggcagctcttctgggca

SEQ ID NO: 737999 - DNA, 15 bp, Homo sapiens
ggcggcagggctggg

SEQ ID NO: 738000 - DNA, 17 bp, Homo sapiens
ggcggcaggggcctgga

SEQ ID NO: 738001 - DNA, 15 bp, Homo sapiens
ggcggcatgaaccct

SEQ ID NO: 738002 - DNA, 13 bp, Homo sapiens
ggcggccagggac

SEQ ID NO: 738003 - DNA, 19 bp, Homo sapiens
ggcggccagggcggccagg

SEQ ID NO: 738004 - DNA, 14 bp, Homo sapiens
ggcggcctgcagtg

SEQ ID NO: 738005 - DNA, 13 bp, Homo sapiens
ggcggcctgtggg

SEQ ID NO: 738006 - DNA, 17 bp, Homo sapiens
ggcggctctgagcaggg

SEQ ID NO: 738007 - DNA, 20 bp, Homo sapiens
ggcggctctgagcaggggca

SEQ ID NO: 738008 - DNA, 18 bp, Homo sapiens
ggcggctgagagccccag

SEQ ID NO: 738009 - DNA, 16 bp, Homo sapiens
ggcgggagatggaccc

SEQ ID NO: 738010 - DNA, 22 bp, Homo sapiens
ggcgggatcctccacagagagg

SEQ ID NO: 738011 - DNA, 17 bp, Homo sapiens
ggcgggcagagggctgg

SEQ ID NO: 738012 - DNA, 17 bp, Homo sapiens
ggcgggccaaggactgc

SEQ ID NO: 738013 - DNA, 12 bp, Homo sapiens
ggcgggccaggg

SEQ ID NO: 738014 - DNA, 14 bp, Homo sapiens
ggcgggcggtcagg

SEQ ID NO: 738015 - DNA, 15 bp, Homo sapiens
ggcggggactgctgg

SEQ ID NO: 738016 - DNA, 13 bp, Homo sapiens
ggcggggcagtat

SEQ ID NO: 738017 - DNA, 11 bp, Homo sapiens
ggcgggggcac

SEQ ID NO: 738018 - DNA, 23 bp, Homo sapiens
ggcggggttagagccaagctgca

SEQ ID NO: 738019 - DNA, 20 bp, Homo sapiens
ggcgggtacagcgcggagga

SEQ ID NO: 738020 - DNA, 20 bp, Homo sapiens
ggcgggtggatcacaaggtc

SEQ ID NO: 738021 - DNA, 23 bp, Homo sapiens
ggcggtcacagcatggaggagga

SEQ ID NO: 738022 - DNA, 17 bp, Homo sapiens
ggcggtgcccacaccgg

SEQ ID NO: 738023 - DNA, 23 bp, Homo sapiens
ggcggtgcccacaccggggacag

SEQ ID NO: 738024 - DNA, 17 bp, Homo sapiens
ggcggtgccgcgctccg

SEQ ID NO: 738025 - DNA, 15 bp, Homo sapiens
ggcgtaatgggcctg

SEQ ID NO: 738026 - DNA, 23 bp, Homo sapiens
tgcacattttccacggaaacaga

SEQ ID NO: 738027 - DNA, 21 bp, Homo sapiens
tgcacatttttttctatgcat

SEQ ID NO: 738028 - DNA, 12 bp, Homo sapiens
tgcaccaaagac

SEQ ID NO: 738029 - DNA, 18 bp, Homo sapiens
ggcgtaatgggcctgccc

SEQ ID NO: 738030 - DNA, 18 bp, Homo sapiens
ggcgtcaggggtgcacag

SEQ ID NO: 738031 - DNA, 19 bp, Homo sapiens
ggcgtctcccccagagtgc

SEQ ID NO: 738032 - DNA, 12 bp, Homo sapiens
ggcgtctccctc

SEQ ID NO: 738033 - DNA, 13 bp, Homo sapiens
ggcgtctgctctg

SEQ ID NO: 738034 - DNA, 16 bp, Homo sapiens
ggcgtctgtatatttt

SEQ ID NO: 738035 - DNA, 21 bp, Homo sapiens
ggcgtcttcatctccctgcca

SEQ ID NO: 738036 - DNA, 18 bp, Homo sapiens
ggcgtcttgcccagcagc

SEQ ID NO: 738037 - DNA, 15 bp, Homo sapiens
ggcgtgactcaccca

SEQ ID NO: 738038 - DNA, 12 bp, Homo sapiens
ggcgtgagccac

SEQ ID NO: 738039 - DNA, 13 bp, Homo sapiens
ggcgtgagccact

SEQ ID NO: 738040 - DNA, 19 bp, Homo sapiens
ggcgtgcccccctcctcca

SEQ ID NO: 738041 - DNA, 16 bp, Homo sapiens
ggcgtgctcagaccca

SEQ ID NO: 738042 - DNA, 16 bp, Homo sapiens
ggcgtggaggagagga

SEQ ID NO: 738043 - DNA, 17 bp, Homo sapiens
ggcgtggctggcctttc

SEQ ID NO: 738044 - DNA, 19 bp, Homo sapiens
ggcgtgggggcactgacca

SEQ ID NO: 738045 - DNA, 16 bp, Homo sapiens
ggcgtggtggcgggca

SEQ ID NO: 738046 - DNA, 14 bp, Homo sapiens
ggcgtgtgcaggcc

SEQ ID NO: 738047 - DNA, 21 bp, Homo sapiens
ggcgtgtgcatagcgtcctgc

SEQ ID NO: 738048 - DNA, 22 bp, Homo sapiens
ggcgtgtgcatagcgtcctgcc

SEQ ID NO: 738049 - DNA, 23 bp, Homo sapiens
ggcgtgtggtttccctgcccctg

SEQ ID NO: 738050 - DNA, 13 bp, Homo sapiens
ggcgtgtgtgaca

SEQ ID NO: 738051 - DNA, 19 bp, Homo sapiens
ggcgttcacctccctgctc

SEQ ID NO: 738052 - DNA, 22 bp, Homo sapiens
ggcgttctaggtaggaagagcc

SEQ ID NO: 738053 - DNA, 14 bp, Homo sapiens
ggcgttctcctgct

SEQ ID NO: 738054 - DNA, 15 bp, Homo sapiens
ggcgttctcctgctt

SEQ ID NO: 738055 - DNA, 17 bp, Homo sapiens
ggcgttggtgccacttc

SEQ ID NO: 738056 - DNA, 20 bp, Homo sapiens
ggctaaaggggagaaactga

SEQ ID NO: 738057 - DNA, 21 bp, Homo sapiens
ggctaacctggacctggaact

SEQ ID NO: 738058 - DNA, 18 bp, Homo sapiens
ggctaagcaggggagaag

SEQ ID NO: 738059 - DNA, 15 bp, Homo sapiens
ggctaaggcccccaa

SEQ ID NO: 738060 - DNA, 16 bp, Homo sapiens
ggctaatgtactgcat

SEQ ID NO: 738061 - DNA, 12 bp, Homo sapiens
ggctaatgtttg

SEQ ID NO: 738062 - DNA, 17 bp, Homo sapiens
ggctaatgtttgtattt

SEQ ID NO: 738063 - DNA, 15 bp, Homo sapiens
ggctaattaaataaa

SEQ ID NO: 738064 - DNA, 21 bp, Homo sapiens
ggctacaacaggattctaggt

SEQ ID NO: 738065 - DNA, 20 bp, Homo sapiens
ggctacatcccagcctgtgg

SEQ ID NO: 738066 - DNA, 14 bp, Homo sapiens
ggctaccaggaaag

SEQ ID NO: 738067 - DNA, 22 bp, Homo sapiens
ggctacccctcgactcagcacc

SEQ ID NO: 738068 - DNA, 13 bp, Homo sapiens
ggctacctttgta

SEQ ID NO: 738069 - DNA, 15 bp, Homo sapiens
ggctactcagcagcc

SEQ ID NO: 738070 - DNA, 20 bp, Homo sapiens
ggctactcagcagccctcct

SEQ ID NO: 738071 - DNA, 22 bp, Homo sapiens
ggctactgccactgtgtgcctt

SEQ ID NO: 738072 - DNA, 16 bp, Homo sapiens
ggctagaggttcaaag

SEQ ID NO: 738073 - DNA, 13 bp, Homo sapiens
ggctagagtcctc

SEQ ID NO: 738074 - DNA, 19 bp, Homo sapiens
ggctagagtcctcactccc

SEQ ID NO: 738075 - DNA, 18 bp, Homo sapiens
ggctagcattcctcagga

SEQ ID NO: 738076 - DNA, 19 bp, Homo sapiens
ggctagcattcctcaggaa

SEQ ID NO: 738077 - DNA, 16 bp, Homo sapiens
ggctagccctgagccc

SEQ ID NO: 738078 - DNA, 20 bp, Homo sapiens
ggctagccctgagcccggcc

SEQ ID NO: 738079 - DNA, 13 bp, Homo sapiens
ggctaggtacaca

SEQ ID NO: 738080 - DNA, 19 bp, Homo sapiens
ggctaggtgggttgaaagc

SEQ ID NO: 738081 - DNA, 13 bp, Homo sapiens
ggctagtactgta

SEQ ID NO: 738082 - DNA, 22 bp, Homo sapiens
ggctagtcaagctcctcctccc

SEQ ID NO: 738083 - DNA, 13 bp, Homo sapiens
ggctagtcagaga

SEQ ID NO: 738084 - DNA, 14 bp, Homo sapiens
ggctagtcagagag

SEQ ID NO: 738085 - DNA, 18 bp, Homo sapiens
ggctagtcagagagagtg

SEQ ID NO: 738086 - DNA, 17 bp, Homo sapiens
ggctagtgaagtggcct

SEQ ID NO: 738087 - DNA, 19 bp, Homo sapiens
ggctagtgaagtggcctct

SEQ ID NO: 738088 - DNA, 20 bp, Homo sapiens
ggctagtgacttgtgtccca

SEQ ID NO: 738089 - DNA, 23 bp, Homo sapiens
ggctagtgacttgtgtcccatga

SEQ ID NO: 738090 - DNA, 19 bp, Homo sapiens
ggctagtggggtgaacagc

SEQ ID NO: 738091 - DNA, 15 bp, Homo sapiens
ggctagtgtgagtgg

SEQ ID NO: 738092 - DNA, 21 bp, Homo sapiens
ggctagtgtgagtggcagcca

SEQ ID NO: 738093 - DNA, 23 bp, Homo sapiens
ggctagtgtgagtggcagccatg

SEQ ID NO: 738094 - DNA, 17 bp, Homo sapiens
ggctatagatgtctttt

SEQ ID NO: 738095 - DNA, 16 bp, Homo sapiens
ggctatcctgctgaaa

SEQ ID NO: 738096 - DNA, 17 bp, Homo sapiens
ggctatctactaccaga

SEQ ID NO: 738097 - DNA, 20 bp, Homo sapiens
ggctatgaaaatgagccctg

SEQ ID NO: 738098 - DNA, 13 bp, Homo sapiens
ggctatgaacaga

SEQ ID NO: 738099 - DNA, 12 bp, Homo sapiens
ggctatgcattt

SEQ ID NO: 738100 - DNA, 13 bp, Homo sapiens
ggctatgcatttg

SEQ ID NO: 738101 - DNA, 17 bp, Homo sapiens
ggctatttgtgtgtatg

SEQ ID NO: 738102 - DNA, 13 bp, Homo sapiens
ggctatttgttca

SEQ ID NO: 738103 - DNA, 20 bp, Homo sapiens
ggctattttctaaagacttg

SEQ ID NO: 738104 - DNA, 17 bp, Homo sapiens
ggctcaaagcccttcct

SEQ ID NO: 738105 - DNA, 20 bp, Homo sapiens
ggctcaagcaatcctcctgc

SEQ ID NO: 738106 - DNA, 18 bp, Homo sapiens
ggctcacacacctgtagc

SEQ ID NO: 738107 - DNA, 14 bp, Homo sapiens
ggctcacactcctg

SEQ ID NO: 738108 - DNA, 17 bp, Homo sapiens
ggctcacactcctgggc

SEQ ID NO: 738109 - DNA, 18 bp, Homo sapiens
ggctcacactcctgggct

SEQ ID NO: 738110 - DNA, 16 bp, Homo sapiens
ggctcacagggcaggc

SEQ ID NO: 738111 - DNA, 19 bp, Homo sapiens
ggctcacctttagaacagg

SEQ ID NO: 738112 - DNA, 18 bp, Homo sapiens
ggctcacgcctgtaatcc

SEQ ID NO: 738113 - DNA, 22 bp, Homo sapiens
ggctcacgcctgtaatcccagc

SEQ ID NO: 738114 - DNA, 20 bp, Homo sapiens
ggctcacggggcctccaacc

SEQ ID NO: 738115 - DNA, 13 bp, Homo sapiens
ggctcactactga

SEQ ID NO: 738116 - DNA, 18 bp, Homo sapiens
ggctcactactgaacaca

SEQ ID NO: 738117 - DNA, 15 bp, Homo sapiens
ggctcactgccaggc

SEQ ID NO: 738118 - DNA, 20 bp, Homo sapiens
ggctcactgccaggccagcc

SEQ ID NO: 738119 - DNA, 14 bp, Homo sapiens
ggctcactggctgg

SEQ ID NO: 738120 - DNA, 20 bp, Homo sapiens
ggctcacttttcatccttcc

SEQ ID NO: 738121 - DNA, 12 bp, Homo sapiens
ggctcagagctt

SEQ ID NO: 738122 - DNA, 17 bp, Homo sapiens
ggctcagagcttgaaga

SEQ ID NO: 738123 - DNA, 20 bp, Homo sapiens
ggctcagagctttgtcactt

SEQ ID NO: 738124 - DNA, 15 bp, Homo sapiens
ggctcagagggggac

SEQ ID NO: 738125 - DNA, 18 bp, Homo sapiens
ggctcagagtgaccctca

SEQ ID NO: 738126 - DNA, 17 bp, Homo sapiens
ggctcagatgaaatgca

SEQ ID NO: 738127 - DNA, 18 bp, Homo sapiens
ggctcagccacagcctga

SEQ ID NO: 738128 - DNA, 11 bp, Homo sapiens
ggctcagcctg

SEQ ID NO: 738129 - DNA, 12 bp, Homo sapiens
ggctcagcctgg

SEQ ID NO: 738130 - DNA, 14 bp, Homo sapiens
ggctcagccttgca

SEQ ID NO: 738131 - DNA, 17 bp, Homo sapiens
ggctcaggcagacaaga

SEQ ID NO: 738132 - DNA, 14 bp, Homo sapiens
ggctcagggctgga

SEQ ID NO: 738133 - DNA, 15 bp, Homo sapiens
ggctcagtctcagga

SEQ ID NO: 738134 - DNA, 17 bp, Homo sapiens
ggctcagtctcaggagc

SEQ ID NO: 738135 - DNA, 15 bp, Homo sapiens
ggctcagtgccacct

SEQ ID NO: 738136 - DNA, 20 bp, Homo sapiens
ggctcagtttgtataaactg

SEQ ID NO: 738137 - DNA, 15 bp, Homo sapiens
ggctcatgccccttg

SEQ ID NO: 738138 - DNA, 16 bp, Homo sapiens
ggctccaagaggctga

SEQ ID NO: 738139 - DNA, 18 bp, Homo sapiens
ggctccacacctccaatg

SEQ ID NO: 738140 - DNA, 16 bp, Homo sapiens
ggctccagaggacctg

SEQ ID NO: 738141 - DNA, 16 bp, Homo sapiens
ggctccagagggcact

SEQ ID NO: 738142 - DNA, 17 bp, Homo sapiens
ggctccagatgcagggc

SEQ ID NO: 738143 - DNA, 14 bp, Homo sapiens
ggctccagcatcca

SEQ ID NO: 738144 - DNA, 15 bp, Homo sapiens
ggctccagcatccag

SEQ ID NO: 738145 - DNA, 19 bp, Homo sapiens
ggctccagcatccagcctg

SEQ ID NO: 738146 - DNA, 15 bp, Homo sapiens
ggctccagcccctct

SEQ ID NO: 738147 - DNA, 22 bp, Homo sapiens
ggctccagcccctcttggagaa

SEQ ID NO: 738148 - DNA, 23 bp, Homo sapiens
ggctccagcccctcttggagaag

SEQ ID NO: 738149 - DNA, 20 bp, Homo sapiens
ggctctgtgaaaacatattt

SEQ ID NO: 738150 - DNA, 21 bp, Homo sapiens
ggctctgttatcagctgggca

SEQ ID NO: 738151 - DNA, 19 bp, Homo sapiens
ggctctgtttgtgggactg

SEQ ID NO: 738152 - DNA, 20 bp, Homo sapiens
ggctctgtttgtgggactgg

SEQ ID NO: 738153 - DNA, 20 bp, Homo sapiens
ggctcttagcagcttccaga

SEQ ID NO: 738154 - DNA, 21 bp, Homo sapiens
ggctcttagcagcttccagat

SEQ ID NO: 738155 - DNA, 15 bp, Homo sapiens
ggctcttcatctgcc

SEQ ID NO: 738156 - DNA, 21 bp, Homo sapiens
ggctcttcccctagacctccc

SEQ ID NO: 738157 - DNA, 14 bp, Homo sapiens
ggctcttcctggac

SEQ ID NO: 738158 - DNA, 17 bp, Homo sapiens
ggctcttcctggacctg

SEQ ID NO: 738159 - DNA, 12 bp, Homo sapiens
ggctcttctcct

SEQ ID NO: 738160 - DNA, 14 bp, Homo sapiens
tgcacttaaagaag

SEQ ID NO: 738161 - DNA, 15 bp, Homo sapiens
tgcacttaatggctg

SEQ ID NO: 738162 - DNA, 21 bp, Homo sapiens
tgcacttattgtccccttttt

SEQ ID NO: 738163 - DNA, 20 bp, Homo sapiens
tgcacttcaaataattaaat

SEQ ID NO: 738164 - DNA, 17 bp, Homo sapiens
tgcacttgtgattattt

SEQ ID NO: 738165 - DNA, 20 bp, Homo sapiens
tgcacttgtgattatttatt

SEQ ID NO: 738166 - DNA, 16 bp, Homo sapiens
tgcactttaattgaag

SEQ ID NO: 738167 - DNA, 20 bp, Homo sapiens
tgcactttaattgaagaact

SEQ ID NO: 738168 - DNA, 19 bp, Homo sapiens
tgcactttagacatttttg

SEQ ID NO: 738169 - DNA, 16 bp, Homo sapiens
tgcactttataaacac

SEQ ID NO: 738170 - DNA, 18 bp, Homo sapiens
tgcactttcccccttccc

SEQ ID NO: 738171 - DNA, 21 bp, Homo sapiens
tgcactttcccccttcccgcc

SEQ ID NO: 738172 - DNA, 12 bp, Homo sapiens
tgcactttccct

SEQ ID NO: 738173 - DNA, 15 bp, Homo sapiens
tgcactttccctaga

SEQ ID NO: 738174 - DNA, 18 bp, Homo sapiens
tgcactttccctagaaag

SEQ ID NO: 738175 - DNA, 19 bp, Homo sapiens
tgcactttccctagaaagc

SEQ ID NO: 738176 - DNA, 19 bp, Homo sapiens
tgcactttctaatgtttct

SEQ ID NO: 738177 - DNA, 14 bp, Homo sapiens
tgcactttgtaaat

SEQ ID NO: 738178 - DNA, 17 bp, Homo sapiens
tgcactttgtaaattcc

SEQ ID NO: 738179 - DNA, 15 bp, Homo sapiens
tgcactttgtttaga

SEQ ID NO: 738180 - DNA, 19 bp, Homo sapiens
tgcactttgtttagaaaaa

SEQ ID NO: 738181 - DNA, 19 bp, Homo sapiens
tgcacttttagaaatgcat

SEQ ID NO: 738182 - DNA, 16 bp, Homo sapiens
tgcacttttgggcctt

SEQ ID NO: 738183 - DNA, 15 bp, Homo sapiens
tgcagaaaaaacaaa

SEQ ID NO: 738184 - DNA, 21 bp, Homo sapiens
tgcagaaaagctcagagtagg

SEQ ID NO: 738185 - DNA, 18 bp, Homo sapiens
tgcagaaaattctgtgcc

SEQ ID NO: 738186 - DNA, 15 bp, Homo sapiens
tgcagaaactactga

SEQ ID NO: 738187 - DNA, 21 bp, Homo sapiens
tgcagaaatagacaaaaagta

SEQ ID NO: 738188 - DNA, 20 bp, Homo sapiens
tgcagaaatcacgttgctgg

SEQ ID NO: 738189 - DNA, 13 bp, Homo sapiens
tgcagaacacctg

SEQ ID NO: 738190 - DNA, 15 bp, Homo sapiens
tgcagaacacctggc

SEQ ID NO: 738191 - DNA, 19 bp, Homo sapiens
tgcagaacacctggccggg

SEQ ID NO: 738192 - DNA, 13 bp, Homo sapiens
tgcagaactgcca

SEQ ID NO: 738193 - DNA, 22 bp, Homo sapiens
tgcagaagcatattttgctggt

SEQ ID NO: 738194 - DNA, 12 bp, Homo sapiens
tgcagaaggaaa

SEQ ID NO: 738195 - DNA, 21 bp, Homo sapiens
tgcagaaggaaaaatgtgtaa

SEQ ID NO: 738196 - DNA, 15 bp, Homo sapiens
tgcagaaggaaatga

SEQ ID NO: 738197 - DNA, 18 bp, Homo sapiens
tgcagaaggaaatgatgg

SEQ ID NO: 738198 - DNA, 16 bp, Homo sapiens
tgcagaatacttgact

SEQ ID NO: 738199 - DNA, 23 bp, Homo sapiens
tgcagaatccctttgcacctgag

SEQ ID NO: 738200 - DNA, 17 bp, Homo sapiens
tgcagaatgactccacc

SEQ ID NO: 738201 - DNA, 17 bp, Homo sapiens
tgcagacacctggactg

SEQ ID NO: 738202 - DNA, 21 bp, Homo sapiens
tgcagacagaagtctcctcaa

SEQ ID NO: 738203 - DNA, 13 bp, Homo sapiens
tgcagacagccat

SEQ ID NO: 738204 - DNA, 14 bp, Homo sapiens
tgcagacagccatg

SEQ ID NO: 738205 - DNA, 23 bp, Homo sapiens
tgcagacaggccatgtgagccac

SEQ ID NO: 738206 - DNA, 15 bp, Homo sapiens
tgcagacaggctctg

SEQ ID NO: 738207 - DNA, 22 bp, Homo sapiens
tgcagacagtctgttatgcact

SEQ ID NO: 738208 - DNA, 16 bp, Homo sapiens
tgcagacatctctgga

SEQ ID NO: 738209 - DNA, 17 bp, Homo sapiens
tgcagacatctctggag

SEQ ID NO: 738210 - DNA, 22 bp, Homo sapiens
tgcagacatctctggagccaga

SEQ ID NO: 738211 - DNA, 15 bp, Homo sapiens
tgcagacattctcaa

SEQ ID NO: 738212 - DNA, 22 bp, Homo sapiens
tgcagacattctcaaagcctct

SEQ ID NO: 738213 - DNA, 14 bp, Homo sapiens
tgcagaccatgcca

SEQ ID NO: 738214 - DNA, 17 bp, Homo sapiens
tgcagaccctgaaccca

SEQ ID NO: 738215 - DNA, 23 bp, Homo sapiens
tgcagaccctgaacccacacctg

SEQ ID NO: 738216 - DNA, 19 bp, Homo sapiens
tgcagacgggaatgcctag

SEQ ID NO: 738217 - DNA, 20 bp, Homo sapiens
tgcagacgggaatgcctagg

SEQ ID NO: 738218 - DNA, 10 bp, Homo sapiens
tgcagagaaa

SEQ ID NO: 738219 - DNA, 19 bp, Homo sapiens
tgcagagaaacgcgctcct

SEQ ID NO: 738220 - DNA, 19 bp, Homo sapiens
tgcagagaaacttaagcaa

SEQ ID NO: 738221 - DNA, 15 bp, Homo sapiens
tgcagagaaagaaag

SEQ ID NO: 738222 - DNA, 20 bp, Homo sapiens
tgcagagacaggacctgact

SEQ ID NO: 738223 - DNA, 13 bp, Homo sapiens
tgcagagagaagc

SEQ ID NO: 738224 - DNA, 16 bp, Homo sapiens
tgcagagcaataacac

SEQ ID NO: 738225 - DNA, 23 bp, Homo sapiens
tgcagagcacctttgcacaggat

SEQ ID NO: 738226 - DNA, 10 bp, Homo sapiens
tgcagagcct

SEQ ID NO: 738227 - DNA, 15 bp, Homo sapiens
tgcagagccttctca

SEQ ID NO: 738228 - DNA, 17 bp, Homo sapiens
tgcagagccttctcaga

SEQ ID NO: 738229 - DNA, 14 bp, Homo sapiens
tgcagagctatggt

SEQ ID NO: 738230 - DNA, 15 bp, Homo sapiens
tgcagaggagcccag

SEQ ID NO: 738231 - DNA, 17 bp, Homo sapiens
tgcagaggagcccagtg

SEQ ID NO: 738232 - DNA, 18 bp, Homo sapiens
tgcagaggagcccagtgg

SEQ ID NO: 738233 - DNA, 22 bp, Homo sapiens
tgcagaggagcccagtgggctg

SEQ ID NO: 738234 - DNA, 13 bp, Homo sapiens
tgcagaggattta

SEQ ID NO: 738235 - DNA, 18 bp, Homo sapiens
tgcagaggatttaactgt

SEQ ID NO: 738236 - DNA, 14 bp, Homo sapiens
tgcagaggcctggg

SEQ ID NO: 738237 - DNA, 17 bp, Homo sapiens
tgcagaggcctggggga

SEQ ID NO: 738238 - DNA, 11 bp, Homo sapiens
tgcagaggctg

SEQ ID NO: 738239 - DNA, 13 bp, Homo sapiens
tgcagaggctgtg

SEQ ID NO: 738240 - DNA, 14 bp, Homo sapiens
tgcagaggctgtgg

SEQ ID NO: 738241 - DNA, 14 bp, Homo sapiens
tgcagaggtctgtg

SEQ ID NO: 738242 - DNA, 18 bp, Homo sapiens
tgcagaggtctgtgctga

SEQ ID NO: 738243 - DNA, 14 bp, Homo sapiens
tgcagaggtttctt

SEQ ID NO: 738244 - DNA, 17 bp, Homo sapiens
tgcagagtcctgcacag

SEQ ID NO: 738245 - DNA, 15 bp, Homo sapiens
tgcagataaaatatt

SEQ ID NO: 738246 - DNA, 17 bp, Homo sapiens
tgcagataattctggac

SEQ ID NO: 738247 - DNA, 18 bp, Homo sapiens
tgcagatagcccaggagc

SEQ ID NO: 738248 - DNA, 17 bp, Homo sapiens
tgcagatatctgcatgt

SEQ ID NO: 738249 - DNA, 19 bp, Homo sapiens
tgcagatatctgcatgtgt

SEQ ID NO: 738250 - DNA, 19 bp, Homo sapiens
tgcagatcatccgtctgtg

SEQ ID NO: 738251 - DNA, 15 bp, Homo sapiens
tgcagatgcaattgt

SEQ ID NO: 738252 - DNA, 17 bp, Homo sapiens
tgcagatgcaattgttt

SEQ ID NO: 738253 - DNA, 17 bp, Homo sapiens
tgcagatgccaccctag

SEQ ID NO: 738254 - DNA, 20 bp, Homo sapiens
tgcagatgccaccctagcca

SEQ ID NO: 738255 - DNA, 17 bp, Homo sapiens
tgcagatgctgctgaag

SEQ ID NO: 738256 - DNA, 14 bp, Homo sapiens
tgcagatgggctgt

SEQ ID NO: 738257 - DNA, 18 bp, Homo sapiens
tgcagatggtgagagata

SEQ ID NO: 738258 - DNA, 16 bp, Homo sapiens
tgcagattacactgat

SEQ ID NO: 738259 - DNA, 17 bp, Homo sapiens
tgcagattcctgggcct

SEQ ID NO: 738260 - DNA, 21 bp, Homo sapiens
tgcagattcctgggcctgtcc

SEQ ID NO: 738261 - DNA, 22 bp, Homo sapiens
tgcagattcctgggcctgtccc

SEQ ID NO: 738262 - DNA, 22 bp, Homo sapiens
tgcagattgagacctacaggct

SEQ ID NO: 738263 - DNA, 22 bp, Homo sapiens
tgcagcaaacactccaccctcc

SEQ ID NO: 738264 - DNA, 20 bp, Homo sapiens
tgcagcaataaagcagcgtt

SEQ ID NO: 738265 - DNA, 23 bp, Homo sapiens
tgcagcacagctgagaggctgtc

SEQ ID NO: 738266 - DNA, 21 bp, Homo sapiens
tgcagcacatgcgggctcgcc

SEQ ID NO: 738267 - DNA, 15 bp, Homo sapiens
tgcagcacctccagg

SEQ ID NO: 738268 - DNA, 15 bp, Homo sapiens
tgcagcacgcggcct

SEQ ID NO: 738269 - DNA, 20 bp, Homo sapiens
tgcagcactttaaccctctc

SEQ ID NO: 738270 - DNA, 23 bp, Homo sapiens
tgcagcactttaaccctctcttc

SEQ ID NO: 738271 - DNA, 15 bp, Homo sapiens
tgagagttccttctc

SEQ ID NO: 738272 - DNA, 18 bp, Homo sapiens
tgagagttccttctcact

SEQ ID NO: 738273 - DNA, 18 bp, Homo sapiens
tgagagttggctcaggca

SEQ ID NO: 738274 - DNA, 12 bp, Homo sapiens
tgagagttgtct

SEQ ID NO: 738275 - DNA, 14 bp, Homo sapiens
tgagagttgtctct

SEQ ID NO: 738276 - DNA, 16 bp, Homo sapiens
tgagagttgtctctgt

SEQ ID NO: 738277 - DNA, 17 bp, Homo sapiens
tgagagttgtctctgtt

SEQ ID NO: 738278 - DNA, 15 bp, Homo sapiens
tgagagtttcctcag

SEQ ID NO: 738279 - DNA, 18 bp, Homo sapiens
tgagagttttgtcttgaa

SEQ ID NO: 738280 - DNA, 16 bp, Homo sapiens
tgagataatgttagag

SEQ ID NO: 738281 - DNA, 18 bp, Homo sapiens
tgagataccacaaaccct

SEQ ID NO: 738282 - DNA, 21 bp, Homo sapiens
tgagataccagcgaggaggct

SEQ ID NO: 738283 - DNA, 21 bp, Homo sapiens
tgagatactttgcattgtctg

SEQ ID NO: 738284 - DNA, 16 bp, Homo sapiens
tgagatagaagaactg

SEQ ID NO: 738285 - DNA, 19 bp, Homo sapiens
tgagatagaagaactgcaa

SEQ ID NO: 738286 - DNA, 23 bp, Homo sapiens
tgagatagtagcatacatttata

SEQ ID NO: 738287 - DNA, 15 bp, Homo sapiens
tgagatatttattgt

SEQ ID NO: 738288 - DNA, 17 bp, Homo sapiens
tgagatcacagcctcca

SEQ ID NO: 738289 - DNA, 22 bp, Homo sapiens
tgagatcactgactctgactca

SEQ ID NO: 738290 - DNA, 16 bp, Homo sapiens
tgagatcccctgagcc

SEQ ID NO: 738291 - DNA, 13 bp, Homo sapiens
tgagatcctcttt

SEQ ID NO: 738292 - DNA, 19 bp, Homo sapiens
tgagatcctctttactctg

SEQ ID NO: 738293 - DNA, 20 bp, Homo sapiens
tgagatcctctttactctgg

SEQ ID NO: 738294 - DNA, 21 bp, Homo sapiens
tgagatcctctttactctggg

SEQ ID NO: 738295 - DNA, 23 bp, Homo sapiens
tgagatcctctttactctgggca

SEQ ID NO: 738296 - DNA, 20 bp, Homo sapiens
tgagatcgtgctactgcact

SEQ ID NO: 738297 - DNA, 22 bp, Homo sapiens
tgagatctaagcctttccataa

SEQ ID NO: 738298 - DNA, 21 bp, Homo sapiens
tgagatgagggatgggcctgg

SEQ ID NO: 738299 - DNA, 22 bp, Homo sapiens
tgagatgagggatgggcctggc

SEQ ID NO: 738300 - DNA, 15 bp, Homo sapiens
tgagatgagtttctg

SEQ ID NO: 738301 - DNA, 16 bp, Homo sapiens
tgagatgagtttctgg

SEQ ID NO: 738302 - DNA, 14 bp, Homo sapiens
tgagatgcagctgg

SEQ ID NO: 738303 - DNA, 14 bp, Homo sapiens
tgagatgctaattt

SEQ ID NO: 738304 - DNA, 21 bp, Homo sapiens
tgagatggaacccttttggcc

SEQ ID NO: 738305 - DNA, 17 bp, Homo sapiens
tgagatggagaggctga

SEQ ID NO: 738306 - DNA, 18 bp, Homo sapiens
tgagatggagaggctgag

SEQ ID NO: 738307 - DNA, 13 bp, Homo sapiens
tgagatggagctg

SEQ ID NO: 738308 - DNA, 16 bp, Homo sapiens
tgagatggccatgctc

SEQ ID NO: 738309 - DNA, 16 bp, Homo sapiens
tgagatggtatgaaat

SEQ ID NO: 738310 - DNA, 22 bp, Homo sapiens
tgagatggttaaaaaggccaaa

SEQ ID NO: 738311 - DNA, 16 bp, Homo sapiens
tgagatgtagaaagtt

SEQ ID NO: 738312 - DNA, 12 bp, Homo sapiens
tgagatgtatga

SEQ ID NO: 738313 - DNA, 18 bp, Homo sapiens
tgagatgtgtatcagtgt

SEQ ID NO: 738314 - DNA, 20 bp, Homo sapiens
tgagatgtgtatcagtgttt

SEQ ID NO: 738315 - DNA, 15 bp, Homo sapiens
tgagatgttttacca

SEQ ID NO: 738316 - DNA, 18 bp, Homo sapiens
tgagattactttgtcccg

SEQ ID NO: 738317 - DNA, 19 bp, Homo sapiens
tgagattgacctgaggaga

SEQ ID NO: 738318 - DNA, 23 bp, Homo sapiens
tgagattgttttctttttctacc

SEQ ID NO: 738319 - DNA, 16 bp, Homo sapiens
tgagatttactgctct

SEQ ID NO: 738320 - DNA, 20 bp, Homo sapiens
tgagatttgccagcacaggg

SEQ ID NO: 738321 - DNA, 19 bp, Homo sapiens
tgagattttcctccatttt

SEQ ID NO: 738322 - DNA, 21 bp, Homo sapiens
tgagattttcctccattttta

SEQ ID NO: 738323 - DNA, 22 bp, Homo sapiens
tgagattttggaagaagttttt

SEQ ID NO: 738324 - DNA, 18 bp, Homo sapiens
tgagatttttaagaactt

SEQ ID NO: 738325 - DNA, 20 bp, Homo sapiens
tgagatttttttgtgtatgt

SEQ ID NO: 738326 - DNA, 16 bp, Homo sapiens
tgagatttttttttct

SEQ ID NO: 738327 - DNA, 19 bp, Homo sapiens
tgagcaaaatatgcccctt

SEQ ID NO: 738328 - DNA, 14 bp, Homo sapiens
ctgtgttctgggct

SEQ ID NO: 738329 - DNA, 22 bp, Homo sapiens
ctgtgttcttgccactgcactc

SEQ ID NO: 738330 - DNA, 20 bp, Homo sapiens
ctgtgttcttgctgagcacc

SEQ ID NO: 738331 - DNA, 14 bp, Homo sapiens
ctgtgttgaacaca

SEQ ID NO: 738332 - DNA, 19 bp, Homo sapiens
ctgtgttgactgctgctcc

SEQ ID NO: 738333 - DNA, 22 bp, Homo sapiens
ctgtgttgactgctgctcccca

SEQ ID NO: 738334 - DNA, 22 bp, Homo sapiens
ctgtgttgtattaacaaaagtt

SEQ ID NO: 738335 - DNA, 13 bp, Homo sapiens
ctgtgtttaaaaa

SEQ ID NO: 738336 - DNA, 19 bp, Homo sapiens
ctgtgtttaaaaagtaagt

SEQ ID NO: 738337 - DNA, 14 bp, Homo sapiens
ctgtgtttcactta

SEQ ID NO: 738338 - DNA, 21 bp, Homo sapiens
ctgtgtttcacttaatgtttc

SEQ ID NO: 738339 - DNA, 14 bp, Homo sapiens
ctgtgtttccaaag

SEQ ID NO: 738340 - DNA, 15 bp, Homo sapiens
ctgtgtttgaagttt

SEQ ID NO: 738341 - DNA, 15 bp, Homo sapiens
ctgtgtttgcagcct

SEQ ID NO: 738342 - DNA, 15 bp, Homo sapiens
ctgtgtttgtcctgg

SEQ ID NO: 738343 - DNA, 18 bp, Homo sapiens
ctgtgttttgaaagaata

SEQ ID NO: 738344 - DNA, 15 bp, Homo sapiens
ctgtgtttttgaaat

SEQ ID NO: 738345 - DNA, 23 bp, Homo sapiens
ctgtgtttttgctatcacacagt

SEQ ID NO: 738346 - DNA, 15 bp, Homo sapiens
ctgttaaaaaaataa

SEQ ID NO: 738347 - DNA, 19 bp, Homo sapiens
ctgttaaaaaagaaatctg

SEQ ID NO: 738348 - DNA, 16 bp, Homo sapiens
ctgttaaaatgtacac

SEQ ID NO: 738349 - DNA, 13 bp, Homo sapiens
ctgttaaacagta

SEQ ID NO: 738350 - DNA, 22 bp, Homo sapiens
ctgttaaacagtagttgtattc

SEQ ID NO: 738351 - DNA, 12 bp, Homo sapiens
ctgttaaactgt

SEQ ID NO: 738352 - DNA, 15 bp, Homo sapiens
ctgttaaactgttag

SEQ ID NO: 738353 - DNA, 16 bp, Homo sapiens
ctgttaaatacaggaa

SEQ ID NO: 738354 - DNA, 17 bp, Homo sapiens
ctgttaaatacaggaaa

SEQ ID NO: 738355 - DNA, 19 bp, Homo sapiens
ctgttaaatacaggaaaca

SEQ ID NO: 738356 - DNA, 13 bp, Homo sapiens
ctgttaacatcta

SEQ ID NO: 738357 - DNA, 18 bp, Homo sapiens
ctgttaactgaataccac

SEQ ID NO: 738358 - DNA, 19 bp, Homo sapiens
ctgttaactgaataccact

SEQ ID NO: 738359 - DNA, 13 bp, Homo sapiens
ctgttaagaaagg

SEQ ID NO: 738360 - DNA, 14 bp, Homo sapiens
ctgttaagagagga

SEQ ID NO: 738361 - DNA, 17 bp, Homo sapiens
ctgttaatttataatgt

SEQ ID NO: 738362 - DNA, 21 bp, Homo sapiens
ctgttaatttataatgtattt

SEQ ID NO: 738363 - DNA, 22 bp, Homo sapiens
ctgttaatttataatgtatttg

SEQ ID NO: 738364 - DNA, 16 bp, Homo sapiens
ctgttaatttttctta

SEQ ID NO: 738365 - DNA, 13 bp, Homo sapiens
ctgttacactgga

SEQ ID NO: 738366 - DNA, 14 bp, Homo sapiens
ctgttacagtaatg

SEQ ID NO: 738367 - DNA, 17 bp, Homo sapiens
ctgttacctgtcttgct

SEQ ID NO: 738368 - DNA, 21 bp, Homo sapiens
ctgttacctgtcttgctcctg

SEQ ID NO: 738369 - DNA, 22 bp, Homo sapiens
ctgttacctgtcttgctcctgg

SEQ ID NO: 738370 - DNA, 23 bp, Homo sapiens
ctgttacctgtcttgctcctggg

SEQ ID NO: 738371 - DNA, 18 bp, Homo sapiens
ctgttactctaaatagaa

SEQ ID NO: 738372 - DNA, 13 bp, Homo sapiens
ctgttactgcttc

SEQ ID NO: 738373 - DNA, 23 bp, Homo sapiens
ctgttactgcttctctttgtgca

SEQ ID NO: 738374 - DNA, 19 bp, Homo sapiens
ctgttacttacctaaacag

SEQ ID NO: 738375 - DNA, 18 bp, Homo sapiens
ctgttacttgaaatacca

SEQ ID NO: 738376 - DNA, 16 bp, Homo sapiens
ctgttacttgcttcag

SEQ ID NO: 738377 - DNA, 15 bp, Homo sapiens
ctgttactttctttc

SEQ ID NO: 738378 - DNA, 17 bp, Homo sapiens
ctgttagaattctttta

SEQ ID NO: 738379 - DNA, 18 bp, Homo sapiens
ctgttagaattcttttat

SEQ ID NO: 738380 - DNA, 13 bp, Homo sapiens
ctgttagcactgt

SEQ ID NO: 738381 - DNA, 16 bp, Homo sapiens
ctgttagcactgttga

SEQ ID NO: 738382 - DNA, 13 bp, Homo sapiens
ctgttagcagagt

SEQ ID NO: 738383 - DNA, 15 bp, Homo sapiens
ctgttagcagagtct

SEQ ID NO: 738384 - DNA, 22 bp, Homo sapiens
ctgttagcagagtctgtctctt

SEQ ID NO: 738385 - DNA, 16 bp, Homo sapiens
ctgttaggtccatttt

SEQ ID NO: 738386 - DNA, 15 bp, Homo sapiens
ctgttagtcatttgc

SEQ ID NO: 738387 - DNA, 22 bp, Homo sapiens
gaaatatcagttactcagccct

SEQ ID NO: 738388 - DNA, 14 bp, Homo sapiens
gaaatatcatttat

SEQ ID NO: 738389 - DNA, 23 bp, Homo sapiens
gaaatatccacccagcaggcaga

SEQ ID NO: 738390 - DNA, 20 bp, Homo sapiens
gaaatatctgaaaatgtatg

SEQ ID NO: 738391 - DNA, 21 bp, Homo sapiens
gaaatatctgtgaaatatcat

SEQ ID NO: 738392 - DNA, 15 bp, Homo sapiens
gaaatatctttctct

SEQ ID NO: 738393 - DNA, 16 bp, Homo sapiens
gaaatatctttctctt

SEQ ID NO: 738394 - DNA, 17 bp, Homo sapiens
gaaatatgaaattccag

SEQ ID NO: 738395 - DNA, 13 bp, Homo sapiens
gaaatatttaagt

SEQ ID NO: 738396 - DNA, 22 bp, Homo sapiens
gaaatatttaagtatatagtat

SEQ ID NO: 738397 - DNA, 15 bp, Homo sapiens
gaaatatttacctaa

SEQ ID NO: 738398 - DNA, 13 bp, Homo sapiens
gaaatatttattt

SEQ ID NO: 738399 - DNA, 19 bp, Homo sapiens
gaaatatttatttttttaa

SEQ ID NO: 738400 - DNA, 19 bp, Homo sapiens
gaaatatttccattaacag

SEQ ID NO: 738401 - DNA, 13 bp, Homo sapiens
gaaatattttaaa

SEQ ID NO: 738402 - DNA, 15 bp, Homo sapiens
gaaatcaaccctctc

SEQ ID NO: 738403 - DNA, 18 bp, Homo sapiens
gaaatcaaccctctcctg

SEQ ID NO: 738404 - DNA, 21 bp, Homo sapiens
gaaatcaaccctctcctgtct

SEQ ID NO: 738405 - DNA, 16 bp, Homo sapiens
gaaatcacagaatcat

SEQ ID NO: 738406 - DNA, 23 bp, Homo sapiens
gaaatcacgttgctggtggtttt

SEQ ID NO: 738407 - DNA, 10 bp, Homo sapiens
gaaatcactg

SEQ ID NO: 738408 - DNA, 12 bp, Homo sapiens
gaaatcactgtg

SEQ ID NO: 738409 - DNA, 14 bp, Homo sapiens
gaaatcactgtgaa

SEQ ID NO: 738410 - DNA, 12 bp, Homo sapiens
gaaatcagcatg

SEQ ID NO: 738411 - DNA, 17 bp, Homo sapiens
gaaatcagcatgacaaa

SEQ ID NO: 738412 - DNA, 14 bp, Homo sapiens
gaaatcagccaagt

SEQ ID NO: 738413 - DNA, 17 bp, Homo sapiens
gaaatcatgtccataca

SEQ ID NO: 738414 - DNA, 11 bp, Homo sapiens
gaaatccagga

SEQ ID NO: 738415 - DNA, 19 bp, Homo sapiens
gaaatccatatatatgaaa

SEQ ID NO: 738416 - DNA, 22 bp, Homo sapiens
gtttttttccctctcctgtcct

SEQ ID NO: 738417 - DNA, 21 bp, Homo sapiens
gtttttttcctcatgtaacat

SEQ ID NO: 738418 - DNA, 15 bp, Homo sapiens
gtttttttggtcact

SEQ ID NO: 738419 - DNA, 21 bp, Homo sapiens
gtttttttggtcactccagta

SEQ ID NO: 738420 - DNA, 18 bp, Homo sapiens
gttttttttaaataaaag

SEQ ID NO: 738421 - DNA, 20 bp, Homo sapiens
gttttttttaaataaaagca

SEQ ID NO: 738422 - DNA, 15 bp, Homo sapiens
gttttttttaatgtg

SEQ ID NO: 738423 - DNA, 15 bp, Homo sapiens
gttttttttcagttg

SEQ ID NO: 738424 - DNA, 14 bp, Homo sapiens
gttttttttgcagg

SEQ ID NO: 738425 - DNA, 17 bp, Homo sapiens
gtttttttttttccaga

SEQ ID NO: 738426 - DNA, 17 bp, Homo sapiens
gttttttttttttcctt

SEQ ID NO: 738427 - DNA, 20 bp, Homo sapiens
gtttttttttttttacatgt

SEQ ID NO: 738428 - DNA, 17 bp, Homo sapiens
taaaaaaaaaaggatga

SEQ ID NO: 738429 - DNA, 16 bp, Homo sapiens
taaaaaaaaaagtcac

SEQ ID NO: 738430 - DNA, 16 bp, Homo sapiens
taaaaaaaaaggcata

SEQ ID NO: 738431 - DNA, 22 bp, Homo sapiens
taaaaaaaaatactctttcaat

SEQ ID NO: 738432 - DNA, 15 bp, Homo sapiens
taaaaaaaaattgta

SEQ ID NO: 738433 - DNA, 13 bp, Homo sapiens
taaaaaaaacaaa

SEQ ID NO: 738434 - DNA, 18 bp, Homo sapiens
taaaaaaaacaaaaagaa

SEQ ID NO: 738435 - DNA, 19 bp, Homo sapiens
taaaaaaaacaaaaagaac

SEQ ID NO: 738436 - DNA, 15 bp, Homo sapiens
taaaaaaaagaagag

SEQ ID NO: 738437 - DNA, 12 bp, Homo sapiens
taaaaaaacaat

SEQ ID NO: 738438 - DNA, 13 bp, Homo sapiens
taaaaaaactgaa

SEQ ID NO: 738439 - DNA, 18 bp, Homo sapiens
taaaaaaactgaaggttt

SEQ ID NO: 738440 - DNA, 19 bp, Homo sapiens
taaaaaaactgaaggtttt

SEQ ID NO: 738441 - DNA, 20 bp, Homo sapiens
taaaaaaactggccttttga

SEQ ID NO: 738442 - DNA, 15 bp, Homo sapiens
taaaaaaagaaagca

SEQ ID NO: 738443 - DNA, 14 bp, Homo sapiens
taaaaaaagcaaaa

SEQ ID NO: 738444 - DNA, 15 bp, Homo sapiens
taaaaaaagcaaaaa

SEQ ID NO: 738445 - DNA, 21 bp, Homo sapiens
taaaaaaagcaaaaatgacaa

SEQ ID NO: 738446 - DNA, 12 bp, Homo sapiens
taaaaaaagtag

SEQ ID NO: 738447 - DNA, 20 bp, Homo sapiens
taaaaaaataagaagaatgc

SEQ ID NO: 738448 - DNA, 21 bp, Homo sapiens
taaaaaaatagaaaaaaagaa

SEQ ID NO: 738449 - DNA, 21 bp, Homo sapiens
taaaaaaatgatgcagctgtt

SEQ ID NO: 738450 - DNA, 13 bp, Homo sapiens
taaaaaaattggt

SEQ ID NO: 738451 - DNA, 17 bp, Homo sapiens
taaaaaacaaaaaaaga

SEQ ID NO: 738452 - DNA, 12 bp, Homo sapiens
taaaaaacaaga

SEQ ID NO: 738453 - DNA, 17 bp, Homo sapiens
taaaaaactaaaaacta

SEQ ID NO: 738454 - DNA, 19 bp, Homo sapiens
taaaaaactaaaaactaga

SEQ ID NO: 738455 - DNA, 13 bp, Homo sapiens
taaaaaagaaaaa

SEQ ID NO: 738456 - DNA, 18 bp, Homo sapiens
taaaaaagactgaacatg

SEQ ID NO: 738457 - DNA, 20 bp, Homo sapiens
taaaaaagactgaacatgtt

SEQ ID NO: 738458 - DNA, 15 bp, Homo sapiens
taaaaaagattctac

SEQ ID NO: 738459 - DNA, 17 bp, Homo sapiens
taaaaaagcaaatggaa

SEQ ID NO: 738460 - DNA, 18 bp, Homo sapiens
taaaaaagcatacttcta

SEQ ID NO: 738461 - DNA, 23 bp, Homo sapiens
taaaaaagcctggtttttctcaa

SEQ ID NO: 738462 - DNA, 15 bp, Homo sapiens
taaaaaagccttcct

SEQ ID NO: 738463 - DNA, 18 bp, Homo sapiens
taaaaaagcgaggtggcc

SEQ ID NO: 738464 - DNA, 17 bp, Homo sapiens
taaaaaagcttaaaact

SEQ ID NO: 738465 - DNA, 17 bp, Homo sapiens
taaaaaataccattgaa

SEQ ID NO: 738466 - DNA, 13 bp, Homo sapiens
taaaaaatcaatc

SEQ ID NO: 738467 - DNA, 14 bp, Homo sapiens
taaaaaatcaatca

SEQ ID NO: 738468 - DNA, 11 bp, Homo sapiens
taaaaaatgta

SEQ ID NO: 738469 - DNA, 14 bp, Homo sapiens
taaaaaatgtaaca

SEQ ID NO: 738470 - DNA, 13 bp, Homo sapiens
taaaaaatgtcca

SEQ ID NO: 738471 - DNA, 14 bp, Homo sapiens
taaaaaatgtgaaa

SEQ ID NO: 738472 - DNA, 13 bp, Homo sapiens
taaaaaatgtttc

SEQ ID NO: 738473 - DNA, 13 bp, Homo sapiens
taaaaaattctct

SEQ ID NO: 738474 - DNA, 19 bp, Homo sapiens
taaaaacaactttcacttc

SEQ ID NO: 738475 - DNA, 15 bp, Homo sapiens
taaaaacagattctg

SEQ ID NO: 738476 - DNA, 17 bp, Homo sapiens
taaaaacagattctgat

SEQ ID NO: 738477 - DNA, 18 bp, Homo sapiens
taaaaacagattctgatt

SEQ ID NO: 738478 - DNA, 20 bp, Homo sapiens
taaaaacagatttggaaaga

SEQ ID NO: 738479 - DNA, 22 bp, Homo sapiens
taaaaacagatttggaaagact

SEQ ID NO: 738480 - DNA, 17 bp, Homo sapiens
taaaaacagcagctcat

SEQ ID NO: 738481 - DNA, 18 bp, Homo sapiens
taaaaacagcattgcttt

SEQ ID NO: 738482 - DNA, 19 bp, Homo sapiens
taaaaacagcattgctttc

SEQ ID NO: 738483 - DNA, 21 bp, Homo sapiens
taaaaacattgcctttgaatg

SEQ ID NO: 738484 - DNA, 19 bp, Homo sapiens
taaaaaccaaacccagaca

SEQ ID NO: 738485 - DNA, 19 bp, Homo sapiens
taaaaaccatgctggtata

SEQ ID NO: 738486 - DNA, 18 bp, Homo sapiens
taaaaaccgaataaatgt

SEQ ID NO: 738487 - DNA, 20 bp, Homo sapiens
taaaaactcaggcaaagaaa

SEQ ID NO: 738488 - DNA, 14 bp, Homo sapiens
taaaaactcctttt

SEQ ID NO: 738489 - DNA, 13 bp, Homo sapiens
taaaaactcttca

SEQ ID NO: 738490 - DNA, 16 bp, Homo sapiens
taaaaactgactcctt

SEQ ID NO: 738491 - DNA, 16 bp, Homo sapiens
taaaaactgagtgact

SEQ ID NO: 738492 - DNA, 11 bp, Homo sapiens
taaaaactgtg

SEQ ID NO: 738493 - DNA, 12 bp, Homo sapiens
taaaaactgtgt

SEQ ID NO: 738494 - DNA, 13 bp, Homo sapiens
taaaaactgtgta

SEQ ID NO: 738495 - DNA, 18 bp, Homo sapiens
taaaaactgtgtatcatt

SEQ ID NO: 738496 - DNA, 23 bp, Homo sapiens
taaaaactgtgtatcattaaaat

SEQ ID NO: 738497 - DNA, 13 bp, Homo sapiens
taaaaagaaaggc

SEQ ID NO: 738498 - DNA, 16 bp, Homo sapiens
taaaaagaaatccagt

SEQ ID NO: 738499 - DNA, 20 bp, Homo sapiens
taaaaagaaggaaaatgatc

SEQ ID NO: 738500 - DNA, 21 bp, Homo sapiens
taaaaagaaggaaaatgatct

SEQ ID NO: 738501 - DNA, 13 bp, Homo sapiens
taaaaagacactt

SEQ ID NO: 738502 - DNA, 17 bp, Homo sapiens
taaaaagacctggcctt

SEQ ID NO: 738503 - DNA, 21 bp, Homo sapiens
taaaaagaggatgatttcaga

SEQ ID NO: 738504 - DNA, 14 bp, Homo sapiens
taaaaagcaaaaat

SEQ ID NO: 738505 - DNA, 13 bp, Homo sapiens
taaaaagcaaatc

SEQ ID NO: 738506 - DNA, 23 bp, Homo sapiens
taaaaagcagaattttaatgtga

SEQ ID NO: 738507 - DNA, 18 bp, Homo sapiens
taaaaagcagcagaggtg

SEQ ID NO: 738508 - DNA, 16 bp, Homo sapiens
taaaaagcctcagtga

SEQ ID NO: 738509 - DNA, 10 bp, Homo sapiens
taaaaaggaa

SEQ ID NO: 738510 - DNA, 15 bp, Homo sapiens
gaacagtggctgggt

SEQ ID NO: 738511 - DNA, 16 bp, Homo sapiens
gaacagtggctgggtg

SEQ ID NO: 738512 - DNA, 18 bp, Homo sapiens
gaacagtgtttcccataa

SEQ ID NO: 738513 - DNA, 21 bp, Homo sapiens
gaacagtgtttcccataattt

SEQ ID NO: 738514 - DNA, 17 bp, Homo sapiens
gaacagttgctgttctt

SEQ ID NO: 738515 - DNA, 18 bp, Homo sapiens
gaacatacactgtgaact

SEQ ID NO: 738516 - DNA, 19 bp, Homo sapiens
gaacatacttcaaaaataa

SEQ ID NO: 738517 - DNA, 13 bp, Homo sapiens
gaacatacttggt

SEQ ID NO: 738518 - DNA, 17 bp, Homo sapiens
gaacatatcatttgtga

SEQ ID NO: 738519 - DNA, 21 bp, Homo sapiens
gaacatatcatttgtgaagaa

SEQ ID NO: 738520 - DNA, 18 bp, Homo sapiens
gaacatatgcacagggga

SEQ ID NO: 738521 - DNA, 18 bp, Homo sapiens
gaacatccaaccttccca

SEQ ID NO: 738522 - DNA, 20 bp, Homo sapiens
gaacatccaaggagaaacag

SEQ ID NO: 738523 - DNA, 20 bp, Homo sapiens
gaacatccaagtctttcttc

SEQ ID NO: 738524 - DNA, 17 bp, Homo sapiens
gaacatctatagagata

SEQ ID NO: 738525 - DNA, 15 bp, Homo sapiens
gaacatctcttgaaa

SEQ ID NO: 738526 - DNA, 19 bp, Homo sapiens
gaacatgcacatttatata

SEQ ID NO: 738527 - DNA, 21 bp, Homo sapiens
gaacatgcagttcattatttt

SEQ ID NO: 738528 - DNA, 13 bp, Homo sapiens
gaacatgccccct

SEQ ID NO: 738529 - DNA, 14 bp, Homo sapiens
gaacatgccccctg

SEQ ID NO: 738530 - DNA, 17 bp, Homo sapiens
gaacatggaattttata

SEQ ID NO: 738531 - DNA, 17 bp, Homo sapiens
gaacatggacttgtata

SEQ ID NO: 738532 - DNA, 19 bp, Homo sapiens
gaacatggacttgtatatt

SEQ ID NO: 738533 - DNA, 22 bp, Homo sapiens
gaacatggacttgtatatttgt

SEQ ID NO: 738534 - DNA, 23 bp, Homo sapiens
gaacatggctagcctttcttgta

SEQ ID NO: 738535 - DNA, 19 bp, Homo sapiens
gaacatgtgccttttctga

SEQ ID NO: 738536 - DNA, 23 bp, Homo sapiens
gaacatgtttacaggtttgaatt

SEQ ID NO: 738537 - DNA, 14 bp, Homo sapiens
gaacattaggaatt

SEQ ID NO: 738538 - DNA, 12 bp, Homo sapiens
gaacattattca

SEQ ID NO: 738539 - DNA, 20 bp, Homo sapiens
gaacattattcatctctcct

SEQ ID NO: 738540 - DNA, 13 bp, Homo sapiens
gaacattcccagc

SEQ ID NO: 738541 - DNA, 21 bp, Homo sapiens
gaacattctaccaaatttttg

SEQ ID NO: 738542 - DNA, 21 bp, Homo sapiens
gaacattctggatctgaccct

SEQ ID NO: 738543 - DNA, 23 bp, Homo sapiens
gaacattgcatataacttatatt

SEQ ID NO: 738544 - DNA, 22 bp, Homo sapiens
gaacattggaatgttctcagat

SEQ ID NO: 738545 - DNA, 14 bp, Homo sapiens
gaacattggggatt

SEQ ID NO: 738546 - DNA, 10 bp, Homo sapiens
gaacattgta

SEQ ID NO: 738547 - DNA, 21 bp, Homo sapiens
gaacattgtactgttgcttta

SEQ ID NO: 738548 - DNA, 16 bp, Homo sapiens
gaacattgttctgaac

SEQ ID NO: 738549 - DNA, 19 bp, Homo sapiens
taaaaggcaaatgtgtaca

SEQ ID NO: 738550 - DNA, 19 bp, Homo sapiens
taaaaggctaagaatagtg

SEQ ID NO: 738551 - DNA, 19 bp, Homo sapiens
taaaagggatacacaggac

SEQ ID NO: 738552 - DNA, 18 bp, Homo sapiens
taaaaggtagagtcttac

SEQ ID NO: 738553 - DNA, 20 bp, Homo sapiens
taaaaggtagagtcttacaa

SEQ ID NO: 738554 - DNA, 19 bp, Homo sapiens
taaaaggtgaccaatgatg

SEQ ID NO: 738555 - DNA, 16 bp, Homo sapiens
taaaagtaaaatgtct

SEQ ID NO: 738556 - DNA, 12 bp, Homo sapiens
taaaagtaaaca

SEQ ID NO: 738557 - DNA, 15 bp, Homo sapiens
taaaagtaaagacta

SEQ ID NO: 738558 - DNA, 16 bp, Homo sapiens
taaaagtaaagactat

SEQ ID NO: 738559 - DNA, 16 bp, Homo sapiens
taaaagtccaatgttg

SEQ ID NO: 738560 - DNA, 21 bp, Homo sapiens
taaaagtgaagtgaatctgat

SEQ ID NO: 738561 - DNA, 17 bp, Homo sapiens
taaaagtgccattaaca

SEQ ID NO: 738562 - DNA, 19 bp, Homo sapiens
taaaagtggtctctgctgg

SEQ ID NO: 738563 - DNA, 22 bp, Homo sapiens
taaaagttaataacagctcctt

SEQ ID NO: 738564 - DNA, 14 bp, Homo sapiens
taaaagttcctctc

SEQ ID NO: 738565 - DNA, 21 bp, Homo sapiens
taaaagttcctctcccttccc

SEQ ID NO: 738566 - DNA, 13 bp, Homo sapiens
taaaagttgaact

SEQ ID NO: 738567 - DNA, 15 bp, Homo sapiens
taaaagttgtgattc

SEQ ID NO: 738568 - DNA, 16 bp, Homo sapiens
taaaagttgtgcatgt

SEQ ID NO: 738569 - DNA, 14 bp, Homo sapiens
taaaagttgtgggg

SEQ ID NO: 738570 - DNA, 20 bp, Homo sapiens
taaaagtttacaacttgatt

SEQ ID NO: 738571 - DNA, 15 bp, Homo sapiens
taaaagtttcaatgt

SEQ ID NO: 738572 - DNA, 19 bp, Homo sapiens
taaaagtttcaatgtgatt

SEQ ID NO: 738573 - DNA, 18 bp, Homo sapiens
taaaagttttgaaggaaa

SEQ ID NO: 738574 - DNA, 19 bp, Homo sapiens
taaaagttttgaaggaaac

SEQ ID NO: 738575 - DNA, 21 bp, Homo sapiens
taaaataaaaattctgaatgt

SEQ ID NO: 738576 - DNA, 16 bp, Homo sapiens
taaaataaaaatttaa

SEQ ID NO: 738577 - DNA, 12 bp, Homo sapiens
taaaataaaaca

SEQ ID NO: 738578 - DNA, 18 bp, Homo sapiens
taaaataaaacaagcctt

SEQ ID NO: 738579 - DNA, 19 bp, Homo sapiens
taaaataaaatgaaaattg

SEQ ID NO: 738580 - DNA, 14 bp, Homo sapiens
taaaataaactaga

SEQ ID NO: 738581 - DNA, 16 bp, Homo sapiens
taaaataaactagata

SEQ ID NO: 738582 - DNA, 15 bp, Homo sapiens
taaaataaacttctt

SEQ ID NO: 738583 - DNA, 17 bp, Homo sapiens
taaaataaagaaataga

SEQ ID NO: 738584 - DNA, 13 bp, Homo sapiens
taaaataaagcct

SEQ ID NO: 738585 - DNA, 23 bp, Homo sapiens
taaaataaagcctatttttcaaa

SEQ ID NO: 738586 - DNA, 16 bp, Homo sapiens
taaaataaataatttt

SEQ ID NO: 738587 - DNA, 13 bp, Homo sapiens
taaaataaatata

SEQ ID NO: 738588 - DNA, 13 bp, Homo sapiens
taaaataaatggt

SEQ ID NO: 738589 - DNA, 16 bp, Homo sapiens
taaaataactaaaatg

SEQ ID NO: 738590 - DNA, 18 bp, Homo sapiens
taaaataactaaaatgta

SEQ ID NO: 738591 - DNA, 19 bp, Homo sapiens
taaaataactaaaatgtat

SEQ ID NO: 738592 - DNA, 21 bp, Homo sapiens
taaaataactaaaatgtatct

SEQ ID NO: 738593 - DNA, 21 bp, Homo sapiens
taaaataactagtgttgcttg

SEQ ID NO: 738594 - DNA, 21 bp, Homo sapiens
taaaataagcaggtggatcta

SEQ ID NO: 738595 - DNA, 15 bp, Homo sapiens
taaaataagtctgat

SEQ ID NO: 738596 - DNA, 15 bp, Homo sapiens
taaaataatgggatt

SEQ ID NO: 738597 - DNA, 18 bp, Homo sapiens
taaaataattatataact

SEQ ID NO: 738598 - DNA, 16 bp, Homo sapiens
taaaataattctgagt

SEQ ID NO: 738599 - DNA, 15 bp, Homo sapiens
taaaataattttgta

SEQ ID NO: 738600 - DNA, 19 bp, Homo sapiens
taaaatactatgcagtatc

SEQ ID NO: 738601 - DNA, 12 bp, Homo sapiens
taaaatacttat

SEQ ID NO: 738602 - DNA, 17 bp, Homo sapiens
taaaatagaaataagtg

SEQ ID NO: 738603 - DNA, 22 bp, Homo sapiens
taaaatagaaatatagccaaaa

SEQ ID NO: 738604 - DNA, 22 bp, Homo sapiens
taaaatagaatgatagaacttt

SEQ ID NO: 738605 - DNA, 17 bp, Homo sapiens
taaaatagcaaaagaag

SEQ ID NO: 738606 - DNA, 21 bp, Homo sapiens
taaaatagcaacactctatat

SEQ ID NO: 738607 - DNA, 22 bp, Homo sapiens
taaaatagcggtacaagttctg

SEQ ID NO: 738608 - DNA, 14 bp, Homo sapiens
taaaatagcttgta

SEQ ID NO: 738609 - DNA, 19 bp, Homo sapiens
taaaataggggatatttaa

SEQ ID NO: 738610 - DNA, 16 bp, Homo sapiens
taaaatataaaactga

SEQ ID NO: 738611 - DNA, 16 bp, Homo sapiens
taaaatatatgtctat

SEQ ID NO: 738612 - DNA, 15 bp, Homo sapiens
taaaatatattgctg

SEQ ID NO: 738613 - DNA, 22 bp, Homo sapiens
taaaatatattgctgcatttta

SEQ ID NO: 738614 - DNA, 17 bp, Homo sapiens
taaaatatatttcagat

SEQ ID NO: 738615 - DNA, 15 bp, Homo sapiens
taaaatatcataaag

SEQ ID NO: 738616 - DNA, 10 bp, Homo sapiens
taaaatatcc

SEQ ID NO: 738617 - DNA, 18 bp, Homo sapiens
taaaatatcttcctttgg

SEQ ID NO: 738618 - DNA, 20 bp, Homo sapiens
taaaatatgaagacataaac

SEQ ID NO: 738619 - DNA, 14 bp, Homo sapiens
taaaatatggctat

SEQ ID NO: 738620 - DNA, 12 bp, Homo sapiens
taaaatattatt

SEQ ID NO: 738621 - DNA, 16 bp, Homo sapiens
taaaatattattgaac

SEQ ID NO: 738622 - DNA, 13 bp, Homo sapiens
taaaatattcctg

SEQ ID NO: 738623 - DNA, 15 bp, Homo sapiens
taaaatatttatctg

SEQ ID NO: 738624 - DNA, 13 bp, Homo sapiens
taaaatatttccc

SEQ ID NO: 738625 - DNA, 19 bp, Homo sapiens
taaaatatttgaatgaaaa

SEQ ID NO: 738626 - DNA, 20 bp, Homo sapiens
taaaatatttgaatgaaaac

SEQ ID NO: 738627 - DNA, 21 bp, Homo sapiens
taaaatattttagatgttatt

SEQ ID NO: 738628 - DNA, 23 bp, Homo sapiens
taaaatattttgttaacttttgt

SEQ ID NO: 738629 - DNA, 17 bp, Homo sapiens
taaaatatttttgaaag

SEQ ID NO: 738630 - DNA, 18 bp, Homo sapiens
taaaatcaacttaacatg

SEQ ID NO: 738631 - DNA, 18 bp, Homo sapiens
taaaatcactctcagtgc

SEQ ID NO: 738632 - DNA, 14 bp, Homo sapiens
taaacttcttaaca

SEQ ID NO: 738633 - DNA, 17 bp, Homo sapiens
taaacttgaaatatata

SEQ ID NO: 738634 - DNA, 18 bp, Homo sapiens
taaacttgaaatatataa

SEQ ID NO: 738635 - DNA, 22 bp, Homo sapiens
taaacttggtgcttattgatat

SEQ ID NO: 738636 - DNA, 22 bp, Homo sapiens
taaacttggtttttaaaaaact

SEQ ID NO: 738637 - DNA, 14 bp, Homo sapiens
taaactttagactt

SEQ ID NO: 738638 - DNA, 18 bp, Homo sapiens
taaactttagacttccca

SEQ ID NO: 738639 - DNA, 16 bp, Homo sapiens
taaactttatcactta

SEQ ID NO: 738640 - DNA, 13 bp, Homo sapiens
taaactttatttg

SEQ ID NO: 738641 - DNA, 13 bp, Homo sapiens
taaactttctcca

SEQ ID NO: 738642 - DNA, 15 bp, Homo sapiens
taaactttgtgcctt

SEQ ID NO: 738643 - DNA, 17 bp, Homo sapiens
taaactttgtgcctttg

SEQ ID NO: 738644 - DNA, 15 bp, Homo sapiens
taaacttttaattca

SEQ ID NO: 738645 - DNA, 22 bp, Homo sapiens
taaacttttaccacttgctgca

SEQ ID NO: 738646 - DNA, 19 bp, Homo sapiens
taaactttttaaaatactt

SEQ ID NO: 738647 - DNA, 18 bp, Homo sapiens
taaactttttcaatggtt

SEQ ID NO: 738648 - DNA, 12 bp, Homo sapiens
taaactttttgt

SEQ ID NO: 738649 - DNA, 23 bp, Homo sapiens
taaagaaaaaaattgaaatgtaa

SEQ ID NO: 738650 - DNA, 21 bp, Homo sapiens
taaagaaaaccataatgtctt

SEQ ID NO: 738651 - DNA, 10 bp, Homo sapiens
taaagaaaag

SEQ ID NO: 738652 - DNA, 14 bp, Homo sapiens
taaagaaaattgca

SEQ ID NO: 738653 - DNA, 15 bp, Homo sapiens
taaagaaaattgcat

SEQ ID NO: 738654 - DNA, 17 bp, Homo sapiens
taaagaaaattgcatga

SEQ ID NO: 738655 - DNA, 18 bp, Homo sapiens
taaagaaaattgcatgaa

SEQ ID NO: 738656 - DNA, 14 bp, Homo sapiens
taaagaaacagctt

SEQ ID NO: 738657 - DNA, 20 bp, Homo sapiens
taaagaaacagctttcaagt

SEQ ID NO: 738658 - DNA, 18 bp, Homo sapiens
taaagaaagaatgcattc

SEQ ID NO: 738659 - DNA, 15 bp, Homo sapiens
taaagaaagcagaat

SEQ ID NO: 738660 - DNA, 15 bp, Homo sapiens
taaagaaaggaaaag

SEQ ID NO: 738661 - DNA, 22 bp, Homo sapiens
taaagaaaggaaaagaaaacaa

SEQ ID NO: 738662 - DNA, 21 bp, Homo sapiens
taaagaaagtcgaattaatag

SEQ ID NO: 738663 - DNA, 14 bp, Homo sapiens
taaagaaagtgtat

SEQ ID NO: 738664 - DNA, 18 bp, Homo sapiens
taaagaaatatttaccta

SEQ ID NO: 738665 - DNA, 17 bp, Homo sapiens
taaagaaattgcaataa

SEQ ID NO: 738666 - DNA, 17 bp, Homo sapiens
taaagaacagtgagaaa

SEQ ID NO: 738667 - DNA, 12 bp, Homo sapiens
taaagaagacct

SEQ ID NO: 738668 - DNA, 16 bp, Homo sapiens
taaagaagacctgaga

SEQ ID NO: 738669 - DNA, 20 bp, Homo sapiens
taaagaagataaacacaaaa

SEQ ID NO: 738670 - DNA, 21 bp, Homo sapiens
taaagaagcaataaagaagag

SEQ ID NO: 738671 - DNA, 13 bp, Homo sapiens
taaagaagctgca

SEQ ID NO: 738672 - DNA, 17 bp, Homo sapiens
taaagaagctgcatgtt

SEQ ID NO: 738673 - DNA, 22 bp, Homo sapiens
taaagaagtatttttagaataa

SEQ ID NO: 738674 - DNA, 14 bp, Homo sapiens
taaagaagtttgaa

SEQ ID NO: 738675 - DNA, 18 bp, Homo sapiens
taaagaatgagaaacata

SEQ ID NO: 738676 - DNA, 15 bp, Homo sapiens
taaagaattttcatc

SEQ ID NO: 738677 - DNA, 16 bp, Homo sapiens
taaagaccagaaattc

SEQ ID NO: 738678 - DNA, 15 bp, Homo sapiens
taaagactggctttt

SEQ ID NO: 738679 - DNA, 19 bp, Homo sapiens
taaagactggttttctgcc

SEQ ID NO: 738680 - DNA, 22 bp, Homo sapiens
taaagacttgtatagcatgaaa

SEQ ID NO: 738681 - DNA, 13 bp, Homo sapiens
taaagacttttat

SEQ ID NO: 738682 - DNA, 16 bp, Homo sapiens
taaagagcccttgcct

SEQ ID NO: 738683 - DNA, 19 bp, Homo sapiens
taaagagcccttgcctccc

SEQ ID NO: 738684 - DNA, 21 bp, Homo sapiens
taaagagcccttgcctcccca

SEQ ID NO: 738685 - DNA, 20 bp, Homo sapiens
taaagagctgcacagcaaaa

SEQ ID NO: 738686 - DNA, 20 bp, Homo sapiens
taaagaggctgaaagaggcc

SEQ ID NO: 738687 - DNA, 12 bp, Homo sapiens
taaagagttatt

SEQ ID NO: 738688 - DNA, 21 bp, Homo sapiens
taaagataaaatatcctcagg

SEQ ID NO: 738689 - DNA, 17 bp, Homo sapiens
taaagataagtctacat

SEQ ID NO: 738690 - DNA, 17 bp, Homo sapiens
taaagataattgctatt

SEQ ID NO: 738691 - DNA, 18 bp, Homo sapiens
taaagataattgctattt

SEQ ID NO: 738692 - DNA, 13 bp, Homo sapiens
taaagatcacaca

SEQ ID NO: 738693 - DNA, 14 bp, Homo sapiens
taaagatcacacat

SEQ ID NO: 738694 - DNA, 13 bp, Homo sapiens
taaagatgagttg

SEQ ID NO: 738695 - DNA, 13 bp, Homo sapiens
taaagatgccata

SEQ ID NO: 738696 - DNA, 18 bp, Homo sapiens
taaagatgccatagcata

SEQ ID NO: 738697 - DNA, 15 bp, Homo sapiens
taaagatgttaaatg

SEQ ID NO: 738698 - DNA, 23 bp, Homo sapiens
taaagattagggaaaatggatat

SEQ ID NO: 738699 - DNA, 16 bp, Homo sapiens
taaagattattttttg

SEQ ID NO: 738700 - DNA, 20 bp, Homo sapiens
taaagattctctttaaaaaa

SEQ ID NO: 738701 - DNA, 14 bp, Homo sapiens
taaagatttcttga

SEQ ID NO: 738702 - DNA, 21 bp, Homo sapiens
taaagattttgttttgttgga

SEQ ID NO: 738703 - DNA, 16 bp, Homo sapiens
taaagattttttaata

SEQ ID NO: 738704 - DNA, 21 bp, Homo sapiens
taaagattttttaataattta

SEQ ID NO: 738705 - DNA, 22 bp, Homo sapiens
taaagattttttaataatttag

SEQ ID NO: 738706 - DNA, 13 bp, Homo sapiens
taaagcaaaatag

SEQ ID NO: 738707 - DNA, 14 bp, Homo sapiens
taaagcaaaatagt

SEQ ID NO: 738708 - DNA, 15 bp, Homo sapiens
taaagcaaaatagta

SEQ ID NO: 738709 - DNA, 20 bp, Homo sapiens
taaagcaaaatagtattgct

SEQ ID NO: 738710 - DNA, 21 bp, Homo sapiens
taaagcaaaatagtattgctg

SEQ ID NO: 738711 - DNA, 21 bp, Homo sapiens
taaagcaaactatgatttatt

SEQ ID NO: 738712 - DNA, 17 bp, Homo sapiens
taaagcaatatgcattt

SEQ ID NO: 738713 - DNA, 21 bp, Homo sapiens
taaagcactggtttcaagaat

SEQ ID NO: 738714 - DNA, 18 bp, Homo sapiens
taaagcactttgcactta

SEQ ID NO: 738715 - DNA, 16 bp, Homo sapiens
taaagcagagccaagg

SEQ ID NO: 738716 - DNA, 19 bp, Homo sapiens
taaagcagagccaaggcca

SEQ ID NO: 738717 - DNA, 21 bp, Homo sapiens
taaagcagagccaaggccacc

SEQ ID NO: 738718 - DNA, 18 bp, Homo sapiens
taaagcagattacctctt

SEQ ID NO: 738719 - DNA, 18 bp, Homo sapiens
taaagcagttaatttata

SEQ ID NO: 738720 - DNA, 14 bp, Homo sapiens
taaagcatcagaga

SEQ ID NO: 738721 - DNA, 14 bp, Homo sapiens
taaagcattactct

SEQ ID NO: 738722 - DNA, 21 bp, Homo sapiens
taaagcattactctttttcaa

SEQ ID NO: 738723 - DNA, 11 bp, Homo sapiens
taaagcattta

SEQ ID NO: 738724 - DNA, 12 bp, Homo sapiens
taaagcatttat

SEQ ID NO: 738725 - DNA, 16 bp, Homo sapiens
taaagccaaagtttct

SEQ ID NO: 738726 - DNA, 19 bp, Homo sapiens
taaagccaaagtttctgtt

SEQ ID NO: 738727 - DNA, 21 bp, Homo sapiens
taaagccaaagtttctgttga

SEQ ID NO: 738728 - DNA, 16 bp, Homo sapiens
taaagccaaccagcct

SEQ ID NO: 738729 - DNA, 18 bp, Homo sapiens
taaagccaagaagaattt

SEQ ID NO: 738730 - DNA, 14 bp, Homo sapiens
taaagccagcctga

SEQ ID NO: 738731 - DNA, 23 bp, Homo sapiens
taaagccagttagatagaagaat

SEQ ID NO: 738732 - DNA, 17 bp, Homo sapiens
taaagccattctgatta

SEQ ID NO: 738733 - DNA, 18 bp, Homo sapiens
taaagcccataaggccag

SEQ ID NO: 738734 - DNA, 22 bp, Homo sapiens
taaagcccataaggccagaaac

SEQ ID NO: 738735 - DNA, 15 bp, Homo sapiens
taaagccctgtgtta

SEQ ID NO: 738736 - DNA, 18 bp, Homo sapiens
taaagccgtgctctttta

SEQ ID NO: 738737 - DNA, 12 bp, Homo sapiens
taaagcctcctc

SEQ ID NO: 738738 - DNA, 12 bp, Homo sapiens
taaagctaaact

SEQ ID NO: 738739 - DNA, 14 bp, Homo sapiens
taaagctaaatttt

SEQ ID NO: 738740 - DNA, 14 bp, Homo sapiens
taaagctagaaatg

SEQ ID NO: 738741 - DNA, 17 bp, Homo sapiens
taaagctcaaatgaaat

SEQ ID NO: 738742 - DNA, 18 bp, Homo sapiens
taaagctcaaatgaaatg

SEQ ID NO: 738743 - DNA, 14 bp, Homo sapiens
taaagctcttcatt

SEQ ID NO: 738744 - DNA, 15 bp, Homo sapiens
taaagctggtttaat

SEQ ID NO: 738745 - DNA, 13 bp, Homo sapiens
taaagctgtacac

SEQ ID NO: 738746 - DNA, 14 bp, Homo sapiens
taaagctgtacacc

SEQ ID NO: 738747 - DNA, 16 bp, Homo sapiens
taaagcttatttttat

SEQ ID NO: 738748 - DNA, 17 bp, Homo sapiens
taaagcttctataaaat

SEQ ID NO: 738749 - DNA, 13 bp, Homo sapiens
taaagcttgattt

SEQ ID NO: 738750 - DNA, 21 bp, Homo sapiens
taaagctttatctttgtgtaa

SEQ ID NO: 738751 - DNA, 17 bp, Homo sapiens
taaagctttcaacatgt

SEQ ID NO: 738752 - DNA, 18 bp, Homo sapiens
taaagctttcaacatgta

SEQ ID NO: 738753 - DNA, 22 bp, Homo sapiens
taaagctttggacaagtccttg

SEQ ID NO: 738754 - DNA, 15 bp, Homo sapiens
taaagcttttattcg

SEQ ID NO: 738755 - DNA, 23 bp, Homo sapiens
tgaaaatatctgctcaaaacttt

SEQ ID NO: 738756 - DNA, 20 bp, Homo sapiens
tgaaaatatgatgtttcaca

SEQ ID NO: 738757 - DNA, 22 bp, Homo sapiens
tgaaaatatgttggaaaaaaga

SEQ ID NO: 738758 - DNA, 16 bp, Homo sapiens
tgaaaatattgtttta

SEQ ID NO: 738759 - DNA, 18 bp, Homo sapiens
tgaaaatcctatatctgt

SEQ ID NO: 738760 - DNA, 16 bp, Homo sapiens
tgaaaatcctgaataa

SEQ ID NO: 738761 - DNA, 16 bp, Homo sapiens
tgaaaatgaatagctt

SEQ ID NO: 738762 - DNA, 19 bp, Homo sapiens
tgaaaatgaatatctatta

SEQ ID NO: 738763 - DNA, 20 bp, Homo sapiens
ggaggtggaggctgcggtga

SEQ ID NO: 738764 - DNA, 20 bp, Homo sapiens
ggaggtggattccgagtggt

SEQ ID NO: 738765 - DNA, 14 bp, Homo sapiens
ggaggtgggggctg

SEQ ID NO: 738766 - DNA, 17 bp, Homo sapiens
ggaggtggtgaattttt

SEQ ID NO: 738767 - DNA, 12 bp, Homo sapiens
ggaggtgtgagg

SEQ ID NO: 738768 - DNA, 21 bp, Homo sapiens
ggaggtgtttaaagagaggtt

SEQ ID NO: 738769 - DNA, 15 bp, Homo sapiens
ggaggttctcagagc

SEQ ID NO: 738770 - DNA, 14 bp, Homo sapiens
ggaggttctgggcc

SEQ ID NO: 738771 - DNA, 19 bp, Homo sapiens
ggaggttctgggcctctga

SEQ ID NO: 738772 - DNA, 16 bp, Homo sapiens
ggaggttgaagccaag

SEQ ID NO: 738773 - DNA, 12 bp, Homo sapiens
ggaggttgcagg

SEQ ID NO: 738774 - DNA, 20 bp, Homo sapiens
ggaggttgcagtgagctgag

SEQ ID NO: 738775 - DNA, 15 bp, Homo sapiens
ggaggttgggtgggc

SEQ ID NO: 738776 - DNA, 14 bp, Homo sapiens
ggaggttggtgact

SEQ ID NO: 738777 - DNA, 14 bp, Homo sapiens
ggaggttgtgcatg

SEQ ID NO: 738778 - DNA, 21 bp, Homo sapiens
ggaggtttccttttggaacat

SEQ ID NO: 738779 - DNA, 14 bp, Homo sapiens
ggaggtttgtcggg

SEQ ID NO: 738780 - DNA, 21 bp, Homo sapiens
ggagtaaagtggcaatttctt

SEQ ID NO: 738781 - DNA, 22 bp, Homo sapiens
ggagtaacaatacaaatggatt

SEQ ID NO: 738782 - DNA, 17 bp, Homo sapiens
ggagtaacagggcagaa

SEQ ID NO: 738783 - DNA, 21 bp, Homo sapiens
ggagtaacagggcagaaatga

SEQ ID NO: 738784 - DNA, 15 bp, Homo sapiens
ggagtacaaaacaat

SEQ ID NO: 738785 - DNA, 13 bp, Homo sapiens
ggagtacctgctg

SEQ ID NO: 738786 - DNA, 21 bp, Homo sapiens
tgaatgaaaaatttaagcatt

SEQ ID NO: 738787 - DNA, 18 bp, Homo sapiens
tgaatgaaaatacatctt

SEQ ID NO: 738788 - DNA, 14 bp, Homo sapiens
tgaatgaaatatca

SEQ ID NO: 738789 - DNA, 15 bp, Homo sapiens
tgaatgaaccttctg

SEQ ID NO: 738790 - DNA, 14 bp, Homo sapiens
tgaatgagaatcta

SEQ ID NO: 738791 - DNA, 19 bp, Homo sapiens
tgaatgaggattattataa

SEQ ID NO: 738792 - DNA, 17 bp, Homo sapiens
tgaatgaggtcccaggc

SEQ ID NO: 738793 - DNA, 15 bp, Homo sapiens
tgaatgatatctttg

SEQ ID NO: 738794 - DNA, 14 bp, Homo sapiens
tgaatgatgagcct

SEQ ID NO: 738795 - DNA, 17 bp, Homo sapiens
tgaatgattcatgttat

SEQ ID NO: 738796 - DNA, 18 bp, Homo sapiens
tgaatgattcatgttata

SEQ ID NO: 738797 - DNA, 19 bp, Homo sapiens
tgaatgatttgtgtttctt

SEQ ID NO: 738798 - DNA, 15 bp, Homo sapiens
tgaatgatttttctt

SEQ ID NO: 738799 - DNA, 19 bp, Homo sapiens
tgaatgcaaaccatagcac

SEQ ID NO: 738800 - DNA, 21 bp, Homo sapiens
tgaatgccactgccttcgctt

SEQ ID NO: 738801 - DNA, 18 bp, Homo sapiens
tgaatgcccccagctggc

SEQ ID NO: 738802 - DNA, 19 bp, Homo sapiens
tgaatgcccccagctggcc

SEQ ID NO: 738803 - DNA, 14 bp, Homo sapiens
tgaatgccgtggat

SEQ ID NO: 738804 - DNA, 13 bp, Homo sapiens
tgaatgcctcctg

SEQ ID NO: 738805 - DNA, 17 bp, Homo sapiens
tgaatgcctcctgtggg

SEQ ID NO: 738806 - DNA, 20 bp, Homo sapiens
tgaatgctatgttctgggaa

SEQ ID NO: 738807 - DNA, 12 bp, Homo sapiens
tgaatgctggga

SEQ ID NO: 738808 - DNA, 23 bp, Homo sapiens
tgaatgcttttagtgtgtgcata

SEQ ID NO: 738809 - DNA, 21 bp, Homo sapiens
tgaatggcatttgctggttat

SEQ ID NO: 738810 - DNA, 15 bp, Homo sapiens
tgaatggcctgcctt

SEQ ID NO: 738811 - DNA, 17 bp, Homo sapiens
tgaatggcctgccttga

SEQ ID NO: 738812 - DNA, 21 bp, Homo sapiens
tgaatggcctgccttgaagcc

SEQ ID NO: 738813 - DNA, 20 bp, Homo sapiens
tgaatggctatgtttttaat

SEQ ID NO: 738814 - DNA, 21 bp, Homo sapiens
tgaatggctatgtttttaatg

SEQ ID NO: 738815 - DNA, 15 bp, Homo sapiens
tgaatggtccagggt

SEQ ID NO: 738816 - DNA, 21 bp, Homo sapiens
tgaatggttccatgcctgagg

SEQ ID NO: 738817 - DNA, 22 bp, Homo sapiens
tgaatgtaaactcgggggtgct

SEQ ID NO: 738818 - DNA, 18 bp, Homo sapiens
tgaatgtagaataggcag

SEQ ID NO: 738819 - DNA, 22 bp, Homo sapiens
tgaatgtagcttccacctcatg

SEQ ID NO: 738820 - DNA, 15 bp, Homo sapiens
tgaatgtatcaggaa

SEQ ID NO: 738821 - DNA, 18 bp, Homo sapiens
tgaatgtatgtgcactgt

SEQ ID NO: 738822 - DNA, 23 bp, Homo sapiens
tgaatgtatgtgcactgtcactt

SEQ ID NO: 738823 - DNA, 19 bp, Homo sapiens
tgaatgtatttatttggga

SEQ ID NO: 738824 - DNA, 11 bp, Homo sapiens
tgaatgtcaca

SEQ ID NO: 738825 - DNA, 17 bp, Homo sapiens
tgaatgtcacaaattga

SEQ ID NO: 738826 - DNA, 18 bp, Homo sapiens
tgaatgtcacatttgaat

SEQ ID NO: 738827 - DNA, 16 bp, Homo sapiens
tgaatgtcacttctgg

SEQ ID NO: 738828 - DNA, 15 bp, Homo sapiens
tgaatgtcttttgaa

SEQ ID NO: 738829 - DNA, 20 bp, Homo sapiens
tgaatgtgagtgtgtatgtc

SEQ ID NO: 738830 - DNA, 23 bp, Homo sapiens
tgaatgtggataaaactgtgtaa

SEQ ID NO: 738831 - DNA, 15 bp, Homo sapiens
tgaatgtgggcactg

SEQ ID NO: 738832 - DNA, 14 bp, Homo sapiens
tgaatgtgtcacta

SEQ ID NO: 738833 - DNA, 17 bp, Homo sapiens
tgaatgttaagaattga

SEQ ID NO: 738834 - DNA, 15 bp, Homo sapiens
tgaatgttatttgtt

SEQ ID NO: 738835 - DNA, 14 bp, Homo sapiens
tgaatgttctgaca

SEQ ID NO: 738836 - DNA, 16 bp, Homo sapiens
tgaatgttctgacatt

SEQ ID NO: 738837 - DNA, 17 bp, Homo sapiens
tgaatgttctgacatta

SEQ ID NO: 738838 - DNA, 21 bp, Homo sapiens
tgaatgttctgacattaacag

SEQ ID NO: 738839 - DNA, 22 bp, Homo sapiens
tgaatgtttccaacctggagta

SEQ ID NO: 738840 - DNA, 11 bp, Homo sapiens
tgaattaaaac

SEQ ID NO: 738841 - DNA, 19 bp, Homo sapiens
tgaattaaaataaaacaca

SEQ ID NO: 738842 - DNA, 23 bp, Homo sapiens
tgaattaaaattgtcccatttgc

SEQ ID NO: 738843 - DNA, 16 bp, Homo sapiens
tgaattaaattaggaa

SEQ ID NO: 738844 - DNA, 18 bp, Homo sapiens
tgaattaagcccaattaa

SEQ ID NO: 738845 - DNA, 23 bp, Homo sapiens
tgaattaatatccctacatgtat

SEQ ID NO: 738846 - DNA, 23 bp, Homo sapiens
tgaattaatcatctataaagaag

SEQ ID NO: 738847 - DNA, 15 bp, Homo sapiens
tgaattacagtgaaa

SEQ ID NO: 738848 - DNA, 16 bp, Homo sapiens
tgaattactgtatata

SEQ ID NO: 738849 - DNA, 20 bp, Homo sapiens
tgaattaggctgtaactact

SEQ ID NO: 738850 - DNA, 15 bp, Homo sapiens
tgaattagtgagtat

SEQ ID NO: 738851 - DNA, 18 bp, Homo sapiens
tgaattataacagttata

SEQ ID NO: 738852 - DNA, 15 bp, Homo sapiens
tgaattatatgttca

SEQ ID NO: 738853 - DNA, 15 bp, Homo sapiens
tgaattatcagcaaa

SEQ ID NO: 738854 - DNA, 17 bp, Homo sapiens
tgaattatcagcaaaga

SEQ ID NO: 738855 - DNA, 15 bp, Homo sapiens
tgaattatctataca

SEQ ID NO: 738856 - DNA, 16 bp, Homo sapiens
tgaattattacagtgt

SEQ ID NO: 738857 - DNA, 17 bp, Homo sapiens
tgaattattacagtgtt

SEQ ID NO: 738858 - DNA, 18 bp, Homo sapiens
tgaattattacagtgttt

SEQ ID NO: 738859 - DNA, 18 bp, Homo sapiens
tgaattattatatacata

SEQ ID NO: 738860 - DNA, 15 bp, Homo sapiens
tgaattattcaattt

SEQ ID NO: 738861 - DNA, 16 bp, Homo sapiens
tgaattattgacactg

SEQ ID NO: 738862 - DNA, 21 bp, Homo sapiens
tgaattattgacactgaactt

SEQ ID NO: 738863 - DNA, 12 bp, Homo sapiens
tgaattcagatt

SEQ ID NO: 738864 - DNA, 17 bp, Homo sapiens
tgaattcagattttaaa

SEQ ID NO: 738865 - DNA, 17 bp, Homo sapiens
tgaattcccagactctg

SEQ ID NO: 738866 - DNA, 17 bp, Homo sapiens
tgaattcctaaaattat

SEQ ID NO: 738867 - DNA, 16 bp, Homo sapiens
tgaattcctagaatta

SEQ ID NO: 738868 - DNA, 18 bp, Homo sapiens
tgaattcctagaattaaa

SEQ ID NO: 738869 - DNA, 16 bp, Homo sapiens
tgaattcgatgcgtat

SEQ ID NO: 738870 - DNA, 18 bp, Homo sapiens
tgaattcttgatctctaa

SEQ ID NO: 738871 - DNA, 20 bp, Homo sapiens
tgaattcttggttgaggaaa

SEQ ID NO: 738872 - DNA, 21 bp, Homo sapiens
tgaattcttggttgaggaaac

SEQ ID NO: 738873 - DNA, 22 bp, Homo sapiens
tgaattcttggttgaggaaaca

SEQ ID NO: 738874 - DNA, 16 bp, Homo sapiens
tgaattgaagtttcaa

SEQ ID NO: 738875 - DNA, 17 bp, Homo sapiens
tgaattgaagtttcaag

SEQ ID NO: 738876 - DNA, 13 bp, Homo sapiens
tgaattgactacc

SEQ ID NO: 738877 - DNA, 20 bp, Homo sapiens
tgaattgaggggattaatat

SEQ ID NO: 738878 - DNA, 18 bp, Homo sapiens
tgaattgatgatgcagtt

SEQ ID NO: 738879 - DNA, 22 bp, Homo sapiens
tgaattgcctgcagagagaagc

SEQ ID NO: 738880 - DNA, 17 bp, Homo sapiens
tgaattggcaggataag

SEQ ID NO: 738881 - DNA, 18 bp, Homo sapiens
tgaattgtaactgttctt

SEQ ID NO: 738882 - DNA, 19 bp, Homo sapiens
tgaattgtaactgttcttg

SEQ ID NO: 738883 - DNA, 19 bp, Homo sapiens
tgaattgtacctatttctg

SEQ ID NO: 738884 - DNA, 21 bp, Homo sapiens
tgaattgtacctatttctgat

SEQ ID NO: 738885 - DNA, 10 bp, Homo sapiens
ggataataaa

SEQ ID NO: 738886 - DNA, 14 bp, Homo sapiens
ggataatataaaaa

SEQ ID NO: 738887 - DNA, 14 bp, Homo sapiens
ggataatgaaataa

SEQ ID NO: 738888 - DNA, 19 bp, Homo sapiens
ggataatgtccccactccc

SEQ ID NO: 738889 - DNA, 18 bp, Homo sapiens
ggatacaaaagcatgtga

SEQ ID NO: 738890 - DNA, 12 bp, Homo sapiens
ggatacacagga

SEQ ID NO: 738891 - DNA, 15 bp, Homo sapiens
ggatacagaggagat

SEQ ID NO: 738892 - DNA, 13 bp, Homo sapiens
ggatacagctgct

SEQ ID NO: 738893 - DNA, 17 bp, Homo sapiens
ggatacatctgctgtgt

SEQ ID NO: 738894 - DNA, 16 bp, Homo sapiens
ggataccagctcaggg

SEQ ID NO: 738895 - DNA, 13 bp, Homo sapiens
ggatactggacac

SEQ ID NO: 738896 - DNA, 18 bp, Homo sapiens
ggatactggcacagaggt

SEQ ID NO: 738897 - DNA, 20 bp, Homo sapiens
ggatacttagtggtatgtct

SEQ ID NO: 738898 - DNA, 14 bp, Homo sapiens
ggatagacttggga

SEQ ID NO: 738899 - DNA, 19 bp, Homo sapiens
ggatagagaatgttccaga

SEQ ID NO: 738900 - DNA, 13 bp, Homo sapiens
ggatagcattttt

SEQ ID NO: 738901 - DNA, 18 bp, Homo sapiens
ggataggaaaaatgagta

SEQ ID NO: 738902 - DNA, 22 bp, Homo sapiens
ggataggactccatttctttct

SEQ ID NO: 738903 - DNA, 21 bp, Homo sapiens
ggataggccttcattaacaaa

SEQ ID NO: 738904 - DNA, 14 bp, Homo sapiens
ggatatactgcagc

SEQ ID NO: 738905 - DNA, 21 bp, Homo sapiens
ggatatcattttaaaaacttt

SEQ ID NO: 738906 - DNA, 16 bp, Homo sapiens
ggatatctactgtggt

SEQ ID NO: 738907 - DNA, 20 bp, Homo sapiens
ggatatgctgaacgcagaag

SEQ ID NO: 738908 - DNA, 19 bp, Homo sapiens
ggatatggcaggactcctg

SEQ ID NO: 738909 - DNA, 12 bp, Homo sapiens
ggatatggtctt

SEQ ID NO: 738910 - DNA, 12 bp, Homo sapiens
ggatattgcctt

SEQ ID NO: 738911 - DNA, 17 bp, Homo sapiens
ggatattgccttatttg

SEQ ID NO: 738912 - DNA, 12 bp, Homo sapiens
ggatatttaagg

SEQ ID NO: 738913 - DNA, 23 bp, Homo sapiens
ggatatttactgctctttattgc

SEQ ID NO: 738914 - DNA, 18 bp, Homo sapiens
tgaattttcaaggccttc

SEQ ID NO: 738915 - DNA, 20 bp, Homo sapiens
tgaattttcaaggccttcag

SEQ ID NO: 738916 - DNA, 21 bp, Homo sapiens
tgaattttcaaggccttcagt

SEQ ID NO: 738917 - DNA, 11 bp, Homo sapiens
tgaattttcta

SEQ ID NO: 738918 - DNA, 15 bp, Homo sapiens
tgaattttctgtgtt

SEQ ID NO: 738919 - DNA, 21 bp, Homo sapiens
tgaattttggggattttcaaa

SEQ ID NO: 738920 - DNA, 17 bp, Homo sapiens
tgaattttgttctctgg

SEQ ID NO: 738921 - DNA, 19 bp, Homo sapiens
tgaattttgttctctggga

SEQ ID NO: 738922 - DNA, 22 bp, Homo sapiens
tgaattttgttctctgggagaa

SEQ ID NO: 738923 - DNA, 17 bp, Homo sapiens
tgaatttttaaacaagt

SEQ ID NO: 738924 - DNA, 21 bp, Homo sapiens
tgaatttttaaacaagtattt

SEQ ID NO: 738925 - DNA, 22 bp, Homo sapiens
tgaatttttctctaactcagaa

SEQ ID NO: 738926 - DNA, 15 bp, Homo sapiens
tgaatttttgcctat

SEQ ID NO: 738927 - DNA, 19 bp, Homo sapiens
tgaatttttgcctatcttt

SEQ ID NO: 738928 - DNA, 22 bp, Homo sapiens
tgaatttttgcctatctttaaa

SEQ ID NO: 738929 - DNA, 22 bp, Homo sapiens
tgaattttttgaaatgggcatt

SEQ ID NO: 738930 - DNA, 15 bp, Homo sapiens
tgaatttttttgtaa

SEQ ID NO: 738931 - DNA, 18 bp, Homo sapiens
tgaatttttttgtaataa

SEQ ID NO: 738932 - DNA, 22 bp, Homo sapiens
tgaatttttttgtaataagcaa

SEQ ID NO: 738933 - DNA, 20 bp, Homo sapiens
tgaatttttttttcctagcc

SEQ ID NO: 738934 - DNA, 15 bp, Homo sapiens
tgacaaaaataacac

SEQ ID NO: 738935 - DNA, 16 bp, Homo sapiens
tgacaaaaataacact

SEQ ID NO: 738936 - DNA, 18 bp, Homo sapiens
tgacaaaaataacactgt

SEQ ID NO: 738937 - DNA, 17 bp, Homo sapiens
tgacaaaacctaacttg

SEQ ID NO: 738938 - DNA, 15 bp, Homo sapiens
tgacaaaagtaaatg

SEQ ID NO: 738939 - DNA, 23 bp, Homo sapiens
tgacaaaatgggaggaggaaaga

SEQ ID NO: 738940 - DNA, 22 bp, Homo sapiens
tgacaaaatggggcagaagaga

SEQ ID NO: 738941 - DNA, 16 bp, Homo sapiens
tgacaaaccataactg

SEQ ID NO: 738942 - DNA, 19 bp, Homo sapiens
tgacaaaccatttccaaca

SEQ ID NO: 738943 - DNA, 22 bp, Homo sapiens
tgacaaacctagcttttaaaaa

SEQ ID NO: 738944 - DNA, 15 bp, Homo sapiens
tgacaaagaaaccca

SEQ ID NO: 738945 - DNA, 17 bp, Homo sapiens
tgacaaaggcaagcact

SEQ ID NO: 738946 - DNA, 15 bp, Homo sapiens
tgacaaagtcatccc

SEQ ID NO: 738947 - DNA, 16 bp, Homo sapiens
tgacaaagtcatcccc

SEQ ID NO: 738948 - DNA, 19 bp, Homo sapiens
tgacaaagtcatcccctct

SEQ ID NO: 738949 - DNA, 23 bp, Homo sapiens
tgacaaatgtgtatcggatgctt

SEQ ID NO: 738950 - DNA, 12 bp, Homo sapiens
tgacaacactta

SEQ ID NO: 738951 - DNA, 19 bp, Homo sapiens
tgacaacacttaatagcaa

SEQ ID NO: 738952 - DNA, 17 bp, Homo sapiens
tgacaacagaaaaacaa

SEQ ID NO: 738953 - DNA, 13 bp, Homo sapiens
tgacaacagactg

SEQ ID NO: 738954 - DNA, 19 bp, Homo sapiens
tgacaacatcccacagtgg

SEQ ID NO: 738955 - DNA, 16 bp, Homo sapiens
tgacaaccaccgctcc

SEQ ID NO: 738956 - DNA, 19 bp, Homo sapiens
tgacaaccaccgctcccca

SEQ ID NO: 738957 - DNA, 21 bp, Homo sapiens
tgacaaccattaaagtcagaa

SEQ ID NO: 738958 - DNA, 16 bp, Homo sapiens
tgacaaccctggcctc

SEQ ID NO: 738959 - DNA, 16 bp, Homo sapiens
tgacaacctagaatgt

SEQ ID NO: 738960 - DNA, 21 bp, Homo sapiens
tgacaacgtttcagcgactcc

SEQ ID NO: 738961 - DNA, 13 bp, Homo sapiens
tgacaactgtgac

SEQ ID NO: 738962 - DNA, 21 bp, Homo sapiens
tgacaagagttggggacagaa

SEQ ID NO: 738963 - DNA, 23 bp, Homo sapiens
tgacaagatggtccatttgttcc

SEQ ID NO: 738964 - DNA, 13 bp, Homo sapiens
tgacaaggaaaat

SEQ ID NO: 738965 - DNA, 15 bp, Homo sapiens
tgacaaggaaaatct

SEQ ID NO: 738966 - DNA, 13 bp, Homo sapiens
tgacaaggcccca

SEQ ID NO: 738967 - DNA, 22 bp, Homo sapiens
tgacaaggccccagagactcag

SEQ ID NO: 738968 - DNA, 14 bp, Homo sapiens
tgacaagtcatttt

SEQ ID NO: 738969 - DNA, 16 bp, Homo sapiens
tgacaagtgaagaaca

SEQ ID NO: 738970 - DNA, 16 bp, Homo sapiens
tgacaataaaacatta

SEQ ID NO: 738971 - DNA, 15 bp, Homo sapiens
tgacaataaaatatt

SEQ ID NO: 738972 - DNA, 14 bp, Homo sapiens
tgacaataatttca

SEQ ID NO: 738973 - DNA, 13 bp, Homo sapiens
tgacaatatactt

SEQ ID NO: 738974 - DNA, 19 bp, Homo sapiens
tgacaatcaaagaaaagac

SEQ ID NO: 738975 - DNA, 14 bp, Homo sapiens
tgacaatcttttgg

SEQ ID NO: 738976 - DNA, 14 bp, Homo sapiens
tgacaatgaaggga

SEQ ID NO: 738977 - DNA, 12 bp, Homo sapiens
tgacaattctgc

SEQ ID NO: 738978 - DNA, 17 bp, Homo sapiens
tgacaattctgggtgcg

SEQ ID NO: 738979 - DNA, 17 bp, Homo sapiens
tgacaattctgttttta

SEQ ID NO: 738980 - DNA, 20 bp, Homo sapiens
tgacaatttctggcagatgt

SEQ ID NO: 738981 - DNA, 16 bp, Homo sapiens
tgacaattttgtacaa

SEQ ID NO: 738982 - DNA, 22 bp, Homo sapiens
tgacaattttgtacaaatttgt

SEQ ID NO: 738983 - DNA, 16 bp, Homo sapiens
tgacacaaaggtggaa

SEQ ID NO: 738984 - DNA, 20 bp, Homo sapiens
tgacacacccctaagtacaa

SEQ ID NO: 738985 - DNA, 20 bp, Homo sapiens
tgacacacgtatttatattt

SEQ ID NO: 738986 - DNA, 16 bp, Homo sapiens
tgacacagcagcttca

SEQ ID NO: 738987 - DNA, 20 bp, Homo sapiens
tgacacaggtcagggctcag

SEQ ID NO: 738988 - DNA, 15 bp, Homo sapiens
tgacacatatgaaca

SEQ ID NO: 738989 - DNA, 16 bp, Homo sapiens
tgacaccaataaatgt

SEQ ID NO: 738990 - DNA, 20 bp, Homo sapiens
tgacaccaataaatgtttgt

SEQ ID NO: 738991 - DNA, 21 bp, Homo sapiens
tgacaccaataaatgtttgtt

SEQ ID NO: 738992 - DNA, 17 bp, Homo sapiens
tgacaccatcttttatt

SEQ ID NO: 738993 - DNA, 20 bp, Homo sapiens
tgacacccatgccagagagg

SEQ ID NO: 738994 - DNA, 13 bp, Homo sapiens
tgacaccccctcc

SEQ ID NO: 738995 - DNA, 16 bp, Homo sapiens
tgacaccctggcctga

SEQ ID NO: 738996 - DNA, 16 bp, Homo sapiens
tgacaccgtccctcag

SEQ ID NO: 738997 - DNA, 18 bp, Homo sapiens
tgacaccgtcgaccagga

SEQ ID NO: 738998 - DNA, 23 bp, Homo sapiens
tgacaccgtcgaccaggaaagcc

SEQ ID NO: 738999 - DNA, 18 bp, Homo sapiens
tgacaccgtgggtcatta

SEQ ID NO: 739000 - DNA, 19 bp, Homo sapiens
tgacacctaccatgctgct

SEQ ID NO: 739001 - DNA, 13 bp, Homo sapiens
tgacacctccccc

SEQ ID NO: 739002 - DNA, 15 bp, Homo sapiens
tgacacctccccctt

SEQ ID NO: 739003 - DNA, 17 bp, Homo sapiens
tgacacctcttttttcg

SEQ ID NO: 739004 - DNA, 18 bp, Homo sapiens
tgacacgcaagtgtgtga

SEQ ID NO: 739005 - DNA, 23 bp, Homo sapiens
tgacacgcgctctccaccaccca

SEQ ID NO: 739006 - DNA, 19 bp, Homo sapiens
tgacactaaaacaagagga

SEQ ID NO: 739007 - DNA, 16 bp, Homo sapiens
ggatgcgcagtgcctt

SEQ ID NO: 739008 - DNA, 16 bp, Homo sapiens
ggatgcggatggccgg

SEQ ID NO: 739009 - DNA, 17 bp, Homo sapiens
ggatgcggctttctctg

SEQ ID NO: 739010 - DNA, 18 bp, Homo sapiens
ggatgcggctttctctgc

SEQ ID NO: 739011 - DNA, 19 bp, Homo sapiens
ggatgcggctttctctgcc

SEQ ID NO: 739012 - DNA, 13 bp, Homo sapiens
ggatgcgtgggag

SEQ ID NO: 739013 - DNA, 16 bp, Homo sapiens
ggatgcgtgggaggca

SEQ ID NO: 739014 - DNA, 17 bp, Homo sapiens
ggatgcgtgggaggcag

SEQ ID NO: 739015 - DNA, 14 bp, Homo sapiens
ggatgctgacccag

SEQ ID NO: 739016 - DNA, 18 bp, Homo sapiens
ggatgctgacccaggaat

SEQ ID NO: 739017 - DNA, 19 bp, Homo sapiens
ggatgctgacccaggaata

SEQ ID NO: 739018 - DNA, 13 bp, Homo sapiens
ggatgctgagctg

SEQ ID NO: 739019 - DNA, 14 bp, Homo sapiens
ggatgctgcagcag

SEQ ID NO: 739020 - DNA, 13 bp, Homo sapiens
ggatgctggaacc

SEQ ID NO: 739021 - DNA, 13 bp, Homo sapiens
ggatgctgggctg

SEQ ID NO: 739022 - DNA, 14 bp, Homo sapiens
ggatgctgggctgg

SEQ ID NO: 739023 - DNA, 15 bp, Homo sapiens
ggatgctgggctggg

SEQ ID NO: 739024 - DNA, 13 bp, Homo sapiens
ggatgctggtggc

SEQ ID NO: 739025 - DNA, 22 bp, Homo sapiens
ggatgcttcatgtgaacgtggg

SEQ ID NO: 739026 - DNA, 21 bp, Homo sapiens
ggatgcttgcctagggcctgg

SEQ ID NO: 739027 - DNA, 15 bp, Homo sapiens
ggatgcttgtacata

SEQ ID NO: 739028 - DNA, 19 bp, Homo sapiens
ggatggaaaaggaagacta

SEQ ID NO: 739029 - DNA, 20 bp, Homo sapiens
ggatggaacgggcatgggcc

SEQ ID NO: 739030 - DNA, 17 bp, Homo sapiens
ggatggaagcaggacag

SEQ ID NO: 739031 - DNA, 19 bp, Homo sapiens
ggatggaaggttggatgga

SEQ ID NO: 739032 - DNA, 11 bp, Homo sapiens
ggatggacaga

SEQ ID NO: 739033 - DNA, 20 bp, Homo sapiens
ggatggacagacacctcccc

SEQ ID NO: 739034 - DNA, 21 bp, Homo sapiens
ggatggcccagcaggcaggca

SEQ ID NO: 739035 - DNA, 13 bp, Homo sapiens
ggatggccccagc

SEQ ID NO: 739036 - DNA, 18 bp, Homo sapiens
ggatggcccctccttgca

SEQ ID NO: 739037 - DNA, 19 bp, Homo sapiens
ggatggcctttccttccct

SEQ ID NO: 739038 - DNA, 20 bp, Homo sapiens
ggatggcctttccttccctc

SEQ ID NO: 739039 - DNA, 11 bp, Homo sapiens
ggatgggactc

SEQ ID NO: 739040 - DNA, 15 bp, Homo sapiens
ggatgggaggagagc

SEQ ID NO: 739041 - DNA, 17 bp, Homo sapiens
ggatgggccagggttta

SEQ ID NO: 739042 - DNA, 15 bp, Homo sapiens
tgacagctagacacc

SEQ ID NO: 739043 - DNA, 14 bp, Homo sapiens
tgacagctgctcct

SEQ ID NO: 739044 - DNA, 21 bp, Homo sapiens
tgacagctgctcctagaggga

SEQ ID NO: 739045 - DNA, 13 bp, Homo sapiens
tgacagctggcta

SEQ ID NO: 739046 - DNA, 18 bp, Homo sapiens
tgacagctgtccctgtca

SEQ ID NO: 739047 - DNA, 21 bp, Homo sapiens
tgacagctgtccctgtcacca

SEQ ID NO: 739048 - DNA, 17 bp, Homo sapiens
tgacagctttctgggat

SEQ ID NO: 739049 - DNA, 15 bp, Homo sapiens
tgacagctttgctgc

SEQ ID NO: 739050 - DNA, 17 bp, Homo sapiens
tgacaggaaagccctcc

SEQ ID NO: 739051 - DNA, 18 bp, Homo sapiens
tgacaggcagcctggaca

SEQ ID NO: 739052 - DNA, 14 bp, Homo sapiens
tgacaggcccagtg

SEQ ID NO: 739053 - DNA, 20 bp, Homo sapiens
tgacaggcccagtggaacag

SEQ ID NO: 739054 - DNA, 14 bp, Homo sapiens
tgacaggcctgtcc

SEQ ID NO: 739055 - DNA, 12 bp, Homo sapiens
tgacaggctgtt

SEQ ID NO: 739056 - DNA, 19 bp, Homo sapiens
tgacagggacatgccctgt

SEQ ID NO: 739057 - DNA, 23 bp, Homo sapiens
tgacagggcagagcaggaaggac

SEQ ID NO: 739058 - DNA, 21 bp, Homo sapiens
tgacagggccagtggggcctg

SEQ ID NO: 739059 - DNA, 15 bp, Homo sapiens
tgacaggtaaactat

SEQ ID NO: 739060 - DNA, 16 bp, Homo sapiens
tgacaggtaatgaagc

SEQ ID NO: 739061 - DNA, 18 bp, Homo sapiens
tgacagtaaccatttcag

SEQ ID NO: 739062 - DNA, 12 bp, Homo sapiens
tgacagtatatt

SEQ ID NO: 739063 - DNA, 21 bp, Homo sapiens
tgacagtatatttgaaactgt

SEQ ID NO: 739064 - DNA, 14 bp, Homo sapiens
tgacagtattaagg

SEQ ID NO: 739065 - DNA, 22 bp, Homo sapiens
tgacagtattatacgctggcaa

SEQ ID NO: 739066 - DNA, 14 bp, Homo sapiens
tgacagtcataaat

SEQ ID NO: 739067 - DNA, 13 bp, Homo sapiens
tgacagtcatcat

SEQ ID NO: 739068 - DNA, 19 bp, Homo sapiens
tgacagtcatcatcagggc

SEQ ID NO: 739069 - DNA, 21 bp, Homo sapiens
tgacagtcatcatcagggcct

SEQ ID NO: 739070 - DNA, 14 bp, Homo sapiens
tgacagtcctccat

SEQ ID NO: 739071 - DNA, 18 bp, Homo sapiens
tgacagtcctccatccac

SEQ ID NO: 739072 - DNA, 11 bp, Homo sapiens
tgacagtctga

SEQ ID NO: 739073 - DNA, 23 bp, Homo sapiens
tgacagtcttgtgcttttcctat

SEQ ID NO: 739074 - DNA, 22 bp, Homo sapiens
tgacagtgaagcagcactgtga

SEQ ID NO: 739075 - DNA, 21 bp, Homo sapiens
tgacagtgcctcttccagtga

SEQ ID NO: 739076 - DNA, 14 bp, Homo sapiens
tgacagtgccttct

SEQ ID NO: 739077 - DNA, 16 bp, Homo sapiens
tgacagtgcttgcatc

SEQ ID NO: 739078 - DNA, 16 bp, Homo sapiens
tgacagtggaactaca

SEQ ID NO: 739079 - DNA, 18 bp, Homo sapiens
tgacagtggaactacatt

SEQ ID NO: 739080 - DNA, 14 bp, Homo sapiens
tgacagtgtatggg

SEQ ID NO: 739081 - DNA, 19 bp, Homo sapiens
tgacagtgttgaaaatgtt

SEQ ID NO: 739082 - DNA, 16 bp, Homo sapiens
tgacagtttccaaatt

SEQ ID NO: 739083 - DNA, 16 bp, Homo sapiens
tgacataaagttgata

SEQ ID NO: 739084 - DNA, 17 bp, Homo sapiens
tgacataacactataaa

SEQ ID NO: 739085 - DNA, 16 bp, Homo sapiens
tgacataatatattct

SEQ ID NO: 739086 - DNA, 15 bp, Homo sapiens
tgacataattgtcca

SEQ ID NO: 739087 - DNA, 12 bp, Homo sapiens
tgacatacctac

SEQ ID NO: 739088 - DNA, 18 bp, Homo sapiens
tgacatacctaccagtat

SEQ ID NO: 739089 - DNA, 15 bp, Homo sapiens
tgacatagcctcatg

SEQ ID NO: 739090 - DNA, 19 bp, Homo sapiens
tgacataggccaaggccca

SEQ ID NO: 739091 - DNA, 13 bp, Homo sapiens
tgacatatacata

SEQ ID NO: 739092 - DNA, 16 bp, Homo sapiens
tgacatatttaatgtt

SEQ ID NO: 739093 - DNA, 13 bp, Homo sapiens
tgacatcacttgt

SEQ ID NO: 739094 - DNA, 19 bp, Homo sapiens
tgacatcacttgtacaaaa

SEQ ID NO: 739095 - DNA, 18 bp, Homo sapiens
tgacatcagcgtagtgtt

SEQ ID NO: 739096 - DNA, 23 bp, Homo sapiens
tgacatcagtggcatggctccag

SEQ ID NO: 739097 - DNA, 20 bp, Homo sapiens
tgacatcattcatgacaaca

SEQ ID NO: 739098 - DNA, 21 bp, Homo sapiens
tgacatcattcatgacaacat

SEQ ID NO: 739099 - DNA, 21 bp, Homo sapiens
tgacatccactgtttgccttg

SEQ ID NO: 739100 - DNA, 21 bp, Homo sapiens
tgacatccagaaagctgagga

SEQ ID NO: 739101 - DNA, 13 bp, Homo sapiens
tgacatcccttcc

SEQ ID NO: 739102 - DNA, 14 bp, Homo sapiens
tgacatcccttcct

SEQ ID NO: 739103 - DNA, 17 bp, Homo sapiens
tgacatcccttcctgga

SEQ ID NO: 739104 - DNA, 22 bp, Homo sapiens
tgacatcccttcctggaaacag

SEQ ID NO: 739105 - DNA, 19 bp, Homo sapiens
tgacatcggaaaaataatc

SEQ ID NO: 739106 - DNA, 22 bp, Homo sapiens
tgacatctcaggggccagagga

SEQ ID NO: 739107 - DNA, 16 bp, Homo sapiens
tgacatctgtgtttca

SEQ ID NO: 739108 - DNA, 14 bp, Homo sapiens
tgacatgatcgctt

SEQ ID NO: 739109 - DNA, 15 bp, Homo sapiens
tgacatggggaaggc

SEQ ID NO: 739110 - DNA, 20 bp, Homo sapiens
tgacatggggaaggcagagg

SEQ ID NO: 739111 - DNA, 18 bp, Homo sapiens
tgacatgggtattttata

SEQ ID NO: 739112 - DNA, 16 bp, Homo sapiens
tgacatggtgcctgag

SEQ ID NO: 739113 - DNA, 21 bp, Homo sapiens
tgacatggtgcctgagaggca

SEQ ID NO: 739114 - DNA, 22 bp, Homo sapiens
tgacatgtaccccctttccctt

SEQ ID NO: 739115 - DNA, 16 bp, Homo sapiens
tgacatgtccctacac

SEQ ID NO: 739116 - DNA, 14 bp, Homo sapiens
tgacatgtccttct

SEQ ID NO: 739117 - DNA, 17 bp, Homo sapiens
tgacatgtctacttttt

SEQ ID NO: 739118 - DNA, 22 bp, Homo sapiens
tgacatgtggaaagtgaatttg

SEQ ID NO: 739119 - DNA, 20 bp, Homo sapiens
tgacattaaatgcaataatt

SEQ ID NO: 739120 - DNA, 21 bp, Homo sapiens
tgacattaaatgcaataattt

SEQ ID NO: 739121 - DNA, 22 bp, Homo sapiens
tgacattaacagttttccatga

SEQ ID NO: 739122 - DNA, 12 bp, Homo sapiens
tgacattcacct

SEQ ID NO: 739123 - DNA, 18 bp, Homo sapiens
tgacattcacctgcccca

SEQ ID NO: 739124 - DNA, 10 bp, Homo sapiens
tgacattcct

SEQ ID NO: 739125 - DNA, 18 bp, Homo sapiens
tgacattccttgtcacca

SEQ ID NO: 739126 - DNA, 15 bp, Homo sapiens
tgacattctgaatgc

SEQ ID NO: 739127 - DNA, 13 bp, Homo sapiens
tgacattgaaatc

SEQ ID NO: 739128 - DNA, 21 bp, Homo sapiens
tgacattgaaatctaggaaaa

SEQ ID NO: 739129 - DNA, 15 bp, Homo sapiens
tgacattgctggtca

SEQ ID NO: 739130 - DNA, 21 bp, Homo sapiens
ggatttgtagcataactgtag

SEQ ID NO: 739131 - DNA, 20 bp, Homo sapiens
ggattttaaaaaatcaatca

SEQ ID NO: 739132 - DNA, 22 bp, Homo sapiens
ggattttaacaaaagcaagact

SEQ ID NO: 739133 - DNA, 14 bp, Homo sapiens
ggattttaccaaag

SEQ ID NO: 739134 - DNA, 10 bp, Homo sapiens
ggattttcta

SEQ ID NO: 739135 - DNA, 23 bp, Homo sapiens
ggattttgaattagattatttct

SEQ ID NO: 739136 - DNA, 14 bp, Homo sapiens
ggatttttgtcttg

SEQ ID NO: 739137 - DNA, 14 bp, Homo sapiens
ggattttttccctt

SEQ ID NO: 739138 - DNA, 17 bp, Homo sapiens
ggcaaaaaaaaaaaagc

SEQ ID NO: 739139 - DNA, 18 bp, Homo sapiens
ggcaaaaaaaaaaaagcg

SEQ ID NO: 739140 - DNA, 19 bp, Homo sapiens
ggcaaaacacgcaagggca

SEQ ID NO: 739141 - DNA, 13 bp, Homo sapiens
ggcaaaagactgg

SEQ ID NO: 739142 - DNA, 10 bp, Homo sapiens
ggcaaacaat

SEQ ID NO: 739143 - DNA, 13 bp, Homo sapiens
ggcaaacccatca

SEQ ID NO: 739144 - DNA, 15 bp, Homo sapiens
ggcaaacctttcccc

SEQ ID NO: 739145 - DNA, 13 bp, Homo sapiens
ggcaaactctcta

SEQ ID NO: 739146 - DNA, 15 bp, Homo sapiens
ggcaaagaggatccg

SEQ ID NO: 739147 - DNA, 21 bp, Homo sapiens
ggcaaagtgctgtacccttcc

SEQ ID NO: 739148 - DNA, 23 bp, Homo sapiens
ggcaaagttttacagagaggata

SEQ ID NO: 739149 - DNA, 13 bp, Homo sapiens
ggcaaatattgaa

SEQ ID NO: 739150 - DNA, 14 bp, Homo sapiens
ggcaaatcaggggc

SEQ ID NO: 739151 - DNA, 15 bp, Homo sapiens
ggcaaatcaggggcc

SEQ ID NO: 739152 - DNA, 17 bp, Homo sapiens
ggcaaatgccagggccc

SEQ ID NO: 739153 - DNA, 13 bp, Homo sapiens
ggcaaatggctga

SEQ ID NO: 739154 - DNA, 16 bp, Homo sapiens
ggcaaattaactgtat

SEQ ID NO: 739155 - DNA, 17 bp, Homo sapiens
ggcaacactgcaggaca

SEQ ID NO: 739156 - DNA, 18 bp, Homo sapiens
ggcaacactgctgtccac

SEQ ID NO: 739157 - DNA, 21 bp, Homo sapiens
ggcaacactggaacatggcta

SEQ ID NO: 739158 - DNA, 16 bp, Homo sapiens
ggcaacagagcaagac

SEQ ID NO: 739159 - DNA, 20 bp, Homo sapiens
ggcaacagagcaagactcca

SEQ ID NO: 739160 - DNA, 19 bp, Homo sapiens
ggcaacagagcaagatcct

SEQ ID NO: 739161 - DNA, 13 bp, Homo sapiens
ggcaacagggagc

SEQ ID NO: 739162 - DNA, 16 bp, Homo sapiens
ggcaacagggagcacc

SEQ ID NO: 739163 - DNA, 18 bp, Homo sapiens
ggcaaccacatgtcccag

SEQ ID NO: 739164 - DNA, 21 bp, Homo sapiens
ggcaaccacatgtcccagatc

SEQ ID NO: 739165 - DNA, 16 bp, Homo sapiens
ggcaaccccagttctg

SEQ ID NO: 739166 - DNA, 17 bp, Homo sapiens
ggcaaccccagttctgc

SEQ ID NO: 739167 - DNA, 20 bp, Homo sapiens
ggcaaccccagttctgctcc

SEQ ID NO: 739168 - DNA, 20 bp, Homo sapiens
ggcaaccccctcggagcctg

SEQ ID NO: 739169 - DNA, 15 bp, Homo sapiens
ggcaaccttgtctct

SEQ ID NO: 739170 - DNA, 18 bp, Homo sapiens
tgaccacacttcctgtcc

SEQ ID NO: 739171 - DNA, 20 bp, Homo sapiens
tgaccacacttcctgtccag

SEQ ID NO: 739172 - DNA, 23 bp, Homo sapiens
tgaccacacttcctgtccagaga

SEQ ID NO: 739173 - DNA, 14 bp, Homo sapiens
tgaccacagcacag

SEQ ID NO: 739174 - DNA, 12 bp, Homo sapiens
tgaccacataga

SEQ ID NO: 739175 - DNA, 16 bp, Homo sapiens
tgaccaccccctgttc

SEQ ID NO: 739176 - DNA, 21 bp, Homo sapiens
tgaccacgctttctagctgtt

SEQ ID NO: 739177 - DNA, 22 bp, Homo sapiens
tgaccacgctttctagctgttg

SEQ ID NO: 739178 - DNA, 22 bp, Homo sapiens
tgaccacgtgaaatttgcctct

SEQ ID NO: 739179 - DNA, 23 bp, Homo sapiens
tgaccacgtgaaatttgcctctg

SEQ ID NO: 739180 - DNA, 15 bp, Homo sapiens
tgaccactccagaga

SEQ ID NO: 739181 - DNA, 16 bp, Homo sapiens
tgaccactccagagaa

SEQ ID NO: 739182 - DNA, 16 bp, Homo sapiens
tgaccactctgtcttg

SEQ ID NO: 739183 - DNA, 23 bp, Homo sapiens
tgaccactcttctttaagccata

SEQ ID NO: 739184 - DNA, 15 bp, Homo sapiens
tgaccagatctttct

SEQ ID NO: 739185 - DNA, 16 bp, Homo sapiens
tgaccagatctttctc

SEQ ID NO: 739186 - DNA, 17 bp, Homo sapiens
tgaccagatctttctct

SEQ ID NO: 739187 - DNA, 22 bp, Homo sapiens
tgaccagatctttctcttccct

SEQ ID NO: 739188 - DNA, 20 bp, Homo sapiens
tgaccagcagcagctttcag

SEQ ID NO: 739189 - DNA, 22 bp, Homo sapiens
tgaccagcctccatgctgcctc

SEQ ID NO: 739190 - DNA, 23 bp, Homo sapiens
tgaccagcctccatgctgcctcc

SEQ ID NO: 739191 - DNA, 20 bp, Homo sapiens
tgaccagcctgtcacccagc

SEQ ID NO: 739192 - DNA, 20 bp, Homo sapiens
tgaccaggcttttgtagatg

SEQ ID NO: 739193 - DNA, 11 bp, Homo sapiens
tgaccagggaa

SEQ ID NO: 739194 - DNA, 12 bp, Homo sapiens
tgaccagggaag

SEQ ID NO: 739195 - DNA, 13 bp, Homo sapiens
tgaccagggaagt

SEQ ID NO: 739196 - DNA, 18 bp, Homo sapiens
tgaccagggatgctgggc

SEQ ID NO: 739197 - DNA, 19 bp, Homo sapiens
tgaccagggatgctgggct

SEQ ID NO: 739198 - DNA, 22 bp, Homo sapiens
tgaccaggggtgatttcagaga

SEQ ID NO: 739199 - DNA, 20 bp, Homo sapiens
tgaccatacaatttcatcct

SEQ ID NO: 739200 - DNA, 18 bp, Homo sapiens
tgaccatcttcataattt

SEQ ID NO: 739201 - DNA, 20 bp, Homo sapiens
tgaccatgcactatatttgt

SEQ ID NO: 739202 - DNA, 19 bp, Homo sapiens
tgaccatgcattttaccat

SEQ ID NO: 739203 - DNA, 12 bp, Homo sapiens
tgaccatgctca

SEQ ID NO: 739204 - DNA, 18 bp, Homo sapiens
tgaccatggttttggctc

SEQ ID NO: 739205 - DNA, 23 bp, Homo sapiens
tgaccatggttttggctctccca

SEQ ID NO: 739206 - DNA, 14 bp, Homo sapiens
tgaccatgttcatt

SEQ ID NO: 739207 - DNA, 17 bp, Homo sapiens
tgaccattcaattagtg

SEQ ID NO: 739208 - DNA, 14 bp, Homo sapiens
tgaccatttataat

SEQ ID NO: 739209 - DNA, 23 bp, Homo sapiens
tgaccatttataatgttagtaga

SEQ ID NO: 739210 - DNA, 20 bp, Homo sapiens
tgaccattttgttaaaatct

SEQ ID NO: 739211 - DNA, 12 bp, Homo sapiens
tgacccaaagca

SEQ ID NO: 739212 - DNA, 15 bp, Homo sapiens
tgacccaaagcaaaa

SEQ ID NO: 739213 - DNA, 14 bp, Homo sapiens
tgacccaattaagt

SEQ ID NO: 739214 - DNA, 13 bp, Homo sapiens
tgacccacactgc

SEQ ID NO: 739215 - DNA, 16 bp, Homo sapiens
tgacccacactgccag

SEQ ID NO: 739216 - DNA, 13 bp, Homo sapiens
tgacccacccctg

SEQ ID NO: 739217 - DNA, 16 bp, Homo sapiens
tgacccacggggcagt

SEQ ID NO: 739218 - DNA, 22 bp, Homo sapiens
tgacccagagccaccaaagtca

SEQ ID NO: 739219 - DNA, 20 bp, Homo sapiens
tgacccagagtggagtctga

SEQ ID NO: 739220 - DNA, 13 bp, Homo sapiens
tgacccaggccgc

SEQ ID NO: 739221 - DNA, 22 bp, Homo sapiens
tgacccaggccgcagctcttgc

SEQ ID NO: 739222 - DNA, 21 bp, Homo sapiens
tgacccagtccccgtgccccg

SEQ ID NO: 739223 - DNA, 15 bp, Homo sapiens
tgacccagtccctgg

SEQ ID NO: 739224 - DNA, 20 bp, Homo sapiens
tgacccagtccctgggggaa

SEQ ID NO: 739225 - DNA, 13 bp, Homo sapiens
tgacccagtgaga

SEQ ID NO: 739226 - DNA, 14 bp, Homo sapiens
tgacccatcccttt

SEQ ID NO: 739227 - DNA, 23 bp, Homo sapiens
tgacccatcccttttcctttctg

SEQ ID NO: 739228 - DNA, 21 bp, Homo sapiens
tgaccccaaacaccttccagc

SEQ ID NO: 739229 - DNA, 22 bp, Homo sapiens
tgaccccaaacaccttccagct

SEQ ID NO: 739230 - DNA, 13 bp, Homo sapiens
tgaccccagagga

SEQ ID NO: 739231 - DNA, 19 bp, Homo sapiens
tgaccccagggcctgtctc

SEQ ID NO: 739232 - DNA, 18 bp, Homo sapiens
tgaccccaggtcagccct

SEQ ID NO: 739233 - DNA, 17 bp, Homo sapiens
tgaccccagtttcttct

SEQ ID NO: 739234 - DNA, 14 bp, Homo sapiens
tgacccccagctcc

SEQ ID NO: 739235 - DNA, 23 bp, Homo sapiens
tgaccccccccattagaatgtga

SEQ ID NO: 739236 - DNA, 15 bp, Homo sapiens
tgaccccctcccctg

SEQ ID NO: 739237 - DNA, 22 bp, Homo sapiens
tgaccccgagaagtgctcttgg

SEQ ID NO: 739238 - DNA, 13 bp, Homo sapiens
tgacccctacccc

SEQ ID NO: 739239 - DNA, 14 bp, Homo sapiens
tgacccctaccccc

SEQ ID NO: 739240 - DNA, 21 bp, Homo sapiens
tgacccctaccccctcatccc

SEQ ID NO: 739241 - DNA, 14 bp, Homo sapiens
tgacccctccctgc

SEQ ID NO: 739242 - DNA, 16 bp, Homo sapiens
tgacccctccctgcag

SEQ ID NO: 739243 - DNA, 16 bp, Homo sapiens
tgacccctctcctcaa

SEQ ID NO: 739244 - DNA, 20 bp, Homo sapiens
tgaccccttctctctccaga

SEQ ID NO: 739245 - DNA, 16 bp, Homo sapiens
tgacccggaggaaagg

SEQ ID NO: 739246 - DNA, 22 bp, Homo sapiens
tgacccggctgggtcggccctg

SEQ ID NO: 739247 - DNA, 17 bp, Homo sapiens
tgacccggttgcagtca

SEQ ID NO: 739248 - DNA, 19 bp, Homo sapiens
tgacccggttgcagtcact

SEQ ID NO: 739249 - DNA, 20 bp, Homo sapiens
tgacccggttgcagtcactg

SEQ ID NO: 739250 - DNA, 20 bp, Homo sapiens
tgacccgtccattcttcagt

SEQ ID NO: 739251 - DNA, 21 bp, Homo sapiens
tgaccctatgggtctaggaca

SEQ ID NO: 739252 - DNA, 21 bp, Homo sapiens
ggcaccagggcgctgggaagg

SEQ ID NO: 739253 - DNA, 17 bp, Homo sapiens
ggcaccaggggtttctc

SEQ ID NO: 739254 - DNA, 16 bp, Homo sapiens
ggcacccacaaataaa

SEQ ID NO: 739255 - DNA, 23 bp, Homo sapiens
ggcacccaccagaaattccagta

SEQ ID NO: 739256 - DNA, 22 bp, Homo sapiens
ggcacccaccgtctcggccctg

SEQ ID NO: 739257 - DNA, 13 bp, Homo sapiens
ggcacccccatgc

SEQ ID NO: 739258 - DNA, 21 bp, Homo sapiens
ggcacccctccgtgtggagca

SEQ ID NO: 739259 - DNA, 12 bp, Homo sapiens
ggcacccttctt

SEQ ID NO: 739260 - DNA, 20 bp, Homo sapiens
ggcacccttctttcctcttc

SEQ ID NO: 739261 - DNA, 22 bp, Homo sapiens
ggcacccttctttcctcttccc

SEQ ID NO: 739262 - DNA, 16 bp, Homo sapiens
ggcaccggcgctgcag

SEQ ID NO: 739263 - DNA, 23 bp, Homo sapiens
ggcaccgggctccatgcctctgg

SEQ ID NO: 739264 - DNA, 16 bp, Homo sapiens
ggcaccgtgtcctcct

SEQ ID NO: 739265 - DNA, 21 bp, Homo sapiens
ggcacctacactcacctgcac

SEQ ID NO: 739266 - DNA, 19 bp, Homo sapiens
ggcacctcacaggccccag

SEQ ID NO: 739267 - DNA, 14 bp, Homo sapiens
ggcacctcagaaag

SEQ ID NO: 739268 - DNA, 18 bp, Homo sapiens
ggcacctccaggcaggcc

SEQ ID NO: 739269 - DNA, 19 bp, Homo sapiens
ggcacctccggctgcctag

SEQ ID NO: 739270 - DNA, 14 bp, Homo sapiens
ggcacctcctgaga

SEQ ID NO: 739271 - DNA, 16 bp, Homo sapiens
ggcacctgaaattaat

SEQ ID NO: 739272 - DNA, 12 bp, Homo sapiens
ggcacctgctgg

SEQ ID NO: 739273 - DNA, 13 bp, Homo sapiens
ggcacctggcctg

SEQ ID NO: 739274 - DNA, 16 bp, Homo sapiens
ggcacctggcctgctg

SEQ ID NO: 739275 - DNA, 19 bp, Homo sapiens
ggcacctggcctgctggga

SEQ ID NO: 739276 - DNA, 20 bp, Homo sapiens
ggcacctgtagtcccagcta

SEQ ID NO: 739277 - DNA, 17 bp, Homo sapiens
ggcacgaacccacctgc

SEQ ID NO: 739278 - DNA, 18 bp, Homo sapiens
ggcacggagagaaggccc

SEQ ID NO: 739279 - DNA, 17 bp, Homo sapiens
ggcacgggccctccctc

SEQ ID NO: 739280 - DNA, 22 bp, Homo sapiens
ggcacgtattgctgtgtctcct

SEQ ID NO: 739281 - DNA, 20 bp, Homo sapiens
ggcactaaaccacttctctg

SEQ ID NO: 739282 - DNA, 21 bp, Homo sapiens
ggcactaaatacatgtttgtt

SEQ ID NO: 739283 - DNA, 23 bp, Homo sapiens
ggcactaacgttgagcccctgga

SEQ ID NO: 739284 - DNA, 18 bp, Homo sapiens
ggcactatttatttacaa

SEQ ID NO: 739285 - DNA, 17 bp, Homo sapiens
ggcactcacagacctgg

SEQ ID NO: 739286 - DNA, 21 bp, Homo sapiens
ggcactcacagacctggagcc

SEQ ID NO: 739287 - DNA, 18 bp, Homo sapiens
ggcactcagtgagcctcc

SEQ ID NO: 739288 - DNA, 20 bp, Homo sapiens
ggcactcagtgagcctcctg

SEQ ID NO: 739289 - DNA, 16 bp, Homo sapiens
ggcactcccaaccctg

SEQ ID NO: 739290 - DNA, 22 bp, Homo sapiens
ggcactccgcgccgatgccacc

SEQ ID NO: 739291 - DNA, 23 bp, Homo sapiens
ggcactccgcgccgatgccaccg

SEQ ID NO: 739292 - DNA, 21 bp, Homo sapiens
ggcactgaacaggctggggcc

SEQ ID NO: 739293 - DNA, 17 bp, Homo sapiens
ggcactgaagtggccct

SEQ ID NO: 739294 - DNA, 18 bp, Homo sapiens
ggcactgaagtggccctc

SEQ ID NO: 739295 - DNA, 22 bp, Homo sapiens
ggcactgaagtggccctccctc

SEQ ID NO: 739296 - DNA, 15 bp, Homo sapiens
tgacctacagtgctg

SEQ ID NO: 739297 - DNA, 19 bp, Homo sapiens
tgacctagaccagtttgca

SEQ ID NO: 739298 - DNA, 21 bp, Homo sapiens
tgacctattcaccctccactt

SEQ ID NO: 739299 - DNA, 17 bp, Homo sapiens
tgacctcaacctgtgat

SEQ ID NO: 739300 - DNA, 18 bp, Homo sapiens
tgacctcaacctgtgatg

SEQ ID NO: 739301 - DNA, 13 bp, Homo sapiens
tgacctcagctgc

SEQ ID NO: 739302 - DNA, 19 bp, Homo sapiens
tgacctcaggtgatccgcc

SEQ ID NO: 739303 - DNA, 11 bp, Homo sapiens
tgacctcccag

SEQ ID NO: 739304 - DNA, 12 bp, Homo sapiens
tgacctcccagc

SEQ ID NO: 739305 - DNA, 22 bp, Homo sapiens
tgacctcccagccctatggatg

SEQ ID NO: 739306 - DNA, 14 bp, Homo sapiens
tgacctcccctccc

SEQ ID NO: 739307 - DNA, 19 bp, Homo sapiens
tgacctcccctccccagcc

SEQ ID NO: 739308 - DNA, 14 bp, Homo sapiens
tgacctccctctaa

SEQ ID NO: 739309 - DNA, 19 bp, Homo sapiens
tgacctccgccatccaccc

SEQ ID NO: 739310 - DNA, 15 bp, Homo sapiens
tgacctcctgtcact

SEQ ID NO: 739311 - DNA, 24 bp, Homo sapiens
tgacctcctgtcactcactgaggc

SEQ ID NO: 739312 - DNA, 17 bp, Homo sapiens
tgacctctagagctgga

SEQ ID NO: 739313 - DNA, 15 bp, Homo sapiens
tgacctctataaact

SEQ ID NO: 739314 - DNA, 13 bp, Homo sapiens
tgacctctgcagc

SEQ ID NO: 739315 - DNA, 21 bp, Homo sapiens
tgacctctgcagcaataaagc

SEQ ID NO: 739316 - DNA, 16 bp, Homo sapiens
tgacctctgctgagtg

SEQ ID NO: 739317 - DNA, 17 bp, Homo sapiens
tgacctctgtgaccaac

SEQ ID NO: 739318 - DNA, 21 bp, Homo sapiens
tgacctctgttgtcctcccct

SEQ ID NO: 739319 - DNA, 22 bp, Homo sapiens
tgacctctgttgtcctcccctt

SEQ ID NO: 739320 - DNA, 13 bp, Homo sapiens
tgacctcttcaaa

SEQ ID NO: 739321 - DNA, 15 bp, Homo sapiens
tgacctcttgctgtc

SEQ ID NO: 739322 - DNA, 22 bp, Homo sapiens
tgacctcttgctgtctctgctc

SEQ ID NO: 739323 - DNA, 17 bp, Homo sapiens
tgacctgaggagacatc

SEQ ID NO: 739324 - DNA, 12 bp, Homo sapiens
tgacctgcattg

SEQ ID NO: 739325 - DNA, 20 bp, Homo sapiens
tgacctgcgggtcctcagct

SEQ ID NO: 739326 - DNA, 22 bp, Homo sapiens
tgacctgcgggtcctcagctgc

SEQ ID NO: 739327 - DNA, 21 bp, Homo sapiens
tgacctgctccgccaggaaag

SEQ ID NO: 739328 - DNA, 19 bp, Homo sapiens
tgacctgctccgctgctcc

SEQ ID NO: 739329 - DNA, 16 bp, Homo sapiens
tgacctgctgaattgt

SEQ ID NO: 739330 - DNA, 13 bp, Homo sapiens
tgacctgctgacc

SEQ ID NO: 739331 - DNA, 15 bp, Homo sapiens
tgacctgctgacctg

SEQ ID NO: 739332 - DNA, 18 bp, Homo sapiens
tgacctgctgacctgtgc

SEQ ID NO: 739333 - DNA, 13 bp, Homo sapiens
tgacctgtgacca

SEQ ID NO: 739334 - DNA, 20 bp, Homo sapiens
tgacctgtgagcccagctgg

SEQ ID NO: 739335 - DNA, 16 bp, Homo sapiens
tgacctgtttctctgc

SEQ ID NO: 739336 - DNA, 19 bp, Homo sapiens
tgaccttagcgttctggac

SEQ ID NO: 739337 - DNA, 21 bp, Homo sapiens
tgaccttagcgttctggactc

SEQ ID NO: 739338 - DNA, 22 bp, Homo sapiens
tgaccttatgagaaactgcatg

SEQ ID NO: 739339 - DNA, 20 bp, Homo sapiens
tgaccttcatttcatgtata

SEQ ID NO: 739340 - DNA, 11 bp, Homo sapiens
tgaccttcccc

SEQ ID NO: 739341 - DNA, 16 bp, Homo sapiens
tgaccttccttcctgt

SEQ ID NO: 739342 - DNA, 13 bp, Homo sapiens
tgaccttctggga

SEQ ID NO: 739343 - DNA, 15 bp, Homo sapiens
tgaccttgaatcttt

SEQ ID NO: 739344 - DNA, 13 bp, Homo sapiens
tgaccttgctgcc

SEQ ID NO: 739345 - DNA, 14 bp, Homo sapiens
tgaccttgctgcca

SEQ ID NO: 739346 - DNA, 16 bp, Homo sapiens
tgaccttgctgccaca

SEQ ID NO: 739347 - DNA, 21 bp, Homo sapiens
tgaccttggaggaatgacaat

SEQ ID NO: 739348 - DNA, 19 bp, Homo sapiens
tgaccttggctgactgggg

SEQ ID NO: 739349 - DNA, 20 bp, Homo sapiens
tgaccttggctgactggggc

SEQ ID NO: 739350 - DNA, 14 bp, Homo sapiens
tgaccttgggacca

SEQ ID NO: 739351 - DNA, 20 bp, Homo sapiens
tgaccttgggaccaaagggg

SEQ ID NO: 739352 - DNA, 15 bp, Homo sapiens
tgacctttaggtatt

SEQ ID NO: 739353 - DNA, 22 bp, Homo sapiens
tgacctttcatcgtaaagtgct

SEQ ID NO: 739354 - DNA, 20 bp, Homo sapiens
tgacctttgaggtctaaaca

SEQ ID NO: 739355 - DNA, 20 bp, Homo sapiens
tgaccttttgacttaaagca

SEQ ID NO: 739356 - DNA, 21 bp, Homo sapiens
tgacgatgggtgttgctgttt

SEQ ID NO: 739357 - DNA, 18 bp, Homo sapiens
tgacgcaccactgccaat

SEQ ID NO: 739358 - DNA, 18 bp, Homo sapiens
tgacgcccaccttcgggc

SEQ ID NO: 739359 - DNA, 12 bp, Homo sapiens
tgacgcccagct

SEQ ID NO: 739360 - DNA, 22 bp, Homo sapiens
tgacgccctgcgttggagccac

SEQ ID NO: 739361 - DNA, 19 bp, Homo sapiens
tgacgcctgagacagcacc

SEQ ID NO: 739362 - DNA, 20 bp, Homo sapiens
tgacgcctgagacagcacca

SEQ ID NO: 739363 - DNA, 15 bp, Homo sapiens
tgacgcttgtgacag

SEQ ID NO: 739364 - DNA, 19 bp, Homo sapiens
tgacgcttgtgacagtgcc

SEQ ID NO: 739365 - DNA, 15 bp, Homo sapiens
tgacggccttcttgg

SEQ ID NO: 739366 - DNA, 16 bp, Homo sapiens
tgacggccttcttggt

SEQ ID NO: 739367 - DNA, 12 bp, Homo sapiens
tgacggctgggg

SEQ ID NO: 739368 - DNA, 16 bp, Homo sapiens
tgacgggccgcaggag

SEQ ID NO: 739369 - DNA, 22 bp, Homo sapiens
tgacgggccgcaggagggaggc

SEQ ID NO: 739370 - DNA, 23 bp, Homo sapiens
tgacggtcccacactggtgactg

SEQ ID NO: 739371 - DNA, 22 bp, Homo sapiens
tgacggtcctttaggcagcctg

SEQ ID NO: 739372 - DNA, 15 bp, Homo sapiens
tgacggtgacaaaga

SEQ ID NO: 739373 - DNA, 15 bp, Homo sapiens
tgagaagctgaggcc

SEQ ID NO: 739374 - DNA, 21 bp, Homo sapiens
tgagaagctgctccaggcctg

SEQ ID NO: 739375 - DNA, 22 bp, Homo sapiens
tgagaagctgctccaggcctgc

SEQ ID NO: 739376 - DNA, 16 bp, Homo sapiens
tgagaaggaaataaaa

SEQ ID NO: 739377 - DNA, 18 bp, Homo sapiens
tgagaaggcaggcctccg

SEQ ID NO: 739378 - DNA, 20 bp, Homo sapiens
tgagaaggcagtagttttca

SEQ ID NO: 739379 - DNA, 17 bp, Homo sapiens
tgagaaggcgaggagag

SEQ ID NO: 739380 - DNA, 21 bp, Homo sapiens
tgagaagggaaggccgggtgc

SEQ ID NO: 739381 - DNA, 22 bp, Homo sapiens
tgagaaggttactgagtgagtt

SEQ ID NO: 739382 - DNA, 13 bp, Homo sapiens
tgagaagtacttg

SEQ ID NO: 739383 - DNA, 19 bp, Homo sapiens
tgagaagtgaatgctggga

SEQ ID NO: 739384 - DNA, 22 bp, Homo sapiens
tgagaagtgaatgctgggactc

SEQ ID NO: 739385 - DNA, 18 bp, Homo sapiens
tgagaatagctttaaaag

SEQ ID NO: 739386 - DNA, 13 bp, Homo sapiens
tgagaatatacct

SEQ ID NO: 739387 - DNA, 16 bp, Homo sapiens
tgagaatcacggtggt

SEQ ID NO: 739388 - DNA, 20 bp, Homo sapiens
tgagaatcagatcatttcaa

SEQ ID NO: 739389 - DNA, 19 bp, Homo sapiens
tgagaatcaggttgcaaaa

SEQ ID NO: 739390 - DNA, 15 bp, Homo sapiens
tgagaatcctctcct

SEQ ID NO: 739391 - DNA, 14 bp, Homo sapiens
tgagaatcctgcct

SEQ ID NO: 739392 - DNA, 16 bp, Homo sapiens
tgagaatcctgcctct

SEQ ID NO: 739393 - DNA, 12 bp, Homo sapiens
tgagaatctacc

SEQ ID NO: 739394 - DNA, 15 bp, Homo sapiens
tgagaatctgggggt

SEQ ID NO: 739395 - DNA, 16 bp, Homo sapiens
tgagaatctgggggtg

SEQ ID NO: 739396 - DNA, 22 bp, Homo sapiens
tgagaatctgggggtgaggagg

SEQ ID NO: 739397 - DNA, 21 bp, Homo sapiens
tgagaatctttattgagaaag

SEQ ID NO: 739398 - DNA, 10 bp, Homo sapiens
tgagaatgag

SEQ ID NO: 739399 - DNA, 17 bp, Homo sapiens
tgagaatgagtgggaat

SEQ ID NO: 739400 - DNA, 13 bp, Homo sapiens
tgagaatgtgacc

SEQ ID NO: 739401 - DNA, 20 bp, Homo sapiens
tgagaattttatattctaag

SEQ ID NO: 739402 - DNA, 16 bp, Homo sapiens
tgagacaatgttttct

SEQ ID NO: 739403 - DNA, 16 bp, Homo sapiens
tgagacaattttgctt

SEQ ID NO: 739404 - DNA, 23 bp, Homo sapiens
tgagacacacaacggcagtgaag

SEQ ID NO: 739405 - DNA, 19 bp, Homo sapiens
tgagacactgcacagaaga

SEQ ID NO: 739406 - DNA, 17 bp, Homo sapiens
tgagacagataagagaa

SEQ ID NO: 739407 - DNA, 23 bp, Homo sapiens
tgagacagcaccactgctgagga

SEQ ID NO: 739408 - DNA, 17 bp, Homo sapiens
tgagacaggaaaaacca

SEQ ID NO: 739409 - DNA, 17 bp, Homo sapiens
tgagacagtctggaaag

SEQ ID NO: 739410 - DNA, 14 bp, Homo sapiens
tgagacagtgaatt

SEQ ID NO: 739411 - DNA, 15 bp, Homo sapiens
tgagacagtgaattt

SEQ ID NO: 739412 - DNA, 17 bp, Homo sapiens
tgagacagtgggaaata

SEQ ID NO: 739413 - DNA, 22 bp, Homo sapiens
tgagacagtttactttgccaac

SEQ ID NO: 739414 - DNA, 16 bp, Homo sapiens
tgagacatcaggaagg

SEQ ID NO: 739415 - DNA, 13 bp, Homo sapiens
tgagaccagggtc

SEQ ID NO: 739416 - DNA, 20 bp, Homo sapiens
tgagaccagtggtctggaaa

SEQ ID NO: 739417 - DNA, 21 bp, Homo sapiens
tgagaccagttgggagcactg

SEQ ID NO: 739418 - DNA, 23 bp, Homo sapiens
tgagaccatgtttcaaacaagaa

SEQ ID NO: 739419 - DNA, 20 bp, Homo sapiens
tgagacccagccctcatccc

SEQ ID NO: 739420 - DNA, 16 bp, Homo sapiens
tgagaccctgggagag

SEQ ID NO: 739421 - DNA, 15 bp, Homo sapiens
tgagacccttttctc

SEQ ID NO: 739422 - DNA, 18 bp, Homo sapiens
tgagacctaatctctgta

SEQ ID NO: 739423 - DNA, 17 bp, Homo sapiens
tgagacctacaggctga

SEQ ID NO: 739424 - DNA, 12 bp, Homo sapiens
tgagacctcagc

SEQ ID NO: 739425 - DNA, 16 bp, Homo sapiens
tctcctcctcccctcc

SEQ ID NO: 739426 - DNA, 18 bp, Homo sapiens
tctcctcctcccctcctc

SEQ ID NO: 739427 - DNA, 17 bp, Homo sapiens
tctcctcgagccctccc

SEQ ID NO: 739428 - DNA, 14 bp, Homo sapiens
tctcctctccattt

SEQ ID NO: 739429 - DNA, 22 bp, Homo sapiens
tctcctctccattttagcccag

SEQ ID NO: 739430 - DNA, 13 bp, Homo sapiens
tctcctctctgct

SEQ ID NO: 739431 - DNA, 18 bp, Homo sapiens
tctcctctctgcttcata

SEQ ID NO: 739432 - DNA, 12 bp, Homo sapiens
tctcctctctgg

SEQ ID NO: 739433 - DNA, 23 bp, Homo sapiens
tctcctctgctatgcattttctt

SEQ ID NO: 739434 - DNA, 19 bp, Homo sapiens
tctcctctgctcattaaac

SEQ ID NO: 739435 - DNA, 22 bp, Homo sapiens
tctcctcttgccactgcctctt

SEQ ID NO: 739436 - DNA, 13 bp, Homo sapiens
tctcctcttgtaa

SEQ ID NO: 739437 - DNA, 14 bp, Homo sapiens
tctcctcttgtaaa

SEQ ID NO: 739438 - DNA, 16 bp, Homo sapiens
tctcctgacccctgcc

SEQ ID NO: 739439 - DNA, 17 bp, Homo sapiens
tctcctgacccctgcct

SEQ ID NO: 739440 - DNA, 15 bp, Homo sapiens
tctcctgattattta

SEQ ID NO: 739441 - DNA, 16 bp, Homo sapiens
tctcctgccatgggtg

SEQ ID NO: 739442 - DNA, 22 bp, Homo sapiens
tctcctgcccaagcacttcaca

SEQ ID NO: 739443 - DNA, 14 bp, Homo sapiens
tctcctgcccagat

SEQ ID NO: 739444 - DNA, 15 bp, Homo sapiens
tctcctgccctctgc

SEQ ID NO: 739445 - DNA, 19 bp, Homo sapiens
tctcctgccctctgctctg

SEQ ID NO: 739446 - DNA, 18 bp, Homo sapiens
tctcctgccctttcccag

SEQ ID NO: 739447 - DNA, 15 bp, Homo sapiens
tctcctgcctcagcc

SEQ ID NO: 739448 - DNA, 23 bp, Homo sapiens
tctcctgcctcagcctccccagt

SEQ ID NO: 739449 - DNA, 21 bp, Homo sapiens
tctcctgcctgccctgcctca

SEQ ID NO: 739450 - DNA, 20 bp, Homo sapiens
tctcctgcctgtgctgtgac

SEQ ID NO: 739451 - DNA, 16 bp, Homo sapiens
tctcctgccttcctcc

SEQ ID NO: 739452 - DNA, 17 bp, Homo sapiens
tctcctgctgatttcac

SEQ ID NO: 739453 - DNA, 16 bp, Homo sapiens
tctcctgcttgtacta

SEQ ID NO: 739454 - DNA, 17 bp, Homo sapiens
tctcctggaccttgaca

SEQ ID NO: 739455 - DNA, 11 bp, Homo sapiens
tctcctggagg

SEQ ID NO: 739456 - DNA, 19 bp, Homo sapiens
tctcctggcctatccgctg

SEQ ID NO: 739457 - DNA, 20 bp, Homo sapiens
tctcctggcctggccatctc

SEQ ID NO: 739458 - DNA, 20 bp, Homo sapiens
tctcctgggaaacctgcctt

SEQ ID NO: 739459 - DNA, 19 bp, Homo sapiens
tctcctgggggtggcaggc

SEQ ID NO: 739460 - DNA, 12 bp, Homo sapiens
tctcctggtgac

SEQ ID NO: 739461 - DNA, 11 bp, Homo sapiens
tctcctggtgt

SEQ ID NO: 739462 - DNA, 13 bp, Homo sapiens
tctcctgtacctc

SEQ ID NO: 739463 - DNA, 15 bp, Homo sapiens
tctcctgtacctctt

SEQ ID NO: 739464 - DNA, 16 bp, Homo sapiens
tctcctgtacctcttg

SEQ ID NO: 739465 - DNA, 16 bp, Homo sapiens
tctcctgtccaaccta

SEQ ID NO: 739466 - DNA, 12 bp, Homo sapiens
tctcctgtctgc

SEQ ID NO: 739467 - DNA, 17 bp, Homo sapiens
tctcctgtgcatgggtg

SEQ ID NO: 739468 - DNA, 12 bp, Homo sapiens
tctcctgtgccc

SEQ ID NO: 739469 - DNA, 16 bp, Homo sapiens
tctcctgtgcccacat

SEQ ID NO: 739470 - DNA, 16 bp, Homo sapiens
tctcctgtgtgcttgt

SEQ ID NO: 739471 - DNA, 15 bp, Homo sapiens
tctccttacctctgg

SEQ ID NO: 739472 - DNA, 18 bp, Homo sapiens
tctccttacctctggaac

SEQ ID NO: 739473 - DNA, 17 bp, Homo sapiens
tctccttactctgagcc

SEQ ID NO: 739474 - DNA, 17 bp, Homo sapiens
tctccttagacactttg

SEQ ID NO: 739475 - DNA, 17 bp, Homo sapiens
tctccttagtcttctca

SEQ ID NO: 739476 - DNA, 20 bp, Homo sapiens
tctccttatagacacttgct

SEQ ID NO: 739477 - DNA, 18 bp, Homo sapiens
tctccttcccacaaaaga

SEQ ID NO: 739478 - DNA, 15 bp, Homo sapiens
tctccttcccagata

SEQ ID NO: 739479 - DNA, 21 bp, Homo sapiens
tctccttcccatttctctaca

SEQ ID NO: 739480 - DNA, 14 bp, Homo sapiens
tctccttcccctac

SEQ ID NO: 739481 - DNA, 17 bp, Homo sapiens
tctccttcctcagcctc

SEQ ID NO: 739482 - DNA, 18 bp, Homo sapiens
tctccttcctcagcctcc

SEQ ID NO: 739483 - DNA, 19 bp, Homo sapiens
tctccttcctcagcctccc

SEQ ID NO: 739484 - DNA, 16 bp, Homo sapiens
tctccttcctgtgtgt

SEQ ID NO: 739485 - DNA, 19 bp, Homo sapiens
tctccttcgtatcccgagt

SEQ ID NO: 739486 - DNA, 19 bp, Homo sapiens
tctccttcgtgtctctccc

SEQ ID NO: 739487 - DNA, 13 bp, Homo sapiens
tctccttgaaatg

SEQ ID NO: 739488 - DNA, 20 bp, Homo sapiens
tctccttggccacagactga

SEQ ID NO: 739489 - DNA, 17 bp, Homo sapiens
tctccttgggctcctgg

SEQ ID NO: 739490 - DNA, 20 bp, Homo sapiens
tctccttgggctcctggctg

SEQ ID NO: 739491 - DNA, 15 bp, Homo sapiens
tctcctttaattgta

SEQ ID NO: 739492 - DNA, 22 bp, Homo sapiens
tctcctttaattgtaaagtaaa

SEQ ID NO: 739493 - DNA, 16 bp, Homo sapiens
tctcctttcacaacct

SEQ ID NO: 739494 - DNA, 15 bp, Homo sapiens
tctcctttctccctg

SEQ ID NO: 739495 - DNA, 21 bp, Homo sapiens
tctcctttctccctgcagcct

SEQ ID NO: 739496 - DNA, 16 bp, Homo sapiens
tctcctttgcactgag

SEQ ID NO: 739497 - DNA, 22 bp, Homo sapiens
tctcctttgctgaggcctccag

SEQ ID NO: 739498 - DNA, 22 bp, Homo sapiens
tctccttttacttcacttcaaa

SEQ ID NO: 739499 - DNA, 16 bp, Homo sapiens
tctccttttccttacc

SEQ ID NO: 739500 - DNA, 17 bp, Homo sapiens
tctccttttccttacca

SEQ ID NO: 739501 - DNA, 15 bp, Homo sapiens
tctccttttgaactt

SEQ ID NO: 739502 - DNA, 22 bp, Homo sapiens
tctccttttgcgcttatttgga

SEQ ID NO: 739503 - DNA, 14 bp, Homo sapiens
tctcgaactcctga

SEQ ID NO: 739504 - DNA, 18 bp, Homo sapiens
tctcgaactcctgacctc

SEQ ID NO: 739505 - DNA, 15 bp, Homo sapiens
tctcgaatgtaattg

SEQ ID NO: 739506 - DNA, 13 bp, Homo sapiens
tctcgaccttctg

SEQ ID NO: 739507 - DNA, 16 bp, Homo sapiens
tctcgactgcttttcg

SEQ ID NO: 739508 - DNA, 14 bp, Homo sapiens
tctcgcacacctct

SEQ ID NO: 739509 - DNA, 16 bp, Homo sapiens
tctcgcagcctgaagc

SEQ ID NO: 739510 - DNA, 22 bp, Homo sapiens
tctcgcagcctgaagcctggat

SEQ ID NO: 739511 - DNA, 16 bp, Homo sapiens
tctcgcataggacctt

SEQ ID NO: 739512 - DNA, 18 bp, Homo sapiens
tctcggatgacaccctgg

SEQ ID NO: 739513 - DNA, 19 bp, Homo sapiens
tctcggatgacaccctggc

SEQ ID NO: 739514 - DNA, 23 bp, Homo sapiens
tctcggatgaccaaaccagcctt

SEQ ID NO: 739515 - DNA, 13 bp, Homo sapiens
tctcggccccatc

SEQ ID NO: 739516 - DNA, 21 bp, Homo sapiens
tctcggccccctcaccccagc

SEQ ID NO: 739517 - DNA, 12 bp, Homo sapiens
tctcggccctga

SEQ ID NO: 739518 - DNA, 15 bp, Homo sapiens
tctcggctcagcctc

SEQ ID NO: 739519 - DNA, 16 bp, Homo sapiens
tctcggctcagcctcc

SEQ ID NO: 739520 - DNA, 21 bp, Homo sapiens
tctcggctccccatgtgtcct

SEQ ID NO: 739521 - DNA, 21 bp, Homo sapiens
tctcggctggaagaacatcaa

SEQ ID NO: 739522 - DNA, 22 bp, Homo sapiens
tctcggctggaagaacatcaag

SEQ ID NO: 739523 - DNA, 15 bp, Homo sapiens
tctcgggactagctg

SEQ ID NO: 739524 - DNA, 22 bp, Homo sapiens
tctcggggcccttggggcctgg

SEQ ID NO: 739525 - DNA, 13 bp, Homo sapiens
tctcggggcttgc

SEQ ID NO: 739526 - DNA, 17 bp, Homo sapiens
tctcggttccacgtccc

SEQ ID NO: 739527 - DNA, 23 bp, Homo sapiens
tctcgtatccaacccaaggacct

SEQ ID NO: 739528 - DNA, 17 bp, Homo sapiens
tctcgtcttccgtctcc

SEQ ID NO: 739529 - DNA, 18 bp, Homo sapiens
tctcgtcttccgtctccc

SEQ ID NO: 739530 - DNA, 15 bp, Homo sapiens
tctcgtgagtcattt

SEQ ID NO: 739531 - DNA, 19 bp, Homo sapiens
tctcgtggtagaagccagt

SEQ ID NO: 739532 - DNA, 23 bp, Homo sapiens
tctcgttttgttgccaaagctgg

SEQ ID NO: 739533 - DNA, 19 bp, Homo sapiens
tctctaaagagtttatttt

SEQ ID NO: 739534 - DNA, 22 bp, Homo sapiens
tctctaaagagtttattttaag

SEQ ID NO: 739535 - DNA, 13 bp, Homo sapiens
tctctaacatatg

SEQ ID NO: 739536 - DNA, 21 bp, Homo sapiens
tctctaactcagaaacatcag

SEQ ID NO: 739537 - DNA, 19 bp, Homo sapiens
tctctaaggagcagcggga

SEQ ID NO: 739538 - DNA, 21 bp, Homo sapiens
tctctaagttccactgagctc

SEQ ID NO: 739539 - DNA, 13 bp, Homo sapiens
tctctaatgagct

SEQ ID NO: 739540 - DNA, 20 bp, Homo sapiens
tctctacagacttctccaga

SEQ ID NO: 739541 - DNA, 18 bp, Homo sapiens
tctctacccatcttaaaa

SEQ ID NO: 739542 - DNA, 16 bp, Homo sapiens
tctctaccccaaagaa

SEQ ID NO: 739543 - DNA, 20 bp, Homo sapiens
gctctgtctcccaggctgga

SEQ ID NO: 739544 - DNA, 14 bp, Homo sapiens
gctctgtgacaagg

SEQ ID NO: 739545 - DNA, 21 bp, Homo sapiens
gctctgtgcagtcactggagg

SEQ ID NO: 739546 - DNA, 19 bp, Homo sapiens
gctctgtggaattcagtga

SEQ ID NO: 739547 - DNA, 23 bp, Homo sapiens
tctgagggaggaggccacctctc

SEQ ID NO: 739548 - DNA, 21 bp, Homo sapiens
tctgaggggaggcacctccag

SEQ ID NO: 739549 - DNA, 22 bp, Homo sapiens
tctgaggggaggcacctccagg

SEQ ID NO: 739550 - DNA, 20 bp, Homo sapiens
tctgaggggctaccaggaaa

SEQ ID NO: 739551 - DNA, 17 bp, Homo sapiens
tctgaggtcaataaagc

SEQ ID NO: 739552 - DNA, 19 bp, Homo sapiens
tctgaggtcaataaagcag

SEQ ID NO: 739553 - DNA, 23 bp, Homo sapiens
tctgaggtcccttcaaggcctcc

SEQ ID NO: 739554 - DNA, 15 bp, Homo sapiens
tctgaggttttattt

SEQ ID NO: 739555 - DNA, 16 bp, Homo sapiens
tctgagtattctcata

SEQ ID NO: 739556 - DNA, 20 bp, Homo sapiens
tctgagtcacaggtgtggga

SEQ ID NO: 739557 - DNA, 15 bp, Homo sapiens
tctgagtccactgct

SEQ ID NO: 739558 - DNA, 16 bp, Homo sapiens
tctgagtccagctccc

SEQ ID NO: 739559 - DNA, 17 bp, Homo sapiens
tctgagtccagctcccc

SEQ ID NO: 739560 - DNA, 14 bp, Homo sapiens
tctgagtcccagga

SEQ ID NO: 739561 - DNA, 16 bp, Homo sapiens
tctgagtcctgagact

SEQ ID NO: 739562 - DNA, 18 bp, Homo sapiens
tctgagtcctgtctctgc

SEQ ID NO: 739563 - DNA, 21 bp, Homo sapiens
tctgagtcctgtctctgcctg

SEQ ID NO: 739564 - DNA, 15 bp, Homo sapiens
tctgagtctatgttc

SEQ ID NO: 739565 - DNA, 16 bp, Homo sapiens
gctgcgcttccctgca

SEQ ID NO: 739566 - DNA, 20 bp, Homo sapiens
gctgcggacaccgtggcctg

SEQ ID NO: 739567 - DNA, 16 bp, Homo sapiens
gctgcgggtctgaagg

SEQ ID NO: 739568 - DNA, 16 bp, Homo sapiens
gctgcgtactccactg

SEQ ID NO: 739569 - DNA, 15 bp, Homo sapiens
gctgcgtccccactc

SEQ ID NO: 739570 - DNA, 17 bp, Homo sapiens
gctgcgtccccactccc

SEQ ID NO: 739571 - DNA, 14 bp, Homo sapiens
gctgcgtgccatca

SEQ ID NO: 739572 - DNA, 17 bp, Homo sapiens
gctgctaacctggaaag

SEQ ID NO: 739573 - DNA, 15 bp, Homo sapiens
gctgctaccagcgcc

SEQ ID NO: 739574 - DNA, 14 bp, Homo sapiens
gctgctacccagaa

SEQ ID NO: 739575 - DNA, 15 bp, Homo sapiens
gctgctaccgccctg

SEQ ID NO: 739576 - DNA, 18 bp, Homo sapiens
gctgctaccgccctgggc

SEQ ID NO: 739577 - DNA, 22 bp, Homo sapiens
gctgctaccgccctgggctgga

SEQ ID NO: 739578 - DNA, 23 bp, Homo sapiens
gctgctaccgccctgggctggac

SEQ ID NO: 739579 - DNA, 23 bp, Homo sapiens
gctgctactacccgagcccagct

SEQ ID NO: 739580 - DNA, 19 bp, Homo sapiens
gctgctagcacttggagcc

SEQ ID NO: 739581 - DNA, 15 bp, Homo sapiens
gctgctaggccagag

SEQ ID NO: 739582 - DNA, 15 bp, Homo sapiens
gctgctatagcctgg

SEQ ID NO: 739583 - DNA, 23 bp, Homo sapiens
gctgctatccccatctccctgcc

SEQ ID NO: 739584 - DNA, 14 bp, Homo sapiens
gctgctattgctgt

SEQ ID NO: 739585 - DNA, 23 bp, Homo sapiens
gctgctatttcatctggtttctt

SEQ ID NO: 739586 - DNA, 22 bp, Homo sapiens
gctgctcaaggaccaagagcaa

SEQ ID NO: 739587 - DNA, 18 bp, Homo sapiens
gctgctcattacagttct

SEQ ID NO: 739588 - DNA, 23 bp, Homo sapiens
gctgctcattacagttctttcct

SEQ ID NO: 739589 - DNA, 24 bp, Homo sapiens
gctgctcattacagttctttcctc

SEQ ID NO: 739590 - DNA, 16 bp, Homo sapiens
gctgctccaggcctgc

SEQ ID NO: 739591 - DNA, 20 bp, Homo sapiens
gctgctcccacacttgtgcc

SEQ ID NO: 739592 - DNA, 21 bp, Homo sapiens
gctgctcccacacttgtgcca

SEQ ID NO: 739593 - DNA, 22 bp, Homo sapiens
gctgctcccacacttgtgccag

SEQ ID NO: 739594 - DNA, 19 bp, Homo sapiens
gctgctccccaacacctgc

SEQ ID NO: 739595 - DNA, 15 bp, Homo sapiens
gctgctcctagaggg

SEQ ID NO: 739596 - DNA, 13 bp, Homo sapiens
gctgctcctccag

SEQ ID NO: 739597 - DNA, 15 bp, Homo sapiens
gctgctcctccagcc

SEQ ID NO: 739598 - DNA, 17 bp, Homo sapiens
gctgctcctccagccct

SEQ ID NO: 739599 - DNA, 18 bp, Homo sapiens
gctgctcctccagggcca

SEQ ID NO: 739600 - DNA, 23 bp, Homo sapiens
gctgctcctccagggccacgtgc

SEQ ID NO: 739601 - DNA, 18 bp, Homo sapiens
gctgctcctctttcccct

SEQ ID NO: 739602 - DNA, 21 bp, Homo sapiens
gctgctcctgtttgtctgatg

SEQ ID NO: 739603 - DNA, 14 bp, Homo sapiens
gctgctccttggct

SEQ ID NO: 739604 - DNA, 20 bp, Homo sapiens
gctgctcctttaccctcttg

SEQ ID NO: 739605 - DNA, 13 bp, Homo sapiens
gctgctctagctg

SEQ ID NO: 739606 - DNA, 19 bp, Homo sapiens
gctgctctgcaggctgggg

SEQ ID NO: 739607 - DNA, 20 bp, Homo sapiens
gctgctctgcaggctgggga

SEQ ID NO: 739608 - DNA, 12 bp, Homo sapiens
gctgctctgccc

SEQ ID NO: 739609 - DNA, 14 bp, Homo sapiens
gctgctctgcccct

SEQ ID NO: 739610 - DNA, 22 bp, Homo sapiens
gctgctctgccccttgggcatc

SEQ ID NO: 739611 - DNA, 12 bp, Homo sapiens
gctgctctggaa

SEQ ID NO: 739612 - DNA, 14 bp, Homo sapiens
gctgctctggaaaa

SEQ ID NO: 739613 - DNA, 18 bp, Homo sapiens
gctgctgaagttctgagc

SEQ ID NO: 739614 - DNA, 23 bp, Homo sapiens
gctgctgacacgcagcctgctct

SEQ ID NO: 739615 - DNA, 21 bp, Homo sapiens
gctgctgaccaattgtgctgc

SEQ ID NO: 739616 - DNA, 23 bp, Homo sapiens
gctgctgaccaattgtgctgcca

SEQ ID NO: 739617 - DNA, 18 bp, Homo sapiens
gctgctgcctggccactg

SEQ ID NO: 739618 - DNA, 13 bp, Homo sapiens
gctgctgctgctg

SEQ ID NO: 739619 - DNA, 12 bp, Homo sapiens
gctgctgcttct

SEQ ID NO: 739620 - DNA, 23 bp, Homo sapiens
gctgctgcttctgctccagcccc

SEQ ID NO: 739621 - DNA, 14 bp, Homo sapiens
gctgctggagaata

SEQ ID NO: 739622 - DNA, 18 bp, Homo sapiens
gctgctggatcacagctg

SEQ ID NO: 739623 - DNA, 11 bp, Homo sapiens
gctgctggcca

SEQ ID NO: 739624 - DNA, 11 bp, Homo sapiens
gctgctggctt

SEQ ID NO: 739625 - DNA, 15 bp, Homo sapiens
gctgctggcttcagg

SEQ ID NO: 739626 - DNA, 22 bp, Homo sapiens
gctgctgggctgagtgacacaa

SEQ ID NO: 739627 - DNA, 16 bp, Homo sapiens
gctgctgtaactgctg

SEQ ID NO: 739628 - DNA, 18 bp, Homo sapiens
gctgctgtaactgctgag

SEQ ID NO: 739629 - DNA, 14 bp, Homo sapiens
gctgctgtcttgtt

SEQ ID NO: 739630 - DNA, 15 bp, Homo sapiens
gctgctgtgccccac

SEQ ID NO: 739631 - DNA, 21 bp, Homo sapiens
gctgctgtgccccaccacgtc

SEQ ID NO: 739632 - DNA, 13 bp, Homo sapiens
gctgctgtgcctg

SEQ ID NO: 739633 - DNA, 24 bp, Homo sapiens
gctgctgtgtgtgagcagtggaca

SEQ ID NO: 739634 - DNA, 13 bp, Homo sapiens
gctgctgttctca

SEQ ID NO: 739635 - DNA, 16 bp, Homo sapiens
gctgctgttctcagga

SEQ ID NO: 739636 - DNA, 21 bp, Homo sapiens
gctgcttaatcctaccccctc

SEQ ID NO: 739637 - DNA, 23 bp, Homo sapiens
gctgcttaatcctaccccctctt

SEQ ID NO: 739638 - DNA, 15 bp, Homo sapiens
gctgcttccaggctg

SEQ ID NO: 739639 - DNA, 20 bp, Homo sapiens
gctgcttcccagaggagcag

SEQ ID NO: 739640 - DNA, 12 bp, Homo sapiens
gctgcttccctc

SEQ ID NO: 739641 - DNA, 14 bp, Homo sapiens
gctgcttccctctg

SEQ ID NO: 739642 - DNA, 15 bp, Homo sapiens
gctgcttccctctgc

SEQ ID NO: 739643 - DNA, 21 bp, Homo sapiens
gctgcttccctctgcctgtcc

SEQ ID NO: 739644 - DNA, 23 bp, Homo sapiens
gctgcttccctctgcctgtccct

SEQ ID NO: 739645 - DNA, 15 bp, Homo sapiens
gctgcttcctcctgg

SEQ ID NO: 739646 - DNA, 17 bp, Homo sapiens
gctgcttcctcctggaa

SEQ ID NO: 739647 - DNA, 14 bp, Homo sapiens
gctgcttctccccc

SEQ ID NO: 739648 - DNA, 13 bp, Homo sapiens
gctgcttctgctc

SEQ ID NO: 739649 - DNA, 15 bp, Homo sapiens
gctgcttctgctcca

SEQ ID NO: 739650 - DNA, 19 bp, Homo sapiens
gctgcttctgctccagccc

SEQ ID NO: 739651 - DNA, 21 bp, Homo sapiens
gctgcttctgctccagcccct

SEQ ID NO: 739652 - DNA, 23 bp, Homo sapiens
gctgcttggatgcgagcttggcc

SEQ ID NO: 739653 - DNA, 17 bp, Homo sapiens
gctgcttgtcctgctct

SEQ ID NO: 739654 - DNA, 14 bp, Homo sapiens
gctgcttgtcctgg

SEQ ID NO: 739655 - DNA, 21 bp, Homo sapiens
gctgcttgtgcctcccttccc

SEQ ID NO: 739656 - DNA, 22 bp, Homo sapiens
gctgcttgtgcctcccttccca

SEQ ID NO: 739657 - DNA, 23 bp, Homo sapiens
gctgcttgtgcctcccttcccag

SEQ ID NO: 739658 - DNA, 20 bp, Homo sapiens
gctgctttgccaagttgctg

SEQ ID NO: 739659 - DNA, 14 bp, Homo sapiens
gctgctttgtccag

SEQ ID NO: 739660 - DNA, 12 bp, Homo sapiens
gctgcttttctt

SEQ ID NO: 739661 - DNA, 19 bp, Homo sapiens
gctgcttttcttttctaac

SEQ ID NO: 739662 - DNA, 23 bp, Homo sapiens
gctggaaaagggtcttgggaaat

SEQ ID NO: 739663 - DNA, 17 bp, Homo sapiens
gctggaaacacagtcac

SEQ ID NO: 739664 - DNA, 18 bp, Homo sapiens
gctggaaagcagagcctc

SEQ ID NO: 739665 - DNA, 20 bp, Homo sapiens
gctggaaagcagagcctcct

SEQ ID NO: 739666 - DNA, 13 bp, Homo sapiens
gctggaacccagg

SEQ ID NO: 739667 - DNA, 14 bp, Homo sapiens
gctggaacccagga

SEQ ID NO: 739668 - DNA, 20 bp, Homo sapiens
gctggctccccctccccagg

SEQ ID NO: 739669 - DNA, 21 bp, Homo sapiens
gctggctccccctccccaggc

SEQ ID NO: 739670 - DNA, 14 bp, Homo sapiens
gctggctccctggg

SEQ ID NO: 739671 - DNA, 17 bp, Homo sapiens
gctggctccctgggcag

SEQ ID NO: 739672 - DNA, 18 bp, Homo sapiens
gctggctccctgggcagt

SEQ ID NO: 739673 - DNA, 13 bp, Homo sapiens
gctggctctgaga

SEQ ID NO: 739674 - DNA, 15 bp, Homo sapiens
gctggctgacctggg

SEQ ID NO: 739675 - DNA, 16 bp, Homo sapiens
gctggctgacctgggc

SEQ ID NO: 739676 - DNA, 22 bp, Homo sapiens
gctggctgacctgggcccacag

SEQ ID NO: 739677 - DNA, 17 bp, Homo sapiens
gctggctgagctgaaca

SEQ ID NO: 739678 - DNA, 13 bp, Homo sapiens
gctggctgcagtg

SEQ ID NO: 739679 - DNA, 14 bp, Homo sapiens
gctggctgcagtga

SEQ ID NO: 739680 - DNA, 13 bp, Homo sapiens
gctggctgcggcc

SEQ ID NO: 739681 - DNA, 12 bp, Homo sapiens
gctggctgcttg

SEQ ID NO: 739682 - DNA, 19 bp, Homo sapiens
gctggctgcttgcagccag

SEQ ID NO: 739683 - DNA, 17 bp, Homo sapiens
gctggctgtgcctgctt

SEQ ID NO: 739684 - DNA, 15 bp, Homo sapiens
gctggcttcagggag

SEQ ID NO: 739685 - DNA, 17 bp, Homo sapiens
gctggcttcagggaggg

SEQ ID NO: 739686 - DNA, 20 bp, Homo sapiens
gctggctttgaaacctcagg

SEQ ID NO: 739687 - DNA, 21 bp, Homo sapiens
gctgggaacatgacccagcct

SEQ ID NO: 739688 - DNA, 18 bp, Homo sapiens
gctgggaaccccgcagcc

SEQ ID NO: 739689 - DNA, 22 bp, Homo sapiens
gctgggaaccccgcagcccgtg

SEQ ID NO: 739690 - DNA, 20 bp, Homo sapiens
gctgggaacgtgtgtccagg

SEQ ID NO: 739691 - DNA, 20 bp, Homo sapiens
gctgggaagagaagagggcc

SEQ ID NO: 739692 - DNA, 21 bp, Homo sapiens
gctgggaagagctcccctcca

SEQ ID NO: 739693 - DNA, 21 bp, Homo sapiens
gctgggaatggaggggcagag

SEQ ID NO: 739694 - DNA, 21 bp, Homo sapiens
tctgcagtagtctctgtgctt

SEQ ID NO: 739695 - DNA, 20 bp, Homo sapiens
tctgcagtcctccggggtgg

SEQ ID NO: 739696 - DNA, 14 bp, Homo sapiens
tctgcagtgccttg

SEQ ID NO: 739697 - DNA, 15 bp, Homo sapiens
tctgcagtgccttgg

SEQ ID NO: 739698 - DNA, 17 bp, Homo sapiens
tctgcagttttgacatt

SEQ ID NO: 739699 - DNA, 17 bp, Homo sapiens
tctgcagtttttcccaa

SEQ ID NO: 739700 - DNA, 16 bp, Homo sapiens
tctgcatcatctgtag

SEQ ID NO: 739701 - DNA, 21 bp, Homo sapiens
tctgcatccagagattcattt

SEQ ID NO: 739702 - DNA, 15 bp, Homo sapiens
tctgcatcttaacat

SEQ ID NO: 739703 - DNA, 16 bp, Homo sapiens
tctgcatcttaacatg

SEQ ID NO: 739704 - DNA, 17 bp, Homo sapiens
tctgcatcttggggaca

SEQ ID NO: 739705 - DNA, 20 bp, Homo sapiens
tctgcattatctatgcagca

SEQ ID NO: 739706 - DNA, 17 bp, Homo sapiens
tctgcattcaggatcaa

SEQ ID NO: 739707 - DNA, 16 bp, Homo sapiens
tctgcattctagtact

SEQ ID NO: 739708 - DNA, 20 bp, Homo sapiens
tctgcattgttattgtggaa

SEQ ID NO: 739709 - DNA, 21 bp, Homo sapiens
tctgcattgttattgtggaag

SEQ ID NO: 739710 - DNA, 18 bp, Homo sapiens
tctgcatttcggtggcta

SEQ ID NO: 739711 - DNA, 19 bp, Homo sapiens
tctgcatttcggtggctag

SEQ ID NO: 739712 - DNA, 21 bp, Homo sapiens
tctgcattttcaccccaccct

SEQ ID NO: 739713 - DNA, 23 bp, Homo sapiens
tctgccaaattgagataatgata

SEQ ID NO: 739714 - DNA, 14 bp, Homo sapiens
tctgccaacctaaa

SEQ ID NO: 739715 - DNA, 18 bp, Homo sapiens
tctgccaacctaaaactc

SEQ ID NO: 739716 - DNA, 19 bp, Homo sapiens
tctgccaatcggctacccc

SEQ ID NO: 739717 - DNA, 20 bp, Homo sapiens
tctgccaatgtgggctgccc

SEQ ID NO: 739718 - DNA, 14 bp, Homo sapiens
tctgccacccactc

SEQ ID NO: 739719 - DNA, 13 bp, Homo sapiens
tctgccaccccta

SEQ ID NO: 739720 - DNA, 21 bp, Homo sapiens
tctgccaccctacctgttcag

SEQ ID NO: 739721 - DNA, 18 bp, Homo sapiens
tctgccacctctgacgca

SEQ ID NO: 739722 - DNA, 15 bp, Homo sapiens
tctgccacttctgcg

SEQ ID NO: 739723 - DNA, 21 bp, Homo sapiens
tctgccacttctgcgggctcc

SEQ ID NO: 739724 - DNA, 12 bp, Homo sapiens
tctgccagacct

SEQ ID NO: 739725 - DNA, 13 bp, Homo sapiens
tctgccagccaca

SEQ ID NO: 739726 - DNA, 15 bp, Homo sapiens
tctgccaggcactct

SEQ ID NO: 739727 - DNA, 23 bp, Homo sapiens
tctgccaggcactctcatcaccc

SEQ ID NO: 739728 - DNA, 14 bp, Homo sapiens
tctgccaggcccat

SEQ ID NO: 739729 - DNA, 12 bp, Homo sapiens
tctgccagggag

SEQ ID NO: 739730 - DNA, 14 bp, Homo sapiens
tctgccagggagct

SEQ ID NO: 739731 - DNA, 18 bp, Homo sapiens
tctgccaggtgcttggct

SEQ ID NO: 739732 - DNA, 19 bp, Homo sapiens
tctgccagtcgggagagcc

SEQ ID NO: 739733 - DNA, 21 bp, Homo sapiens
tctgccatctaatggcttcag

SEQ ID NO: 739734 - DNA, 21 bp, Homo sapiens
tctgccatgatgtttacaaga

SEQ ID NO: 739735 - DNA, 13 bp, Homo sapiens
tctgcccacctct

SEQ ID NO: 739736 - DNA, 14 bp, Homo sapiens
tctgcccacctggg

SEQ ID NO: 739737 - DNA, 21 bp, Homo sapiens
tctgcccacgatcccctcccc

SEQ ID NO: 739738 - DNA, 12 bp, Homo sapiens
tctgcccagctt

SEQ ID NO: 739739 - DNA, 14 bp, Homo sapiens
tctgcccaggggtg

SEQ ID NO: 739740 - DNA, 20 bp, Homo sapiens
tctgcccaggggtgccccct

SEQ ID NO: 739741 - DNA, 12 bp, Homo sapiens
tctgccccaagc

SEQ ID NO: 739742 - DNA, 18 bp, Homo sapiens
tctgccccaagcagccag

SEQ ID NO: 739743 - DNA, 22 bp, Homo sapiens
tctgccccaagcccccaacccc

SEQ ID NO: 739744 - DNA, 23 bp, Homo sapiens
tctgccccaatcgggtccagaga

SEQ ID NO: 739745 - DNA, 20 bp, Homo sapiens
tctgccccagctctggcttc

SEQ ID NO: 739746 - DNA, 14 bp, Homo sapiens
tctgcccccagccc

SEQ ID NO: 739747 - DNA, 18 bp, Homo sapiens
tctgcccccagcccaaag

SEQ ID NO: 739748 - DNA, 19 bp, Homo sapiens
tctgcccccagcccaaagg

SEQ ID NO: 739749 - DNA, 17 bp, Homo sapiens
tctgccccccagggcta

SEQ ID NO: 739750 - DNA, 13 bp, Homo sapiens
tctgccccctccc

SEQ ID NO: 739751 - DNA, 23 bp, Homo sapiens
tctgccccctcccccatgggctg

SEQ ID NO: 739752 - DNA, 20 bp, Homo sapiens
tctgcccctaaagatgggag

SEQ ID NO: 739753 - DNA, 21 bp, Homo sapiens
tctgcccctaaagatgggagg

SEQ ID NO: 739754 - DNA, 23 bp, Homo sapiens
tctgcccctaaagatgggaggag

SEQ ID NO: 739755 - DNA, 17 bp, Homo sapiens
tctgcccctcagggggc

SEQ ID NO: 739756 - DNA, 13 bp, Homo sapiens
tctgcccctcccc

SEQ ID NO: 739757 - DNA, 15 bp, Homo sapiens
tctgcccctccccca

SEQ ID NO: 739758 - DNA, 18 bp, Homo sapiens
tctgcccctcccccaacc

SEQ ID NO: 739759 - DNA, 22 bp, Homo sapiens
tctgccccttgggcatccaccc

SEQ ID NO: 739760 - DNA, 14 bp, Homo sapiens
tctgcccgcagagc

SEQ ID NO: 739761 - DNA, 18 bp, Homo sapiens
tctgccctcattactggg

SEQ ID NO: 739762 - DNA, 15 bp, Homo sapiens
tctgccctctgggtc

SEQ ID NO: 739763 - DNA, 14 bp, Homo sapiens
tctgccctgcccat

SEQ ID NO: 739764 - DNA, 13 bp, Homo sapiens
tctgccctgcctc

SEQ ID NO: 739765 - DNA, 18 bp, Homo sapiens
tctgccctgcctgaggag

SEQ ID NO: 739766 - DNA, 21 bp, Homo sapiens
tctgccctggctgctgccccc

SEQ ID NO: 739767 - DNA, 13 bp, Homo sapiens
tctgcccttcccc

SEQ ID NO: 739768 - DNA, 15 bp, Homo sapiens
tctgcccttctctgc

SEQ ID NO: 739769 - DNA, 19 bp, Homo sapiens
tctgcccttctctgcctcc

SEQ ID NO: 739770 - DNA, 18 bp, Homo sapiens
tctgccctttcctaggcc

SEQ ID NO: 739771 - DNA, 22 bp, Homo sapiens
tctgccctttcctaggcccagg

SEQ ID NO: 739772 - DNA, 18 bp, Homo sapiens
tctgccgcaatacaggaa

SEQ ID NO: 739773 - DNA, 14 bp, Homo sapiens
tctgccgcccacct

SEQ ID NO: 739774 - DNA, 15 bp, Homo sapiens
tctgccgcccacctc

SEQ ID NO: 739775 - DNA, 19 bp, Homo sapiens
tctgccgctgtcaaggccg

SEQ ID NO: 739776 - DNA, 22 bp, Homo sapiens
tctgccgctgtcaaggccgagg

SEQ ID NO: 739777 - DNA, 13 bp, Homo sapiens
tctgccgctgtgt

SEQ ID NO: 739778 - DNA, 20 bp, Homo sapiens
tctgccgctgtgtagggacc

SEQ ID NO: 739779 - DNA, 16 bp, Homo sapiens
tctgcctaacttgtaa

SEQ ID NO: 739780 - DNA, 21 bp, Homo sapiens
tctgcctacagaacttcagaa

SEQ ID NO: 739781 - DNA, 21 bp, Homo sapiens
tctgcctagagtgtagcctaa

SEQ ID NO: 739782 - DNA, 21 bp, Homo sapiens
tctgcctagatccacgtgtgg

SEQ ID NO: 739783 - DNA, 20 bp, Homo sapiens
tctgcctcagacgttgcctg

SEQ ID NO: 739784 - DNA, 18 bp, Homo sapiens
tctgcctctccaggcatt

SEQ ID NO: 739785 - DNA, 15 bp, Homo sapiens
tctgcctctcccagg

SEQ ID NO: 739786 - DNA, 17 bp, Homo sapiens
tctgcctctccctgggt

SEQ ID NO: 739787 - DNA, 12 bp, Homo sapiens
tctgcctctctg

SEQ ID NO: 739788 - DNA, 13 bp, Homo sapiens
tctgcctctctgg

SEQ ID NO: 739789 - DNA, 16 bp, Homo sapiens
tctgcctctcttcttc

SEQ ID NO: 739790 - DNA, 14 bp, Homo sapiens
tctgcttacttttt

SEQ ID NO: 739791 - DNA, 12 bp, Homo sapiens
tctgcttagaaa

SEQ ID NO: 739792 - DNA, 16 bp, Homo sapiens
tctgcttaggagagac

SEQ ID NO: 739793 - DNA, 12 bp, Homo sapiens
tctgcttcaata

SEQ ID NO: 739794 - DNA, 22 bp, Homo sapiens
tctgcttccatggcttcctgag

SEQ ID NO: 739795 - DNA, 13 bp, Homo sapiens
tctgcttctcatc

SEQ ID NO: 739796 - DNA, 16 bp, Homo sapiens
tctgcttctcatccca

SEQ ID NO: 739797 - DNA, 21 bp, Homo sapiens
tctgcttctcggggtccagtg

SEQ ID NO: 739798 - DNA, 22 bp, Homo sapiens
tctgctttcacttaagtgtctg

SEQ ID NO: 739799 - DNA, 18 bp, Homo sapiens
tctgctttccttttctct

SEQ ID NO: 739800 - DNA, 20 bp, Homo sapiens
tctgctttccttttctctgc

SEQ ID NO: 739801 - DNA, 17 bp, Homo sapiens
tctgctttctcctttaa

SEQ ID NO: 739802 - DNA, 18 bp, Homo sapiens
tctgcttttaccatgccc

SEQ ID NO: 739803 - DNA, 17 bp, Homo sapiens
tctgcttttctgccctg

SEQ ID NO: 739804 - DNA, 20 bp, Homo sapiens
tctgcttttctgccctggct

SEQ ID NO: 739805 - DNA, 19 bp, Homo sapiens
tctggaaaaaaaatatata

SEQ ID NO: 739806 - DNA, 12 bp, Homo sapiens
tctggaaacagc

SEQ ID NO: 739807 - DNA, 9 bp, Homo sapiens
tctggaaat

SEQ ID NO: 739808 - DNA, 20 bp, Homo sapiens
tctggaaccccccaggccct

SEQ ID NO: 739809 - DNA, 13 bp, Homo sapiens
tctggaagaaaaa

SEQ ID NO: 739810 - DNA, 13 bp, Homo sapiens
tctggaaggaatg

SEQ ID NO: 739811 - DNA, 20 bp, Homo sapiens
tctggaaggcccctcccagc

SEQ ID NO: 739812 - DNA, 15 bp, Homo sapiens
tctggaaggggcagc

SEQ ID NO: 739813 - DNA, 22 bp, Homo sapiens
tctggaaggggcagccctgagt

SEQ ID NO: 739814 - DNA, 13 bp, Homo sapiens
tctggaagtccaa

SEQ ID NO: 739815 - DNA, 20 bp, Homo sapiens
tctggaagttttctagcaac

SEQ ID NO: 739816 - DNA, 13 bp, Homo sapiens
tctggaatcttcc

SEQ ID NO: 739817 - DNA, 18 bp, Homo sapiens
tctggaatgtaatcaatg

SEQ ID NO: 739818 - DNA, 22 bp, Homo sapiens
tctggaatgtaatcaatgtttc

SEQ ID NO: 739819 - DNA, 18 bp, Homo sapiens
tctggaatgtttttccct

SEQ ID NO: 739820 - DNA, 14 bp, Homo sapiens
tctggacagcagaa

SEQ ID NO: 739821 - DNA, 23 bp, Homo sapiens
tctggaccaaccctgtttcctga

SEQ ID NO: 739822 - DNA, 17 bp, Homo sapiens
tctggaccccatctgtg

SEQ ID NO: 739823 - DNA, 14 bp, Homo sapiens
gctgggtcaggcag

SEQ ID NO: 739824 - DNA, 12 bp, Homo sapiens
gctgggtcaggg

SEQ ID NO: 739825 - DNA, 16 bp, Homo sapiens
gctgggtcagggccag

SEQ ID NO: 739826 - DNA, 17 bp, Homo sapiens
gctgggtcggccctgcc

SEQ ID NO: 739827 - DNA, 19 bp, Homo sapiens
gctgggtcggccctgccca

SEQ ID NO: 739828 - DNA, 18 bp, Homo sapiens
gctgggtgagctcttcca

SEQ ID NO: 739829 - DNA, 19 bp, Homo sapiens
gctgggtgagctcttccag

SEQ ID NO: 739830 - DNA, 16 bp, Homo sapiens
gctgggtgccctctca

SEQ ID NO: 739831 - DNA, 23 bp, Homo sapiens
gctgggtggcaccagcagcctgg

SEQ ID NO: 739832 - DNA, 15 bp, Homo sapiens
gctgggtggggacag

SEQ ID NO: 739833 - DNA, 17 bp, Homo sapiens
gctgggtggtaccctct

SEQ ID NO: 739834 - DNA, 13 bp, Homo sapiens
gctgggtggtttt

SEQ ID NO: 739835 - DNA, 16 bp, Homo sapiens
gctgggttggtgcaca

SEQ ID NO: 739836 - DNA, 17 bp, Homo sapiens
gctgggttggtgcacag

SEQ ID NO: 739837 - DNA, 17 bp, Homo sapiens
gctggtaaaaatgacaa

SEQ ID NO: 739838 - DNA, 14 bp, Homo sapiens
gctggtaaactatt

SEQ ID NO: 739839 - DNA, 15 bp, Homo sapiens
gctggtaaactattt

SEQ ID NO: 739840 - DNA, 15 bp, Homo sapiens
gctggtagctgaggg

SEQ ID NO: 739841 - DNA, 16 bp, Homo sapiens
gctggtatctcagaaa

SEQ ID NO: 739842 - DNA, 18 bp, Homo sapiens
gctggtatctcagaaagt

SEQ ID NO: 739843 - DNA, 24 bp, Homo sapiens
gctggtatctcagaaagtgcctga

SEQ ID NO: 739844 - DNA, 17 bp, Homo sapiens
gctggtattctctctat

SEQ ID NO: 739845 - DNA, 19 bp, Homo sapiens
gctggtattctctctatgc

SEQ ID NO: 739846 - DNA, 20 bp, Homo sapiens
gctggtattctctctatgca

SEQ ID NO: 739847 - DNA, 13 bp, Homo sapiens
gctggtatttcta

SEQ ID NO: 739848 - DNA, 15 bp, Homo sapiens
gctggtatttctaat

SEQ ID NO: 739849 - DNA, 13 bp, Homo sapiens
gctggtcactctg

SEQ ID NO: 739850 - DNA, 16 bp, Homo sapiens
gctggtcactctgccc

SEQ ID NO: 739851 - DNA, 12 bp, Homo sapiens
gctggtcagagt

SEQ ID NO: 739852 - DNA, 14 bp, Homo sapiens
gctggtcagagtgg

SEQ ID NO: 739853 - DNA, 13 bp, Homo sapiens
gctggtcaggtcc

SEQ ID NO: 739854 - DNA, 17 bp, Homo sapiens
gctggtcagtctttgct

SEQ ID NO: 739855 - DNA, 23 bp, Homo sapiens
gctggtcagtctttgctcagtgt

SEQ ID NO: 739856 - DNA, 19 bp, Homo sapiens
gctggtccagggctagtga

SEQ ID NO: 739857 - DNA, 17 bp, Homo sapiens
gctggtcctccactttg

SEQ ID NO: 739858 - DNA, 14 bp, Homo sapiens
gctggtccttattt

SEQ ID NO: 739859 - DNA, 24 bp, Homo sapiens
gctggtctcaaacttgtggcctca

SEQ ID NO: 739860 - DNA, 20 bp, Homo sapiens
gctggtctcgaactcctgac

SEQ ID NO: 739861 - DNA, 21 bp, Homo sapiens
gctggtctgaaacccttgagc

SEQ ID NO: 739862 - DNA, 19 bp, Homo sapiens
gctggtcttgaattcctgg

SEQ ID NO: 739863 - DNA, 16 bp, Homo sapiens
gctggtgaacactgtg

SEQ ID NO: 739864 - DNA, 18 bp, Homo sapiens
gctggtgaacactgtgac

SEQ ID NO: 739865 - DNA, 22 bp, Homo sapiens
gctggtgaacactgtgaccagg

SEQ ID NO: 739866 - DNA, 21 bp, Homo sapiens
gctggtgactttggggacagg

SEQ ID NO: 739867 - DNA, 23 bp, Homo sapiens
gctggtgagaccccgcactgcag

SEQ ID NO: 739868 - DNA, 13 bp, Homo sapiens
gctggtgcattac

SEQ ID NO: 739869 - DNA, 22 bp, Homo sapiens
gctggtgcattacagagaggag

SEQ ID NO: 739870 - DNA, 22 bp, Homo sapiens
gctggtgccaaatagccccaga

SEQ ID NO: 739871 - DNA, 15 bp, Homo sapiens
gctggtgccagcctt

SEQ ID NO: 739872 - DNA, 13 bp, Homo sapiens
gctggtgcccatg

SEQ ID NO: 739873 - DNA, 18 bp, Homo sapiens
gctggtgccccacagcta

SEQ ID NO: 739874 - DNA, 17 bp, Homo sapiens
gctggtgctgtggccag

SEQ ID NO: 739875 - DNA, 12 bp, Homo sapiens
gctggtggccac

SEQ ID NO: 739876 - DNA, 12 bp, Homo sapiens
gctggtggccca

SEQ ID NO: 739877 - DNA, 13 bp, Homo sapiens
gctggtggcccag

SEQ ID NO: 739878 - DNA, 14 bp, Homo sapiens
gctggtggcccagg

SEQ ID NO: 739879 - DNA, 17 bp, Homo sapiens
gctggtggccctgtgcc

SEQ ID NO: 739880 - DNA, 21 bp, Homo sapiens
gctggtggccctgtgcctggg

SEQ ID NO: 739881 - DNA, 23 bp, Homo sapiens
gctggtggccctgtgcctgggcc

SEQ ID NO: 739882 - DNA, 14 bp, Homo sapiens
gctggtggccttgg

SEQ ID NO: 739883 - DNA, 18 bp, Homo sapiens
gctggtgggtctgagctg

SEQ ID NO: 739884 - DNA, 14 bp, Homo sapiens
gctggtggttgtgc

SEQ ID NO: 739885 - DNA, 15 bp, Homo sapiens
gctggtgtcctgacc

SEQ ID NO: 739886 - DNA, 17 bp, Homo sapiens
gctggttcagccttcgt

SEQ ID NO: 739887 - DNA, 15 bp, Homo sapiens
gctggttcctctctc

SEQ ID NO: 739888 - DNA, 21 bp, Homo sapiens
gctggttttggcatctctgtc

SEQ ID NO: 739889 - DNA, 20 bp, Homo sapiens
gctggttttgtaagatgctg

SEQ ID NO: 739890 - DNA, 21 bp, Homo sapiens
gctggttttgtaagatgctgg

SEQ ID NO: 739891 - DNA, 16 bp, Homo sapiens
gctgtaaaaatgttac

SEQ ID NO: 739892 - DNA, 13 bp, Homo sapiens
gctgtaaaatttg

SEQ ID NO: 739893 - DNA, 14 bp, Homo sapiens
gctgtaaaatttgt

SEQ ID NO: 739894 - DNA, 15 bp, Homo sapiens
gctgtaacctgctgg

SEQ ID NO: 739895 - DNA, 16 bp, Homo sapiens
gctgtaacgtggcact

SEQ ID NO: 739896 - DNA, 14 bp, Homo sapiens
gctgtaactgctga

SEQ ID NO: 739897 - DNA, 16 bp, Homo sapiens
gctgtaacttaaaata

SEQ ID NO: 739898 - DNA, 12 bp, Homo sapiens
gctgtaagggca

SEQ ID NO: 739899 - DNA, 22 bp, Homo sapiens
gctgtaatttcgccttaaactc

SEQ ID NO: 739900 - DNA, 21 bp, Homo sapiens
gctgtacaaatataagaataa

SEQ ID NO: 739901 - DNA, 12 bp, Homo sapiens
gctgtacatcta

SEQ ID NO: 739902 - DNA, 23 bp, Homo sapiens
gctgtacatctattttggattgt

SEQ ID NO: 739903 - DNA, 15 bp, Homo sapiens
gctgtacccttccac

SEQ ID NO: 739904 - DNA, 17 bp, Homo sapiens
gctgtacccttccacct

SEQ ID NO: 739905 - DNA, 13 bp, Homo sapiens
gctgtactataag

SEQ ID NO: 739906 - DNA, 17 bp, Homo sapiens
gctgtacttcttgaata

SEQ ID NO: 739907 - DNA, 18 bp, Homo sapiens
gctgtagatggtgacctg

SEQ ID NO: 739908 - DNA, 15 bp, Homo sapiens
gctgtagccatggct

SEQ ID NO: 739909 - DNA, 13 bp, Homo sapiens
gctgtaggtgtgc

SEQ ID NO: 739910 - DNA, 22 bp, Homo sapiens
gctgtatctatttttttttctt

SEQ ID NO: 739911 - DNA, 14 bp, Homo sapiens
gctgtatctgtgct

SEQ ID NO: 739912 - DNA, 17 bp, Homo sapiens
gctgtatggcccaggca

SEQ ID NO: 739913 - DNA, 22 bp, Homo sapiens
gctgtggtctataaaataaact

SEQ ID NO: 739914 - DNA, 16 bp, Homo sapiens
gctgtggtctgaagtg

SEQ ID NO: 739915 - DNA, 20 bp, Homo sapiens
gctgtgtaagctcacatcca

SEQ ID NO: 739916 - DNA, 19 bp, Homo sapiens
gctgtgtcctaaggcccat

SEQ ID NO: 739917 - DNA, 16 bp, Homo sapiens
gctgtgtcctccctcc

SEQ ID NO: 739918 - DNA, 14 bp, Homo sapiens
gctgtgtccttcct

SEQ ID NO: 739919 - DNA, 16 bp, Homo sapiens
gctgtgtctaaactgc

SEQ ID NO: 739920 - DNA, 18 bp, Homo sapiens
gctgtgtctcctctcaga

SEQ ID NO: 739921 - DNA, 22 bp, Homo sapiens
gctgtgtgacagaatcttgtat

SEQ ID NO: 739922 - DNA, 12 bp, Homo sapiens
gctgtgtgccca

SEQ ID NO: 739923 - DNA, 20 bp, Homo sapiens
gctgtgtggccaaccaggac

SEQ ID NO: 739924 - DNA, 21 bp, Homo sapiens
gctgtgtggccaaccaggacc

SEQ ID NO: 739925 - DNA, 23 bp, Homo sapiens
gctgttaaatacaggaaacagtt

SEQ ID NO: 739926 - DNA, 15 bp, Homo sapiens
gctgttactgcttct

SEQ ID NO: 739927 - DNA, 21 bp, Homo sapiens
gctgttattatatttgacatg

SEQ ID NO: 739928 - DNA, 13 bp, Homo sapiens
gctgttcagggca

SEQ ID NO: 739929 - DNA, 20 bp, Homo sapiens
gctgttcagggcatcggcag

SEQ ID NO: 739930 - DNA, 20 bp, Homo sapiens
gctgttcagtgctttttcct

SEQ ID NO: 739931 - DNA, 13 bp, Homo sapiens
gctgttccagact

SEQ ID NO: 739932 - DNA, 22 bp, Homo sapiens
gctgttcccatgtagccccctg

SEQ ID NO: 739933 - DNA, 16 bp, Homo sapiens
gctgttccctttgcct

SEQ ID NO: 739934 - DNA, 13 bp, Homo sapiens
gctgttcctgaga

SEQ ID NO: 739935 - DNA, 21 bp, Homo sapiens
gctgttcctgttcagtaataa

SEQ ID NO: 739936 - DNA, 18 bp, Homo sapiens
gctgttcgctcctcccag

SEQ ID NO: 739937 - DNA, 24 bp, Homo sapiens
gctgttcgctcctcccagatggct

SEQ ID NO: 739938 - DNA, 23 bp, Homo sapiens
gctgttctcaggacagcatccct

SEQ ID NO: 739939 - DNA, 12 bp, Homo sapiens
gctgttctgtgg

SEQ ID NO: 739940 - DNA, 21 bp, Homo sapiens
gctgttctgtggttcctctgc

SEQ ID NO: 739941 - DNA, 19 bp, Homo sapiens
gctgttcttcacttctggg

SEQ ID NO: 739942 - DNA, 20 bp, Homo sapiens
gctgttcttcacttctggga

SEQ ID NO: 739943 - DNA, 15 bp, Homo sapiens
gctgttcttccagga

SEQ ID NO: 739944 - DNA, 16 bp, Homo sapiens
gctgttgaagtctcag

SEQ ID NO: 739945 - DNA, 19 bp, Homo sapiens
gctgttgacatatttaatg

SEQ ID NO: 739946 - DNA, 12 bp, Homo sapiens
gctgttgagaaa

SEQ ID NO: 739947 - DNA, 12 bp, Homo sapiens
gctgttgagctg

SEQ ID NO: 739948 - DNA, 16 bp, Homo sapiens
gctgttgagctgtttt

SEQ ID NO: 739949 - DNA, 18 bp, Homo sapiens
gctgttgagctgttttcc

SEQ ID NO: 739950 - DNA, 15 bp, Homo sapiens
gctgttgaggtggct

SEQ ID NO: 739951 - DNA, 21 bp, Homo sapiens
gctgttgatgaggcctcttgg

SEQ ID NO: 739952 - DNA, 16 bp, Homo sapiens
gctgttgccatagccc

SEQ ID NO: 739953 - DNA, 15 bp, Homo sapiens
tctgggcagagcctg

SEQ ID NO: 739954 - DNA, 17 bp, Homo sapiens
tctgggcagagcctgtc

SEQ ID NO: 739955 - DNA, 21 bp, Homo sapiens
tctgggcagcacctctggtca

SEQ ID NO: 739956 - DNA, 15 bp, Homo sapiens
tctgggcagcctgct

SEQ ID NO: 739957 - DNA, 12 bp, Homo sapiens
tctgggcctggg

SEQ ID NO: 739958 - DNA, 13 bp, Homo sapiens
tctgggcctgggg

SEQ ID NO: 739959 - DNA, 17 bp, Homo sapiens
tctgggcgtccagctca

SEQ ID NO: 739960 - DNA, 20 bp, Homo sapiens
tctgggcgtccagctcagcc

SEQ ID NO: 739961 - DNA, 21 bp, Homo sapiens
tctgggctactgccactgtgt

SEQ ID NO: 739962 - DNA, 14 bp, Homo sapiens
tctgggctcagggc

SEQ ID NO: 739963 - DNA, 16 bp, Homo sapiens
tctgggctcagggctg

SEQ ID NO: 739964 - DNA, 17 bp, Homo sapiens
tctgggctcagggctgg

SEQ ID NO: 739965 - DNA, 20 bp, Homo sapiens
tctgggctcagggctggagt

SEQ ID NO: 739966 - DNA, 22 bp, Homo sapiens
tctgggctcctggaaccaatcc

SEQ ID NO: 739967 - DNA, 13 bp, Homo sapiens
tctgggctgggca

SEQ ID NO: 739968 - DNA, 14 bp, Homo sapiens
tctgggctgggcac

SEQ ID NO: 739969 - DNA, 13 bp, Homo sapiens
tctgggctggggc

SEQ ID NO: 739970 - DNA, 21 bp, Homo sapiens
tctgggcttggggcttcctaa

SEQ ID NO: 739971 - DNA, 13 bp, Homo sapiens
tctgggctttctc

SEQ ID NO: 739972 - DNA, 15 bp, Homo sapiens
tctgggctttctcct

SEQ ID NO: 739973 - DNA, 16 bp, Homo sapiens
tctgggctttctcctg

SEQ ID NO: 739974 - DNA, 21 bp, Homo sapiens
tctggggaaaaaaaagagact

SEQ ID NO: 739975 - DNA, 13 bp, Homo sapiens
tctggggaagagg

SEQ ID NO: 739976 - DNA, 21 bp, Homo sapiens
tctggggaagaggttttattt

SEQ ID NO: 739977 - DNA, 22 bp, Homo sapiens
tctggggaagtcaggggagaag

SEQ ID NO: 739978 - DNA, 22 bp, Homo sapiens
tctggggaattactttcctcct

SEQ ID NO: 739979 - DNA, 23 bp, Homo sapiens
tctggggacagcttcctcacacc

SEQ ID NO: 739980 - DNA, 23 bp, Homo sapiens
tctggggagaaatccctcagatc

SEQ ID NO: 739981 - DNA, 15 bp, Homo sapiens
tctggggagctcctg

SEQ ID NO: 739982 - DNA, 22 bp, Homo sapiens
tctggggaggcaggcattcctg

SEQ ID NO: 739983 - DNA, 18 bp, Homo sapiens
tctggggatgggtgggga

SEQ ID NO: 739984 - DNA, 15 bp, Homo sapiens
tctggggcagatccc

SEQ ID NO: 739985 - DNA, 18 bp, Homo sapiens
tctggggcaggctgggcc

SEQ ID NO: 739986 - DNA, 21 bp, Homo sapiens
tctggggcaggctgggccatg

SEQ ID NO: 739987 - DNA, 13 bp, Homo sapiens
tctggggcccctt

SEQ ID NO: 739988 - DNA, 15 bp, Homo sapiens
tctggggccctgggc

SEQ ID NO: 739989 - DNA, 16 bp, Homo sapiens
tctggggccctgggcc

SEQ ID NO: 739990 - DNA, 19 bp, Homo sapiens
tctggggcttgtcctgtgc

SEQ ID NO: 739991 - DNA, 16 bp, Homo sapiens
tctgggggaggcaggg

SEQ ID NO: 739992 - DNA, 18 bp, Homo sapiens
tctgggggaggcagggct

SEQ ID NO: 739993 - DNA, 20 bp, Homo sapiens
tctgggggcccgacaggtgg

SEQ ID NO: 739994 - DNA, 17 bp, Homo sapiens
tctggggtcaggtgcca

SEQ ID NO: 739995 - DNA, 22 bp, Homo sapiens
tctggggtctttttatgcattt

SEQ ID NO: 739996 - DNA, 17 bp, Homo sapiens
tctggggttcagcccct

SEQ ID NO: 739997 - DNA, 21 bp, Homo sapiens
tctggggttcagcccctcctc

SEQ ID NO: 739998 - DNA, 18 bp, Homo sapiens
tctgggtccaggcctggc

SEQ ID NO: 739999 - DNA, 16 bp, Homo sapiens
tctgggtccctcggag

SEQ ID NO: 740000 - DNA, 15 bp, Homo sapiens
tctgggtccctgctc

SEQ ID NO: 740001 - DNA, 16 bp, Homo sapiens
tctgggtccttggctc

SEQ ID NO: 740002 - DNA, 17 bp, Homo sapiens
tctgggtccttggctcc

SEQ ID NO: 740003 - DNA, 21 bp, Homo sapiens
tctgggtctcccaggacacat

SEQ ID NO: 740004 - DNA, 14 bp, Homo sapiens
tctgggtgaggtag

SEQ ID NO: 740005 - DNA, 17 bp, Homo sapiens
tctgggtgcagctgggc

SEQ ID NO: 740006 - DNA, 20 bp, Homo sapiens
tctgggtgttgaccactcca

SEQ ID NO: 740007 - DNA, 23 bp, Homo sapiens
tctgggttaggtggccgctcctc

SEQ ID NO: 740008 - DNA, 14 bp, Homo sapiens
tctgggtttctaag

SEQ ID NO: 740009 - DNA, 18 bp, Homo sapiens
tctgggtttctaagcagt

SEQ ID NO: 740010 - DNA, 16 bp, Homo sapiens
tctgggtttgcccagt

SEQ ID NO: 740011 - DNA, 17 bp, Homo sapiens
tctgggtttgcccagtc

SEQ ID NO: 740012 - DNA, 18 bp, Homo sapiens
tctgggtttggcccaaga

SEQ ID NO: 740013 - DNA, 21 bp, Homo sapiens
tctggtaaacattcctccagc

SEQ ID NO: 740014 - DNA, 15 bp, Homo sapiens
tctggtactctccta

SEQ ID NO: 740015 - DNA, 15 bp, Homo sapiens
tctggtattaaatgc

SEQ ID NO: 740016 - DNA, 17 bp, Homo sapiens
tctggtattaaatgcca

SEQ ID NO: 740017 - DNA, 17 bp, Homo sapiens
tctggtatttcccctgt

SEQ ID NO: 740018 - DNA, 22 bp, Homo sapiens
tctggtatttcccctgtcagtt

SEQ ID NO: 740019 - DNA, 21 bp, Homo sapiens
tctggtcaacctcctggacat

SEQ ID NO: 740020 - DNA, 16 bp, Homo sapiens
tctggtcccctctctt

SEQ ID NO: 740021 - DNA, 13 bp, Homo sapiens
tctggtcccttgc

SEQ ID NO: 740022 - DNA, 14 bp, Homo sapiens
tctggtcctaccca

SEQ ID NO: 740023 - DNA, 12 bp, Homo sapiens
tctggtcctcgg

SEQ ID NO: 740024 - DNA, 16 bp, Homo sapiens
tctggtcctcggagct

SEQ ID NO: 740025 - DNA, 15 bp, Homo sapiens
tctggtcgctcctgc

SEQ ID NO: 740026 - DNA, 17 bp, Homo sapiens
tctggtgaagctcactt

SEQ ID NO: 740027 - DNA, 17 bp, Homo sapiens
tctggtgaggtggccca

SEQ ID NO: 740028 - DNA, 17 bp, Homo sapiens
tctggtgagtcaccact

SEQ ID NO: 740029 - DNA, 17 bp, Homo sapiens
tctggtgatctcccaag

SEQ ID NO: 740030 - DNA, 19 bp, Homo sapiens
tctggtgcacgcctgagcg

SEQ ID NO: 740031 - DNA, 16 bp, Homo sapiens
tctggtgcctcctcaa

SEQ ID NO: 740032 - DNA, 21 bp, Homo sapiens
tctggtggaggagctgaggga

SEQ ID NO: 740033 - DNA, 16 bp, Homo sapiens
tctggtggtcagccct

SEQ ID NO: 740034 - DNA, 14 bp, Homo sapiens
tctggtggtggcct

SEQ ID NO: 740035 - DNA, 21 bp, Homo sapiens
gcttccgggaaaacagctatt

SEQ ID NO: 740036 - DNA, 13 bp, Homo sapiens
gcttcctcacacc

SEQ ID NO: 740037 - DNA, 16 bp, Homo sapiens
gcttcctcagcctcca

SEQ ID NO: 740038 - DNA, 18 bp, Homo sapiens
gcttcctccagaggaggg

SEQ ID NO: 740039 - DNA, 18 bp, Homo sapiens
gcttcctccgtccaccca

SEQ ID NO: 740040 - DNA, 12 bp, Homo sapiens
gcttcctcctca

SEQ ID NO: 740041 - DNA, 14 bp, Homo sapiens
gcttcctcctccct

SEQ ID NO: 740042 - DNA, 16 bp, Homo sapiens
gcttcctcctggaaat

SEQ ID NO: 740043 - DNA, 15 bp, Homo sapiens
gcttcctctagaagc

SEQ ID NO: 740044 - DNA, 17 bp, Homo sapiens
gcttcctctagaagcca

SEQ ID NO: 740045 - DNA, 20 bp, Homo sapiens
gcttcctctagaagccaagg

SEQ ID NO: 740046 - DNA, 22 bp, Homo sapiens
gcttcctctagaagccaaggga

SEQ ID NO: 740047 - DNA, 21 bp, Homo sapiens
gcttcctgagaaagcccacct

SEQ ID NO: 740048 - DNA, 11 bp, Homo sapiens
gcttcctgccc

SEQ ID NO: 740049 - DNA, 17 bp, Homo sapiens
gcttcctgcccttccct

SEQ ID NO: 740050 - DNA, 19 bp, Homo sapiens
gcttcctgcccttccctct

SEQ ID NO: 740051 - DNA, 12 bp, Homo sapiens
gcttcctgctgg

SEQ ID NO: 740052 - DNA, 18 bp, Homo sapiens
gcttcctgctgtatgtga

SEQ ID NO: 740053 - DNA, 13 bp, Homo sapiens
gcttcctgcttgc

SEQ ID NO: 740054 - DNA, 17 bp, Homo sapiens
gcttcctggctctgggg

SEQ ID NO: 740055 - DNA, 12 bp, Homo sapiens
gcttcctggtgt

SEQ ID NO: 740056 - DNA, 14 bp, Homo sapiens
gcttcctgtccact

SEQ ID NO: 740057 - DNA, 23 bp, Homo sapiens
gcttcctgtccactctcggggcc

SEQ ID NO: 740058 - DNA, 15 bp, Homo sapiens
gcttcctgtctgttt

SEQ ID NO: 740059 - DNA, 19 bp, Homo sapiens
gcttcctgtctgtttatat

SEQ ID NO: 740060 - DNA, 24 bp, Homo sapiens
gcttcctgtctgtttatatattga

SEQ ID NO: 740061 - DNA, 21 bp, Homo sapiens
gcttcctgtgccctcacccca

SEQ ID NO: 740062 - DNA, 23 bp, Homo sapiens
gcttcctgtgctaagtctttccc

SEQ ID NO: 740063 - DNA, 23 bp, Homo sapiens
gcttccttcagtttgtaaagtcg

SEQ ID NO: 740064 - DNA, 23 bp, Homo sapiens
gcttcctttcctgtgtgtactct

SEQ ID NO: 740065 - DNA, 22 bp, Homo sapiens
gcttcgactactgctcctgtgg

SEQ ID NO: 740066 - DNA, 23 bp, Homo sapiens
gcttcgactactgctcctgtggc

SEQ ID NO: 740067 - DNA, 19 bp, Homo sapiens
gcttcggagggcccctgcg

SEQ ID NO: 740068 - DNA, 22 bp, Homo sapiens
gcttcggagggccgcagggccc

SEQ ID NO: 740069 - DNA, 14 bp, Homo sapiens
gcttcggcatttga

SEQ ID NO: 740070 - DNA, 19 bp, Homo sapiens
gcttcggccacaggcaggt

SEQ ID NO: 740071 - DNA, 16 bp, Homo sapiens
gcttcgtgctggagga

SEQ ID NO: 740072 - DNA, 16 bp, Homo sapiens
gcttcgtttattttca

SEQ ID NO: 740073 - DNA, 12 bp, Homo sapiens
gcttctaaagca

SEQ ID NO: 740074 - DNA, 15 bp, Homo sapiens
gcttctaaagcaggt

SEQ ID NO: 740075 - DNA, 16 bp, Homo sapiens
gcttctaagtaaatac

SEQ ID NO: 740076 - DNA, 19 bp, Homo sapiens
gcttctaagtaaatacaat

SEQ ID NO: 740077 - DNA, 21 bp, Homo sapiens
gcttctaagtaaatacaattt

SEQ ID NO: 740078 - DNA, 22 bp, Homo sapiens
gcttctaagtaaatacaatttt

SEQ ID NO: 740079 - DNA, 19 bp, Homo sapiens
gcttctaccatgaacagaa

SEQ ID NO: 740080 - DNA, 20 bp, Homo sapiens
gcttctacggccatgagact

SEQ ID NO: 740081 - DNA, 19 bp, Homo sapiens
gcttctataattttgcctt

SEQ ID NO: 740082 - DNA, 16 bp, Homo sapiens
gcttctcaccacggga

SEQ ID NO: 740083 - DNA, 22 bp, Homo sapiens
gcttctcactgccatgccagct

SEQ ID NO: 740084 - DNA, 15 bp, Homo sapiens
gcttctcagcccctt

SEQ ID NO: 740085 - DNA, 12 bp, Homo sapiens
gcttctccaggc

SEQ ID NO: 740086 - DNA, 17 bp, Homo sapiens
tctgtgaccaactgttg

SEQ ID NO: 740087 - DNA, 18 bp, Homo sapiens
tctgtgaccaatgtcttg

SEQ ID NO: 740088 - DNA, 19 bp, Homo sapiens
tctgtgaccaatgtcttga

SEQ ID NO: 740089 - DNA, 14 bp, Homo sapiens
tctgtgacgcagac

SEQ ID NO: 740090 - DNA, 14 bp, Homo sapiens
tctgtgactggatc

SEQ ID NO: 740091 - DNA, 15 bp, Homo sapiens
tctgtgactggatct

SEQ ID NO: 740092 - DNA, 23 bp, Homo sapiens
tctgtgagaggcagctatctgca

SEQ ID NO: 740093 - DNA, 17 bp, Homo sapiens
tctgtgatgagctgatc

SEQ ID NO: 740094 - DNA, 23 bp, Homo sapiens
tctgtgattaaagcagtaatatt

SEQ ID NO: 740095 - DNA, 14 bp, Homo sapiens
tctgtgattacata

SEQ ID NO: 740096 - DNA, 17 bp, Homo sapiens
tctgtgattacatagat

SEQ ID NO: 740097 - DNA, 24 bp, Homo sapiens
tctgtgattacatagatcagccat

SEQ ID NO: 740098 - DNA, 13 bp, Homo sapiens
tctgtgatttctt

SEQ ID NO: 740099 - DNA, 18 bp, Homo sapiens
tctgtgcaaacagtaacg

SEQ ID NO: 740100 - DNA, 20 bp, Homo sapiens
tctgtgcactagcctgtgat

SEQ ID NO: 740101 - DNA, 15 bp, Homo sapiens
tctgtgccatggatt

SEQ ID NO: 740102 - DNA, 22 bp, Homo sapiens
tctgtgccccatgcctgtccag

SEQ ID NO: 740103 - DNA, 17 bp, Homo sapiens
tctgtgccctccaaaga

SEQ ID NO: 740104 - DNA, 20 bp, Homo sapiens
tctgtgcctccaggaccagg

SEQ ID NO: 740105 - DNA, 17 bp, Homo sapiens
tctgtgcctccccccag

SEQ ID NO: 740106 - DNA, 18 bp, Homo sapiens
tctgtgcctccccccaga

SEQ ID NO: 740107 - DNA, 19 bp, Homo sapiens
tctgtgcctccccccagac

SEQ ID NO: 740108 - DNA, 14 bp, Homo sapiens
tctgtgcctgggat

SEQ ID NO: 740109 - DNA, 22 bp, Homo sapiens
tctgtgcgtgaaacacaccagg

SEQ ID NO: 740110 - DNA, 15 bp, Homo sapiens
tctgtgcgtgtggcg

SEQ ID NO: 740111 - DNA, 21 bp, Homo sapiens
tctgtgctagggaaacttccc

SEQ ID NO: 740112 - DNA, 14 bp, Homo sapiens
tctgtgctggccat

SEQ ID NO: 740113 - DNA, 13 bp, Homo sapiens
tctgtgctgtgcc

SEQ ID NO: 740114 - DNA, 14 bp, Homo sapiens
tctgtgctgtgcct

SEQ ID NO: 740115 - DNA, 15 bp, Homo sapiens
tctgtgctgtgcctg

SEQ ID NO: 740116 - DNA, 12 bp, Homo sapiens
tctgtgcttgga

SEQ ID NO: 740117 - DNA, 22 bp, Homo sapiens
tctgtgctttgactcacctgtt

SEQ ID NO: 740118 - DNA, 19 bp, Homo sapiens
tctgtggaaaagccatctc

SEQ ID NO: 740119 - DNA, 22 bp, Homo sapiens
tctgtggaaaagccatctcagg

SEQ ID NO: 740120 - DNA, 11 bp, Homo sapiens
tctgtggaaga

SEQ ID NO: 740121 - DNA, 14 bp, Homo sapiens
tctgtggaagagat

SEQ ID NO: 740122 - DNA, 22 bp, Homo sapiens
tctgtggaccactgcatgagct

SEQ ID NO: 740123 - DNA, 18 bp, Homo sapiens
tctgtggagctgccacag

SEQ ID NO: 740124 - DNA, 22 bp, Homo sapiens
tctgtggagctgccacagagaa

SEQ ID NO: 740125 - DNA, 22 bp, Homo sapiens
tctgtggagggagggcagctgg

SEQ ID NO: 740126 - DNA, 17 bp, Homo sapiens
tctgtggagttcctgct

SEQ ID NO: 740127 - DNA, 17 bp, Homo sapiens
tctgtggcctgtctcta

SEQ ID NO: 740128 - DNA, 23 bp, Homo sapiens
tctgtggcctgtgtccagcagct

SEQ ID NO: 740129 - DNA, 15 bp, Homo sapiens
tctgtggctggctct

SEQ ID NO: 740130 - DNA, 23 bp, Homo sapiens
tctgtgggcatggccgcttctag

SEQ ID NO: 740131 - DNA, 15 bp, Homo sapiens
tctgtgggcttcagc

SEQ ID NO: 740132 - DNA, 17 bp, Homo sapiens
tctgtgggcttggcctt

SEQ ID NO: 740133 - DNA, 18 bp, Homo sapiens
tctgtgggcttggccttg

SEQ ID NO: 740134 - DNA, 21 bp, Homo sapiens
tctgtggggaggggttgtttt

SEQ ID NO: 740135 - DNA, 11 bp, Homo sapiens
tctgtggtggg

SEQ ID NO: 740136 - DNA, 19 bp, Homo sapiens
tctgtggttcctctgctca

SEQ ID NO: 740137 - DNA, 21 bp, Homo sapiens
tctgtggttctataataagtt

SEQ ID NO: 740138 - DNA, 20 bp, Homo sapiens
tctgtggttttcccctccct

SEQ ID NO: 740139 - DNA, 21 bp, Homo sapiens
tctgtggttttcccctccctg

SEQ ID NO: 740140 - DNA, 16 bp, Homo sapiens
tctgtgtacaaagaaa

SEQ ID NO: 740141 - DNA, 14 bp, Homo sapiens
tctgtgtacaattt

SEQ ID NO: 740142 - DNA, 22 bp, Homo sapiens
tctgtgtaccacttctgtgggc

SEQ ID NO: 740143 - DNA, 15 bp, Homo sapiens
tctgtgtagccgccc

SEQ ID NO: 740144 - DNA, 17 bp, Homo sapiens
tctgtgtagccgccctg

SEQ ID NO: 740145 - DNA, 18 bp, Homo sapiens
tctgtgtagccgccctga

SEQ ID NO: 740146 - DNA, 18 bp, Homo sapiens
tctgtgtattttcagtca

SEQ ID NO: 740147 - DNA, 15 bp, Homo sapiens
tctgtgtccttccct

SEQ ID NO: 740148 - DNA, 12 bp, Homo sapiens
tctgtgtctctt

SEQ ID NO: 740149 - DNA, 16 bp, Homo sapiens
tctgtgtgaaactttc

SEQ ID NO: 740150 - DNA, 15 bp, Homo sapiens
tctgtgtgaatgtgg

SEQ ID NO: 740151 - DNA, 18 bp, Homo sapiens
tctgtgtgatgaactttc

SEQ ID NO: 740152 - DNA, 22 bp, Homo sapiens
tctgtgtgcaccttaccaactt

SEQ ID NO: 740153 - DNA, 17 bp, Homo sapiens
tctgtgtgcatatttgt

SEQ ID NO: 740154 - DNA, 19 bp, Homo sapiens
tctgtgtggtggagccagg

SEQ ID NO: 740155 - DNA, 18 bp, Homo sapiens
tctgtgtgtcagttttca

SEQ ID NO: 740156 - DNA, 17 bp, Homo sapiens
tcttaactgtatttcag

SEQ ID NO: 740157 - DNA, 23 bp, Homo sapiens
tcttaactgtatttcagtatttt

SEQ ID NO: 740158 - DNA, 16 bp, Homo sapiens
tcttaagacagcatgt

SEQ ID NO: 740159 - DNA, 19 bp, Homo sapiens
tcttaagagcttgatctgt

SEQ ID NO: 740160 - DNA, 21 bp, Homo sapiens
tcttaagagcttgatctgtga

SEQ ID NO: 740161 - DNA, 14 bp, Homo sapiens
tcttaagcactttg

SEQ ID NO: 740162 - DNA, 15 bp, Homo sapiens
tcttaagcactttga

SEQ ID NO: 740163 - DNA, 15 bp, Homo sapiens
tcttaagcagcatgg

SEQ ID NO: 740164 - DNA, 21 bp, Homo sapiens
tcttaagcagcatggaaaaat

SEQ ID NO: 740165 - DNA, 18 bp, Homo sapiens
tcttaagcctaaatgcct

SEQ ID NO: 740166 - DNA, 16 bp, Homo sapiens
tcttaaggaattttgt

SEQ ID NO: 740167 - DNA, 20 bp, Homo sapiens
tcttaaggaattttgtctca

SEQ ID NO: 740168 - DNA, 23 bp, Homo sapiens
tcttaaggattgtgatattttta

SEQ ID NO: 740169 - DNA, 15 bp, Homo sapiens
tcttaatataaattc

SEQ ID NO: 740170 - DNA, 17 bp, Homo sapiens
tcttaatatatacattt

SEQ ID NO: 740171 - DNA, 19 bp, Homo sapiens
tcttaatatgttcttttaa

SEQ ID NO: 740172 - DNA, 19 bp, Homo sapiens
tcttaatattgagaatcag

SEQ ID NO: 740173 - DNA, 15 bp, Homo sapiens
tcttaatcactactg

SEQ ID NO: 740174 - DNA, 18 bp, Homo sapiens
tcttaatcgatgaatgta

SEQ ID NO: 740175 - DNA, 12 bp, Homo sapiens
tcttaatctgtg

SEQ ID NO: 740176 - DNA, 15 bp, Homo sapiens
tcttaatgttcctca

SEQ ID NO: 740177 - DNA, 20 bp, Homo sapiens
tcttaatgttcctcaaagct

SEQ ID NO: 740178 - DNA, 14 bp, Homo sapiens
tcttaatgttgaat

SEQ ID NO: 740179 - DNA, 14 bp, Homo sapiens
tcttaattattata

SEQ ID NO: 740180 - DNA, 17 bp, Homo sapiens
tcttaattctttgttct

SEQ ID NO: 740181 - DNA, 19 bp, Homo sapiens
tcttaattctttgttctgt

SEQ ID NO: 740182 - DNA, 16 bp, Homo sapiens
tcttaatttggataat

SEQ ID NO: 740183 - DNA, 22 bp, Homo sapiens
tcttaatttggataataaaaat

SEQ ID NO: 740184 - DNA, 20 bp, Homo sapiens
tcttaattttaaagacccaa

SEQ ID NO: 740185 - DNA, 20 bp, Homo sapiens
tcttacaaaaagaaatgtca

SEQ ID NO: 740186 - DNA, 17 bp, Homo sapiens
tcttacaatcaaatctc

SEQ ID NO: 740187 - DNA, 22 bp, Homo sapiens
tcttacaattgcactgctgttc

SEQ ID NO: 740188 - DNA, 19 bp, Homo sapiens
tcttacagcacatcacctc

SEQ ID NO: 740189 - DNA, 21 bp, Homo sapiens
tcttacagcacatcacctctt

SEQ ID NO: 740190 - DNA, 20 bp, Homo sapiens
tcttacattttcgtcctgta

SEQ ID NO: 740191 - DNA, 16 bp, Homo sapiens
tcttaccacagtgttt

SEQ ID NO: 740192 - DNA, 18 bp, Homo sapiens
tcttaccacagtgtttta

SEQ ID NO: 740193 - DNA, 14 bp, Homo sapiens
tcttaccagatgct

SEQ ID NO: 740194 - DNA, 15 bp, Homo sapiens
tcttaccagatgcta

SEQ ID NO: 740195 - DNA, 15 bp, Homo sapiens
tcttacctctctggg

SEQ ID NO: 740196 - DNA, 21 bp, Homo sapiens
tcttacctgttatttatcaat

SEQ ID NO: 740197 - DNA, 14 bp, Homo sapiens
tcttactaaacatt

SEQ ID NO: 740198 - DNA, 16 bp, Homo sapiens
tcttactaaacatttt

SEQ ID NO: 740199 - DNA, 17 bp, Homo sapiens
tcttactattaagcagt

SEQ ID NO: 740200 - DNA, 23 bp, Homo sapiens
tcttactattaagcagtaaaaac

SEQ ID NO: 740201 - DNA, 16 bp, Homo sapiens
tcttactcctcctctt

SEQ ID NO: 740202 - DNA, 14 bp, Homo sapiens
tcttactctgtctc

SEQ ID NO: 740203 - DNA, 15 bp, Homo sapiens
tcttactctttccta

SEQ ID NO: 740204 - DNA, 23 bp, Homo sapiens
tcttactgaaggtaaaattgaaa

SEQ ID NO: 740205 - DNA, 13 bp, Homo sapiens
tcttactttgctt

SEQ ID NO: 740206 - DNA, 20 bp, Homo sapiens
tcttacttttattattttaa

SEQ ID NO: 740207 - DNA, 17 bp, Homo sapiens
tcttacttttccagtct

SEQ ID NO: 740208 - DNA, 22 bp, Homo sapiens
tcttagaaaattaaaataggca

SEQ ID NO: 740209 - DNA, 15 bp, Homo sapiens
tcttagaaatgaagg

SEQ ID NO: 740210 - DNA, 13 bp, Homo sapiens
tcttagaagaata

SEQ ID NO: 740211 - DNA, 12 bp, Homo sapiens
tcttagaagcca

SEQ ID NO: 740212 - DNA, 18 bp, Homo sapiens
tcttagacttgaaatact

SEQ ID NO: 740213 - DNA, 23 bp, Homo sapiens
tcttagacttgaaatactactta

SEQ ID NO: 740214 - DNA, 23 bp, Homo sapiens
tcttagagccttttatctgcaga

SEQ ID NO: 740215 - DNA, 15 bp, Homo sapiens
gcttgggctccacgg

SEQ ID NO: 740216 - DNA, 23 bp, Homo sapiens
gcttgggctgacccagcatctcc

SEQ ID NO: 740217 - DNA, 16 bp, Homo sapiens
gcttgggcttcttcct

SEQ ID NO: 740218 - DNA, 11 bp, Homo sapiens
gcttggggcta

SEQ ID NO: 740219 - DNA, 16 bp, Homo sapiens
gcttggggctcacaca

SEQ ID NO: 740220 - DNA, 20 bp, Homo sapiens
gcttggggctcacacacctg

SEQ ID NO: 740221 - DNA, 22 bp, Homo sapiens
gcttgggggttttcaatgtgaa

SEQ ID NO: 740222 - DNA, 16 bp, Homo sapiens
gcttggtcaaactttt

SEQ ID NO: 740223 - DNA, 13 bp, Homo sapiens
gcttggtctgttt

SEQ ID NO: 740224 - DNA, 15 bp, Homo sapiens
gcttggtctgtttga

SEQ ID NO: 740225 - DNA, 17 bp, Homo sapiens
gcttgtaacaagaaaac

SEQ ID NO: 740226 - DNA, 12 bp, Homo sapiens
gcttgtacataa

SEQ ID NO: 740227 - DNA, 16 bp, Homo sapiens
gcttgtacataatgcg

SEQ ID NO: 740228 - DNA, 15 bp, Homo sapiens
gcttgtactaagcca

SEQ ID NO: 740229 - DNA, 22 bp, Homo sapiens
gcttgtactaagccaggaggct

SEQ ID NO: 740230 - DNA, 22 bp, Homo sapiens
gcttgtagaactcactctgggc

SEQ ID NO: 740231 - DNA, 23 bp, Homo sapiens
gcttgtagaactcactctgggct

SEQ ID NO: 740232 - DNA, 13 bp, Homo sapiens
gcttgtaggagct

SEQ ID NO: 740233 - DNA, 22 bp, Homo sapiens
gcttgtatatagagattgtaca

SEQ ID NO: 740234 - DNA, 15 bp, Homo sapiens
gcttgtcagagctgg

SEQ ID NO: 740235 - DNA, 16 bp, Homo sapiens
gcttgtcattccagag

SEQ ID NO: 740236 - DNA, 14 bp, Homo sapiens
gcttgtgacagtgc

SEQ ID NO: 740237 - DNA, 16 bp, Homo sapiens
gcttgtgcctcccttc

SEQ ID NO: 740238 - DNA, 21 bp, Homo sapiens
gcttgtggagttgatgacttt

SEQ ID NO: 740239 - DNA, 23 bp, Homo sapiens
gcttgtggattgagggtaggagg

SEQ ID NO: 740240 - DNA, 13 bp, Homo sapiens
gcttgtgggctgg

SEQ ID NO: 740241 - DNA, 14 bp, Homo sapiens
gcttgtgggctggt

SEQ ID NO: 740242 - DNA, 15 bp, Homo sapiens
gcttgtgggctggtg

SEQ ID NO: 740243 - DNA, 13 bp, Homo sapiens
gcttgtgtacttg

SEQ ID NO: 740244 - DNA, 21 bp, Homo sapiens
gcttgttaatgctttctgaag

SEQ ID NO: 740245 - DNA, 15 bp, Homo sapiens
gcttgttagagagaa

SEQ ID NO: 740246 - DNA, 18 bp, Homo sapiens
gcttgttcatcatccaga

SEQ ID NO: 740247 - DNA, 21 bp, Homo sapiens
gcttgttcatcatccagatgt

SEQ ID NO: 740248 - DNA, 18 bp, Homo sapiens
gcttgttccctctccctg

SEQ ID NO: 740249 - DNA, 18 bp, Homo sapiens
gcttgttgggattcctga

SEQ ID NO: 740250 - DNA, 22 bp, Homo sapiens
gcttgttgggattcctgaccca

SEQ ID NO: 740251 - DNA, 13 bp, Homo sapiens
gcttgtttacagc

SEQ ID NO: 740252 - DNA, 17 bp, Homo sapiens
gcttgtttgatttcaac

SEQ ID NO: 740253 - DNA, 20 bp, Homo sapiens
gcttgttttataaaattttg

SEQ ID NO: 740254 - DNA, 13 bp, Homo sapiens
gcttgttttccaa

SEQ ID NO: 740255 - DNA, 21 bp, Homo sapiens
gctttaaaaagggaagaaact

SEQ ID NO: 740256 - DNA, 13 bp, Homo sapiens
gctttaaaacaag

SEQ ID NO: 740257 - DNA, 19 bp, Homo sapiens
gctttaaaacaagtgtgat

SEQ ID NO: 740258 - DNA, 17 bp, Homo sapiens
gctttaaaaccacagct

SEQ ID NO: 740259 - DNA, 15 bp, Homo sapiens
gctttaaaagaaaaa

SEQ ID NO: 740260 - DNA, 16 bp, Homo sapiens
gctttaaactcaggga

SEQ ID NO: 740261 - DNA, 21 bp, Homo sapiens
gctttaacctgaaccttgagc

SEQ ID NO: 740262 - DNA, 22 bp, Homo sapiens
gctttaagtaaaaatccaaaaa

SEQ ID NO: 740263 - DNA, 22 bp, Homo sapiens
gctttaattaattaagtatctg

SEQ ID NO: 740264 - DNA, 17 bp, Homo sapiens
gctttaccttttcaggg

SEQ ID NO: 740265 - DNA, 18 bp, Homo sapiens
gctttaccttttcagggc

SEQ ID NO: 740266 - DNA, 17 bp, Homo sapiens
gctttactactgtggaa

SEQ ID NO: 740267 - DNA, 21 bp, Homo sapiens
gctttactttaaaattcaagt

SEQ ID NO: 740268 - DNA, 16 bp, Homo sapiens
gctttagaaaacattc

SEQ ID NO: 740269 - DNA, 18 bp, Homo sapiens
gctttaggggaaggggga

SEQ ID NO: 740270 - DNA, 20 bp, Homo sapiens
gctttaggggtggtgggggt

SEQ ID NO: 740271 - DNA, 17 bp, Homo sapiens
gctttatactgagcttt

SEQ ID NO: 740272 - DNA, 17 bp, Homo sapiens
gctttatctttgtgtaa

SEQ ID NO: 740273 - DNA, 18 bp, Homo sapiens
gctttattgaattagaaa

SEQ ID NO: 740274 - DNA, 16 bp, Homo sapiens
gctttatttgtaaatt

SEQ ID NO: 740275 - DNA, 20 bp, Homo sapiens
gctttatttttcttttcctg

SEQ ID NO: 740276 - DNA, 13 bp, Homo sapiens
gctttatttttta

SEQ ID NO: 740277 - DNA, 19 bp, Homo sapiens
gctttattttttaagtatt

SEQ ID NO: 740278 - DNA, 14 bp, Homo sapiens
tcttcctgttgtga

SEQ ID NO: 740279 - DNA, 23 bp, Homo sapiens
tcttcctgttgtgactgccagga

SEQ ID NO: 740280 - DNA, 23 bp, Homo sapiens
tcttccttgaagaactgcaggcc

SEQ ID NO: 740281 - DNA, 18 bp, Homo sapiens
tcttccttgatgtttggg

SEQ ID NO: 740282 - DNA, 18 bp, Homo sapiens
tcttccttggagggggga

SEQ ID NO: 740283 - DNA, 17 bp, Homo sapiens
tcttcctttactttccc

SEQ ID NO: 740284 - DNA, 17 bp, Homo sapiens
tcttcctttccctggag

SEQ ID NO: 740285 - DNA, 15 bp, Homo sapiens
tcttcctttctcctt

SEQ ID NO: 740286 - DNA, 16 bp, Homo sapiens
tcttcctttcttgtct

SEQ ID NO: 740287 - DNA, 14 bp, Homo sapiens
tcttcggcagggag

SEQ ID NO: 740288 - DNA, 19 bp, Homo sapiens
tcttcggggaactcctgga

SEQ ID NO: 740289 - DNA, 15 bp, Homo sapiens
tcttcggtttctgag

SEQ ID NO: 740290 - DNA, 13 bp, Homo sapiens
tcttcgtcctttt

SEQ ID NO: 740291 - DNA, 14 bp, Homo sapiens
tcttcgtgaacata

SEQ ID NO: 740292 - DNA, 23 bp, Homo sapiens
tcttcgttaatagattatttcat

SEQ ID NO: 740293 - DNA, 19 bp, Homo sapiens
tcttcgttctttttaagtt

SEQ ID NO: 740294 - DNA, 13 bp, Homo sapiens
tcttctaattatt

SEQ ID NO: 740295 - DNA, 20 bp, Homo sapiens
tcttctaatttcaaaaatat

SEQ ID NO: 740296 - DNA, 12 bp, Homo sapiens
tcttctacttgt

SEQ ID NO: 740297 - DNA, 20 bp, Homo sapiens
tcttctataatatttccttt

SEQ ID NO: 740298 - DNA, 21 bp, Homo sapiens
tcttctataatatttcctttt

SEQ ID NO: 740299 - DNA, 16 bp, Homo sapiens
tcttctattttattcc

SEQ ID NO: 740300 - DNA, 20 bp, Homo sapiens
tcttctatttttatcatgaa

SEQ ID NO: 740301 - DNA, 18 bp, Homo sapiens
tcttctcagctcttccat

SEQ ID NO: 740302 - DNA, 14 bp, Homo sapiens
tcttctcataaatc

SEQ ID NO: 740303 - DNA, 17 bp, Homo sapiens
tcttctcatagcattaa

SEQ ID NO: 740304 - DNA, 18 bp, Homo sapiens
tcttctcatcttttatct

SEQ ID NO: 740305 - DNA, 12 bp, Homo sapiens
tcttctccactg

SEQ ID NO: 740306 - DNA, 16 bp, Homo sapiens
tcttctccactggatg

SEQ ID NO: 740307 - DNA, 16 bp, Homo sapiens
tcttctcccagaatcc

SEQ ID NO: 740308 - DNA, 22 bp, Homo sapiens
tcttctcccagaatcccagccg

SEQ ID NO: 740309 - DNA, 16 bp, Homo sapiens
tcttctcctatgtgta

SEQ ID NO: 740310 - DNA, 19 bp, Homo sapiens
tcttctctatcctctctct

SEQ ID NO: 740311 - DNA, 16 bp, Homo sapiens
tcttctctccacttct

SEQ ID NO: 740312 - DNA, 19 bp, Homo sapiens
tcttctctcctcagtttct

SEQ ID NO: 740313 - DNA, 15 bp, Homo sapiens
tcttctctcctttct

SEQ ID NO: 740314 - DNA, 20 bp, Homo sapiens
tcttctctctcaattttatc

SEQ ID NO: 740315 - DNA, 15 bp, Homo sapiens
tcttctctcttcaat

SEQ ID NO: 740316 - DNA, 14 bp, Homo sapiens
tcttctcttatcct

SEQ ID NO: 740317 - DNA, 14 bp, Homo sapiens
tcttctcttcctgt

SEQ ID NO: 740318 - DNA, 15 bp, Homo sapiens
tcttctcttcctgta

SEQ ID NO: 740319 - DNA, 15 bp, Homo sapiens
tcttctcttggtgaa

SEQ ID NO: 740320 - DNA, 24 bp, Homo sapiens
tcttctgaactcaaactgaggaat

SEQ ID NO: 740321 - DNA, 14 bp, Homo sapiens
tcttctgacgtgcc

SEQ ID NO: 740322 - DNA, 15 bp, Homo sapiens
tcttctgacgtgcct

SEQ ID NO: 740323 - DNA, 17 bp, Homo sapiens
tcttctgacgtgccttt

SEQ ID NO: 740324 - DNA, 15 bp, Homo sapiens
tcttctgagcactgt

SEQ ID NO: 740325 - DNA, 21 bp, Homo sapiens
tcttctgccacttctgcgggc

SEQ ID NO: 740326 - DNA, 19 bp, Homo sapiens
tcttctgcccctctactgt

SEQ ID NO: 740327 - DNA, 11 bp, Homo sapiens
tcttctgccct

SEQ ID NO: 740328 - DNA, 16 bp, Homo sapiens
tcttctgcctgttata

SEQ ID NO: 740329 - DNA, 13 bp, Homo sapiens
tcttctgctccac

SEQ ID NO: 740330 - DNA, 19 bp, Homo sapiens
tcttctgctccacccttgg

SEQ ID NO: 740331 - DNA, 20 bp, Homo sapiens
tcttctgctccacccttggc

SEQ ID NO: 740332 - DNA, 23 bp, Homo sapiens
tcttctgctccacccttggcctg

SEQ ID NO: 740333 - DNA, 13 bp, Homo sapiens
tcttctgctcctt

SEQ ID NO: 740334 - DNA, 16 bp, Homo sapiens
tcttctgctgttcttc

SEQ ID NO: 740335 - DNA, 18 bp, Homo sapiens
tcttctgcttaggagaga

SEQ ID NO: 740336 - DNA, 14 bp, Homo sapiens
tcttctggaatatt

SEQ ID NO: 740337 - DNA, 19 bp, Homo sapiens
tcttctggagtctccagtg

SEQ ID NO: 740338 - DNA, 16 bp, Homo sapiens
tcttctggagtttctc

SEQ ID NO: 740339 - DNA, 22 bp, Homo sapiens
tcttctgggagggcagcagggc

SEQ ID NO: 740340 - DNA, 18 bp, Homo sapiens
tcttctgggcagagcctg

SEQ ID NO: 740341 - DNA, 19 bp, Homo sapiens
tcttctgggcagagcctgt

SEQ ID NO: 740342 - DNA, 11 bp, Homo sapiens
tcttctgggta

SEQ ID NO: 740343 - DNA, 16 bp, Homo sapiens
tcttctgggtgtgctt

SEQ ID NO: 740344 - DNA, 17 bp, Homo sapiens
tcttctgggtgtgcttt

SEQ ID NO: 740345 - DNA, 14 bp, Homo sapiens
tcttctggttttct

SEQ ID NO: 740346 - DNA, 13 bp, Homo sapiens
tcttctgtggacc

SEQ ID NO: 740347 - DNA, 20 bp, Homo sapiens
ggaaaacaaaagttttaatt

SEQ ID NO: 740348 - DNA, 16 bp, Homo sapiens
ggaaaacctgaagact

SEQ ID NO: 740349 - DNA, 16 bp, Homo sapiens
ggaaaactgacagagg

SEQ ID NO: 740350 - DNA, 14 bp, Homo sapiens
ggaaaactgggaca

SEQ ID NO: 740351 - DNA, 19 bp, Homo sapiens
ggaaaacttaataaaaatt

SEQ ID NO: 740352 - DNA, 14 bp, Homo sapiens
ggaaaagaaacctg

SEQ ID NO: 740353 - DNA, 23 bp, Homo sapiens
ggaaaagaatccctgcagcctgg

SEQ ID NO: 740354 - DNA, 17 bp, Homo sapiens
ggaaaagactgtgggtg

SEQ ID NO: 740355 - DNA, 22 bp, Homo sapiens
ggaaaagataaagaccagaaat

SEQ ID NO: 740356 - DNA, 22 bp, Homo sapiens
ggaaaagcaataaagatttttc

SEQ ID NO: 740357 - DNA, 14 bp, Homo sapiens
ggaaaaggcccctg

SEQ ID NO: 740358 - DNA, 16 bp, Homo sapiens
ggaaaaggcccctgca

SEQ ID NO: 740359 - DNA, 17 bp, Homo sapiens
ggaaaaggcccctgcaa

SEQ ID NO: 740360 - DNA, 17 bp, Homo sapiens
ggaaaagggagaaaaag

SEQ ID NO: 740361 - DNA, 15 bp, Homo sapiens
ggaaaagtacattta

SEQ ID NO: 740362 - DNA, 16 bp, Homo sapiens
ggaaaataaaaatgct

SEQ ID NO: 740363 - DNA, 20 bp, Homo sapiens
ggaaaataaaaatgctataa

SEQ ID NO: 740364 - DNA, 21 bp, Homo sapiens
ggaaaatacctaattgtggat

SEQ ID NO: 740365 - DNA, 19 bp, Homo sapiens
ggaaaataggcaggaagcc

SEQ ID NO: 740366 - DNA, 17 bp, Homo sapiens
ggaaaatggccatgcag

SEQ ID NO: 740367 - DNA, 17 bp, Homo sapiens
ggaaaatgtattgattc

SEQ ID NO: 740368 - DNA, 19 bp, Homo sapiens
ggaaaatgtattgattcaa

SEQ ID NO: 740369 - DNA, 22 bp, Homo sapiens
ggaaaatgtttccttgtgcctg

SEQ ID NO: 740370 - DNA, 14 bp, Homo sapiens
ggaaaattcatttt

SEQ ID NO: 740371 - DNA, 18 bp, Homo sapiens
ggaaaattttaaaaatac

SEQ ID NO: 740372 - DNA, 21 bp, Homo sapiens
ggaaacaaagtttacattgtc

SEQ ID NO: 740373 - DNA, 13 bp, Homo sapiens
ggaaacaacagct

SEQ ID NO: 740374 - DNA, 16 bp, Homo sapiens
ggaaacaagggaaggg

SEQ ID NO: 740375 - DNA, 13 bp, Homo sapiens
ggaaacaatgaaa

SEQ ID NO: 740376 - DNA, 22 bp, Homo sapiens
ggaaacagactcgattcatatt

SEQ ID NO: 740377 - DNA, 14 bp, Homo sapiens
ggaaacagcatgaa

SEQ ID NO: 740378 - DNA, 20 bp, Homo sapiens
ggaaacaggctccaagaggc

SEQ ID NO: 740379 - DNA, 13 bp, Homo sapiens
ggaaacaggtgtg

SEQ ID NO: 740380 - DNA, 23 bp, Homo sapiens
ggaaacatacagaggatgccttt

SEQ ID NO: 740381 - DNA, 18 bp, Homo sapiens
ggaaacattacagttcat

SEQ ID NO: 740382 - DNA, 22 bp, Homo sapiens
ggaaacattttatactgtacat

SEQ ID NO: 740383 - DNA, 23 bp, Homo sapiens
ggaaacattttatactgtacatg

SEQ ID NO: 740384 - DNA, 20 bp, Homo sapiens
ggaaaccaagtcaggccagg

SEQ ID NO: 740385 - DNA, 22 bp, Homo sapiens
ggaaaccaagtcaggccaggtg

SEQ ID NO: 740386 - DNA, 23 bp, Homo sapiens
ggaaaccagctcgtgggctggga

SEQ ID NO: 740387 - DNA, 17 bp, Homo sapiens
ggaaaccctggagccat

SEQ ID NO: 740388 - DNA, 17 bp, Homo sapiens
ggaaaccgtgtgtccag

SEQ ID NO: 740389 - DNA, 18 bp, Homo sapiens
ggaaacctgccctgcctg

SEQ ID NO: 740390 - DNA, 19 bp, Homo sapiens
ggaaaccttggagaggaga

SEQ ID NO: 740391 - DNA, 22 bp, Homo sapiens
ggaaacggtatcctccctgccc

SEQ ID NO: 740392 - DNA, 14 bp, Homo sapiens
ggaaactcagatgt

SEQ ID NO: 740393 - DNA, 16 bp, Homo sapiens
ggaaactcagatgtcc

SEQ ID NO: 740394 - DNA, 17 bp, Homo sapiens
ggaaactcagatgtcca

SEQ ID NO: 740395 - DNA, 20 bp, Homo sapiens
ggaaactccacatctgcctt

SEQ ID NO: 740396 - DNA, 13 bp, Homo sapiens
ggaaactggctga

SEQ ID NO: 740397 - DNA, 13 bp, Homo sapiens
ggaaactttattt

SEQ ID NO: 740398 - DNA, 22 bp, Homo sapiens
ggaaagaaagcacctgttttta

SEQ ID NO: 740399 - DNA, 12 bp, Homo sapiens
ggaaagaagaaa

SEQ ID NO: 740400 - DNA, 20 bp, Homo sapiens
tcttgggggggtggccgctg

SEQ ID NO: 740401 - DNA, 14 bp, Homo sapiens
tcttgggggtcagg

SEQ ID NO: 740402 - DNA, 16 bp, Homo sapiens
tcttggggtcccaggg

SEQ ID NO: 740403 - DNA, 16 bp, Homo sapiens
tcttgggtaggcggga

SEQ ID NO: 740404 - DNA, 15 bp, Homo sapiens
tcttgggtctgccct

SEQ ID NO: 740405 - DNA, 23 bp, Homo sapiens
tcttgggtggttcctaagggaaa

SEQ ID NO: 740406 - DNA, 15 bp, Homo sapiens
tcttgggtgtattct

SEQ ID NO: 740407 - DNA, 14 bp, Homo sapiens
tcttggtaagaagc

SEQ ID NO: 740408 - DNA, 15 bp, Homo sapiens
tcttggtagagattc

SEQ ID NO: 740409 - DNA, 19 bp, Homo sapiens
tcttggtagttctgtgcct

SEQ ID NO: 740410 - DNA, 14 bp, Homo sapiens
tcttggtattctta

SEQ ID NO: 740411 - DNA, 14 bp, Homo sapiens
tcttggtccctggt

SEQ ID NO: 740412 - DNA, 14 bp, Homo sapiens
tcttggtgaaataa

SEQ ID NO: 740413 - DNA, 20 bp, Homo sapiens
tcttggtgaaataataaaat

SEQ ID NO: 740414 - DNA, 13 bp, Homo sapiens
tcttggtgcccag

SEQ ID NO: 740415 - DNA, 23 bp, Homo sapiens
tcttggtgccttttgtgtgatgc

SEQ ID NO: 740416 - DNA, 14 bp, Homo sapiens
tcttggtgtaattt

SEQ ID NO: 740417 - DNA, 13 bp, Homo sapiens
tcttggttcctgg

SEQ ID NO: 740418 - DNA, 14 bp, Homo sapiens
tcttggttcctggg

SEQ ID NO: 740419 - DNA, 13 bp, Homo sapiens
tcttggttctaaa

SEQ ID NO: 740420 - DNA, 15 bp, Homo sapiens
tcttggttctaaagg

SEQ ID NO: 740421 - DNA, 20 bp, Homo sapiens
tcttggttcttatttaagta

SEQ ID NO: 740422 - DNA, 23 bp, Homo sapiens
tcttggttgaaaataaaaagatc

SEQ ID NO: 740423 - DNA, 21 bp, Homo sapiens
tcttggtttctggataaacca

SEQ ID NO: 740424 - DNA, 14 bp, Homo sapiens
tcttggtttgggga

SEQ ID NO: 740425 - DNA, 16 bp, Homo sapiens
tcttggtttggggaga

SEQ ID NO: 740426 - DNA, 20 bp, Homo sapiens
tcttggtttggggagaaata

SEQ ID NO: 740427 - DNA, 15 bp, Homo sapiens
tcttggttttctctc

SEQ ID NO: 740428 - DNA, 15 bp, Homo sapiens
tcttgtaaatctttt

SEQ ID NO: 740429 - DNA, 14 bp, Homo sapiens
tcttgtaaatgttt

SEQ ID NO: 740430 - DNA, 16 bp, Homo sapiens
tcttgtaaatgtttct

SEQ ID NO: 740431 - DNA, 11 bp, Homo sapiens
tcttgtaccat

SEQ ID NO: 740432 - DNA, 20 bp, Homo sapiens
tcttgtaccatagaaaaatg

SEQ ID NO: 740433 - DNA, 12 bp, Homo sapiens
tcttgtacttct

SEQ ID NO: 740434 - DNA, 14 bp, Homo sapiens
tcttgtacttctgt

SEQ ID NO: 740435 - DNA, 16 bp, Homo sapiens
tcttgtacttctgtgt

SEQ ID NO: 740436 - DNA, 20 bp, Homo sapiens
tcttgtacttctgtgttcat

SEQ ID NO: 740437 - DNA, 17 bp, Homo sapiens
tcttgtagccatggctg

SEQ ID NO: 740438 - DNA, 22 bp, Homo sapiens
tcttgtatttattggttttgca

SEQ ID NO: 740439 - DNA, 17 bp, Homo sapiens
tcttgtcaacatgcatt

SEQ ID NO: 740440 - DNA, 17 bp, Homo sapiens
tcttgtcataaaatgca

SEQ ID NO: 740441 - DNA, 18 bp, Homo sapiens
tcttgtcataaaatgcat

SEQ ID NO: 740442 - DNA, 16 bp, Homo sapiens
tcttgtcatacaaatt

SEQ ID NO: 740443 - DNA, 21 bp, Homo sapiens
tcttgtcatacaaatttataa

SEQ ID NO: 740444 - DNA, 12 bp, Homo sapiens
tcttgtcatttt

SEQ ID NO: 740445 - DNA, 19 bp, Homo sapiens
tcttgtcatttttaatatt

SEQ ID NO: 740446 - DNA, 14 bp, Homo sapiens
tcttgtccacattc

SEQ ID NO: 740447 - DNA, 20 bp, Homo sapiens
tcttgtcccacgtgtcttcc

SEQ ID NO: 740448 - DNA, 23 bp, Homo sapiens
tcttgtcccacgtgtcttccact

SEQ ID NO: 740449 - DNA, 15 bp, Homo sapiens
tcttgtcccttggca

SEQ ID NO: 740450 - DNA, 20 bp, Homo sapiens
tcttgtccctttccctacct

SEQ ID NO: 740451 - DNA, 13 bp, Homo sapiens
tcttgtcctggaa

SEQ ID NO: 740452 - DNA, 12 bp, Homo sapiens
tcttgtctcccc

SEQ ID NO: 740453 - DNA, 13 bp, Homo sapiens
tcttgtctcccct

SEQ ID NO: 740454 - DNA, 21 bp, Homo sapiens
tcttgtgacatattatgtctt

SEQ ID NO: 740455 - DNA, 21 bp, Homo sapiens
tcttgtgactcagcagaggca

SEQ ID NO: 740456 - DNA, 11 bp, Homo sapiens
tcttgtgcatg

SEQ ID NO: 740457 - DNA, 13 bp, Homo sapiens
tcttgtgcatgtt

SEQ ID NO: 740458 - DNA, 17 bp, Homo sapiens
tcttgtgcatgtttact

SEQ ID NO: 740459 - DNA, 17 bp, Homo sapiens
tcttgtgctagaatact

SEQ ID NO: 740460 - DNA, 15 bp, Homo sapiens
tcttgtgctcacgct

SEQ ID NO: 740461 - DNA, 13 bp, Homo sapiens
tcttgtgcttctt

SEQ ID NO: 740462 - DNA, 22 bp, Homo sapiens
tcttgtggaagtgcatctactt

SEQ ID NO: 740463 - DNA, 23 bp, Homo sapiens
tcttgtggaagtgcatctacttg

SEQ ID NO: 740464 - DNA, 15 bp, Homo sapiens
tcttgtggggccagg

SEQ ID NO: 740465 - DNA, 16 bp, Homo sapiens
tcttgtggggccagga

SEQ ID NO: 740466 - DNA, 19 bp, Homo sapiens
tcttgtggttataacttaa

SEQ ID NO: 740467 - DNA, 23 bp, Homo sapiens
tcttgtggttataacttaatgaa

SEQ ID NO: 740468 - DNA, 17 bp, Homo sapiens
tcttgtgtcttgagagc

SEQ ID NO: 740469 - DNA, 15 bp, Homo sapiens
tcttgtgtctttgga

SEQ ID NO: 740470 - DNA, 13 bp, Homo sapiens
tcttgtgtttgct

SEQ ID NO: 740471 - DNA, 15 bp, Homo sapiens
tcttgtgtttgctgc

SEQ ID NO: 740472 - DNA, 19 bp, Homo sapiens
tcttgttatggtagaaaaa

SEQ ID NO: 740473 - DNA, 16 bp, Homo sapiens
tcttgttatgtacaaa

SEQ ID NO: 740474 - DNA, 20 bp, Homo sapiens
tcttgttattaatgtttctt

SEQ ID NO: 740475 - DNA, 16 bp, Homo sapiens
tcttgttgcatctttt

SEQ ID NO: 740476 - DNA, 17 bp, Homo sapiens
tcttgttgcatcttttc

SEQ ID NO: 740477 - DNA, 18 bp, Homo sapiens
tcttgttgctgtacaaaa

SEQ ID NO: 740478 - DNA, 17 bp, Homo sapiens
tcttgttggtgcacagc

SEQ ID NO: 740479 - DNA, 10 bp, Homo sapiens
tcttgtttaa

SEQ ID NO: 740480 - DNA, 11 bp, Homo sapiens
tcttgtttaac

SEQ ID NO: 740481 - DNA, 23 bp, Homo sapiens
tcttgtttacgatttcactagga

SEQ ID NO: 740482 - DNA, 17 bp, Homo sapiens
ggaagatttggaagctc

SEQ ID NO: 740483 - DNA, 18 bp, Homo sapiens
ggaagattttaaattcac

SEQ ID NO: 740484 - DNA, 19 bp, Homo sapiens
ggaagattttatgcacagc

SEQ ID NO: 740485 - DNA, 18 bp, Homo sapiens
ggaagattttggtaatga

SEQ ID NO: 740486 - DNA, 15 bp, Homo sapiens
ggaagcaaagacaaa

SEQ ID NO: 740487 - DNA, 18 bp, Homo sapiens
ggaagcaaaggggggagg

SEQ ID NO: 740488 - DNA, 19 bp, Homo sapiens
ggaagcacagcctcgggga

SEQ ID NO: 740489 - DNA, 22 bp, Homo sapiens
ggaagcacagcctcggggatgg

SEQ ID NO: 740490 - DNA, 14 bp, Homo sapiens
ggaagcacagcttg

SEQ ID NO: 740491 - DNA, 15 bp, Homo sapiens
ggaagcacagcttgg

SEQ ID NO: 740492 - DNA, 13 bp, Homo sapiens
ggaagcaggacag

SEQ ID NO: 740493 - DNA, 14 bp, Homo sapiens
ggaagcagggaatt

SEQ ID NO: 740494 - DNA, 19 bp, Homo sapiens
ggaagcagggaattcctgg

SEQ ID NO: 740495 - DNA, 13 bp, Homo sapiens
ggaagcagggaga

SEQ ID NO: 740496 - DNA, 11 bp, Homo sapiens
ggaagcagtgc

SEQ ID NO: 740497 - DNA, 20 bp, Homo sapiens
ggaagcagtgccttccataa

SEQ ID NO: 740498 - DNA, 16 bp, Homo sapiens
ggaagcatggctgtct

SEQ ID NO: 740499 - DNA, 17 bp, Homo sapiens
ggaagcatgtaggagaa

SEQ ID NO: 740500 - DNA, 23 bp, Homo sapiens
ggaagccagagccccaagcagga

SEQ ID NO: 740501 - DNA, 21 bp, Homo sapiens
ggaagccaggtacaggagagg

SEQ ID NO: 740502 - DNA, 17 bp, Homo sapiens
ggaagccagtcaccttc

SEQ ID NO: 740503 - DNA, 18 bp, Homo sapiens
ggaagccagtggagctgg

SEQ ID NO: 740504 - DNA, 18 bp, Homo sapiens
ggaagccatagggggctg

SEQ ID NO: 740505 - DNA, 21 bp, Homo sapiens
ggaagccatagggggctgcac

SEQ ID NO: 740506 - DNA, 17 bp, Homo sapiens
ggaagccatcctgccct

SEQ ID NO: 740507 - DNA, 23 bp, Homo sapiens
ggaagcccagcccctactgctgt

SEQ ID NO: 740508 - DNA, 14 bp, Homo sapiens
ggaagcccatcctg

SEQ ID NO: 740509 - DNA, 18 bp, Homo sapiens
ggaagcccatcctgacca

SEQ ID NO: 740510 - DNA, 20 bp, Homo sapiens
ggaagcccatcctgaccagc

SEQ ID NO: 740511 - DNA, 18 bp, Homo sapiens
ggaagccccctcttcctc

SEQ ID NO: 740512 - DNA, 15 bp, Homo sapiens
ggaagcccctgggcc

SEQ ID NO: 740513 - DNA, 16 bp, Homo sapiens
ggaagccctccttcca

SEQ ID NO: 740514 - DNA, 17 bp, Homo sapiens
ggaagccctccttccac

SEQ ID NO: 740515 - DNA, 20 bp, Homo sapiens
ggaagccggagggtgtttat

SEQ ID NO: 740516 - DNA, 20 bp, Homo sapiens
ggaagccggcggcccaagcc

SEQ ID NO: 740517 - DNA, 17 bp, Homo sapiens
ggaagccgtctgactcc

SEQ ID NO: 740518 - DNA, 22 bp, Homo sapiens
ggaagcctgaactgaggccttg

SEQ ID NO: 740519 - DNA, 13 bp, Homo sapiens
ggaagcctgagca

SEQ ID NO: 740520 - DNA, 20 bp, Homo sapiens
ggaagcctggactctaagct

SEQ ID NO: 740521 - DNA, 17 bp, Homo sapiens
ggaagcctgtgccagca

SEQ ID NO: 740522 - DNA, 15 bp, Homo sapiens
ggaagccttgctcat

SEQ ID NO: 740523 - DNA, 23 bp, Homo sapiens
ggaatatgttcaatgcaaagtaa

SEQ ID NO: 740524 - DNA, 22 bp, Homo sapiens
ggaatattcccctatctctaga

SEQ ID NO: 740525 - DNA, 15 bp, Homo sapiens
ggaatattttatcct

SEQ ID NO: 740526 - DNA, 22 bp, Homo sapiens
ggaatcaagatgtcagactggc

SEQ ID NO: 740527 - DNA, 17 bp, Homo sapiens
ggaatcaattatttatg

SEQ ID NO: 740528 - DNA, 23 bp, Homo sapiens
ggaatcactggggatggtggcac

SEQ ID NO: 740529 - DNA, 23 bp, Homo sapiens
ggaatcagacttcacactgcaag

SEQ ID NO: 740530 - DNA, 19 bp, Homo sapiens
ggaatcatgtcaggcctgt

SEQ ID NO: 740531 - DNA, 22 bp, Homo sapiens
ggaatcattccagtgctagaaa

SEQ ID NO: 740532 - DNA, 21 bp, Homo sapiens
ggaatccaagcctccacagcg

SEQ ID NO: 740533 - DNA, 15 bp, Homo sapiens
ggaatccatcctgca

SEQ ID NO: 740534 - DNA, 19 bp, Homo sapiens
ggaatcctcctccagggtg

SEQ ID NO: 740535 - DNA, 21 bp, Homo sapiens
ggaatcgaggaaccagagcca

SEQ ID NO: 740536 - DNA, 20 bp, Homo sapiens
ggaatctgccttccagccca

SEQ ID NO: 740537 - DNA, 13 bp, Homo sapiens
ggaatctggatta

SEQ ID NO: 740538 - DNA, 23 bp, Homo sapiens
ggaatctggcattctacacctgg

SEQ ID NO: 740539 - DNA, 19 bp, Homo sapiens
ggaatcttcacctcagagt

SEQ ID NO: 740540 - DNA, 22 bp, Homo sapiens
ggaatcttcacctcagagtgga

SEQ ID NO: 740541 - DNA, 22 bp, Homo sapiens
ggaatcttggagcctaaagaga

SEQ ID NO: 740542 - DNA, 21 bp, Homo sapiens
ggaatctttgtaccaaaattt

SEQ ID NO: 740543 - DNA, 11 bp, Homo sapiens
ggaatctttta

SEQ ID NO: 740544 - DNA, 19 bp, Homo sapiens
ggaatgagtcaatcagcct

SEQ ID NO: 740545 - DNA, 21 bp, Homo sapiens
ggaatgagtcaatcagccttt

SEQ ID NO: 740546 - DNA, 18 bp, Homo sapiens
ggaatgatgggcttttgt

SEQ ID NO: 740547 - DNA, 17 bp, Homo sapiens
ggaatgcacctccccaa

SEQ ID NO: 740548 - DNA, 12 bp, Homo sapiens
ggaatgcaggga

SEQ ID NO: 740549 - DNA, 19 bp, Homo sapiens
ggaatgcccttcactgtca

SEQ ID NO: 740550 - DNA, 14 bp, Homo sapiens
ggaatgcctggagg

SEQ ID NO: 740551 - DNA, 15 bp, Homo sapiens
ggaatgcctgtgcca

SEQ ID NO: 740552 - DNA, 13 bp, Homo sapiens
ggaatgccttgga

SEQ ID NO: 740553 - DNA, 14 bp, Homo sapiens
ggaatgcggcaaga

SEQ ID NO: 740554 - DNA, 23 bp, Homo sapiens
ggaatgcggccgcattccctgag

SEQ ID NO: 740555 - DNA, 13 bp, Homo sapiens
ggaatgctccccc

SEQ ID NO: 740556 - DNA, 18 bp, Homo sapiens
ggaatgctctgtgccaga

SEQ ID NO: 740557 - DNA, 16 bp, Homo sapiens
ggaatgctgaggcctc

SEQ ID NO: 740558 - DNA, 14 bp, Homo sapiens
ggaatgctgggccc

SEQ ID NO: 740559 - DNA, 15 bp, Homo sapiens
ggaatggaataacta

SEQ ID NO: 740560 - DNA, 17 bp, Homo sapiens
ggaatggatggggagaa

SEQ ID NO: 740561 - DNA, 22 bp, Homo sapiens
ggaatggatttttctttaactg

SEQ ID NO: 740562 - DNA, 16 bp, Homo sapiens
ggaatgggagaggggt

SEQ ID NO: 740563 - DNA, 20 bp, Homo sapiens
ggaatggggggcgggccagg

SEQ ID NO: 740564 - DNA, 11 bp, Homo sapiens
ggaatgtaaag

SEQ ID NO: 740565 - DNA, 18 bp, Homo sapiens
ggaatgtacagtattttg

SEQ ID NO: 740566 - DNA, 16 bp, Homo sapiens
ggaatgtcagggccag

SEQ ID NO: 740567 - DNA, 19 bp, Homo sapiens
ggaatgtgccacctgtccg

SEQ ID NO: 740568 - DNA, 19 bp, Homo sapiens
ggaatgtgtccaagacaca

SEQ ID NO: 740569 - DNA, 16 bp, Homo sapiens
ggaatgttaaagtcag

SEQ ID NO: 740570 - DNA, 21 bp, Homo sapiens
ggaatgttccctgcaccctgg

SEQ ID NO: 740571 - DNA, 20 bp, Homo sapiens
ggaatgttggataaggaatt

SEQ ID NO: 740572 - DNA, 19 bp, Homo sapiens
ggaatgtttgggcagaagg

SEQ ID NO: 740573 - DNA, 14 bp, Homo sapiens
ggaattaacctggt

SEQ ID NO: 740574 - DNA, 15 bp, Homo sapiens
ggaattactttcctc

SEQ ID NO: 740575 - DNA, 21 bp, Homo sapiens
ggaattcagcaccctgggtgc

SEQ ID NO: 740576 - DNA, 20 bp, Homo sapiens
ggaattccaacttgaaggat

SEQ ID NO: 740577 - DNA, 22 bp, Homo sapiens
ggaattccaacttgaaggattg

SEQ ID NO: 740578 - DNA, 14 bp, Homo sapiens
ggaattccctcctg

SEQ ID NO: 740579 - DNA, 16 bp, Homo sapiens
ggaattctactggaaa

SEQ ID NO: 740580 - DNA, 18 bp, Homo sapiens
ggaattcttcctcctctg

SEQ ID NO: 740581 - DNA, 17 bp, Homo sapiens
ggaattgattgtcagcc

SEQ ID NO: 740582 - DNA, 19 bp, Homo sapiens
ggaattgatttgcattgaa

SEQ ID NO: 740583 - DNA, 18 bp, Homo sapiens
ggaattgcttctgtgtag

SEQ ID NO: 740584 - DNA, 15 bp, Homo sapiens
ggaatttaaaattaa

SEQ ID NO: 740585 - DNA, 15 bp, Homo sapiens
ggaatttactttctt

SEQ ID NO: 740586 - DNA, 18 bp, Homo sapiens
ggaatttccctgtgtgga

SEQ ID NO: 740587 - DNA, 11 bp, Homo sapiens
ggaatttcctc

SEQ ID NO: 740588 - DNA, 19 bp, Homo sapiens
ggaatttctgctgtggtct

SEQ ID NO: 740589 - DNA, 14 bp, Homo sapiens
ggaatttggctgct

SEQ ID NO: 740590 - DNA, 17 bp, Homo sapiens
ggaatttgtaacctcag

SEQ ID NO: 740591 - DNA, 18 bp, Homo sapiens
ggaatttgtaacctcagc

SEQ ID NO: 740592 - DNA, 13 bp, Homo sapiens
ggaatttgtactt

SEQ ID NO: 740593 - DNA, 14 bp, Homo sapiens
ggaatttgtacttc

SEQ ID NO: 740594 - DNA, 21 bp, Homo sapiens
ggaatttgttcaagttttggg

SEQ ID NO: 740595 - DNA, 15 bp, Homo sapiens
ggacaaaacccacct

SEQ ID NO: 740596 - DNA, 18 bp, Homo sapiens
ggacaaaacccaccttgt

SEQ ID NO: 740597 - DNA, 14 bp, Homo sapiens
ggacaaaagggcca

SEQ ID NO: 740598 - DNA, 20 bp, Homo sapiens
ggacaaattagcatgcaagc

SEQ ID NO: 740599 - DNA, 12 bp, Homo sapiens
ggacaacactga

SEQ ID NO: 740600 - DNA, 22 bp, Homo sapiens
ggacaacactgattcctggaga

SEQ ID NO: 740601 - DNA, 19 bp, Homo sapiens
ggacaaccccccaagacca

SEQ ID NO: 740602 - DNA, 15 bp, Homo sapiens
ggacaacttatttaa

SEQ ID NO: 740603 - DNA, 17 bp, Homo sapiens
ggacaacttatttaaaa

SEQ ID NO: 740604 - DNA, 21 bp, Homo sapiens
ggacaacttatttaaaaatat

SEQ ID NO: 740605 - DNA, 18 bp, Homo sapiens
ggacaagggaggcagtgg

SEQ ID NO: 740606 - DNA, 23 bp, Homo sapiens
ggacaatataaactgaaaaatgt

SEQ ID NO: 740607 - DNA, 18 bp, Homo sapiens
ggacacaaaactccgccc

SEQ ID NO: 740608 - DNA, 20 bp, Homo sapiens
ggacacaaaactccgccccc

SEQ ID NO: 740609 - DNA, 16 bp, Homo sapiens
ggacacaaggcacggc

SEQ ID NO: 740610 - DNA, 13 bp, Homo sapiens
ggacacacagcct

SEQ ID NO: 740611 - DNA, 19 bp, Homo sapiens
ggacacacatggtgagcct

SEQ ID NO: 740612 - DNA, 21 bp, Homo sapiens
ggacacactaaactctggggc

SEQ ID NO: 740613 - DNA, 13 bp, Homo sapiens
ggacacagaccca

SEQ ID NO: 740614 - DNA, 16 bp, Homo sapiens
ggacacagcagtattg

SEQ ID NO: 740615 - DNA, 16 bp, Homo sapiens
ggacacagttcctggg

SEQ ID NO: 740616 - DNA, 22 bp, Homo sapiens
ggacacatcccggcctcttcca

SEQ ID NO: 740617 - DNA, 21 bp, Homo sapiens
ggacacattggaatgccttgg

SEQ ID NO: 740618 - DNA, 12 bp, Homo sapiens
ggacaccagagc

SEQ ID NO: 740619 - DNA, 23 bp, Homo sapiens
ggacaccatcccctcctagcaca

SEQ ID NO: 740620 - DNA, 20 bp, Homo sapiens
ggacaccccttatccaggac

SEQ ID NO: 740621 - DNA, 17 bp, Homo sapiens
ggacaccgctcagtatt

SEQ ID NO: 740622 - DNA, 18 bp, Homo sapiens
ggacaccgtggcctgggc

SEQ ID NO: 740623 - DNA, 17 bp, Homo sapiens
ggacaccgtggggaagg

SEQ ID NO: 740624 - DNA, 18 bp, Homo sapiens
ggacaccgtggggaaggg

SEQ ID NO: 740625 - DNA, 19 bp, Homo sapiens
ggacaccgtggggaagggg

SEQ ID NO: 740626 - DNA, 22 bp, Homo sapiens
ggacaccgtggggaaggggtgc

SEQ ID NO: 740627 - DNA, 12 bp, Homo sapiens
ggacacctccca

SEQ ID NO: 740628 - DNA, 13 bp, Homo sapiens
ggacacctcccag

SEQ ID NO: 740629 - DNA, 15 bp, Homo sapiens
ggacacctcccaggg

SEQ ID NO: 740630 - DNA, 15 bp, Homo sapiens
ggacacctgccctgc

SEQ ID NO: 740631 - DNA, 16 bp, Homo sapiens
ggacacctgccctgcc

SEQ ID NO: 740632 - DNA, 19 bp, Homo sapiens
ggacacctgggccgggctg

SEQ ID NO: 740633 - DNA, 20 bp, Homo sapiens
ggacacgcgcgtcgccgcca

SEQ ID NO: 740634 - DNA, 18 bp, Homo sapiens
ggacactccagtgccagc

SEQ ID NO: 740635 - DNA, 18 bp, Homo sapiens
ggacactccatgagtgtc

SEQ ID NO: 740636 - DNA, 13 bp, Homo sapiens
ggacactggcccc

SEQ ID NO: 740637 - DNA, 16 bp, Homo sapiens
ggacactggccccaca

SEQ ID NO: 740638 - DNA, 17 bp, Homo sapiens
ggacactggccccacag

SEQ ID NO: 740639 - DNA, 13 bp, Homo sapiens
ggacactgggcag

SEQ ID NO: 740640 - DNA, 18 bp, Homo sapiens
ggacacttaacagatgca

SEQ ID NO: 740641 - DNA, 21 bp, Homo sapiens
ggacacttggttagacgcctt

SEQ ID NO: 740642 - DNA, 17 bp, Homo sapiens
ggacagacacctccccc

SEQ ID NO: 740643 - DNA, 18 bp, Homo sapiens
ggacagacactgttgcaa

SEQ ID NO: 740644 - DNA, 16 bp, Homo sapiens
ggacgtcgcggtgtgt

SEQ ID NO: 740645 - DNA, 17 bp, Homo sapiens
ggacgtgcactgacagc

SEQ ID NO: 740646 - DNA, 21 bp, Homo sapiens
ggacgtgctggccttggtatg

SEQ ID NO: 740647 - DNA, 14 bp, Homo sapiens
ggacgtgggccctg

SEQ ID NO: 740648 - DNA, 15 bp, Homo sapiens
ggacgtgggccctgc

SEQ ID NO: 740649 - DNA, 12 bp, Homo sapiens
ggacgtttctca

SEQ ID NO: 740650 - DNA, 20 bp, Homo sapiens
ggactaaaacattttgacta

SEQ ID NO: 740651 - DNA, 16 bp, Homo sapiens
ggactaagtgggagaa

SEQ ID NO: 740652 - DNA, 15 bp, Homo sapiens
ggactaccgcaggcc

SEQ ID NO: 740653 - DNA, 18 bp, Homo sapiens
ggactaccgcaggcccgg

SEQ ID NO: 740654 - DNA, 21 bp, Homo sapiens
ggactagagggacctctccca

SEQ ID NO: 740655 - DNA, 18 bp, Homo sapiens
ggactagtgagtcagcac

SEQ ID NO: 740656 - DNA, 20 bp, Homo sapiens
ggactagtgagtcagcacct

SEQ ID NO: 740657 - DNA, 14 bp, Homo sapiens
ggactagtgtccta

SEQ ID NO: 740658 - DNA, 14 bp, Homo sapiens
ggactatcaggtaa

SEQ ID NO: 740659 - DNA, 18 bp, Homo sapiens
ggactcaccctccacaaa

SEQ ID NO: 740660 - DNA, 16 bp, Homo sapiens
ggactcagcagtgacc

SEQ ID NO: 740661 - DNA, 15 bp, Homo sapiens
ggactcagccttcag

SEQ ID NO: 740662 - DNA, 21 bp, Homo sapiens
ggactcagccttcagacagag

SEQ ID NO: 740663 - DNA, 13 bp, Homo sapiens
ggactcaggatcc

SEQ ID NO: 740664 - DNA, 13 bp, Homo sapiens
ggactcagggcag

SEQ ID NO: 740665 - DNA, 15 bp, Homo sapiens
ggactcagggcagcg

SEQ ID NO: 740666 - DNA, 22 bp, Homo sapiens
ggactcaggtctgtaactgccc

SEQ ID NO: 740667 - DNA, 24 bp, Homo sapiens
ggactcatttcattcctaacacag

SEQ ID NO: 740668 - DNA, 21 bp, Homo sapiens
ggactccaggcagcagacaca

SEQ ID NO: 740669 - DNA, 22 bp, Homo sapiens
ggactccaggcagcagacacat

SEQ ID NO: 740670 - DNA, 14 bp, Homo sapiens
ggactccaggccca

SEQ ID NO: 740671 - DNA, 15 bp, Homo sapiens
ggactccaggcccaa

SEQ ID NO: 740672 - DNA, 11 bp, Homo sapiens
ggactccatct

SEQ ID NO: 740673 - DNA, 22 bp, Homo sapiens
ggactccatctctcatcctcca

SEQ ID NO: 740674 - DNA, 17 bp, Homo sapiens
ggactccatttctttct

SEQ ID NO: 740675 - DNA, 18 bp, Homo sapiens
ggactcccaaccctggct

SEQ ID NO: 740676 - DNA, 19 bp, Homo sapiens
ggactcccagcagagccca

SEQ ID NO: 740677 - DNA, 19 bp, Homo sapiens
ggactcccgggccacgccc

SEQ ID NO: 740678 - DNA, 22 bp, Homo sapiens
ggactccctcctcacctctgga

SEQ ID NO: 740679 - DNA, 17 bp, Homo sapiens
ggactccggaggactga

SEQ ID NO: 740680 - DNA, 20 bp, Homo sapiens
ggactccggaggactgagcc

SEQ ID NO: 740681 - DNA, 21 bp, Homo sapiens
ggactccggaggactgagccc

SEQ ID NO: 740682 - DNA, 16 bp, Homo sapiens
ggactccggccctcct

SEQ ID NO: 740683 - DNA, 18 bp, Homo sapiens
ggactcctcaaaccactt

SEQ ID NO: 740684 - DNA, 21 bp, Homo sapiens
ggactcctcaaaccacttgcc

SEQ ID NO: 740685 - DNA, 13 bp, Homo sapiens
ggactcctcccac

SEQ ID NO: 740686 - DNA, 14 bp, Homo sapiens
ggactcctctgtcc

SEQ ID NO: 740687 - DNA, 17 bp, Homo sapiens
ggactcctgccaccagc

SEQ ID NO: 740688 - DNA, 14 bp, Homo sapiens
ggactcctggcagg

SEQ ID NO: 740689 - DNA, 21 bp, Homo sapiens
ggactcggagactatggcctc

SEQ ID NO: 740690 - DNA, 22 bp, Homo sapiens
ggactcggccactgtgtctctg

SEQ ID NO: 740691 - DNA, 18 bp, Homo sapiens
ggactctaagctggagct

SEQ ID NO: 740692 - DNA, 20 bp, Homo sapiens
ggactctcagggattctggg

SEQ ID NO: 740693 - DNA, 18 bp, Homo sapiens
ggactctcagtctctgag

SEQ ID NO: 740694 - DNA, 20 bp, Homo sapiens
ggactctcagtctctgagca

SEQ ID NO: 740695 - DNA, 21 bp, Homo sapiens
ggactctcagtctctgagcag

SEQ ID NO: 740696 - DNA, 16 bp, Homo sapiens
ggactctcctcctccc

SEQ ID NO: 740697 - DNA, 19 bp, Homo sapiens
ggactctcctcctcccctc

SEQ ID NO: 740698 - DNA, 15 bp, Homo sapiens
ggactctgagcggga

SEQ ID NO: 740699 - DNA, 21 bp, Homo sapiens
ggactctgagcgggaggcaga

SEQ ID NO: 740700 - DNA, 11 bp, Homo sapiens
ggactctgagg

SEQ ID NO: 740701 - DNA, 20 bp, Homo sapiens
ggactctgaggactcctgag

SEQ ID NO: 740702 - DNA, 14 bp, Homo sapiens
ggactctgcccctg

SEQ ID NO: 740703 - DNA, 16 bp, Homo sapiens
ggactctgcccctgga

SEQ ID NO: 740704 - DNA, 18 bp, Homo sapiens
ggactctgcgggaggctg

SEQ ID NO: 740705 - DNA, 12 bp, Homo sapiens
ggactctggcac

SEQ ID NO: 740706 - DNA, 17 bp, Homo sapiens
ggactctggcacttcca

SEQ ID NO: 740707 - DNA, 20 bp, Homo sapiens
ggactctgggctatggacac

SEQ ID NO: 740708 - DNA, 18 bp, Homo sapiens
ggactgaaaacctctcct

SEQ ID NO: 740709 - DNA, 13 bp, Homo sapiens
ggactgaactcca

SEQ ID NO: 740710 - DNA, 16 bp, Homo sapiens
ggactgaagcctgcag

SEQ ID NO: 740711 - DNA, 19 bp, Homo sapiens
ggactgaattgtccccagt

SEQ ID NO: 740712 - DNA, 20 bp, Homo sapiens
ggactgacagcatgtgccct

SEQ ID NO: 740713 - DNA, 14 bp, Homo sapiens
ggactgagccctct

SEQ ID NO: 740714 - DNA, 19 bp, Homo sapiens
ggactgagccctctcactc

SEQ ID NO: 740715 - DNA, 15 bp, Homo sapiens
ggactgaggtgcctg

SEQ ID NO: 740716 - DNA, 17 bp, Homo sapiens
ggactgagtgggaagcc

SEQ ID NO: 740717 - DNA, 22 bp, Homo sapiens
ggactgcacagcgtcctgtcca

SEQ ID NO: 740718 - DNA, 23 bp, Homo sapiens
ggactgcagctgcaccagcaggt

SEQ ID NO: 740719 - DNA, 22 bp, Homo sapiens
ggactgcagtcggcatgccagg

SEQ ID NO: 740720 - DNA, 23 bp, Homo sapiens
ggactgcagtcggcatgccagga

SEQ ID NO: 740721 - DNA, 11 bp, Homo sapiens
ggactgcatgg

SEQ ID NO: 740722 - DNA, 14 bp, Homo sapiens
ggactgcccccaga

SEQ ID NO: 740723 - DNA, 16 bp, Homo sapiens
ggactgctcaggaaac

SEQ ID NO: 740724 - DNA, 18 bp, Homo sapiens
ggactgctgctgcctggc

SEQ ID NO: 740725 - DNA, 20 bp, Homo sapiens
ggactgctgctgcctggcca

SEQ ID NO: 740726 - DNA, 12 bp, Homo sapiens
ggactgctggct

SEQ ID NO: 740727 - DNA, 17 bp, Homo sapiens
ggactggaaccagggag

SEQ ID NO: 740728 - DNA, 18 bp, Homo sapiens
ggactggaaccagggaga

SEQ ID NO: 740729 - DNA, 22 bp, Homo sapiens
ggactggaaccagggagaccga

SEQ ID NO: 740730 - DNA, 19 bp, Homo sapiens
ggactggaggtgggcatgc

SEQ ID NO: 740731 - DNA, 16 bp, Homo sapiens
ggactggctgtgcccc

SEQ ID NO: 740732 - DNA, 19 bp, Homo sapiens
ggactggggagcacaggtg

SEQ ID NO: 740733 - DNA, 17 bp, Homo sapiens
ggactggggatgtggga

SEQ ID NO: 740734 - DNA, 23 bp, Homo sapiens
ggactggggatgtgggagggagc

SEQ ID NO: 740735 - DNA, 22 bp, Homo sapiens
ggactgggggactgggagtcag

SEQ ID NO: 740736 - DNA, 11 bp, Homo sapiens
ggactgggttt

SEQ ID NO: 740737 - DNA, 24 bp, Homo sapiens
ggactgggtttggaccccagctgg

SEQ ID NO: 740738 - DNA, 14 bp, Homo sapiens
tcttgtttcagtga

SEQ ID NO: 740739 - DNA, 20 bp, Homo sapiens
tcttgtttctgaagtactta

SEQ ID NO: 740740 - DNA, 22 bp, Homo sapiens
tcttgtttctgggtccctgctc

SEQ ID NO: 740741 - DNA, 22 bp, Homo sapiens
tcttgtttcttttcacatagct

SEQ ID NO: 740742 - DNA, 20 bp, Homo sapiens
tcttgtttttattaatttat

SEQ ID NO: 740743 - DNA, 12 bp, Homo sapiens
tctttaaaaact

SEQ ID NO: 740744 - DNA, 15 bp, Homo sapiens
tctttaaaaactgtt

SEQ ID NO: 740745 - DNA, 16 bp, Homo sapiens
tctttaaaagagagag

SEQ ID NO: 740746 - DNA, 12 bp, Homo sapiens
tctttaaaagct

SEQ ID NO: 740747 - DNA, 17 bp, Homo sapiens
tctttaaaagtgcctta

SEQ ID NO: 740748 - DNA, 14 bp, Homo sapiens
tctttaaaataaaa

SEQ ID NO: 740749 - DNA, 20 bp, Homo sapiens
tctttaaacaaatatgaaaa

SEQ ID NO: 740750 - DNA, 14 bp, Homo sapiens
tctttaaactatgt

SEQ ID NO: 740751 - DNA, 15 bp, Homo sapiens
tctttaaaggcccag

SEQ ID NO: 740752 - DNA, 18 bp, Homo sapiens
tctttaaaggcccagccc

SEQ ID NO: 740753 - DNA, 22 bp, Homo sapiens
tctttaaaggcccagcccctag

SEQ ID NO: 740754 - DNA, 14 bp, Homo sapiens
tctttaaagttctt

SEQ ID NO: 740755 - DNA, 21 bp, Homo sapiens
tctttaaccagtctgaagttt

SEQ ID NO: 740756 - DNA, 21 bp, Homo sapiens
tctttaactgccgtaatttaa

SEQ ID NO: 740757 - DNA, 13 bp, Homo sapiens
tctttaactgtgt

SEQ ID NO: 740758 - DNA, 23 bp, Homo sapiens
tctttaagccatagaccctgagg

SEQ ID NO: 740759 - DNA, 19 bp, Homo sapiens
tctttaaggtattgtgcat

SEQ ID NO: 740760 - DNA, 16 bp, Homo sapiens
tctttaataaattgct

SEQ ID NO: 740761 - DNA, 13 bp, Homo sapiens
tctttaataacaa

SEQ ID NO: 740762 - DNA, 24 bp, Homo sapiens
tctttaataacaaggagatttctt

SEQ ID NO: 740763 - DNA, 22 bp, Homo sapiens
tctttaatgcctagagaatggg

SEQ ID NO: 740764 - DNA, 11 bp, Homo sapiens
tctttaatgct

SEQ ID NO: 740765 - DNA, 11 bp, Homo sapiens
tctttctttta

SEQ ID NO: 740766 - DNA, 19 bp, Homo sapiens
tctttctttttctggaaat

SEQ ID NO: 740767 - DNA, 20 bp, Homo sapiens
tctttctttttctggaaatt

SEQ ID NO: 740768 - DNA, 15 bp, Homo sapiens
tctttgaaataaaaa

SEQ ID NO: 740769 - DNA, 16 bp, Homo sapiens
tctttgaaataaaaaa

SEQ ID NO: 740770 - DNA, 22 bp, Homo sapiens
tctttgaaatgacatgttcctt

SEQ ID NO: 740771 - DNA, 22 bp, Homo sapiens
tctttgaagaaaagaaaaaaca

SEQ ID NO: 740772 - DNA, 16 bp, Homo sapiens
tctttgaatatgtagt

SEQ ID NO: 740773 - DNA, 22 bp, Homo sapiens
tctttgacaattcctagataaa

SEQ ID NO: 740774 - DNA, 17 bp, Homo sapiens
tctttgactgtcagcaa

SEQ ID NO: 740775 - DNA, 19 bp, Homo sapiens
tctttgactgtcagcaaga

SEQ ID NO: 740776 - DNA, 17 bp, Homo sapiens
tctttgagatagaagaa

SEQ ID NO: 740777 - DNA, 21 bp, Homo sapiens
tctttgagcccattcttctgg

SEQ ID NO: 740778 - DNA, 22 bp, Homo sapiens
tctttgagcccattcttctggg

SEQ ID NO: 740779 - DNA, 17 bp, Homo sapiens
tctttgatccagaggtg

SEQ ID NO: 740780 - DNA, 23 bp, Homo sapiens
tctttgattagaaaataaactca

SEQ ID NO: 740781 - DNA, 17 bp, Homo sapiens
tctttgatttgtaccat

SEQ ID NO: 740782 - DNA, 12 bp, Homo sapiens
tctttgcaaagt

SEQ ID NO: 740783 - DNA, 13 bp, Homo sapiens
tctttgcacatgt

SEQ ID NO: 740784 - DNA, 18 bp, Homo sapiens
tctttgcacatgtgacca

SEQ ID NO: 740785 - DNA, 22 bp, Homo sapiens
tctttgcaccaaagatgtcctg

SEQ ID NO: 740786 - DNA, 13 bp, Homo sapiens
tctttgcagagcc

SEQ ID NO: 740787 - DNA, 15 bp, Homo sapiens
tctttgcagagcctt

SEQ ID NO: 740788 - DNA, 13 bp, Homo sapiens
tctttgcagggct

SEQ ID NO: 740789 - DNA, 22 bp, Homo sapiens
tctttgcccccgacggctgtga

SEQ ID NO: 740790 - DNA, 20 bp, Homo sapiens
tctttgccttgggctgctcc

SEQ ID NO: 740791 - DNA, 12 bp, Homo sapiens
tctttgctcagt

SEQ ID NO: 740792 - DNA, 22 bp, Homo sapiens
tctttgctccagataactctct

SEQ ID NO: 740793 - DNA, 16 bp, Homo sapiens
tctttgctgcattcct

SEQ ID NO: 740794 - DNA, 12 bp, Homo sapiens
tctttgctgccc

SEQ ID NO: 740795 - DNA, 17 bp, Homo sapiens
tctttgctgcccctgtc

SEQ ID NO: 740796 - DNA, 19 bp, Homo sapiens
tctttgctgcccctgtctg

SEQ ID NO: 740797 - DNA, 20 bp, Homo sapiens
tctttgctgcccctgtctgg

SEQ ID NO: 740798 - DNA, 19 bp, Homo sapiens
tctttgctgctgctctcag

SEQ ID NO: 740799 - DNA, 20 bp, Homo sapiens
tctttgctgtactcttgctg

SEQ ID NO: 740800 - DNA, 23 bp, Homo sapiens
tctttgctgtactcttgctgatg

SEQ ID NO: 740801 - DNA, 12 bp, Homo sapiens
tctttgctttgc

SEQ ID NO: 740802 - DNA, 16 bp, Homo sapiens
tctttggaaatagcat

SEQ ID NO: 740803 - DNA, 17 bp, Homo sapiens
tctttggaaatagcatg

SEQ ID NO: 740804 - DNA, 18 bp, Homo sapiens
tctttggaacagatattt

SEQ ID NO: 740805 - DNA, 23 bp, Homo sapiens
tctttggaagcagccccctgtgg

SEQ ID NO: 740806 - DNA, 17 bp, Homo sapiens
tctttggacactcacac

SEQ ID NO: 740807 - DNA, 20 bp, Homo sapiens
tctttggcctacattcttta

SEQ ID NO: 740808 - DNA, 14 bp, Homo sapiens
tctttgggaatgtt

SEQ ID NO: 740809 - DNA, 14 bp, Homo sapiens
tctttgggaccctg

SEQ ID NO: 740810 - DNA, 22 bp, Homo sapiens
tctttggtctattttctgcaga

SEQ ID NO: 740811 - DNA, 15 bp, Homo sapiens
tctttgtaataaaat

SEQ ID NO: 740812 - DNA, 14 bp, Homo sapiens
tctttgtaccaaaa

SEQ ID NO: 740813 - DNA, 22 bp, Homo sapiens
tctttgtataaataaatatttt

SEQ ID NO: 740814 - DNA, 15 bp, Homo sapiens
tctttgtgcagtgtt

SEQ ID NO: 740815 - DNA, 17 bp, Homo sapiens
tctttgtggactgtggg

SEQ ID NO: 740816 - DNA, 13 bp, Homo sapiens
tctttgtggccaa

SEQ ID NO: 740817 - DNA, 23 bp, Homo sapiens
tctttgtggccaaggagctgcta

SEQ ID NO: 740818 - DNA, 23 bp, Homo sapiens
tctttgtgggttggccaggaggt

SEQ ID NO: 740819 - DNA, 19 bp, Homo sapiens
tctttgtggtctgtgtcac

SEQ ID NO: 740820 - DNA, 15 bp, Homo sapiens
tctttgtgtaatcta

SEQ ID NO: 740821 - DNA, 20 bp, Homo sapiens
tctttgtgtgttatattcca

SEQ ID NO: 740822 - DNA, 15 bp, Homo sapiens
tctttgttacaggca

SEQ ID NO: 740823 - DNA, 21 bp, Homo sapiens
tctttgttatcaaacttcagc

SEQ ID NO: 740824 - DNA, 11 bp, Homo sapiens
tctttgttcaa

SEQ ID NO: 740825 - DNA, 16 bp, Homo sapiens
tctttgttcatagccc

SEQ ID NO: 740826 - DNA, 17 bp, Homo sapiens
tctttgtttaaatgcca

SEQ ID NO: 740827 - DNA, 14 bp, Homo sapiens
tctttgtttaacaa

SEQ ID NO: 740828 - DNA, 21 bp, Homo sapiens
tcttttaaaagacaagacttc

SEQ ID NO: 740829 - DNA, 22 bp, Homo sapiens
tcttttaaaataagctttctca

SEQ ID NO: 740830 - DNA, 23 bp, Homo sapiens
tcttttaaatatttgtgactctt

SEQ ID NO: 740831 - DNA, 20 bp, Homo sapiens
tcttttaaattagaaaatat

SEQ ID NO: 740832 - DNA, 12 bp, Homo sapiens
tcttttaatgct

SEQ ID NO: 740833 - DNA, 19 bp, Homo sapiens
tcttttaatgcttcattca

SEQ ID NO: 740834 - DNA, 23 bp, Homo sapiens
tcttttaccaacttcctctgcca

SEQ ID NO: 740835 - DNA, 15 bp, Homo sapiens
tcttttactctgtgt

SEQ ID NO: 740836 - DNA, 18 bp, Homo sapiens
tcttttactgttatagaa

SEQ ID NO: 740837 - DNA, 23 bp, Homo sapiens
tcttttactttttttagtaagtt

SEQ ID NO: 740838 - DNA, 15 bp, Homo sapiens
tcttttataaatatt

SEQ ID NO: 740839 - DNA, 18 bp, Homo sapiens
tcttttatactcagcttt

SEQ ID NO: 740840 - DNA, 13 bp, Homo sapiens
tcttttatatttg

SEQ ID NO: 740841 - DNA, 14 bp, Homo sapiens
tcttttatatttgt

SEQ ID NO: 740842 - DNA, 12 bp, Homo sapiens
tcttttattatc

SEQ ID NO: 740843 - DNA, 12 bp, Homo sapiens
tcttttccaagc

SEQ ID NO: 740844 - DNA, 15 bp, Homo sapiens
tcttttccattgtca

SEQ ID NO: 740845 - DNA, 19 bp, Homo sapiens
tcttttcccactgtttaag

SEQ ID NO: 740846 - DNA, 16 bp, Homo sapiens
tcttttcccatttatc

SEQ ID NO: 740847 - DNA, 18 bp, Homo sapiens
tcttttcccctttcctgt

SEQ ID NO: 740848 - DNA, 13 bp, Homo sapiens
tcttttccctctc

SEQ ID NO: 740849 - DNA, 13 bp, Homo sapiens
tcttttcctctct

SEQ ID NO: 740850 - DNA, 17 bp, Homo sapiens
tcttttcctggcagctg

SEQ ID NO: 740851 - DNA, 11 bp, Homo sapiens
tcttttccttt

SEQ ID NO: 740852 - DNA, 17 bp, Homo sapiens
tcttttcgttttcgttt

SEQ ID NO: 740853 - DNA, 19 bp, Homo sapiens
tcttttctaccctagccat

SEQ ID NO: 740854 - DNA, 12 bp, Homo sapiens
tcttttctagag

SEQ ID NO: 740855 - DNA, 14 bp, Homo sapiens
tcttttctcatgtg

SEQ ID NO: 740856 - DNA, 15 bp, Homo sapiens
tcttttctcatgtgt

SEQ ID NO: 740857 - DNA, 14 bp, Homo sapiens
tcttttctcctccg

SEQ ID NO: 740858 - DNA, 17 bp, Homo sapiens
tcttttctctgtgcttc

SEQ ID NO: 740859 - DNA, 21 bp, Homo sapiens
tcttttctgtcaccaaatttg

SEQ ID NO: 740860 - DNA, 17 bp, Homo sapiens
tcttttcttactcctcc

SEQ ID NO: 740861 - DNA, 12 bp, Homo sapiens
tcttttcttatt

SEQ ID NO: 740862 - DNA, 13 bp, Homo sapiens
tcttttctttggg

SEQ ID NO: 740863 - DNA, 23 bp, Homo sapiens
tcttttgaatattcccaagccca

SEQ ID NO: 740864 - DNA, 16 bp, Homo sapiens
tcttttgaattcttga

SEQ ID NO: 740865 - DNA, 14 bp, Homo sapiens
tcttttgaattgtt

SEQ ID NO: 740866 - DNA, 13 bp, Homo sapiens
tcttttgacatgt

SEQ ID NO: 740867 - DNA, 20 bp, Homo sapiens
tcttttgacatgtggaaagt

SEQ ID NO: 740868 - DNA, 16 bp, Homo sapiens
tcttttgagtccttgt

SEQ ID NO: 740869 - DNA, 14 bp, Homo sapiens
ggagagacaggcag

SEQ ID NO: 740870 - DNA, 16 bp, Homo sapiens
ggagagacaggcagcc

SEQ ID NO: 740871 - DNA, 18 bp, Homo sapiens
ggagagactgaaagcagc

SEQ ID NO: 740872 - DNA, 19 bp, Homo sapiens
ggagagactgaaagcagca

SEQ ID NO: 740873 - DNA, 20 bp, Homo sapiens
ggagagactgaaagcagcag

SEQ ID NO: 740874 - DNA, 22 bp, Homo sapiens
ggagagactgaaagcagcagct

SEQ ID NO: 740875 - DNA, 16 bp, Homo sapiens
ggagagactgagcagc

SEQ ID NO: 740876 - DNA, 21 bp, Homo sapiens
ggagagagacttggaagagga

SEQ ID NO: 740877 - DNA, 23 bp, Homo sapiens
ggagagagaggctgcctcagcca

SEQ ID NO: 740878 - DNA, 22 bp, Homo sapiens
ggagagagccaggatgcccaga

SEQ ID NO: 740879 - DNA, 14 bp, Homo sapiens
ggagagaggggaat

SEQ ID NO: 740880 - DNA, 21 bp, Homo sapiens
ggagagaggggaataatagaa

SEQ ID NO: 740881 - DNA, 23 bp, Homo sapiens
ggagagatgacccctaccccctc

SEQ ID NO: 740882 - DNA, 13 bp, Homo sapiens
ggagagcaaaggc

SEQ ID NO: 740883 - DNA, 16 bp, Homo sapiens
ggagagcaaaggccca

SEQ ID NO: 740884 - DNA, 23 bp, Homo sapiens
ggagagcaaaggcccatgccccc

SEQ ID NO: 740885 - DNA, 19 bp, Homo sapiens
ggagagcactgcctctatg

SEQ ID NO: 740886 - DNA, 14 bp, Homo sapiens
ggagagcagcagca

SEQ ID NO: 740887 - DNA, 17 bp, Homo sapiens
tccagatgcagggcagt

SEQ ID NO: 740888 - DNA, 15 bp, Homo sapiens
tccagatgccacaat

SEQ ID NO: 740889 - DNA, 21 bp, Homo sapiens
tccagatgtggctactgacat

SEQ ID NO: 740890 - DNA, 18 bp, Homo sapiens
tccagatgtttccagact

SEQ ID NO: 740891 - DNA, 17 bp, Homo sapiens
tccagattagagcctgt

SEQ ID NO: 740892 - DNA, 20 bp, Homo sapiens
tctaactgtggaatataaat

SEQ ID NO: 740893 - DNA, 24 bp, Homo sapiens
tctaactgtggaatataaatagct

SEQ ID NO: 740894 - DNA, 11 bp, Homo sapiens
tctaagaaaag

SEQ ID NO: 740895 - DNA, 16 bp, Homo sapiens
tctaagaaatatctgt

SEQ ID NO: 740896 - DNA, 21 bp, Homo sapiens
tctaagaaatatctgtgaaat

SEQ ID NO: 740897 - DNA, 22 bp, Homo sapiens
tctaagaaatatctgtgaaata

SEQ ID NO: 740898 - DNA, 15 bp, Homo sapiens
tctaagaagacattt

SEQ ID NO: 740899 - DNA, 18 bp, Homo sapiens
tctaagaagacattttgt

SEQ ID NO: 740900 - DNA, 19 bp, Homo sapiens
tctaagaagacattttgtt

SEQ ID NO: 740901 - DNA, 18 bp, Homo sapiens
tctaagatacactgcact

SEQ ID NO: 740902 - DNA, 20 bp, Homo sapiens
tctaagatacactgcacttt

SEQ ID NO: 740903 - DNA, 22 bp, Homo sapiens
tctaagatgccagcatatactg

SEQ ID NO: 740904 - DNA, 12 bp, Homo sapiens
tctaagatgttc

SEQ ID NO: 740905 - DNA, 16 bp, Homo sapiens
tctaagccagttttca

SEQ ID NO: 740906 - DNA, 16 bp, Homo sapiens
tctaagcctgaagggg

SEQ ID NO: 740907 - DNA, 19 bp, Homo sapiens
tctaagctggagctcttgg

SEQ ID NO: 740908 - DNA, 17 bp, Homo sapiens
tctaagctgtttgccaa

SEQ ID NO: 740909 - DNA, 23 bp, Homo sapiens
tctaagctgtttgccaagctgaa

SEQ ID NO: 740910 - DNA, 23 bp, Homo sapiens
tctaaggatgtcacagggccaac

SEQ ID NO: 740911 - DNA, 16 bp, Homo sapiens
tctaagggtagaagag

SEQ ID NO: 740912 - DNA, 19 bp, Homo sapiens
tctaagtacatatgtagat

SEQ ID NO: 740913 - DNA, 17 bp, Homo sapiens
tctaagtatttaaatgt

SEQ ID NO: 740914 - DNA, 15 bp, Homo sapiens
tctaagtcatgtatg

SEQ ID NO: 740915 - DNA, 16 bp, Homo sapiens
tctaagtcatgtatgt

SEQ ID NO: 740916 - DNA, 18 bp, Homo sapiens
tctaagtgcctcacattt

SEQ ID NO: 740917 - DNA, 14 bp, Homo sapiens
tctaagtgtaacct

SEQ ID NO: 740918 - DNA, 21 bp, Homo sapiens
tctaagttaatttaaagttgt

SEQ ID NO: 740919 - DNA, 22 bp, Homo sapiens
tctaataaacttggattctcta

SEQ ID NO: 740920 - DNA, 19 bp, Homo sapiens
tctaataaagtagttatta

SEQ ID NO: 740921 - DNA, 20 bp, Homo sapiens
tctaataaagtcatttgtga

SEQ ID NO: 740922 - DNA, 14 bp, Homo sapiens
tctaataaatcagt

SEQ ID NO: 740923 - DNA, 21 bp, Homo sapiens
tctaataaatcagtgaactgt

SEQ ID NO: 740924 - DNA, 22 bp, Homo sapiens
tctaatagaactcagttttaac

SEQ ID NO: 740925 - DNA, 15 bp, Homo sapiens
tctaatatatatgaa

SEQ ID NO: 740926 - DNA, 13 bp, Homo sapiens
tctaatattagtt

SEQ ID NO: 740927 - DNA, 13 bp, Homo sapiens
tctaatcagtcct

SEQ ID NO: 740928 - DNA, 19 bp, Homo sapiens
tctaatctagatatcgact

SEQ ID NO: 740929 - DNA, 20 bp, Homo sapiens
tctaatctagatatcgactt

SEQ ID NO: 740930 - DNA, 12 bp, Homo sapiens
tctaatctctta

SEQ ID NO: 740931 - DNA, 13 bp, Homo sapiens
tctaatctcttat

SEQ ID NO: 740932 - DNA, 16 bp, Homo sapiens
tctaatctcttattct

SEQ ID NO: 740933 - DNA, 14 bp, Homo sapiens
tctaatgcttgttt

SEQ ID NO: 740934 - DNA, 13 bp, Homo sapiens
tctaatgtagcta

SEQ ID NO: 740935 - DNA, 20 bp, Homo sapiens
tctaatgtagctatttttct

SEQ ID NO: 740936 - DNA, 14 bp, Homo sapiens
tctaatgtgtgaat

SEQ ID NO: 740937 - DNA, 13 bp, Homo sapiens
tctaatgtttgtg

SEQ ID NO: 740938 - DNA, 16 bp, Homo sapiens
tctaatgtttgtgaga

SEQ ID NO: 740939 - DNA, 16 bp, Homo sapiens
tctaattaaaacactt

SEQ ID NO: 740940 - DNA, 18 bp, Homo sapiens
tctaattaaccttactaa

SEQ ID NO: 740941 - DNA, 12 bp, Homo sapiens
tctaattagaga

SEQ ID NO: 740942 - DNA, 22 bp, Homo sapiens
tctaattatttccacttgccct

SEQ ID NO: 740943 - DNA, 21 bp, Homo sapiens
tctaattcccattttgcaaaa

SEQ ID NO: 740944 - DNA, 19 bp, Homo sapiens
tctaattgcatctcaaaat

SEQ ID NO: 740945 - DNA, 12 bp, Homo sapiens
tctaattgtaag

SEQ ID NO: 740946 - DNA, 22 bp, Homo sapiens
tctaatttatcttgtctctggg

SEQ ID NO: 740947 - DNA, 23 bp, Homo sapiens
tctaatttatcttgtctctgggc

SEQ ID NO: 740948 - DNA, 15 bp, Homo sapiens
tctaatttgaactgg

SEQ ID NO: 740949 - DNA, 22 bp, Homo sapiens
tctaatttgaactggtattgtt

SEQ ID NO: 740950 - DNA, 15 bp, Homo sapiens
tctaatttgcacctt

SEQ ID NO: 740951 - DNA, 17 bp, Homo sapiens
tctaatttgcattgtgt

SEQ ID NO: 740952 - DNA, 16 bp, Homo sapiens
tctaattttggatgga

SEQ ID NO: 740953 - DNA, 16 bp, Homo sapiens
tctaatttttaagcaa

SEQ ID NO: 740954 - DNA, 22 bp, Homo sapiens
tctacaaaaaatgcagaactta

SEQ ID NO: 740955 - DNA, 22 bp, Homo sapiens
tctacaaaataacattctgaat

SEQ ID NO: 740956 - DNA, 14 bp, Homo sapiens
tctacaactggagt

SEQ ID NO: 740957 - DNA, 20 bp, Homo sapiens
tctacaagcatatttgagaa

SEQ ID NO: 740958 - DNA, 23 bp, Homo sapiens
tctacaagccaaaagtccctccc

SEQ ID NO: 740959 - DNA, 15 bp, Homo sapiens
tctacaaggactcca

SEQ ID NO: 740960 - DNA, 15 bp, Homo sapiens
tctacaagtatatgt

SEQ ID NO: 740961 - DNA, 19 bp, Homo sapiens
tctacaagtatatgtgaaa

SEQ ID NO: 740962 - DNA, 21 bp, Homo sapiens
tctacaagtatatgtgaaaaa

SEQ ID NO: 740963 - DNA, 14 bp, Homo sapiens
tctacaatacatat

SEQ ID NO: 740964 - DNA, 21 bp, Homo sapiens
tctacaattcctctgataata

SEQ ID NO: 740965 - DNA, 15 bp, Homo sapiens
tctacacatacagaa

SEQ ID NO: 740966 - DNA, 21 bp, Homo sapiens
tctacacctcctttaagattt

SEQ ID NO: 740967 - DNA, 13 bp, Homo sapiens
tctacacctggac

SEQ ID NO: 740968 - DNA, 17 bp, Homo sapiens
gctatataagacaagaa

SEQ ID NO: 740969 - DNA, 21 bp, Homo sapiens
gctatataattgtgaagtatt

SEQ ID NO: 740970 - DNA, 19 bp, Homo sapiens
gctatatgccttaagccaa

SEQ ID NO: 740971 - DNA, 14 bp, Homo sapiens
gctatattagctga

SEQ ID NO: 740972 - DNA, 20 bp, Homo sapiens
gctatcagagcctctcccac

SEQ ID NO: 740973 - DNA, 11 bp, Homo sapiens
gctatcagcaa

SEQ ID NO: 740974 - DNA, 23 bp, Homo sapiens
gctatcagcaatactcatcagag

SEQ ID NO: 740975 - DNA, 17 bp, Homo sapiens
gctatccatttctcatg

SEQ ID NO: 740976 - DNA, 21 bp, Homo sapiens
gctatccccatctccctgcct

SEQ ID NO: 740977 - DNA, 23 bp, Homo sapiens
gctatccccatctccctgcctgg

SEQ ID NO: 740978 - DNA, 12 bp, Homo sapiens
gctatcctgatt

SEQ ID NO: 740979 - DNA, 15 bp, Homo sapiens
gctatcctgctgaaa

SEQ ID NO: 740980 - DNA, 20 bp, Homo sapiens
gctatcctgctgaaagtcct

SEQ ID NO: 740981 - DNA, 23 bp, Homo sapiens
gctatccttggctttcagagcca

SEQ ID NO: 740982 - DNA, 20 bp, Homo sapiens
gctatcgccctcctttccct

SEQ ID NO: 740983 - DNA, 17 bp, Homo sapiens
gctatctatacctgcct

SEQ ID NO: 740984 - DNA, 17 bp, Homo sapiens
gctatctggtcaacctc

SEQ ID NO: 740985 - DNA, 16 bp, Homo sapiens
gctatgacagctggct

SEQ ID NO: 740986 - DNA, 17 bp, Homo sapiens
gctatgatcgcgccact

SEQ ID NO: 740987 - DNA, 21 bp, Homo sapiens
gctatgatggaagtgttcaga

SEQ ID NO: 740988 - DNA, 18 bp, Homo sapiens
gctatgcattttcttcac

SEQ ID NO: 740989 - DNA, 19 bp, Homo sapiens
gctatgcattttcttcaca

SEQ ID NO: 740990 - DNA, 19 bp, Homo sapiens
gctatgccatttcttctct

SEQ ID NO: 740991 - DNA, 18 bp, Homo sapiens
gctatgcgcaatgtggca

SEQ ID NO: 740992 - DNA, 20 bp, Homo sapiens
gctatgcggaggaaagcaag

SEQ ID NO: 740993 - DNA, 20 bp, Homo sapiens
gctatgctgaagacattcaa

SEQ ID NO: 740994 - DNA, 11 bp, Homo sapiens
gctatggacac

SEQ ID NO: 740995 - DNA, 13 bp, Homo sapiens
gctatggacacag

SEQ ID NO: 740996 - DNA, 14 bp, Homo sapiens
gctatggacacagg

SEQ ID NO: 740997 - DNA, 18 bp, Homo sapiens
gctatggatggcttctaa

SEQ ID NO: 740998 - DNA, 15 bp, Homo sapiens
gctatggcaaggggg

SEQ ID NO: 740999 - DNA, 23 bp, Homo sapiens
gctatggcccagaaacaacaggg

SEQ ID NO: 741000 - DNA, 14 bp, Homo sapiens
gctatgggagcccc

SEQ ID NO: 741001 - DNA, 21 bp, Homo sapiens
gctatgggagccccagggtct

SEQ ID NO: 741002 - DNA, 15 bp, Homo sapiens
gctatggtgagatgc

SEQ ID NO: 741003 - DNA, 23 bp, Homo sapiens
gctatgtaaacaaaccacagcag

SEQ ID NO: 741004 - DNA, 22 bp, Homo sapiens
gctatgtatggaatacagtgtt

SEQ ID NO: 741005 - DNA, 13 bp, Homo sapiens
gctatgtgacttg

SEQ ID NO: 741006 - DNA, 14 bp, Homo sapiens
gctatgtgacttgc

SEQ ID NO: 741007 - DNA, 17 bp, Homo sapiens
gctatgttccctccagc

SEQ ID NO: 741008 - DNA, 12 bp, Homo sapiens
gctattaaaaaa

SEQ ID NO: 741009 - DNA, 19 bp, Homo sapiens
gctattaacaattaattgt

SEQ ID NO: 741010 - DNA, 17 bp, Homo sapiens
gctattattttcactgt

SEQ ID NO: 741011 - DNA, 23 bp, Homo sapiens
gctattcacctcagtagaaaagg

SEQ ID NO: 741012 - DNA, 20 bp, Homo sapiens
gctattcagtaataactcta

SEQ ID NO: 741013 - DNA, 18 bp, Homo sapiens
gctcagcctggtgggcct

SEQ ID NO: 741014 - DNA, 20 bp, Homo sapiens
gctcagcctggtgggcctcc

SEQ ID NO: 741015 - DNA, 13 bp, Homo sapiens
gctcagcctgtct

SEQ ID NO: 741016 - DNA, 21 bp, Homo sapiens
gctcagccttgcacacccact

SEQ ID NO: 741017 - DNA, 22 bp, Homo sapiens
gctcagctagaagatccacatc

SEQ ID NO: 741018 - DNA, 16 bp, Homo sapiens
gctcagctctgggcca

SEQ ID NO: 741019 - DNA, 20 bp, Homo sapiens
gctcagctctggtccaggcc

SEQ ID NO: 741020 - DNA, 12 bp, Homo sapiens
gctcagctgcat

SEQ ID NO: 741021 - DNA, 19 bp, Homo sapiens
gctcagctgcattccgcag

SEQ ID NO: 741022 - DNA, 19 bp, Homo sapiens
gctcagctgtcaaggctca

SEQ ID NO: 741023 - DNA, 16 bp, Homo sapiens
gctcagcttctcctgt

SEQ ID NO: 741024 - DNA, 17 bp, Homo sapiens
gctcagctttctgaggc

SEQ ID NO: 741025 - DNA, 18 bp, Homo sapiens
gctcaggaagaagagatg

SEQ ID NO: 741026 - DNA, 14 bp, Homo sapiens
gctcaggacccagg

SEQ ID NO: 741027 - DNA, 18 bp, Homo sapiens
gctcaggacccaggccct

SEQ ID NO: 741028 - DNA, 19 bp, Homo sapiens
gctcaggacccaggccctc

SEQ ID NO: 741029 - DNA, 11 bp, Homo sapiens
gctcaggcaga

SEQ ID NO: 741030 - DNA, 20 bp, Homo sapiens
gctcaggcagctcgaggccc

SEQ ID NO: 741031 - DNA, 13 bp, Homo sapiens
gctcaggcctagg

SEQ ID NO: 741032 - DNA, 18 bp, Homo sapiens
gctcaggcctaggaggcc

SEQ ID NO: 741033 - DNA, 22 bp, Homo sapiens
gctcaggctactataggtccag

SEQ ID NO: 741034 - DNA, 23 bp, Homo sapiens
gctcaggctgcagctggacagag

SEQ ID NO: 741035 - DNA, 19 bp, Homo sapiens
gctcaggctggagtgcagt

SEQ ID NO: 741036 - DNA, 16 bp, Homo sapiens
gctcagggcagtggct

SEQ ID NO: 741037 - DNA, 19 bp, Homo sapiens
gctcagggccatgctgagg

SEQ ID NO: 741038 - DNA, 20 bp, Homo sapiens
gctcagggccatgctgaggc

SEQ ID NO: 741039 - DNA, 23 bp, Homo sapiens
gctcagggccatgctgaggcctg

SEQ ID NO: 741040 - DNA, 15 bp, Homo sapiens
gctcagggctggagt

SEQ ID NO: 741041 - DNA, 16 bp, Homo sapiens
gctcaggggagcaagc

SEQ ID NO: 741042 - DNA, 23 bp, Homo sapiens
gctcagggtcaaagacagaatgg

SEQ ID NO: 741043 - DNA, 22 bp, Homo sapiens
gctcagggtcactgaaccactg

SEQ ID NO: 741044 - DNA, 15 bp, Homo sapiens
gctcaggtccctggg

SEQ ID NO: 741045 - DNA, 21 bp, Homo sapiens
gctcaggtgatcaaaataaag

SEQ ID NO: 741046 - DNA, 18 bp, Homo sapiens
gctcaggtttgtcctggt

SEQ ID NO: 741047 - DNA, 12 bp, Homo sapiens
gctcagtaaacg

SEQ ID NO: 741048 - DNA, 18 bp, Homo sapiens
gctcagtaaacgggaaca

SEQ ID NO: 741049 - DNA, 16 bp, Homo sapiens
gctcagtaatttgagg

SEQ ID NO: 741050 - DNA, 23 bp, Homo sapiens
gctcagtcccatcagagagcgag

SEQ ID NO: 741051 - DNA, 14 bp, Homo sapiens
gctcagtctcagga

SEQ ID NO: 741052 - DNA, 11 bp, Homo sapiens
gctcagtctgt

SEQ ID NO: 741053 - DNA, 15 bp, Homo sapiens
gctcagtctgttcac

SEQ ID NO: 741054 - DNA, 18 bp, Homo sapiens
gctcagtctgttcactgc

SEQ ID NO: 741055 - DNA, 17 bp, Homo sapiens
gctcagtgccacctatg

SEQ ID NO: 741056 - DNA, 19 bp, Homo sapiens
gctcagtgccacctatgcc

SEQ ID NO: 741057 - DNA, 22 bp, Homo sapiens
gctcagtgccacctatgcctgt

SEQ ID NO: 741058 - DNA, 14 bp, Homo sapiens
gctcagtgcctcct

SEQ ID NO: 741059 - DNA, 16 bp, Homo sapiens
gctcagtgcctcctgg

SEQ ID NO: 741060 - DNA, 17 bp, Homo sapiens
gctcagtgcctcctggc

SEQ ID NO: 741061 - DNA, 16 bp, Homo sapiens
gctcagtgccttcctc

SEQ ID NO: 741062 - DNA, 17 bp, Homo sapiens
gctcagtgcttgggctc

SEQ ID NO: 741063 - DNA, 20 bp, Homo sapiens
gctcagtgcttgggctccac

SEQ ID NO: 741064 - DNA, 21 bp, Homo sapiens
gctcagtgcttgggctccacg

SEQ ID NO: 741065 - DNA, 10 bp, Homo sapiens
gctcagtgtc

SEQ ID NO: 741066 - DNA, 13 bp, Homo sapiens
gctcagtgtcagc

SEQ ID NO: 741067 - DNA, 14 bp, Homo sapiens
gctcagtgtcagcg

SEQ ID NO: 741068 - DNA, 13 bp, Homo sapiens
gctcagtgtccag

SEQ ID NO: 741069 - DNA, 18 bp, Homo sapiens
gctcagtgtccagcttcc

SEQ ID NO: 741070 - DNA, 23 bp, Homo sapiens
gctcagtgtccagcttccaaagc

SEQ ID NO: 741071 - DNA, 19 bp, Homo sapiens
gctcatatggggctgggag

SEQ ID NO: 741072 - DNA, 18 bp, Homo sapiens
gctcatcattctctgtct

SEQ ID NO: 741073 - DNA, 19 bp, Homo sapiens
gctcatcccccctgctgcc

SEQ ID NO: 741074 - DNA, 20 bp, Homo sapiens
gctcatcccccctgctgccc

SEQ ID NO: 741075 - DNA, 23 bp, Homo sapiens
gctcatcccccctgctgcccagt

SEQ ID NO: 741076 - DNA, 16 bp, Homo sapiens
gctcatctctggaagg

SEQ ID NO: 741077 - DNA, 17 bp, Homo sapiens
gctcatgcatagtccca

SEQ ID NO: 741078 - DNA, 18 bp, Homo sapiens
gctcatgcatagtcccag

SEQ ID NO: 741079 - DNA, 16 bp, Homo sapiens
gctcatgccccttggg

SEQ ID NO: 741080 - DNA, 19 bp, Homo sapiens
gctcatgcctgtaaccctg

SEQ ID NO: 741081 - DNA, 20 bp, Homo sapiens
gctcatggcgtaatgggcct

SEQ ID NO: 741082 - DNA, 20 bp, Homo sapiens
gctcatgtaatgtggtcacc

SEQ ID NO: 741083 - DNA, 22 bp, Homo sapiens
gctcatgtccctgtccccaggc

SEQ ID NO: 741084 - DNA, 22 bp, Homo sapiens
gctcatgtgtgcaacagggtat

SEQ ID NO: 741085 - DNA, 16 bp, Homo sapiens
gctcatgttgagccag

SEQ ID NO: 741086 - DNA, 17 bp, Homo sapiens
gctcatgttgagccagt

SEQ ID NO: 741087 - DNA, 18 bp, Homo sapiens
gctcatgttgagccagtg

SEQ ID NO: 741088 - DNA, 19 bp, Homo sapiens
gctcattaaactgattcca

SEQ ID NO: 741089 - DNA, 21 bp, Homo sapiens
gctcattataatgtcattaaa

SEQ ID NO: 741090 - DNA, 14 bp, Homo sapiens
gctcattatgaaaa

SEQ ID NO: 741091 - DNA, 16 bp, Homo sapiens
gctcattatgccactt

SEQ ID NO: 741092 - DNA, 20 bp, Homo sapiens
gctcattctgtctcttttct

SEQ ID NO: 741093 - DNA, 14 bp, Homo sapiens
gctcatttaaaaca

SEQ ID NO: 741094 - DNA, 12 bp, Homo sapiens
gctcatttaagt

SEQ ID NO: 741095 - DNA, 18 bp, Homo sapiens
gctcatttaatcccagga

SEQ ID NO: 741096 - DNA, 19 bp, Homo sapiens
gctcatttaatcccaggaa

SEQ ID NO: 741097 - DNA, 14 bp, Homo sapiens
tctagcatgttggg

SEQ ID NO: 741098 - DNA, 17 bp, Homo sapiens
tctagccactccctccc

SEQ ID NO: 741099 - DNA, 20 bp, Homo sapiens
tctagccactccctcccaga

SEQ ID NO: 741100 - DNA, 15 bp, Homo sapiens
tctagcccactccct

SEQ ID NO: 741101 - DNA, 17 bp, Homo sapiens
tctagccgatggaaaat

SEQ ID NO: 741102 - DNA, 12 bp, Homo sapiens
tctagcctctga

SEQ ID NO: 741103 - DNA, 19 bp, Homo sapiens
tctagcctctgagatgcta

SEQ ID NO: 741104 - DNA, 12 bp, Homo sapiens
tctagcctgggc

SEQ ID NO: 741105 - DNA, 17 bp, Homo sapiens
tctagcctgggccagag

SEQ ID NO: 741106 - DNA, 17 bp, Homo sapiens
tctagctaaataaatgg

SEQ ID NO: 741107 - DNA, 23 bp, Homo sapiens
tctagctagaaatatgattttat

SEQ ID NO: 741108 - DNA, 19 bp, Homo sapiens
tctagctatgctgtatctg

SEQ ID NO: 741109 - DNA, 13 bp, Homo sapiens
tctagctccccaa

SEQ ID NO: 741110 - DNA, 16 bp, Homo sapiens
tctagctctctaggcc

SEQ ID NO: 741111 - DNA, 21 bp, Homo sapiens
tctagctgggggtgggccagg

SEQ ID NO: 741112 - DNA, 14 bp, Homo sapiens
tctagctgtctgtg

SEQ ID NO: 741113 - DNA, 19 bp, Homo sapiens
tctagctgttgagctgttt

SEQ ID NO: 741114 - DNA, 21 bp, Homo sapiens
tctagcttaagtgtaaatgaa

SEQ ID NO: 741115 - DNA, 12 bp, Homo sapiens
tctagcttggtg

SEQ ID NO: 741116 - DNA, 15 bp, Homo sapiens
tctaggaaatatact

SEQ ID NO: 741117 - DNA, 19 bp, Homo sapiens
tctaggaaattcttgaaaa

SEQ ID NO: 741118 - DNA, 15 bp, Homo sapiens
tctaggaagacattt

SEQ ID NO: 741119 - DNA, 16 bp, Homo sapiens
tctaggactgcagtgt

SEQ ID NO: 741120 - DNA, 23 bp, Homo sapiens
tctaggagaaacttagaggaaaa

SEQ ID NO: 741121 - DNA, 13 bp, Homo sapiens
tctaggatgtgga

SEQ ID NO: 741122 - DNA, 16 bp, Homo sapiens
tctaggatgtggagct

SEQ ID NO: 741123 - DNA, 15 bp, Homo sapiens
tctaggcacaaggtt

SEQ ID NO: 741124 - DNA, 14 bp, Homo sapiens
tctaggcatttcat

SEQ ID NO: 741125 - DNA, 18 bp, Homo sapiens
tctaggccaaaaatggtg

SEQ ID NO: 741126 - DNA, 21 bp, Homo sapiens
tctaggcccattgtcctcctt

SEQ ID NO: 741127 - DNA, 22 bp, Homo sapiens
tctaggcccattgtcctccttt

SEQ ID NO: 741128 - DNA, 13 bp, Homo sapiens
tctagggaaatga

SEQ ID NO: 741129 - DNA, 17 bp, Homo sapiens
tctagggagagaccctt

SEQ ID NO: 741130 - DNA, 16 bp, Homo sapiens
tctagggcagggtggg

SEQ ID NO: 741131 - DNA, 15 bp, Homo sapiens
tctaggggcagcctc

SEQ ID NO: 741132 - DNA, 19 bp, Homo sapiens
tctaggggtcaggctccat

SEQ ID NO: 741133 - DNA, 21 bp, Homo sapiens
tctaggtacgatgacagtgtt

SEQ ID NO: 741134 - DNA, 20 bp, Homo sapiens
tctaggtggaggttgtgcat

SEQ ID NO: 741135 - DNA, 21 bp, Homo sapiens
tctattaatgaggtctttaaa

SEQ ID NO: 741136 - DNA, 15 bp, Homo sapiens
tctattatcacatta

SEQ ID NO: 741137 - DNA, 19 bp, Homo sapiens
tctattattcaaaaaatca

SEQ ID NO: 741138 - DNA, 12 bp, Homo sapiens
tctattcagctt

SEQ ID NO: 741139 - DNA, 17 bp, Homo sapiens
tctattctaataactgc

SEQ ID NO: 741140 - DNA, 14 bp, Homo sapiens
tctattctctgcaa

SEQ ID NO: 741141 - DNA, 16 bp, Homo sapiens
tctattctctgcaatt

SEQ ID NO: 741142 - DNA, 13 bp, Homo sapiens
tctattctgtcag

SEQ ID NO: 741143 - DNA, 16 bp, Homo sapiens
tctattgtattatttg

SEQ ID NO: 741144 - DNA, 23 bp, Homo sapiens
tctattgtcatggggatcaattt

SEQ ID NO: 741145 - DNA, 21 bp, Homo sapiens
tctattgtcgctatgtgactt

SEQ ID NO: 741146 - DNA, 17 bp, Homo sapiens
tctattgtttattcttt

SEQ ID NO: 741147 - DNA, 12 bp, Homo sapiens
tctatttaagcc

SEQ ID NO: 741148 - DNA, 12 bp, Homo sapiens
tctatttaatat

SEQ ID NO: 741149 - DNA, 13 bp, Homo sapiens
tctatttatgttt

SEQ ID NO: 741150 - DNA, 16 bp, Homo sapiens
tctatttattaatatt

SEQ ID NO: 741151 - DNA, 16 bp, Homo sapiens
tctatttcatgttttt

SEQ ID NO: 741152 - DNA, 14 bp, Homo sapiens
tctatttctcctcc

SEQ ID NO: 741153 - DNA, 15 bp, Homo sapiens
tctatttctcctcca

SEQ ID NO: 741154 - DNA, 14 bp, Homo sapiens
tctatttcttgaag

SEQ ID NO: 741155 - DNA, 17 bp, Homo sapiens
tctatttgtacaatttt

SEQ ID NO: 741156 - DNA, 18 bp, Homo sapiens
tctatttgtacaatttta

SEQ ID NO: 741157 - DNA, 22 bp, Homo sapiens
tctatttgtatatctcaacaga

SEQ ID NO: 741158 - DNA, 15 bp, Homo sapiens
tctattttaaaataa

SEQ ID NO: 741159 - DNA, 14 bp, Homo sapiens
tctattttcataat

SEQ ID NO: 741160 - DNA, 13 bp, Homo sapiens
tctattttcccta

SEQ ID NO: 741161 - DNA, 13 bp, Homo sapiens
tctatttttacat

SEQ ID NO: 741162 - DNA, 17 bp, Homo sapiens
tctatttttacatttaa

SEQ ID NO: 741163 - DNA, 22 bp, Homo sapiens
tctatttttacctactgtgtct

SEQ ID NO: 741164 - DNA, 17 bp, Homo sapiens
tctatttttcaatcatc

SEQ ID NO: 741165 - DNA, 13 bp, Homo sapiens
tctatttttgtct

SEQ ID NO: 741166 - DNA, 21 bp, Homo sapiens
tctattttttacttgttttcg

SEQ ID NO: 741167 - DNA, 14 bp, Homo sapiens
tctattttttgtat

SEQ ID NO: 741168 - DNA, 20 bp, Homo sapiens
tctatttttttaactgaaaa

SEQ ID NO: 741169 - DNA, 21 bp, Homo sapiens
tctatttttttaactgaaaat

SEQ ID NO: 741170 - DNA, 22 bp, Homo sapiens
tctcaaaaaaaaaaaaatgcac

SEQ ID NO: 741171 - DNA, 22 bp, Homo sapiens
tctcaaaaaaaagaaaatgtct

SEQ ID NO: 741172 - DNA, 17 bp, Homo sapiens
tctcaaaacagagggct

SEQ ID NO: 741173 - DNA, 18 bp, Homo sapiens
tctcaaaacagagggctg

SEQ ID NO: 741174 - DNA, 16 bp, Homo sapiens
tctcaaaagtctattt

SEQ ID NO: 741175 - DNA, 17 bp, Homo sapiens
tctcaaaataaagcaat

SEQ ID NO: 741176 - DNA, 13 bp, Homo sapiens
tctcaaacacagt

SEQ ID NO: 741177 - DNA, 19 bp, Homo sapiens
tctcaaacacagttacact

SEQ ID NO: 741178 - DNA, 17 bp, Homo sapiens
tctcaaagagattcgaa

SEQ ID NO: 741179 - DNA, 16 bp, Homo sapiens
tctcaaagagggggct

SEQ ID NO: 741180 - DNA, 14 bp, Homo sapiens
tctcaaaggagaaa

SEQ ID NO: 741181 - DNA, 18 bp, Homo sapiens
tctcaaaggagaaaaaaa

SEQ ID NO: 741182 - DNA, 19 bp, Homo sapiens
tctcaaagtataatctttc

SEQ ID NO: 741183 - DNA, 17 bp, Homo sapiens
tctcaaagttaattcac

SEQ ID NO: 741184 - DNA, 22 bp, Homo sapiens
tctcaaataggctattaaaaaa

SEQ ID NO: 741185 - DNA, 13 bp, Homo sapiens
tctcaaatttcta

SEQ ID NO: 741186 - DNA, 14 bp, Homo sapiens
tctcaaatttctaa

SEQ ID NO: 741187 - DNA, 19 bp, Homo sapiens
tctcaacaaagcacagtgt

SEQ ID NO: 741188 - DNA, 14 bp, Homo sapiens
tctcaacatgtgtt

SEQ ID NO: 741189 - DNA, 20 bp, Homo sapiens
tctcaacatgtgtttctgac

SEQ ID NO: 741190 - DNA, 23 bp, Homo sapiens
tctcaacctaccaccccttcctg

SEQ ID NO: 741191 - DNA, 23 bp, Homo sapiens
tctcaagaaagccctcattttta

SEQ ID NO: 741192 - DNA, 22 bp, Homo sapiens
tctcaagaatctagaagatgtg

SEQ ID NO: 741193 - DNA, 16 bp, Homo sapiens
tctcaagacctgagta

SEQ ID NO: 741194 - DNA, 18 bp, Homo sapiens
tctcaagacctgagtatt

SEQ ID NO: 741195 - DNA, 12 bp, Homo sapiens
tctcaagacttt

SEQ ID NO: 741196 - DNA, 15 bp, Homo sapiens
tctcaagccagcccc

SEQ ID NO: 741197 - DNA, 18 bp, Homo sapiens
tctcaagctagtgtttct

SEQ ID NO: 741198 - DNA, 19 bp, Homo sapiens
tctcaagctagtgtttcta

SEQ ID NO: 741199 - DNA, 23 bp, Homo sapiens
tctcaagggctagcatccctgag

SEQ ID NO: 741200 - DNA, 22 bp, Homo sapiens
tctcaagtgatgagacagtgaa

SEQ ID NO: 741201 - DNA, 22 bp, Homo sapiens
tctcaagtgttttggagaaaaa

SEQ ID NO: 741202 - DNA, 14 bp, Homo sapiens
tctcaatatgctta

SEQ ID NO: 741203 - DNA, 15 bp, Homo sapiens
tctcaatcagtgcag

SEQ ID NO: 741204 - DNA, 16 bp, Homo sapiens
tctcaatcagtgcagt

SEQ ID NO: 741205 - DNA, 14 bp, Homo sapiens
tctcaatctgcagc

SEQ ID NO: 741206 - DNA, 23 bp, Homo sapiens
tctcaatctgcagccattcttca

SEQ ID NO: 741207 - DNA, 16 bp, Homo sapiens
tctcaatgaagccagc

SEQ ID NO: 741208 - DNA, 19 bp, Homo sapiens
tctcaatggtattgtaact

SEQ ID NO: 741209 - DNA, 22 bp, Homo sapiens
tctcaattaaagtctattcaaa

SEQ ID NO: 741210 - DNA, 22 bp, Homo sapiens
tctcaatttttggttgaataaa

SEQ ID NO: 741211 - DNA, 18 bp, Homo sapiens
tctcacacatcacattcc

SEQ ID NO: 741212 - DNA, 18 bp, Homo sapiens
tctcacaggctgagaact

SEQ ID NO: 741213 - DNA, 12 bp, Homo sapiens
tctcaccaggaa

SEQ ID NO: 741214 - DNA, 11 bp, Homo sapiens
tctcacccacc

SEQ ID NO: 741215 - DNA, 14 bp, Homo sapiens
tctcacccaccagc

SEQ ID NO: 741216 - DNA, 14 bp, Homo sapiens
tctcacccagcctg

SEQ ID NO: 741217 - DNA, 15 bp, Homo sapiens
tctcacccagcctgg

SEQ ID NO: 741218 - DNA, 15 bp, Homo sapiens
tctcacccaggcaat

SEQ ID NO: 741219 - DNA, 20 bp, Homo sapiens
tctcacccattatctggaat

SEQ ID NO: 741220 - DNA, 13 bp, Homo sapiens
tctcaccccaagc

SEQ ID NO: 741221 - DNA, 12 bp, Homo sapiens
tctcacctcagc

SEQ ID NO: 741222 - DNA, 24 bp, Homo sapiens
tctcacctggacttaagcatctgg

SEQ ID NO: 741223 - DNA, 15 bp, Homo sapiens
tctcacctgtactct

SEQ ID NO: 741224 - DNA, 16 bp, Homo sapiens
tctcacgggccctgcc

SEQ ID NO: 741225 - DNA, 20 bp, Homo sapiens
tctcacgggctctatgcctg

SEQ ID NO: 741226 - DNA, 17 bp, Homo sapiens
tctcactaaactttacc

SEQ ID NO: 741227 - DNA, 20 bp, Homo sapiens
gctccctgacttctcccccg

SEQ ID NO: 741228 - DNA, 12 bp, Homo sapiens
gctccctgcccc

SEQ ID NO: 741229 - DNA, 12 bp, Homo sapiens
gctccctggagc

SEQ ID NO: 741230 - DNA, 14 bp, Homo sapiens
gctccctggagccc

SEQ ID NO: 741231 - DNA, 17 bp, Homo sapiens
gctccctggagccctgt

SEQ ID NO: 741232 - DNA, 13 bp, Homo sapiens
gctccctgggcag

SEQ ID NO: 741233 - DNA, 21 bp, Homo sapiens
gctccctggggttctctacag

SEQ ID NO: 741234 - DNA, 19 bp, Homo sapiens
gctccctgtggggcaggag

SEQ ID NO: 741235 - DNA, 21 bp, Homo sapiens
gctcccttcatctccagggag

SEQ ID NO: 741236 - DNA, 12 bp, Homo sapiens
gctcccttccct

SEQ ID NO: 741237 - DNA, 22 bp, Homo sapiens
gctcccttgggaaggacacagc

SEQ ID NO: 741238 - DNA, 15 bp, Homo sapiens
gctcccttgtgcgtg

SEQ ID NO: 741239 - DNA, 16 bp, Homo sapiens
gctcccttttgtcctt

SEQ ID NO: 741240 - DNA, 15 bp, Homo sapiens
gctccgaaattccaa

SEQ ID NO: 741241 - DNA, 22 bp, Homo sapiens
gctccgacctctctcagcccca

SEQ ID NO: 741242 - DNA, 15 bp, Homo sapiens
gctccgaggacccag

SEQ ID NO: 741243 - DNA, 17 bp, Homo sapiens
gctccgagggcggccag

SEQ ID NO: 741244 - DNA, 20 bp, Homo sapiens
gctccgagggcggccaggga

SEQ ID NO: 741245 - DNA, 22 bp, Homo sapiens
gctccgagggcggccagggaca

SEQ ID NO: 741246 - DNA, 13 bp, Homo sapiens
gctccgccaggaa

SEQ ID NO: 741247 - DNA, 20 bp, Homo sapiens
gctccgccatggtgtcccgg

SEQ ID NO: 741248 - DNA, 22 bp, Homo sapiens
gctccgctgctccttggcttac

SEQ ID NO: 741249 - DNA, 22 bp, Homo sapiens
gctccggaggggacccagctcc

SEQ ID NO: 741250 - DNA, 15 bp, Homo sapiens
gctccggcctgcgtc

SEQ ID NO: 741251 - DNA, 14 bp, Homo sapiens
gctccgtctctgtc

SEQ ID NO: 741252 - DNA, 14 bp, Homo sapiens
gctccgtgcctcca

SEQ ID NO: 741253 - DNA, 16 bp, Homo sapiens
gctccgtgcctccacc

SEQ ID NO: 741254 - DNA, 17 bp, Homo sapiens
gctccgtgcctccacca

SEQ ID NO: 741255 - DNA, 17 bp, Homo sapiens
gctccgtggactgcagt

SEQ ID NO: 741256 - DNA, 19 bp, Homo sapiens
gctccgtgttcctcggtgg

SEQ ID NO: 741257 - DNA, 18 bp, Homo sapiens
tctcatttaagggaaaaa

SEQ ID NO: 741258 - DNA, 19 bp, Homo sapiens
tctcatttaagggaaaaat

SEQ ID NO: 741259 - DNA, 17 bp, Homo sapiens
tctcattttggtctgtt

SEQ ID NO: 741260 - DNA, 21 bp, Homo sapiens
tctcatttttccgtaaaaatg

SEQ ID NO: 741261 - DNA, 21 bp, Homo sapiens
tctccaaaaaaaaaaaaaata

SEQ ID NO: 741262 - DNA, 23 bp, Homo sapiens
tctccaaaaaaaaaaaaaataca

SEQ ID NO: 741263 - DNA, 21 bp, Homo sapiens
tctccaaacaccggcagaaaa

SEQ ID NO: 741264 - DNA, 23 bp, Homo sapiens
tctccaaaccagacggtgacgcc

SEQ ID NO: 741265 - DNA, 22 bp, Homo sapiens
tctccaaactgaagcagcctct

SEQ ID NO: 741266 - DNA, 15 bp, Homo sapiens
tctccaaaggggctg

SEQ ID NO: 741267 - DNA, 24 bp, Homo sapiens
tctccaaatattattcaagtgcct

SEQ ID NO: 741268 - DNA, 21 bp, Homo sapiens
tctccaacatcacagcccagc

SEQ ID NO: 741269 - DNA, 21 bp, Homo sapiens
tctccaactgcctaaggccct

SEQ ID NO: 741270 - DNA, 21 bp, Homo sapiens
tctccaagaaactgaatgaat

SEQ ID NO: 741271 - DNA, 16 bp, Homo sapiens
tctccaagaccttggc

SEQ ID NO: 741272 - DNA, 19 bp, Homo sapiens
tctccaaggatcctctcca

SEQ ID NO: 741273 - DNA, 22 bp, Homo sapiens
tctccaagggagggtgcagccc

SEQ ID NO: 741274 - DNA, 16 bp, Homo sapiens
tctccaagggcttctg

SEQ ID NO: 741275 - DNA, 21 bp, Homo sapiens
tctccaagggcttctgcaccc

SEQ ID NO: 741276 - DNA, 22 bp, Homo sapiens
tctccaagggcttctgcaccct

SEQ ID NO: 741277 - DNA, 18 bp, Homo sapiens
tctccaagtctctctgtg

SEQ ID NO: 741278 - DNA, 21 bp, Homo sapiens
tctccaagtctctctgtgaat

SEQ ID NO: 741279 - DNA, 23 bp, Homo sapiens
tctccaagtctctctgtgaatac

SEQ ID NO: 741280 - DNA, 14 bp, Homo sapiens
tctccaagtgccag

SEQ ID NO: 741281 - DNA, 18 bp, Homo sapiens
tctccacaacagcctggg

SEQ ID NO: 741282 - DNA, 19 bp, Homo sapiens
tctccacaacagcctgggg

SEQ ID NO: 741283 - DNA, 22 bp, Homo sapiens
tctccaccagccctactcctgc

SEQ ID NO: 741284 - DNA, 22 bp, Homo sapiens
tctccacctacacccctgtgct

SEQ ID NO: 741285 - DNA, 12 bp, Homo sapiens
tctccacctcag

SEQ ID NO: 741286 - DNA, 20 bp, Homo sapiens
tctccacgtctttcctgcta

SEQ ID NO: 741287 - DNA, 12 bp, Homo sapiens
tctccactccat

SEQ ID NO: 741288 - DNA, 15 bp, Homo sapiens
tctccactcttctct

SEQ ID NO: 741289 - DNA, 22 bp, Homo sapiens
tctccactcttctctcctttct

SEQ ID NO: 741290 - DNA, 17 bp, Homo sapiens
tctccactgctggacat

SEQ ID NO: 741291 - DNA, 19 bp, Homo sapiens
tctccactgtgcctttgca

SEQ ID NO: 741292 - DNA, 13 bp, Homo sapiens
tctccacttgtat

SEQ ID NO: 741293 - DNA, 22 bp, Homo sapiens
tctccagaaacagctgcttctc

SEQ ID NO: 741294 - DNA, 23 bp, Homo sapiens
tctccagaaacagctgcttctcc

SEQ ID NO: 741295 - DNA, 11 bp, Homo sapiens
tctccagaccc

SEQ ID NO: 741296 - DNA, 20 bp, Homo sapiens
tctccagacccccacccctt

SEQ ID NO: 741297 - DNA, 15 bp, Homo sapiens
tctccagatgttaat

SEQ ID NO: 741298 - DNA, 16 bp, Homo sapiens
tctccagccagcaatg

SEQ ID NO: 741299 - DNA, 21 bp, Homo sapiens
tctccagcgtcagctgctccc

SEQ ID NO: 741300 - DNA, 23 bp, Homo sapiens
tctccagctcagaacccagggct

SEQ ID NO: 741301 - DNA, 12 bp, Homo sapiens
tctccagctgac

SEQ ID NO: 741302 - DNA, 12 bp, Homo sapiens
tctccagctgcc

SEQ ID NO: 741303 - DNA, 13 bp, Homo sapiens
tctccagctgcct

SEQ ID NO: 741304 - DNA, 17 bp, Homo sapiens
tctccagctgcctgggc

SEQ ID NO: 741305 - DNA, 14 bp, Homo sapiens
tctccaggaccaat

SEQ ID NO: 741306 - DNA, 13 bp, Homo sapiens
tctccaggatcca

SEQ ID NO: 741307 - DNA, 23 bp, Homo sapiens
tctccaggcacccttctttcctc

SEQ ID NO: 741308 - DNA, 13 bp, Homo sapiens
tctccaggcattt

SEQ ID NO: 741309 - DNA, 13 bp, Homo sapiens
tctccaggccagg

SEQ ID NO: 741310 - DNA, 18 bp, Homo sapiens
tctccaggccatgatggc

SEQ ID NO: 741311 - DNA, 14 bp, Homo sapiens
tctccagggaagcg

SEQ ID NO: 741312 - DNA, 21 bp, Homo sapiens
tctccagggagtcccctcccc

SEQ ID NO: 741313 - DNA, 14 bp, Homo sapiens
tctccagggctcca

SEQ ID NO: 741314 - DNA, 23 bp, Homo sapiens
tctccaggggctgcttcctcctg

SEQ ID NO: 741315 - DNA, 16 bp, Homo sapiens
tctccaggggtttaca

SEQ ID NO: 741316 - DNA, 18 bp, Homo sapiens
tctccagtggattcccag

SEQ ID NO: 741317 - DNA, 14 bp, Homo sapiens
tctccagtgtgcca

SEQ ID NO: 741318 - DNA, 18 bp, Homo sapiens
tctccagtgtgccagaca

SEQ ID NO: 741319 - DNA, 18 bp, Homo sapiens
tctccagtttttgaggag

SEQ ID NO: 741320 - DNA, 19 bp, Homo sapiens
tctccatacctgcccctgc

SEQ ID NO: 741321 - DNA, 15 bp, Homo sapiens
tctccatatctcctt

SEQ ID NO: 741322 - DNA, 16 bp, Homo sapiens
tctccatatctccttc

SEQ ID NO: 741323 - DNA, 21 bp, Homo sapiens
tctccatcaccctcttcctgt

SEQ ID NO: 741324 - DNA, 15 bp, Homo sapiens
tctccatcagatgtg

SEQ ID NO: 741325 - DNA, 18 bp, Homo sapiens
tctccatcatatgcctga

SEQ ID NO: 741326 - DNA, 22 bp, Homo sapiens
tctccatcccctccctgcctgc

SEQ ID NO: 741327 - DNA, 14 bp, Homo sapiens
tctccatctgtttg

SEQ ID NO: 741328 - DNA, 16 bp, Homo sapiens
tctccatctttataga

SEQ ID NO: 741329 - DNA, 22 bp, Homo sapiens
tctccatgaggtactggtccct

SEQ ID NO: 741330 - DNA, 14 bp, Homo sapiens
tctccatgctgcaa

SEQ ID NO: 741331 - DNA, 22 bp, Homo sapiens
tctccatgctggatactggaca

SEQ ID NO: 741332 - DNA, 15 bp, Homo sapiens
tctccatggccacct

SEQ ID NO: 741333 - DNA, 13 bp, Homo sapiens
tctccatggccct

SEQ ID NO: 741334 - DNA, 21 bp, Homo sapiens
tctccatggccctgtcccagg

SEQ ID NO: 741335 - DNA, 20 bp, Homo sapiens
tctccatggcttcctcctcc

SEQ ID NO: 741336 - DNA, 23 bp, Homo sapiens
tctccatgtagaataaatgaaga

SEQ ID NO: 741337 - DNA, 19 bp, Homo sapiens
tctccatgttggcctgtca

SEQ ID NO: 741338 - DNA, 12 bp, Homo sapiens
tctccatttcaa

SEQ ID NO: 741339 - DNA, 15 bp, Homo sapiens
tctccatttggaatt

SEQ ID NO: 741340 - DNA, 15 bp, Homo sapiens
tctccattttagccc

SEQ ID NO: 741341 - DNA, 17 bp, Homo sapiens
tctccattttagcccag

SEQ ID NO: 741342 - DNA, 17 bp, Homo sapiens
tctccattttcttctct

SEQ ID NO: 741343 - DNA, 21 bp, Homo sapiens
tctccattttcttctctgtga

SEQ ID NO: 741344 - DNA, 18 bp, Homo sapiens
tctcccaaaaaactactt

SEQ ID NO: 741345 - DNA, 18 bp, Homo sapiens
tctcccaacatgggaggg

SEQ ID NO: 741346 - DNA, 19 bp, Homo sapiens
tctcccacacccacccttt

SEQ ID NO: 741347 - DNA, 21 bp, Homo sapiens
tctcccacatgaggccatctc

SEQ ID NO: 741348 - DNA, 22 bp, Homo sapiens
tctcccacatgaggccatctca

SEQ ID NO: 741349 - DNA, 14 bp, Homo sapiens
tctcccaccccgcc

SEQ ID NO: 741350 - DNA, 14 bp, Homo sapiens
tctcccaccccttg

SEQ ID NO: 741351 - DNA, 18 bp, Homo sapiens
tctcccaccccttggccc

SEQ ID NO: 741352 - DNA, 22 bp, Homo sapiens
tctcccaccccttggcccctca

SEQ ID NO: 741353 - DNA, 22 bp, Homo sapiens
tctcccaccctaagggcagccc

SEQ ID NO: 741354 - DNA, 18 bp, Homo sapiens
tctcccactccagcgctg

SEQ ID NO: 741355 - DNA, 21 bp, Homo sapiens
tctcccactgcaacttgtgaa

SEQ ID NO: 741356 - DNA, 15 bp, Homo sapiens
tctcccactttctgt

SEQ ID NO: 741357 - DNA, 15 bp, Homo sapiens
tctcccagaatccca

SEQ ID NO: 741358 - DNA, 19 bp, Homo sapiens
tctcccagaatcccagccg

SEQ ID NO: 741359 - DNA, 12 bp, Homo sapiens
tctcccagcaca

SEQ ID NO: 741360 - DNA, 22 bp, Homo sapiens
tctcccagcactgcctcctgtt

SEQ ID NO: 741361 - DNA, 19 bp, Homo sapiens
ctgtgcagaataatggaaa

SEQ ID NO: 741362 - DNA, 16 bp, Homo sapiens
ctgtgcagcagcccag

SEQ ID NO: 741363 - DNA, 23 bp, Homo sapiens
ctgtgcagcagcccagcttcctg

SEQ ID NO: 741364 - DNA, 21 bp, Homo sapiens
ctgtgcagccgctgagcgagg

SEQ ID NO: 741365 - DNA, 15 bp, Homo sapiens
ctgtgcagcgcagct

SEQ ID NO: 741366 - DNA, 17 bp, Homo sapiens
ctgtgcagcgcagctgg

SEQ ID NO: 741367 - DNA, 21 bp, Homo sapiens
ctgtgcagcgcagctggactc

SEQ ID NO: 741368 - DNA, 22 bp, Homo sapiens
ctgtgcagggaggaggtggcag

SEQ ID NO: 741369 - DNA, 18 bp, Homo sapiens
ctgtgcatagtgctggga

SEQ ID NO: 741370 - DNA, 22 bp, Homo sapiens
ctgtgcatgggtgaagggagag

SEQ ID NO: 741371 - DNA, 22 bp, Homo sapiens
ctgtgccagaaacagtgggagc

SEQ ID NO: 741372 - DNA, 11 bp, Homo sapiens
ctgtgccagca

SEQ ID NO: 741373 - DNA, 15 bp, Homo sapiens
ctgtgccagcaccac

SEQ ID NO: 741374 - DNA, 16 bp, Homo sapiens
ctgtgccaggaggcgg

SEQ ID NO: 741375 - DNA, 19 bp, Homo sapiens
ctgtgccatggccccccac

SEQ ID NO: 741376 - DNA, 22 bp, Homo sapiens
ctgtgccatggccccccactcc

SEQ ID NO: 741377 - DNA, 21 bp, Homo sapiens
ctgtgcccacggtctgagcta

SEQ ID NO: 741378 - DNA, 16 bp, Homo sapiens
ctgtgcccagcaggcc

SEQ ID NO: 741379 - DNA, 11 bp, Homo sapiens
ctgtgccccac

SEQ ID NO: 741380 - DNA, 14 bp, Homo sapiens
ctgtgccccaccac

SEQ ID NO: 741381 - DNA, 17 bp, Homo sapiens
ctgtgccccagctgcca

SEQ ID NO: 741382 - DNA, 18 bp, Homo sapiens
ctgtgccccagctgccag

SEQ ID NO: 741383 - DNA, 21 bp, Homo sapiens
ctgtgccccatgcctgtccag

SEQ ID NO: 741384 - DNA, 19 bp, Homo sapiens
ctgtgcccccagcctcagc

SEQ ID NO: 741385 - DNA, 17 bp, Homo sapiens
ctgtgccccctctggtt

SEQ ID NO: 741386 - DNA, 22 bp, Homo sapiens
ctgtgccccgcgggctttgttg

SEQ ID NO: 741387 - DNA, 15 bp, Homo sapiens
ctgtgcccctgatgc

SEQ ID NO: 741388 - DNA, 14 bp, Homo sapiens
ctgtgccctcacca

SEQ ID NO: 741389 - DNA, 18 bp, Homo sapiens
ctgtgccctcaccaccac

SEQ ID NO: 741390 - DNA, 15 bp, Homo sapiens
ctgtgccctcacccc

SEQ ID NO: 741391 - DNA, 11 bp, Homo sapiens
ctgtgccctgg

SEQ ID NO: 741392 - DNA, 16 bp, Homo sapiens
ctgtgccctggtggag

SEQ ID NO: 741393 - DNA, 17 bp, Homo sapiens
ctgtgccctggtggaga

SEQ ID NO: 741394 - DNA, 17 bp, Homo sapiens
ctgtgccgcactctggc

SEQ ID NO: 741395 - DNA, 15 bp, Homo sapiens
ctgtgcctcagagac

SEQ ID NO: 741396 - DNA, 13 bp, Homo sapiens
ctgtgcctcaggc

SEQ ID NO: 741397 - DNA, 15 bp, Homo sapiens
ctgtgcctcaggcca

SEQ ID NO: 741398 - DNA, 21 bp, Homo sapiens
ctgtgcctcaggccagggctc

SEQ ID NO: 741399 - DNA, 17 bp, Homo sapiens
ctgtgcctccaggacca

SEQ ID NO: 741400 - DNA, 14 bp, Homo sapiens
ctgtgcctcccccc

SEQ ID NO: 741401 - DNA, 17 bp, Homo sapiens
ctgtgcctccccccaga

SEQ ID NO: 741402 - DNA, 18 bp, Homo sapiens
ctgtgcctccccccagac

SEQ ID NO: 741403 - DNA, 19 bp, Homo sapiens
ctgtgcctccccccagacc

SEQ ID NO: 741404 - DNA, 21 bp, Homo sapiens
ctgtgcctccccccagacccc

SEQ ID NO: 741405 - DNA, 17 bp, Homo sapiens
ctgtgcctcgcatccta

SEQ ID NO: 741406 - DNA, 21 bp, Homo sapiens
ctgtgcctcgcatcctatgct

SEQ ID NO: 741407 - DNA, 14 bp, Homo sapiens
ctgtgcctctgcct

SEQ ID NO: 741408 - DNA, 17 bp, Homo sapiens
ctgtgcctctgcctgtc

SEQ ID NO: 741409 - DNA, 17 bp, Homo sapiens
ctgtgcctctgggactg

SEQ ID NO: 741410 - DNA, 15 bp, Homo sapiens
ctgtgcctgaatatt

SEQ ID NO: 741411 - DNA, 18 bp, Homo sapiens
ctgtgcctgcctttgtgt

SEQ ID NO: 741412 - DNA, 11 bp, Homo sapiens
ctgtgcctgct

SEQ ID NO: 741413 - DNA, 13 bp, Homo sapiens
ctgtgcctgctca

SEQ ID NO: 741414 - DNA, 14 bp, Homo sapiens
ctgtgcctgctcag

SEQ ID NO: 741415 - DNA, 21 bp, Homo sapiens
ctgtgcctgctcagcagccag

SEQ ID NO: 741416 - DNA, 13 bp, Homo sapiens
ctgtgcctggcct

SEQ ID NO: 741417 - DNA, 18 bp, Homo sapiens
ctgtgcctgggccctggg

SEQ ID NO: 741418 - DNA, 20 bp, Homo sapiens
ctgtgcctgggccctgggct

SEQ ID NO: 741419 - DNA, 21 bp, Homo sapiens
ctgtgcctgggccctgggctg

SEQ ID NO: 741420 - DNA, 14 bp, Homo sapiens
ctgtgcctttccta

SEQ ID NO: 741421 - DNA, 19 bp, Homo sapiens
ctgtgcctttgcaaatcag

SEQ ID NO: 741422 - DNA, 20 bp, Homo sapiens
ctgtgcgcgtggcgtggccc

SEQ ID NO: 741423 - DNA, 16 bp, Homo sapiens
ctgtgcgtgaaacaca

SEQ ID NO: 741424 - DNA, 21 bp, Homo sapiens
ctgtgcgtgtggcgtggcccg

SEQ ID NO: 741425 - DNA, 17 bp, Homo sapiens
ctgtgcgttactaattg

SEQ ID NO: 741426 - DNA, 20 bp, Homo sapiens
ctgtgctagttttacagatt

SEQ ID NO: 741427 - DNA, 16 bp, Homo sapiens
ctgtgctatgaatttt

SEQ ID NO: 741428 - DNA, 23 bp, Homo sapiens
ctgtgctccatatttgatttcta

SEQ ID NO: 741429 - DNA, 18 bp, Homo sapiens
ctgtgctcccctgccaca

SEQ ID NO: 741430 - DNA, 23 bp, Homo sapiens
ctgtgctcccctgccacactgat

SEQ ID NO: 741431 - DNA, 23 bp, Homo sapiens
ctgtgctccgccatggtgtcccg

SEQ ID NO: 741432 - DNA, 18 bp, Homo sapiens
ctgtgctccgtgcctcca

SEQ ID NO: 741433 - DNA, 15 bp, Homo sapiens
ctgtgctctctgtgg

SEQ ID NO: 741434 - DNA, 12 bp, Homo sapiens
ctgtgctctgaa

SEQ ID NO: 741435 - DNA, 16 bp, Homo sapiens
ctgtggggtgggctgg

SEQ ID NO: 741436 - DNA, 19 bp, Homo sapiens
ctgtggggtgggctggagt

SEQ ID NO: 741437 - DNA, 17 bp, Homo sapiens
ctgtgggtctctgaagg

SEQ ID NO: 741438 - DNA, 15 bp, Homo sapiens
ctgtgggtgacccag

SEQ ID NO: 741439 - DNA, 12 bp, Homo sapiens
ctgtgggtgggg

SEQ ID NO: 741440 - DNA, 16 bp, Homo sapiens
ctgtgggtggggaggc

SEQ ID NO: 741441 - DNA, 20 bp, Homo sapiens
ctgtgggtggggaggccctg

SEQ ID NO: 741442 - DNA, 19 bp, Homo sapiens
ctgtgggtgtctccctcgg

SEQ ID NO: 741443 - DNA, 21 bp, Homo sapiens
ctgtgggtgtctccctcgggg

SEQ ID NO: 741444 - DNA, 22 bp, Homo sapiens
ctgtgggtgtctccctcggggg

SEQ ID NO: 741445 - DNA, 11 bp, Homo sapiens
ctgtgggtgtg

SEQ ID NO: 741446 - DNA, 21 bp, Homo sapiens
ctgtgggtttgggtgcctcct

SEQ ID NO: 741447 - DNA, 24 bp, Homo sapiens
ctgtgggtttgggtgcctcctgca

SEQ ID NO: 741448 - DNA, 17 bp, Homo sapiens
ctgtggtaggggcaggg

SEQ ID NO: 741449 - DNA, 18 bp, Homo sapiens
ctgtggtaggggcaggga

SEQ ID NO: 741450 - DNA, 23 bp, Homo sapiens
ctgtggtagtactcctgcaaaat

SEQ ID NO: 741451 - DNA, 15 bp, Homo sapiens
ctgtggtcacagtga

SEQ ID NO: 741452 - DNA, 20 bp, Homo sapiens
ctgtggtcagcagatgccag

SEQ ID NO: 741453 - DNA, 22 bp, Homo sapiens
ctgtggtcagcagatgccagtg

SEQ ID NO: 741454 - DNA, 17 bp, Homo sapiens
ctgtggtctataaaata

SEQ ID NO: 741455 - DNA, 21 bp, Homo sapiens
ctgtggtgaagtgtggctggt

SEQ ID NO: 741456 - DNA, 20 bp, Homo sapiens
ctgtggtggctccccctctg

SEQ ID NO: 741457 - DNA, 14 bp, Homo sapiens
ctgtggttacagtg

SEQ ID NO: 741458 - DNA, 19 bp, Homo sapiens
ctgtggttcctaagcctgt

SEQ ID NO: 741459 - DNA, 19 bp, Homo sapiens
ctgtggttctataataagt

SEQ ID NO: 741460 - DNA, 22 bp, Homo sapiens
ctgtggtttaagctttgtgaaa

SEQ ID NO: 741461 - DNA, 22 bp, Homo sapiens
ctgtggttttattacaaatgca

SEQ ID NO: 741462 - DNA, 19 bp, Homo sapiens
ctgtggttttcccctccct

SEQ ID NO: 741463 - DNA, 22 bp, Homo sapiens
ctgtggttttcccctccctggg

SEQ ID NO: 741464 - DNA, 23 bp, Homo sapiens
ctgtggttttcccctccctgggt

SEQ ID NO: 741465 - DNA, 15 bp, Homo sapiens
ctgtgtaaaccacat

SEQ ID NO: 741466 - DNA, 19 bp, Homo sapiens
ctgtgtaaagacttgagaa

SEQ ID NO: 741467 - DNA, 19 bp, Homo sapiens
ctgtgtaaatatttttccc

SEQ ID NO: 741468 - DNA, 21 bp, Homo sapiens
ctgtgtaaatatttttccctc

SEQ ID NO: 741469 - DNA, 18 bp, Homo sapiens
ctgtgtaaccttgggtgg

SEQ ID NO: 741470 - DNA, 18 bp, Homo sapiens
ctgtgtaagatttgtttt

SEQ ID NO: 741471 - DNA, 14 bp, Homo sapiens
ctgtgtacaaagaa

SEQ ID NO: 741472 - DNA, 23 bp, Homo sapiens
ctgtgtacataactctgtaaaaa

SEQ ID NO: 741473 - DNA, 20 bp, Homo sapiens
ctgtgtacataactgaaaat

SEQ ID NO: 741474 - DNA, 15 bp, Homo sapiens
ctgtgtaccacttct

SEQ ID NO: 741475 - DNA, 18 bp, Homo sapiens
ctgtgtagccgccctgag

SEQ ID NO: 741476 - DNA, 19 bp, Homo sapiens
ctgtgtatcattaaaatat

SEQ ID NO: 741477 - DNA, 14 bp, Homo sapiens
ctgtgtatgtttta

SEQ ID NO: 741478 - DNA, 19 bp, Homo sapiens
ctgtgtatgttttatatca

SEQ ID NO: 741479 - DNA, 14 bp, Homo sapiens
ctgtgtatttgctt

SEQ ID NO: 741480 - DNA, 16 bp, Homo sapiens
ctgtgtattttcagtc

SEQ ID NO: 741481 - DNA, 23 bp, Homo sapiens
ctgtgtattttttaaagctacaa

SEQ ID NO: 741482 - DNA, 17 bp, Homo sapiens
ctgtgtcagagcctacc

SEQ ID NO: 741483 - DNA, 18 bp, Homo sapiens
ctgtgtcagagcctacct

SEQ ID NO: 741484 - DNA, 21 bp, Homo sapiens
ctgtgtcagagcctaccttca

SEQ ID NO: 741485 - DNA, 17 bp, Homo sapiens
ctgtgtccacctgtggg

SEQ ID NO: 741486 - DNA, 14 bp, Homo sapiens
gtcccccagctctg

SEQ ID NO: 741487 - DNA, 15 bp, Homo sapiens
gtcccccagctctgg

SEQ ID NO: 741488 - DNA, 20 bp, Homo sapiens
gtcccccaggctggagtgca

SEQ ID NO: 741489 - DNA, 20 bp, Homo sapiens
gtcccccatcatgtggccca

SEQ ID NO: 741490 - DNA, 19 bp, Homo sapiens
gtccccccaccgctcagtg

SEQ ID NO: 741491 - DNA, 21 bp, Homo sapiens
gtcccccccaggccttgtcct

SEQ ID NO: 741492 - DNA, 13 bp, Homo sapiens
gtccccccccagg

SEQ ID NO: 741493 - DNA, 18 bp, Homo sapiens
gtcccccgaccaatcccc

SEQ ID NO: 741494 - DNA, 13 bp, Homo sapiens
gtccccctaccca

SEQ ID NO: 741495 - DNA, 14 bp, Homo sapiens
gtccccgaggagct

SEQ ID NO: 741496 - DNA, 23 bp, Homo sapiens
gtccccgaggagctgggcccctg

SEQ ID NO: 741497 - DNA, 19 bp, Homo sapiens
gtccccgagtgcctaggtt

SEQ ID NO: 741498 - DNA, 17 bp, Homo sapiens
gtccccgccttccctca

SEQ ID NO: 741499 - DNA, 13 bp, Homo sapiens
gtccccgctggct

SEQ ID NO: 741500 - DNA, 16 bp, Homo sapiens
gtcccctatcctcccc

SEQ ID NO: 741501 - DNA, 19 bp, Homo sapiens
gtcccctcactctgtcagc

SEQ ID NO: 741502 - DNA, 12 bp, Homo sapiens
gtcccctcccca

SEQ ID NO: 741503 - DNA, 13 bp, Homo sapiens
gtcccctccctcg

SEQ ID NO: 741504 - DNA, 18 bp, Homo sapiens
gtcccctcgtcccatcca

SEQ ID NO: 741505 - DNA, 17 bp, Homo sapiens
gtcccctgagttggagc

SEQ ID NO: 741506 - DNA, 13 bp, Homo sapiens
gtcccctgcagcc

SEQ ID NO: 741507 - DNA, 17 bp, Homo sapiens
gtcccctgcagcctggg

SEQ ID NO: 741508 - DNA, 13 bp, Homo sapiens
gtcccctgccacc

SEQ ID NO: 741509 - DNA, 21 bp, Homo sapiens
gtcccctggagtgtgtcagag

SEQ ID NO: 741510 - DNA, 23 bp, Homo sapiens
gtcccctggagtgtgtcagagcc

SEQ ID NO: 741511 - DNA, 21 bp, Homo sapiens
gtcccctgttgattatcttca

SEQ ID NO: 741512 - DNA, 13 bp, Homo sapiens
gtccccttcccct

SEQ ID NO: 741513 - DNA, 16 bp, Homo sapiens
gtccccttcccctgct

SEQ ID NO: 741514 - DNA, 18 bp, Homo sapiens
gtccccttcccctgctga

SEQ ID NO: 741515 - DNA, 12 bp, Homo sapiens
gtccccttcctg

SEQ ID NO: 741516 - DNA, 20 bp, Homo sapiens
gtccccttcctgttcttcct

SEQ ID NO: 741517 - DNA, 22 bp, Homo sapiens
gtccccttcctgttcttccttc

SEQ ID NO: 741518 - DNA, 19 bp, Homo sapiens
gtcccgatagggtatttga

SEQ ID NO: 741519 - DNA, 16 bp, Homo sapiens
gtcccgcactctgccc

SEQ ID NO: 741520 - DNA, 17 bp, Homo sapiens
gtcccgcactctgcccc

SEQ ID NO: 741521 - DNA, 21 bp, Homo sapiens
gtcccgccttcctcctccaca

SEQ ID NO: 741522 - DNA, 21 bp, Homo sapiens
gtcccgcgcttcgaactccag

SEQ ID NO: 741523 - DNA, 16 bp, Homo sapiens
gtcccgctgcctcctg

SEQ ID NO: 741524 - DNA, 17 bp, Homo sapiens
gtcccgctgcctcctgc

SEQ ID NO: 741525 - DNA, 16 bp, Homo sapiens
gtcccggtgtatcctg

SEQ ID NO: 741526 - DNA, 21 bp, Homo sapiens
gtcccggttcagacccctgcc

SEQ ID NO: 741527 - DNA, 22 bp, Homo sapiens
gtcccggttcagacccctgcct

SEQ ID NO: 741528 - DNA, 14 bp, Homo sapiens
ctgtctgtgggccg

SEQ ID NO: 741529 - DNA, 22 bp, Homo sapiens
ctgtctgtgggcttcagcactt

SEQ ID NO: 741530 - DNA, 20 bp, Homo sapiens
ctgtctgtgtgcatcatgtt

SEQ ID NO: 741531 - DNA, 16 bp, Homo sapiens
ctgtctgttatgattt

SEQ ID NO: 741532 - DNA, 16 bp, Homo sapiens
ctgtcttatcctccac

SEQ ID NO: 741533 - DNA, 18 bp, Homo sapiens
ctgtcttatggtccagaa

SEQ ID NO: 741534 - DNA, 22 bp, Homo sapiens
ctgtcttcagcacattccacgg

SEQ ID NO: 741535 - DNA, 14 bp, Homo sapiens
ctgtcttccaagga

SEQ ID NO: 741536 - DNA, 18 bp, Homo sapiens
ctgtcttcccctgagagt

SEQ ID NO: 741537 - DNA, 14 bp, Homo sapiens
ctgtcttcctcaaa

SEQ ID NO: 741538 - DNA, 13 bp, Homo sapiens
ctgtcttctctcc

SEQ ID NO: 741539 - DNA, 15 bp, Homo sapiens
ctgtcttgccccagt

SEQ ID NO: 741540 - DNA, 22 bp, Homo sapiens
ctgtcttgccccagtttggggt

SEQ ID NO: 741541 - DNA, 15 bp, Homo sapiens
ctgtcttgctcctgg

SEQ ID NO: 741542 - DNA, 13 bp, Homo sapiens
ctgtcttggcatt

SEQ ID NO: 741543 - DNA, 21 bp, Homo sapiens
ctgtcttgttcattttgagta

SEQ ID NO: 741544 - DNA, 22 bp, Homo sapiens
ctgtcttgttgcggatggatgg

SEQ ID NO: 741545 - DNA, 18 bp, Homo sapiens
ctgtctttaaaagagaga

SEQ ID NO: 741546 - DNA, 13 bp, Homo sapiens
ctgtctttattct

SEQ ID NO: 741547 - DNA, 14 bp, Homo sapiens
ctgtctttattctt

SEQ ID NO: 741548 - DNA, 19 bp, Homo sapiens
ctgtctttcactggaatga

SEQ ID NO: 741549 - DNA, 18 bp, Homo sapiens
ctgtctttccactctgga

SEQ ID NO: 741550 - DNA, 17 bp, Homo sapiens
ctgtctttgtggactgt

SEQ ID NO: 741551 - DNA, 15 bp, Homo sapiens
ctgtgaaactggcac

SEQ ID NO: 741552 - DNA, 18 bp, Homo sapiens
ctgtgaaaggtaggaaac

SEQ ID NO: 741553 - DNA, 15 bp, Homo sapiens
ctgtgaaatatcatc

SEQ ID NO: 741554 - DNA, 21 bp, Homo sapiens
ctgtgaacaagcttcagtaag

SEQ ID NO: 741555 - DNA, 17 bp, Homo sapiens
ctgtgaacagcttgctg

SEQ ID NO: 741556 - DNA, 22 bp, Homo sapiens
ctgtgaacgatttagaaagaag

SEQ ID NO: 741557 - DNA, 15 bp, Homo sapiens
ctgtgaactgggcat

SEQ ID NO: 741558 - DNA, 20 bp, Homo sapiens
ctgtgaactgggcatttcac

SEQ ID NO: 741559 - DNA, 17 bp, Homo sapiens
ctgtgaacttgactggg

SEQ ID NO: 741560 - DNA, 22 bp, Homo sapiens
ctgtgaacttggggaacaaggg

SEQ ID NO: 741561 - DNA, 21 bp, Homo sapiens
ctgtgaagagccggtggtgcc

SEQ ID NO: 741562 - DNA, 14 bp, Homo sapiens
ctgtgaaggcttca

SEQ ID NO: 741563 - DNA, 16 bp, Homo sapiens
ctgtgaagtccttcac

SEQ ID NO: 741564 - DNA, 14 bp, Homo sapiens
ctgtgaatacaatt

SEQ ID NO: 741565 - DNA, 18 bp, Homo sapiens
ctgtgaatacaattaaag

SEQ ID NO: 741566 - DNA, 16 bp, Homo sapiens
ctgtgaatgccactgc

SEQ ID NO: 741567 - DNA, 20 bp, Homo sapiens
ctgtgaatgccactgccttc

SEQ ID NO: 741568 - DNA, 15 bp, Homo sapiens
ctgtgaattgagctg

SEQ ID NO: 741569 - DNA, 17 bp, Homo sapiens
ctgtgacaaccctggcc

SEQ ID NO: 741570 - DNA, 23 bp, Homo sapiens
ctgtgacaaccctggcctcactt

SEQ ID NO: 741571 - DNA, 16 bp, Homo sapiens
ctgtgacaataagttt

SEQ ID NO: 741572 - DNA, 18 bp, Homo sapiens
ctgtgacatcctgcttct

SEQ ID NO: 741573 - DNA, 18 bp, Homo sapiens
ctgtgacatggtgcctga

SEQ ID NO: 741574 - DNA, 19 bp, Homo sapiens
ctgtgacatggtgcctgag

SEQ ID NO: 741575 - DNA, 21 bp, Homo sapiens
ctgtgacatggtgcctgagag

SEQ ID NO: 741576 - DNA, 24 bp, Homo sapiens
ctgtgacatggtgcctgagaggca

SEQ ID NO: 741577 - DNA, 17 bp, Homo sapiens
ctgtgacattgctggtc

SEQ ID NO: 741578 - DNA, 17 bp, Homo sapiens
ctgtgaccaactgttgg

SEQ ID NO: 741579 - DNA, 15 bp, Homo sapiens
ctgtgaccaatgtct

SEQ ID NO: 741580 - DNA, 14 bp, Homo sapiens
ctgtgaccagcact

SEQ ID NO: 741581 - DNA, 18 bp, Homo sapiens
ctgtgaccaggaaggaag

SEQ ID NO: 741582 - DNA, 17 bp, Homo sapiens
ctgtgaccatttataat

SEQ ID NO: 741583 - DNA, 15 bp, Homo sapiens
ctgtgacccccagct

SEQ ID NO: 741584 - DNA, 21 bp, Homo sapiens
ctgtgacccccagctccggcc

SEQ ID NO: 741585 - DNA, 15 bp, Homo sapiens
ctgtgacctcttcaa

SEQ ID NO: 741586 - DNA, 16 bp, Homo sapiens
ctgtgacctgtgggga

SEQ ID NO: 741587 - DNA, 14 bp, Homo sapiens
ctgtgaccttggga

SEQ ID NO: 741588 - DNA, 16 bp, Homo sapiens
ctgtgacgcagacaga

SEQ ID NO: 741589 - DNA, 21 bp, Homo sapiens
ctgtgacgcagacagagggga

SEQ ID NO: 741590 - DNA, 17 bp, Homo sapiens
ctgtgactagatacaga

SEQ ID NO: 741591 - DNA, 16 bp, Homo sapiens
ctgtgactctgggcag

SEQ ID NO: 741592 - DNA, 17 bp, Homo sapiens
ctgtgacttcagctctg

SEQ ID NO: 741593 - DNA, 16 bp, Homo sapiens
ctgtgacttctccagg

SEQ ID NO: 741594 - DNA, 12 bp, Homo sapiens
ctgtgagacagt

SEQ ID NO: 741595 - DNA, 15 bp, Homo sapiens
ctgtgagacagtggg

SEQ ID NO: 741596 - DNA, 14 bp, Homo sapiens
ctgtgagaggcagc

SEQ ID NO: 741597 - DNA, 15 bp, Homo sapiens
ctgtgagccatgcct

SEQ ID NO: 741598 - DNA, 17 bp, Homo sapiens
ctgtgagccatgcctcc

SEQ ID NO: 741599 - DNA, 18 bp, Homo sapiens
ctgtgagccatgcctccc

SEQ ID NO: 741600 - DNA, 19 bp, Homo sapiens
ctgtgagccatgcctccct

SEQ ID NO: 741601 - DNA, 21 bp, Homo sapiens
ctgtgagccatgcctccctgg

SEQ ID NO: 741602 - DNA, 14 bp, Homo sapiens
ctgtgagcccctgg

SEQ ID NO: 741603 - DNA, 15 bp, Homo sapiens
ctgtgagcccctggt

SEQ ID NO: 741604 - DNA, 21 bp, Homo sapiens
ctgtgagcccctggtcctgag

SEQ ID NO: 741605 - DNA, 18 bp, Homo sapiens
ctgtgagccgccaggaac

SEQ ID NO: 741606 - DNA, 22 bp, Homo sapiens
ctgtgagcgctggctccctggg

SEQ ID NO: 741607 - DNA, 23 bp, Homo sapiens
ctgtgagcgctggctccctgggc

SEQ ID NO: 741608 - DNA, 15 bp, Homo sapiens
ctgtctcgggctgac

SEQ ID NO: 741609 - DNA, 20 bp, Homo sapiens
ctgtctctaaccattcaaat

SEQ ID NO: 741610 - DNA, 16 bp, Homo sapiens
ctgtctctccatctgt

SEQ ID NO: 741611 - DNA, 11 bp, Homo sapiens
ctgtctctccc

SEQ ID NO: 741612 - DNA, 15 bp, Homo sapiens
ctgtctctcctagcc

SEQ ID NO: 741613 - DNA, 18 bp, Homo sapiens
ctgtctctcctagcccct

SEQ ID NO: 741614 - DNA, 16 bp, Homo sapiens
ctgtctctctgggctg

SEQ ID NO: 741615 - DNA, 12 bp, Homo sapiens
ctgtctctgcct

SEQ ID NO: 741616 - DNA, 21 bp, Homo sapiens
ctgtctctgctcgccctcctt

SEQ ID NO: 741617 - DNA, 11 bp, Homo sapiens
ctgtctctgga

SEQ ID NO: 741618 - DNA, 15 bp, Homo sapiens
ctgtctctggagtga

SEQ ID NO: 741619 - DNA, 23 bp, Homo sapiens
ctgtctctgttcagatgtgcatt

SEQ ID NO: 741620 - DNA, 21 bp, Homo sapiens
ctgtctgaaccacgcgggggc

SEQ ID NO: 741621 - DNA, 20 bp, Homo sapiens
ctgtctgaaggacacttcct

SEQ ID NO: 741622 - DNA, 20 bp, Homo sapiens
ctgtctgacaacctcttggt

SEQ ID NO: 741623 - DNA, 16 bp, Homo sapiens
ctgtctgaggagtaag

SEQ ID NO: 741624 - DNA, 14 bp, Homo sapiens
ctgtctgcacagag

SEQ ID NO: 741625 - DNA, 15 bp, Homo sapiens
ctgtctgccagccag

SEQ ID NO: 741626 - DNA, 21 bp, Homo sapiens
ctgtctgccagccagcagcca

SEQ ID NO: 741627 - DNA, 13 bp, Homo sapiens
ctgtctgccaggc

SEQ ID NO: 741628 - DNA, 14 bp, Homo sapiens
ctgtctgccaggca

SEQ ID NO: 741629 - DNA, 21 bp, Homo sapiens
ctgtctggaagacgtggctct

SEQ ID NO: 741630 - DNA, 14 bp, Homo sapiens
ctgtctggccctgg

SEQ ID NO: 741631 - DNA, 20 bp, Homo sapiens
ctgtctggctcggacccacc

SEQ ID NO: 741632 - DNA, 13 bp, Homo sapiens
ctgtctggggccc

SEQ ID NO: 741633 - DNA, 17 bp, Homo sapiens
ctgtctggtgaggtggc

SEQ ID NO: 741634 - DNA, 21 bp, Homo sapiens
ctgtctggtgaggtggcccag

SEQ ID NO: 741635 - DNA, 23 bp, Homo sapiens
ctgtctggtgaggtggcccaggc

SEQ ID NO: 741636 - DNA, 13 bp, Homo sapiens
ctgtctggtggcc

SEQ ID NO: 741637 - DNA, 16 bp, Homo sapiens
ctgtctggttttaaca

SEQ ID NO: 741638 - DNA, 14 bp, Homo sapiens
ctgtctgtacctaa

SEQ ID NO: 741639 - DNA, 16 bp, Homo sapiens
ctgtctgtcaccagct

SEQ ID NO: 741640 - DNA, 21 bp, Homo sapiens
ctgtctgtcccttttctttga

SEQ ID NO: 741641 - DNA, 15 bp, Homo sapiens
ctgtctgtcgccctt

SEQ ID NO: 741642 - DNA, 16 bp, Homo sapiens
ctgtctgtctctccat

SEQ ID NO: 741643 - DNA, 14 bp, Homo sapiens
ctgtctgtctgtgg

SEQ ID NO: 741644 - DNA, 20 bp, Homo sapiens
ctggggaaaaaaaagagact

SEQ ID NO: 741645 - DNA, 22 bp, Homo sapiens
ctggggaaaaaaaagagactgg

SEQ ID NO: 741646 - DNA, 20 bp, Homo sapiens
ctggggaaacaacatttata

SEQ ID NO: 741647 - DNA, 21 bp, Homo sapiens
ctggggaagaggatgagcaga

SEQ ID NO: 741648 - DNA, 17 bp, Homo sapiens
ctggggaaggagccagt

SEQ ID NO: 741649 - DNA, 12 bp, Homo sapiens
ctggggaagtca

SEQ ID NO: 741650 - DNA, 16 bp, Homo sapiens
ctggggaatgctccca

SEQ ID NO: 741651 - DNA, 11 bp, Homo sapiens
ctggggacaga

SEQ ID NO: 741652 - DNA, 12 bp, Homo sapiens
ctggggacagag

SEQ ID NO: 741653 - DNA, 14 bp, Homo sapiens
ctggggacagagcc

SEQ ID NO: 741654 - DNA, 14 bp, Homo sapiens
ctggggacagaggg

SEQ ID NO: 741655 - DNA, 16 bp, Homo sapiens
ctggggacagcttcct

SEQ ID NO: 741656 - DNA, 12 bp, Homo sapiens
ctggggacaggc

SEQ ID NO: 741657 - DNA, 14 bp, Homo sapiens
ctggggacaggccc

SEQ ID NO: 741658 - DNA, 14 bp, Homo sapiens
ctggggacctggca

SEQ ID NO: 741659 - DNA, 20 bp, Homo sapiens
ctggggacctggtaccctcc

SEQ ID NO: 741660 - DNA, 22 bp, Homo sapiens
ctggggacctggtaccctcctg

SEQ ID NO: 741661 - DNA, 15 bp, Homo sapiens
ctggggacctggttt

SEQ ID NO: 741662 - DNA, 13 bp, Homo sapiens
ctggggactcagg

SEQ ID NO: 741663 - DNA, 14 bp, Homo sapiens
ctggggactcctca

SEQ ID NO: 741664 - DNA, 15 bp, Homo sapiens
ctggggactcctcaa

SEQ ID NO: 741665 - DNA, 13 bp, Homo sapiens
ctggggactctgg

SEQ ID NO: 741666 - DNA, 13 bp, Homo sapiens
ctggggacttgtg

SEQ ID NO: 741667 - DNA, 17 bp, Homo sapiens
ctggggacttgtgtctg

SEQ ID NO: 741668 - DNA, 16 bp, Homo sapiens
ctggggagatgggggc

SEQ ID NO: 741669 - DNA, 20 bp, Homo sapiens
ctggggagatgggggcttct

SEQ ID NO: 741670 - DNA, 12 bp, Homo sapiens
ctggggagcccg

SEQ ID NO: 741671 - DNA, 20 bp, Homo sapiens
ctggggagcccgtctcagtg

SEQ ID NO: 741672 - DNA, 13 bp, Homo sapiens
ctggggagccctc

SEQ ID NO: 741673 - DNA, 14 bp, Homo sapiens
ctggggagccctca

SEQ ID NO: 741674 - DNA, 15 bp, Homo sapiens
ctggggagccctcag

SEQ ID NO: 741675 - DNA, 16 bp, Homo sapiens
ctggggagccctcagg

SEQ ID NO: 741676 - DNA, 20 bp, Homo sapiens
ctggggagccctcaggctcc

SEQ ID NO: 741677 - DNA, 15 bp, Homo sapiens
ctggggagctcctgg

SEQ ID NO: 741678 - DNA, 16 bp, Homo sapiens
ctggggagctcctggc

SEQ ID NO: 741679 - DNA, 17 bp, Homo sapiens
ctggggaggaccagggc

SEQ ID NO: 741680 - DNA, 16 bp, Homo sapiens
ctggggaggaggagag

SEQ ID NO: 741681 - DNA, 19 bp, Homo sapiens
ctggggaggaggagagagt

SEQ ID NO: 741682 - DNA, 14 bp, Homo sapiens
ctggggaggcaggc

SEQ ID NO: 741683 - DNA, 16 bp, Homo sapiens
ctggggaggtgggagg

SEQ ID NO: 741684 - DNA, 18 bp, Homo sapiens
ctggggaggtgggaggcc

SEQ ID NO: 741685 - DNA, 20 bp, Homo sapiens
ctggggaggtgggaggccag

SEQ ID NO: 741686 - DNA, 12 bp, Homo sapiens
ctggggagtccc

SEQ ID NO: 741687 - DNA, 14 bp, Homo sapiens
ctggggatccccgc

SEQ ID NO: 741688 - DNA, 20 bp, Homo sapiens
ctggggatccccgcctggcc

SEQ ID NO: 741689 - DNA, 14 bp, Homo sapiens
ctggggatggtggc

SEQ ID NO: 741690 - DNA, 16 bp, Homo sapiens
ctggggatggtggcac

SEQ ID NO: 741691 - DNA, 17 bp, Homo sapiens
ctggggatgtgggaggg

SEQ ID NO: 741692 - DNA, 17 bp, Homo sapiens
ctggggatttctgggat

SEQ ID NO: 741693 - DNA, 12 bp, Homo sapiens
ctggggcacagt

SEQ ID NO: 741694 - DNA, 21 bp, Homo sapiens
ctggggcacttggcagcgcgg

SEQ ID NO: 741695 - DNA, 12 bp, Homo sapiens
ctggggcagaga

SEQ ID NO: 741696 - DNA, 13 bp, Homo sapiens
ctggggcagaggg

SEQ ID NO: 741697 - DNA, 14 bp, Homo sapiens
ctggggcagatccc

SEQ ID NO: 741698 - DNA, 12 bp, Homo sapiens
ctggggcaggct

SEQ ID NO: 741699 - DNA, 13 bp, Homo sapiens
ctggggcaggctc

SEQ ID NO: 741700 - DNA, 15 bp, Homo sapiens
ctggggcaggctggg

SEQ ID NO: 741701 - DNA, 17 bp, Homo sapiens
ctggggcaggctgggcc

SEQ ID NO: 741702 - DNA, 19 bp, Homo sapiens
ctggggcaggctgggccat

SEQ ID NO: 741703 - DNA, 16 bp, Homo sapiens
ctggggcaggggcctg

SEQ ID NO: 741704 - DNA, 23 bp, Homo sapiens
ctggggcaggggcctgggccggc

SEQ ID NO: 741705 - DNA, 14 bp, Homo sapiens
ctggggcaggggtg

SEQ ID NO: 741706 - DNA, 22 bp, Homo sapiens
ctggggcatgtgtgcctgtggc

SEQ ID NO: 741707 - DNA, 18 bp, Homo sapiens
ctggggccacacagaaac

SEQ ID NO: 741708 - DNA, 15 bp, Homo sapiens
ctggggccacctttg

SEQ ID NO: 741709 - DNA, 17 bp, Homo sapiens
ctggggccacctttgtg

SEQ ID NO: 741710 - DNA, 18 bp, Homo sapiens
ctggggccacctttgtgc

SEQ ID NO: 741711 - DNA, 23 bp, Homo sapiens
ctggggccacctttgtgcagctt

SEQ ID NO: 741712 - DNA, 12 bp, Homo sapiens
ctggggccagag

SEQ ID NO: 741713 - DNA, 14 bp, Homo sapiens
ctggggccagaggc

SEQ ID NO: 741714 - DNA, 19 bp, Homo sapiens
ctggggccagaggctggga

SEQ ID NO: 741715 - DNA, 14 bp, Homo sapiens
ctggggccagggca

SEQ ID NO: 741716 - DNA, 13 bp, Homo sapiens
ctggggcccagcc

SEQ ID NO: 741717 - DNA, 14 bp, Homo sapiens
ctggggccctgggc

SEQ ID NO: 741718 - DNA, 15 bp, Homo sapiens
ctggggccctgggcc

SEQ ID NO: 741719 - DNA, 19 bp, Homo sapiens
ctggggccctgggcctcag

SEQ ID NO: 741720 - DNA, 20 bp, Homo sapiens
ctggggccgcctgccctgcc

SEQ ID NO: 741721 - DNA, 16 bp, Homo sapiens
ctggggccggggctga

SEQ ID NO: 741722 - DNA, 24 bp, Homo sapiens
ctggggcctagcgatctctcctgg

SEQ ID NO: 741723 - DNA, 11 bp, Homo sapiens
ctggggcctcc

SEQ ID NO: 741724 - DNA, 17 bp, Homo sapiens
ctggggcctccagaact

SEQ ID NO: 741725 - DNA, 17 bp, Homo sapiens
ctggggcctgagagaat

SEQ ID NO: 741726 - DNA, 14 bp, Homo sapiens
ctggggcctggacc

SEQ ID NO: 741727 - DNA, 13 bp, Homo sapiens
ctggggcggagct

SEQ ID NO: 741728 - DNA, 14 bp, Homo sapiens
ctggggcgtgggga

SEQ ID NO: 741729 - DNA, 19 bp, Homo sapiens
ctggggctccctctctggt

SEQ ID NO: 741730 - DNA, 16 bp, Homo sapiens
ctggggctccgaaatt

SEQ ID NO: 741731 - DNA, 17 bp, Homo sapiens
ctggggctctctgaccc

SEQ ID NO: 741732 - DNA, 14 bp, Homo sapiens
ctggggctctggga

SEQ ID NO: 741733 - DNA, 15 bp, Homo sapiens
ctggggctctgggat

SEQ ID NO: 741734 - DNA, 14 bp, Homo sapiens
ctggggctgaacat

SEQ ID NO: 741735 - DNA, 22 bp, Homo sapiens
ctggggctgaacatgcctgcca

SEQ ID NO: 741736 - DNA, 17 bp, Homo sapiens
ctggggctgccagcctg

SEQ ID NO: 741737 - DNA, 14 bp, Homo sapiens
ctggggctgctccc

SEQ ID NO: 741738 - DNA, 12 bp, Homo sapiens
ctggggctgggg

SEQ ID NO: 741739 - DNA, 16 bp, Homo sapiens
ctggggctgtatttat

SEQ ID NO: 741740 - DNA, 16 bp, Homo sapiens
ctggggctgttgggga

SEQ ID NO: 741741 - DNA, 17 bp, Homo sapiens
ctggggcttgtcctgtg

SEQ ID NO: 741742 - DNA, 14 bp, Homo sapiens
ctgggggaagccct

SEQ ID NO: 741743 - DNA, 17 bp, Homo sapiens
ctgggggaagccctgga

SEQ ID NO: 741744 - DNA, 16 bp, Homo sapiens
ctgggggaagggtggt

SEQ ID NO: 741745 - DNA, 19 bp, Homo sapiens
ctgggggacccctggctct

SEQ ID NO: 741746 - DNA, 17 bp, Homo sapiens
ctgggggactgggagtc

SEQ ID NO: 741747 - DNA, 14 bp, Homo sapiens
ctgggggagagccg

SEQ ID NO: 741748 - DNA, 19 bp, Homo sapiens
gtactccacatatttcagt

SEQ ID NO: 741749 - DNA, 12 bp, Homo sapiens
gtactccagcct

SEQ ID NO: 741750 - DNA, 14 bp, Homo sapiens
gtactccagcctgg

SEQ ID NO: 741751 - DNA, 18 bp, Homo sapiens
gtactccctgcaccgtct

SEQ ID NO: 741752 - DNA, 21 bp, Homo sapiens
gtactcctcacttttcaattt

SEQ ID NO: 741753 - DNA, 17 bp, Homo sapiens
gtactcggcttcctgtg

SEQ ID NO: 741754 - DNA, 15 bp, Homo sapiens
gtactcgttggatgt

SEQ ID NO: 741755 - DNA, 21 bp, Homo sapiens
gtactcgttggatgtctgtga

SEQ ID NO: 741756 - DNA, 18 bp, Homo sapiens
gtactctacgccaaagtg

SEQ ID NO: 741757 - DNA, 18 bp, Homo sapiens
gtactctataagaggtgt

SEQ ID NO: 741758 - DNA, 17 bp, Homo sapiens
gtactctctgctctagc

SEQ ID NO: 741759 - DNA, 19 bp, Homo sapiens
gtactctctgctctagcca

SEQ ID NO: 741760 - DNA, 21 bp, Homo sapiens
gtactctctgctctagccagg

SEQ ID NO: 741761 - DNA, 18 bp, Homo sapiens
gtactcttgatgtgaaga

SEQ ID NO: 741762 - DNA, 14 bp, Homo sapiens
gtactgaaagcctt

SEQ ID NO: 741763 - DNA, 23 bp, Homo sapiens
gtactgaaagccttagggaagct

SEQ ID NO: 741764 - DNA, 12 bp, Homo sapiens
gtactgaatttt

SEQ ID NO: 741765 - DNA, 20 bp, Homo sapiens
gtactgaatttttttgtaat

SEQ ID NO: 741766 - DNA, 22 bp, Homo sapiens
gtactgaatttttttgtaataa

SEQ ID NO: 741767 - DNA, 17 bp, Homo sapiens
gtactgactttgcttgc

SEQ ID NO: 741768 - DNA, 18 bp, Homo sapiens
tatagtttcaccactcct

SEQ ID NO: 741769 - DNA, 13 bp, Homo sapiens
tatagtttcagat

SEQ ID NO: 741770 - DNA, 16 bp, Homo sapiens
tatagttttactttta

SEQ ID NO: 741771 - DNA, 23 bp, Homo sapiens
tatagttttacttttaaactgtg

SEQ ID NO: 741772 - DNA, 22 bp, Homo sapiens
tatagttttgaatcctttgcct

SEQ ID NO: 741773 - DNA, 23 bp, Homo sapiens
tatagttttgaatcctttgcctg

SEQ ID NO: 741774 - DNA, 20 bp, Homo sapiens
tatataaaaagaaaagataa

SEQ ID NO: 741775 - DNA, 11 bp, Homo sapiens
tatataaaaat

SEQ ID NO: 741776 - DNA, 12 bp, Homo sapiens
tatataaaaatg

SEQ ID NO: 741777 - DNA, 19 bp, Homo sapiens
tatataaaacggtgctgtg

SEQ ID NO: 741778 - DNA, 18 bp, Homo sapiens
tatataaaataaatatat

SEQ ID NO: 741779 - DNA, 21 bp, Homo sapiens
tatataaaatgtattcaagca

SEQ ID NO: 741780 - DNA, 12 bp, Homo sapiens
tatataaacact

SEQ ID NO: 741781 - DNA, 23 bp, Homo sapiens
tatataaacactccacagtgttt

SEQ ID NO: 741782 - DNA, 13 bp, Homo sapiens
tatataaacatat

SEQ ID NO: 741783 - DNA, 21 bp, Homo sapiens
tatataaacctaaaaaagata

SEQ ID NO: 741784 - DNA, 22 bp, Homo sapiens
tatataaacctaaaaaagatat

SEQ ID NO: 741785 - DNA, 16 bp, Homo sapiens
tatataaagatatata

SEQ ID NO: 741786 - DNA, 17 bp, Homo sapiens
tatataaagatatatag

SEQ ID NO: 741787 - DNA, 13 bp, Homo sapiens
tatataaataagc

SEQ ID NO: 741788 - DNA, 14 bp, Homo sapiens
tatataacaaataa

SEQ ID NO: 741789 - DNA, 13 bp, Homo sapiens
tatataacagata

SEQ ID NO: 741790 - DNA, 17 bp, Homo sapiens
tatataacagatacatt

SEQ ID NO: 741791 - DNA, 23 bp, Homo sapiens
tatataagaaaaaattctttcac

SEQ ID NO: 741792 - DNA, 17 bp, Homo sapiens
tatataaggtaatgtag

SEQ ID NO: 741793 - DNA, 12 bp, Homo sapiens
tatataatatct

SEQ ID NO: 741794 - DNA, 17 bp, Homo sapiens
tatataatatctaaagt

SEQ ID NO: 741795 - DNA, 15 bp, Homo sapiens
tatataattgtgaag

SEQ ID NO: 741796 - DNA, 14 bp, Homo sapiens
tatataattttatg

SEQ ID NO: 741797 - DNA, 16 bp, Homo sapiens
tatatacaaaaagaaa

SEQ ID NO: 741798 - DNA, 22 bp, Homo sapiens
tatatacaaggtgagtgtgact

SEQ ID NO: 741799 - DNA, 17 bp, Homo sapiens
tatatacaataacataa

SEQ ID NO: 741800 - DNA, 13 bp, Homo sapiens
tatatacacatac

SEQ ID NO: 741801 - DNA, 14 bp, Homo sapiens
tatatacacataca

SEQ ID NO: 741802 - DNA, 18 bp, Homo sapiens
tatatacacatacataca

SEQ ID NO: 741803 - DNA, 20 bp, Homo sapiens
tatatacagggtattaagaa

SEQ ID NO: 741804 - DNA, 18 bp, Homo sapiens
tatatacatacataatgt

SEQ ID NO: 741805 - DNA, 15 bp, Homo sapiens
tatatacatatatat

SEQ ID NO: 741806 - DNA, 16 bp, Homo sapiens
tatatacatatatatt

SEQ ID NO: 741807 - DNA, 20 bp, Homo sapiens
tatatacccgtacaacgtgt

SEQ ID NO: 741808 - DNA, 18 bp, Homo sapiens
tatatacgcatctataaa

SEQ ID NO: 741809 - DNA, 14 bp, Homo sapiens
tatatactgaagtg

SEQ ID NO: 741810 - DNA, 21 bp, Homo sapiens
tatatagccaatataactatc

SEQ ID NO: 741811 - DNA, 18 bp, Homo sapiens
tatataggctattttcta

SEQ ID NO: 741812 - DNA, 19 bp, Homo sapiens
tatatagtgaaaaatgtca

SEQ ID NO: 741813 - DNA, 13 bp, Homo sapiens
tatatagttcctt

SEQ ID NO: 741814 - DNA, 19 bp, Homo sapiens
tatatagttccttgcctta

SEQ ID NO: 741815 - DNA, 10 bp, Homo sapiens
tatatataaa

SEQ ID NO: 741816 - DNA, 13 bp, Homo sapiens
tatatataaacag

SEQ ID NO: 741817 - DNA, 13 bp, Homo sapiens
tatatataaacct

SEQ ID NO: 741818 - DNA, 20 bp, Homo sapiens
tatatataatcatcaagtaa

SEQ ID NO: 741819 - DNA, 13 bp, Homo sapiens
tatatatacacat

SEQ ID NO: 741820 - DNA, 13 bp, Homo sapiens
tatatatataaaa

SEQ ID NO: 741821 - DNA, 13 bp, Homo sapiens
tatatatatgtat

SEQ ID NO: 741822 - DNA, 14 bp, Homo sapiens
tatatatatgtata

SEQ ID NO: 741823 - DNA, 13 bp, Homo sapiens
tatatatatttgt

SEQ ID NO: 741824 - DNA, 13 bp, Homo sapiens
tatatatctatta

SEQ ID NO: 741825 - DNA, 20 bp, Homo sapiens
tatatatctgataaaattgt

SEQ ID NO: 741826 - DNA, 19 bp, Homo sapiens
tatatatctgcttcagtgg

SEQ ID NO: 741827 - DNA, 14 bp, Homo sapiens
tatatatgaagttg

SEQ ID NO: 741828 - DNA, 14 bp, Homo sapiens
tatatatgatcatt

SEQ ID NO: 741829 - DNA, 16 bp, Homo sapiens
tatatatgatcattga

SEQ ID NO: 741830 - DNA, 17 bp, Homo sapiens
tatatatgatgtggaca

SEQ ID NO: 741831 - DNA, 22 bp, Homo sapiens
tatatatgatgtggacatatgt

SEQ ID NO: 741832 - DNA, 21 bp, Homo sapiens
tatatatgcacttaatttgtt

SEQ ID NO: 741833 - DNA, 13 bp, Homo sapiens
tatatatggacat

SEQ ID NO: 741834 - DNA, 23 bp, Homo sapiens
tatatatggcatatttatattgt

SEQ ID NO: 741835 - DNA, 22 bp, Homo sapiens
tatatatggggatggtagtttt

SEQ ID NO: 741836 - DNA, 20 bp, Homo sapiens
tatatatgtatatgtatata

SEQ ID NO: 741837 - DNA, 18 bp, Homo sapiens
tatatatgtatctacaat

SEQ ID NO: 741838 - DNA, 21 bp, Homo sapiens
tatatatgtatctacaataca

SEQ ID NO: 741839 - DNA, 17 bp, Homo sapiens
tatatatgtgtgtttaa

SEQ ID NO: 741840 - DNA, 14 bp, Homo sapiens
tatatattaagtgt

SEQ ID NO: 741841 - DNA, 17 bp, Homo sapiens
tatatattcatctaata

SEQ ID NO: 741842 - DNA, 20 bp, Homo sapiens
tatatattcttataaaaatg

SEQ ID NO: 741843 - DNA, 15 bp, Homo sapiens
tatatattgaaagtt

SEQ ID NO: 741844 - DNA, 13 bp, Homo sapiens
tatatattgtaaa

SEQ ID NO: 741845 - DNA, 14 bp, Homo sapiens
tatatatttataac

SEQ ID NO: 741846 - DNA, 17 bp, Homo sapiens
tatatatttctattatt

SEQ ID NO: 741847 - DNA, 14 bp, Homo sapiens
tatatatttgtaac

SEQ ID NO: 741848 - DNA, 20 bp, Homo sapiens
tatatatttgtaacattgta

SEQ ID NO: 741849 - DNA, 16 bp, Homo sapiens
tatatcaaaaaacctt

SEQ ID NO: 741850 - DNA, 14 bp, Homo sapiens
tatatcaaatgcct

SEQ ID NO: 741851 - DNA, 22 bp, Homo sapiens
tatatcaagcttaatatgtgct

SEQ ID NO: 741852 - DNA, 18 bp, Homo sapiens
tatatcagaaaagggaag

SEQ ID NO: 741853 - DNA, 22 bp, Homo sapiens
tatatcaggtgtataaatgtac

SEQ ID NO: 741854 - DNA, 16 bp, Homo sapiens
tatatcagtacctctc

SEQ ID NO: 741855 - DNA, 19 bp, Homo sapiens
tatatcagtagtgtacatt

SEQ ID NO: 741856 - DNA, 14 bp, Homo sapiens
tatatcatgcaaaa

SEQ ID NO: 741857 - DNA, 16 bp, Homo sapiens
tatatcattctacaga

SEQ ID NO: 741858 - DNA, 22 bp, Homo sapiens
tatatcattggaacaactgata

SEQ ID NO: 741859 - DNA, 20 bp, Homo sapiens
tatatccaaaagctttttat

SEQ ID NO: 741860 - DNA, 22 bp, Homo sapiens
tatatccagttcctgctctctg

SEQ ID NO: 741861 - DNA, 23 bp, Homo sapiens
tatatccagttcctgctctctgc

SEQ ID NO: 741862 - DNA, 14 bp, Homo sapiens
tatatccatgtact

SEQ ID NO: 741863 - DNA, 14 bp, Homo sapiens
tatatcctgtgact

SEQ ID NO: 741864 - DNA, 16 bp, Homo sapiens
tatatcgttatcactg

SEQ ID NO: 741865 - DNA, 22 bp, Homo sapiens
tatatctagaactatcattttt

SEQ ID NO: 741866 - DNA, 17 bp, Homo sapiens
tatatctatatgtactt

SEQ ID NO: 741867 - DNA, 17 bp, Homo sapiens
tatatctatctatttga

SEQ ID NO: 741868 - DNA, 23 bp, Homo sapiens
tatatctctagatgcaaatacat

SEQ ID NO: 741869 - DNA, 15 bp, Homo sapiens
tatatctctatttga

SEQ ID NO: 741870 - DNA, 15 bp, Homo sapiens
tatatctgataaaat

SEQ ID NO: 741871 - DNA, 23 bp, Homo sapiens
gaggggagagacaggcagcccag

SEQ ID NO: 741872 - DNA, 19 bp, Homo sapiens
gaggggagcgtctgggaac

SEQ ID NO: 741873 - DNA, 18 bp, Homo sapiens
gaggggagggctcctggg

SEQ ID NO: 741874 - DNA, 17 bp, Homo sapiens
gaggggaggggcctccc

SEQ ID NO: 741875 - DNA, 12 bp, Homo sapiens
gaggggagggta

SEQ ID NO: 741876 - DNA, 14 bp, Homo sapiens
gaggggataacttt

SEQ ID NO: 741877 - DNA, 22 bp, Homo sapiens
gaggggcaaccaactgccccag

SEQ ID NO: 741878 - DNA, 16 bp, Homo sapiens
gaggggcagagaggaa

SEQ ID NO: 741879 - DNA, 13 bp, Homo sapiens
gaggggcagagcc

SEQ ID NO: 741880 - DNA, 15 bp, Homo sapiens
gaggggcagcccttg

SEQ ID NO: 741881 - DNA, 13 bp, Homo sapiens
gaggggcaggctg

SEQ ID NO: 741882 - DNA, 14 bp, Homo sapiens
gaggggcaggctga

SEQ ID NO: 741883 - DNA, 15 bp, Homo sapiens
gaggggccactgacc

SEQ ID NO: 741884 - DNA, 17 bp, Homo sapiens
gaggggccagcagaggg

SEQ ID NO: 741885 - DNA, 23 bp, Homo sapiens
gaggggccaggggcaggcagggc

SEQ ID NO: 741886 - DNA, 22 bp, Homo sapiens
gaggggccccagcgtctgcagg

SEQ ID NO: 741887 - DNA, 23 bp, Homo sapiens
gaggggccccagcgtctgcaggg

SEQ ID NO: 741888 - DNA, 24 bp, Homo sapiens
gaggggccccagcgtctgcagggt

SEQ ID NO: 741889 - DNA, 13 bp, Homo sapiens
gaggggccctcag

SEQ ID NO: 741890 - DNA, 16 bp, Homo sapiens
gaggggccctcaggcc

SEQ ID NO: 741891 - DNA, 23 bp, Homo sapiens
gaggggcctaggcctcagccaga

SEQ ID NO: 741892 - DNA, 15 bp, Homo sapiens
gaggggcctagggag

SEQ ID NO: 741893 - DNA, 16 bp, Homo sapiens
gaggggcctagggagc

SEQ ID NO: 741894 - DNA, 18 bp, Homo sapiens
gaggggcctcccggggcc

SEQ ID NO: 741895 - DNA, 16 bp, Homo sapiens
tatatggcaagaaagc

SEQ ID NO: 741896 - DNA, 12 bp, Homo sapiens
tatatgtaaatg

SEQ ID NO: 741897 - DNA, 13 bp, Homo sapiens
tatatgtaaatgt

SEQ ID NO: 741898 - DNA, 16 bp, Homo sapiens
tatatgtaaatgtgtt

SEQ ID NO: 741899 - DNA, 12 bp, Homo sapiens
tatatgtacagt

SEQ ID NO: 741900 - DNA, 12 bp, Homo sapiens
tatatgtacatg

SEQ ID NO: 741901 - DNA, 19 bp, Homo sapiens
tatatgtaccgtaggcttt

SEQ ID NO: 741902 - DNA, 18 bp, Homo sapiens
tatatgtagatgtatgca

SEQ ID NO: 741903 - DNA, 20 bp, Homo sapiens
tatatgtagatgtatgcaca

SEQ ID NO: 741904 - DNA, 12 bp, Homo sapiens
tatatgtatatg

SEQ ID NO: 741905 - DNA, 14 bp, Homo sapiens
tatatgtatgtagt

SEQ ID NO: 741906 - DNA, 19 bp, Homo sapiens
tatatgtattatttataat

SEQ ID NO: 741907 - DNA, 11 bp, Homo sapiens
tatatgtattt

SEQ ID NO: 741908 - DNA, 20 bp, Homo sapiens
tatatgtatttaaaaaaatc

SEQ ID NO: 741909 - DNA, 18 bp, Homo sapiens
tatatgtatttaagatgt

SEQ ID NO: 741910 - DNA, 13 bp, Homo sapiens
tatatgtgagaaa

SEQ ID NO: 741911 - DNA, 22 bp, Homo sapiens
tatatgtgtgtgtatgtttgca

SEQ ID NO: 741912 - DNA, 16 bp, Homo sapiens
tatatgtgtgtttaaa

SEQ ID NO: 741913 - DNA, 23 bp, Homo sapiens
tatatgtgtgtttaaataaagta

SEQ ID NO: 741914 - DNA, 18 bp, Homo sapiens
tatatgttctgcaagaat

SEQ ID NO: 741915 - DNA, 14 bp, Homo sapiens
tatatgttgtaata

SEQ ID NO: 741916 - DNA, 15 bp, Homo sapiens
tatatgttgtaataa

SEQ ID NO: 741917 - DNA, 19 bp, Homo sapiens
tatattaaaaatataaaac

SEQ ID NO: 741918 - DNA, 16 bp, Homo sapiens
tatattaaaatagcat

SEQ ID NO: 741919 - DNA, 21 bp, Homo sapiens
tatattaaaatagcatactgt

SEQ ID NO: 741920 - DNA, 24 bp, Homo sapiens
tatattaaaatagcatactgtgta

SEQ ID NO: 741921 - DNA, 13 bp, Homo sapiens
tatattaaaattc

SEQ ID NO: 741922 - DNA, 21 bp, Homo sapiens
tatattaaaattccaaattca

SEQ ID NO: 741923 - DNA, 13 bp, Homo sapiens
tatattaaacaaa

SEQ ID NO: 741924 - DNA, 13 bp, Homo sapiens
tatattaagcaga

SEQ ID NO: 741925 - DNA, 15 bp, Homo sapiens
tatattaagcagaaa

SEQ ID NO: 741926 - DNA, 18 bp, Homo sapiens
tatattaccagcaagaat

SEQ ID NO: 741927 - DNA, 21 bp, Homo sapiens
tatattaccagcaagaataaa

SEQ ID NO: 741928 - DNA, 17 bp, Homo sapiens
tatattagctaattaga

SEQ ID NO: 741929 - DNA, 16 bp, Homo sapiens
tatattagctgaaaca

SEQ ID NO: 741930 - DNA, 18 bp, Homo sapiens
tatattaggatctgcaaa

SEQ ID NO: 741931 - DNA, 22 bp, Homo sapiens
tatattaggatctgcaaacaat

SEQ ID NO: 741932 - DNA, 16 bp, Homo sapiens
tatattagtgaagatg

SEQ ID NO: 741933 - DNA, 20 bp, Homo sapiens
tatattatcatgcaaatgct

SEQ ID NO: 741934 - DNA, 19 bp, Homo sapiens
tatattatgtcttcttttg

SEQ ID NO: 741935 - DNA, 16 bp, Homo sapiens
tatattattatatata

SEQ ID NO: 741936 - DNA, 22 bp, Homo sapiens
tatattcaaattatgtataaat

SEQ ID NO: 741937 - DNA, 14 bp, Homo sapiens
tatattccaaggaa

SEQ ID NO: 741938 - DNA, 18 bp, Homo sapiens
tatattccaccattcaca

SEQ ID NO: 741939 - DNA, 19 bp, Homo sapiens
tatattccaccattcacat

SEQ ID NO: 741940 - DNA, 18 bp, Homo sapiens
tatattccaggtttaagt

SEQ ID NO: 741941 - DNA, 21 bp, Homo sapiens
tatattccaggtttaagtaga

SEQ ID NO: 741942 - DNA, 18 bp, Homo sapiens
tatattcccaatagcaac

SEQ ID NO: 741943 - DNA, 18 bp, Homo sapiens
tatattccgtatttaaag

SEQ ID NO: 741944 - DNA, 23 bp, Homo sapiens
tatattccttttcccaggaaaga

SEQ ID NO: 741945 - DNA, 16 bp, Homo sapiens
tatattctaatagttt

SEQ ID NO: 741946 - DNA, 22 bp, Homo sapiens
tatattctattccatgtccata

SEQ ID NO: 741947 - DNA, 17 bp, Homo sapiens
tatattctgaaaggaaa

SEQ ID NO: 741948 - DNA, 14 bp, Homo sapiens
tatattctggaaaa

SEQ ID NO: 741949 - DNA, 18 bp, Homo sapiens
tatattcttattggaaat

SEQ ID NO: 741950 - DNA, 12 bp, Homo sapiens
tatattgaactt

SEQ ID NO: 741951 - DNA, 13 bp, Homo sapiens
tatattgaacttt

SEQ ID NO: 741952 - DNA, 19 bp, Homo sapiens
tatattgaatatatcagaa

SEQ ID NO: 741953 - DNA, 20 bp, Homo sapiens
tatattgagaatcccttaaa

SEQ ID NO: 741954 - DNA, 13 bp, Homo sapiens
tatattgatttaa

SEQ ID NO: 741955 - DNA, 12 bp, Homo sapiens
tatattgcctta

SEQ ID NO: 741956 - DNA, 23 bp, Homo sapiens
tatattgggtgtagatttctgac

SEQ ID NO: 741957 - DNA, 15 bp, Homo sapiens
tatattggtgtatat

SEQ ID NO: 741958 - DNA, 19 bp, Homo sapiens
tatattggtgtatattata

SEQ ID NO: 741959 - DNA, 22 bp, Homo sapiens
tatattggtgtatattatataa

SEQ ID NO: 741960 - DNA, 12 bp, Homo sapiens
tatattgtaaga

SEQ ID NO: 741961 - DNA, 22 bp, Homo sapiens
tatattgtaagaaatactgtac

SEQ ID NO: 741962 - DNA, 12 bp, Homo sapiens
tatattgtaatt

SEQ ID NO: 741963 - DNA, 14 bp, Homo sapiens
tatattgtaattta

SEQ ID NO: 741964 - DNA, 15 bp, Homo sapiens
tatattgtacaaatg

SEQ ID NO: 741965 - DNA, 17 bp, Homo sapiens
tatattgtacaaatgta

SEQ ID NO: 741966 - DNA, 23 bp, Homo sapiens
tatattgttgttactttttcttg

SEQ ID NO: 741967 - DNA, 17 bp, Homo sapiens
tatatttaaaaataagt

SEQ ID NO: 741968 - DNA, 16 bp, Homo sapiens
tatatttaaaaattgt

SEQ ID NO: 741969 - DNA, 13 bp, Homo sapiens
tatatttaaactc

SEQ ID NO: 741970 - DNA, 21 bp, Homo sapiens
tatatttaaaggggagatact

SEQ ID NO: 741971 - DNA, 15 bp, Homo sapiens
tatatttaacaagat

SEQ ID NO: 741972 - DNA, 13 bp, Homo sapiens
tatatttaatata

SEQ ID NO: 741973 - DNA, 16 bp, Homo sapiens
tatatttaatatattg

SEQ ID NO: 741974 - DNA, 14 bp, Homo sapiens
tatatttaatatgt

SEQ ID NO: 741975 - DNA, 16 bp, Homo sapiens
tatatttaatgcatta

SEQ ID NO: 741976 - DNA, 19 bp, Homo sapiens
tatatttaatgcattaaac

SEQ ID NO: 741977 - DNA, 22 bp, Homo sapiens
tatatttaatgcattaaacctg

SEQ ID NO: 741978 - DNA, 17 bp, Homo sapiens
tatatttaattaaagca

SEQ ID NO: 741979 - DNA, 17 bp, Homo sapiens
tatatttacaaataaaa

SEQ ID NO: 741980 - DNA, 16 bp, Homo sapiens
tatatttagttacgta

SEQ ID NO: 741981 - DNA, 16 bp, Homo sapiens
tatatttagttatagt

SEQ ID NO: 741982 - DNA, 12 bp, Homo sapiens
tatatttatact

SEQ ID NO: 741983 - DNA, 19 bp, Homo sapiens
tatatttattcataatgaa

SEQ ID NO: 741984 - DNA, 12 bp, Homo sapiens
tatatttattgt

SEQ ID NO: 741985 - DNA, 20 bp, Homo sapiens
tatatttcaaacattttgta

SEQ ID NO: 741986 - DNA, 16 bp, Homo sapiens
tatatttcactatttt

SEQ ID NO: 741987 - DNA, 12 bp, Homo sapiens
tatatttcctgt

SEQ ID NO: 741988 - DNA, 20 bp, Homo sapiens
tatatttcctgtattgcttt

SEQ ID NO: 741989 - DNA, 21 bp, Homo sapiens
tatatttcctgtattgcttta

SEQ ID NO: 741990 - DNA, 18 bp, Homo sapiens
tatatttcctttatgtga

SEQ ID NO: 741991 - DNA, 15 bp, Homo sapiens
tatatttctttaaac

SEQ ID NO: 741992 - DNA, 13 bp, Homo sapiens
tatatttgacatg

SEQ ID NO: 741993 - DNA, 22 bp, Homo sapiens
tatatttgctgcaaagagaaac

SEQ ID NO: 741994 - DNA, 13 bp, Homo sapiens
tatatttgcttca

SEQ ID NO: 741995 - DNA, 11 bp, Homo sapiens
tatatttggaa

SEQ ID NO: 741996 - DNA, 18 bp, Homo sapiens
tatatttggaaagagacc

SEQ ID NO: 741997 - DNA, 18 bp, Homo sapiens
tatatttgggagtgactg

SEQ ID NO: 741998 - DNA, 15 bp, Homo sapiens
tatatttgtaacatt

SEQ ID NO: 741999 - DNA, 18 bp, Homo sapiens
tatatttgtaacattgta

SEQ ID NO: 742000 - DNA, 15 bp, Homo sapiens
tatatttgtacaaaa

SEQ ID NO: 742001 - DNA, 13 bp, Homo sapiens
tatatttgtcatg

SEQ ID NO: 742002 - DNA, 17 bp, Homo sapiens
tatatttgtcttccgat

SEQ ID NO: 742003 - DNA, 20 bp, Homo sapiens
tatatttgtgctatagtatt

SEQ ID NO: 742004 - DNA, 15 bp, Homo sapiens
tatattttaatagaa

SEQ ID NO: 742005 - DNA, 15 bp, Homo sapiens
tatattttagcattt

SEQ ID NO: 742006 - DNA, 18 bp, Homo sapiens
tatattttatataaagta

SEQ ID NO: 742007 - DNA, 21 bp, Homo sapiens
tatattttatgaacattgtac

SEQ ID NO: 742008 - DNA, 23 bp, Homo sapiens
tatattttatgaacattgtactg

SEQ ID NO: 742009 - DNA, 18 bp, Homo sapiens
tatattttatttcaatgt

SEQ ID NO: 742010 - DNA, 18 bp, Homo sapiens
tatattttgattttacat

SEQ ID NO: 742011 - DNA, 18 bp, Homo sapiens
tatattttgtactttgtg

SEQ ID NO: 742012 - DNA, 21 bp, Homo sapiens
tatattttgtgttattcgtga

SEQ ID NO: 742013 - DNA, 20 bp, Homo sapiens
tatatttttagcctaaatgt

SEQ ID NO: 742014 - DNA, 18 bp, Homo sapiens
tatatttttatatttagt

SEQ ID NO: 742015 - DNA, 20 bp, Homo sapiens
tatatttttatatttagtta

SEQ ID NO: 742016 - DNA, 14 bp, Homo sapiens
tatatttttgtaca

SEQ ID NO: 742017 - DNA, 18 bp, Homo sapiens
tatatttttgtctgcagc

SEQ ID NO: 742018 - DNA, 20 bp, Homo sapiens
tatatttttgtctgcagctg

SEQ ID NO: 742019 - DNA, 16 bp, Homo sapiens
tatatttttgtgtttt

SEQ ID NO: 742020 - DNA, 22 bp, Homo sapiens
gaggggcctcccggggcccagg

SEQ ID NO: 742021 - DNA, 15 bp, Homo sapiens
gaggggcctgggcag

SEQ ID NO: 742022 - DNA, 20 bp, Homo sapiens
gaggggcctgggcagcccca

SEQ ID NO: 742023 - DNA, 13 bp, Homo sapiens
gaggggcgctggc

SEQ ID NO: 742024 - DNA, 16 bp, Homo sapiens
gaggggcgctggccca

SEQ ID NO: 742025 - DNA, 17 bp, Homo sapiens
gaggggcgctggcccag

SEQ ID NO: 742026 - DNA, 16 bp, Homo sapiens
gaggggcgctgtcctg

SEQ ID NO: 742027 - DNA, 21 bp, Homo sapiens
gaggggcggcaggagggaggt

SEQ ID NO: 742028 - DNA, 18 bp, Homo sapiens
gaggggcgggctcagagc

SEQ ID NO: 742029 - DNA, 21 bp, Homo sapiens
gaggggcgttctcccaaagat

SEQ ID NO: 742030 - DNA, 15 bp, Homo sapiens
gaggggctcaggaaa

SEQ ID NO: 742031 - DNA, 16 bp, Homo sapiens
gaggggctctcagctc

SEQ ID NO: 742032 - DNA, 19 bp, Homo sapiens
gaggggctctcagctcagc

SEQ ID NO: 742033 - DNA, 23 bp, Homo sapiens
gaggggctctcagctcagcgcca

SEQ ID NO: 742034 - DNA, 22 bp, Homo sapiens
gaggggctgctccagtgggcag

SEQ ID NO: 742035 - DNA, 11 bp, Homo sapiens
gaggggctggg

SEQ ID NO: 742036 - DNA, 13 bp, Homo sapiens
gaggggctgggct

SEQ ID NO: 742037 - DNA, 12 bp, Homo sapiens
gaggggctgggg

SEQ ID NO: 742038 - DNA, 19 bp, Homo sapiens
gaggggctggggagggggt

SEQ ID NO: 742039 - DNA, 14 bp, Homo sapiens
gaggggctggggca

SEQ ID NO: 742040 - DNA, 15 bp, Homo sapiens
gaggggctgtcctcc

SEQ ID NO: 742041 - DNA, 17 bp, Homo sapiens
gaggggctgtcctcctt

SEQ ID NO: 742042 - DNA, 15 bp, Homo sapiens
gagggggaagcaaag

SEQ ID NO: 742043 - DNA, 18 bp, Homo sapiens
gagggggacctgtccccc

SEQ ID NO: 742044 - DNA, 14 bp, Homo sapiens
gagggggactgctg

SEQ ID NO: 742045 - DNA, 14 bp, Homo sapiens
gagggggagggggt

SEQ ID NO: 742046 - DNA, 14 bp, Homo sapiens
gagggggcacggca

SEQ ID NO: 742047 - DNA, 16 bp, Homo sapiens
gagggggcacggcagg

SEQ ID NO: 742048 - DNA, 23 bp, Homo sapiens
gagggggcggcagggctgggcct

SEQ ID NO: 742049 - DNA, 21 bp, Homo sapiens
gagggggctatagctacagga

SEQ ID NO: 742050 - DNA, 19 bp, Homo sapiens
gagggggctatttctctcc

SEQ ID NO: 742051 - DNA, 13 bp, Homo sapiens
gagggggctctgc

SEQ ID NO: 742052 - DNA, 12 bp, Homo sapiens
gaggggggctgg

SEQ ID NO: 742053 - DNA, 19 bp, Homo sapiens
gaggggggggtgggtgaga

SEQ ID NO: 742054 - DNA, 18 bp, Homo sapiens
gagggggtgagaggcagg

SEQ ID NO: 742055 - DNA, 20 bp, Homo sapiens
gagggggttacaaactgcaa

SEQ ID NO: 742056 - DNA, 23 bp, Homo sapiens
gaggggtctcggatgacaccctg

SEQ ID NO: 742057 - DNA, 20 bp, Homo sapiens
gaggggtgagtcccctactc

SEQ ID NO: 742058 - DNA, 17 bp, Homo sapiens
gaggggtgcagaggctg

SEQ ID NO: 742059 - DNA, 14 bp, Homo sapiens
gaggggtgtggcag

SEQ ID NO: 742060 - DNA, 15 bp, Homo sapiens
gagggtaaataaacc

SEQ ID NO: 742061 - DNA, 16 bp, Homo sapiens
gagggtaactgggggg

SEQ ID NO: 742062 - DNA, 19 bp, Homo sapiens
gagggtaactggggggcca

SEQ ID NO: 742063 - DNA, 17 bp, Homo sapiens
gagggtatgaagagctg

SEQ ID NO: 742064 - DNA, 17 bp, Homo sapiens
gagggtcctgcagcctg

SEQ ID NO: 742065 - DNA, 18 bp, Homo sapiens
gagggtctcccctcctgc

SEQ ID NO: 742066 - DNA, 15 bp, Homo sapiens
gagggtctgggggca

SEQ ID NO: 742067 - DNA, 18 bp, Homo sapiens
gagggtctgggggcagct

SEQ ID NO: 742068 - DNA, 19 bp, Homo sapiens
gagggtctgggggcagctg

SEQ ID NO: 742069 - DNA, 21 bp, Homo sapiens
gagggtcttttaccctgtgtc

SEQ ID NO: 742070 - DNA, 18 bp, Homo sapiens
gagggtgacagcttcctt

SEQ ID NO: 742071 - DNA, 22 bp, Homo sapiens
gagggtgacatggggaaggcag

SEQ ID NO: 742072 - DNA, 21 bp, Homo sapiens
gagggtgacccacagctctgg

SEQ ID NO: 742073 - DNA, 15 bp, Homo sapiens
gagggtgacgcccag

SEQ ID NO: 742074 - DNA, 17 bp, Homo sapiens
gagggtgacgcccagct

SEQ ID NO: 742075 - DNA, 15 bp, Homo sapiens
gagggtgagtgcaag

SEQ ID NO: 742076 - DNA, 16 bp, Homo sapiens
gagggtgcagccctct

SEQ ID NO: 742077 - DNA, 12 bp, Homo sapiens
gagggtggaata

SEQ ID NO: 742078 - DNA, 20 bp, Homo sapiens
gagggtggagactaagccct

SEQ ID NO: 742079 - DNA, 23 bp, Homo sapiens
gagggtggaggaaggtgctgagc

SEQ ID NO: 742080 - DNA, 14 bp, Homo sapiens
gagggtgggggagg

SEQ ID NO: 742081 - DNA, 20 bp, Homo sapiens
gagggtggttcaacaaagaa

SEQ ID NO: 742082 - DNA, 18 bp, Homo sapiens
gagggtgttcagaggcag

SEQ ID NO: 742083 - DNA, 19 bp, Homo sapiens
gagggtgttcagaggcagc

SEQ ID NO: 742084 - DNA, 14 bp, Homo sapiens
gagggttcccctgg

SEQ ID NO: 742085 - DNA, 17 bp, Homo sapiens
gagggttcccctggcct

SEQ ID NO: 742086 - DNA, 21 bp, Homo sapiens
gagggttcctcttaggtcaga

SEQ ID NO: 742087 - DNA, 12 bp, Homo sapiens
gagggttcctgt

SEQ ID NO: 742088 - DNA, 20 bp, Homo sapiens
gagggttgggttcatctgag

SEQ ID NO: 742089 - DNA, 18 bp, Homo sapiens
gagggtttctgatctgta

SEQ ID NO: 742090 - DNA, 15 bp, Homo sapiens
gagggtttgtgccca

SEQ ID NO: 742091 - DNA, 12 bp, Homo sapiens
gaggtaagtttt

SEQ ID NO: 742092 - DNA, 13 bp, Homo sapiens
gaggtactgagac

SEQ ID NO: 742093 - DNA, 19 bp, Homo sapiens
gaggtagagtttgaaggag

SEQ ID NO: 742094 - DNA, 16 bp, Homo sapiens
gaggtagcgagctgct

SEQ ID NO: 742095 - DNA, 21 bp, Homo sapiens
gaggtaggcgggaaaggatgg

SEQ ID NO: 742096 - DNA, 21 bp, Homo sapiens
gaggtaggtggatcacctgag

SEQ ID NO: 742097 - DNA, 16 bp, Homo sapiens
gaggtagttaagggat

SEQ ID NO: 742098 - DNA, 14 bp, Homo sapiens
gaggtataaagaca

SEQ ID NO: 742099 - DNA, 15 bp, Homo sapiens
gaggtataggggtcc

SEQ ID NO: 742100 - DNA, 23 bp, Homo sapiens
gaggtatgtcagaaaaaatatgt

SEQ ID NO: 742101 - DNA, 14 bp, Homo sapiens
gaggtatttaactg

SEQ ID NO: 742102 - DNA, 19 bp, Homo sapiens
gaggtcaaatcccaaacca

SEQ ID NO: 742103 - DNA, 22 bp, Homo sapiens
gaggtcaacagagaaggcagga

SEQ ID NO: 742104 - DNA, 18 bp, Homo sapiens
gaggtcaagaccagcctg

SEQ ID NO: 742105 - DNA, 19 bp, Homo sapiens
gaggtcaataaagcagagc

SEQ ID NO: 742106 - DNA, 20 bp, Homo sapiens
gaggtcaataaagcagagcc

SEQ ID NO: 742107 - DNA, 22 bp, Homo sapiens
gaggtcacattcaggaagatga

SEQ ID NO: 742108 - DNA, 17 bp, Homo sapiens
gaggtcaccagctgctg

SEQ ID NO: 742109 - DNA, 18 bp, Homo sapiens
gaggtcaccagctgctgt

SEQ ID NO: 742110 - DNA, 17 bp, Homo sapiens
gaggtcactggaaaggg

SEQ ID NO: 742111 - DNA, 17 bp, Homo sapiens
gaggtcagcatttgatc

SEQ ID NO: 742112 - DNA, 23 bp, Homo sapiens
gaggtcagggagtgctggctcac

SEQ ID NO: 742113 - DNA, 17 bp, Homo sapiens
gaggtccaagattctgg

SEQ ID NO: 742114 - DNA, 13 bp, Homo sapiens
gaggtccagaccc

SEQ ID NO: 742115 - DNA, 16 bp, Homo sapiens
gaggtcccagccccag

SEQ ID NO: 742116 - DNA, 18 bp, Homo sapiens
tatcatctcttaaatttt

SEQ ID NO: 742117 - DNA, 21 bp, Homo sapiens
tatcatgaagccttgctgaac

SEQ ID NO: 742118 - DNA, 19 bp, Homo sapiens
tatcatgaattttaaagta

SEQ ID NO: 742119 - DNA, 17 bp, Homo sapiens
tatcatgcatgtcctgt

SEQ ID NO: 742120 - DNA, 19 bp, Homo sapiens
tatcatgcatgtcctgtaa

SEQ ID NO: 742121 - DNA, 19 bp, Homo sapiens
tatcatgcgttttatatct

SEQ ID NO: 742122 - DNA, 17 bp, Homo sapiens
tatcatggggagtaata

SEQ ID NO: 742123 - DNA, 13 bp, Homo sapiens
tatcatggtaatg

SEQ ID NO: 742124 - DNA, 19 bp, Homo sapiens
tatcatggtaatgacagat

SEQ ID NO: 742125 - DNA, 17 bp, Homo sapiens
tatcatgtcttgtgcat

SEQ ID NO: 742126 - DNA, 18 bp, Homo sapiens
tatcatgtcttgtgcata

SEQ ID NO: 742127 - DNA, 13 bp, Homo sapiens
tatcattaaaaat

SEQ ID NO: 742128 - DNA, 21 bp, Homo sapiens
tatcattaaaatatatgttct

SEQ ID NO: 742129 - DNA, 12 bp, Homo sapiens
tatcattaaaca

SEQ ID NO: 742130 - DNA, 17 bp, Homo sapiens
tatcattaaacaaataa

SEQ ID NO: 742131 - DNA, 14 bp, Homo sapiens
tatcattcaagtgt

SEQ ID NO: 742132 - DNA, 22 bp, Homo sapiens
tatcattcaagtgtaaaatatt

SEQ ID NO: 742133 - DNA, 13 bp, Homo sapiens
tatcattcattct

SEQ ID NO: 742134 - DNA, 17 bp, Homo sapiens
tatcattccaattctaa

SEQ ID NO: 742135 - DNA, 18 bp, Homo sapiens
tatcattctacagaataa

SEQ ID NO: 742136 - DNA, 13 bp, Homo sapiens
tatcattctcagt

SEQ ID NO: 742137 - DNA, 20 bp, Homo sapiens
tatcattgattttataattg

SEQ ID NO: 742138 - DNA, 17 bp, Homo sapiens
tatcatttcttaaccca

SEQ ID NO: 742139 - DNA, 14 bp, Homo sapiens
tatcatttgtgaag

SEQ ID NO: 742140 - DNA, 16 bp, Homo sapiens
tatcatttttacacta

SEQ ID NO: 742141 - DNA, 13 bp, Homo sapiens
tatcatttttgta

SEQ ID NO: 742142 - DNA, 22 bp, Homo sapiens
tatcatttttgtataaaaagga

SEQ ID NO: 742143 - DNA, 18 bp, Homo sapiens
tatcatttttgtgcacag

SEQ ID NO: 742144 - DNA, 22 bp, Homo sapiens
tatccaaagaacttgatttgca

SEQ ID NO: 742145 - DNA, 17 bp, Homo sapiens
tatccaaatctgaagat

SEQ ID NO: 742146 - DNA, 21 bp, Homo sapiens
tatccaaggaaacattttatc

SEQ ID NO: 742147 - DNA, 20 bp, Homo sapiens
tatccaagtaccaatgctgt

SEQ ID NO: 742148 - DNA, 23 bp, Homo sapiens
gaggtggaggaagatagcgcata

SEQ ID NO: 742149 - DNA, 13 bp, Homo sapiens
gaggtggaggtgg

SEQ ID NO: 742150 - DNA, 21 bp, Homo sapiens
gaggtggccaccgggggtggc

SEQ ID NO: 742151 - DNA, 13 bp, Homo sapiens
gaggtggcccagg

SEQ ID NO: 742152 - DNA, 16 bp, Homo sapiens
gaggtggcccttgttt

SEQ ID NO: 742153 - DNA, 18 bp, Homo sapiens
gaggtgggagaggcctca

SEQ ID NO: 742154 - DNA, 13 bp, Homo sapiens
gaggtgggaggcc

SEQ ID NO: 742155 - DNA, 18 bp, Homo sapiens
gaggtgggaggtggaaga

SEQ ID NO: 742156 - DNA, 12 bp, Homo sapiens
gaggtgggcagc

SEQ ID NO: 742157 - DNA, 23 bp, Homo sapiens
gaggtgggcaggtggtggcactg

SEQ ID NO: 742158 - DNA, 14 bp, Homo sapiens
gaggtgggcccagg

SEQ ID NO: 742159 - DNA, 23 bp, Homo sapiens
gaggtgggcccaggaccagctgg

SEQ ID NO: 742160 - DNA, 13 bp, Homo sapiens
gaggtggggaagg

SEQ ID NO: 742161 - DNA, 20 bp, Homo sapiens
gaggtgggggcctcctcagc

SEQ ID NO: 742162 - DNA, 21 bp, Homo sapiens
gaggtgggtggtgggcttctg

SEQ ID NO: 742163 - DNA, 13 bp, Homo sapiens
gaggtggtctgaa

SEQ ID NO: 742164 - DNA, 16 bp, Homo sapiens
gaggtggtctgaatgt

SEQ ID NO: 742165 - DNA, 17 bp, Homo sapiens
gaggtggtctgaatgtt

SEQ ID NO: 742166 - DNA, 19 bp, Homo sapiens
gaggtggtctgaatgttct

SEQ ID NO: 742167 - DNA, 19 bp, Homo sapiens
gaggtgtcaccctgcagag

SEQ ID NO: 742168 - DNA, 15 bp, Homo sapiens
gaggtgtccaactgg

SEQ ID NO: 742169 - DNA, 16 bp, Homo sapiens
gaggtgtccaactggc

SEQ ID NO: 742170 - DNA, 21 bp, Homo sapiens
gaggtgtgactaactatgcaa

SEQ ID NO: 742171 - DNA, 17 bp, Homo sapiens
gaggtgtgggggctgca

SEQ ID NO: 742172 - DNA, 14 bp, Homo sapiens
gaggtgtttaaaga

SEQ ID NO: 742173 - DNA, 21 bp, Homo sapiens
gaggtgtttaaagagaggtta

SEQ ID NO: 742174 - DNA, 21 bp, Homo sapiens
gaggttaaggtgggtccagga

SEQ ID NO: 742175 - DNA, 22 bp, Homo sapiens
gaggttaggagttcgagaccag

SEQ ID NO: 742176 - DNA, 13 bp, Homo sapiens
gaggttatctgcc

SEQ ID NO: 742177 - DNA, 18 bp, Homo sapiens
gaggttatctgcctggcc

SEQ ID NO: 742178 - DNA, 19 bp, Homo sapiens
gaggttatctgcctggcct

SEQ ID NO: 742179 - DNA, 20 bp, Homo sapiens
gaggttatctgcctggcctg

SEQ ID NO: 742180 - DNA, 21 bp, Homo sapiens
gaggttatctgcctggcctgg

SEQ ID NO: 742181 - DNA, 22 bp, Homo sapiens
gaggttatctgcctggcctggc

SEQ ID NO: 742182 - DNA, 23 bp, Homo sapiens
gaggttatctgcctggcctggct

SEQ ID NO: 742183 - DNA, 17 bp, Homo sapiens
gaggttcctctgcctgc

SEQ ID NO: 742184 - DNA, 18 bp, Homo sapiens
gaggttcctctgcctgcc

SEQ ID NO: 742185 - DNA, 13 bp, Homo sapiens
gaggttctcagag

SEQ ID NO: 742186 - DNA, 14 bp, Homo sapiens
gaggttctcagagc

SEQ ID NO: 742187 - DNA, 19 bp, Homo sapiens
gaggttgacctgtttctct

SEQ ID NO: 742188 - DNA, 14 bp, Homo sapiens
gaggttgagtgagc

SEQ ID NO: 742189 - DNA, 19 bp, Homo sapiens
gaggttgctgtacaggaaa

SEQ ID NO: 742190 - DNA, 12 bp, Homo sapiens
gaggttggattt

SEQ ID NO: 742191 - DNA, 21 bp, Homo sapiens
gaggttgtggatgctccaggg

SEQ ID NO: 742192 - DNA, 15 bp, Homo sapiens
gaggttgtggggagg

SEQ ID NO: 742193 - DNA, 13 bp, Homo sapiens
gaggtttaaatgt

SEQ ID NO: 742194 - DNA, 19 bp, Homo sapiens
gagtaacaatacaaatgga

SEQ ID NO: 742195 - DNA, 13 bp, Homo sapiens
gagtaacatttgc

SEQ ID NO: 742196 - DNA, 14 bp, Homo sapiens
gagtaagtgtgttc

SEQ ID NO: 742197 - DNA, 13 bp, Homo sapiens
gagtaatcaatct

SEQ ID NO: 742198 - DNA, 22 bp, Homo sapiens
gagtaatctgtgtacaaagaaa

SEQ ID NO: 742199 - DNA, 22 bp, Homo sapiens
gagtaattaataaagaaaaaga

SEQ ID NO: 742200 - DNA, 18 bp, Homo sapiens
gagtaattgcacattttt

SEQ ID NO: 742201 - DNA, 16 bp, Homo sapiens
gagtaatttattgttt

SEQ ID NO: 742202 - DNA, 14 bp, Homo sapiens
gagtacagactgca

SEQ ID NO: 742203 - DNA, 16 bp, Homo sapiens
gagtacctgctgcccc

SEQ ID NO: 742204 - DNA, 14 bp, Homo sapiens
gagtacgttaaaag

SEQ ID NO: 742205 - DNA, 20 bp, Homo sapiens
gagtacgttgtgcatttggt

SEQ ID NO: 742206 - DNA, 15 bp, Homo sapiens
gagtactatatttac

SEQ ID NO: 742207 - DNA, 16 bp, Homo sapiens
gagtagaaaatgtgac

SEQ ID NO: 742208 - DNA, 12 bp, Homo sapiens
gagtagagaagt

SEQ ID NO: 742209 - DNA, 21 bp, Homo sapiens
gagtagagaggcccgcccgcc

SEQ ID NO: 742210 - DNA, 18 bp, Homo sapiens
gagtagatggtgaaattt

SEQ ID NO: 742211 - DNA, 13 bp, Homo sapiens
gagtagccaagct

SEQ ID NO: 742212 - DNA, 17 bp, Homo sapiens
gagtagccgagagcctg

SEQ ID NO: 742213 - DNA, 18 bp, Homo sapiens
gagtagccgagagcctgc

SEQ ID NO: 742214 - DNA, 19 bp, Homo sapiens
gagtagccgagagcctgct

SEQ ID NO: 742215 - DNA, 15 bp, Homo sapiens
gagtagctgggatta

SEQ ID NO: 742216 - DNA, 16 bp, Homo sapiens
gagtaggtctgggatg

SEQ ID NO: 742217 - DNA, 21 bp, Homo sapiens
gagtaggtctgggatggacag

SEQ ID NO: 742218 - DNA, 24 bp, Homo sapiens
gagtaggtgggtaggagcccttct

SEQ ID NO: 742219 - DNA, 14 bp, Homo sapiens
gagtagtgtggaat

SEQ ID NO: 742220 - DNA, 23 bp, Homo sapiens
gagtataaataaccctgggctgt

SEQ ID NO: 742221 - DNA, 19 bp, Homo sapiens
gagtatacctcctatatgt

SEQ ID NO: 742222 - DNA, 16 bp, Homo sapiens
gagtatagtgcaaatt

SEQ ID NO: 742223 - DNA, 22 bp, Homo sapiens
gagtatatttttgtctgcagct

SEQ ID NO: 742224 - DNA, 21 bp, Homo sapiens
gagtatcactttaactcagga

SEQ ID NO: 742225 - DNA, 17 bp, Homo sapiens
gagtatcaggtctccca

SEQ ID NO: 742226 - DNA, 14 bp, Homo sapiens
gagtatgaacttga

SEQ ID NO: 742227 - DNA, 22 bp, Homo sapiens
gagtatgttaagctctttatga

SEQ ID NO: 742228 - DNA, 14 bp, Homo sapiens
gagtatgttgtcat

SEQ ID NO: 742229 - DNA, 16 bp, Homo sapiens
gagtatgttgtcataa

SEQ ID NO: 742230 - DNA, 21 bp, Homo sapiens
gagtattccatgagctgctca

SEQ ID NO: 742231 - DNA, 13 bp, Homo sapiens
gagtatttccctt

SEQ ID NO: 742232 - DNA, 19 bp, Homo sapiens
gagtatttcccttccaaag

SEQ ID NO: 742233 - DNA, 19 bp, Homo sapiens
gagtcaaaactacaaatca

SEQ ID NO: 742234 - DNA, 15 bp, Homo sapiens
gagtcaaaagcctgg

SEQ ID NO: 742235 - DNA, 15 bp, Homo sapiens
gagtcaactggagca

SEQ ID NO: 742236 - DNA, 14 bp, Homo sapiens
gagtcaagttgttc

SEQ ID NO: 742237 - DNA, 20 bp, Homo sapiens
gagtcaatcccctcattcag

SEQ ID NO: 742238 - DNA, 17 bp, Homo sapiens
tatctaatatatatgaa

SEQ ID NO: 742239 - DNA, 18 bp, Homo sapiens
tatctaatatatatgaat

SEQ ID NO: 742240 - DNA, 13 bp, Homo sapiens
tatctacaaaaat

SEQ ID NO: 742241 - DNA, 13 bp, Homo sapiens
tatctacacatac

SEQ ID NO: 742242 - DNA, 15 bp, Homo sapiens
tatctacctgttctg

SEQ ID NO: 742243 - DNA, 17 bp, Homo sapiens
tatctacctgttctgta

SEQ ID NO: 742244 - DNA, 14 bp, Homo sapiens
tatctactaccaga

SEQ ID NO: 742245 - DNA, 15 bp, Homo sapiens
tatctagatactgta

SEQ ID NO: 742246 - DNA, 20 bp, Homo sapiens
tatctagcaatcacaacact

SEQ ID NO: 742247 - DNA, 19 bp, Homo sapiens
tatctagcagtaaaagata

SEQ ID NO: 742248 - DNA, 14 bp, Homo sapiens
tatctagcttcttc

SEQ ID NO: 742249 - DNA, 15 bp, Homo sapiens
tatctaggcatttca

SEQ ID NO: 742250 - DNA, 17 bp, Homo sapiens
tatctaggcatttcatt

SEQ ID NO: 742251 - DNA, 19 bp, Homo sapiens
tatctagtgcagctgattt

SEQ ID NO: 742252 - DNA, 13 bp, Homo sapiens
tatctatagctaa

SEQ ID NO: 742253 - DNA, 14 bp, Homo sapiens
tatctatataaaat

SEQ ID NO: 742254 - DNA, 16 bp, Homo sapiens
tatctatatatgtgta

SEQ ID NO: 742255 - DNA, 17 bp, Homo sapiens
tatctatatatgtgtat

SEQ ID NO: 742256 - DNA, 16 bp, Homo sapiens
tatctatatgtacttg

SEQ ID NO: 742257 - DNA, 19 bp, Homo sapiens
tatctatatgtacttgtca

SEQ ID NO: 742258 - DNA, 22 bp, Homo sapiens
tatctatgaacaacagtagttt

SEQ ID NO: 742259 - DNA, 21 bp, Homo sapiens
tatctatgcaaagcactctct

SEQ ID NO: 742260 - DNA, 22 bp, Homo sapiens
tatctatggaaatgtgagaaat

SEQ ID NO: 742261 - DNA, 21 bp, Homo sapiens
tatctatggtactaaggaagt

SEQ ID NO: 742262 - DNA, 17 bp, Homo sapiens
tatctatgtggaaaaca

SEQ ID NO: 742263 - DNA, 19 bp, Homo sapiens
tatctattaaagtgacttt

SEQ ID NO: 742264 - DNA, 15 bp, Homo sapiens
tatctattaatatat

SEQ ID NO: 742265 - DNA, 17 bp, Homo sapiens
tatctatttgtacaatt

SEQ ID NO: 742266 - DNA, 15 bp, Homo sapiens
tatctcaatctgcag

SEQ ID NO: 742267 - DNA, 13 bp, Homo sapiens
tatctcagaaagt

SEQ ID NO: 742268 - DNA, 19 bp, Homo sapiens
tatctcagaaagtgcctga

SEQ ID NO: 742269 - DNA, 19 bp, Homo sapiens
tatctcagatgttaaaata

SEQ ID NO: 742270 - DNA, 15 bp, Homo sapiens
tatctcagccatagg

SEQ ID NO: 742271 - DNA, 13 bp, Homo sapiens
tatctcagggagg

SEQ ID NO: 742272 - DNA, 14 bp, Homo sapiens
tatctcagggaggg

SEQ ID NO: 742273 - DNA, 13 bp, Homo sapiens
tatctcatactgt

SEQ ID NO: 742274 - DNA, 14 bp, Homo sapiens
tatctccctggaga

SEQ ID NO: 742275 - DNA, 18 bp, Homo sapiens
tatctccctggagaagca

SEQ ID NO: 742276 - DNA, 15 bp, Homo sapiens
gagtccatgaaaata

SEQ ID NO: 742277 - DNA, 16 bp, Homo sapiens
gagtccattctcccag

SEQ ID NO: 742278 - DNA, 18 bp, Homo sapiens
gagtccattctcccaggt

SEQ ID NO: 742279 - DNA, 14 bp, Homo sapiens
gagtcccaaggaaa

SEQ ID NO: 742280 - DNA, 18 bp, Homo sapiens
gagtcccctactccctct

SEQ ID NO: 742281 - DNA, 14 bp, Homo sapiens
gagtccgcccatcc

SEQ ID NO: 742282 - DNA, 22 bp, Homo sapiens
gagtccgcctgcgcctccatcc

SEQ ID NO: 742283 - DNA, 15 bp, Homo sapiens
gagtccggaggcagc

SEQ ID NO: 742284 - DNA, 20 bp, Homo sapiens
gagtccgtggttgccctaga

SEQ ID NO: 742285 - DNA, 16 bp, Homo sapiens
gagtcctcactcccag

SEQ ID NO: 742286 - DNA, 14 bp, Homo sapiens
gagtcctccacccc

SEQ ID NO: 742287 - DNA, 16 bp, Homo sapiens
gagtcctccaccccat

SEQ ID NO: 742288 - DNA, 17 bp, Homo sapiens
gagtcctctagcaggcc

SEQ ID NO: 742289 - DNA, 14 bp, Homo sapiens
gagtcctgggaggt

SEQ ID NO: 742290 - DNA, 14 bp, Homo sapiens
gagtcctgtctctg

SEQ ID NO: 742291 - DNA, 18 bp, Homo sapiens
gagtcctgtctctgcctg

SEQ ID NO: 742292 - DNA, 17 bp, Homo sapiens
gagtcctgttgaagact

SEQ ID NO: 742293 - DNA, 23 bp, Homo sapiens
gagtcctgttgaagacttcctct

SEQ ID NO: 742294 - DNA, 20 bp, Homo sapiens
gagtcggagtggacaccgct

SEQ ID NO: 742295 - DNA, 19 bp, Homo sapiens
gagtcgtcatcacttttca

SEQ ID NO: 742296 - DNA, 23 bp, Homo sapiens
gagtcgtcatcacttttcagtga

SEQ ID NO: 742297 - DNA, 17 bp, Homo sapiens
gagtcgtggggtgtgct

SEQ ID NO: 742298 - DNA, 19 bp, Homo sapiens
gagtcgtggggtgtgctgg

SEQ ID NO: 742299 - DNA, 20 bp, Homo sapiens
gagtcgtggggtgtgctggg

SEQ ID NO: 742300 - DNA, 19 bp, Homo sapiens
gagtctaatagtctttgcc

SEQ ID NO: 742301 - DNA, 19 bp, Homo sapiens
gagtctatgttcaaagact

SEQ ID NO: 742302 - DNA, 21 bp, Homo sapiens
gagtctcagaaactcccctgg

SEQ ID NO: 742303 - DNA, 22 bp, Homo sapiens
gagtctcagaaactcccctggg

SEQ ID NO: 742304 - DNA, 14 bp, Homo sapiens
gagtctcaggagga

SEQ ID NO: 742305 - DNA, 18 bp, Homo sapiens
gagtctcaggaggaggct

SEQ ID NO: 742306 - DNA, 19 bp, Homo sapiens
gagtctcaggaggaggctg

SEQ ID NO: 742307 - DNA, 20 bp, Homo sapiens
gagtctccagtggttgctgt

SEQ ID NO: 742308 - DNA, 22 bp, Homo sapiens
gagtctccctccgactccagat

SEQ ID NO: 742309 - DNA, 14 bp, Homo sapiens
gagtctctgccacc

SEQ ID NO: 742310 - DNA, 16 bp, Homo sapiens
gagtctctgccaccca

SEQ ID NO: 742311 - DNA, 13 bp, Homo sapiens
gagtctgagcccc

SEQ ID NO: 742312 - DNA, 13 bp, Homo sapiens
gagtctgaggact

SEQ ID NO: 742313 - DNA, 22 bp, Homo sapiens
gagtctgaggactgtcctccca

SEQ ID NO: 742314 - DNA, 15 bp, Homo sapiens
gagtctgagtcctgt

SEQ ID NO: 742315 - DNA, 18 bp, Homo sapiens
gagtctgagtcctgtctc

SEQ ID NO: 742316 - DNA, 18 bp, Homo sapiens
gagtctgagtctgagtcc

SEQ ID NO: 742317 - DNA, 11 bp, Homo sapiens
gagtctgcaca

SEQ ID NO: 742318 - DNA, 23 bp, Homo sapiens
gagtctgccccacatgtggccat

SEQ ID NO: 742319 - DNA, 15 bp, Homo sapiens
gagtctggggacctg

SEQ ID NO: 742320 - DNA, 23 bp, Homo sapiens
gagtctggtgaagctcacttctg

SEQ ID NO: 742321 - DNA, 19 bp, Homo sapiens
gagtctggtggaggagctg

SEQ ID NO: 742322 - DNA, 20 bp, Homo sapiens
gagtctggtggaggagctga

SEQ ID NO: 742323 - DNA, 17 bp, Homo sapiens
gagtctgtaggagcaag

SEQ ID NO: 742324 - DNA, 13 bp, Homo sapiens
gagtctgtctctt

SEQ ID NO: 742325 - DNA, 17 bp, Homo sapiens
gagtctgtctcttggct

SEQ ID NO: 742326 - DNA, 14 bp, Homo sapiens
gagtctgtgctctt

SEQ ID NO: 742327 - DNA, 16 bp, Homo sapiens
gagtcttgctctgtct

SEQ ID NO: 742328 - DNA, 15 bp, Homo sapiens
gagtgaaaaagagaa

SEQ ID NO: 742329 - DNA, 23 bp, Homo sapiens
gagtgaaaaatcttaagtaccaa

SEQ ID NO: 742330 - DNA, 14 bp, Homo sapiens
gagtgaaacagaga

SEQ ID NO: 742331 - DNA, 20 bp, Homo sapiens
gagtgaaacctttagggcag

SEQ ID NO: 742332 - DNA, 23 bp, Homo sapiens
gagtgaaacctttagggcagctt

SEQ ID NO: 742333 - DNA, 14 bp, Homo sapiens
gagtgaaagggcta

SEQ ID NO: 742334 - DNA, 14 bp, Homo sapiens
gagtgaagaggggc

SEQ ID NO: 742335 - DNA, 17 bp, Homo sapiens
gagtgaagaggggcagc

SEQ ID NO: 742336 - DNA, 18 bp, Homo sapiens
gagtgaagaggggcagcc

SEQ ID NO: 742337 - DNA, 17 bp, Homo sapiens
gagtgaatcaaagtgtc

SEQ ID NO: 742338 - DNA, 17 bp, Homo sapiens
gagtgaatcaggcaaag

SEQ ID NO: 742339 - DNA, 22 bp, Homo sapiens
gagtgaattgtacctatttctg

SEQ ID NO: 742340 - DNA, 12 bp, Homo sapiens
gagtgacagctt

SEQ ID NO: 742341 - DNA, 23 bp, Homo sapiens
gagtgacagctttctgggatgtc

SEQ ID NO: 742342 - DNA, 19 bp, Homo sapiens
gagtgacagtggattgcat

SEQ ID NO: 742343 - DNA, 21 bp, Homo sapiens
gagtgaccctcagctgtcacc

SEQ ID NO: 742344 - DNA, 22 bp, Homo sapiens
gagtgaccgggggctgctgggc

SEQ ID NO: 742345 - DNA, 23 bp, Homo sapiens
gagtgaccgggggctgctgggcg

SEQ ID NO: 742346 - DNA, 15 bp, Homo sapiens
gagtgacggtcccac

SEQ ID NO: 742347 - DNA, 15 bp, Homo sapiens
gagtgactcaagaag

SEQ ID NO: 742348 - DNA, 15 bp, Homo sapiens
gagtgactcgagggt

SEQ ID NO: 742349 - DNA, 23 bp, Homo sapiens
gagtgagacccagccctcatccc

SEQ ID NO: 742350 - DNA, 18 bp, Homo sapiens
gagtgagactccacctca

SEQ ID NO: 742351 - DNA, 18 bp, Homo sapiens
gagtgagcaagggggccc

SEQ ID NO: 742352 - DNA, 19 bp, Homo sapiens
gagtgagcaagggggccca

SEQ ID NO: 742353 - DNA, 17 bp, Homo sapiens
gagtgagcagctactgt

SEQ ID NO: 742354 - DNA, 13 bp, Homo sapiens
gagtgagccagtg

SEQ ID NO: 742355 - DNA, 15 bp, Homo sapiens
gagtgaggcttccag

SEQ ID NO: 742356 - DNA, 18 bp, Homo sapiens
gagtgaggcttccaggct

SEQ ID NO: 742357 - DNA, 21 bp, Homo sapiens
gagtgagggcctcagagcctg

SEQ ID NO: 742358 - DNA, 22 bp, Homo sapiens
gagtgaggggttacctccctcg

SEQ ID NO: 742359 - DNA, 14 bp, Homo sapiens
gagtgagtcacctg

SEQ ID NO: 742360 - DNA, 14 bp, Homo sapiens
tatcttttctttca

SEQ ID NO: 742361 - DNA, 16 bp, Homo sapiens
tatcttttctttcaaa

SEQ ID NO: 742362 - DNA, 15 bp, Homo sapiens
tatgaaaaacatccc

SEQ ID NO: 742363 - DNA, 23 bp, Homo sapiens
tatgaaaaacatcccaaacttta

SEQ ID NO: 742364 - DNA, 14 bp, Homo sapiens
tatgaaaaagaaga

SEQ ID NO: 742365 - DNA, 17 bp, Homo sapiens
tatgaaaaagattattt

SEQ ID NO: 742366 - DNA, 21 bp, Homo sapiens
tatgaaaatatagacattctc

SEQ ID NO: 742367 - DNA, 19 bp, Homo sapiens
tatgaaaatcctatatctg

SEQ ID NO: 742368 - DNA, 22 bp, Homo sapiens
tatgaaagatggctgtgcctct

SEQ ID NO: 742369 - DNA, 23 bp, Homo sapiens
tatgaaagatggctgtgcctctg

SEQ ID NO: 742370 - DNA, 19 bp, Homo sapiens
tatgaaagcaacaaagaaa

SEQ ID NO: 742371 - DNA, 14 bp, Homo sapiens
tatgaaataaagaa

SEQ ID NO: 742372 - DNA, 17 bp, Homo sapiens
tatgaaataaattctga

SEQ ID NO: 742373 - DNA, 15 bp, Homo sapiens
tatgaaatatatgtg

SEQ ID NO: 742374 - DNA, 14 bp, Homo sapiens
tatgaaatctcaca

SEQ ID NO: 742375 - DNA, 18 bp, Homo sapiens
tatgaaattcaagtgctt

SEQ ID NO: 742376 - DNA, 18 bp, Homo sapiens
tatgaaattccagcaata

SEQ ID NO: 742377 - DNA, 23 bp, Homo sapiens
tatgaaattccagcaataagaaa

SEQ ID NO: 742378 - DNA, 14 bp, Homo sapiens
tatgaacaactcca

SEQ ID NO: 742379 - DNA, 15 bp, Homo sapiens
tatgaacactgtcat

SEQ ID NO: 742380 - DNA, 17 bp, Homo sapiens
tatgaacagctgtgtct

SEQ ID NO: 742381 - DNA, 14 bp, Homo sapiens
tatgaacatattgt

SEQ ID NO: 742382 - DNA, 14 bp, Homo sapiens
tatgaacatgcagt

SEQ ID NO: 742383 - DNA, 16 bp, Homo sapiens
tatgaacattgtactg

SEQ ID NO: 742384 - DNA, 18 bp, Homo sapiens
tatgaacattgtactgtt

SEQ ID NO: 742385 - DNA, 23 bp, Homo sapiens
tatgaacctattttcatttgtac

SEQ ID NO: 742386 - DNA, 22 bp, Homo sapiens
tatgaacttgagatctgtataa

SEQ ID NO: 742387 - DNA, 20 bp, Homo sapiens
tatgaactttatagttgttt

SEQ ID NO: 742388 - DNA, 16 bp, Homo sapiens
tatgaagaactgagga

SEQ ID NO: 742389 - DNA, 17 bp, Homo sapiens
tatgaagaactgaggag

SEQ ID NO: 742390 - DNA, 19 bp, Homo sapiens
tatgaagataagtgtattt

SEQ ID NO: 742391 - DNA, 21 bp, Homo sapiens
tatgaagcagatttatttttg

SEQ ID NO: 742392 - DNA, 21 bp, Homo sapiens
tatgaagctacctcaaacttc

SEQ ID NO: 742393 - DNA, 20 bp, Homo sapiens
tatgaaggaatcattccagt

SEQ ID NO: 742394 - DNA, 16 bp, Homo sapiens
tatgaagtataaatct

SEQ ID NO: 742395 - DNA, 13 bp, Homo sapiens
tatgaagtgcgtg

SEQ ID NO: 742396 - DNA, 13 bp, Homo sapiens
tatgaagttgctg

SEQ ID NO: 742397 - DNA, 18 bp, Homo sapiens
tatgaagttggcacattt

SEQ ID NO: 742398 - DNA, 22 bp, Homo sapiens
tatgaagttggcacatttcatg

SEQ ID NO: 742399 - DNA, 18 bp, Homo sapiens
tatgaataaagacaccta

SEQ ID NO: 742400 - DNA, 16 bp, Homo sapiens
tatgaatacagggcat

SEQ ID NO: 742401 - DNA, 13 bp, Homo sapiens
tatgaatatcatt

SEQ ID NO: 742402 - DNA, 16 bp, Homo sapiens
tatgaatatcattgat

SEQ ID NO: 742403 - DNA, 16 bp, Homo sapiens
gagtggcacttctgcc

SEQ ID NO: 742404 - DNA, 12 bp, Homo sapiens
gagtggcagcca

SEQ ID NO: 742405 - DNA, 16 bp, Homo sapiens
gagtggcagccatgcc

SEQ ID NO: 742406 - DNA, 18 bp, Homo sapiens
gagtggcagccatgcctc

SEQ ID NO: 742407 - DNA, 24 bp, Homo sapiens
gagtggcagccatgcctcatgcca

SEQ ID NO: 742408 - DNA, 14 bp, Homo sapiens
gagtggcaggtggg

SEQ ID NO: 742409 - DNA, 23 bp, Homo sapiens
gagtggccaaataggagggagac

SEQ ID NO: 742410 - DNA, 19 bp, Homo sapiens
gagtggccagcgccagggc

SEQ ID NO: 742411 - DNA, 21 bp, Homo sapiens
gagtggccagcgccagggccc

SEQ ID NO: 742412 - DNA, 17 bp, Homo sapiens
gagtggccatttggggt

SEQ ID NO: 742413 - DNA, 21 bp, Homo sapiens
gagtggcccctcacctgggcc

SEQ ID NO: 742414 - DNA, 14 bp, Homo sapiens
gagtggcctagagc

SEQ ID NO: 742415 - DNA, 14 bp, Homo sapiens
gagtggcctccctg

SEQ ID NO: 742416 - DNA, 10 bp, Homo sapiens
gagtggcctg

SEQ ID NO: 742417 - DNA, 12 bp, Homo sapiens
gagtggcctggc

SEQ ID NO: 742418 - DNA, 20 bp, Homo sapiens
gagtggcctggccaggagct

SEQ ID NO: 742419 - DNA, 17 bp, Homo sapiens
gagtggcgtgagctgcc

SEQ ID NO: 742420 - DNA, 19 bp, Homo sapiens
gagtggcgtggcctcccca

SEQ ID NO: 742421 - DNA, 15 bp, Homo sapiens
gagtggctcctcccg

SEQ ID NO: 742422 - DNA, 13 bp, Homo sapiens
gagtgggaagccc

SEQ ID NO: 742423 - DNA, 15 bp, Homo sapiens
gagtgggacttggag

SEQ ID NO: 742424 - DNA, 22 bp, Homo sapiens
gagtgggccctgcccggggagc

SEQ ID NO: 742425 - DNA, 17 bp, Homo sapiens
gagtggggggaggaagc

SEQ ID NO: 742426 - DNA, 21 bp, Homo sapiens
gagtggggttatctctgtgtt

SEQ ID NO: 742427 - DNA, 20 bp, Homo sapiens
gagtgggtgacaagagcctg

SEQ ID NO: 742428 - DNA, 15 bp, Homo sapiens
gagtgggtggaggca

SEQ ID NO: 742429 - DNA, 20 bp, Homo sapiens
gagtggtcactggtcagggc

SEQ ID NO: 742430 - DNA, 14 bp, Homo sapiens
gagtggtctttctg

SEQ ID NO: 742431 - DNA, 12 bp, Homo sapiens
gagtggtgagtg

SEQ ID NO: 742432 - DNA, 16 bp, Homo sapiens
gagtggtgcagacaga

SEQ ID NO: 742433 - DNA, 14 bp, Homo sapiens
gagtggttctcatt

SEQ ID NO: 742434 - DNA, 16 bp, Homo sapiens
gagtggttctcatttg

SEQ ID NO: 742435 - DNA, 15 bp, Homo sapiens
gagtggttgttgcca

SEQ ID NO: 742436 - DNA, 21 bp, Homo sapiens
gagtggtttaggctatttgta

SEQ ID NO: 742437 - DNA, 18 bp, Homo sapiens
gagtggtttcggaaaaaa

SEQ ID NO: 742438 - DNA, 19 bp, Homo sapiens
gagtgtaaataattttaaa

SEQ ID NO: 742439 - DNA, 13 bp, Homo sapiens
gagtgtacaagta

SEQ ID NO: 742440 - DNA, 20 bp, Homo sapiens
gagtgtagcctaaagggcag

SEQ ID NO: 742441 - DNA, 22 bp, Homo sapiens
gagtgtagcctaaagggcaggg

SEQ ID NO: 742442 - DNA, 14 bp, Homo sapiens
gagtgtagctgtaa

SEQ ID NO: 742443 - DNA, 13 bp, Homo sapiens
gagtgtagctgtg

SEQ ID NO: 742444 - DNA, 14 bp, Homo sapiens
gagtgtagctgtga

SEQ ID NO: 742445 - DNA, 14 bp, Homo sapiens
gagtgtatatatat

SEQ ID NO: 742446 - DNA, 18 bp, Homo sapiens
gagtgtctggaattgtgg

SEQ ID NO: 742447 - DNA, 19 bp, Homo sapiens
gagtgtctttccacggagc

SEQ ID NO: 742448 - DNA, 18 bp, Homo sapiens
gagtgtgaatataaatgt

SEQ ID NO: 742449 - DNA, 17 bp, Homo sapiens
gagtgtgacagggccag

SEQ ID NO: 742450 - DNA, 21 bp, Homo sapiens
gagtgtgaccaaaagttacat

SEQ ID NO: 742451 - DNA, 23 bp, Homo sapiens
gagtgtgagccacctaagatctc

SEQ ID NO: 742452 - DNA, 15 bp, Homo sapiens
gagtgtgagggcagc

SEQ ID NO: 742453 - DNA, 19 bp, Homo sapiens
gagtgtgagtgtgtgtgca

SEQ ID NO: 742454 - DNA, 18 bp, Homo sapiens
gagtgtgcagacagccat

SEQ ID NO: 742455 - DNA, 14 bp, Homo sapiens
gagtgtgcagactg

SEQ ID NO: 742456 - DNA, 14 bp, Homo sapiens
gagtgtgctctccc

SEQ ID NO: 742457 - DNA, 17 bp, Homo sapiens
gagtgtggaagccggag

SEQ ID NO: 742458 - DNA, 12 bp, Homo sapiens
gagtgtgggaag

SEQ ID NO: 742459 - DNA, 14 bp, Homo sapiens
gagtgtgtatgtca

SEQ ID NO: 742460 - DNA, 16 bp, Homo sapiens
gagtgtgtcagagccc

SEQ ID NO: 742461 - DNA, 19 bp, Homo sapiens
gagtgtgtgcatgtgtgtg

SEQ ID NO: 742462 - DNA, 17 bp, Homo sapiens
gagtgtgtgggcagggt

SEQ ID NO: 742463 - DNA, 13 bp, Homo sapiens
gagtgtgtgtgct

SEQ ID NO: 742464 - DNA, 21 bp, Homo sapiens
gagtgttcaaactactgtaca

SEQ ID NO: 742465 - DNA, 23 bp, Homo sapiens
gagtgttcaaactactgtacatt

SEQ ID NO: 742466 - DNA, 22 bp, Homo sapiens
gagtgttcattttagtgactgt

SEQ ID NO: 742467 - DNA, 18 bp, Homo sapiens
gagtgttctgtgggcttg

SEQ ID NO: 742468 - DNA, 19 bp, Homo sapiens
gagtgttctgtgggcttgg

SEQ ID NO: 742469 - DNA, 22 bp, Homo sapiens
gagtgttgggcatgtgatcacg

SEQ ID NO: 742470 - DNA, 19 bp, Homo sapiens
gagtgttgttgctgaccag

SEQ ID NO: 742471 - DNA, 22 bp, Homo sapiens
gagtgtttctaataaacttgga

SEQ ID NO: 742472 - DNA, 18 bp, Homo sapiens
gagttacagcgagaggca

SEQ ID NO: 742473 - DNA, 20 bp, Homo sapiens
gagttacagcgagaggcaga

SEQ ID NO: 742474 - DNA, 17 bp, Homo sapiens
gagttacattaatgtta

SEQ ID NO: 742475 - DNA, 18 bp, Homo sapiens
gagttacttagaatgcca

SEQ ID NO: 742476 - DNA, 17 bp, Homo sapiens
gagttaggctattcaca

SEQ ID NO: 742477 - DNA, 18 bp, Homo sapiens
gagttaggggccttaggg

SEQ ID NO: 742478 - DNA, 15 bp, Homo sapiens
gagttaggtcctcac

SEQ ID NO: 742479 - DNA, 20 bp, Homo sapiens
gagttatcatgaattttaaa

SEQ ID NO: 742480 - DNA, 23 bp, Homo sapiens
gagttatcatgaattttaaagta

SEQ ID NO: 742481 - DNA, 21 bp, Homo sapiens
gagttatttaactggtaagcg

SEQ ID NO: 742482 - DNA, 16 bp, Homo sapiens
gataatcctagagtct

SEQ ID NO: 742483 - DNA, 14 bp, Homo sapiens
gataatgaacagaa

SEQ ID NO: 742484 - DNA, 19 bp, Homo sapiens
gataatgctgttgcctcat

SEQ ID NO: 742485 - DNA, 16 bp, Homo sapiens
gataatgggagacagt

SEQ ID NO: 742486 - DNA, 18 bp, Homo sapiens
gataatgtccccactccc

SEQ ID NO: 742487 - DNA, 15 bp, Homo sapiens
gataattcatttgta

SEQ ID NO: 742488 - DNA, 18 bp, Homo sapiens
gataattcatttgtattg

SEQ ID NO: 742489 - DNA, 19 bp, Homo sapiens
gataattcatttgtattgc

SEQ ID NO: 742490 - DNA, 12 bp, Homo sapiens
gataattgtgta

SEQ ID NO: 742491 - DNA, 19 bp, Homo sapiens
gataattgtgtattttctt

SEQ ID NO: 742492 - DNA, 22 bp, Homo sapiens
gataatttaaaatccattttag

SEQ ID NO: 742493 - DNA, 12 bp, Homo sapiens
gataatttcagg

SEQ ID NO: 742494 - DNA, 15 bp, Homo sapiens
gataatttcagggtg

SEQ ID NO: 742495 - DNA, 13 bp, Homo sapiens
gatacaaagtgtt

SEQ ID NO: 742496 - DNA, 17 bp, Homo sapiens
gatacaaatgtctatca

SEQ ID NO: 742497 - DNA, 14 bp, Homo sapiens
gatacaaatttggc

SEQ ID NO: 742498 - DNA, 11 bp, Homo sapiens
gatacaataaa

SEQ ID NO: 742499 - DNA, 18 bp, Homo sapiens
gatacaatgctgtgccct

SEQ ID NO: 742500 - DNA, 20 bp, Homo sapiens
gatacactgaagttaacaga

SEQ ID NO: 742501 - DNA, 14 bp, Homo sapiens
gatacactgcactt

SEQ ID NO: 742502 - DNA, 19 bp, Homo sapiens
gatacactgcactttgttt

SEQ ID NO: 742503 - DNA, 13 bp, Homo sapiens
gatacactgcagc

SEQ ID NO: 742504 - DNA, 15 bp, Homo sapiens
gatacagtgcccacc

SEQ ID NO: 742505 - DNA, 18 bp, Homo sapiens
gatacagtgtaggcattt

SEQ ID NO: 742506 - DNA, 15 bp, Homo sapiens
gatacataataaaaa

SEQ ID NO: 742507 - DNA, 20 bp, Homo sapiens
gatacatatgagtgtggaag

SEQ ID NO: 742508 - DNA, 14 bp, Homo sapiens
gatacatcactgct

SEQ ID NO: 742509 - DNA, 17 bp, Homo sapiens
gatacatcactgcttga

SEQ ID NO: 742510 - DNA, 21 bp, Homo sapiens
gatacatcactgcttgatgaa

SEQ ID NO: 742511 - DNA, 20 bp, Homo sapiens
gatacatccaaagcagacag

SEQ ID NO: 742512 - DNA, 18 bp, Homo sapiens
gataccacaaaccctgct

SEQ ID NO: 742513 - DNA, 17 bp, Homo sapiens
gataccacctttactgt

SEQ ID NO: 742514 - DNA, 14 bp, Homo sapiens
gataccagaaggga

SEQ ID NO: 742515 - DNA, 12 bp, Homo sapiens
gataccagcccc

SEQ ID NO: 742516 - DNA, 13 bp, Homo sapiens
gataccagctgga

SEQ ID NO: 742517 - DNA, 20 bp, Homo sapiens
gataccaggttgaaagacct

SEQ ID NO: 742518 - DNA, 22 bp, Homo sapiens
gataccataaaaagaggatgat

SEQ ID NO: 742519 - DNA, 19 bp, Homo sapiens
gataccatgctgtaaggat

SEQ ID NO: 742520 - DNA, 23 bp, Homo sapiens
gatacccaacagtttatttttat

SEQ ID NO: 742521 - DNA, 15 bp, Homo sapiens
gatacccagtggaat

SEQ ID NO: 742522 - DNA, 13 bp, Homo sapiens
gatacccccctct

SEQ ID NO: 742523 - DNA, 21 bp, Homo sapiens
gataccgccacgggtttccct

SEQ ID NO: 742524 - DNA, 17 bp, Homo sapiens
gatacctccaaccctgc

SEQ ID NO: 742525 - DNA, 18 bp, Homo sapiens
gatacctgctttggaagc

SEQ ID NO: 742526 - DNA, 20 bp, Homo sapiens
gataccttcatttaatatat

SEQ ID NO: 742527 - DNA, 18 bp, Homo sapiens
gataccttcttatttaat

SEQ ID NO: 742528 - DNA, 22 bp, Homo sapiens
gatacgctactataaagagaag

SEQ ID NO: 742529 - DNA, 19 bp, Homo sapiens
gatacgtagttgtgctttt

SEQ ID NO: 742530 - DNA, 13 bp, Homo sapiens
gatacgtgtatga

SEQ ID NO: 742531 - DNA, 18 bp, Homo sapiens
gatactaaagcaaattgt

SEQ ID NO: 742532 - DNA, 22 bp, Homo sapiens
gatactaataaactaataattg

SEQ ID NO: 742533 - DNA, 18 bp, Homo sapiens
tatgccacacctggcctt

SEQ ID NO: 742534 - DNA, 22 bp, Homo sapiens
tatgccacgggaagtttagaga

SEQ ID NO: 742535 - DNA, 13 bp, Homo sapiens
tatgccatagaaa

SEQ ID NO: 742536 - DNA, 19 bp, Homo sapiens
tatgccattggggtagttg

SEQ ID NO: 742537 - DNA, 15 bp, Homo sapiens
tatgcccacataccc

SEQ ID NO: 742538 - DNA, 20 bp, Homo sapiens
tatgccccttcttgggcccc

SEQ ID NO: 742539 - DNA, 15 bp, Homo sapiens
tatgccctgcagagc

SEQ ID NO: 742540 - DNA, 12 bp, Homo sapiens
tatgccctgccc

SEQ ID NO: 742541 - DNA, 15 bp, Homo sapiens
tatgccggatgtgct

SEQ ID NO: 742542 - DNA, 16 bp, Homo sapiens
tatgccggatgtgctt

SEQ ID NO: 742543 - DNA, 21 bp, Homo sapiens
tatgccggatgtgcttttctc

SEQ ID NO: 742544 - DNA, 13 bp, Homo sapiens
tatgcctacagcc

SEQ ID NO: 742545 - DNA, 16 bp, Homo sapiens
tatgcctctgtattta

SEQ ID NO: 742546 - DNA, 13 bp, Homo sapiens
tatgcctgacccc

SEQ ID NO: 742547 - DNA, 18 bp, Homo sapiens
tatgcctgctatttgaag

SEQ ID NO: 742548 - DNA, 13 bp, Homo sapiens
tatgccttaagca

SEQ ID NO: 742549 - DNA, 14 bp, Homo sapiens
tatgccttaagcag

SEQ ID NO: 742550 - DNA, 17 bp, Homo sapiens
tatgccttaagcagaac

SEQ ID NO: 742551 - DNA, 22 bp, Homo sapiens
tatgccttaagcagaacaaatg

SEQ ID NO: 742552 - DNA, 13 bp, Homo sapiens
tatgccttctgta

SEQ ID NO: 742553 - DNA, 20 bp, Homo sapiens
tatgcctttaaatctgtgat

SEQ ID NO: 742554 - DNA, 19 bp, Homo sapiens
tatgcgtcccaagcagccg

SEQ ID NO: 742555 - DNA, 20 bp, Homo sapiens
tatgcgtgtccgtctgtctg

SEQ ID NO: 742556 - DNA, 21 bp, Homo sapiens
tatgctagtttattggaagtg

SEQ ID NO: 742557 - DNA, 17 bp, Homo sapiens
tatgctattgacaataa

SEQ ID NO: 742558 - DNA, 14 bp, Homo sapiens
tatgctatttctgt

SEQ ID NO: 742559 - DNA, 18 bp, Homo sapiens
tatgctctacccttgtgt

SEQ ID NO: 742560 - DNA, 14 bp, Homo sapiens
tatgctctgcatgt

SEQ ID NO: 742561 - DNA, 19 bp, Homo sapiens
tatgctctgcatgttacat

SEQ ID NO: 742562 - DNA, 17 bp, Homo sapiens
tatgctcttgaaatatt

SEQ ID NO: 742563 - DNA, 19 bp, Homo sapiens
tatgctgaagacattcaaa

SEQ ID NO: 742564 - DNA, 22 bp, Homo sapiens
tatgctgagtatgttaagctct

SEQ ID NO: 742565 - DNA, 17 bp, Homo sapiens
tatgctgatcttttaaa

SEQ ID NO: 742566 - DNA, 18 bp, Homo sapiens
tatgctgctgtgaatttt

SEQ ID NO: 742567 - DNA, 14 bp, Homo sapiens
tatgctgtatctgt

SEQ ID NO: 742568 - DNA, 19 bp, Homo sapiens
tatgctgtatttctttgta

SEQ ID NO: 742569 - DNA, 19 bp, Homo sapiens
tatgcttaaaataagcagg

SEQ ID NO: 742570 - DNA, 15 bp, Homo sapiens
tatgcttactcttgc

SEQ ID NO: 742571 - DNA, 21 bp, Homo sapiens
tatgcttactgatatatttta

SEQ ID NO: 742572 - DNA, 18 bp, Homo sapiens
tatgcttgtaactaaaat

SEQ ID NO: 742573 - DNA, 17 bp, Homo sapiens
tatgctttccctgagga

SEQ ID NO: 742574 - DNA, 13 bp, Homo sapiens
tatgctttccttc

SEQ ID NO: 742575 - DNA, 19 bp, Homo sapiens
tatgctttgaactttagtt

SEQ ID NO: 742576 - DNA, 21 bp, Homo sapiens
tatggaaaaaccatttgaagt

SEQ ID NO: 742577 - DNA, 13 bp, Homo sapiens
tatggaaaactgt

SEQ ID NO: 742578 - DNA, 22 bp, Homo sapiens
tatggaaaagggtcttcttggc

SEQ ID NO: 742579 - DNA, 16 bp, Homo sapiens
tatggaaaatcagctg

SEQ ID NO: 742580 - DNA, 13 bp, Homo sapiens
tatggaaacattt

SEQ ID NO: 742581 - DNA, 22 bp, Homo sapiens
tatggaaacattttatactgta

SEQ ID NO: 742582 - DNA, 17 bp, Homo sapiens
tatggaaataaatgtat

SEQ ID NO: 742583 - DNA, 15 bp, Homo sapiens
tatggaaatctttta

SEQ ID NO: 742584 - DNA, 18 bp, Homo sapiens
tatggaaatgtgagaaat

SEQ ID NO: 742585 - DNA, 15 bp, Homo sapiens
tatggaacagggatg

SEQ ID NO: 742586 - DNA, 20 bp, Homo sapiens
tatggaacttctaatatatt

SEQ ID NO: 742587 - DNA, 19 bp, Homo sapiens
tatggaagttgttgctata

SEQ ID NO: 742588 - DNA, 23 bp, Homo sapiens
tatggaatacagtgttattttct

SEQ ID NO: 742589 - DNA, 24 bp, Homo sapiens
tatggaatacagtgttattttctt

SEQ ID NO: 742590 - DNA, 14 bp, Homo sapiens
tatggaatattcat

SEQ ID NO: 742591 - DNA, 18 bp, Homo sapiens
tatggaatattcatttta

SEQ ID NO: 742592 - DNA, 18 bp, Homo sapiens
tatggaattgatttgcat

SEQ ID NO: 742593 - DNA, 22 bp, Homo sapiens
tatggacaacttatttaaaaat

SEQ ID NO: 742594 - DNA, 16 bp, Homo sapiens
tatggacactgcctta

SEQ ID NO: 742595 - DNA, 23 bp, Homo sapiens
tatggacactgccttagcctctt

SEQ ID NO: 742596 - DNA, 19 bp, Homo sapiens
tatggaggactgtgacaga

SEQ ID NO: 742597 - DNA, 21 bp, Homo sapiens
tatggagtgagtcacctgctc

SEQ ID NO: 742598 - DNA, 13 bp, Homo sapiens
tatggattaaaaa

SEQ ID NO: 742599 - DNA, 14 bp, Homo sapiens
tatggattctaaaa

SEQ ID NO: 742600 - DNA, 15 bp, Homo sapiens
tatggattctaaaat

SEQ ID NO: 742601 - DNA, 16 bp, Homo sapiens
tatggattctaaaatg

SEQ ID NO: 742602 - DNA, 20 bp, Homo sapiens
tatggcaaccattataacct

SEQ ID NO: 742603 - DNA, 10 bp, Homo sapiens
tatggcactt

SEQ ID NO: 742604 - DNA, 23 bp, Homo sapiens
gatataggtcagtgaggcccagg

SEQ ID NO: 742605 - DNA, 17 bp, Homo sapiens
gatatagtcagctgcct

SEQ ID NO: 742606 - DNA, 21 bp, Homo sapiens
gatatagttttacttttaaac

SEQ ID NO: 742607 - DNA, 15 bp, Homo sapiens
gatatatacaaggtg

SEQ ID NO: 742608 - DNA, 20 bp, Homo sapiens
gatatatcatgagtgaataa

SEQ ID NO: 742609 - DNA, 21 bp, Homo sapiens
gatatatcatgagtgaataaa

SEQ ID NO: 742610 - DNA, 22 bp, Homo sapiens
gatatatgtgtttttcacattt

SEQ ID NO: 742611 - DNA, 15 bp, Homo sapiens
gatatatttaaaaat

SEQ ID NO: 742612 - DNA, 22 bp, Homo sapiens
gatatatttcacttttgttctg

SEQ ID NO: 742613 - DNA, 19 bp, Homo sapiens
gatatatttctatgtgtat

SEQ ID NO: 742614 - DNA, 14 bp, Homo sapiens
gatatcaaaattct

SEQ ID NO: 742615 - DNA, 18 bp, Homo sapiens
gatatcagagctgggaaa

SEQ ID NO: 742616 - DNA, 18 bp, Homo sapiens
gatatcagggtataaatt

SEQ ID NO: 742617 - DNA, 11 bp, Homo sapiens
gatatcctctc

SEQ ID NO: 742618 - DNA, 20 bp, Homo sapiens
gatatcctctccccctcctc

SEQ ID NO: 742619 - DNA, 16 bp, Homo sapiens
gatatccttatcagag

SEQ ID NO: 742620 - DNA, 23 bp, Homo sapiens
gatatctatatatgtatctacaa

SEQ ID NO: 742621 - DNA, 15 bp, Homo sapiens
gatatctgagggagg

SEQ ID NO: 742622 - DNA, 20 bp, Homo sapiens
gatatctgagggaggaggcc

SEQ ID NO: 742623 - DNA, 21 bp, Homo sapiens
gatatctgagggaggaggcca

SEQ ID NO: 742624 - DNA, 17 bp, Homo sapiens
gatatgacccacactgc

SEQ ID NO: 742625 - DNA, 18 bp, Homo sapiens
gatatgacccacactgcc

SEQ ID NO: 742626 - DNA, 18 bp, Homo sapiens
gatatgcagttttcctta

SEQ ID NO: 742627 - DNA, 17 bp, Homo sapiens
gatatgcatatttgttt

SEQ ID NO: 742628 - DNA, 12 bp, Homo sapiens
gatatgcttgta

SEQ ID NO: 742629 - DNA, 22 bp, Homo sapiens
gatatgcttgtaactaaaataa

SEQ ID NO: 742630 - DNA, 21 bp, Homo sapiens
gatatggagtgagtcacctgc

SEQ ID NO: 742631 - DNA, 22 bp, Homo sapiens
gatatggagtgagtcacctgct

SEQ ID NO: 742632 - DNA, 23 bp, Homo sapiens
gatatggagtgagtcacctgctc

SEQ ID NO: 742633 - DNA, 19 bp, Homo sapiens
gatatggcaggactcctgg

SEQ ID NO: 742634 - DNA, 17 bp, Homo sapiens
gatatgtaaaacattta

SEQ ID NO: 742635 - DNA, 16 bp, Homo sapiens
gatatgtatatataca

SEQ ID NO: 742636 - DNA, 14 bp, Homo sapiens
gatatgtggtgtat

SEQ ID NO: 742637 - DNA, 19 bp, Homo sapiens
gatatgtggtgtatatcct

SEQ ID NO: 742638 - DNA, 16 bp, Homo sapiens
gatattaaaatttggt

SEQ ID NO: 742639 - DNA, 19 bp, Homo sapiens
gatattaaacgtgtaaatt

SEQ ID NO: 742640 - DNA, 21 bp, Homo sapiens
gatattaaacgtgtaaattgc

SEQ ID NO: 742641 - DNA, 13 bp, Homo sapiens
gatattaaatttc

SEQ ID NO: 742642 - DNA, 14 bp, Homo sapiens
gatattaaatttca

SEQ ID NO: 742643 - DNA, 12 bp, Homo sapiens
gatattaatcaa

SEQ ID NO: 742644 - DNA, 14 bp, Homo sapiens
gatattaatcaaaa

SEQ ID NO: 742645 - DNA, 12 bp, Homo sapiens
gatattatctac

SEQ ID NO: 742646 - DNA, 23 bp, Homo sapiens
gatattattagaaattagaaaaa

SEQ ID NO: 742647 - DNA, 15 bp, Homo sapiens
gatattattcttgta

SEQ ID NO: 742648 - DNA, 23 bp, Homo sapiens
gatattattttagcttcagttgt

SEQ ID NO: 742649 - DNA, 18 bp, Homo sapiens
gatattcaaggctttaaa

SEQ ID NO: 742650 - DNA, 15 bp, Homo sapiens
gatattcagatgtat

SEQ ID NO: 742651 - DNA, 19 bp, Homo sapiens
gatattccatgaatgtatc

SEQ ID NO: 742652 - DNA, 22 bp, Homo sapiens
gatattcctattgtgcaatgta

SEQ ID NO: 742653 - DNA, 21 bp, Homo sapiens
gatattctaagaaatatctgt

SEQ ID NO: 742654 - DNA, 23 bp, Homo sapiens
gatattctaagaaatatctgtga

SEQ ID NO: 742655 - DNA, 18 bp, Homo sapiens
gatattctccctgacctt

SEQ ID NO: 742656 - DNA, 20 bp, Homo sapiens
gatattcttatttcactaaa

SEQ ID NO: 742657 - DNA, 11 bp, Homo sapiens
gatattgcctt

SEQ ID NO: 742658 - DNA, 21 bp, Homo sapiens
gatattgccttatttgtctgt

SEQ ID NO: 742659 - DNA, 22 bp, Homo sapiens
gatattgggaaggaaatatatt

SEQ ID NO: 742660 - DNA, 18 bp, Homo sapiens
tatggttggagagccctg

SEQ ID NO: 742661 - DNA, 14 bp, Homo sapiens
tatggttgtataca

SEQ ID NO: 742662 - DNA, 13 bp, Homo sapiens
tatgtaaaacatt

SEQ ID NO: 742663 - DNA, 15 bp, Homo sapiens
tatgtaaaacattta

SEQ ID NO: 742664 - DNA, 12 bp, Homo sapiens
tatgtaaaataa

SEQ ID NO: 742665 - DNA, 14 bp, Homo sapiens
tatgtaaagtatgt

SEQ ID NO: 742666 - DNA, 19 bp, Homo sapiens
tatgtaaagtatgtaaaca

SEQ ID NO: 742667 - DNA, 16 bp, Homo sapiens
tatgtaaagtatgttt

SEQ ID NO: 742668 - DNA, 23 bp, Homo sapiens
tatgtaaagtatgtttttacatt

SEQ ID NO: 742669 - DNA, 16 bp, Homo sapiens
tatgtaaatatgaaga

SEQ ID NO: 742670 - DNA, 10 bp, Homo sapiens
tatgtaaatg

SEQ ID NO: 742671 - DNA, 20 bp, Homo sapiens
tatgtaaatggtatgtcatt

SEQ ID NO: 742672 - DNA, 13 bp, Homo sapiens
tatgtaaatgtgc

SEQ ID NO: 742673 - DNA, 13 bp, Homo sapiens
tatgtaaatgtgt

SEQ ID NO: 742674 - DNA, 21 bp, Homo sapiens
tatgtaacaaacctgcactta

SEQ ID NO: 742675 - DNA, 11 bp, Homo sapiens
tatgtaacatg

SEQ ID NO: 742676 - DNA, 14 bp, Homo sapiens
tatgtaactgcatt

SEQ ID NO: 742677 - DNA, 24 bp, Homo sapiens
tatgtaactgcattgagaactgca

SEQ ID NO: 742678 - DNA, 21 bp, Homo sapiens
tatgtaagaattcagaagacc

SEQ ID NO: 742679 - DNA, 15 bp, Homo sapiens
tatgtaagagcacct

SEQ ID NO: 742680 - DNA, 17 bp, Homo sapiens
tatgtaatataaattta

SEQ ID NO: 742681 - DNA, 17 bp, Homo sapiens
tatgtaatatattgtac

SEQ ID NO: 742682 - DNA, 20 bp, Homo sapiens
tatgtaatatattgtacaaa

SEQ ID NO: 742683 - DNA, 24 bp, Homo sapiens
tatgtaatatattgtacaaatgta

SEQ ID NO: 742684 - DNA, 18 bp, Homo sapiens
tatgtaatcaaacttcta

SEQ ID NO: 742685 - DNA, 14 bp, Homo sapiens
tatgtaatttatgc

SEQ ID NO: 742686 - DNA, 14 bp, Homo sapiens
tatgtaatttcaaa

SEQ ID NO: 742687 - DNA, 21 bp, Homo sapiens
tatgtacaatacaatgtacaa

SEQ ID NO: 742688 - DNA, 16 bp, Homo sapiens
tatgtaccatgtacat

SEQ ID NO: 742689 - DNA, 22 bp, Homo sapiens
tatgtacctctagctgttcttt

SEQ ID NO: 742690 - DNA, 18 bp, Homo sapiens
tatgtacgtttgtatgtg

SEQ ID NO: 742691 - DNA, 21 bp, Homo sapiens
tatgtactctacgccaaagtg

SEQ ID NO: 742692 - DNA, 16 bp, Homo sapiens
tatgtagatgtgcatt

SEQ ID NO: 742693 - DNA, 19 bp, Homo sapiens
tatgtagtatctatatgac

SEQ ID NO: 742694 - DNA, 15 bp, Homo sapiens
tatgtagtattaaaa

SEQ ID NO: 742695 - DNA, 18 bp, Homo sapiens
tatgtagtattaaaagtt

SEQ ID NO: 742696 - DNA, 9 bp, Homo sapiens
tatgtatac

SEQ ID NO: 742697 - DNA, 14 bp, Homo sapiens
tatgtatacacaca

SEQ ID NO: 742698 - DNA, 16 bp, Homo sapiens
tatgtatacacacata

SEQ ID NO: 742699 - DNA, 21 bp, Homo sapiens
tatgtatatcattctacagaa

SEQ ID NO: 742700 - DNA, 14 bp, Homo sapiens
tatgtatatgtata

SEQ ID NO: 742701 - DNA, 16 bp, Homo sapiens
tatgtatatgtatata

SEQ ID NO: 742702 - DNA, 17 bp, Homo sapiens
tatgtatatgtatatat

SEQ ID NO: 742703 - DNA, 16 bp, Homo sapiens
tatgtatattttaata

SEQ ID NO: 742704 - DNA, 16 bp, Homo sapiens
tatgtatcagaagaga

SEQ ID NO: 742705 - DNA, 17 bp, Homo sapiens
tatgtatgtttacatat

SEQ ID NO: 742706 - DNA, 13 bp, Homo sapiens
tatgtattattta

SEQ ID NO: 742707 - DNA, 21 bp, Homo sapiens
tatgtattatttacatttaat

SEQ ID NO: 742708 - DNA, 15 bp, Homo sapiens
tatgtattcccttgt

SEQ ID NO: 742709 - DNA, 22 bp, Homo sapiens
tatgtattcccttgtattttgt

SEQ ID NO: 742710 - DNA, 19 bp, Homo sapiens
tatgtattctttctgcctt

SEQ ID NO: 742711 - DNA, 18 bp, Homo sapiens
tatgtattgtaaacatgt

SEQ ID NO: 742712 - DNA, 22 bp, Homo sapiens
tatgtatttaccaaaaattttg

SEQ ID NO: 742713 - DNA, 16 bp, Homo sapiens
tatgtatttataattt

SEQ ID NO: 742714 - DNA, 22 bp, Homo sapiens
tatgtatttataatttaaatga

SEQ ID NO: 742715 - DNA, 14 bp, Homo sapiens
tatgtattttccta

SEQ ID NO: 742716 - DNA, 17 bp, Homo sapiens
tatgtcaatttgtatat

SEQ ID NO: 742717 - DNA, 15 bp, Homo sapiens
tatgtcatcatgctt

SEQ ID NO: 742718 - DNA, 15 bp, Homo sapiens
tatgtcatgcctcac

SEQ ID NO: 742719 - DNA, 18 bp, Homo sapiens
tatgtcatttttaatgta

SEQ ID NO: 742720 - DNA, 23 bp, Homo sapiens
tatgtccactgtgtatagaagta

SEQ ID NO: 742721 - DNA, 13 bp, Homo sapiens
tatgtcctaagga

SEQ ID NO: 742722 - DNA, 18 bp, Homo sapiens
tatgtcctgtgagatgtg

SEQ ID NO: 742723 - DNA, 21 bp, Homo sapiens
tatgtcgtgttttcaaggaag

SEQ ID NO: 742724 - DNA, 12 bp, Homo sapiens
tatgtctattta

SEQ ID NO: 742725 - DNA, 13 bp, Homo sapiens
tatgtctatttaa

SEQ ID NO: 742726 - DNA, 17 bp, Homo sapiens
gatcactggagcccagg

SEQ ID NO: 742727 - DNA, 18 bp, Homo sapiens
gatcactggctggcctga

SEQ ID NO: 742728 - DNA, 21 bp, Homo sapiens
gatcactgtagtttagttctg

SEQ ID NO: 742729 - DNA, 22 bp, Homo sapiens
gatcactgtagtttagttctgt

SEQ ID NO: 742730 - DNA, 15 bp, Homo sapiens
gatcacttgttgttt

SEQ ID NO: 742731 - DNA, 17 bp, Homo sapiens
gatcacttgttgtttta

SEQ ID NO: 742732 - DNA, 15 bp, Homo sapiens
gatcagaacagcaga

SEQ ID NO: 742733 - DNA, 14 bp, Homo sapiens
gatcagaagaacat

SEQ ID NO: 742734 - DNA, 19 bp, Homo sapiens
gatcagacatacagctgcc

SEQ ID NO: 742735 - DNA, 15 bp, Homo sapiens
gatcagagcaggacc

SEQ ID NO: 742736 - DNA, 16 bp, Homo sapiens
gatcagaggagtaaat

SEQ ID NO: 742737 - DNA, 19 bp, Homo sapiens
gatcagcaaaccggggcct

SEQ ID NO: 742738 - DNA, 17 bp, Homo sapiens
gatcagcattgtgactt

SEQ ID NO: 742739 - DNA, 14 bp, Homo sapiens
gatcagccattaaa

SEQ ID NO: 742740 - DNA, 16 bp, Homo sapiens
gatcagccattaaaat

SEQ ID NO: 742741 - DNA, 17 bp, Homo sapiens
gatcagccattaaaata

SEQ ID NO: 742742 - DNA, 18 bp, Homo sapiens
gatcagccattaaaataa

SEQ ID NO: 742743 - DNA, 20 bp, Homo sapiens
gatcagccattaaaataaaa

SEQ ID NO: 742744 - DNA, 23 bp, Homo sapiens
gatcagccattaaaataaaacaa

SEQ ID NO: 742745 - DNA, 22 bp, Homo sapiens
gatcagccccaccctggcctag

SEQ ID NO: 742746 - DNA, 19 bp, Homo sapiens
gatcagccccgcctgtcac

SEQ ID NO: 742747 - DNA, 17 bp, Homo sapiens
gatcagccccgctcctc

SEQ ID NO: 742748 - DNA, 12 bp, Homo sapiens
gatcagcctggg

SEQ ID NO: 742749 - DNA, 18 bp, Homo sapiens
gatcagctgtttgtcata

SEQ ID NO: 742750 - DNA, 16 bp, Homo sapiens
gatcaggaaccagggc

SEQ ID NO: 742751 - DNA, 22 bp, Homo sapiens
gatcaggaaccagggcctccct

SEQ ID NO: 742752 - DNA, 23 bp, Homo sapiens
gatcaggaaccagggcctccctg

SEQ ID NO: 742753 - DNA, 22 bp, Homo sapiens
gatcaggagcccccaacacagg

SEQ ID NO: 742754 - DNA, 21 bp, Homo sapiens
gatcaggcacccggggccaga

SEQ ID NO: 742755 - DNA, 19 bp, Homo sapiens
gatcagggaatccagctcc

SEQ ID NO: 742756 - DNA, 23 bp, Homo sapiens
gatcagtgggcctccaaggaggg

SEQ ID NO: 742757 - DNA, 21 bp, Homo sapiens
gatcagttaagaaatttcaca

SEQ ID NO: 742758 - DNA, 19 bp, Homo sapiens
gatcatacagttatgtggg

SEQ ID NO: 742759 - DNA, 15 bp, Homo sapiens
gatcatagctcactg

SEQ ID NO: 742760 - DNA, 17 bp, Homo sapiens
gatcatagctcactgca

SEQ ID NO: 742761 - DNA, 21 bp, Homo sapiens
gatcatagctcactgcagcct

SEQ ID NO: 742762 - DNA, 17 bp, Homo sapiens
gatcataggtatttcaa

SEQ ID NO: 742763 - DNA, 19 bp, Homo sapiens
gatcatatggagctcatgt

SEQ ID NO: 742764 - DNA, 14 bp, Homo sapiens
gatcatgcatagag

SEQ ID NO: 742765 - DNA, 17 bp, Homo sapiens
gatcatgcatagagtgt

SEQ ID NO: 742766 - DNA, 13 bp, Homo sapiens
gatcatgcattgt

SEQ ID NO: 742767 - DNA, 22 bp, Homo sapiens
gatcatgggagcatgcttacct

SEQ ID NO: 742768 - DNA, 13 bp, Homo sapiens
gatcatgtacttt

SEQ ID NO: 742769 - DNA, 18 bp, Homo sapiens
gatcattacatggctgtg

SEQ ID NO: 742770 - DNA, 13 bp, Homo sapiens
gatcattgcattt

SEQ ID NO: 742771 - DNA, 16 bp, Homo sapiens
gatcattgcatttcca

SEQ ID NO: 742772 - DNA, 18 bp, Homo sapiens
gatcattgcatttccaga

SEQ ID NO: 742773 - DNA, 17 bp, Homo sapiens
gatcatttatttcatga

SEQ ID NO: 742774 - DNA, 17 bp, Homo sapiens
gatcatttgagcccagg

SEQ ID NO: 742775 - DNA, 18 bp, Homo sapiens
gatcatttgttggaatga

SEQ ID NO: 742776 - DNA, 23 bp, Homo sapiens
gatcattttcttatcttctgcaa

SEQ ID NO: 742777 - DNA, 14 bp, Homo sapiens
gatcatttttccag

SEQ ID NO: 742778 - DNA, 19 bp, Homo sapiens
gatccaaggccgcggccca

SEQ ID NO: 742779 - DNA, 13 bp, Homo sapiens
gatccacatcctc

SEQ ID NO: 742780 - DNA, 16 bp, Homo sapiens
gatccaccctatccct

SEQ ID NO: 742781 - DNA, 18 bp, Homo sapiens
gatccacctgtctcagcc

SEQ ID NO: 742782 - DNA, 18 bp, Homo sapiens
gatccactcgcctcagcc

SEQ ID NO: 742783 - DNA, 17 bp, Homo sapiens
gatccacttcttggttc

SEQ ID NO: 742784 - DNA, 23 bp, Homo sapiens
gatccacttcttggttcctggga

SEQ ID NO: 742785 - DNA, 16 bp, Homo sapiens
gatccagaagagccca

SEQ ID NO: 742786 - DNA, 16 bp, Homo sapiens
gatccagagagcagct

SEQ ID NO: 742787 - DNA, 14 bp, Homo sapiens
gatccagagcacag

SEQ ID NO: 742788 - DNA, 18 bp, Homo sapiens
tatgttgcctttatggtt

SEQ ID NO: 742789 - DNA, 17 bp, Homo sapiens
tatgttgctcagtctcc

SEQ ID NO: 742790 - DNA, 14 bp, Homo sapiens
tatgttgtaataaa

SEQ ID NO: 742791 - DNA, 15 bp, Homo sapiens
tatgttgtacatact

SEQ ID NO: 742792 - DNA, 12 bp, Homo sapiens
tatgttgtcata

SEQ ID NO: 742793 - DNA, 13 bp, Homo sapiens
tatgttgtcataa

SEQ ID NO: 742794 - DNA, 14 bp, Homo sapiens
tatgttgtcataac

SEQ ID NO: 742795 - DNA, 19 bp, Homo sapiens
tatgttgtcataacattta

SEQ ID NO: 742796 - DNA, 16 bp, Homo sapiens
tatgttgtttacctga

SEQ ID NO: 742797 - DNA, 16 bp, Homo sapiens
tatgtttaaaagaaat

SEQ ID NO: 742798 - DNA, 23 bp, Homo sapiens
tatgtttccccatctctgtctgg

SEQ ID NO: 742799 - DNA, 24 bp, Homo sapiens
tatgtttccccatctctgtctggg

SEQ ID NO: 742800 - DNA, 12 bp, Homo sapiens
tatgtttcttct

SEQ ID NO: 742801 - DNA, 22 bp, Homo sapiens
tatgtttgccactttgcaaagg

SEQ ID NO: 742802 - DNA, 19 bp, Homo sapiens
tatgtttgctgattattta

SEQ ID NO: 742803 - DNA, 14 bp, Homo sapiens
tatgtttgtgcctt

SEQ ID NO: 742804 - DNA, 14 bp, Homo sapiens
tatgttttagcatg

SEQ ID NO: 742805 - DNA, 15 bp, Homo sapiens
tatgttttgtttctg

SEQ ID NO: 742806 - DNA, 20 bp, Homo sapiens
tatgtttttacattatgcaa

SEQ ID NO: 742807 - DNA, 21 bp, Homo sapiens
tatgtttttacattatgcaaa

SEQ ID NO: 742808 - DNA, 17 bp, Homo sapiens
tatgtttttatttatga

SEQ ID NO: 742809 - DNA, 22 bp, Homo sapiens
tatgtttttctgtgtgtcagtt

SEQ ID NO: 742810 - DNA, 16 bp, Homo sapiens
tatgtttttgaaggca

SEQ ID NO: 742811 - DNA, 21 bp, Homo sapiens
tatgtttttgactcttttgag

SEQ ID NO: 742812 - DNA, 18 bp, Homo sapiens
tattaaaaaaactggcct

SEQ ID NO: 742813 - DNA, 13 bp, Homo sapiens
tattaaaaaacaa

SEQ ID NO: 742814 - DNA, 23 bp, Homo sapiens
tattaaaaaagagacatccaaat

SEQ ID NO: 742815 - DNA, 15 bp, Homo sapiens
tattaaaaatataaa

SEQ ID NO: 742816 - DNA, 20 bp, Homo sapiens
tattaaaaatatggaacttc

SEQ ID NO: 742817 - DNA, 22 bp, Homo sapiens
tattaaaaatatggaacttcta

SEQ ID NO: 742818 - DNA, 20 bp, Homo sapiens
tattaaaaatctcaaatttc

SEQ ID NO: 742819 - DNA, 22 bp, Homo sapiens
tattaaaaatctcaaatttcta

SEQ ID NO: 742820 - DNA, 14 bp, Homo sapiens
tattaaaaatgttc

SEQ ID NO: 742821 - DNA, 22 bp, Homo sapiens
tattaaaatagcatactgtgta

SEQ ID NO: 742822 - DNA, 15 bp, Homo sapiens
tattaaaatattttg

SEQ ID NO: 742823 - DNA, 17 bp, Homo sapiens
tattaaaatgattgtaa

SEQ ID NO: 742824 - DNA, 19 bp, Homo sapiens
tattaaaatgattgtaaaa

SEQ ID NO: 742825 - DNA, 20 bp, Homo sapiens
tattaaaatgattgtaaaat

SEQ ID NO: 742826 - DNA, 22 bp, Homo sapiens
tattaaaatgattgtaaaatag

SEQ ID NO: 742827 - DNA, 14 bp, Homo sapiens
tattaaaattctga

SEQ ID NO: 742828 - DNA, 15 bp, Homo sapiens
tattaaaattctgaa

SEQ ID NO: 742829 - DNA, 19 bp, Homo sapiens
tattaaaattctgaatttt

SEQ ID NO: 742830 - DNA, 13 bp, Homo sapiens
tattaaacaaagt

SEQ ID NO: 742831 - DNA, 23 bp, Homo sapiens
tattaaacagatttttacaaatg

SEQ ID NO: 742832 - DNA, 20 bp, Homo sapiens
tattaaacgtatgcatgtga

SEQ ID NO: 742833 - DNA, 21 bp, Homo sapiens
tattaaacgtatgcatgtgaa

SEQ ID NO: 742834 - DNA, 15 bp, Homo sapiens
tattaaacgtgtaaa

SEQ ID NO: 742835 - DNA, 16 bp, Homo sapiens
tattaaacgtgtaaat

SEQ ID NO: 742836 - DNA, 13 bp, Homo sapiens
tattaaagggggg

SEQ ID NO: 742837 - DNA, 12 bp, Homo sapiens
tattaaagtgac

SEQ ID NO: 742838 - DNA, 19 bp, Homo sapiens
tattaaatacaaaacttcc

SEQ ID NO: 742839 - DNA, 12 bp, Homo sapiens
tattaaatacag

SEQ ID NO: 742840 - DNA, 13 bp, Homo sapiens
tattaaatacaga

SEQ ID NO: 742841 - DNA, 21 bp, Homo sapiens
tattaaatacagacactaagt

SEQ ID NO: 742842 - DNA, 19 bp, Homo sapiens
tattaaatggtttttaaat

SEQ ID NO: 742843 - DNA, 20 bp, Homo sapiens
tattaacaattaattgtctt

SEQ ID NO: 742844 - DNA, 13 bp, Homo sapiens
tattaaccttttt

SEQ ID NO: 742845 - DNA, 19 bp, Homo sapiens
tattaaccttttttgtctt

SEQ ID NO: 742846 - DNA, 15 bp, Homo sapiens
tattaacgatgtcca

SEQ ID NO: 742847 - DNA, 22 bp, Homo sapiens
gatccttctgagctccacctct

SEQ ID NO: 742848 - DNA, 22 bp, Homo sapiens
gatccttgtctttactgacaag

SEQ ID NO: 742849 - DNA, 16 bp, Homo sapiens
gatccttttttgtcat

SEQ ID NO: 742850 - DNA, 21 bp, Homo sapiens
gatccttttttgtcattttat

SEQ ID NO: 742851 - DNA, 19 bp, Homo sapiens
gatcgagaccatcctggct

SEQ ID NO: 742852 - DNA, 13 bp, Homo sapiens
gatcgcagtttgc

SEQ ID NO: 742853 - DNA, 17 bp, Homo sapiens
gatcgcttgagcccagg

SEQ ID NO: 742854 - DNA, 18 bp, Homo sapiens
gatcgcttgagcccagga

SEQ ID NO: 742855 - DNA, 15 bp, Homo sapiens
gatcggactctgccc

SEQ ID NO: 742856 - DNA, 22 bp, Homo sapiens
gatcggccatcaagggaagaac

SEQ ID NO: 742857 - DNA, 20 bp, Homo sapiens
gatcggtttcatattttaaa

SEQ ID NO: 742858 - DNA, 23 bp, Homo sapiens
gatcgtgcatttgaggggccagg

SEQ ID NO: 742859 - DNA, 17 bp, Homo sapiens
gatctaagcctttccat

SEQ ID NO: 742860 - DNA, 23 bp, Homo sapiens
gatctaaggatgtcacagggcca

SEQ ID NO: 742861 - DNA, 22 bp, Homo sapiens
gatctaagggaagatcactgta

SEQ ID NO: 742862 - DNA, 13 bp, Homo sapiens
gatctaatgtgaa

SEQ ID NO: 742863 - DNA, 18 bp, Homo sapiens
gatctaccccagggagaa

SEQ ID NO: 742864 - DNA, 17 bp, Homo sapiens
gatctacttcatagctc

SEQ ID NO: 742865 - DNA, 20 bp, Homo sapiens
gatctacttctgtaattgtg

SEQ ID NO: 742866 - DNA, 21 bp, Homo sapiens
gatctacttgcctcatttccc

SEQ ID NO: 742867 - DNA, 16 bp, Homo sapiens
gatctagaatgtgttt

SEQ ID NO: 742868 - DNA, 20 bp, Homo sapiens
gatctagaatgtgttttctg

SEQ ID NO: 742869 - DNA, 21 bp, Homo sapiens
gatctagaatgtgttttctga

SEQ ID NO: 742870 - DNA, 22 bp, Homo sapiens
gatctagaatgtgttttctgaa

SEQ ID NO: 742871 - DNA, 22 bp, Homo sapiens
gatctagcactcctcaagactt

SEQ ID NO: 742872 - DNA, 15 bp, Homo sapiens
gatctaggagaggag

SEQ ID NO: 742873 - DNA, 19 bp, Homo sapiens
gatctcagggcagacagcc

SEQ ID NO: 742874 - DNA, 17 bp, Homo sapiens
gatctcattcagtatta

SEQ ID NO: 742875 - DNA, 17 bp, Homo sapiens
gatctccaattgcctct

SEQ ID NO: 742876 - DNA, 17 bp, Homo sapiens
gatctccatatgttaca

SEQ ID NO: 742877 - DNA, 20 bp, Homo sapiens
gatctcctgtttttttcagg

SEQ ID NO: 742878 - DNA, 20 bp, Homo sapiens
gatctcggtttgccaaaatt

SEQ ID NO: 742879 - DNA, 15 bp, Homo sapiens
gatctctaacttcac

SEQ ID NO: 742880 - DNA, 14 bp, Homo sapiens
gatctctcaggagc

SEQ ID NO: 742881 - DNA, 16 bp, Homo sapiens
gatctctcaggagcac

SEQ ID NO: 742882 - DNA, 18 bp, Homo sapiens
gatctctcaggagcacag

SEQ ID NO: 742883 - DNA, 23 bp, Homo sapiens
gatctctcaggagcacaggcagc

SEQ ID NO: 742884 - DNA, 22 bp, Homo sapiens
gatctctgggatttatgctcat

SEQ ID NO: 742885 - DNA, 15 bp, Homo sapiens
gatctctgtcacatc

SEQ ID NO: 742886 - DNA, 14 bp, Homo sapiens
gatctcttcctgtt

SEQ ID NO: 742887 - DNA, 20 bp, Homo sapiens
gatctctttctaaagacagg

SEQ ID NO: 742888 - DNA, 21 bp, Homo sapiens
gatctctttttatttaaatgt

SEQ ID NO: 742889 - DNA, 22 bp, Homo sapiens
gatctgaacccagctgtgcccc

SEQ ID NO: 742890 - DNA, 14 bp, Homo sapiens
gatctgaccctccc

SEQ ID NO: 742891 - DNA, 16 bp, Homo sapiens
gatctgaccctcccag

SEQ ID NO: 742892 - DNA, 15 bp, Homo sapiens
gatctgagtcccagg

SEQ ID NO: 742893 - DNA, 19 bp, Homo sapiens
gatctgatccccaagacat

SEQ ID NO: 742894 - DNA, 18 bp, Homo sapiens
gatctgatggtgagctgg

SEQ ID NO: 742895 - DNA, 20 bp, Homo sapiens
gatctgatggtgagctggga

SEQ ID NO: 742896 - DNA, 18 bp, Homo sapiens
gatctgcatatttctgta

SEQ ID NO: 742897 - DNA, 11 bp, Homo sapiens
gatctgcctgg

SEQ ID NO: 742898 - DNA, 20 bp, Homo sapiens
gatctgcctgggcctgtgca

SEQ ID NO: 742899 - DNA, 22 bp, Homo sapiens
gatctgcctgggcctgtgcagc

SEQ ID NO: 742900 - DNA, 17 bp, Homo sapiens
gatctgcggatctcagc

SEQ ID NO: 742901 - DNA, 15 bp, Homo sapiens
gatctgctagtgctg

SEQ ID NO: 742902 - DNA, 18 bp, Homo sapiens
gatctgctagtgctgtaa

SEQ ID NO: 742903 - DNA, 17 bp, Homo sapiens
gatctgctgaggcccag

SEQ ID NO: 742904 - DNA, 17 bp, Homo sapiens
gatctgggaccctttcc

SEQ ID NO: 742905 - DNA, 23 bp, Homo sapiens
gatctgggaccctttccttcctt

SEQ ID NO: 742906 - DNA, 18 bp, Homo sapiens
gatctgggcattttcctc

SEQ ID NO: 742907 - DNA, 21 bp, Homo sapiens
gatctgggcattttcctcctc

SEQ ID NO: 742908 - DNA, 22 bp, Homo sapiens
gatctgggcattttcctcctct

SEQ ID NO: 742909 - DNA, 23 bp, Homo sapiens
gatctgggcattttcctcctctg

SEQ ID NO: 742910 - DNA, 17 bp, Homo sapiens
gatctggggctctggga

SEQ ID NO: 742911 - DNA, 20 bp, Homo sapiens
gatctggggggtggggagga

SEQ ID NO: 742912 - DNA, 21 bp, Homo sapiens
gatctgggttaggtggccgct

SEQ ID NO: 742913 - DNA, 15 bp, Homo sapiens
tattactgatttaga

SEQ ID NO: 742914 - DNA, 19 bp, Homo sapiens
tattactgctgctgtgctt

SEQ ID NO: 742915 - DNA, 16 bp, Homo sapiens
tattactgttgcattt

SEQ ID NO: 742916 - DNA, 19 bp, Homo sapiens
tattactgttgcatttact

SEQ ID NO: 742917 - DNA, 18 bp, Homo sapiens
tattacttccatgaattt

SEQ ID NO: 742918 - DNA, 17 bp, Homo sapiens
tattacttgtgcactta

SEQ ID NO: 742919 - DNA, 15 bp, Homo sapiens
tattactttctgccg

SEQ ID NO: 742920 - DNA, 16 bp, Homo sapiens
tattacttttctgttt

SEQ ID NO: 742921 - DNA, 16 bp, Homo sapiens
tattacttttgtaaat

SEQ ID NO: 742922 - DNA, 23 bp, Homo sapiens
tattagaacattcacttttgtta

SEQ ID NO: 742923 - DNA, 17 bp, Homo sapiens
tattagaatcaaacatt

SEQ ID NO: 742924 - DNA, 16 bp, Homo sapiens
tattagactttagaaa

SEQ ID NO: 742925 - DNA, 17 bp, Homo sapiens
tattagataatattttt

SEQ ID NO: 742926 - DNA, 22 bp, Homo sapiens
tattagatcaaatagttgcata

SEQ ID NO: 742927 - DNA, 23 bp, Homo sapiens
tattagccacaaaattgggaaag

SEQ ID NO: 742928 - DNA, 17 bp, Homo sapiens
tattagccctgcatttt

SEQ ID NO: 742929 - DNA, 15 bp, Homo sapiens
tattagcggctcctc

SEQ ID NO: 742930 - DNA, 15 bp, Homo sapiens
tattagctgaaacaa

SEQ ID NO: 742931 - DNA, 14 bp, Homo sapiens
tattagctttactg

SEQ ID NO: 742932 - DNA, 16 bp, Homo sapiens
tattaggataatacat

SEQ ID NO: 742933 - DNA, 14 bp, Homo sapiens
tattagtgaagatg

SEQ ID NO: 742934 - DNA, 22 bp, Homo sapiens
tattagtggtttatcagcaaaa

SEQ ID NO: 742935 - DNA, 17 bp, Homo sapiens
tattagttaaaacacat

SEQ ID NO: 742936 - DNA, 20 bp, Homo sapiens
tattataaactataaactta

SEQ ID NO: 742937 - DNA, 18 bp, Homo sapiens
tattataagtcttacata

SEQ ID NO: 742938 - DNA, 21 bp, Homo sapiens
tattataataagcaaaaagat

SEQ ID NO: 742939 - DNA, 15 bp, Homo sapiens
tattataatcaaagc

SEQ ID NO: 742940 - DNA, 19 bp, Homo sapiens
tattatacaggaaagcaat

SEQ ID NO: 742941 - DNA, 20 bp, Homo sapiens
tattatacagtaataggagt

SEQ ID NO: 742942 - DNA, 12 bp, Homo sapiens
tattataccttt

SEQ ID NO: 742943 - DNA, 14 bp, Homo sapiens
tattatagaaaatt

SEQ ID NO: 742944 - DNA, 21 bp, Homo sapiens
tattatagcaactttaagaag

SEQ ID NO: 742945 - DNA, 15 bp, Homo sapiens
tattatataaacttt

SEQ ID NO: 742946 - DNA, 13 bp, Homo sapiens
tattatatacata

SEQ ID NO: 742947 - DNA, 17 bp, Homo sapiens
tattatatatttacaga

SEQ ID NO: 742948 - DNA, 16 bp, Homo sapiens
tattatcatgcaaatg

SEQ ID NO: 742949 - DNA, 23 bp, Homo sapiens
tattatccaattcaaaaataaat

SEQ ID NO: 742950 - DNA, 15 bp, Homo sapiens
tattatcgctttatg

SEQ ID NO: 742951 - DNA, 14 bp, Homo sapiens
tattatctaaatga

SEQ ID NO: 742952 - DNA, 17 bp, Homo sapiens
tattatctatggaaatg

SEQ ID NO: 742953 - DNA, 20 bp, Homo sapiens
tattatgaggctattaaaag

SEQ ID NO: 742954 - DNA, 13 bp, Homo sapiens
tattatgcataaa

SEQ ID NO: 742955 - DNA, 16 bp, Homo sapiens
tattatggaaaactgt

SEQ ID NO: 742956 - DNA, 15 bp, Homo sapiens
tattatggcaagtga

SEQ ID NO: 742957 - DNA, 20 bp, Homo sapiens
tattatgtaacatccagaag

SEQ ID NO: 742958 - DNA, 21 bp, Homo sapiens
tattatgtcctgtgagatgtg

SEQ ID NO: 742959 - DNA, 14 bp, Homo sapiens
tattatgtcttctt

SEQ ID NO: 742960 - DNA, 12 bp, Homo sapiens
tattatgtttaa

SEQ ID NO: 742961 - DNA, 20 bp, Homo sapiens
tattatgtttattacaattt

SEQ ID NO: 742962 - DNA, 14 bp, Homo sapiens
tattattaaagaaa

SEQ ID NO: 742963 - DNA, 17 bp, Homo sapiens
tattattaacataccta

SEQ ID NO: 742964 - DNA, 19 bp, Homo sapiens
tattattaatttattgggg

SEQ ID NO: 742965 - DNA, 20 bp, Homo sapiens
tattattactctacactgaa

SEQ ID NO: 742966 - DNA, 19 bp, Homo sapiens
tattattacttatttttga

SEQ ID NO: 742967 - DNA, 17 bp, Homo sapiens
tattattagataatatt

SEQ ID NO: 742968 - DNA, 18 bp, Homo sapiens
gatgaagggcgagtgaat

SEQ ID NO: 742969 - DNA, 15 bp, Homo sapiens
gatgaagtatacttt

SEQ ID NO: 742970 - DNA, 22 bp, Homo sapiens
gatgaagttttacattgttgag

SEQ ID NO: 742971 - DNA, 23 bp, Homo sapiens
gatgaagttttacattgttgagc

SEQ ID NO: 742972 - DNA, 19 bp, Homo sapiens
gatgaatctcccactccag

SEQ ID NO: 742973 - DNA, 15 bp, Homo sapiens
gatgaatgataaact

SEQ ID NO: 742974 - DNA, 16 bp, Homo sapiens
gatgaatgtactatgt

SEQ ID NO: 742975 - DNA, 14 bp, Homo sapiens
gatgaatttgtcca

SEQ ID NO: 742976 - DNA, 15 bp, Homo sapiens
gatgacaccctggcc

SEQ ID NO: 742977 - DNA, 17 bp, Homo sapiens
gatgacaccctggcctg

SEQ ID NO: 742978 - DNA, 18 bp, Homo sapiens
gatgacaccctggcctga

SEQ ID NO: 742979 - DNA, 21 bp, Homo sapiens
gatgacacgcgctctccacca

SEQ ID NO: 742980 - DNA, 14 bp, Homo sapiens
gatgacagagcgag

SEQ ID NO: 742981 - DNA, 20 bp, Homo sapiens
gatgacaggcgcctgccatc

SEQ ID NO: 742982 - DNA, 21 bp, Homo sapiens
gatgacaggtgtgagccactg

SEQ ID NO: 742983 - DNA, 14 bp, Homo sapiens
gatgacatttcgtt

SEQ ID NO: 742984 - DNA, 18 bp, Homo sapiens
gatgaccaaaccagcctt

SEQ ID NO: 742985 - DNA, 17 bp, Homo sapiens
gatgaccacgcacctcc

SEQ ID NO: 742986 - DNA, 13 bp, Homo sapiens
gatgaccagaaca

SEQ ID NO: 742987 - DNA, 14 bp, Homo sapiens
gatgaccagggatg

SEQ ID NO: 742988 - DNA, 11 bp, Homo sapiens
gatgaccccta

SEQ ID NO: 742989 - DNA, 18 bp, Homo sapiens
gatgacccctaccccctc

SEQ ID NO: 742990 - DNA, 15 bp, Homo sapiens
gatgacccttttcat

SEQ ID NO: 742991 - DNA, 14 bp, Homo sapiens
gatgaccgtgtaca

SEQ ID NO: 742992 - DNA, 15 bp, Homo sapiens
gatgacctggataac

SEQ ID NO: 742993 - DNA, 19 bp, Homo sapiens
gatgacctttttgcagtgt

SEQ ID NO: 742994 - DNA, 15 bp, Homo sapiens
gatgactcaaggcca

SEQ ID NO: 742995 - DNA, 14 bp, Homo sapiens
gatgactgagtcct

SEQ ID NO: 742996 - DNA, 22 bp, Homo sapiens
gatgacttggtggcttttcctt

SEQ ID NO: 742997 - DNA, 13 bp, Homo sapiens
gatgagaaagctt

SEQ ID NO: 742998 - DNA, 23 bp, Homo sapiens
gatgagaaagcttttattccttt

SEQ ID NO: 742999 - DNA, 14 bp, Homo sapiens
gatgagaacaaagc

SEQ ID NO: 743000 - DNA, 15 bp, Homo sapiens
gatgagaacaaagct

SEQ ID NO: 743001 - DNA, 22 bp, Homo sapiens
gatgagaacaaagctgttaaac

SEQ ID NO: 743002 - DNA, 20 bp, Homo sapiens
gatgagaatgtgacctttaa

SEQ ID NO: 743003 - DNA, 15 bp, Homo sapiens
gatgagatccgggag

SEQ ID NO: 743004 - DNA, 16 bp, Homo sapiens
gatgagatttgccagc

SEQ ID NO: 743005 - DNA, 21 bp, Homo sapiens
gatgagatttgccagcacagg

SEQ ID NO: 743006 - DNA, 20 bp, Homo sapiens
gatgagcacatctctctgcc

SEQ ID NO: 743007 - DNA, 20 bp, Homo sapiens
gatgagcagaccagctttga

SEQ ID NO: 743008 - DNA, 19 bp, Homo sapiens
gatgagcagagggaggaag

SEQ ID NO: 743009 - DNA, 13 bp, Homo sapiens
gatgagccgctgt

SEQ ID NO: 743010 - DNA, 23 bp, Homo sapiens
gatgagccgctgtgagcccctgg

SEQ ID NO: 743011 - DNA, 22 bp, Homo sapiens
gatgagccttcgtgccccccct

SEQ ID NO: 743012 - DNA, 15 bp, Homo sapiens
gatgagcgccacctc

SEQ ID NO: 743013 - DNA, 16 bp, Homo sapiens
gatgagcgccacctct

SEQ ID NO: 743014 - DNA, 13 bp, Homo sapiens
gatgaggccagac

SEQ ID NO: 743015 - DNA, 15 bp, Homo sapiens
gatgaggccagacca

SEQ ID NO: 743016 - DNA, 21 bp, Homo sapiens
gatgaggccgctagaggcctg

SEQ ID NO: 743017 - DNA, 14 bp, Homo sapiens
gatgaggcctcttg

SEQ ID NO: 743018 - DNA, 17 bp, Homo sapiens
gatgaggctggtgacgt

SEQ ID NO: 743019 - DNA, 18 bp, Homo sapiens
gatgagggatgggcctgg

SEQ ID NO: 743020 - DNA, 15 bp, Homo sapiens
gatgagggcatgtgc

SEQ ID NO: 743021 - DNA, 16 bp, Homo sapiens
gatgagtgagcatgcc

SEQ ID NO: 743022 - DNA, 16 bp, Homo sapiens
gatgagttgcagtttt

SEQ ID NO: 743023 - DNA, 14 bp, Homo sapiens
gatgagtttctggg

SEQ ID NO: 743024 - DNA, 18 bp, Homo sapiens
gatgataaatatggttaa

SEQ ID NO: 743025 - DNA, 23 bp, Homo sapiens
gatgatagtccaatttttactca

SEQ ID NO: 743026 - DNA, 21 bp, Homo sapiens
gatgatcccagtcactcctct

SEQ ID NO: 743027 - DNA, 13 bp, Homo sapiens
gatgatcctaggc

SEQ ID NO: 743028 - DNA, 22 bp, Homo sapiens
gatgatctctccacggtagcac

SEQ ID NO: 743029 - DNA, 23 bp, Homo sapiens
gatgatgacgacgacaacgatga

SEQ ID NO: 743030 - DNA, 14 bp, Homo sapiens
gatgatgatgaaaa

SEQ ID NO: 743031 - DNA, 17 bp, Homo sapiens
gatgatgatgatgatga

SEQ ID NO: 743032 - DNA, 12 bp, Homo sapiens
gatgatgctgtg

SEQ ID NO: 743033 - DNA, 17 bp, Homo sapiens
gatgatggcagagccag

SEQ ID NO: 743034 - DNA, 17 bp, Homo sapiens
gatgatggccatttcta

SEQ ID NO: 743035 - DNA, 22 bp, Homo sapiens
gatgatggttgcaaaagactaa

SEQ ID NO: 743036 - DNA, 20 bp, Homo sapiens
gatgatgtctcttgtagaag

SEQ ID NO: 743037 - DNA, 22 bp, Homo sapiens
gatgattcttaacacagccttc

SEQ ID NO: 743038 - DNA, 17 bp, Homo sapiens
gatgatttcatcttctg

SEQ ID NO: 743039 - DNA, 15 bp, Homo sapiens
gatgatttgggggag

SEQ ID NO: 743040 - DNA, 20 bp, Homo sapiens
tattccaaggaaaattgaaa

SEQ ID NO: 743041 - DNA, 14 bp, Homo sapiens
tattccaagtgcat

SEQ ID NO: 743042 - DNA, 17 bp, Homo sapiens
tattccaccattcacat

SEQ ID NO: 743043 - DNA, 14 bp, Homo sapiens
tattccaccttaaa

SEQ ID NO: 743044 - DNA, 14 bp, Homo sapiens
tattccaggagaag

SEQ ID NO: 743045 - DNA, 22 bp, Homo sapiens
tattccatgaatgtatcaggaa

SEQ ID NO: 743046 - DNA, 23 bp, Homo sapiens
tattccatgaatgtatcaggaaa

SEQ ID NO: 743047 - DNA, 18 bp, Homo sapiens
tattccatgtataagtgt

SEQ ID NO: 743048 - DNA, 22 bp, Homo sapiens
tattcccaagcccatgagtcct

SEQ ID NO: 743049 - DNA, 23 bp, Homo sapiens
tattcccaagctctagtgggaag

SEQ ID NO: 743050 - DNA, 18 bp, Homo sapiens
tattcccaagtatgcctt

SEQ ID NO: 743051 - DNA, 19 bp, Homo sapiens
tattcccactcaccagccc

SEQ ID NO: 743052 - DNA, 20 bp, Homo sapiens
tattcccactcaccagccct

SEQ ID NO: 743053 - DNA, 14 bp, Homo sapiens
tattcccattgtga

SEQ ID NO: 743054 - DNA, 18 bp, Homo sapiens
tattccccatttcctgta

SEQ ID NO: 743055 - DNA, 21 bp, Homo sapiens
tattccccatttcctgtacaa

SEQ ID NO: 743056 - DNA, 15 bp, Homo sapiens
tattcccttgtattt

SEQ ID NO: 743057 - DNA, 20 bp, Homo sapiens
tattccctttgacttcagct

SEQ ID NO: 743058 - DNA, 17 bp, Homo sapiens
tattccgagcattccag

SEQ ID NO: 743059 - DNA, 19 bp, Homo sapiens
tattcctagtctttccagt

SEQ ID NO: 743060 - DNA, 14 bp, Homo sapiens
tattcctattgtgc

SEQ ID NO: 743061 - DNA, 22 bp, Homo sapiens
tattcctgacctccgccatcca

SEQ ID NO: 743062 - DNA, 17 bp, Homo sapiens
tattcctgcatttgtga

SEQ ID NO: 743063 - DNA, 22 bp, Homo sapiens
tattccttgatactaaaagttc

SEQ ID NO: 743064 - DNA, 16 bp, Homo sapiens
tattcctttcccttcc

SEQ ID NO: 743065 - DNA, 17 bp, Homo sapiens
tattcctttcccttcct

SEQ ID NO: 743066 - DNA, 17 bp, Homo sapiens
tattcctttgaatattt

SEQ ID NO: 743067 - DNA, 16 bp, Homo sapiens
tattcggcatttaact

SEQ ID NO: 743068 - DNA, 15 bp, Homo sapiens
tattctaaagttttg

SEQ ID NO: 743069 - DNA, 18 bp, Homo sapiens
tattctaaagttttgcaa

SEQ ID NO: 743070 - DNA, 22 bp, Homo sapiens
tattctaagccagttttcattt

SEQ ID NO: 743071 - DNA, 16 bp, Homo sapiens
tattctaataaatata

SEQ ID NO: 743072 - DNA, 15 bp, Homo sapiens
tattctactgtactt

SEQ ID NO: 743073 - DNA, 16 bp, Homo sapiens
tattctactgtacttt

SEQ ID NO: 743074 - DNA, 22 bp, Homo sapiens
tattctatccatctcctggtgt

SEQ ID NO: 743075 - DNA, 16 bp, Homo sapiens
tattctatgagaacaa

SEQ ID NO: 743076 - DNA, 13 bp, Homo sapiens
tattctattaact

SEQ ID NO: 743077 - DNA, 19 bp, Homo sapiens
tattctattaactttaatt

SEQ ID NO: 743078 - DNA, 20 bp, Homo sapiens
tattctattacattttcagt

SEQ ID NO: 743079 - DNA, 11 bp, Homo sapiens
tattctattct

SEQ ID NO: 743080 - DNA, 16 bp, Homo sapiens
tattctattgtattat

SEQ ID NO: 743081 - DNA, 13 bp, Homo sapiens
tattctcaaagat

SEQ ID NO: 743082 - DNA, 16 bp, Homo sapiens
tattctcaaagatgca

SEQ ID NO: 743083 - DNA, 14 bp, Homo sapiens
tattctcaaagcag

SEQ ID NO: 743084 - DNA, 21 bp, Homo sapiens
tattctcggctcaggttttga

SEQ ID NO: 743085 - DNA, 22 bp, Homo sapiens
tattctctcacagtgtactcta

SEQ ID NO: 743086 - DNA, 17 bp, Homo sapiens
tattctctcctgtacct

SEQ ID NO: 743087 - DNA, 18 bp, Homo sapiens
tattctctcctgtacctc

SEQ ID NO: 743088 - DNA, 20 bp, Homo sapiens
tattctctcctgtacctctt

SEQ ID NO: 743089 - DNA, 24 bp, Homo sapiens
tattctctcctgtacctcttgagc

SEQ ID NO: 743090 - DNA, 15 bp, Homo sapiens
gatgccccttctccc

SEQ ID NO: 743091 - DNA, 12 bp, Homo sapiens
gatgccctggag

SEQ ID NO: 743092 - DNA, 16 bp, Homo sapiens
gatgccgggcgccagg

SEQ ID NO: 743093 - DNA, 17 bp, Homo sapiens
gatgccgtcctgctgga

SEQ ID NO: 743094 - DNA, 22 bp, Homo sapiens
gatgcctaaaaattcccttcct

SEQ ID NO: 743095 - DNA, 11 bp, Homo sapiens
gatgcctcacc

SEQ ID NO: 743096 - DNA, 14 bp, Homo sapiens
gatgcctgaacttg

SEQ ID NO: 743097 - DNA, 21 bp, Homo sapiens
gatgcctgattcggacggcca

SEQ ID NO: 743098 - DNA, 13 bp, Homo sapiens
gatgcctgcttga

SEQ ID NO: 743099 - DNA, 14 bp, Homo sapiens
gatgcctttgctgt

SEQ ID NO: 743100 - DNA, 22 bp, Homo sapiens
gatgccttttttgtagtttttt

SEQ ID NO: 743101 - DNA, 13 bp, Homo sapiens
gatgcggccaaga

SEQ ID NO: 743102 - DNA, 22 bp, Homo sapiens
gatgcggctttctctgcctctg

SEQ ID NO: 743103 - DNA, 13 bp, Homo sapiens
gatgcggggacag

SEQ ID NO: 743104 - DNA, 17 bp, Homo sapiens
gatgcgtattctgtggc

SEQ ID NO: 743105 - DNA, 18 bp, Homo sapiens
gatgcgtattctgtggcc

SEQ ID NO: 743106 - DNA, 18 bp, Homo sapiens
gatgcgttgttacaggaa

SEQ ID NO: 743107 - DNA, 19 bp, Homo sapiens
gatgcgtttgcctcctgga

SEQ ID NO: 743108 - DNA, 18 bp, Homo sapiens
gatgctatggtcaggtta

SEQ ID NO: 743109 - DNA, 15 bp, Homo sapiens
gatgctatttatgca

SEQ ID NO: 743110 - DNA, 23 bp, Homo sapiens
gatgctatttatgcaagttaggg

SEQ ID NO: 743111 - DNA, 20 bp, Homo sapiens
gatgctcaaaatctttccaa

SEQ ID NO: 743112 - DNA, 14 bp, Homo sapiens
gatgctcacagggc

SEQ ID NO: 743113 - DNA, 12 bp, Homo sapiens
gatgctccagcc

SEQ ID NO: 743114 - DNA, 16 bp, Homo sapiens
gatgctccagccaacc

SEQ ID NO: 743115 - DNA, 23 bp, Homo sapiens
gatgctccagccaacccctgtgg

SEQ ID NO: 743116 - DNA, 15 bp, Homo sapiens
gatgctccagggcag

SEQ ID NO: 743117 - DNA, 21 bp, Homo sapiens
gatgctccctcccctgccctg

SEQ ID NO: 743118 - DNA, 23 bp, Homo sapiens
gatgctccctcccctgccctggt

SEQ ID NO: 743119 - DNA, 20 bp, Homo sapiens
gatgctgacattcacctgcc

SEQ ID NO: 743120 - DNA, 21 bp, Homo sapiens
gatgctgacattcacctgccc

SEQ ID NO: 743121 - DNA, 15 bp, Homo sapiens
gatgctgacccagga

SEQ ID NO: 743122 - DNA, 11 bp, Homo sapiens
gatgctgctga

SEQ ID NO: 743123 - DNA, 12 bp, Homo sapiens
gatgctgctttc

SEQ ID NO: 743124 - DNA, 15 bp, Homo sapiens
gatgctggagaggtt

SEQ ID NO: 743125 - DNA, 13 bp, Homo sapiens
gatgctgggaccc

SEQ ID NO: 743126 - DNA, 11 bp, Homo sapiens
gatgctgggct

SEQ ID NO: 743127 - DNA, 15 bp, Homo sapiens
gatgctgggctgggc

SEQ ID NO: 743128 - DNA, 19 bp, Homo sapiens
gatgctgggttggtgcaca

SEQ ID NO: 743129 - DNA, 16 bp, Homo sapiens
gatgctggtggctggt

SEQ ID NO: 743130 - DNA, 18 bp, Homo sapiens
gatgctggtggctggtga

SEQ ID NO: 743131 - DNA, 13 bp, Homo sapiens
gatgctgtatttg

SEQ ID NO: 743132 - DNA, 21 bp, Homo sapiens
gatgctgtcactggcagagca

SEQ ID NO: 743133 - DNA, 22 bp, Homo sapiens
gatgctgtgacaataagtttga

SEQ ID NO: 743134 - DNA, 20 bp, Homo sapiens
gatgcttgcggcaaaaggaa

SEQ ID NO: 743135 - DNA, 18 bp, Homo sapiens
gatgcttgtaacaagaaa

SEQ ID NO: 743136 - DNA, 21 bp, Homo sapiens
gatgcttgtaacaagaaaaca

SEQ ID NO: 743137 - DNA, 16 bp, Homo sapiens
gatgcttttctgtctc

SEQ ID NO: 743138 - DNA, 11 bp, Homo sapiens
gatgcttttgc

SEQ ID NO: 743139 - DNA, 14 bp, Homo sapiens
gatgcttttgctgc

SEQ ID NO: 743140 - DNA, 18 bp, Homo sapiens
gatgcttttgctgctgct

SEQ ID NO: 743141 - DNA, 16 bp, Homo sapiens
gatgcttttgtctaat

SEQ ID NO: 743142 - DNA, 17 bp, Homo sapiens
gatggaaaaggaagact

SEQ ID NO: 743143 - DNA, 18 bp, Homo sapiens
gatggaaaagtgtccttc

SEQ ID NO: 743144 - DNA, 15 bp, Homo sapiens
gatggaaagaaagca

SEQ ID NO: 743145 - DNA, 19 bp, Homo sapiens
gatggaacgggcatgggcc

SEQ ID NO: 743146 - DNA, 14 bp, Homo sapiens
gatggaatggaaaa

SEQ ID NO: 743147 - DNA, 17 bp, Homo sapiens
gatggaatgtgccacct

SEQ ID NO: 743148 - DNA, 17 bp, Homo sapiens
gatggaattaaatgtgg

SEQ ID NO: 743149 - DNA, 16 bp, Homo sapiens
gatggaattattgtac

SEQ ID NO: 743150 - DNA, 13 bp, Homo sapiens
gatggacaccccc

SEQ ID NO: 743151 - DNA, 18 bp, Homo sapiens
gatggacacgagccacaa

SEQ ID NO: 743152 - DNA, 19 bp, Homo sapiens
gatggacactaatgcagcc

SEQ ID NO: 743153 - DNA, 14 bp, Homo sapiens
gatggacactccag

SEQ ID NO: 743154 - DNA, 15 bp, Homo sapiens
gatggacactccagg

SEQ ID NO: 743155 - DNA, 17 bp, Homo sapiens
gatggacactgccaaga

SEQ ID NO: 743156 - DNA, 12 bp, Homo sapiens
gatggacagaca

SEQ ID NO: 743157 - DNA, 19 bp, Homo sapiens
gatggaccaacctgctctg

SEQ ID NO: 743158 - DNA, 16 bp, Homo sapiens
gatggacccctccctt

SEQ ID NO: 743159 - DNA, 18 bp, Homo sapiens
gatggaccgggtgggcct

SEQ ID NO: 743160 - DNA, 20 bp, Homo sapiens
gatggaccgggtgggcctgg

SEQ ID NO: 743161 - DNA, 21 bp, Homo sapiens
gatggaccgggtgggcctggc

SEQ ID NO: 743162 - DNA, 22 bp, Homo sapiens
gatggaccgggtgggcctggcc

SEQ ID NO: 743163 - DNA, 18 bp, Homo sapiens
gatggacgcaggccctgt

SEQ ID NO: 743164 - DNA, 14 bp, Homo sapiens
gatggactcaggat

SEQ ID NO: 743165 - DNA, 18 bp, Homo sapiens
gatggagaaagaagtgga

SEQ ID NO: 743166 - DNA, 23 bp, Homo sapiens
gatggagactggtcctgtgtgca

SEQ ID NO: 743167 - DNA, 12 bp, Homo sapiens
tattgcaaaata

SEQ ID NO: 743168 - DNA, 15 bp, Homo sapiens
tattgcaaaatacat

SEQ ID NO: 743169 - DNA, 17 bp, Homo sapiens
tattgcaaaatacatga

SEQ ID NO: 743170 - DNA, 23 bp, Homo sapiens
tattgcaaaggttccaactgtat

SEQ ID NO: 743171 - DNA, 23 bp, Homo sapiens
tattgcaaatgagggaagaacat

SEQ ID NO: 743172 - DNA, 18 bp, Homo sapiens
tattgcaaggcagtctct

SEQ ID NO: 743173 - DNA, 23 bp, Homo sapiens
tattgcaaggcagtctctatatt

SEQ ID NO: 743174 - DNA, 13 bp, Homo sapiens
tattgcacattgt

SEQ ID NO: 743175 - DNA, 22 bp, Homo sapiens
tattgcatctgggtagctgtaa

SEQ ID NO: 743176 - DNA, 15 bp, Homo sapiens
tattgcatctgtata

SEQ ID NO: 743177 - DNA, 16 bp, Homo sapiens
tattgcatctgtataa

SEQ ID NO: 743178 - DNA, 21 bp, Homo sapiens
tattgcatgctgataatcatt

SEQ ID NO: 743179 - DNA, 22 bp, Homo sapiens
tattgccaggaaaggagagtac

SEQ ID NO: 743180 - DNA, 20 bp, Homo sapiens
tattgcccatgatataactt

SEQ ID NO: 743181 - DNA, 16 bp, Homo sapiens
tattgcccatgggata

SEQ ID NO: 743182 - DNA, 17 bp, Homo sapiens
tattgctaaaagtgcat

SEQ ID NO: 743183 - DNA, 17 bp, Homo sapiens
tattgctatctaatggg

SEQ ID NO: 743184 - DNA, 13 bp, Homo sapiens
tattgctattaaa

SEQ ID NO: 743185 - DNA, 19 bp, Homo sapiens
tattgctcgcccagacacc

SEQ ID NO: 743186 - DNA, 22 bp, Homo sapiens
tattgctcgcccagacaccatg

SEQ ID NO: 743187 - DNA, 23 bp, Homo sapiens
tattgctcgcccagacaccatgt

SEQ ID NO: 743188 - DNA, 13 bp, Homo sapiens
tattgctgaactc

SEQ ID NO: 743189 - DNA, 15 bp, Homo sapiens
tattgctgaagaatc

SEQ ID NO: 743190 - DNA, 17 bp, Homo sapiens
tattgctgagaagcaaa

SEQ ID NO: 743191 - DNA, 15 bp, Homo sapiens
tattgctgagagaaa

SEQ ID NO: 743192 - DNA, 19 bp, Homo sapiens
tattgctgagagaaatatg

SEQ ID NO: 743193 - DNA, 11 bp, Homo sapiens
tattgctgcca

SEQ ID NO: 743194 - DNA, 14 bp, Homo sapiens
tattgctgccaaaa

SEQ ID NO: 743195 - DNA, 20 bp, Homo sapiens
tattgctgccaaaaccacat

SEQ ID NO: 743196 - DNA, 15 bp, Homo sapiens
tattgctgtctggtg

SEQ ID NO: 743197 - DNA, 22 bp, Homo sapiens
tattgctgtctggtgaggtggc

SEQ ID NO: 743198 - DNA, 19 bp, Homo sapiens
tattgctgtgtaacactgt

SEQ ID NO: 743199 - DNA, 19 bp, Homo sapiens
tattgcttaatttctgcct

SEQ ID NO: 743200 - DNA, 20 bp, Homo sapiens
tattgcttaatttctgcctt

SEQ ID NO: 743201 - DNA, 21 bp, Homo sapiens
tattgcttatctgaaatgctt

SEQ ID NO: 743202 - DNA, 15 bp, Homo sapiens
tattgcttcatctgt

SEQ ID NO: 743203 - DNA, 16 bp, Homo sapiens
tattggaagacttggg

SEQ ID NO: 743204 - DNA, 18 bp, Homo sapiens
tattggaagtgttcaaga

SEQ ID NO: 743205 - DNA, 19 bp, Homo sapiens
tattggaagtgttcaagaa

SEQ ID NO: 743206 - DNA, 17 bp, Homo sapiens
tattggattgcgccttt

SEQ ID NO: 743207 - DNA, 22 bp, Homo sapiens
tattggcagccaaggaatgtgt

SEQ ID NO: 743208 - DNA, 18 bp, Homo sapiens
tattggggaattaaatag

SEQ ID NO: 743209 - DNA, 19 bp, Homo sapiens
tattgggtgtagatttctg

SEQ ID NO: 743210 - DNA, 15 bp, Homo sapiens
tattggtaaattctg

SEQ ID NO: 743211 - DNA, 20 bp, Homo sapiens
tattggtgcttgactctcac

SEQ ID NO: 743212 - DNA, 17 bp, Homo sapiens
tatttagcgcacccaga

SEQ ID NO: 743213 - DNA, 14 bp, Homo sapiens
tatttagctttaca

SEQ ID NO: 743214 - DNA, 18 bp, Homo sapiens
tatttagctttacatatt

SEQ ID NO: 743215 - DNA, 17 bp, Homo sapiens
tatttagggaactgctt

SEQ ID NO: 743216 - DNA, 18 bp, Homo sapiens
tatttagggaactgcttg

SEQ ID NO: 743217 - DNA, 15 bp, Homo sapiens
tatttaggtttttgg

SEQ ID NO: 743218 - DNA, 22 bp, Homo sapiens
tatttagttacgtataatgctt

SEQ ID NO: 743219 - DNA, 15 bp, Homo sapiens
tatttagttatagtt

SEQ ID NO: 743220 - DNA, 14 bp, Homo sapiens
tatttagttggaat

SEQ ID NO: 743221 - DNA, 19 bp, Homo sapiens
tatttataaactaggtaaa

SEQ ID NO: 743222 - DNA, 19 bp, Homo sapiens
tatttataacaacctaaat

SEQ ID NO: 743223 - DNA, 18 bp, Homo sapiens
tatttataatacagaatc

SEQ ID NO: 743224 - DNA, 17 bp, Homo sapiens
tatttataatacatttc

SEQ ID NO: 743225 - DNA, 19 bp, Homo sapiens
tatttatacccccaggaaa

SEQ ID NO: 743226 - DNA, 18 bp, Homo sapiens
tatttatagcaatccatg

SEQ ID NO: 743227 - DNA, 19 bp, Homo sapiens
tatttatatatttataact

SEQ ID NO: 743228 - DNA, 15 bp, Homo sapiens
tatttatatgtacat

SEQ ID NO: 743229 - DNA, 16 bp, Homo sapiens
tatttatattccgtat

SEQ ID NO: 743230 - DNA, 13 bp, Homo sapiens
tatttatattgta

SEQ ID NO: 743231 - DNA, 16 bp, Homo sapiens
tatttatatttcctgt

SEQ ID NO: 743232 - DNA, 13 bp, Homo sapiens
tatttatatttgg

SEQ ID NO: 743233 - DNA, 21 bp, Homo sapiens
tatttatatttggaaagagac

SEQ ID NO: 743234 - DNA, 21 bp, Homo sapiens
tatttatatttttattttatt

SEQ ID NO: 743235 - DNA, 20 bp, Homo sapiens
tatttatcaatttttcccag

SEQ ID NO: 743236 - DNA, 13 bp, Homo sapiens
tatttatcacata

SEQ ID NO: 743237 - DNA, 13 bp, Homo sapiens
tatttatcagtga

SEQ ID NO: 743238 - DNA, 15 bp, Homo sapiens
tatttatccctttcc

SEQ ID NO: 743239 - DNA, 16 bp, Homo sapiens
tatttatctctattta

SEQ ID NO: 743240 - DNA, 17 bp, Homo sapiens
tatttatctctatttaa

SEQ ID NO: 743241 - DNA, 17 bp, Homo sapiens
tatttatctgagcaata

SEQ ID NO: 743242 - DNA, 21 bp, Homo sapiens
tatttatctgattaagttgtc

SEQ ID NO: 743243 - DNA, 20 bp, Homo sapiens
tatttatctgtgcaaatcct

SEQ ID NO: 743244 - DNA, 22 bp, Homo sapiens
tatttatctgtgtttttgaaat

SEQ ID NO: 743245 - DNA, 11 bp, Homo sapiens
tatttatgaaa

SEQ ID NO: 743246 - DNA, 20 bp, Homo sapiens
tatttatgaaaaccatatga

SEQ ID NO: 743247 - DNA, 12 bp, Homo sapiens
tatttatgaatt

SEQ ID NO: 743248 - DNA, 14 bp, Homo sapiens
tatttatgaattgt

SEQ ID NO: 743249 - DNA, 20 bp, Homo sapiens
tatttatgcctctgtattta

SEQ ID NO: 743250 - DNA, 20 bp, Homo sapiens
tatttatgcgtaatttaatg

SEQ ID NO: 743251 - DNA, 16 bp, Homo sapiens
tatttatggtttctgt

SEQ ID NO: 743252 - DNA, 23 bp, Homo sapiens
tatttatggtttctgtctgaatt

SEQ ID NO: 743253 - DNA, 15 bp, Homo sapiens
tatttatgttaaaag

SEQ ID NO: 743254 - DNA, 13 bp, Homo sapiens
tatttatgtttgc

SEQ ID NO: 743255 - DNA, 19 bp, Homo sapiens
tatttattaatatttaaca

SEQ ID NO: 743256 - DNA, 16 bp, Homo sapiens
tatttattacataatt

SEQ ID NO: 743257 - DNA, 13 bp, Homo sapiens
tatttattacctc

SEQ ID NO: 743258 - DNA, 16 bp, Homo sapiens
tatttattacctctga

SEQ ID NO: 743259 - DNA, 20 bp, Homo sapiens
tatttattacttgtgcactt

SEQ ID NO: 743260 - DNA, 12 bp, Homo sapiens
tatttattgact

SEQ ID NO: 743261 - DNA, 14 bp, Homo sapiens
tatttattgcattg

SEQ ID NO: 743262 - DNA, 13 bp, Homo sapiens
tatttattgtcag

SEQ ID NO: 743263 - DNA, 14 bp, Homo sapiens
tatttattgttaaa

SEQ ID NO: 743264 - DNA, 19 bp, Homo sapiens
tatttattgttaaattaca

SEQ ID NO: 743265 - DNA, 22 bp, Homo sapiens
tatttattgtttatttatcagt

SEQ ID NO: 743266 - DNA, 15 bp, Homo sapiens
tatttatttaaaact

SEQ ID NO: 743267 - DNA, 16 bp, Homo sapiens
tatttatttaaaactc

SEQ ID NO: 743268 - DNA, 20 bp, Homo sapiens
tatttatttaaataaaggag

SEQ ID NO: 743269 - DNA, 14 bp, Homo sapiens
tatttatttaaatt

SEQ ID NO: 743270 - DNA, 21 bp, Homo sapiens
tatttatttaataacaattgt

SEQ ID NO: 743271 - DNA, 16 bp, Homo sapiens
tatttatttacaaatg

SEQ ID NO: 743272 - DNA, 13 bp, Homo sapiens
tatttatttactg

SEQ ID NO: 743273 - DNA, 14 bp, Homo sapiens
tatttatttatgga

SEQ ID NO: 743274 - DNA, 16 bp, Homo sapiens
tatttatttcctgcta

SEQ ID NO: 743275 - DNA, 21 bp, Homo sapiens
tatttattttcagtatactgt

SEQ ID NO: 743276 - DNA, 16 bp, Homo sapiens
tatttattttcctaaa

SEQ ID NO: 743277 - DNA, 22 bp, Homo sapiens
tatttcaaacattttgtatcaa

SEQ ID NO: 743278 - DNA, 18 bp, Homo sapiens
tatttcaagggttgcttc

SEQ ID NO: 743279 - DNA, 23 bp, Homo sapiens
tatttcaagggttgcttctgagt

SEQ ID NO: 743280 - DNA, 15 bp, Homo sapiens
tatttcacaacagcc

SEQ ID NO: 743281 - DNA, 14 bp, Homo sapiens
tatttcacagagca

SEQ ID NO: 743282 - DNA, 16 bp, Homo sapiens
tatttcacttgatgat

SEQ ID NO: 743283 - DNA, 18 bp, Homo sapiens
tatttcagatatcaaaat

SEQ ID NO: 743284 - DNA, 22 bp, Homo sapiens
tatttcagatatcaaaattcta

SEQ ID NO: 743285 - DNA, 14 bp, Homo sapiens
tatttcagatgttt

SEQ ID NO: 743286 - DNA, 21 bp, Homo sapiens
tatttcaggcattggatattt

SEQ ID NO: 743287 - DNA, 17 bp, Homo sapiens
tatttcagtattttcca

SEQ ID NO: 743288 - DNA, 20 bp, Homo sapiens
tatttcatcacaagaacaca

SEQ ID NO: 743289 - DNA, 21 bp, Homo sapiens
tatttcatgtttttgatcaaa

SEQ ID NO: 743290 - DNA, 19 bp, Homo sapiens
tatttccactaaaaatatt

SEQ ID NO: 743291 - DNA, 21 bp, Homo sapiens
tatttccactattttcaaaga

SEQ ID NO: 743292 - DNA, 14 bp, Homo sapiens
tatttccactgaac

SEQ ID NO: 743293 - DNA, 18 bp, Homo sapiens
tatttccactgaacaaaa

SEQ ID NO: 743294 - DNA, 18 bp, Homo sapiens
tatttccattcaacaaga

SEQ ID NO: 743295 - DNA, 14 bp, Homo sapiens
tatttcccctgtca

SEQ ID NO: 743296 - DNA, 15 bp, Homo sapiens
tatttccccttggac

SEQ ID NO: 743297 - DNA, 17 bp, Homo sapiens
gatggttattttctttt

SEQ ID NO: 743298 - DNA, 17 bp, Homo sapiens
gatggtttgaaattttt

SEQ ID NO: 743299 - DNA, 24 bp, Homo sapiens
gatgtaaaatgagtttgtattatt

SEQ ID NO: 743300 - DNA, 19 bp, Homo sapiens
gatgtaaacagtgcctgct

SEQ ID NO: 743301 - DNA, 12 bp, Homo sapiens
gatgtaaagatg

SEQ ID NO: 743302 - DNA, 16 bp, Homo sapiens
gatgtaaggactgtaa

SEQ ID NO: 743303 - DNA, 13 bp, Homo sapiens
gatgtaattttgt

SEQ ID NO: 743304 - DNA, 19 bp, Homo sapiens
gatgtaattttgtgtaaga

SEQ ID NO: 743305 - DNA, 20 bp, Homo sapiens
gatgtacagaacacaaatgt

SEQ ID NO: 743306 - DNA, 19 bp, Homo sapiens
gatgtacagtctgtcatga

SEQ ID NO: 743307 - DNA, 13 bp, Homo sapiens
gatgtagaaagtt

SEQ ID NO: 743308 - DNA, 19 bp, Homo sapiens
gatgtagagagaacaggtg

SEQ ID NO: 743309 - DNA, 15 bp, Homo sapiens
gatgtagcattatgc

SEQ ID NO: 743310 - DNA, 15 bp, Homo sapiens
gatgtagtctgaggc

SEQ ID NO: 743311 - DNA, 19 bp, Homo sapiens
gatgtatctgagttgccaa

SEQ ID NO: 743312 - DNA, 15 bp, Homo sapiens
gatgtatgtaaatat

SEQ ID NO: 743313 - DNA, 22 bp, Homo sapiens
gatgtatgtgaataaaaattat

SEQ ID NO: 743314 - DNA, 16 bp, Homo sapiens
gatgtattttcatagt

SEQ ID NO: 743315 - DNA, 14 bp, Homo sapiens
gatgtatttttctt

SEQ ID NO: 743316 - DNA, 15 bp, Homo sapiens
gatgtcagccttgca

SEQ ID NO: 743317 - DNA, 18 bp, Homo sapiens
gatgtcataataaagttg

SEQ ID NO: 743318 - DNA, 20 bp, Homo sapiens
gatgtcatagccaaagccag

SEQ ID NO: 743319 - DNA, 20 bp, Homo sapiens
gatgtcatgtacttcctgtg

SEQ ID NO: 743320 - DNA, 22 bp, Homo sapiens
gatgtcatgtacttcctgtgta

SEQ ID NO: 743321 - DNA, 17 bp, Homo sapiens
gatgtccaaaagatacc

SEQ ID NO: 743322 - DNA, 12 bp, Homo sapiens
gatgtccagggc

SEQ ID NO: 743323 - DNA, 16 bp, Homo sapiens
gatgtccagggcccca

SEQ ID NO: 743324 - DNA, 16 bp, Homo sapiens
gatgtcccctgcgggc

SEQ ID NO: 743325 - DNA, 16 bp, Homo sapiens
gatgtccctgggccag

SEQ ID NO: 743326 - DNA, 21 bp, Homo sapiens
gatgtccctgggccagggtct

SEQ ID NO: 743327 - DNA, 20 bp, Homo sapiens
gatgtcccttgatgcacaga

SEQ ID NO: 743328 - DNA, 21 bp, Homo sapiens
gatgtcccttgatgcacagag

SEQ ID NO: 743329 - DNA, 22 bp, Homo sapiens
gatgtcccttgatgcacagaga

SEQ ID NO: 743330 - DNA, 15 bp, Homo sapiens
gatgtctcagagcct

SEQ ID NO: 743331 - DNA, 20 bp, Homo sapiens
gatgtctcagagccttccat

SEQ ID NO: 743332 - DNA, 20 bp, Homo sapiens
gatgtctcctcaagcctgtg

SEQ ID NO: 743333 - DNA, 21 bp, Homo sapiens
gatgtctcctcaagcctgtgg

SEQ ID NO: 743334 - DNA, 21 bp, Homo sapiens
gattctctctccatttggaat

SEQ ID NO: 743335 - DNA, 16 bp, Homo sapiens
gattctctctttaacc

SEQ ID NO: 743336 - DNA, 19 bp, Homo sapiens
gattctcttagctactgta

SEQ ID NO: 743337 - DNA, 23 bp, Homo sapiens
gattctgaccttaaatgcaacca

SEQ ID NO: 743338 - DNA, 19 bp, Homo sapiens
gattctgataatgctcact

SEQ ID NO: 743339 - DNA, 15 bp, Homo sapiens
gattctgatttcagt

SEQ ID NO: 743340 - DNA, 19 bp, Homo sapiens
gattctgatttcagttttt

SEQ ID NO: 743341 - DNA, 19 bp, Homo sapiens
gattctgcagtaaatcttt

SEQ ID NO: 743342 - DNA, 14 bp, Homo sapiens
gattctgcctctct

SEQ ID NO: 743343 - DNA, 16 bp, Homo sapiens
gattctgcctctctgg

SEQ ID NO: 743344 - DNA, 17 bp, Homo sapiens
gattctgcctctctgga

SEQ ID NO: 743345 - DNA, 19 bp, Homo sapiens
gattctggatctcctgctg

SEQ ID NO: 743346 - DNA, 17 bp, Homo sapiens
gattctgggtttgccca

SEQ ID NO: 743347 - DNA, 19 bp, Homo sapiens
gattctgttaaaaaaataa

SEQ ID NO: 743348 - DNA, 21 bp, Homo sapiens
gattctgtttattcttccaga

SEQ ID NO: 743349 - DNA, 23 bp, Homo sapiens
gattcttaacacagccttccttc

SEQ ID NO: 743350 - DNA, 15 bp, Homo sapiens
gattcttacatatga

SEQ ID NO: 743351 - DNA, 23 bp, Homo sapiens
gattcttatgtagcaggaaataa

SEQ ID NO: 743352 - DNA, 19 bp, Homo sapiens
gattcttccacctcagcct

SEQ ID NO: 743353 - DNA, 16 bp, Homo sapiens
gattcttgattcctgg

SEQ ID NO: 743354 - DNA, 19 bp, Homo sapiens
gattctttccattatgatt

SEQ ID NO: 743355 - DNA, 19 bp, Homo sapiens
gattctttccatttgcatt

SEQ ID NO: 743356 - DNA, 20 bp, Homo sapiens
gattctttcccaattcacat

SEQ ID NO: 743357 - DNA, 14 bp, Homo sapiens
gattctttccccag

SEQ ID NO: 743358 - DNA, 20 bp, Homo sapiens
gattctttttaaagtgtttc

SEQ ID NO: 743359 - DNA, 23 bp, Homo sapiens
gattctttttttctgtcagtaaa

SEQ ID NO: 743360 - DNA, 18 bp, Homo sapiens
gattgaaaatgtccagga

SEQ ID NO: 743361 - DNA, 20 bp, Homo sapiens
gattgaagaatctgcccctg

SEQ ID NO: 743362 - DNA, 19 bp, Homo sapiens
gattgacagctttgctgct

SEQ ID NO: 743363 - DNA, 23 bp, Homo sapiens
gattgacctgctccgctgctcct

SEQ ID NO: 743364 - DNA, 15 bp, Homo sapiens
gattgactaaataaa

SEQ ID NO: 743365 - DNA, 19 bp, Homo sapiens
gattgagacctacaggctg

SEQ ID NO: 743366 - DNA, 21 bp, Homo sapiens
gattgagacctacaggctgac

SEQ ID NO: 743367 - DNA, 20 bp, Homo sapiens
gattgaggggccctggccag

SEQ ID NO: 743368 - DNA, 14 bp, Homo sapiens
gattgagtgagggc

SEQ ID NO: 743369 - DNA, 14 bp, Homo sapiens
gattgatatcgtga

SEQ ID NO: 743370 - DNA, 17 bp, Homo sapiens
gattgatatcgtgaaat

SEQ ID NO: 743371 - DNA, 22 bp, Homo sapiens
gattgattcagtatcttagagt

SEQ ID NO: 743372 - DNA, 23 bp, Homo sapiens
gattgattcagtatcttagagtt

SEQ ID NO: 743373 - DNA, 11 bp, Homo sapiens
gattgcacaga

SEQ ID NO: 743374 - DNA, 19 bp, Homo sapiens
gattgcacgtggcctcttg

SEQ ID NO: 743375 - DNA, 20 bp, Homo sapiens
gattgcacgtggcctcttga

SEQ ID NO: 743376 - DNA, 17 bp, Homo sapiens
gattgcatcctgctggg

SEQ ID NO: 743377 - DNA, 22 bp, Homo sapiens
gattgcattagaaatagacagt

SEQ ID NO: 743378 - DNA, 16 bp, Homo sapiens
gattgccacagctcaa

SEQ ID NO: 743379 - DNA, 15 bp, Homo sapiens
gattgccccagagcc

SEQ ID NO: 743380 - DNA, 19 bp, Homo sapiens
gattgcccgcgctcaggag

SEQ ID NO: 743381 - DNA, 15 bp, Homo sapiens
gattgcctttaatat

SEQ ID NO: 743382 - DNA, 15 bp, Homo sapiens
gattgctatgaatga

SEQ ID NO: 743383 - DNA, 21 bp, Homo sapiens
gattgctgaatcccatcaggc

SEQ ID NO: 743384 - DNA, 18 bp, Homo sapiens
gattgctgataataaatt

SEQ ID NO: 743385 - DNA, 20 bp, Homo sapiens
gattgctgccccatcagtgc

SEQ ID NO: 743386 - DNA, 16 bp, Homo sapiens
gattgctgtggcctag

SEQ ID NO: 743387 - DNA, 17 bp, Homo sapiens
gattgcttcaattaaaa

SEQ ID NO: 743388 - DNA, 22 bp, Homo sapiens
gattgctttgctgcacagcagg

SEQ ID NO: 743389 - DNA, 14 bp, Homo sapiens
gattggacattttc

SEQ ID NO: 743390 - DNA, 14 bp, Homo sapiens
gattggagaatact

SEQ ID NO: 743391 - DNA, 16 bp, Homo sapiens
gattggccagtgagaa

SEQ ID NO: 743392 - DNA, 22 bp, Homo sapiens
gattggccagtgagaagctgag

SEQ ID NO: 743393 - DNA, 16 bp, Homo sapiens
gattggcctgtagagt

SEQ ID NO: 743394 - DNA, 19 bp, Homo sapiens
gattggcttaaagtgaagg

SEQ ID NO: 743395 - DNA, 17 bp, Homo sapiens
gattgggggctggtgcc

SEQ ID NO: 743396 - DNA, 22 bp, Homo sapiens
gattggggggaaagagggagca

SEQ ID NO: 743397 - DNA, 15 bp, Homo sapiens
gattggggtgataag

SEQ ID NO: 743398 - DNA, 12 bp, Homo sapiens
gattggtgttcg

SEQ ID NO: 743399 - DNA, 20 bp, Homo sapiens
gattggttaaaatgtgattt

SEQ ID NO: 743400 - DNA, 20 bp, Homo sapiens
gattgtaaaatagcttgtat

SEQ ID NO: 743401 - DNA, 23 bp, Homo sapiens
gattgtacatttatttattactg

SEQ ID NO: 743402 - DNA, 20 bp, Homo sapiens
gattgtcctttaaaaaagaa

SEQ ID NO: 743403 - DNA, 15 bp, Homo sapiens
gattgtgaggcttct

SEQ ID NO: 743404 - DNA, 20 bp, Homo sapiens
gattgtggggtgcagctggg

SEQ ID NO: 743405 - DNA, 16 bp, Homo sapiens
gattgtgttgaagaag

SEQ ID NO: 743406 - DNA, 23 bp, Homo sapiens
gattgtgtttgttcataataaaa

SEQ ID NO: 743407 - DNA, 16 bp, Homo sapiens
gattgttaaaataact

SEQ ID NO: 743408 - DNA, 11 bp, Homo sapiens
gattgtttgca

SEQ ID NO: 743409 - DNA, 23 bp, Homo sapiens
gatttaaaaacaaccaacagaaa

SEQ ID NO: 743410 - DNA, 15 bp, Homo sapiens
gatttaaacacacag

SEQ ID NO: 743411 - DNA, 12 bp, Homo sapiens
gatttaaatcag

SEQ ID NO: 743412 - DNA, 17 bp, Homo sapiens
gatttaacagaaatgta

SEQ ID NO: 743413 - DNA, 20 bp, Homo sapiens
gatttaacagaaatgtacag

SEQ ID NO: 743414 - DNA, 18 bp, Homo sapiens
gatttaacagtcatttaa

SEQ ID NO: 743415 - DNA, 17 bp, Homo sapiens
gatttaagtgaatacat

SEQ ID NO: 743416 - DNA, 17 bp, Homo sapiens
gatttaagttacaatgt

SEQ ID NO: 743417 - DNA, 12 bp, Homo sapiens
gatttaatgttt

SEQ ID NO: 743418 - DNA, 14 bp, Homo sapiens
gatttaatgttttc

SEQ ID NO: 743419 - DNA, 13 bp, Homo sapiens
gatttaatttcca

SEQ ID NO: 743420 - DNA, 21 bp, Homo sapiens
gatttacagcaagtagataaa

SEQ ID NO: 743421 - DNA, 20 bp, Homo sapiens
gatttacctgttttcgcacc

SEQ ID NO: 743422 - DNA, 17 bp, Homo sapiens
gatttaccttttctgtt

SEQ ID NO: 743423 - DNA, 20 bp, Homo sapiens
gatttaccttttctgttgta

SEQ ID NO: 743424 - DNA, 21 bp, Homo sapiens
gatttagaaaaaagtttacaa

SEQ ID NO: 743425 - DNA, 16 bp, Homo sapiens
gatttaggagcagaaa

SEQ ID NO: 743426 - DNA, 20 bp, Homo sapiens
gatttagtaatagtccaata

SEQ ID NO: 743427 - DNA, 22 bp, Homo sapiens
gatttagtgaaagctagagata

SEQ ID NO: 743428 - DNA, 20 bp, Homo sapiens
gatttagttgtggaaagata

SEQ ID NO: 743429 - DNA, 15 bp, Homo sapiens
gatttagtttcagta

SEQ ID NO: 743430 - DNA, 15 bp, Homo sapiens
gatttagttttgtaa

SEQ ID NO: 743431 - DNA, 18 bp, Homo sapiens
gatttataaatgctattt

SEQ ID NO: 743432 - DNA, 16 bp, Homo sapiens
tcaaaagagccctggc

SEQ ID NO: 743433 - DNA, 16 bp, Homo sapiens
tcaaaagataatattt

SEQ ID NO: 743434 - DNA, 15 bp, Homo sapiens
tcaaaaggaaaccaa

SEQ ID NO: 743435 - DNA, 14 bp, Homo sapiens
tcaaaagggccaaa

SEQ ID NO: 743436 - DNA, 21 bp, Homo sapiens
tcaaaagggccaaagaaccaa

SEQ ID NO: 743437 - DNA, 17 bp, Homo sapiens
tcaaaataaagaagtat

SEQ ID NO: 743438 - DNA, 18 bp, Homo sapiens
tcaaaatacatttgtaag

SEQ ID NO: 743439 - DNA, 15 bp, Homo sapiens
tcaaaatagaaaagt

SEQ ID NO: 743440 - DNA, 17 bp, Homo sapiens
tcaaaatatattttgta

SEQ ID NO: 743441 - DNA, 15 bp, Homo sapiens
tcaaaatatgttctt

SEQ ID NO: 743442 - DNA, 22 bp, Homo sapiens
tcaaaatattgagcagaattca

SEQ ID NO: 743443 - DNA, 13 bp, Homo sapiens
tcaaaatatttaa

SEQ ID NO: 743444 - DNA, 20 bp, Homo sapiens
tcaaaatatttaaaaatgtc

SEQ ID NO: 743445 - DNA, 21 bp, Homo sapiens
tcaaaatatttaaaaatgtct

SEQ ID NO: 743446 - DNA, 22 bp, Homo sapiens
tcaaaatatttaaaaatgtctt

SEQ ID NO: 743447 - DNA, 16 bp, Homo sapiens
tcaaaatcagtttttc

SEQ ID NO: 743448 - DNA, 19 bp, Homo sapiens
tcaaaatctagaagagtct

SEQ ID NO: 743449 - DNA, 22 bp, Homo sapiens
tcaaaatctttgtataaataaa

SEQ ID NO: 743450 - DNA, 16 bp, Homo sapiens
tcaaaatgacagtttc

SEQ ID NO: 743451 - DNA, 21 bp, Homo sapiens
tcaaaatgacagtttcagaga

SEQ ID NO: 743452 - DNA, 13 bp, Homo sapiens
tcaaaatgccttt

SEQ ID NO: 743453 - DNA, 12 bp, Homo sapiens
tcaaaatgcttt

SEQ ID NO: 743454 - DNA, 13 bp, Homo sapiens
tcaaaatgtagct

SEQ ID NO: 743455 - DNA, 14 bp, Homo sapiens
gcaaaaaaaaattt

SEQ ID NO: 743456 - DNA, 14 bp, Homo sapiens
gcaaaaaaagcctc

SEQ ID NO: 743457 - DNA, 12 bp, Homo sapiens
gcaaaaaaatta

SEQ ID NO: 743458 - DNA, 17 bp, Homo sapiens
gcaaaaaagaaaacctt

SEQ ID NO: 743459 - DNA, 15 bp, Homo sapiens
gcaaaaaataatgac

SEQ ID NO: 743460 - DNA, 17 bp, Homo sapiens
gcaaaaaatgtttttgg

SEQ ID NO: 743461 - DNA, 15 bp, Homo sapiens
gcaaaaaattcttta

SEQ ID NO: 743462 - DNA, 15 bp, Homo sapiens
gcaaaaacaaaaaga

SEQ ID NO: 743463 - DNA, 20 bp, Homo sapiens
gcaaaaactacattttgcaa

SEQ ID NO: 743464 - DNA, 18 bp, Homo sapiens
gcaaaaactgtactgtgt

SEQ ID NO: 743465 - DNA, 14 bp, Homo sapiens
gcaaaaacttcctt

SEQ ID NO: 743466 - DNA, 20 bp, Homo sapiens
gcaaaaagaacaaagctgga

SEQ ID NO: 743467 - DNA, 18 bp, Homo sapiens
gcaaaaagcaagggagaa

SEQ ID NO: 743468 - DNA, 22 bp, Homo sapiens
gcaaaaagtagacttggtgtga

SEQ ID NO: 743469 - DNA, 20 bp, Homo sapiens
gcaaaaatgacaacagaaaa

SEQ ID NO: 743470 - DNA, 18 bp, Homo sapiens
gcaaaacaaattcaaata

SEQ ID NO: 743471 - DNA, 18 bp, Homo sapiens
gcaaaacacgcaagggca

SEQ ID NO: 743472 - DNA, 13 bp, Homo sapiens
gcaaaacatcaca

SEQ ID NO: 743473 - DNA, 15 bp, Homo sapiens
gcaaaaccattgctt

SEQ ID NO: 743474 - DNA, 20 bp, Homo sapiens
gcaaaacctgcagttcctga

SEQ ID NO: 743475 - DNA, 20 bp, Homo sapiens
gcaaaacgcatggagtgtgt

SEQ ID NO: 743476 - DNA, 17 bp, Homo sapiens
gcaaaactctacttaat

SEQ ID NO: 743477 - DNA, 23 bp, Homo sapiens
gcaaaactctacttaatccaatg

SEQ ID NO: 743478 - DNA, 14 bp, Homo sapiens
gcaaaactgtgtca

SEQ ID NO: 743479 - DNA, 11 bp, Homo sapiens
gcaaaagaaga

SEQ ID NO: 743480 - DNA, 16 bp, Homo sapiens
gcaaaagatgcttctc

SEQ ID NO: 743481 - DNA, 18 bp, Homo sapiens
gcaaaagcagctaaatgt

SEQ ID NO: 743482 - DNA, 18 bp, Homo sapiens
gcaaaagcctcagaaagg

SEQ ID NO: 743483 - DNA, 16 bp, Homo sapiens
gcaaaaggcagctcac

SEQ ID NO: 743484 - DNA, 23 bp, Homo sapiens
gcaaaaggcagctcacccctggg

SEQ ID NO: 743485 - DNA, 22 bp, Homo sapiens
gcaaaagtggggctaaatgaag

SEQ ID NO: 743486 - DNA, 19 bp, Homo sapiens
gcaaaagttctgacttgac

SEQ ID NO: 743487 - DNA, 10 bp, Homo sapiens
gcaaaataag

SEQ ID NO: 743488 - DNA, 20 bp, Homo sapiens
gcaaaataattttaaacaaa

SEQ ID NO: 743489 - DNA, 13 bp, Homo sapiens
gcaaaatacatga

SEQ ID NO: 743490 - DNA, 14 bp, Homo sapiens
gcaaaatagtattg

SEQ ID NO: 743491 - DNA, 15 bp, Homo sapiens
gcaaaatagtattgc

SEQ ID NO: 743492 - DNA, 23 bp, Homo sapiens
gcaaaatcattttatatgtcaaa

SEQ ID NO: 743493 - DNA, 18 bp, Homo sapiens
gcaaaatcgccataggcc

SEQ ID NO: 743494 - DNA, 21 bp, Homo sapiens
gcaaaatcttgttaatgtcat

SEQ ID NO: 743495 - DNA, 16 bp, Homo sapiens
gcaaaatggaagcaaa

SEQ ID NO: 743496 - DNA, 17 bp, Homo sapiens
gcaaaatggaagcaaag

SEQ ID NO: 743497 - DNA, 20 bp, Homo sapiens
gcaaaatggaagcaaagaca

SEQ ID NO: 743498 - DNA, 16 bp, Homo sapiens
gcaaaatgttgaagaa

SEQ ID NO: 743499 - DNA, 12 bp, Homo sapiens
gcaaaattgttt

SEQ ID NO: 743500 - DNA, 13 bp, Homo sapiens
gcaaaattgtttt

SEQ ID NO: 743501 - DNA, 16 bp, Homo sapiens
gcaaaattgttttcac

SEQ ID NO: 743502 - DNA, 17 bp, Homo sapiens
gcaaaattgttttcact

SEQ ID NO: 743503 - DNA, 21 bp, Homo sapiens
gcaaaattgttttcacttgta

SEQ ID NO: 743504 - DNA, 23 bp, Homo sapiens
gcaaaattgttttcacttgtatt

SEQ ID NO: 743505 - DNA, 22 bp, Homo sapiens
gcaaaatttgatgccaggacac

SEQ ID NO: 743506 - DNA, 19 bp, Homo sapiens
gcaaacaacctgaatcttt

SEQ ID NO: 743507 - DNA, 12 bp, Homo sapiens
gcaaacaatttt

SEQ ID NO: 743508 - DNA, 17 bp, Homo sapiens
gcaaacagaaatcaggt

SEQ ID NO: 743509 - DNA, 14 bp, Homo sapiens
gcaaacagaacagg

SEQ ID NO: 743510 - DNA, 23 bp, Homo sapiens
gcaaacagaggaagaatttgtta

SEQ ID NO: 743511 - DNA, 13 bp, Homo sapiens
gcaaacagcaaga

SEQ ID NO: 743512 - DNA, 18 bp, Homo sapiens
gcaaacagctgaaagagg

SEQ ID NO: 743513 - DNA, 22 bp, Homo sapiens
gcaaacagctgaaagaggagga

SEQ ID NO: 743514 - DNA, 19 bp, Homo sapiens
gcaaacatcaaataaattt

SEQ ID NO: 743515 - DNA, 21 bp, Homo sapiens
gcaaacatcaaataaatttct

SEQ ID NO: 743516 - DNA, 15 bp, Homo sapiens
gcaaaccacactgga

SEQ ID NO: 743517 - DNA, 20 bp, Homo sapiens
gcaaaccacactggactccg

SEQ ID NO: 743518 - DNA, 19 bp, Homo sapiens
gcaaacccatcaacaaaaa

SEQ ID NO: 743519 - DNA, 14 bp, Homo sapiens
gcaaaccctttgta

SEQ ID NO: 743520 - DNA, 15 bp, Homo sapiens
gcaaaccctttgtat

SEQ ID NO: 743521 - DNA, 13 bp, Homo sapiens
gcaaaccttcctg

SEQ ID NO: 743522 - DNA, 13 bp, Homo sapiens
gcaaacctttccc

SEQ ID NO: 743523 - DNA, 16 bp, Homo sapiens
gcaaacgtctattttg

SEQ ID NO: 743524 - DNA, 21 bp, Homo sapiens
gcaaacgtctattttgtatat

SEQ ID NO: 743525 - DNA, 22 bp, Homo sapiens
gcaaactaaccagcattcccta

SEQ ID NO: 743526 - DNA, 13 bp, Homo sapiens
gcaaactgcttta

SEQ ID NO: 743527 - DNA, 21 bp, Homo sapiens
gcaaactgctttattttccct

SEQ ID NO: 743528 - DNA, 20 bp, Homo sapiens
gcaaacttaagaaacactga

SEQ ID NO: 743529 - DNA, 23 bp, Homo sapiens
gcaaacttggaatttgtaacctc

SEQ ID NO: 743530 - DNA, 12 bp, Homo sapiens
gcaaactttttt

SEQ ID NO: 743531 - DNA, 15 bp, Homo sapiens
gcaaagacaaaagaa

SEQ ID NO: 743532 - DNA, 17 bp, Homo sapiens
gcaaagagtgagaaaga

SEQ ID NO: 743533 - DNA, 12 bp, Homo sapiens
gcaaagatcaaa

SEQ ID NO: 743534 - DNA, 18 bp, Homo sapiens
gcaaagatcaaaataaaa

SEQ ID NO: 743535 - DNA, 18 bp, Homo sapiens
gcaaagatggtggctgtg

SEQ ID NO: 743536 - DNA, 21 bp, Homo sapiens
gcaaagatttcagtagaattt

SEQ ID NO: 743537 - DNA, 21 bp, Homo sapiens
gcaaagcaccagcttctccag

SEQ ID NO: 743538 - DNA, 21 bp, Homo sapiens
gcaaagccacaaggctggcca

SEQ ID NO: 743539 - DNA, 12 bp, Homo sapiens
gcaaagcctcct

SEQ ID NO: 743540 - DNA, 14 bp, Homo sapiens
gcaaagcgacagat

SEQ ID NO: 743541 - DNA, 17 bp, Homo sapiens
gcaaagctacaggactg

SEQ ID NO: 743542 - DNA, 18 bp, Homo sapiens
gcaaagctacaggactgg

SEQ ID NO: 743543 - DNA, 14 bp, Homo sapiens
gcaaaggcagagga

SEQ ID NO: 743544 - DNA, 15 bp, Homo sapiens
gcaaaggcagaggaa

SEQ ID NO: 743545 - DNA, 18 bp, Homo sapiens
gcaaaggcagtcccggga

SEQ ID NO: 743546 - DNA, 15 bp, Homo sapiens
gcaaaggcccatgcc

SEQ ID NO: 743547 - DNA, 16 bp, Homo sapiens
gcaaaggcccatgccc

SEQ ID NO: 743548 - DNA, 18 bp, Homo sapiens
gcaaaggcccatgccccc

SEQ ID NO: 743549 - DNA, 16 bp, Homo sapiens
gcaaagggaaatcaag

SEQ ID NO: 743550 - DNA, 18 bp, Homo sapiens
gcaaagggagcactgggt

SEQ ID NO: 743551 - DNA, 13 bp, Homo sapiens
gcaaagggctgcc

SEQ ID NO: 743552 - DNA, 13 bp, Homo sapiens
gcaaaggggggag

SEQ ID NO: 743553 - DNA, 22 bp, Homo sapiens
gcaaaggtgggaggatcatttg

SEQ ID NO: 743554 - DNA, 20 bp, Homo sapiens
gcaaagtaaaaaaatatgaa

SEQ ID NO: 743555 - DNA, 12 bp, Homo sapiens
gcaaagtacaaa

SEQ ID NO: 743556 - DNA, 14 bp, Homo sapiens
gcaaagtagtactt

SEQ ID NO: 743557 - DNA, 16 bp, Homo sapiens
gcaaagtattgtaaat

SEQ ID NO: 743558 - DNA, 17 bp, Homo sapiens
gcaaagtattgtaaatt

SEQ ID NO: 743559 - DNA, 21 bp, Homo sapiens
gcaaagtcgccagtcactgct

SEQ ID NO: 743560 - DNA, 11 bp, Homo sapiens
gcaaagttaaa

SEQ ID NO: 743561 - DNA, 19 bp, Homo sapiens
gcaaagtttacagatgttt

SEQ ID NO: 743562 - DNA, 20 bp, Homo sapiens
gcaaagttttacagagagga

SEQ ID NO: 743563 - DNA, 21 bp, Homo sapiens
gcaaataaaacccaatacttt

SEQ ID NO: 743564 - DNA, 19 bp, Homo sapiens
gcaaataaatacgtgtcaa

SEQ ID NO: 743565 - DNA, 21 bp, Homo sapiens
gcaaataatggaaaaatagta

SEQ ID NO: 743566 - DNA, 21 bp, Homo sapiens
tcaagagtccggatttctaac

SEQ ID NO: 743567 - DNA, 23 bp, Homo sapiens
tcaagagtgagatgtagaaagtt

SEQ ID NO: 743568 - DNA, 18 bp, Homo sapiens
tcaagagtggggggagga

SEQ ID NO: 743569 - DNA, 19 bp, Homo sapiens
tcaagagtggggggaggaa

SEQ ID NO: 743570 - DNA, 23 bp, Homo sapiens
tcaagagtggggggaggaagcag

SEQ ID NO: 743571 - DNA, 18 bp, Homo sapiens
tcaagagttcagtgctca

SEQ ID NO: 743572 - DNA, 15 bp, Homo sapiens
tcaagatacctttgc

SEQ ID NO: 743573 - DNA, 19 bp, Homo sapiens
tcaagatatatgtgtatac

SEQ ID NO: 743574 - DNA, 16 bp, Homo sapiens
tcaagatattaaaatg

SEQ ID NO: 743575 - DNA, 16 bp, Homo sapiens
tcaagatcaacattcc

SEQ ID NO: 743576 - DNA, 19 bp, Homo sapiens
tcaagatctaaatcatata

SEQ ID NO: 743577 - DNA, 13 bp, Homo sapiens
tcacaaactgtga

SEQ ID NO: 743578 - DNA, 14 bp, Homo sapiens
tcacaaactgtgaa

SEQ ID NO: 743579 - DNA, 23 bp, Homo sapiens
tcacaaactgtgaaaatagtgta

SEQ ID NO: 743580 - DNA, 17 bp, Homo sapiens
tcacaaacttttatact

SEQ ID NO: 743581 - DNA, 15 bp, Homo sapiens
tcacaaagcccaagg

SEQ ID NO: 743582 - DNA, 17 bp, Homo sapiens
tcacaaagtggaacgaa

SEQ ID NO: 743583 - DNA, 14 bp, Homo sapiens
tcacaaatgtcatt

SEQ ID NO: 743584 - DNA, 23 bp, Homo sapiens
tcacaaattccgattagaccttt

SEQ ID NO: 743585 - DNA, 23 bp, Homo sapiens
tcacaacaactcatttttacaga

SEQ ID NO: 743586 - DNA, 14 bp, Homo sapiens
tcacaacagcctga

SEQ ID NO: 743587 - DNA, 14 bp, Homo sapiens
tcacaacctgaacc

SEQ ID NO: 743588 - DNA, 12 bp, Homo sapiens
tcacaagaacac

SEQ ID NO: 743589 - DNA, 23 bp, Homo sapiens
tcacaagatggaatttatcaaac

SEQ ID NO: 743590 - DNA, 15 bp, Homo sapiens
tcacaagcctcctgt

SEQ ID NO: 743591 - DNA, 23 bp, Homo sapiens
tcacaaggcacaccagtgcaagc

SEQ ID NO: 743592 - DNA, 20 bp, Homo sapiens
tcacaagttgtgtttgatat

SEQ ID NO: 743593 - DNA, 14 bp, Homo sapiens
tcacaataaagttt

SEQ ID NO: 743594 - DNA, 19 bp, Homo sapiens
tcacaatgttgctagtttt

SEQ ID NO: 743595 - DNA, 19 bp, Homo sapiens
tcacaatttaaaatatttc

SEQ ID NO: 743596 - DNA, 20 bp, Homo sapiens
tcacacaaagactccttgtg

SEQ ID NO: 743597 - DNA, 14 bp, Homo sapiens
tcacacacacagct

SEQ ID NO: 743598 - DNA, 19 bp, Homo sapiens
tcacacacacagctgggca

SEQ ID NO: 743599 - DNA, 21 bp, Homo sapiens
tcacacacaggcaactgaggc

SEQ ID NO: 743600 - DNA, 16 bp, Homo sapiens
tcacacaccagcactt

SEQ ID NO: 743601 - DNA, 15 bp, Homo sapiens
tcacacaccctgagg

SEQ ID NO: 743602 - DNA, 23 bp, Homo sapiens
tcacacactcacaatttaaaata

SEQ ID NO: 743603 - DNA, 19 bp, Homo sapiens
tcacacactggaccccact

SEQ ID NO: 743604 - DNA, 17 bp, Homo sapiens
tcacacactttctcttc

SEQ ID NO: 743605 - DNA, 20 bp, Homo sapiens
tcacacaggacccccttccc

SEQ ID NO: 743606 - DNA, 12 bp, Homo sapiens
tcacacagtgtt

SEQ ID NO: 743607 - DNA, 13 bp, Homo sapiens
tcacacagtgtta

SEQ ID NO: 743608 - DNA, 15 bp, Homo sapiens
tcacacatcacattc

SEQ ID NO: 743609 - DNA, 12 bp, Homo sapiens
tcacacatcagc

SEQ ID NO: 743610 - DNA, 17 bp, Homo sapiens
tcacacatccccagcca

SEQ ID NO: 743611 - DNA, 18 bp, Homo sapiens
tcacacatccccagccag

SEQ ID NO: 743612 - DNA, 19 bp, Homo sapiens
tcacacatgcacttttggg

SEQ ID NO: 743613 - DNA, 16 bp, Homo sapiens
tcacaccaaggaagct

SEQ ID NO: 743614 - DNA, 20 bp, Homo sapiens
tcacacccaccgtccgccct

SEQ ID NO: 743615 - DNA, 21 bp, Homo sapiens
tcacacccaccgtccgccctg

SEQ ID NO: 743616 - DNA, 15 bp, Homo sapiens
tcacacccctgtccc

SEQ ID NO: 743617 - DNA, 19 bp, Homo sapiens
tcacacctcacgctctgga

SEQ ID NO: 743618 - DNA, 18 bp, Homo sapiens
tcacacctcagtgggaag

SEQ ID NO: 743619 - DNA, 22 bp, Homo sapiens
tcacacctctgggcttcagggt

SEQ ID NO: 743620 - DNA, 13 bp, Homo sapiens
tcacacctgactc

SEQ ID NO: 743621 - DNA, 17 bp, Homo sapiens
tcacacctgactctgaa

SEQ ID NO: 743622 - DNA, 18 bp, Homo sapiens
tcacacctgactctgaaa

SEQ ID NO: 743623 - DNA, 23 bp, Homo sapiens
tcacacctgactctgaaatctga

SEQ ID NO: 743624 - DNA, 24 bp, Homo sapiens
tcacacctgggcccgggcaggcca

SEQ ID NO: 743625 - DNA, 21 bp, Homo sapiens
tcacactaagagggcagactg

SEQ ID NO: 743626 - DNA, 15 bp, Homo sapiens
tcacactcaaggaca

SEQ ID NO: 743627 - DNA, 12 bp, Homo sapiens
tcacactctctg

SEQ ID NO: 743628 - DNA, 13 bp, Homo sapiens
tcacactctctgc

SEQ ID NO: 743629 - DNA, 22 bp, Homo sapiens
tcacactctctgcagcccagcc

SEQ ID NO: 743630 - DNA, 18 bp, Homo sapiens
tcacactgcaagagcctt

SEQ ID NO: 743631 - DNA, 21 bp, Homo sapiens
tcacactgcaagagccttggt

SEQ ID NO: 743632 - DNA, 18 bp, Homo sapiens
tcacactgcagagactaa

SEQ ID NO: 743633 - DNA, 18 bp, Homo sapiens
tcacactgctgtcctctc

SEQ ID NO: 743634 - DNA, 21 bp, Homo sapiens
tcacactgggtggtggcctgg

SEQ ID NO: 743635 - DNA, 23 bp, Homo sapiens
tcacactgggtggtggcctggtc

SEQ ID NO: 743636 - DNA, 17 bp, Homo sapiens
tcacactggtctgctgt

SEQ ID NO: 743637 - DNA, 17 bp, Homo sapiens
tcacactggtgctgagt

SEQ ID NO: 743638 - DNA, 21 bp, Homo sapiens
tcacactggttctcaatgaaa

SEQ ID NO: 743639 - DNA, 22 bp, Homo sapiens
tcacacttctgtgagaccccca

SEQ ID NO: 743640 - DNA, 22 bp, Homo sapiens
tcacactttttatttaattaaa

SEQ ID NO: 743641 - DNA, 23 bp, Homo sapiens
tcacactttttatttaattaaat

SEQ ID NO: 743642 - DNA, 14 bp, Homo sapiens
tcacagaaaaagca

SEQ ID NO: 743643 - DNA, 20 bp, Homo sapiens
tcacagaaaggcaggtttca

SEQ ID NO: 743644 - DNA, 17 bp, Homo sapiens
tcacagacctctgcttg

SEQ ID NO: 743645 - DNA, 20 bp, Homo sapiens
tcacagacctctgcttggag

SEQ ID NO: 743646 - DNA, 15 bp, Homo sapiens
tcacagacctggagc

SEQ ID NO: 743647 - DNA, 18 bp, Homo sapiens
tcacagacctggagcccc

SEQ ID NO: 743648 - DNA, 20 bp, Homo sapiens
tcacagacctggagcccctg

SEQ ID NO: 743649 - DNA, 18 bp, Homo sapiens
tcacagagcacgcctgcc

SEQ ID NO: 743650 - DNA, 21 bp, Homo sapiens
tcacagagcacgcctgccatc

SEQ ID NO: 743651 - DNA, 12 bp, Homo sapiens
tcacagaggctt

SEQ ID NO: 743652 - DNA, 17 bp, Homo sapiens
tcacagaggcttcttca

SEQ ID NO: 743653 - DNA, 15 bp, Homo sapiens
tcacagagtgtgctg

SEQ ID NO: 743654 - DNA, 13 bp, Homo sapiens
tcacagatattta

SEQ ID NO: 743655 - DNA, 23 bp, Homo sapiens
tcacagcagtgagactggggcca

SEQ ID NO: 743656 - DNA, 16 bp, Homo sapiens
tcacagccacccctga

SEQ ID NO: 743657 - DNA, 11 bp, Homo sapiens
tcacagcccag

SEQ ID NO: 743658 - DNA, 16 bp, Homo sapiens
tcacagcccagaacca

SEQ ID NO: 743659 - DNA, 23 bp, Homo sapiens
tcacagcccgggtgtgcctgccc

SEQ ID NO: 743660 - DNA, 14 bp, Homo sapiens
tcacagcctccagg

SEQ ID NO: 743661 - DNA, 11 bp, Homo sapiens
tcacagctcct

SEQ ID NO: 743662 - DNA, 14 bp, Homo sapiens
tcacagctcctccc

SEQ ID NO: 743663 - DNA, 12 bp, Homo sapiens
tcacagctgcag

SEQ ID NO: 743664 - DNA, 13 bp, Homo sapiens
tcacagctgcagc

SEQ ID NO: 743665 - DNA, 13 bp, Homo sapiens
tcacagctgcttt

SEQ ID NO: 743666 - DNA, 19 bp, Homo sapiens
tcacaggcaaagtccagct

SEQ ID NO: 743667 - DNA, 20 bp, Homo sapiens
tcacaggcagtgcatgtgaa

SEQ ID NO: 743668 - DNA, 19 bp, Homo sapiens
tcacaggccccaggaaagg

SEQ ID NO: 743669 - DNA, 15 bp, Homo sapiens
tcacaggctgagaac

SEQ ID NO: 743670 - DNA, 23 bp, Homo sapiens
tcacaggctgggtcaaaagagcc

SEQ ID NO: 743671 - DNA, 23 bp, Homo sapiens
tcacagggactgaaaacctctcc

SEQ ID NO: 743672 - DNA, 16 bp, Homo sapiens
tcacagggatgctggt

SEQ ID NO: 743673 - DNA, 21 bp, Homo sapiens
tcacagggatgctggtggctg

SEQ ID NO: 743674 - DNA, 17 bp, Homo sapiens
tcacagggcaggccttg

SEQ ID NO: 743675 - DNA, 23 bp, Homo sapiens
tcacagggcaggccttgctgggg

SEQ ID NO: 743676 - DNA, 16 bp, Homo sapiens
tcacagggccccagaa

SEQ ID NO: 743677 - DNA, 15 bp, Homo sapiens
tcacaggggcggggc

SEQ ID NO: 743678 - DNA, 17 bp, Homo sapiens
tcacagggttgggccca

SEQ ID NO: 743679 - DNA, 18 bp, Homo sapiens
tcacagtaaaaataaaat

SEQ ID NO: 743680 - DNA, 20 bp, Homo sapiens
tcacagtaatgcaagcaaag

SEQ ID NO: 743681 - DNA, 15 bp, Homo sapiens
tcacagtagagccag

SEQ ID NO: 743682 - DNA, 16 bp, Homo sapiens
tcacagtagagccagc

SEQ ID NO: 743683 - DNA, 17 bp, Homo sapiens
tcacagtagagccagct

SEQ ID NO: 743684 - DNA, 19 bp, Homo sapiens
tcacagtagagccagcttg

SEQ ID NO: 743685 - DNA, 14 bp, Homo sapiens
tcacagtcctgagt

SEQ ID NO: 743686 - DNA, 18 bp, Homo sapiens
tcacagtctctttaatct

SEQ ID NO: 743687 - DNA, 17 bp, Homo sapiens
tcacagtgctgtgtgcc

SEQ ID NO: 743688 - DNA, 16 bp, Homo sapiens
tcacagtgttatgtag

SEQ ID NO: 743689 - DNA, 23 bp, Homo sapiens
tcacagtgtttgcaatggtgttg

SEQ ID NO: 743690 - DNA, 16 bp, Homo sapiens
tcacagttcaaaattc

SEQ ID NO: 743691 - DNA, 21 bp, Homo sapiens
tcacagttcctcgccctgggt

SEQ ID NO: 743692 - DNA, 12 bp, Homo sapiens
tcacagttctgt

SEQ ID NO: 743693 - DNA, 14 bp, Homo sapiens
tcacagttctgtaa

SEQ ID NO: 743694 - DNA, 15 bp, Homo sapiens
tcacagttctgtaat

SEQ ID NO: 743695 - DNA, 22 bp, Homo sapiens
tcacagttggctggatgaaatt

SEQ ID NO: 743696 - DNA, 21 bp, Homo sapiens
tcacagtttttggttcctctt

SEQ ID NO: 743697 - DNA, 23 bp, Homo sapiens
tcacataaaaaagaagcactttg

SEQ ID NO: 743698 - DNA, 16 bp, Homo sapiens
gcacagctgccctgct

SEQ ID NO: 743699 - DNA, 12 bp, Homo sapiens
gcacagctgctt

SEQ ID NO: 743700 - DNA, 14 bp, Homo sapiens
gcacagctgcttgt

SEQ ID NO: 743701 - DNA, 18 bp, Homo sapiens
gcacagctgggagcctgg

SEQ ID NO: 743702 - DNA, 19 bp, Homo sapiens
gcacagctgggagcctggt

SEQ ID NO: 743703 - DNA, 20 bp, Homo sapiens
gcacagctgtctgccaggca

SEQ ID NO: 743704 - DNA, 22 bp, Homo sapiens
tcacataggaagggatctgaga

SEQ ID NO: 743705 - DNA, 16 bp, Homo sapiens
tcacatagtcctcagg

SEQ ID NO: 743706 - DNA, 22 bp, Homo sapiens
tcacatattttaaaatttgttc

SEQ ID NO: 743707 - DNA, 22 bp, Homo sapiens
tcacatccctgtaaattgcaga

SEQ ID NO: 743708 - DNA, 14 bp, Homo sapiens
tcacatcctcctgc

SEQ ID NO: 743709 - DNA, 16 bp, Homo sapiens
tcacatcctctccagg

SEQ ID NO: 743710 - DNA, 18 bp, Homo sapiens
tcacatcctggcctggca

SEQ ID NO: 743711 - DNA, 18 bp, Homo sapiens
tcacatcctgtgtttcta

SEQ ID NO: 743712 - DNA, 19 bp, Homo sapiens
tcacatcctgtgtttctag

SEQ ID NO: 743713 - DNA, 14 bp, Homo sapiens
tcacatctaaagct

SEQ ID NO: 743714 - DNA, 17 bp, Homo sapiens
tcacatctaaagcttta

SEQ ID NO: 743715 - DNA, 22 bp, Homo sapiens
tcacatctaaagctttatcttt

SEQ ID NO: 743716 - DNA, 15 bp, Homo sapiens
tcacatgaattatta

SEQ ID NO: 743717 - DNA, 16 bp, Homo sapiens
tcacatgaattattac

SEQ ID NO: 743718 - DNA, 22 bp, Homo sapiens
tcacatgaattattacagtgtt

SEQ ID NO: 743719 - DNA, 20 bp, Homo sapiens
tcacatgaccacatagcatg

SEQ ID NO: 743720 - DNA, 18 bp, Homo sapiens
tcacatgctaaagccagg

SEQ ID NO: 743721 - DNA, 15 bp, Homo sapiens
tcacatgtgaaaagc

SEQ ID NO: 743722 - DNA, 16 bp, Homo sapiens
tcacatgtgaaaagct

SEQ ID NO: 743723 - DNA, 19 bp, Homo sapiens
tcacatgtgaaaagcttaa

SEQ ID NO: 743724 - DNA, 19 bp, Homo sapiens
tcacattaatatttgctga

SEQ ID NO: 743725 - DNA, 20 bp, Homo sapiens
tcacattaatctcaaagaga

SEQ ID NO: 743726 - DNA, 15 bp, Homo sapiens
tcacattatttgcat

SEQ ID NO: 743727 - DNA, 13 bp, Homo sapiens
tcacattcaggaa

SEQ ID NO: 743728 - DNA, 22 bp, Homo sapiens
tcacattcctctgcccttcctg

SEQ ID NO: 743729 - DNA, 20 bp, Homo sapiens
tcacattggagtcactgcca

SEQ ID NO: 743730 - DNA, 13 bp, Homo sapiens
tcacattgtttct

SEQ ID NO: 743731 - DNA, 19 bp, Homo sapiens
tcacattgtttgctgctat

SEQ ID NO: 743732 - DNA, 23 bp, Homo sapiens
tcacatttatgtggcttgtttat

SEQ ID NO: 743733 - DNA, 16 bp, Homo sapiens
tcacatttgaattctt

SEQ ID NO: 743734 - DNA, 18 bp, Homo sapiens
tcacatttgaattcttga

SEQ ID NO: 743735 - DNA, 18 bp, Homo sapiens
tcacatttgatgtacatg

SEQ ID NO: 743736 - DNA, 15 bp, Homo sapiens
tcacattttaagtgc

SEQ ID NO: 743737 - DNA, 18 bp, Homo sapiens
tcacattttaagtgcttc

SEQ ID NO: 743738 - DNA, 23 bp, Homo sapiens
tcacattttaagtgcttcacatt

SEQ ID NO: 743739 - DNA, 11 bp, Homo sapiens
tcacattttcc

SEQ ID NO: 743740 - DNA, 17 bp, Homo sapiens
tcacattttgcctttct

SEQ ID NO: 743741 - DNA, 19 bp, Homo sapiens
tcacattttgcctttctcg

SEQ ID NO: 743742 - DNA, 15 bp, Homo sapiens
tcacatttttttcta

SEQ ID NO: 743743 - DNA, 16 bp, Homo sapiens
tcaccaaaatttctac

SEQ ID NO: 743744 - DNA, 19 bp, Homo sapiens
tcaccaaatcagctgctac

SEQ ID NO: 743745 - DNA, 19 bp, Homo sapiens
tcaccaacttgccacatgt

SEQ ID NO: 743746 - DNA, 14 bp, Homo sapiens
tcaccaaggcagtg

SEQ ID NO: 743747 - DNA, 23 bp, Homo sapiens
tcaccaaggcagtgcatgcatgt

SEQ ID NO: 743748 - DNA, 18 bp, Homo sapiens
tcaccacaagctgagcag

SEQ ID NO: 743749 - DNA, 21 bp, Homo sapiens
tcaccacacccaggtctcttc

SEQ ID NO: 743750 - DNA, 10 bp, Homo sapiens
tcaccaccac

SEQ ID NO: 743751 - DNA, 18 bp, Homo sapiens
tcaccaccacccctacca

SEQ ID NO: 743752 - DNA, 13 bp, Homo sapiens
tcaccacccagcc

SEQ ID NO: 743753 - DNA, 15 bp, Homo sapiens
tcaccacccagccct

SEQ ID NO: 743754 - DNA, 16 bp, Homo sapiens
tcaccacccagccctt

SEQ ID NO: 743755 - DNA, 12 bp, Homo sapiens
tcaccaccccct

SEQ ID NO: 743756 - DNA, 20 bp, Homo sapiens
tcaccacgactggccagggc

SEQ ID NO: 743757 - DNA, 13 bp, Homo sapiens
tcaccactcctct

SEQ ID NO: 743758 - DNA, 21 bp, Homo sapiens
tcaccacttcaatagatcaaa

SEQ ID NO: 743759 - DNA, 14 bp, Homo sapiens
tcaccagaatttct

SEQ ID NO: 743760 - DNA, 15 bp, Homo sapiens
tcaccagacggggct

SEQ ID NO: 743761 - DNA, 19 bp, Homo sapiens
tcaccagacggggctggag

SEQ ID NO: 743762 - DNA, 14 bp, Homo sapiens
tcaccagagacttt

SEQ ID NO: 743763 - DNA, 15 bp, Homo sapiens
tcaccagatttgcta

SEQ ID NO: 743764 - DNA, 13 bp, Homo sapiens
tcaccagcaacat

SEQ ID NO: 743765 - DNA, 15 bp, Homo sapiens
tcaccagccccactg

SEQ ID NO: 743766 - DNA, 22 bp, Homo sapiens
tcaccagccccactgccagcag

SEQ ID NO: 743767 - DNA, 16 bp, Homo sapiens
tcaccagccctgcagc

SEQ ID NO: 743768 - DNA, 20 bp, Homo sapiens
tcaccagccctgcagcccac

SEQ ID NO: 743769 - DNA, 17 bp, Homo sapiens
tcaccagctatctgtca

SEQ ID NO: 743770 - DNA, 13 bp, Homo sapiens
tcaccagctcctc

SEQ ID NO: 743771 - DNA, 11 bp, Homo sapiens
tcaccagctgc

SEQ ID NO: 743772 - DNA, 20 bp, Homo sapiens
tcaccagctgctgtgcccca

SEQ ID NO: 743773 - DNA, 15 bp, Homo sapiens
tcaccaggcccacga

SEQ ID NO: 743774 - DNA, 22 bp, Homo sapiens
tcaccagggtccgcaccagctg

SEQ ID NO: 743775 - DNA, 21 bp, Homo sapiens
tcaccaggttaaaattttaat

SEQ ID NO: 743776 - DNA, 21 bp, Homo sapiens
tcaccagtggccttggtcctt

SEQ ID NO: 743777 - DNA, 15 bp, Homo sapiens
tcaccagtggccttt

SEQ ID NO: 743778 - DNA, 17 bp, Homo sapiens
tcaccagtggcctttca

SEQ ID NO: 743779 - DNA, 13 bp, Homo sapiens
tcaccagtgtccc

SEQ ID NO: 743780 - DNA, 17 bp, Homo sapiens
tcaccagtgtcccctcc

SEQ ID NO: 743781 - DNA, 13 bp, Homo sapiens
tcaccagtgttcc

SEQ ID NO: 743782 - DNA, 16 bp, Homo sapiens
tcaccagtgttcctga

SEQ ID NO: 743783 - DNA, 19 bp, Homo sapiens
tcaccatagggctggggac

SEQ ID NO: 743784 - DNA, 22 bp, Homo sapiens
tcaccatcagcaggctccagtt

SEQ ID NO: 743785 - DNA, 14 bp, Homo sapiens
tcaccatcctcaga

SEQ ID NO: 743786 - DNA, 15 bp, Homo sapiens
tcaccatcctcagag

SEQ ID NO: 743787 - DNA, 17 bp, Homo sapiens
tcaccatctcaggccac

SEQ ID NO: 743788 - DNA, 23 bp, Homo sapiens
tcaccatctcaggccacctgccc

SEQ ID NO: 743789 - DNA, 15 bp, Homo sapiens
tcaccatgatgtgaa

SEQ ID NO: 743790 - DNA, 11 bp, Homo sapiens
tcaccatggcc

SEQ ID NO: 743791 - DNA, 21 bp, Homo sapiens
tcaccatgggaggtggggcct

SEQ ID NO: 743792 - DNA, 21 bp, Homo sapiens
tcaccatgtaagcactctgga

SEQ ID NO: 743793 - DNA, 13 bp, Homo sapiens
tcaccatgttagc

SEQ ID NO: 743794 - DNA, 18 bp, Homo sapiens
tcaccatgttagccttag

SEQ ID NO: 743795 - DNA, 19 bp, Homo sapiens
tcaccatgttggccaggct

SEQ ID NO: 743796 - DNA, 20 bp, Homo sapiens
tcaccatgttggccaggctg

SEQ ID NO: 743797 - DNA, 15 bp, Homo sapiens
tcaccatttcctcct

SEQ ID NO: 743798 - DNA, 22 bp, Homo sapiens
tcaccatttgattatgtagcaa

SEQ ID NO: 743799 - DNA, 16 bp, Homo sapiens
tcacccaaacacttct

SEQ ID NO: 743800 - DNA, 20 bp, Homo sapiens
tcacccaaacacttctgctt

SEQ ID NO: 743801 - DNA, 14 bp, Homo sapiens
tcacccacagggct

SEQ ID NO: 743802 - DNA, 13 bp, Homo sapiens
tcacccaccagct

SEQ ID NO: 743803 - DNA, 15 bp, Homo sapiens
tcacccaccagctcc

SEQ ID NO: 743804 - DNA, 16 bp, Homo sapiens
tcacccaccagctcca

SEQ ID NO: 743805 - DNA, 16 bp, Homo sapiens
tcacccactctggtgg

SEQ ID NO: 743806 - DNA, 17 bp, Homo sapiens
tcacccactctggtggc

SEQ ID NO: 743807 - DNA, 12 bp, Homo sapiens
tcacccagagca

SEQ ID NO: 743808 - DNA, 20 bp, Homo sapiens
tcacccagagcacaggagct

SEQ ID NO: 743809 - DNA, 23 bp, Homo sapiens
tcaccccaatccctgccactggg

SEQ ID NO: 743810 - DNA, 21 bp, Homo sapiens
tcaccccagaggacacaggca

SEQ ID NO: 743811 - DNA, 18 bp, Homo sapiens
tcaccccagaggccttgt

SEQ ID NO: 743812 - DNA, 16 bp, Homo sapiens
tcaccccagcctcatt

SEQ ID NO: 743813 - DNA, 12 bp, Homo sapiens
tcaccccagctc

SEQ ID NO: 743814 - DNA, 13 bp, Homo sapiens
tcaccccatccca

SEQ ID NO: 743815 - DNA, 12 bp, Homo sapiens
tcacccccaact

SEQ ID NO: 743816 - DNA, 22 bp, Homo sapiens
tcacccccaacttcaccacccc

SEQ ID NO: 743817 - DNA, 14 bp, Homo sapiens
tcacccccacttcc

SEQ ID NO: 743818 - DNA, 18 bp, Homo sapiens
tcaccccccactcaccag

SEQ ID NO: 743819 - DNA, 17 bp, Homo sapiens
tcaccccctcccacccc

SEQ ID NO: 743820 - DNA, 14 bp, Homo sapiens
gcacctgcctcagg

SEQ ID NO: 743821 - DNA, 21 bp, Homo sapiens
gcacctgctgcgtccccactc

SEQ ID NO: 743822 - DNA, 11 bp, Homo sapiens
gcacctgctgg

SEQ ID NO: 743823 - DNA, 12 bp, Homo sapiens
gcacctgctgga

SEQ ID NO: 743824 - DNA, 23 bp, Homo sapiens
gcacctgctggaaaccacacttc

SEQ ID NO: 743825 - DNA, 15 bp, Homo sapiens
gcacctgcttccacc

SEQ ID NO: 743826 - DNA, 19 bp, Homo sapiens
gcacctggaccccctgccc

SEQ ID NO: 743827 - DNA, 18 bp, Homo sapiens
gcacctggcatcgcacca

SEQ ID NO: 743828 - DNA, 12 bp, Homo sapiens
gcacctggcctg

SEQ ID NO: 743829 - DNA, 14 bp, Homo sapiens
gcacctggcctgct

SEQ ID NO: 743830 - DNA, 15 bp, Homo sapiens
gcacctggcctgctg

SEQ ID NO: 743831 - DNA, 18 bp, Homo sapiens
gcacctggcctgctggga

SEQ ID NO: 743832 - DNA, 17 bp, Homo sapiens
gcacctggcctgggcca

SEQ ID NO: 743833 - DNA, 18 bp, Homo sapiens
gcacctggcctgggccac

SEQ ID NO: 743834 - DNA, 20 bp, Homo sapiens
gcacctggcctgggccacac

SEQ ID NO: 743835 - DNA, 20 bp, Homo sapiens
gcacctggctgagcctggct

SEQ ID NO: 743836 - DNA, 21 bp, Homo sapiens
gcacctggctgagcctggctg

SEQ ID NO: 743837 - DNA, 14 bp, Homo sapiens
gcacctgggcagct

SEQ ID NO: 743838 - DNA, 12 bp, Homo sapiens
tcacgtgtgtga

SEQ ID NO: 743839 - DNA, 17 bp, Homo sapiens
tcacgtgtgtgactcag

SEQ ID NO: 743840 - DNA, 17 bp, Homo sapiens
tcacgttagaggaaaaa

SEQ ID NO: 743841 - DNA, 15 bp, Homo sapiens
tcacgtttcttcccc

SEQ ID NO: 743842 - DNA, 17 bp, Homo sapiens
tcactaaacaagaaatc

SEQ ID NO: 743843 - DNA, 15 bp, Homo sapiens
tcactaaactttatt

SEQ ID NO: 743844 - DNA, 16 bp, Homo sapiens
tcactaaatgtaaaat

SEQ ID NO: 743845 - DNA, 16 bp, Homo sapiens
tcactaatcttgaatg

SEQ ID NO: 743846 - DNA, 22 bp, Homo sapiens
tcactacccatcggtgtccatt

SEQ ID NO: 743847 - DNA, 22 bp, Homo sapiens
tcactacgggggggagaaggaa

SEQ ID NO: 743848 - DNA, 15 bp, Homo sapiens
tcactactgaacaca

SEQ ID NO: 743849 - DNA, 12 bp, Homo sapiens
tcactactgtat

SEQ ID NO: 743850 - DNA, 15 bp, Homo sapiens
tcactagaagaaaag

SEQ ID NO: 743851 - DNA, 17 bp, Homo sapiens
tcactagaagtcctgct

SEQ ID NO: 743852 - DNA, 21 bp, Homo sapiens
tcactagagacaaatctttaa

SEQ ID NO: 743853 - DNA, 17 bp, Homo sapiens
tcactagatggcgagca

SEQ ID NO: 743854 - DNA, 14 bp, Homo sapiens
tcactagccatgat

SEQ ID NO: 743855 - DNA, 18 bp, Homo sapiens
tcactagccctccttttt

SEQ ID NO: 743856 - DNA, 21 bp, Homo sapiens
tcactagccctcctttttcca

SEQ ID NO: 743857 - DNA, 20 bp, Homo sapiens
tcactaggaaaatcatgtgc

SEQ ID NO: 743858 - DNA, 13 bp, Homo sapiens
tcactagggctga

SEQ ID NO: 743859 - DNA, 14 bp, Homo sapiens
tcactaggtaactt

SEQ ID NO: 743860 - DNA, 20 bp, Homo sapiens
tcactagtgaccccttccct

SEQ ID NO: 743861 - DNA, 23 bp, Homo sapiens
tcactagtgccaatgatgtgacc

SEQ ID NO: 743862 - DNA, 13 bp, Homo sapiens
tcactatgcattt

SEQ ID NO: 743863 - DNA, 13 bp, Homo sapiens
tcactatggtatg

SEQ ID NO: 743864 - DNA, 17 bp, Homo sapiens
tcactatggtatgctgg

SEQ ID NO: 743865 - DNA, 21 bp, Homo sapiens
tcactatggtatgctggccag

SEQ ID NO: 743866 - DNA, 22 bp, Homo sapiens
tcactatggtatgctggccagc

SEQ ID NO: 743867 - DNA, 13 bp, Homo sapiens
tcactattcctat

SEQ ID NO: 743868 - DNA, 16 bp, Homo sapiens
tcactattcttaagca

SEQ ID NO: 743869 - DNA, 21 bp, Homo sapiens
tcactattcttggaccatgcc

SEQ ID NO: 743870 - DNA, 13 bp, Homo sapiens
tcactatttcctt

SEQ ID NO: 743871 - DNA, 19 bp, Homo sapiens
tcactatttcctttataat

SEQ ID NO: 743872 - DNA, 18 bp, Homo sapiens
tcactatttttatttata

SEQ ID NO: 743873 - DNA, 18 bp, Homo sapiens
tcactcacaagcaatcca

SEQ ID NO: 743874 - DNA, 16 bp, Homo sapiens
tcactcaccactacca

SEQ ID NO: 743875 - DNA, 17 bp, Homo sapiens
tcactcactcactcatt

SEQ ID NO: 743876 - DNA, 17 bp, Homo sapiens
tcactcactcactccaa

SEQ ID NO: 743877 - DNA, 15 bp, Homo sapiens
tcactcactcattcc

SEQ ID NO: 743878 - DNA, 16 bp, Homo sapiens
tcactcactccaagac

SEQ ID NO: 743879 - DNA, 16 bp, Homo sapiens
tcactcactccccact

SEQ ID NO: 743880 - DNA, 14 bp, Homo sapiens
tcactcactgaggc

SEQ ID NO: 743881 - DNA, 17 bp, Homo sapiens
tcactcactgaggccat

SEQ ID NO: 743882 - DNA, 14 bp, Homo sapiens
tcactcagccccta

SEQ ID NO: 743883 - DNA, 19 bp, Homo sapiens
tcactcatgcaaactgctt

SEQ ID NO: 743884 - DNA, 21 bp, Homo sapiens
tcactcatgcaaactgcttta

SEQ ID NO: 743885 - DNA, 18 bp, Homo sapiens
tcactcattgctgagcct

SEQ ID NO: 743886 - DNA, 20 bp, Homo sapiens
tcactcattgctgagcctct

SEQ ID NO: 743887 - DNA, 22 bp, Homo sapiens
tcactcattgctgagcctctgc

SEQ ID NO: 743888 - DNA, 18 bp, Homo sapiens
tcactccaagaccaccag

SEQ ID NO: 743889 - DNA, 20 bp, Homo sapiens
tcactccaagaccaccaggg

SEQ ID NO: 743890 - DNA, 14 bp, Homo sapiens
tcactccaccaccc

SEQ ID NO: 743891 - DNA, 15 bp, Homo sapiens
tcactccaccaccca

SEQ ID NO: 743892 - DNA, 17 bp, Homo sapiens
tcactccaccatcccca

SEQ ID NO: 743893 - DNA, 19 bp, Homo sapiens
tcactccaccatccccacc

SEQ ID NO: 743894 - DNA, 14 bp, Homo sapiens
tcactccagcctgg

SEQ ID NO: 743895 - DNA, 15 bp, Homo sapiens
tcactccagtagctc

SEQ ID NO: 743896 - DNA, 19 bp, Homo sapiens
tcactccagtagctcctgg

SEQ ID NO: 743897 - DNA, 19 bp, Homo sapiens
tcactcccaagggacagca

SEQ ID NO: 743898 - DNA, 14 bp, Homo sapiens
tcactccctcttgg

SEQ ID NO: 743899 - DNA, 23 bp, Homo sapiens
tcactccctcttggtttttatca

SEQ ID NO: 743900 - DNA, 17 bp, Homo sapiens
tcactccggtgtgcctg

SEQ ID NO: 743901 - DNA, 23 bp, Homo sapiens
tcactccggtgtgcctgcagccc

SEQ ID NO: 743902 - DNA, 13 bp, Homo sapiens
tcactcctctcta

SEQ ID NO: 743903 - DNA, 12 bp, Homo sapiens
tcactcctgaat

SEQ ID NO: 743904 - DNA, 20 bp, Homo sapiens
tcactcctgcgctgacaagg

SEQ ID NO: 743905 - DNA, 15 bp, Homo sapiens
tcactcctgcttctc

SEQ ID NO: 743906 - DNA, 17 bp, Homo sapiens
tcactcctgcttctctc

SEQ ID NO: 743907 - DNA, 20 bp, Homo sapiens
tcactcctgcttctctcagc

SEQ ID NO: 743908 - DNA, 13 bp, Homo sapiens
tcactcctggagg

SEQ ID NO: 743909 - DNA, 12 bp, Homo sapiens
tcactcctgggg

SEQ ID NO: 743910 - DNA, 22 bp, Homo sapiens
tcactcgcaggaccaagggggc

SEQ ID NO: 743911 - DNA, 14 bp, Homo sapiens
tcactcggcaccct

SEQ ID NO: 743912 - DNA, 20 bp, Homo sapiens
tcactctaagtcatgtatgt

SEQ ID NO: 743913 - DNA, 21 bp, Homo sapiens
tcactctaattaattgtaatc

SEQ ID NO: 743914 - DNA, 19 bp, Homo sapiens
tcactctacttagcatgtc

SEQ ID NO: 743915 - DNA, 20 bp, Homo sapiens
tcactctacttagcatgtcc

SEQ ID NO: 743916 - DNA, 11 bp, Homo sapiens
tcactctgccc

SEQ ID NO: 743917 - DNA, 17 bp, Homo sapiens
tcactctgccctctgct

SEQ ID NO: 743918 - DNA, 13 bp, Homo sapiens
tcactctgctgct

SEQ ID NO: 743919 - DNA, 12 bp, Homo sapiens
tcactctgggct

SEQ ID NO: 743920 - DNA, 18 bp, Homo sapiens
tcactctgtccctgtcct

SEQ ID NO: 743921 - DNA, 13 bp, Homo sapiens
tcactctgtcgct

SEQ ID NO: 743922 - DNA, 14 bp, Homo sapiens
tcactcttcctcat

SEQ ID NO: 743923 - DNA, 20 bp, Homo sapiens
tcactcttcctcatcctgct

SEQ ID NO: 743924 - DNA, 23 bp, Homo sapiens
tcactcttcctcatcctgcttct

SEQ ID NO: 743925 - DNA, 11 bp, Homo sapiens
tcactcttggt

SEQ ID NO: 743926 - DNA, 12 bp, Homo sapiens
tcactcttggtc

SEQ ID NO: 743927 - DNA, 16 bp, Homo sapiens
tcactctttacatggt

SEQ ID NO: 743928 - DNA, 21 bp, Homo sapiens
tcactctttacatggtggtga

SEQ ID NO: 743929 - DNA, 15 bp, Homo sapiens
tcactgaaatgtttg

SEQ ID NO: 743930 - DNA, 23 bp, Homo sapiens
tcactgaacaaactaaaggtgca

SEQ ID NO: 743931 - DNA, 22 bp, Homo sapiens
tcactgaacatgcctagtccaa

SEQ ID NO: 743932 - DNA, 21 bp, Homo sapiens
tcactgaaccactgcttctct

SEQ ID NO: 743933 - DNA, 22 bp, Homo sapiens
tcactgaaccactgcttctctt

SEQ ID NO: 743934 - DNA, 17 bp, Homo sapiens
tcactgaactccaccga

SEQ ID NO: 743935 - DNA, 15 bp, Homo sapiens
tcactgaatcttcac

SEQ ID NO: 743936 - DNA, 22 bp, Homo sapiens
tcactgaatgcctcaatgtgac

SEQ ID NO: 743937 - DNA, 19 bp, Homo sapiens
tcactgacacaaaaagtag

SEQ ID NO: 743938 - DNA, 20 bp, Homo sapiens
tcactgaccctaactgcaga

SEQ ID NO: 743939 - DNA, 23 bp, Homo sapiens
tcactgagcacagtcaggggctg

SEQ ID NO: 743940 - DNA, 16 bp, Homo sapiens
tcactgagccatcatt

SEQ ID NO: 743941 - DNA, 20 bp, Homo sapiens
tcactgagccatcatttcct

SEQ ID NO: 743942 - DNA, 16 bp, Homo sapiens
gcactttaattgaaga

SEQ ID NO: 743943 - DNA, 11 bp, Homo sapiens
gcactttagac

SEQ ID NO: 743944 - DNA, 22 bp, Homo sapiens
gcactttatacacttctggctc

SEQ ID NO: 743945 - DNA, 23 bp, Homo sapiens
gcactttccacttcttcctttct

SEQ ID NO: 743946 - DNA, 20 bp, Homo sapiens
gcactttctatcctctgtaa

SEQ ID NO: 743947 - DNA, 12 bp, Homo sapiens
gcactttgaaaa

SEQ ID NO: 743948 - DNA, 18 bp, Homo sapiens
gcactttgctcaaaattt

SEQ ID NO: 743949 - DNA, 17 bp, Homo sapiens
gcactttgggaggccaa

SEQ ID NO: 743950 - DNA, 17 bp, Homo sapiens
gcactttgggaggctga

SEQ ID NO: 743951 - DNA, 21 bp, Homo sapiens
gcactttgggaggctgaggcg

SEQ ID NO: 743952 - DNA, 18 bp, Homo sapiens
gcacttttaaaaaaattt

SEQ ID NO: 743953 - DNA, 14 bp, Homo sapiens
gcacttttagaaat

SEQ ID NO: 743954 - DNA, 15 bp, Homo sapiens
gcacttttgggcctt

SEQ ID NO: 743955 - DNA, 20 bp, Homo sapiens
gcacttttttatgaagaaaa

SEQ ID NO: 743956 - DNA, 14 bp, Homo sapiens
gcagaaaagaggag

SEQ ID NO: 743957 - DNA, 15 bp, Homo sapiens
gcagaaaagaggaga

SEQ ID NO: 743958 - DNA, 16 bp, Homo sapiens
gcagaaaagaggagac

SEQ ID NO: 743959 - DNA, 15 bp, Homo sapiens
gcagaaaagcacctg

SEQ ID NO: 743960 - DNA, 18 bp, Homo sapiens
gcagaaaataaaggaagc

SEQ ID NO: 743961 - DNA, 22 bp, Homo sapiens
gcagaaaatcttttactagtgt

SEQ ID NO: 743962 - DNA, 17 bp, Homo sapiens
gcagaaaattctgtgcc

SEQ ID NO: 743963 - DNA, 14 bp, Homo sapiens
gcagaaagtgcctt

SEQ ID NO: 743964 - DNA, 12 bp, Homo sapiens
gcagaacaaatg

SEQ ID NO: 743965 - DNA, 13 bp, Homo sapiens
gcagaacacctgg

SEQ ID NO: 743966 - DNA, 15 bp, Homo sapiens
gcagaacacctggcc

SEQ ID NO: 743967 - DNA, 18 bp, Homo sapiens
gcagaacagccgctcctg

SEQ ID NO: 743968 - DNA, 15 bp, Homo sapiens
gcagaacctgcacac

SEQ ID NO: 743969 - DNA, 18 bp, Homo sapiens
gcagaacctgcacacagg

SEQ ID NO: 743970 - DNA, 19 bp, Homo sapiens
gcagaacggaggaggctgc

SEQ ID NO: 743971 - DNA, 17 bp, Homo sapiens
gcagaagaaagggtgga

SEQ ID NO: 743972 - DNA, 21 bp, Homo sapiens
gcagaagaattgaacccagga

SEQ ID NO: 743973 - DNA, 13 bp, Homo sapiens
tcacttttttctt

SEQ ID NO: 743974 - DNA, 19 bp, Homo sapiens
tcactttttttttttttcc

SEQ ID NO: 743975 - DNA, 14 bp, Homo sapiens
tcagaaaacagaga

SEQ ID NO: 743976 - DNA, 17 bp, Homo sapiens
tcagaaaagtaattttg

SEQ ID NO: 743977 - DNA, 22 bp, Homo sapiens
tcagaaaagtaattttgtcaca

SEQ ID NO: 743978 - DNA, 17 bp, Homo sapiens
tcagaaaataacagatg

SEQ ID NO: 743979 - DNA, 19 bp, Homo sapiens
tcagaaaatgttctgtttg

SEQ ID NO: 743980 - DNA, 14 bp, Homo sapiens
tcagaaacagggca

SEQ ID NO: 743981 - DNA, 15 bp, Homo sapiens
tcagaaacagggcag

SEQ ID NO: 743982 - DNA, 17 bp, Homo sapiens
tcagaaacagggcagca

SEQ ID NO: 743983 - DNA, 21 bp, Homo sapiens
tcagaaacagggcagcagtgg

SEQ ID NO: 743984 - DNA, 22 bp, Homo sapiens
tcagaaacagggcagcagtggg

SEQ ID NO: 743985 - DNA, 19 bp, Homo sapiens
tcagaaacatgaaatgctt

SEQ ID NO: 743986 - DNA, 13 bp, Homo sapiens
tcagaaaccagtt

SEQ ID NO: 743987 - DNA, 20 bp, Homo sapiens
tcagaaacccggcttcctgt

SEQ ID NO: 743988 - DNA, 22 bp, Homo sapiens
tcagaaacgagatcgggaagca

SEQ ID NO: 743989 - DNA, 16 bp, Homo sapiens
tcagaaactagaaatg

SEQ ID NO: 743990 - DNA, 17 bp, Homo sapiens
tcagaaacttgtgaagt

SEQ ID NO: 743991 - DNA, 12 bp, Homo sapiens
tcagaaaggaat

SEQ ID NO: 743992 - DNA, 14 bp, Homo sapiens
tcagaaaggatttt

SEQ ID NO: 743993 - DNA, 20 bp, Homo sapiens
tcagaaaggggctcttctga

SEQ ID NO: 743994 - DNA, 13 bp, Homo sapiens
tcagaaagtaaca

SEQ ID NO: 743995 - DNA, 10 bp, Homo sapiens
tcagaaatgt

SEQ ID NO: 743996 - DNA, 15 bp, Homo sapiens
tcagaaatgtgttat

SEQ ID NO: 743997 - DNA, 16 bp, Homo sapiens
tcagaaattggaacag

SEQ ID NO: 743998 - DNA, 12 bp, Homo sapiens
tcagaacaactt

SEQ ID NO: 743999 - DNA, 20 bp, Homo sapiens
tcagaacacacagactttct

SEQ ID NO: 744000 - DNA, 20 bp, Homo sapiens
tcagaacagatgctgagcca

SEQ ID NO: 744001 - DNA, 14 bp, Homo sapiens
tcagaacagcagac

SEQ ID NO: 744002 - DNA, 22 bp, Homo sapiens
tcagaaccatccatagtagtat

SEQ ID NO: 744003 - DNA, 12 bp, Homo sapiens
tcagaacccagg

SEQ ID NO: 744004 - DNA, 20 bp, Homo sapiens
tcagaacccagggctctgcc

SEQ ID NO: 744005 - DNA, 22 bp, Homo sapiens
tcagaacccagggctctgcccc

SEQ ID NO: 744006 - DNA, 23 bp, Homo sapiens
tcagaacccagggctctgcccca

SEQ ID NO: 744007 - DNA, 15 bp, Homo sapiens
tcagaacctcttccc

SEQ ID NO: 744008 - DNA, 21 bp, Homo sapiens
tcagaacctgttattttatgt

SEQ ID NO: 744009 - DNA, 14 bp, Homo sapiens
tcagaactaaattt

SEQ ID NO: 744010 - DNA, 18 bp, Homo sapiens
tcagaactaaatttttca

SEQ ID NO: 744011 - DNA, 19 bp, Homo sapiens
tcagaactatttaaaataa

SEQ ID NO: 744012 - DNA, 12 bp, Homo sapiens
tcagaactgccc

SEQ ID NO: 744013 - DNA, 23 bp, Homo sapiens
tcagaactgtcccatccccaggt

SEQ ID NO: 744014 - DNA, 15 bp, Homo sapiens
tcagaactgtgccac

SEQ ID NO: 744015 - DNA, 16 bp, Homo sapiens
tcagaacttgctgctg

SEQ ID NO: 744016 - DNA, 13 bp, Homo sapiens
tcagaagaaaaag

SEQ ID NO: 744017 - DNA, 16 bp, Homo sapiens
tcagaagaaaaagaag

SEQ ID NO: 744018 - DNA, 12 bp, Homo sapiens
tcagaagaaaga

SEQ ID NO: 744019 - DNA, 12 bp, Homo sapiens
tcagaagaaatt

SEQ ID NO: 744020 - DNA, 18 bp, Homo sapiens
tcagaagaagtgggagca

SEQ ID NO: 744021 - DNA, 21 bp, Homo sapiens
tcagaagaagtgggagcagct

SEQ ID NO: 744022 - DNA, 17 bp, Homo sapiens
tcagaagagaaatacag

SEQ ID NO: 744023 - DNA, 13 bp, Homo sapiens
tcagaagagcagc

SEQ ID NO: 744024 - DNA, 14 bp, Homo sapiens
tcagaagataactt

SEQ ID NO: 744025 - DNA, 14 bp, Homo sapiens
tcagaagcaaacaa

SEQ ID NO: 744026 - DNA, 16 bp, Homo sapiens
tcagaagcaagccaga

SEQ ID NO: 744027 - DNA, 22 bp, Homo sapiens
tcagaagcctccaagcctgcct

SEQ ID NO: 744028 - DNA, 19 bp, Homo sapiens
tcagaagcttctgaaaaca

SEQ ID NO: 744029 - DNA, 14 bp, Homo sapiens
tcagaaggagaagg

SEQ ID NO: 744030 - DNA, 16 bp, Homo sapiens
tcagaaggagaaggaa

SEQ ID NO: 744031 - DNA, 19 bp, Homo sapiens
tcagaaggccccagagaga

SEQ ID NO: 744032 - DNA, 20 bp, Homo sapiens
tcagaaggccccagagagac

SEQ ID NO: 744033 - DNA, 16 bp, Homo sapiens
tcagaagtatatctgt

SEQ ID NO: 744034 - DNA, 19 bp, Homo sapiens
tcagaagtgagctttgctg

SEQ ID NO: 744035 - DNA, 17 bp, Homo sapiens
tcagaagtgatttagtt

SEQ ID NO: 744036 - DNA, 19 bp, Homo sapiens
tcagaataaattgatcctt

SEQ ID NO: 744037 - DNA, 21 bp, Homo sapiens
tcagaataaggcaggcattga

SEQ ID NO: 744038 - DNA, 17 bp, Homo sapiens
tcagaataggaaaacat

SEQ ID NO: 744039 - DNA, 18 bp, Homo sapiens
tcagaataggaaaacatt

SEQ ID NO: 744040 - DNA, 19 bp, Homo sapiens
tcagaatataacatgtaaa

SEQ ID NO: 744041 - DNA, 20 bp, Homo sapiens
tcagaatataacatgtaaaa

SEQ ID NO: 744042 - DNA, 18 bp, Homo sapiens
tcagaatattgtctgcct

SEQ ID NO: 744043 - DNA, 16 bp, Homo sapiens
tcagaatcatggagaa

SEQ ID NO: 744044 - DNA, 18 bp, Homo sapiens
tcagaatctaaacgtggt

SEQ ID NO: 744045 - DNA, 20 bp, Homo sapiens
tcagaatgaaccctcctcct

SEQ ID NO: 744046 - DNA, 22 bp, Homo sapiens
tcagaatgaaccctcctccttt

SEQ ID NO: 744047 - DNA, 19 bp, Homo sapiens
tcagaatggaatccatctg

SEQ ID NO: 744048 - DNA, 23 bp, Homo sapiens
tcagaatggaatccatctgtctc

SEQ ID NO: 744049 - DNA, 14 bp, Homo sapiens
tcagaatgggggct

SEQ ID NO: 744050 - DNA, 17 bp, Homo sapiens
tcagaatgggggctttc

SEQ ID NO: 744051 - DNA, 14 bp, Homo sapiens
tcagaatgtcattt

SEQ ID NO: 744052 - DNA, 16 bp, Homo sapiens
tcagaattaagcagaa

SEQ ID NO: 744053 - DNA, 19 bp, Homo sapiens
tcagaattcggtgtgctgc

SEQ ID NO: 744054 - DNA, 16 bp, Homo sapiens
tcagaattctctagtt

SEQ ID NO: 744055 - DNA, 11 bp, Homo sapiens
tcagacaagca

SEQ ID NO: 744056 - DNA, 13 bp, Homo sapiens
tcagacaagcact

SEQ ID NO: 744057 - DNA, 22 bp, Homo sapiens
tcagacaagcactattttatat

SEQ ID NO: 744058 - DNA, 20 bp, Homo sapiens
tcagacaagtgttttggaaa

SEQ ID NO: 744059 - DNA, 18 bp, Homo sapiens
tcagacaataccactggt

SEQ ID NO: 744060 - DNA, 12 bp, Homo sapiens
tcagacacagct

SEQ ID NO: 744061 - DNA, 13 bp, Homo sapiens
tcagacacagctc

SEQ ID NO: 744062 - DNA, 14 bp, Homo sapiens
tcagacacagctct

SEQ ID NO: 744063 - DNA, 19 bp, Homo sapiens
tcagacacaggaaaaataa

SEQ ID NO: 744064 - DNA, 15 bp, Homo sapiens
tcagacaccctcaac

SEQ ID NO: 744065 - DNA, 13 bp, Homo sapiens
tcagccacactgg

SEQ ID NO: 744066 - DNA, 14 bp, Homo sapiens
tcagccacactggg

SEQ ID NO: 744067 - DNA, 20 bp, Homo sapiens
tcagccacactgggcctgga

SEQ ID NO: 744068 - DNA, 19 bp, Homo sapiens
tcagccaccctgaggcctc

SEQ ID NO: 744069 - DNA, 16 bp, Homo sapiens
tcagccaccctgagtt

SEQ ID NO: 744070 - DNA, 14 bp, Homo sapiens
tcagccacctggga

SEQ ID NO: 744071 - DNA, 18 bp, Homo sapiens
tcagccagccgccctggg

SEQ ID NO: 744072 - DNA, 23 bp, Homo sapiens
tcagccagccgccctgggctgtc

SEQ ID NO: 744073 - DNA, 16 bp, Homo sapiens
tcagccagctgtttaa

SEQ ID NO: 744074 - DNA, 15 bp, Homo sapiens
tcagccagcttaaac

SEQ ID NO: 744075 - DNA, 16 bp, Homo sapiens
tcagccaggctgctaa

SEQ ID NO: 744076 - DNA, 14 bp, Homo sapiens
tcagccagggccag

SEQ ID NO: 744077 - DNA, 16 bp, Homo sapiens
tcagccagggccaggg

SEQ ID NO: 744078 - DNA, 18 bp, Homo sapiens
tcagccagtctcagatgc

SEQ ID NO: 744079 - DNA, 20 bp, Homo sapiens
tcagccagtgaatctgtttc

SEQ ID NO: 744080 - DNA, 16 bp, Homo sapiens
tcagccatcagccatg

SEQ ID NO: 744081 - DNA, 18 bp, Homo sapiens
tcagccatcgtcctggga

SEQ ID NO: 744082 - DNA, 19 bp, Homo sapiens
tcagccatgataagaacag

SEQ ID NO: 744083 - DNA, 20 bp, Homo sapiens
tcagccatgataagaacaga

SEQ ID NO: 744084 - DNA, 20 bp, Homo sapiens
tcagccatgggaacctcata

SEQ ID NO: 744085 - DNA, 17 bp, Homo sapiens
tcagccattaaaataaa

SEQ ID NO: 744086 - DNA, 18 bp, Homo sapiens
tcagccattaaaataaaa

SEQ ID NO: 744087 - DNA, 21 bp, Homo sapiens
tcagccattaaaataaaacaa

SEQ ID NO: 744088 - DNA, 16 bp, Homo sapiens
tcagccattcactgcc

SEQ ID NO: 744089 - DNA, 16 bp, Homo sapiens
tcagccatttccccct

SEQ ID NO: 744090 - DNA, 18 bp, Homo sapiens
tcagccatttgccatcac

SEQ ID NO: 744091 - DNA, 13 bp, Homo sapiens
tcagcccaccccc

SEQ ID NO: 744092 - DNA, 14 bp, Homo sapiens
tcagcccaccctcc

SEQ ID NO: 744093 - DNA, 18 bp, Homo sapiens
tcagccccaagggctggg

SEQ ID NO: 744094 - DNA, 17 bp, Homo sapiens
tcagccccacaggactt

SEQ ID NO: 744095 - DNA, 13 bp, Homo sapiens
tcagccccatcgc

SEQ ID NO: 744096 - DNA, 15 bp, Homo sapiens
tcagcccccaccagg

SEQ ID NO: 744097 - DNA, 13 bp, Homo sapiens
tcagcccccagcc

SEQ ID NO: 744098 - DNA, 14 bp, Homo sapiens
tcagcccccaggat

SEQ ID NO: 744099 - DNA, 20 bp, Homo sapiens
tcagcccccaggatctgggt

SEQ ID NO: 744100 - DNA, 21 bp, Homo sapiens
tcagcccccaggatctgggtt

SEQ ID NO: 744101 - DNA, 15 bp, Homo sapiens
tcagcccccaggcca

SEQ ID NO: 744102 - DNA, 21 bp, Homo sapiens
tcagccccgacttcctgactc

SEQ ID NO: 744103 - DNA, 19 bp, Homo sapiens
tcagccccgagctgtcccc

SEQ ID NO: 744104 - DNA, 14 bp, Homo sapiens
tcagccccgcctgt

SEQ ID NO: 744105 - DNA, 18 bp, Homo sapiens
tcagccccgcctgtcaca

SEQ ID NO: 744106 - DNA, 16 bp, Homo sapiens
tcagcccctaggagta

SEQ ID NO: 744107 - DNA, 15 bp, Homo sapiens
tcagcccctcctctg

SEQ ID NO: 744108 - DNA, 17 bp, Homo sapiens
tcagcccctcctctgcc

SEQ ID NO: 744109 - DNA, 16 bp, Homo sapiens
tcagcccctcttccct

SEQ ID NO: 744110 - DNA, 21 bp, Homo sapiens
gcagcagtgagtctcttcaga

SEQ ID NO: 744111 - DNA, 14 bp, Homo sapiens
gcagcagtggggtg

SEQ ID NO: 744112 - DNA, 15 bp, Homo sapiens
gcagcatctgctaat

SEQ ID NO: 744113 - DNA, 15 bp, Homo sapiens
gcagcatcttcaaac

SEQ ID NO: 744114 - DNA, 13 bp, Homo sapiens
gcagcatgagact

SEQ ID NO: 744115 - DNA, 23 bp, Homo sapiens
gcagcatgcttgggctgacccag

SEQ ID NO: 744116 - DNA, 12 bp, Homo sapiens
gcagcatggaaa

SEQ ID NO: 744117 - DNA, 17 bp, Homo sapiens
gcagcatggaaaaatgg

SEQ ID NO: 744118 - DNA, 14 bp, Homo sapiens
gcagcattcccacc

SEQ ID NO: 744119 - DNA, 19 bp, Homo sapiens
gcagccaaaggggagccag

SEQ ID NO: 744120 - DNA, 14 bp, Homo sapiens
gcagccaacctaag

SEQ ID NO: 744121 - DNA, 12 bp, Homo sapiens
gcagccaaggaa

SEQ ID NO: 744122 - DNA, 17 bp, Homo sapiens
gcagccaaggaatgtgt

SEQ ID NO: 744123 - DNA, 19 bp, Homo sapiens
gcagccaaggccgccagcg

SEQ ID NO: 744124 - DNA, 14 bp, Homo sapiens
gcagccacacgcag

SEQ ID NO: 744125 - DNA, 16 bp, Homo sapiens
gcagccacacttcctt

SEQ ID NO: 744126 - DNA, 19 bp, Homo sapiens
gcagccacaggactgagcc

SEQ ID NO: 744127 - DNA, 23 bp, Homo sapiens
gcagccacaggactgagccctct

SEQ ID NO: 744128 - DNA, 20 bp, Homo sapiens
gcagccacccaagcctgctg

SEQ ID NO: 744129 - DNA, 15 bp, Homo sapiens
gcagccagacccaga

SEQ ID NO: 744130 - DNA, 17 bp, Homo sapiens
gcagccagacccagagc

SEQ ID NO: 744131 - DNA, 16 bp, Homo sapiens
gcagccagagctgtgc

SEQ ID NO: 744132 - DNA, 19 bp, Homo sapiens
gcagccagcaccacctaca

SEQ ID NO: 744133 - DNA, 23 bp, Homo sapiens
gcagccagcaccacctacacagg

SEQ ID NO: 744134 - DNA, 12 bp, Homo sapiens
gcagccagccag

SEQ ID NO: 744135 - DNA, 15 bp, Homo sapiens
gcagccagccagtct

SEQ ID NO: 744136 - DNA, 21 bp, Homo sapiens
gcagccagcccagcccagctg

SEQ ID NO: 744137 - DNA, 17 bp, Homo sapiens
gcagccagctctcagcc

SEQ ID NO: 744138 - DNA, 18 bp, Homo sapiens
gcagccagctctcagcca

SEQ ID NO: 744139 - DNA, 14 bp, Homo sapiens
gcagccaggacccg

SEQ ID NO: 744140 - DNA, 13 bp, Homo sapiens
gcagccaggaggg

SEQ ID NO: 744141 - DNA, 14 bp, Homo sapiens
gcagccaggaggga

SEQ ID NO: 744142 - DNA, 17 bp, Homo sapiens
gcagccaggctgccaag

SEQ ID NO: 744143 - DNA, 13 bp, Homo sapiens
gcagccaggctgg

SEQ ID NO: 744144 - DNA, 15 bp, Homo sapiens
gcagccaggctgggc

SEQ ID NO: 744145 - DNA, 17 bp, Homo sapiens
gcagccaggctgggccg

SEQ ID NO: 744146 - DNA, 23 bp, Homo sapiens
gcagccagtctcagagaccagca

SEQ ID NO: 744147 - DNA, 22 bp, Homo sapiens
gcagccatcccgcttagcctgc

SEQ ID NO: 744148 - DNA, 11 bp, Homo sapiens
gcagccatgcc

SEQ ID NO: 744149 - DNA, 19 bp, Homo sapiens
gcagcccaaaacccagggc

SEQ ID NO: 744150 - DNA, 21 bp, Homo sapiens
gcagcccaaaacccagggcaa

SEQ ID NO: 744151 - DNA, 15 bp, Homo sapiens
gcagcccaagcttcc

SEQ ID NO: 744152 - DNA, 17 bp, Homo sapiens
gcagcccaagcttccct

SEQ ID NO: 744153 - DNA, 11 bp, Homo sapiens
gcagcccacca

SEQ ID NO: 744154 - DNA, 18 bp, Homo sapiens
gcagcccacccctcaaca

SEQ ID NO: 744155 - DNA, 18 bp, Homo sapiens
gcagcccagagactttgt

SEQ ID NO: 744156 - DNA, 18 bp, Homo sapiens
gcagcccagcagtgtgga

SEQ ID NO: 744157 - DNA, 11 bp, Homo sapiens
gcagcccagcc

SEQ ID NO: 744158 - DNA, 13 bp, Homo sapiens
gcagcccagcttc

SEQ ID NO: 744159 - DNA, 16 bp, Homo sapiens
gcagcccagcttcctg

SEQ ID NO: 744160 - DNA, 17 bp, Homo sapiens
gcagcccagcttcctgg

SEQ ID NO: 744161 - DNA, 19 bp, Homo sapiens
gcagcccagcttcctggtg

SEQ ID NO: 744162 - DNA, 13 bp, Homo sapiens
gcagcccatgccc

SEQ ID NO: 744163 - DNA, 15 bp, Homo sapiens
gcagcccatgcccac

SEQ ID NO: 744164 - DNA, 17 bp, Homo sapiens
gcagcccatgcccacct

SEQ ID NO: 744165 - DNA, 18 bp, Homo sapiens
gcagcccatgcccacctg

SEQ ID NO: 744166 - DNA, 17 bp, Homo sapiens
gcagccccacagtccca

SEQ ID NO: 744167 - DNA, 23 bp, Homo sapiens
gcagccccacttcacccccaact

SEQ ID NO: 744168 - DNA, 14 bp, Homo sapiens
gcagccccctgtgg

SEQ ID NO: 744169 - DNA, 15 bp, Homo sapiens
gcagccccctgtggc

SEQ ID NO: 744170 - DNA, 21 bp, Homo sapiens
gcagccccgttttggggacgt

SEQ ID NO: 744171 - DNA, 16 bp, Homo sapiens
gcagcccctttcccca

SEQ ID NO: 744172 - DNA, 15 bp, Homo sapiens
gcagcccggctgctg

SEQ ID NO: 744173 - DNA, 17 bp, Homo sapiens
gcagcccggctgctgct

SEQ ID NO: 744174 - DNA, 20 bp, Homo sapiens
gcagcccgtgaagcagtgcc

SEQ ID NO: 744175 - DNA, 14 bp, Homo sapiens
gcagccctccatgg

SEQ ID NO: 744176 - DNA, 23 bp, Homo sapiens
gcagccctccatggtcctgtctg

SEQ ID NO: 744177 - DNA, 15 bp, Homo sapiens
gcagccctcctcacc

SEQ ID NO: 744178 - DNA, 14 bp, Homo sapiens
gcagccctctgcct

SEQ ID NO: 744179 - DNA, 11 bp, Homo sapiens
gcagccctgag

SEQ ID NO: 744180 - DNA, 14 bp, Homo sapiens
gcagccctgagtgg

SEQ ID NO: 744181 - DNA, 24 bp, Homo sapiens
gcagccctgctttgggctgccctg

SEQ ID NO: 744182 - DNA, 16 bp, Homo sapiens
gcagcccttcctcctg

SEQ ID NO: 744183 - DNA, 12 bp, Homo sapiens
gcagcccttggg

SEQ ID NO: 744184 - DNA, 17 bp, Homo sapiens
gcagccgccagctggga

SEQ ID NO: 744185 - DNA, 17 bp, Homo sapiens
gcagccgccgccgccca

SEQ ID NO: 744186 - DNA, 16 bp, Homo sapiens
gcagccgctgagcgag

SEQ ID NO: 744187 - DNA, 19 bp, Homo sapiens
gcagccggaatagagcctc

SEQ ID NO: 744188 - DNA, 22 bp, Homo sapiens
gcagctgggccccatgctctgc

SEQ ID NO: 744189 - DNA, 22 bp, Homo sapiens
gcagctggggtaggctgtctgt

SEQ ID NO: 744190 - DNA, 21 bp, Homo sapiens
gcagctggtcagtctttgctc

SEQ ID NO: 744191 - DNA, 16 bp, Homo sapiens
gcagctggtcttttct

SEQ ID NO: 744192 - DNA, 17 bp, Homo sapiens
gcagctgtcccctctcc

SEQ ID NO: 744193 - DNA, 20 bp, Homo sapiens
gcagctgtgctgggtgagct

SEQ ID NO: 744194 - DNA, 21 bp, Homo sapiens
gcagctgtggtacaaatgtga

SEQ ID NO: 744195 - DNA, 22 bp, Homo sapiens
gcagctgttttcaaagcccccg

SEQ ID NO: 744196 - DNA, 17 bp, Homo sapiens
gcagctgttttgttgac

SEQ ID NO: 744197 - DNA, 14 bp, Homo sapiens
gcagcttaaaaact

SEQ ID NO: 744198 - DNA, 17 bp, Homo sapiens
gcagcttagggccctgg

SEQ ID NO: 744199 - DNA, 19 bp, Homo sapiens
gcagcttataatgggctct

SEQ ID NO: 744200 - DNA, 14 bp, Homo sapiens
gcagcttcaccaga

SEQ ID NO: 744201 - DNA, 17 bp, Homo sapiens
gcagcttcctgtctgtt

SEQ ID NO: 744202 - DNA, 15 bp, Homo sapiens
gcagcttcgaggaca

SEQ ID NO: 744203 - DNA, 16 bp, Homo sapiens
gcagcttcgaggacag

SEQ ID NO: 744204 - DNA, 19 bp, Homo sapiens
gcagcttcgaggacaggaa

SEQ ID NO: 744205 - DNA, 19 bp, Homo sapiens
gcagcttcggtgtgcagat

SEQ ID NO: 744206 - DNA, 17 bp, Homo sapiens
gcagcttctaagagcga

SEQ ID NO: 744207 - DNA, 16 bp, Homo sapiens
gcagcttctgttggca

SEQ ID NO: 744208 - DNA, 21 bp, Homo sapiens
gcagcttctgttggcagagct

SEQ ID NO: 744209 - DNA, 18 bp, Homo sapiens
gcagcttcttgggctgag

SEQ ID NO: 744210 - DNA, 17 bp, Homo sapiens
gcagctttaaactcagg

SEQ ID NO: 744211 - DNA, 17 bp, Homo sapiens
gcaggaaagccacatct

SEQ ID NO: 744212 - DNA, 19 bp, Homo sapiens
gcaggaaagccacatcttg

SEQ ID NO: 744213 - DNA, 21 bp, Homo sapiens
gcaggaaagtttacccatgaa

SEQ ID NO: 744214 - DNA, 17 bp, Homo sapiens
gcaggaacaatgactac

SEQ ID NO: 744215 - DNA, 14 bp, Homo sapiens
gcaggaacgagcac

SEQ ID NO: 744216 - DNA, 18 bp, Homo sapiens
gcaggaacgagcactggc

SEQ ID NO: 744217 - DNA, 19 bp, Homo sapiens
gcaggaacgagcactggcc

SEQ ID NO: 744218 - DNA, 20 bp, Homo sapiens
gcaggaacgagcactggcca

SEQ ID NO: 744219 - DNA, 21 bp, Homo sapiens
gcaggaacgagcactggccag

SEQ ID NO: 744220 - DNA, 23 bp, Homo sapiens
gcaggaacgagcactggccagag

SEQ ID NO: 744221 - DNA, 15 bp, Homo sapiens
gcaggaactcccagc

SEQ ID NO: 744222 - DNA, 16 bp, Homo sapiens
gcaggaactcccagca

SEQ ID NO: 744223 - DNA, 15 bp, Homo sapiens
gcaggaagaggccca

SEQ ID NO: 744224 - DNA, 21 bp, Homo sapiens
gcaggaaggacaggaagctgg

SEQ ID NO: 744225 - DNA, 23 bp, Homo sapiens
gcaggaaggagagcctgctgcat

SEQ ID NO: 744226 - DNA, 15 bp, Homo sapiens
gcaggaagggaagcg

SEQ ID NO: 744227 - DNA, 15 bp, Homo sapiens
gcaggaagggtggga

SEQ ID NO: 744228 - DNA, 14 bp, Homo sapiens
gcaggaatgggggt

SEQ ID NO: 744229 - DNA, 17 bp, Homo sapiens
gcaggacacatcccggc

SEQ ID NO: 744230 - DNA, 22 bp, Homo sapiens
gcaggacacatcccggcctctt

SEQ ID NO: 744231 - DNA, 15 bp, Homo sapiens
gcaggacagccagca

SEQ ID NO: 744232 - DNA, 17 bp, Homo sapiens
gcaggacagctcttgat

SEQ ID NO: 744233 - DNA, 12 bp, Homo sapiens
gcaggaccaagg

SEQ ID NO: 744234 - DNA, 18 bp, Homo sapiens
gcaggaccaagggggcgg

SEQ ID NO: 744235 - DNA, 22 bp, Homo sapiens
gcaggaccagccagcagcagcc

SEQ ID NO: 744236 - DNA, 13 bp, Homo sapiens
gcaggaccaggac

SEQ ID NO: 744237 - DNA, 23 bp, Homo sapiens
gcaggaccagtttgattgaggag

SEQ ID NO: 744238 - DNA, 11 bp, Homo sapiens
gcaggaccctg

SEQ ID NO: 744239 - DNA, 15 bp, Homo sapiens
gcaggaccctgctga

SEQ ID NO: 744240 - DNA, 19 bp, Homo sapiens
tcagcttcgtttattttca

SEQ ID NO: 744241 - DNA, 21 bp, Homo sapiens
tcagcttcgtttattttcaag

SEQ ID NO: 744242 - DNA, 14 bp, Homo sapiens
tcagcttgaacctg

SEQ ID NO: 744243 - DNA, 17 bp, Homo sapiens
tcagcttgaacctgctt

SEQ ID NO: 744244 - DNA, 22 bp, Homo sapiens
tcagcttgaacctgcttcctgg

SEQ ID NO: 744245 - DNA, 22 bp, Homo sapiens
tcagcttgggcttcttcctcct

SEQ ID NO: 744246 - DNA, 19 bp, Homo sapiens
tcagctttcagagccagtg

SEQ ID NO: 744247 - DNA, 14 bp, Homo sapiens
tcagctttccctgc

SEQ ID NO: 744248 - DNA, 21 bp, Homo sapiens
tcagctttctttaaagttctt

SEQ ID NO: 744249 - DNA, 12 bp, Homo sapiens
tcagctttgact

SEQ ID NO: 744250 - DNA, 17 bp, Homo sapiens
tcagctttgactttatc

SEQ ID NO: 744251 - DNA, 15 bp, Homo sapiens
tcagctttgagaagc

SEQ ID NO: 744252 - DNA, 15 bp, Homo sapiens
tcagctttgccttcc

SEQ ID NO: 744253 - DNA, 22 bp, Homo sapiens
tcagctttgccttccacgctgt

SEQ ID NO: 744254 - DNA, 18 bp, Homo sapiens
tcagctttggatgtggtt

SEQ ID NO: 744255 - DNA, 23 bp, Homo sapiens
tcaggaaaaatgaggaatccaaa

SEQ ID NO: 744256 - DNA, 20 bp, Homo sapiens
tcaggaaaactgacagagga

SEQ ID NO: 744257 - DNA, 19 bp, Homo sapiens
tcaggaaaaggttgaataa

SEQ ID NO: 744258 - DNA, 22 bp, Homo sapiens
tcaggaaaccacaaccttgcag

SEQ ID NO: 744259 - DNA, 21 bp, Homo sapiens
tcaggaaacgagactttccat

SEQ ID NO: 744260 - DNA, 22 bp, Homo sapiens
tcaggaaaggctgtagaaggaa

SEQ ID NO: 744261 - DNA, 21 bp, Homo sapiens
tcaggaaatatatatgtgtgt

SEQ ID NO: 744262 - DNA, 16 bp, Homo sapiens
tcaggaacagaaggat

SEQ ID NO: 744263 - DNA, 17 bp, Homo sapiens
tcaggaaccagggcctc

SEQ ID NO: 744264 - DNA, 23 bp, Homo sapiens
tcaggaagaaaggagtctgcaca

SEQ ID NO: 744265 - DNA, 22 bp, Homo sapiens
tcaggaagaaatcacagaatca

SEQ ID NO: 744266 - DNA, 18 bp, Homo sapiens
tcaggaagaagagatgca

SEQ ID NO: 744267 - DNA, 20 bp, Homo sapiens
tcaggaagatgaaagaggag

SEQ ID NO: 744268 - DNA, 11 bp, Homo sapiens
tcaggaagctc

SEQ ID NO: 744269 - DNA, 14 bp, Homo sapiens
tcaggaagtaaaat

SEQ ID NO: 744270 - DNA, 17 bp, Homo sapiens
tcaggaatattttccaa

SEQ ID NO: 744271 - DNA, 18 bp, Homo sapiens
tcaggaattctaaataaa

SEQ ID NO: 744272 - DNA, 22 bp, Homo sapiens
tcaggaattctaaataaatttc

SEQ ID NO: 744273 - DNA, 21 bp, Homo sapiens
tcaggacagcatcccttccca

SEQ ID NO: 744274 - DNA, 20 bp, Homo sapiens
tcaggaccaaagctttcatg

SEQ ID NO: 744275 - DNA, 12 bp, Homo sapiens
tcaggacccagg

SEQ ID NO: 744276 - DNA, 17 bp, Homo sapiens
tcaggacccaggccctc

SEQ ID NO: 744277 - DNA, 19 bp, Homo sapiens
tcaggacccaggccctcca

SEQ ID NO: 744278 - DNA, 21 bp, Homo sapiens
tcaggacctgggacctcccct

SEQ ID NO: 744279 - DNA, 19 bp, Homo sapiens
tcaggacgagaatgagggt

SEQ ID NO: 744280 - DNA, 15 bp, Homo sapiens
tcaggacggctcctc

SEQ ID NO: 744281 - DNA, 20 bp, Homo sapiens
tcaggacggctcctcagagc

SEQ ID NO: 744282 - DNA, 22 bp, Homo sapiens
tcaggactctgcgggaggctgg

SEQ ID NO: 744283 - DNA, 17 bp, Homo sapiens
tcaggacttgaaagaaa

SEQ ID NO: 744284 - DNA, 14 bp, Homo sapiens
tcaggagagtgtgc

SEQ ID NO: 744285 - DNA, 15 bp, Homo sapiens
tcaggagagtgtgca

SEQ ID NO: 744286 - DNA, 19 bp, Homo sapiens
tcaggagcccccaacacag

SEQ ID NO: 744287 - DNA, 23 bp, Homo sapiens
tcaggagccgaagcccaggggcc

SEQ ID NO: 744288 - DNA, 23 bp, Homo sapiens
tcaggagcttgggcagtgcccca

SEQ ID NO: 744289 - DNA, 22 bp, Homo sapiens
tcaggaggccgaggcaggagaa

SEQ ID NO: 744290 - DNA, 14 bp, Homo sapiens
tcaggaggcgccct

SEQ ID NO: 744291 - DNA, 12 bp, Homo sapiens
tcaggaggctga

SEQ ID NO: 744292 - DNA, 13 bp, Homo sapiens
tcaggaggctgag

SEQ ID NO: 744293 - DNA, 16 bp, Homo sapiens
tcaggaggctgaggca

SEQ ID NO: 744294 - DNA, 21 bp, Homo sapiens
tcaggaggctggaggaagggg

SEQ ID NO: 744295 - DNA, 18 bp, Homo sapiens
tcaggagggcaggctgag

SEQ ID NO: 744296 - DNA, 16 bp, Homo sapiens
tcaggagttggaatgt

SEQ ID NO: 744297 - DNA, 14 bp, Homo sapiens
tcaggatacatgtg

SEQ ID NO: 744298 - DNA, 16 bp, Homo sapiens
tcaggatacatgtgcc

SEQ ID NO: 744299 - DNA, 18 bp, Homo sapiens
tcaggatactctgtcaga

SEQ ID NO: 744300 - DNA, 23 bp, Homo sapiens
tcaggatattagttaatgagcca

SEQ ID NO: 744301 - DNA, 18 bp, Homo sapiens
tcaggatattggttcttc

SEQ ID NO: 744302 - DNA, 20 bp, Homo sapiens
tcaggatattggttcttccc

SEQ ID NO: 744303 - DNA, 20 bp, Homo sapiens
tcaggatcaaaccccgacca

SEQ ID NO: 744304 - DNA, 16 bp, Homo sapiens
tcaggatcaagaaagt

SEQ ID NO: 744305 - DNA, 17 bp, Homo sapiens
tcaggatcaagaaagtg

SEQ ID NO: 744306 - DNA, 20 bp, Homo sapiens
tcaggatccagtctggaaaa

SEQ ID NO: 744307 - DNA, 17 bp, Homo sapiens
tcaggatgaacccagga

SEQ ID NO: 744308 - DNA, 23 bp, Homo sapiens
tcaggatgcacatttctggattg

SEQ ID NO: 744309 - DNA, 15 bp, Homo sapiens
gcaggggcctggagg

SEQ ID NO: 744310 - DNA, 14 bp, Homo sapiens
gcaggggcctgggc

SEQ ID NO: 744311 - DNA, 15 bp, Homo sapiens
gcaggggcctgggcc

SEQ ID NO: 744312 - DNA, 23 bp, Homo sapiens
gcaggggctacgttagcagccca

SEQ ID NO: 744313 - DNA, 13 bp, Homo sapiens
gcaggggctccag

SEQ ID NO: 744314 - DNA, 20 bp, Homo sapiens
gcaggggctgctgccttgtt

SEQ ID NO: 744315 - DNA, 18 bp, Homo sapiens
gcagggggccccgccagg

SEQ ID NO: 744316 - DNA, 13 bp, Homo sapiens
gcagggggccctg

SEQ ID NO: 744317 - DNA, 17 bp, Homo sapiens
gcaggggggctgtgcca

SEQ ID NO: 744318 - DNA, 18 bp, Homo sapiens
gcaggggggctgtgccaa

SEQ ID NO: 744319 - DNA, 19 bp, Homo sapiens
gcaggggtccttggtgtga

SEQ ID NO: 744320 - DNA, 16 bp, Homo sapiens
gcagggtaccctttgg

SEQ ID NO: 744321 - DNA, 13 bp, Homo sapiens
gcagggtccacgc

SEQ ID NO: 744322 - DNA, 21 bp, Homo sapiens
gcagggtctgggctgggcacc

SEQ ID NO: 744323 - DNA, 21 bp, Homo sapiens
gcagggtctgtttggactgca

SEQ ID NO: 744324 - DNA, 21 bp, Homo sapiens
gcagggtcttttcatctggga

SEQ ID NO: 744325 - DNA, 23 bp, Homo sapiens
gcagggtcttttcatctgggaaa

SEQ ID NO: 744326 - DNA, 20 bp, Homo sapiens
gcagggtgacgcctgagaca

SEQ ID NO: 744327 - DNA, 21 bp, Homo sapiens
gcagggtgacgcctgagacag

SEQ ID NO: 744328 - DNA, 23 bp, Homo sapiens
gcagggtgacgcctgagacagca

SEQ ID NO: 744329 - DNA, 23 bp, Homo sapiens
gcagggtgggagccgggaccctc

SEQ ID NO: 744330 - DNA, 17 bp, Homo sapiens
gcagggtgggcagccta

SEQ ID NO: 744331 - DNA, 17 bp, Homo sapiens
gcagggtggggagggag

SEQ ID NO: 744332 - DNA, 17 bp, Homo sapiens
gcagggtggggtctggg

SEQ ID NO: 744333 - DNA, 18 bp, Homo sapiens
gcagggtggggtctggga

SEQ ID NO: 744334 - DNA, 19 bp, Homo sapiens
gcagggtggggtctgggag

SEQ ID NO: 744335 - DNA, 22 bp, Homo sapiens
gcagggtggtggtattctgtca

SEQ ID NO: 744336 - DNA, 14 bp, Homo sapiens
gcagggtttctttt

SEQ ID NO: 744337 - DNA, 16 bp, Homo sapiens
gcaggtaaactcctgt

SEQ ID NO: 744338 - DNA, 14 bp, Homo sapiens
gcaggtaccactga

SEQ ID NO: 744339 - DNA, 18 bp, Homo sapiens
gcaggtacttcctcctga

SEQ ID NO: 744340 - DNA, 24 bp, Homo sapiens
gcaggtacttcctcctgatggcca

SEQ ID NO: 744341 - DNA, 14 bp, Homo sapiens
gcaggtcacagaaa

SEQ ID NO: 744342 - DNA, 17 bp, Homo sapiens
gcaggtcactgtcactg

SEQ ID NO: 744343 - DNA, 21 bp, Homo sapiens
gcaggtcactgtcactgccga

SEQ ID NO: 744344 - DNA, 22 bp, Homo sapiens
gcaggtctctgtacgggccagt

SEQ ID NO: 744345 - DNA, 17 bp, Homo sapiens
gcaggtgaccttctggg

SEQ ID NO: 744346 - DNA, 19 bp, Homo sapiens
gcaggtgaccttctgggaa

SEQ ID NO: 744347 - DNA, 18 bp, Homo sapiens
gcaggtgattggaccagg

SEQ ID NO: 744348 - DNA, 22 bp, Homo sapiens
gcaggtgattggaccaggccat

SEQ ID NO: 744349 - DNA, 15 bp, Homo sapiens
gcaggtgcagatggg

SEQ ID NO: 744350 - DNA, 12 bp, Homo sapiens
gcaggtgccatc

SEQ ID NO: 744351 - DNA, 13 bp, Homo sapiens
gcaggtgcctcca

SEQ ID NO: 744352 - DNA, 16 bp, Homo sapiens
gcaggtgcctccaggt

SEQ ID NO: 744353 - DNA, 21 bp, Homo sapiens
gcaggtgcctccaggtgtgca

SEQ ID NO: 744354 - DNA, 21 bp, Homo sapiens
gcaggtgcctgttgaatctga

SEQ ID NO: 744355 - DNA, 19 bp, Homo sapiens
gcaggtggccgcccctgag

SEQ ID NO: 744356 - DNA, 15 bp, Homo sapiens
gcaggtgggagctga

SEQ ID NO: 744357 - DNA, 14 bp, Homo sapiens
gcaggtgggctgcc

SEQ ID NO: 744358 - DNA, 15 bp, Homo sapiens
gcaggtgggctgcct

SEQ ID NO: 744359 - DNA, 16 bp, Homo sapiens
gcaggtgggctgcctg

SEQ ID NO: 744360 - DNA, 17 bp, Homo sapiens
gcaggtgggctggactt

SEQ ID NO: 744361 - DNA, 17 bp, Homo sapiens
gcaggtggggagactgg

SEQ ID NO: 744362 - DNA, 17 bp, Homo sapiens
gcaggtggggagggggt

SEQ ID NO: 744363 - DNA, 23 bp, Homo sapiens
gcaggtggggtgatggccagagg

SEQ ID NO: 744364 - DNA, 14 bp, Homo sapiens
gcaggtgggtgctg

SEQ ID NO: 744365 - DNA, 19 bp, Homo sapiens
gcaggtgggtgctgccctg

SEQ ID NO: 744366 - DNA, 16 bp, Homo sapiens
gcaggtggtcctgaga

SEQ ID NO: 744367 - DNA, 23 bp, Homo sapiens
gcaggtggtggcactgagccccc

SEQ ID NO: 744368 - DNA, 12 bp, Homo sapiens
gcaggtgtctga

SEQ ID NO: 744369 - DNA, 13 bp, Homo sapiens
gcaggtgtggtgg

SEQ ID NO: 744370 - DNA, 19 bp, Homo sapiens
gcaggtgtttctttcctgt

SEQ ID NO: 744371 - DNA, 16 bp, Homo sapiens
gcaggttcccaagctc

SEQ ID NO: 744372 - DNA, 19 bp, Homo sapiens
gcaggttcccaagctcaga

SEQ ID NO: 744373 - DNA, 15 bp, Homo sapiens
tcagtactgactttc

SEQ ID NO: 744374 - DNA, 18 bp, Homo sapiens
tcagtaggaacaagctgg

SEQ ID NO: 744375 - DNA, 23 bp, Homo sapiens
tcagtaggaacaagctggcttct

SEQ ID NO: 744376 - DNA, 16 bp, Homo sapiens
tcagtaggtccaaggg

SEQ ID NO: 744377 - DNA, 19 bp, Homo sapiens
tcagtaggtccaagggcca

SEQ ID NO: 744378 - DNA, 15 bp, Homo sapiens
tcagtagtgtacatt

SEQ ID NO: 744379 - DNA, 16 bp, Homo sapiens
tcagtagtgtacatta

SEQ ID NO: 744380 - DNA, 21 bp, Homo sapiens
tcagtataaagatcacccgtt

SEQ ID NO: 744381 - DNA, 18 bp, Homo sapiens
tcagtataaattatctta

SEQ ID NO: 744382 - DNA, 12 bp, Homo sapiens
tcagtatagcat

SEQ ID NO: 744383 - DNA, 14 bp, Homo sapiens
tcagtatcatctcc

SEQ ID NO: 744384 - DNA, 17 bp, Homo sapiens
tcagtatccatgctctt

SEQ ID NO: 744385 - DNA, 17 bp, Homo sapiens
tcagtatcttagagttt

SEQ ID NO: 744386 - DNA, 22 bp, Homo sapiens
tcagtatgctttccctgaggaa

SEQ ID NO: 744387 - DNA, 12 bp, Homo sapiens
tcagtattactt

SEQ ID NO: 744388 - DNA, 22 bp, Homo sapiens
tcagtattatctaaatgaatga

SEQ ID NO: 744389 - DNA, 15 bp, Homo sapiens
tcagtattctgacat

SEQ ID NO: 744390 - DNA, 17 bp, Homo sapiens
tcagtattctgacatgt

SEQ ID NO: 744391 - DNA, 18 bp, Homo sapiens
tcagtattctgacatgta

SEQ ID NO: 744392 - DNA, 19 bp, Homo sapiens
tcagtattctgacatgtaa

SEQ ID NO: 744393 - DNA, 15 bp, Homo sapiens
tcagtatttatgtaa

SEQ ID NO: 744394 - DNA, 14 bp, Homo sapiens
tcagtatttccttc

SEQ ID NO: 744395 - DNA, 20 bp, Homo sapiens
tcagtatttccttccactgt

SEQ ID NO: 744396 - DNA, 19 bp, Homo sapiens
tcagtattttggagaaatt

SEQ ID NO: 744397 - DNA, 23 bp, Homo sapiens
tcagtattttggagaaattattt

SEQ ID NO: 744398 - DNA, 14 bp, Homo sapiens
tcagtcaaaacttt

SEQ ID NO: 744399 - DNA, 13 bp, Homo sapiens
tcagtcaccccca

SEQ ID NO: 744400 - DNA, 21 bp, Homo sapiens
tcagtcacccccacttcccac

SEQ ID NO: 744401 - DNA, 13 bp, Homo sapiens
tcagtcattaaat

SEQ ID NO: 744402 - DNA, 12 bp, Homo sapiens
tcagtccaggat

SEQ ID NO: 744403 - DNA, 12 bp, Homo sapiens
tcagtcccctcc

SEQ ID NO: 744404 - DNA, 15 bp, Homo sapiens
tcagtcccctcccat

SEQ ID NO: 744405 - DNA, 23 bp, Homo sapiens
tcagtcccctcccatctgggagt

SEQ ID NO: 744406 - DNA, 19 bp, Homo sapiens
tcagtcccctctctctggg

SEQ ID NO: 744407 - DNA, 17 bp, Homo sapiens
tcagtccctatgtattt

SEQ ID NO: 744408 - DNA, 23 bp, Homo sapiens
tcagtccctatgtatttgcagtt

SEQ ID NO: 744409 - DNA, 19 bp, Homo sapiens
tcagtctcagaatgtcatt

SEQ ID NO: 744410 - DNA, 22 bp, Homo sapiens
tcagtctcccagctaattgaga

SEQ ID NO: 744411 - DNA, 14 bp, Homo sapiens
tcagtctccctttc

SEQ ID NO: 744412 - DNA, 20 bp, Homo sapiens
tcagtctctgagcagtgaat

SEQ ID NO: 744413 - DNA, 13 bp, Homo sapiens
tcagtctgctcca

SEQ ID NO: 744414 - DNA, 14 bp, Homo sapiens
tcagtctgctccac

SEQ ID NO: 744415 - DNA, 21 bp, Homo sapiens
tcagtctgcttagaaataaca

SEQ ID NO: 744416 - DNA, 14 bp, Homo sapiens
tcagtctgttcact

SEQ ID NO: 744417 - DNA, 21 bp, Homo sapiens
tcagtctgttcactgcattca

SEQ ID NO: 744418 - DNA, 18 bp, Homo sapiens
tcagtcttccttgtggaa

SEQ ID NO: 744419 - DNA, 24 bp, Homo sapiens
tcagtctttgctcagtgtccagct

SEQ ID NO: 744420 - DNA, 16 bp, Homo sapiens
tcagtgaaattttcag

SEQ ID NO: 744421 - DNA, 19 bp, Homo sapiens
tcagtgacagagttcacta

SEQ ID NO: 744422 - DNA, 22 bp, Homo sapiens
tcagtgacagcgaaggaagtta

SEQ ID NO: 744423 - DNA, 15 bp, Homo sapiens
tcagtgacccatgag

SEQ ID NO: 744424 - DNA, 12 bp, Homo sapiens
tcagtgactgaa

SEQ ID NO: 744425 - DNA, 14 bp, Homo sapiens
tcagtgactgttgt

SEQ ID NO: 744426 - DNA, 15 bp, Homo sapiens
tcagtgactgttgta

SEQ ID NO: 744427 - DNA, 13 bp, Homo sapiens
tcagtgagcctcc

SEQ ID NO: 744428 - DNA, 17 bp, Homo sapiens
tcagtgaggcccaggga

SEQ ID NO: 744429 - DNA, 17 bp, Homo sapiens
tcagtgcaaattgtatc

SEQ ID NO: 744430 - DNA, 23 bp, Homo sapiens
tcagtgcagcccgtgtggcccct

SEQ ID NO: 744431 - DNA, 20 bp, Homo sapiens
gcatagtaccaatcatttta

SEQ ID NO: 744432 - DNA, 20 bp, Homo sapiens
gcatagtattccattgtgtg

SEQ ID NO: 744433 - DNA, 21 bp, Homo sapiens
gcatagttgtagacaaagtac

SEQ ID NO: 744434 - DNA, 19 bp, Homo sapiens
gcatataaaggttatgaaa

SEQ ID NO: 744435 - DNA, 18 bp, Homo sapiens
gcatataatgaataaatc

SEQ ID NO: 744436 - DNA, 20 bp, Homo sapiens
gcatataattttcacttctg

SEQ ID NO: 744437 - DNA, 16 bp, Homo sapiens
gcatatagattgtcct

SEQ ID NO: 744438 - DNA, 22 bp, Homo sapiens
gcatatagatttagttttgtaa

SEQ ID NO: 744439 - DNA, 18 bp, Homo sapiens
gcatatcattaaacaaat

SEQ ID NO: 744440 - DNA, 18 bp, Homo sapiens
gcatatgaccctgtttac

SEQ ID NO: 744441 - DNA, 17 bp, Homo sapiens
gcatatgagcctgccct

SEQ ID NO: 744442 - DNA, 11 bp, Homo sapiens
gcatatgcagc

SEQ ID NO: 744443 - DNA, 16 bp, Homo sapiens
gcatatgcatgccagg

SEQ ID NO: 744444 - DNA, 21 bp, Homo sapiens
gcatatgcatgccaggctggg

SEQ ID NO: 744445 - DNA, 19 bp, Homo sapiens
gcatatgttgaatactttt

SEQ ID NO: 744446 - DNA, 20 bp, Homo sapiens
gcatatgttgaatacttttt

SEQ ID NO: 744447 - DNA, 21 bp, Homo sapiens
gcatatgtttcgctgatatat

SEQ ID NO: 744448 - DNA, 16 bp, Homo sapiens
gcatattataaaggat

SEQ ID NO: 744449 - DNA, 21 bp, Homo sapiens
gcatattgaaaagcacagagg

SEQ ID NO: 744450 - DNA, 20 bp, Homo sapiens
gcatatttatattgtatatt

SEQ ID NO: 744451 - DNA, 23 bp, Homo sapiens
gcatatttatattgtatattctg

SEQ ID NO: 744452 - DNA, 21 bp, Homo sapiens
gcatatttatccaaaatgtgt

SEQ ID NO: 744453 - DNA, 22 bp, Homo sapiens
gcatatttattgcattgctggt

SEQ ID NO: 744454 - DNA, 23 bp, Homo sapiens
gcatatttattgcattgctggta

SEQ ID NO: 744455 - DNA, 12 bp, Homo sapiens
gcatatttctgt

SEQ ID NO: 744456 - DNA, 14 bp, Homo sapiens
gcatatttctgtat

SEQ ID NO: 744457 - DNA, 23 bp, Homo sapiens
gcatatttctgtatatttgtcat

SEQ ID NO: 744458 - DNA, 19 bp, Homo sapiens
gcatatttgcaaagtgtat

SEQ ID NO: 744459 - DNA, 13 bp, Homo sapiens
gcatattttgctg

SEQ ID NO: 744460 - DNA, 23 bp, Homo sapiens
gcatcaagaggtgggagggccct

SEQ ID NO: 744461 - DNA, 13 bp, Homo sapiens
gcatcaatacaac

SEQ ID NO: 744462 - DNA, 19 bp, Homo sapiens
gcatcaatacaaccagccc

SEQ ID NO: 744463 - DNA, 23 bp, Homo sapiens
gcatcacactcaaggacaggagc

SEQ ID NO: 744464 - DNA, 13 bp, Homo sapiens
gcatcacctcagg

SEQ ID NO: 744465 - DNA, 15 bp, Homo sapiens
gcatcacctcaggcc

SEQ ID NO: 744466 - DNA, 16 bp, Homo sapiens
gcatcacgctacccag

SEQ ID NO: 744467 - DNA, 12 bp, Homo sapiens
gcatcactgcct

SEQ ID NO: 744468 - DNA, 23 bp, Homo sapiens
gcatcacttaacggaccaaagca

SEQ ID NO: 744469 - DNA, 19 bp, Homo sapiens
gcatcagaggtttgcttcc

SEQ ID NO: 744470 - DNA, 15 bp, Homo sapiens
gcatcaggcactggt

SEQ ID NO: 744471 - DNA, 17 bp, Homo sapiens
gcatcaggcactggtgg

SEQ ID NO: 744472 - DNA, 22 bp, Homo sapiens
gcatcagggcctttctcctccc

SEQ ID NO: 744473 - DNA, 23 bp, Homo sapiens
gcatcagggcctttctcctcccc

SEQ ID NO: 744474 - DNA, 18 bp, Homo sapiens
gcatcagggggaagaagc

SEQ ID NO: 744475 - DNA, 20 bp, Homo sapiens
gcatcagggggaagaagcag

SEQ ID NO: 744476 - DNA, 19 bp, Homo sapiens
gcatcagtccctatgtatt

SEQ ID NO: 744477 - DNA, 21 bp, Homo sapiens
gcatcagtgactgaattctgc

SEQ ID NO: 744478 - DNA, 19 bp, Homo sapiens
gcatcatcttgaacattaa

SEQ ID NO: 744479 - DNA, 21 bp, Homo sapiens
gcatcatcttgaacattaatc

SEQ ID NO: 744480 - DNA, 21 bp, Homo sapiens
gcatcatggaaagactgggac

SEQ ID NO: 744481 - DNA, 21 bp, Homo sapiens
gcatcattactgttccagatt

SEQ ID NO: 744482 - DNA, 22 bp, Homo sapiens
gcatcattatttgcagagacag

SEQ ID NO: 744483 - DNA, 19 bp, Homo sapiens
gcatccacccagtgctgcc

SEQ ID NO: 744484 - DNA, 21 bp, Homo sapiens
gcatccacccagtgctgccat

SEQ ID NO: 744485 - DNA, 24 bp, Homo sapiens
gcatccacccagtgctgccatgcc

SEQ ID NO: 744486 - DNA, 13 bp, Homo sapiens
gcatccagacagt

SEQ ID NO: 744487 - DNA, 16 bp, Homo sapiens
gcatccagcctgtgtg

SEQ ID NO: 744488 - DNA, 16 bp, Homo sapiens
gcatccatcttggaag

SEQ ID NO: 744489 - DNA, 15 bp, Homo sapiens
gcatccattcctcag

SEQ ID NO: 744490 - DNA, 16 bp, Homo sapiens
gcatccattcctcagg

SEQ ID NO: 744491 - DNA, 21 bp, Homo sapiens
gcatccattcctcagggacag

SEQ ID NO: 744492 - DNA, 20 bp, Homo sapiens
gcatcccagcacctgcctcc

SEQ ID NO: 744493 - DNA, 21 bp, Homo sapiens
gcatcccagcacctgcctcct

SEQ ID NO: 744494 - DNA, 16 bp, Homo sapiens
gcatcccaggggacca

SEQ ID NO: 744495 - DNA, 17 bp, Homo sapiens
gcatcccagtggcctca

SEQ ID NO: 744496 - DNA, 23 bp, Homo sapiens
gcatcccagtggcctcaaccctc

SEQ ID NO: 744497 - DNA, 20 bp, Homo sapiens
gcatccccacgacccctgcc

SEQ ID NO: 744498 - DNA, 22 bp, Homo sapiens
gcatccccacgacccctgcctc

SEQ ID NO: 744499 - DNA, 21 bp, Homo sapiens
gcatccccctcctctccctgt

SEQ ID NO: 744500 - DNA, 21 bp, Homo sapiens
gcatccccttggctgtgaggc

SEQ ID NO: 744501 - DNA, 12 bp, Homo sapiens
gcatccctgaga

SEQ ID NO: 744502 - DNA, 13 bp, Homo sapiens
gcatccctgagac

SEQ ID NO: 744503 - DNA, 18 bp, Homo sapiens
gcatccctgaggagccag

SEQ ID NO: 744504 - DNA, 13 bp, Homo sapiens
gcatcccttccca

SEQ ID NO: 744505 - DNA, 12 bp, Homo sapiens
tcatatcatttc

SEQ ID NO: 744506 - DNA, 21 bp, Homo sapiens
tcatatgaaaaaaatgcattt

SEQ ID NO: 744507 - DNA, 19 bp, Homo sapiens
tcatatgattctgctttta

SEQ ID NO: 744508 - DNA, 13 bp, Homo sapiens
tcatatgcagaac

SEQ ID NO: 744509 - DNA, 20 bp, Homo sapiens
tcatatgcagaacgtattta

SEQ ID NO: 744510 - DNA, 20 bp, Homo sapiens
tcatatgccaccccatgtgc

SEQ ID NO: 744511 - DNA, 23 bp, Homo sapiens
tcatatgccaccccatgtgcctt

SEQ ID NO: 744512 - DNA, 17 bp, Homo sapiens
tcatatggagctcatgt

SEQ ID NO: 744513 - DNA, 17 bp, Homo sapiens
tcatatggcccagtgtc

SEQ ID NO: 744514 - DNA, 22 bp, Homo sapiens
tcatatgtaccatgtacatgaa

SEQ ID NO: 744515 - DNA, 14 bp, Homo sapiens
tcatatgttgctca

SEQ ID NO: 744516 - DNA, 15 bp, Homo sapiens
tcatatgttgctcag

SEQ ID NO: 744517 - DNA, 20 bp, Homo sapiens
tcatattaacatattctaaa

SEQ ID NO: 744518 - DNA, 13 bp, Homo sapiens
tcatattaagaca

SEQ ID NO: 744519 - DNA, 15 bp, Homo sapiens
tcatattaagacagt

SEQ ID NO: 744520 - DNA, 17 bp, Homo sapiens
tcatattctattgttta

SEQ ID NO: 744521 - DNA, 16 bp, Homo sapiens
tcatattctgtctgga

SEQ ID NO: 744522 - DNA, 21 bp, Homo sapiens
tcatattggattgcgcctttg

SEQ ID NO: 744523 - DNA, 20 bp, Homo sapiens
tcatattgtgccaatatgta

SEQ ID NO: 744524 - DNA, 19 bp, Homo sapiens
tcatatttaaagacaggga

SEQ ID NO: 744525 - DNA, 19 bp, Homo sapiens
tcatatttaagtgtattta

SEQ ID NO: 744526 - DNA, 16 bp, Homo sapiens
tcatatttacttctta

SEQ ID NO: 744527 - DNA, 20 bp, Homo sapiens
tcatatttacttcttataca

SEQ ID NO: 744528 - DNA, 21 bp, Homo sapiens
tcatatttacttcttatacat

SEQ ID NO: 744529 - DNA, 23 bp, Homo sapiens
tcatatttacttcttatacattt

SEQ ID NO: 744530 - DNA, 18 bp, Homo sapiens
tcatatttgtctttgaat

SEQ ID NO: 744531 - DNA, 15 bp, Homo sapiens
tcatattttgtatat

SEQ ID NO: 744532 - DNA, 23 bp, Homo sapiens
tcatattttgtatatatctgctt

SEQ ID NO: 744533 - DNA, 15 bp, Homo sapiens
tcatattttgttgtg

SEQ ID NO: 744534 - DNA, 20 bp, Homo sapiens
tcatcaaaatcatggatctt

SEQ ID NO: 744535 - DNA, 19 bp, Homo sapiens
tcatcaaacatttgccaag

SEQ ID NO: 744536 - DNA, 15 bp, Homo sapiens
tcatcaactgaatga

SEQ ID NO: 744537 - DNA, 11 bp, Homo sapiens
tcatcaagaag

SEQ ID NO: 744538 - DNA, 21 bp, Homo sapiens
tcatcaatatccctcttgtaa

SEQ ID NO: 744539 - DNA, 23 bp, Homo sapiens
tcatcacatttctatgccaaaca

SEQ ID NO: 744540 - DNA, 22 bp, Homo sapiens
tcatcaccatcgtgtttgcaaa

SEQ ID NO: 744541 - DNA, 19 bp, Homo sapiens
tcatcaccatttcctcctt

SEQ ID NO: 744542 - DNA, 19 bp, Homo sapiens
tcatcactccctggatgtg

SEQ ID NO: 744543 - DNA, 14 bp, Homo sapiens
tcatcactggactg

SEQ ID NO: 744544 - DNA, 15 bp, Homo sapiens
tcatcactggactgc

SEQ ID NO: 744545 - DNA, 18 bp, Homo sapiens
tcatcactggactgcatg

SEQ ID NO: 744546 - DNA, 22 bp, Homo sapiens
tcatcactggatgaagattctc

SEQ ID NO: 744547 - DNA, 12 bp, Homo sapiens
tcatcactgtaa

SEQ ID NO: 744548 - DNA, 13 bp, Homo sapiens
tcatcactgtaaa

SEQ ID NO: 744549 - DNA, 15 bp, Homo sapiens
tcatcacttcttcca

SEQ ID NO: 744550 - DNA, 18 bp, Homo sapiens
tcatcacttcttccactg

SEQ ID NO: 744551 - DNA, 14 bp, Homo sapiens
tcatgtctgtatac

SEQ ID NO: 744552 - DNA, 15 bp, Homo sapiens
tcatgtcttgtcata

SEQ ID NO: 744553 - DNA, 18 bp, Homo sapiens
tcatgtctttccacttct

SEQ ID NO: 744554 - DNA, 22 bp, Homo sapiens
tcatgtctttccacttctctgg

SEQ ID NO: 744555 - DNA, 17 bp, Homo sapiens
tcatgtgaccactctgt

SEQ ID NO: 744556 - DNA, 14 bp, Homo sapiens
tcatgtgatgtcat

SEQ ID NO: 744557 - DNA, 16 bp, Homo sapiens
tcatgtgatgtcatga

SEQ ID NO: 744558 - DNA, 14 bp, Homo sapiens
tcatgtgctcagaa

SEQ ID NO: 744559 - DNA, 13 bp, Homo sapiens
tcatgtggactgg

SEQ ID NO: 744560 - DNA, 24 bp, Homo sapiens
tcatgtggcacttgggcatttata

SEQ ID NO: 744561 - DNA, 19 bp, Homo sapiens
tcatgtggtttctatgcaa

SEQ ID NO: 744562 - DNA, 17 bp, Homo sapiens
tcatgtgtgcatgtgag

SEQ ID NO: 744563 - DNA, 16 bp, Homo sapiens
tcatgttaaattagaa

SEQ ID NO: 744564 - DNA, 22 bp, Homo sapiens
tcatgttaaattagaatgaatt

SEQ ID NO: 744565 - DNA, 23 bp, Homo sapiens
tcatgttagttaccttatagtta

SEQ ID NO: 744566 - DNA, 16 bp, Homo sapiens
tcatgttcactgtgag

SEQ ID NO: 744567 - DNA, 15 bp, Homo sapiens
tcatgttctgtgaca

SEQ ID NO: 744568 - DNA, 13 bp, Homo sapiens
tcatgttgaaaca

SEQ ID NO: 744569 - DNA, 15 bp, Homo sapiens
tcatgttggtttatt

SEQ ID NO: 744570 - DNA, 22 bp, Homo sapiens
tcatgttgttgtgtgtatatgt

SEQ ID NO: 744571 - DNA, 16 bp, Homo sapiens
tcatgtttcttaaatg

SEQ ID NO: 744572 - DNA, 15 bp, Homo sapiens
tcatgtttgcttcat

SEQ ID NO: 744573 - DNA, 17 bp, Homo sapiens
tcatgtttgcttcataa

SEQ ID NO: 744574 - DNA, 20 bp, Homo sapiens
tcatgtttgcttcataaatg

SEQ ID NO: 744575 - DNA, 13 bp, Homo sapiens
tcatgtttgtaaa

SEQ ID NO: 744576 - DNA, 14 bp, Homo sapiens
tcatgttttgtgac

SEQ ID NO: 744577 - DNA, 12 bp, Homo sapiens
tcatgtttttga

SEQ ID NO: 744578 - DNA, 15 bp, Homo sapiens
tcatgtttttgatca

SEQ ID NO: 744579 - DNA, 15 bp, Homo sapiens
tcatgttttttcctt

SEQ ID NO: 744580 - DNA, 14 bp, Homo sapiens
tcattaaaatatat

SEQ ID NO: 744581 - DNA, 21 bp, Homo sapiens
tcattaaaatatatgttctgc

SEQ ID NO: 744582 - DNA, 23 bp, Homo sapiens
tcattaaaatatatgttctgcaa

SEQ ID NO: 744583 - DNA, 17 bp, Homo sapiens
tcattaaactgattcca

SEQ ID NO: 744584 - DNA, 14 bp, Homo sapiens
tcattaaacttgaa

SEQ ID NO: 744585 - DNA, 15 bp, Homo sapiens
tcattaaacttgaag

SEQ ID NO: 744586 - DNA, 17 bp, Homo sapiens
tcattaaacttttttaa

SEQ ID NO: 744587 - DNA, 14 bp, Homo sapiens
tcattaaataaatt

SEQ ID NO: 744588 - DNA, 13 bp, Homo sapiens
tcattaaattact

SEQ ID NO: 744589 - DNA, 14 bp, Homo sapiens
tcattaatgtttat

SEQ ID NO: 744590 - DNA, 14 bp, Homo sapiens
tcattaattctata

SEQ ID NO: 744591 - DNA, 15 bp, Homo sapiens
tcattacccttccct

SEQ ID NO: 744592 - DNA, 21 bp, Homo sapiens
tcattacccttccctgcacta

SEQ ID NO: 744593 - DNA, 15 bp, Homo sapiens
tcattacctgtttat

SEQ ID NO: 744594 - DNA, 14 bp, Homo sapiens
tcattactgggcct

SEQ ID NO: 744595 - DNA, 14 bp, Homo sapiens
tcattactggtaaa

SEQ ID NO: 744596 - DNA, 17 bp, Homo sapiens
tcattactggtaaagcc

SEQ ID NO: 744597 - DNA, 19 bp, Homo sapiens
tcattactgttccagattc

SEQ ID NO: 744598 - DNA, 16 bp, Homo sapiens
tcattacttttgaagt

SEQ ID NO: 744599 - DNA, 17 bp, Homo sapiens
tcattagaattaccatt

SEQ ID NO: 744600 - DNA, 13 bp, Homo sapiens
tcattagagctta

SEQ ID NO: 744601 - DNA, 15 bp, Homo sapiens
tcattagctgctctg

SEQ ID NO: 744602 - DNA, 21 bp, Homo sapiens
tcattaggtgtgactgaattt

SEQ ID NO: 744603 - DNA, 16 bp, Homo sapiens
tcattaggttttgctt

SEQ ID NO: 744604 - DNA, 19 bp, Homo sapiens
tcattagtcatgtttatct

SEQ ID NO: 744605 - DNA, 13 bp, Homo sapiens
tcattataaacgt

SEQ ID NO: 744606 - DNA, 17 bp, Homo sapiens
tcattataatctcaaag

SEQ ID NO: 744607 - DNA, 20 bp, Homo sapiens
tcattatatcattggaacaa

SEQ ID NO: 744608 - DNA, 17 bp, Homo sapiens
tcattatcatcaagcag

SEQ ID NO: 744609 - DNA, 18 bp, Homo sapiens
tcattatctgagttgcat

SEQ ID NO: 744610 - DNA, 16 bp, Homo sapiens
tcattatgaaaaacat

SEQ ID NO: 744611 - DNA, 23 bp, Homo sapiens
tcattatgaaaaacatcccaaac

SEQ ID NO: 744612 - DNA, 16 bp, Homo sapiens
tcattatgatttcatt

SEQ ID NO: 744613 - DNA, 18 bp, Homo sapiens
tcattatgctttgaactt

SEQ ID NO: 744614 - DNA, 21 bp, Homo sapiens
tcattatgctttgaactttag

SEQ ID NO: 744615 - DNA, 17 bp, Homo sapiens
tcattatgttcatgtaa

SEQ ID NO: 744616 - DNA, 16 bp, Homo sapiens
tcattattcaagaatg

SEQ ID NO: 744617 - DNA, 14 bp, Homo sapiens
tcattattctctgc

SEQ ID NO: 744618 - DNA, 17 bp, Homo sapiens
tcattattctctgctat

SEQ ID NO: 744619 - DNA, 17 bp, Homo sapiens
tcattattggaattaac

SEQ ID NO: 744620 - DNA, 15 bp, Homo sapiens
tcattatttattgtt

SEQ ID NO: 744621 - DNA, 18 bp, Homo sapiens
tcattatttattgttaaa

SEQ ID NO: 744622 - DNA, 21 bp, Homo sapiens
tcattatttattgttaaatta

SEQ ID NO: 744623 - DNA, 23 bp, Homo sapiens
tcattatttattgttaaattaca

SEQ ID NO: 744624 - DNA, 22 bp, Homo sapiens
tcattcaaatcagtgatctatg

SEQ ID NO: 744625 - DNA, 14 bp, Homo sapiens
tcattcaagctatt

SEQ ID NO: 744626 - DNA, 15 bp, Homo sapiens
tcattcaatattgac

SEQ ID NO: 744627 - DNA, 20 bp, Homo sapiens
tcattcaatattgacatttg

SEQ ID NO: 744628 - DNA, 21 bp, Homo sapiens
tcattcaatattgacatttgt

SEQ ID NO: 744629 - DNA, 13 bp, Homo sapiens
tcattcagaaaaa

SEQ ID NO: 744630 - DNA, 18 bp, Homo sapiens
tcattcagcctttagaaa

SEQ ID NO: 744631 - DNA, 12 bp, Homo sapiens
tcattcaggaaa

SEQ ID NO: 744632 - DNA, 15 bp, Homo sapiens
tcattcatacttaaa

SEQ ID NO: 744633 - DNA, 12 bp, Homo sapiens
tcattcatattt

SEQ ID NO: 744634 - DNA, 18 bp, Homo sapiens
tcattcatgacaacatga

SEQ ID NO: 744635 - DNA, 15 bp, Homo sapiens
tcattcattcttagc

SEQ ID NO: 744636 - DNA, 17 bp, Homo sapiens
tcattccaattctaaat

SEQ ID NO: 744637 - DNA, 19 bp, Homo sapiens
tcattccagagtgctgagg

SEQ ID NO: 744638 - DNA, 15 bp, Homo sapiens
tcattccagcagctg

SEQ ID NO: 744639 - DNA, 18 bp, Homo sapiens
tcattccagtgctagaaa

SEQ ID NO: 744640 - DNA, 13 bp, Homo sapiens
tcattccattgcc

SEQ ID NO: 744641 - DNA, 18 bp, Homo sapiens
gcattaccgcgttgtaaa

SEQ ID NO: 744642 - DNA, 19 bp, Homo sapiens
gcattacttgctttcaatt

SEQ ID NO: 744643 - DNA, 15 bp, Homo sapiens
gcattagaattattt

SEQ ID NO: 744644 - DNA, 18 bp, Homo sapiens
gcattagagaaatgaatt

SEQ ID NO: 744645 - DNA, 21 bp, Homo sapiens
gcattagagtcaactacacaa

SEQ ID NO: 744646 - DNA, 21 bp, Homo sapiens
gcattaggcttttaagaaaca

SEQ ID NO: 744647 - DNA, 16 bp, Homo sapiens
gcattagtgtcccccc

SEQ ID NO: 744648 - DNA, 17 bp, Homo sapiens
gcattagtgtcccccct

SEQ ID NO: 744649 - DNA, 19 bp, Homo sapiens
gcattagtgtccccccttg

SEQ ID NO: 744650 - DNA, 22 bp, Homo sapiens
gcattagtgtccccccttgaag

SEQ ID NO: 744651 - DNA, 15 bp, Homo sapiens
gcattatataccatt

SEQ ID NO: 744652 - DNA, 17 bp, Homo sapiens
gcattatctatgcagca

SEQ ID NO: 744653 - DNA, 14 bp, Homo sapiens
gcattatgcaatta

SEQ ID NO: 744654 - DNA, 22 bp, Homo sapiens
gcattatgtatttataatttaa

SEQ ID NO: 744655 - DNA, 23 bp, Homo sapiens
gcattatgtatttataatttaaa

SEQ ID NO: 744656 - DNA, 21 bp, Homo sapiens
gcattatgtccactgtgtata

SEQ ID NO: 744657 - DNA, 14 bp, Homo sapiens
gcattattcataaa

SEQ ID NO: 744658 - DNA, 14 bp, Homo sapiens
gcattattgcatta

SEQ ID NO: 744659 - DNA, 16 bp, Homo sapiens
gcattatttaatgttt

SEQ ID NO: 744660 - DNA, 23 bp, Homo sapiens
gcattatttaatgtttgatttag

SEQ ID NO: 744661 - DNA, 20 bp, Homo sapiens
gcattcaaaaagacagcaga

SEQ ID NO: 744662 - DNA, 16 bp, Homo sapiens
gcattcagaagaaaaa

SEQ ID NO: 744663 - DNA, 16 bp, Homo sapiens
gcattcagagagcagc

SEQ ID NO: 744664 - DNA, 17 bp, Homo sapiens
gcattcagcacacacaa

SEQ ID NO: 744665 - DNA, 15 bp, Homo sapiens
gcattcatttttata

SEQ ID NO: 744666 - DNA, 17 bp, Homo sapiens
gcattcatttttatagc

SEQ ID NO: 744667 - DNA, 19 bp, Homo sapiens
gcattcatttttatagcaa

SEQ ID NO: 744668 - DNA, 15 bp, Homo sapiens
gcattccagaatctt

SEQ ID NO: 744669 - DNA, 16 bp, Homo sapiens
gcattccagaatcttg

SEQ ID NO: 744670 - DNA, 16 bp, Homo sapiens
gcattccagcccctct

SEQ ID NO: 744671 - DNA, 19 bp, Homo sapiens
gcattccagcccctctggt

SEQ ID NO: 744672 - DNA, 14 bp, Homo sapiens
gcattccagctctg

SEQ ID NO: 744673 - DNA, 13 bp, Homo sapiens
gcattccctgagt

SEQ ID NO: 744674 - DNA, 15 bp, Homo sapiens
gccaagtccactgtc

SEQ ID NO: 744675 - DNA, 21 bp, Homo sapiens
gccaagtccgcagaagccctg

SEQ ID NO: 744676 - DNA, 15 bp, Homo sapiens
gccaagtgcaggctg

SEQ ID NO: 744677 - DNA, 16 bp, Homo sapiens
gccaagtgcaggctgg

SEQ ID NO: 744678 - DNA, 20 bp, Homo sapiens
gccaagtgcaggctggcacc

SEQ ID NO: 744679 - DNA, 12 bp, Homo sapiens
gccaagtgccta

SEQ ID NO: 744680 - DNA, 21 bp, Homo sapiens
gccaagtggacttggagctgc

SEQ ID NO: 744681 - DNA, 23 bp, Homo sapiens
gccaagtggccactggcatcgca

SEQ ID NO: 744682 - DNA, 20 bp, Homo sapiens
gccaagtggggtgctgggag

SEQ ID NO: 744683 - DNA, 12 bp, Homo sapiens
gccaagttctta

SEQ ID NO: 744684 - DNA, 11 bp, Homo sapiens
gccaataaaaa

SEQ ID NO: 744685 - DNA, 19 bp, Homo sapiens
gccaataccctactgtggg

SEQ ID NO: 744686 - DNA, 12 bp, Homo sapiens
gccaatgaggtc

SEQ ID NO: 744687 - DNA, 19 bp, Homo sapiens
gccaatgaggtctgaaatg

SEQ ID NO: 744688 - DNA, 18 bp, Homo sapiens
gccaatgatgtgaccctc

SEQ ID NO: 744689 - DNA, 18 bp, Homo sapiens
gccaatgccccactggca

SEQ ID NO: 744690 - DNA, 19 bp, Homo sapiens
gccaatggaaacctcacgc

SEQ ID NO: 744691 - DNA, 14 bp, Homo sapiens
gccaatggtgcttc

SEQ ID NO: 744692 - DNA, 19 bp, Homo sapiens
gccaatgtgggctgcccct

SEQ ID NO: 744693 - DNA, 20 bp, Homo sapiens
gccaatgtgggctgcccctc

SEQ ID NO: 744694 - DNA, 19 bp, Homo sapiens
gccaattattgttacacat

SEQ ID NO: 744695 - DNA, 15 bp, Homo sapiens
gccaattcagacagg

SEQ ID NO: 744696 - DNA, 20 bp, Homo sapiens
gccaatttcaagttccaagt

SEQ ID NO: 744697 - DNA, 13 bp, Homo sapiens
gccaatttgtctc

SEQ ID NO: 744698 - DNA, 15 bp, Homo sapiens
gccaatttgtctcct

SEQ ID NO: 744699 - DNA, 18 bp, Homo sapiens
gccaatttttgttttccc

SEQ ID NO: 744700 - DNA, 14 bp, Homo sapiens
gccacaaaaacaat

SEQ ID NO: 744701 - DNA, 16 bp, Homo sapiens
gccacaaaccaccagg

SEQ ID NO: 744702 - DNA, 18 bp, Homo sapiens
gccacaacaccagcccca

SEQ ID NO: 744703 - DNA, 21 bp, Homo sapiens
gccacaaccctgttttatact

SEQ ID NO: 744704 - DNA, 23 bp, Homo sapiens
gccacaagaaatttgatttctat

SEQ ID NO: 744705 - DNA, 13 bp, Homo sapiens
gccacaagctgca

SEQ ID NO: 744706 - DNA, 16 bp, Homo sapiens
gccacaagctgcactg

SEQ ID NO: 744707 - DNA, 19 bp, Homo sapiens
gccacaagctgcactgtga

SEQ ID NO: 744708 - DNA, 15 bp, Homo sapiens
gccacaagtcttcca

SEQ ID NO: 744709 - DNA, 21 bp, Homo sapiens
gccacaatgcagttctgagca

SEQ ID NO: 744710 - DNA, 18 bp, Homo sapiens
gccacacactgcacatct

SEQ ID NO: 744711 - DNA, 13 bp, Homo sapiens
gccacacagaaac

SEQ ID NO: 744712 - DNA, 17 bp, Homo sapiens
gccacacattgtgcttg

SEQ ID NO: 744713 - DNA, 18 bp, Homo sapiens
gccacaccaatcagagag

SEQ ID NO: 744714 - DNA, 17 bp, Homo sapiens
gccacacccaggaaggg

SEQ ID NO: 744715 - DNA, 14 bp, Homo sapiens
gccacacccagggg

SEQ ID NO: 744716 - DNA, 21 bp, Homo sapiens
gccacacctggactgaccctg

SEQ ID NO: 744717 - DNA, 12 bp, Homo sapiens
gccacacctggc

SEQ ID NO: 744718 - DNA, 13 bp, Homo sapiens
gccacacgcaggc

SEQ ID NO: 744719 - DNA, 14 bp, Homo sapiens
gccacacgcaggcg

SEQ ID NO: 744720 - DNA, 16 bp, Homo sapiens
gccacacgcaggcggc

SEQ ID NO: 744721 - DNA, 19 bp, Homo sapiens
gccacacgcaggcggccag

SEQ ID NO: 744722 - DNA, 21 bp, Homo sapiens
gccacactattaccatgagaa

SEQ ID NO: 744723 - DNA, 13 bp, Homo sapiens
gccacactcagca

SEQ ID NO: 744724 - DNA, 16 bp, Homo sapiens
gccacactcagcacaa

SEQ ID NO: 744725 - DNA, 17 bp, Homo sapiens
gccacactcagcacaag

SEQ ID NO: 744726 - DNA, 17 bp, Homo sapiens
gccacactctccatcac

SEQ ID NO: 744727 - DNA, 12 bp, Homo sapiens
gccacactgatg

SEQ ID NO: 744728 - DNA, 14 bp, Homo sapiens
gccacactgatggc

SEQ ID NO: 744729 - DNA, 20 bp, Homo sapiens
gccacacttcaggctcttct

SEQ ID NO: 744730 - DNA, 16 bp, Homo sapiens
gccacagcagcctctg

SEQ ID NO: 744731 - DNA, 14 bp, Homo sapiens
gccacagccagagg

SEQ ID NO: 744732 - DNA, 17 bp, Homo sapiens
gccacagccagaggagg

SEQ ID NO: 744733 - DNA, 14 bp, Homo sapiens
gccacagcctgctg

SEQ ID NO: 744734 - DNA, 17 bp, Homo sapiens
gccacagcctgctggca

SEQ ID NO: 744735 - DNA, 15 bp, Homo sapiens
gccacagcgccagcc

SEQ ID NO: 744736 - DNA, 18 bp, Homo sapiens
gccacagcgccagcctca

SEQ ID NO: 744737 - DNA, 16 bp, Homo sapiens
gccacagcgtgctggc

SEQ ID NO: 744738 - DNA, 14 bp, Homo sapiens
gccacagctgctgg

SEQ ID NO: 744739 - DNA, 18 bp, Homo sapiens
gccacagctgctggagaa

SEQ ID NO: 744740 - DNA, 16 bp, Homo sapiens
gccacagctgctgttc

SEQ ID NO: 744741 - DNA, 18 bp, Homo sapiens
gccacagctgctgttctc

SEQ ID NO: 744742 - DNA, 20 bp, Homo sapiens
gccacagctgctgttctcag

SEQ ID NO: 744743 - DNA, 10 bp, Homo sapiens
gccacagctt

SEQ ID NO: 744744 - DNA, 13 bp, Homo sapiens
gccacagcttttg

SEQ ID NO: 744745 - DNA, 17 bp, Homo sapiens
gccacaggaacggccct

SEQ ID NO: 744746 - DNA, 21 bp, Homo sapiens
gccacaggaacggccctgcag

SEQ ID NO: 744747 - DNA, 20 bp, Homo sapiens
gccacaggaaggaggggaga

SEQ ID NO: 744748 - DNA, 20 bp, Homo sapiens
gccacaggactgagccctct

SEQ ID NO: 744749 - DNA, 20 bp, Homo sapiens
gccacaggcaggtcacagaa

SEQ ID NO: 744750 - DNA, 21 bp, Homo sapiens
gccacaggcaggtcacagaaa

SEQ ID NO: 744751 - DNA, 11 bp, Homo sapiens
gccacagtggg

SEQ ID NO: 744752 - DNA, 20 bp, Homo sapiens
gccacagtgtcactggtcag

SEQ ID NO: 744753 - DNA, 13 bp, Homo sapiens
gccacatcagccc

SEQ ID NO: 744754 - DNA, 14 bp, Homo sapiens
gccacatcagcccc

SEQ ID NO: 744755 - DNA, 17 bp, Homo sapiens
gccacatcattctgtgt

SEQ ID NO: 744756 - DNA, 14 bp, Homo sapiens
gccacatcttgctc

SEQ ID NO: 744757 - DNA, 15 bp, Homo sapiens
gccacatggagcccc

SEQ ID NO: 744758 - DNA, 16 bp, Homo sapiens
gccacatggagccccc

SEQ ID NO: 744759 - DNA, 15 bp, Homo sapiens
gccacatgggaggct

SEQ ID NO: 744760 - DNA, 17 bp, Homo sapiens
gccacatggtgtctccc

SEQ ID NO: 744761 - DNA, 23 bp, Homo sapiens
gccacatggtgtctcccaacatg

SEQ ID NO: 744762 - DNA, 18 bp, Homo sapiens
gccacatggtgtggccat

SEQ ID NO: 744763 - DNA, 18 bp, Homo sapiens
gccacattgacagtggtg

SEQ ID NO: 744764 - DNA, 17 bp, Homo sapiens
gccacattgatttttct

SEQ ID NO: 744765 - DNA, 19 bp, Homo sapiens
gccacatttggaatacttt

SEQ ID NO: 744766 - DNA, 19 bp, Homo sapiens
gccaccaaagctgcccact

SEQ ID NO: 744767 - DNA, 14 bp, Homo sapiens
gccaccaagaggga

SEQ ID NO: 744768 - DNA, 22 bp, Homo sapiens
gccaccaagagggacgcctggg

SEQ ID NO: 744769 - DNA, 15 bp, Homo sapiens
gccaccaccctcagg

SEQ ID NO: 744770 - DNA, 18 bp, Homo sapiens
gccaccacctctgtggca

SEQ ID NO: 744771 - DNA, 23 bp, Homo sapiens
gccaccacctttggctggtagca

SEQ ID NO: 744772 - DNA, 19 bp, Homo sapiens
gccaccacgtctgccaggc

SEQ ID NO: 744773 - DNA, 22 bp, Homo sapiens
gccaccacgtctgccaggccca

SEQ ID NO: 744774 - DNA, 16 bp, Homo sapiens
gccaccactagagctg

SEQ ID NO: 744775 - DNA, 17 bp, Homo sapiens
tccaagacattgtcaat

SEQ ID NO: 744776 - DNA, 16 bp, Homo sapiens
tccaagacctggtgtg

SEQ ID NO: 744777 - DNA, 16 bp, Homo sapiens
tccaagactgaagact

SEQ ID NO: 744778 - DNA, 18 bp, Homo sapiens
tccaagagaactaaagct

SEQ ID NO: 744779 - DNA, 12 bp, Homo sapiens
tccaagagacat

SEQ ID NO: 744780 - DNA, 13 bp, Homo sapiens
tccaagagacatg

SEQ ID NO: 744781 - DNA, 20 bp, Homo sapiens
tccaagagacatggaagaga

SEQ ID NO: 744782 - DNA, 22 bp, Homo sapiens
tccaagagacatggaagagaga

SEQ ID NO: 744783 - DNA, 13 bp, Homo sapiens
tccaagaggctga

SEQ ID NO: 744784 - DNA, 19 bp, Homo sapiens
tccaagagggtcctttagt

SEQ ID NO: 744785 - DNA, 18 bp, Homo sapiens
tccaagatattttaaaat

SEQ ID NO: 744786 - DNA, 22 bp, Homo sapiens
tccaagatattttaaaatctgt

SEQ ID NO: 744787 - DNA, 11 bp, Homo sapiens
tccaagcaaag

SEQ ID NO: 744788 - DNA, 19 bp, Homo sapiens
tccaagcaagtagctttcc

SEQ ID NO: 744789 - DNA, 23 bp, Homo sapiens
tccaagcaagtagctttccacat

SEQ ID NO: 744790 - DNA, 21 bp, Homo sapiens
tccaagcacagagcctggccc

SEQ ID NO: 744791 - DNA, 22 bp, Homo sapiens
tccaagcacagagcctggcccc

SEQ ID NO: 744792 - DNA, 15 bp, Homo sapiens
tccaagcagactcca

SEQ ID NO: 744793 - DNA, 17 bp, Homo sapiens
tccaagcagactccagc

SEQ ID NO: 744794 - DNA, 22 bp, Homo sapiens
tccaagcagactccagcccctg

SEQ ID NO: 744795 - DNA, 12 bp, Homo sapiens
tccaagcatttc

SEQ ID NO: 744796 - DNA, 14 bp, Homo sapiens
tccaagcatttcat

SEQ ID NO: 744797 - DNA, 16 bp, Homo sapiens
taaatatctttttcct

SEQ ID NO: 744798 - DNA, 15 bp, Homo sapiens
taaatatgtaatata

SEQ ID NO: 744799 - DNA, 13 bp, Homo sapiens
taaatatgtcaga

SEQ ID NO: 744800 - DNA, 14 bp, Homo sapiens
taaatatgtgaaga

SEQ ID NO: 744801 - DNA, 15 bp, Homo sapiens
taaatatgtgaagaa

SEQ ID NO: 744802 - DNA, 18 bp, Homo sapiens
taaatatgttagcaaaga

SEQ ID NO: 744803 - DNA, 15 bp, Homo sapiens
taaatattctatatg

SEQ ID NO: 744804 - DNA, 14 bp, Homo sapiens
taaatattctgcat

SEQ ID NO: 744805 - DNA, 12 bp, Homo sapiens
taaatattcttg

SEQ ID NO: 744806 - DNA, 13 bp, Homo sapiens
taaatatttcctt

SEQ ID NO: 744807 - DNA, 19 bp, Homo sapiens
taaatatttgtgactcttt

SEQ ID NO: 744808 - DNA, 15 bp, Homo sapiens
taaatattttaaaga

SEQ ID NO: 744809 - DNA, 19 bp, Homo sapiens
taaatattttcaagaaaag

SEQ ID NO: 744810 - DNA, 14 bp, Homo sapiens
taaatattttctat

SEQ ID NO: 744811 - DNA, 18 bp, Homo sapiens
taaatatttttccctccg

SEQ ID NO: 744812 - DNA, 12 bp, Homo sapiens
taaatcaatcag

SEQ ID NO: 744813 - DNA, 18 bp, Homo sapiens
taaatcacgctttttgaa

SEQ ID NO: 744814 - DNA, 19 bp, Homo sapiens
taaatcacgctttttgaaa

SEQ ID NO: 744815 - DNA, 22 bp, Homo sapiens
taaatcacgctttttgaaaaag

SEQ ID NO: 744816 - DNA, 19 bp, Homo sapiens
taaatcagaaagtaacaat

SEQ ID NO: 744817 - DNA, 21 bp, Homo sapiens
taaatcagaaagtaacaatct

SEQ ID NO: 744818 - DNA, 22 bp, Homo sapiens
taaatcagaaagtaacaatcta

SEQ ID NO: 744819 - DNA, 19 bp, Homo sapiens
taaatcagccgtgtaacca

SEQ ID NO: 744820 - DNA, 22 bp, Homo sapiens
taaatcagtcaagctgttgaag

SEQ ID NO: 744821 - DNA, 16 bp, Homo sapiens
taaatcatgatgctag

SEQ ID NO: 744822 - DNA, 14 bp, Homo sapiens
taaatcatgtatgt

SEQ ID NO: 744823 - DNA, 16 bp, Homo sapiens
taaatcatgtatgtta

SEQ ID NO: 744824 - DNA, 15 bp, Homo sapiens
taaatcatgttttga

SEQ ID NO: 744825 - DNA, 21 bp, Homo sapiens
taaatccgacttgaatattcc

SEQ ID NO: 744826 - DNA, 18 bp, Homo sapiens
taaatcctagacttgaaa

SEQ ID NO: 744827 - DNA, 14 bp, Homo sapiens
taaatcctgaagag

SEQ ID NO: 744828 - DNA, 23 bp, Homo sapiens
taaatccttgggagtcattacca

SEQ ID NO: 744829 - DNA, 19 bp, Homo sapiens
taaatccttttgttttgaa

SEQ ID NO: 744830 - DNA, 19 bp, Homo sapiens
taaatctaaatctatttat

SEQ ID NO: 744831 - DNA, 19 bp, Homo sapiens
taaatctccaaaataaaac

SEQ ID NO: 744832 - DNA, 15 bp, Homo sapiens
taaatctctaatatg

SEQ ID NO: 744833 - DNA, 18 bp, Homo sapiens
taaatctctaatatggca

SEQ ID NO: 744834 - DNA, 14 bp, Homo sapiens
taaatctgaagaaa

SEQ ID NO: 744835 - DNA, 20 bp, Homo sapiens
taaatctgaagaaagttatt

SEQ ID NO: 744836 - DNA, 22 bp, Homo sapiens
taaatctgaagaaagttattct

SEQ ID NO: 744837 - DNA, 13 bp, Homo sapiens
taaatctgtgatg

SEQ ID NO: 744838 - DNA, 14 bp, Homo sapiens
taaatctgtgatga

SEQ ID NO: 744839 - DNA, 18 bp, Homo sapiens
taaatctgttgccaagct

SEQ ID NO: 744840 - DNA, 22 bp, Homo sapiens
taaatcttaaacaatgtataaa

SEQ ID NO: 744841 - DNA, 16 bp, Homo sapiens
taaatcttaatgttcc

SEQ ID NO: 744842 - DNA, 16 bp, Homo sapiens
taaatcttagtgttca

SEQ ID NO: 744843 - DNA, 16 bp, Homo sapiens
taaatctttttgcttc

SEQ ID NO: 744844 - DNA, 18 bp, Homo sapiens
taaatctttttgcttcta

SEQ ID NO: 744845 - DNA, 20 bp, Homo sapiens
taaatctttttgcttctact

SEQ ID NO: 744846 - DNA, 14 bp, Homo sapiens
taaatgaaaaacac

SEQ ID NO: 744847 - DNA, 15 bp, Homo sapiens
taaatgaaaggagtt

SEQ ID NO: 744848 - DNA, 22 bp, Homo sapiens
taaatgaagcagctttaaacaa

SEQ ID NO: 744849 - DNA, 16 bp, Homo sapiens
taaatgaatctggtgt

SEQ ID NO: 744850 - DNA, 21 bp, Homo sapiens
taaatgaatgagccaaaatga

SEQ ID NO: 744851 - DNA, 16 bp, Homo sapiens
taaatgacacccagac

SEQ ID NO: 744852 - DNA, 21 bp, Homo sapiens
taaatgacttgattgtacttg

SEQ ID NO: 744853 - DNA, 23 bp, Homo sapiens
taaatgatgtgttggtttacagg

SEQ ID NO: 744854 - DNA, 15 bp, Homo sapiens
taaatgattatattc

SEQ ID NO: 744855 - DNA, 14 bp, Homo sapiens
gaagcagttgtgtc

SEQ ID NO: 744856 - DNA, 18 bp, Homo sapiens
gaagcataatttgtttaa

SEQ ID NO: 744857 - DNA, 22 bp, Homo sapiens
gaagcataatttgtttaaaatt

SEQ ID NO: 744858 - DNA, 17 bp, Homo sapiens
gaagcatacactatgaa

SEQ ID NO: 744859 - DNA, 17 bp, Homo sapiens
gaagcatagctacaatt

SEQ ID NO: 744860 - DNA, 16 bp, Homo sapiens
gaagcatgaaaaagca

SEQ ID NO: 744861 - DNA, 22 bp, Homo sapiens
gaagcatgagttatctgatttt

SEQ ID NO: 744862 - DNA, 19 bp, Homo sapiens
gaagcatgctttgctgcta

SEQ ID NO: 744863 - DNA, 22 bp, Homo sapiens
gaagcatgctttgctgctatga

SEQ ID NO: 744864 - DNA, 17 bp, Homo sapiens
gaagcatgtaggagaat

SEQ ID NO: 744865 - DNA, 13 bp, Homo sapiens
gaagcatgtttca

SEQ ID NO: 744866 - DNA, 20 bp, Homo sapiens
gaagcattaacttctctgga

SEQ ID NO: 744867 - DNA, 23 bp, Homo sapiens
gaagcatttcaaagccctgcctc

SEQ ID NO: 744868 - DNA, 12 bp, Homo sapiens
gaagcatttgta

SEQ ID NO: 744869 - DNA, 14 bp, Homo sapiens
gaagcatttgtatt

SEQ ID NO: 744870 - DNA, 15 bp, Homo sapiens
gaagcatttgtattt

SEQ ID NO: 744871 - DNA, 16 bp, Homo sapiens
gaagcatttgtatttt

SEQ ID NO: 744872 - DNA, 19 bp, Homo sapiens
gaagcatttgtttctactt

SEQ ID NO: 744873 - DNA, 13 bp, Homo sapiens
gaagccaaagaaa

SEQ ID NO: 744874 - DNA, 14 bp, Homo sapiens
gaagccaaagaaaa

SEQ ID NO: 744875 - DNA, 13 bp, Homo sapiens
gaagccaaagagt

SEQ ID NO: 744876 - DNA, 14 bp, Homo sapiens
gaagccaagctccc

SEQ ID NO: 744877 - DNA, 19 bp, Homo sapiens
gaagccaagctccctggag

SEQ ID NO: 744878 - DNA, 23 bp, Homo sapiens
gaagccaagctccctggagccct

SEQ ID NO: 744879 - DNA, 15 bp, Homo sapiens
gaagccaagggaaag

SEQ ID NO: 744880 - DNA, 21 bp, Homo sapiens
gaagccaagtggggtgctggg

SEQ ID NO: 744881 - DNA, 20 bp, Homo sapiens
gaagccaattcagacaggca

SEQ ID NO: 744882 - DNA, 12 bp, Homo sapiens
gaagccacatcg

SEQ ID NO: 744883 - DNA, 14 bp, Homo sapiens
gaagccaccttccc

SEQ ID NO: 744884 - DNA, 15 bp, Homo sapiens
gaagccaccttccca

SEQ ID NO: 744885 - DNA, 16 bp, Homo sapiens
gaagccacgctgtcct

SEQ ID NO: 744886 - DNA, 17 bp, Homo sapiens
gaagccacgctgtcctc

SEQ ID NO: 744887 - DNA, 18 bp, Homo sapiens
gaagccactgaagctggg

SEQ ID NO: 744888 - DNA, 13 bp, Homo sapiens
gaagccagagccc

SEQ ID NO: 744889 - DNA, 13 bp, Homo sapiens
gaagccagctgcc

SEQ ID NO: 744890 - DNA, 15 bp, Homo sapiens
gaagccaggagcaaa

SEQ ID NO: 744891 - DNA, 18 bp, Homo sapiens
gaagccaggtacaggaga

SEQ ID NO: 744892 - DNA, 12 bp, Homo sapiens
gaagccagttgc

SEQ ID NO: 744893 - DNA, 22 bp, Homo sapiens
gaagccatatatgaccagaagc

SEQ ID NO: 744894 - DNA, 17 bp, Homo sapiens
gaagccatcacttctcc

SEQ ID NO: 744895 - DNA, 22 bp, Homo sapiens
gaagccatccctttttttacat

SEQ ID NO: 744896 - DNA, 12 bp, Homo sapiens
gaagccatggga

SEQ ID NO: 744897 - DNA, 15 bp, Homo sapiens
gaagccatgggacct

SEQ ID NO: 744898 - DNA, 21 bp, Homo sapiens
gaagccatgtggggttgctga

SEQ ID NO: 744899 - DNA, 21 bp, Homo sapiens
gaagcccatcctgaccagctg

SEQ ID NO: 744900 - DNA, 18 bp, Homo sapiens
gaagcccctgggcccagt

SEQ ID NO: 744901 - DNA, 13 bp, Homo sapiens
gaagcccctgtcg

SEQ ID NO: 744902 - DNA, 14 bp, Homo sapiens
gaagccccttggag

SEQ ID NO: 744903 - DNA, 19 bp, Homo sapiens
gaagccccttggagagaga

SEQ ID NO: 744904 - DNA, 12 bp, Homo sapiens
gaagccctcctt

SEQ ID NO: 744905 - DNA, 19 bp, Homo sapiens
gaagccctccttccacgga

SEQ ID NO: 744906 - DNA, 20 bp, Homo sapiens
gaagccctgcagagcacaaa

SEQ ID NO: 744907 - DNA, 11 bp, Homo sapiens
gaagccctgga

SEQ ID NO: 744908 - DNA, 21 bp, Homo sapiens
gaagccctggatttcagaaag

SEQ ID NO: 744909 - DNA, 16 bp, Homo sapiens
gaagccctgtctgttt

SEQ ID NO: 744910 - DNA, 19 bp, Homo sapiens
gaagccgactctggccctg

SEQ ID NO: 744911 - DNA, 16 bp, Homo sapiens
gaagccggagggtgtt

SEQ ID NO: 744912 - DNA, 15 bp, Homo sapiens
gaagccggtgtccct

SEQ ID NO: 744913 - DNA, 16 bp, Homo sapiens
gaagccggtgtccctg

SEQ ID NO: 744914 - DNA, 16 bp, Homo sapiens
gaagccgtctgactcc

SEQ ID NO: 744915 - DNA, 21 bp, Homo sapiens
gaagccgttgaatctgggagg

SEQ ID NO: 744916 - DNA, 22 bp, Homo sapiens
gaagccgttgaatctgggaggg

SEQ ID NO: 744917 - DNA, 23 bp, Homo sapiens
gaagccgttgaatctgggaggga

SEQ ID NO: 744918 - DNA, 19 bp, Homo sapiens
gaagcctccaagcacagag

SEQ ID NO: 744919 - DNA, 21 bp, Homo sapiens
gaagcctccaagcacagagcc

SEQ ID NO: 744920 - DNA, 21 bp, Homo sapiens
gaagcctccgtggaacattct

SEQ ID NO: 744921 - DNA, 19 bp, Homo sapiens
gaagcctccttagaaaaaa

SEQ ID NO: 744922 - DNA, 22 bp, Homo sapiens
gaagcctctctccttggccaca

SEQ ID NO: 744923 - DNA, 13 bp, Homo sapiens
gaagcctgaggct

SEQ ID NO: 744924 - DNA, 23 bp, Homo sapiens
gaagcctgcgttggtccagagcg

SEQ ID NO: 744925 - DNA, 21 bp, Homo sapiens
gaagcctggactctaagctgg

SEQ ID NO: 744926 - DNA, 14 bp, Homo sapiens
gaagcctggattcc

SEQ ID NO: 744927 - DNA, 12 bp, Homo sapiens
gaagcctgtcct

SEQ ID NO: 744928 - DNA, 16 bp, Homo sapiens
gaagcctgtcctcacc

SEQ ID NO: 744929 - DNA, 19 bp, Homo sapiens
taacacgctgcctggtctg

SEQ ID NO: 744930 - DNA, 20 bp, Homo sapiens
taacactaatatatttaaaa

SEQ ID NO: 744931 - DNA, 23 bp, Homo sapiens
taacactaatatatttaaaaata

SEQ ID NO: 744932 - DNA, 22 bp, Homo sapiens
taacactctaggatgtatattt

SEQ ID NO: 744933 - DNA, 15 bp, Homo sapiens
taacactgttaagag

SEQ ID NO: 744934 - DNA, 14 bp, Homo sapiens
taacacttctgtat

SEQ ID NO: 744935 - DNA, 20 bp, Homo sapiens
taacactttgtattacttag

SEQ ID NO: 744936 - DNA, 11 bp, Homo sapiens
taacagaaatg

SEQ ID NO: 744937 - DNA, 12 bp, Homo sapiens
taacagaaatgt

SEQ ID NO: 744938 - DNA, 13 bp, Homo sapiens
taacagaaatgta

SEQ ID NO: 744939 - DNA, 14 bp, Homo sapiens
taacagaaatgtac

SEQ ID NO: 744940 - DNA, 15 bp, Homo sapiens
taacagaaatgtaca

SEQ ID NO: 744941 - DNA, 14 bp, Homo sapiens
taacagaaattgta

SEQ ID NO: 744942 - DNA, 14 bp, Homo sapiens
taacagaagaaaat

SEQ ID NO: 744943 - DNA, 15 bp, Homo sapiens
taacagaagaaaata

SEQ ID NO: 744944 - DNA, 13 bp, Homo sapiens
taacagagaaata

SEQ ID NO: 744945 - DNA, 16 bp, Homo sapiens
taacagagaaatagag

SEQ ID NO: 744946 - DNA, 20 bp, Homo sapiens
taacagatcagaacatgaaa

SEQ ID NO: 744947 - DNA, 17 bp, Homo sapiens
taacagatcctttcaaa

SEQ ID NO: 744948 - DNA, 18 bp, Homo sapiens
taacagatcctttcaaaa

SEQ ID NO: 744949 - DNA, 22 bp, Homo sapiens
taacagattttggggttgtgtt

SEQ ID NO: 744950 - DNA, 22 bp, Homo sapiens
taacagcattcttgtcacaata

SEQ ID NO: 744951 - DNA, 19 bp, Homo sapiens
taacagccaggagtgttaa

SEQ ID NO: 744952 - DNA, 18 bp, Homo sapiens
taacagccctcctctgca

SEQ ID NO: 744953 - DNA, 12 bp, Homo sapiens
taacagctgggg

SEQ ID NO: 744954 - DNA, 15 bp, Homo sapiens
taacaggatgaaagt

SEQ ID NO: 744955 - DNA, 23 bp, Homo sapiens
taacagggagaagtagctagtag

SEQ ID NO: 744956 - DNA, 23 bp, Homo sapiens
taacagggtctctagtgctgtga

SEQ ID NO: 744957 - DNA, 13 bp, Homo sapiens
taacaggtctcct

SEQ ID NO: 744958 - DNA, 24 bp, Homo sapiens
taacaggtgtggggacacagcagt

SEQ ID NO: 744959 - DNA, 14 bp, Homo sapiens
taacagtatttctc

SEQ ID NO: 744960 - DNA, 23 bp, Homo sapiens
taacagtatttctcttttattct

SEQ ID NO: 744961 - DNA, 15 bp, Homo sapiens
taacagtcatttaaa

SEQ ID NO: 744962 - DNA, 21 bp, Homo sapiens
taacagtcctaactggtatag

SEQ ID NO: 744963 - DNA, 16 bp, Homo sapiens
taacagtctagtgcaa

SEQ ID NO: 744964 - DNA, 15 bp, Homo sapiens
taacagtcttactgc

SEQ ID NO: 744965 - DNA, 18 bp, Homo sapiens
taacagtggctgcttctc

SEQ ID NO: 744966 - DNA, 19 bp, Homo sapiens
taacagtgtctttctagcc

SEQ ID NO: 744967 - DNA, 20 bp, Homo sapiens
taacagtgtctttctagcca

SEQ ID NO: 744968 - DNA, 15 bp, Homo sapiens
taacagttatatttt

SEQ ID NO: 744969 - DNA, 14 bp, Homo sapiens
taacagttcatgtt

SEQ ID NO: 744970 - DNA, 18 bp, Homo sapiens
taacagttcatgtttgct

SEQ ID NO: 744971 - DNA, 18 bp, Homo sapiens
taacagttgtatttaaca

SEQ ID NO: 744972 - DNA, 19 bp, Homo sapiens
taacagttgtatttaacag

SEQ ID NO: 744973 - DNA, 15 bp, Homo sapiens
taacagttgtgtcat

SEQ ID NO: 744974 - DNA, 16 bp, Homo sapiens
taacagttgtgtcata

SEQ ID NO: 744975 - DNA, 14 bp, Homo sapiens
taacagtttgcctg

SEQ ID NO: 744976 - DNA, 21 bp, Homo sapiens
taacagtttgcctgctgtatt

SEQ ID NO: 744977 - DNA, 16 bp, Homo sapiens
gaagcttccacaaaat

SEQ ID NO: 744978 - DNA, 23 bp, Homo sapiens
gaagcttggcttcctcttcttgt

SEQ ID NO: 744979 - DNA, 12 bp, Homo sapiens
gaagctttacca

SEQ ID NO: 744980 - DNA, 15 bp, Homo sapiens
gaaggaaaagcaaga

SEQ ID NO: 744981 - DNA, 14 bp, Homo sapiens
gaaggaaacaaatg

SEQ ID NO: 744982 - DNA, 20 bp, Homo sapiens
gaaggaaagcatgtctctgc

SEQ ID NO: 744983 - DNA, 15 bp, Homo sapiens
gaaggaaagggaaga

SEQ ID NO: 744984 - DNA, 16 bp, Homo sapiens
gaaggaaataaacatt

SEQ ID NO: 744985 - DNA, 16 bp, Homo sapiens
gaaggaaataacattg

SEQ ID NO: 744986 - DNA, 20 bp, Homo sapiens
gaaggaaatgagtggccagc

SEQ ID NO: 744987 - DNA, 15 bp, Homo sapiens
gaaggaaatgatgga

SEQ ID NO: 744988 - DNA, 13 bp, Homo sapiens
gaaggaaggaggg

SEQ ID NO: 744989 - DNA, 16 bp, Homo sapiens
gaaggaaggagggcac

SEQ ID NO: 744990 - DNA, 18 bp, Homo sapiens
gaaggaagtgtgtttgcc

SEQ ID NO: 744991 - DNA, 22 bp, Homo sapiens
gaaggaataaattgctccttga

SEQ ID NO: 744992 - DNA, 15 bp, Homo sapiens
gaaggaatagccaga

SEQ ID NO: 744993 - DNA, 17 bp, Homo sapiens
gaaggaatagccagaga

SEQ ID NO: 744994 - DNA, 19 bp, Homo sapiens
gaaggaatagccagagagg

SEQ ID NO: 744995 - DNA, 19 bp, Homo sapiens
gaaggaatatatggcagag

SEQ ID NO: 744996 - DNA, 20 bp, Homo sapiens
gaaggaatatatggcagagt

SEQ ID NO: 744997 - DNA, 18 bp, Homo sapiens
gaaggaatttgattgctt

SEQ ID NO: 744998 - DNA, 17 bp, Homo sapiens
gaaggaatttgtacttc

SEQ ID NO: 744999 - DNA, 13 bp, Homo sapiens
gaaggaccccagg

SEQ ID NO: 745000 - DNA, 12 bp, Homo sapiens
gaaggacccctc

SEQ ID NO: 745001 - DNA, 14 bp, Homo sapiens
gaaggacccctcac

SEQ ID NO: 745002 - DNA, 20 bp, Homo sapiens
gaaggacccctcaccacccc

SEQ ID NO: 745003 - DNA, 21 bp, Homo sapiens
gaaggacccctcaccaccccc

SEQ ID NO: 745004 - DNA, 19 bp, Homo sapiens
gaaggactaatagaaaagt

SEQ ID NO: 745005 - DNA, 21 bp, Homo sapiens
gaaggactatgaaaagctaga

SEQ ID NO: 745006 - DNA, 16 bp, Homo sapiens
gaaggagaaggaagga

SEQ ID NO: 745007 - DNA, 23 bp, Homo sapiens
gaaggagagatgacccctacccc

SEQ ID NO: 745008 - DNA, 13 bp, Homo sapiens
gaaggagcccctg

SEQ ID NO: 745009 - DNA, 16 bp, Homo sapiens
gaaggaggacccagga

SEQ ID NO: 745010 - DNA, 18 bp, Homo sapiens
gaaggaggacccaggaca

SEQ ID NO: 745011 - DNA, 16 bp, Homo sapiens
gaaggagggacttggc

SEQ ID NO: 745012 - DNA, 19 bp, Homo sapiens
gaaggagggacttggctgt

SEQ ID NO: 745013 - DNA, 13 bp, Homo sapiens
gaaggagggcaga

SEQ ID NO: 745014 - DNA, 14 bp, Homo sapiens
gaaggagggcagag

SEQ ID NO: 745015 - DNA, 20 bp, Homo sapiens
gaaggaggggagagacaggc

SEQ ID NO: 745016 - DNA, 21 bp, Homo sapiens
gaaggaggggagagacaggca

SEQ ID NO: 745017 - DNA, 15 bp, Homo sapiens
gaaggaggggagcct

SEQ ID NO: 745018 - DNA, 19 bp, Homo sapiens
gaaggagggttagggaggg

SEQ ID NO: 745019 - DNA, 13 bp, Homo sapiens
gaaggaggtgagg

SEQ ID NO: 745020 - DNA, 15 bp, Homo sapiens
gaaggaggtgaggga

SEQ ID NO: 745021 - DNA, 17 bp, Homo sapiens
gaaggaggtgagggatg

SEQ ID NO: 745022 - DNA, 19 bp, Homo sapiens
gaaggatacaaaagcatgt

SEQ ID NO: 745023 - DNA, 14 bp, Homo sapiens
gaaggatccaggaa

SEQ ID NO: 745024 - DNA, 16 bp, Homo sapiens
gaaggatccaggaata

SEQ ID NO: 745025 - DNA, 22 bp, Homo sapiens
gaaggatctgctgaggcccagt

SEQ ID NO: 745026 - DNA, 21 bp, Homo sapiens
gaaggatgatgtctttttatt

SEQ ID NO: 745027 - DNA, 19 bp, Homo sapiens
gaaggatggatgagtcaga

SEQ ID NO: 745028 - DNA, 18 bp, Homo sapiens
gaaggatgggtcccctcc

SEQ ID NO: 745029 - DNA, 19 bp, Homo sapiens
gaaggattgcatcctgctg

SEQ ID NO: 745030 - DNA, 21 bp, Homo sapiens
gaaggattgcatcctgctggg

SEQ ID NO: 745031 - DNA, 15 bp, Homo sapiens
gaaggcaaatataag

SEQ ID NO: 745032 - DNA, 16 bp, Homo sapiens
gaaggcaagagggggt

SEQ ID NO: 745033 - DNA, 22 bp, Homo sapiens
gaaggcaagagggggtggaggg

SEQ ID NO: 745034 - DNA, 22 bp, Homo sapiens
gaaggcacacagagattctgga

SEQ ID NO: 745035 - DNA, 18 bp, Homo sapiens
gaaggcagaaagcaaaat

SEQ ID NO: 745036 - DNA, 13 bp, Homo sapiens
gaaggcagacagc

SEQ ID NO: 745037 - DNA, 14 bp, Homo sapiens
gaaggcagagaaat

SEQ ID NO: 745038 - DNA, 12 bp, Homo sapiens
gaaggcagaggc

SEQ ID NO: 745039 - DNA, 19 bp, Homo sapiens
gaaggcagaggctggcacc

SEQ ID NO: 745040 - DNA, 14 bp, Homo sapiens
gaaggcagcattcc

SEQ ID NO: 745041 - DNA, 14 bp, Homo sapiens
gaaggcagctgctc

SEQ ID NO: 745042 - DNA, 13 bp, Homo sapiens
gaaggcagggaat

SEQ ID NO: 745043 - DNA, 13 bp, Homo sapiens
gaaggcagggcag

SEQ ID NO: 745044 - DNA, 15 bp, Homo sapiens
gaaggcagggcagag

SEQ ID NO: 745045 - DNA, 17 bp, Homo sapiens
gaaggcagggcagaggg

SEQ ID NO: 745046 - DNA, 16 bp, Homo sapiens
gaaggcatttgcagga

SEQ ID NO: 745047 - DNA, 17 bp, Homo sapiens
gaaggcatttgcagggt

SEQ ID NO: 745048 - DNA, 19 bp, Homo sapiens
gaaggcatttgcagggtcc

SEQ ID NO: 745049 - DNA, 23 bp, Homo sapiens
gaaggcatttgcagggtcctctt

SEQ ID NO: 745050 - DNA, 13 bp, Homo sapiens
gaaggccacatgt

SEQ ID NO: 745051 - DNA, 13 bp, Homo sapiens
gaaggccattggg

SEQ ID NO: 745052 - DNA, 16 bp, Homo sapiens
gaaggccccagagaga

SEQ ID NO: 745053 - DNA, 22 bp, Homo sapiens
gaaggccccagagagaccctgc

SEQ ID NO: 745054 - DNA, 14 bp, Homo sapiens
gaaggccctgaggc

SEQ ID NO: 745055 - DNA, 18 bp, Homo sapiens
gaaggcctcttgtgctca

SEQ ID NO: 745056 - DNA, 19 bp, Homo sapiens
gaaggcctcttgtgctcac

SEQ ID NO: 745057 - DNA, 18 bp, Homo sapiens
taacccctaagactgcct

SEQ ID NO: 745058 - DNA, 16 bp, Homo sapiens
taacccctttcctgcg

SEQ ID NO: 745059 - DNA, 23 bp, Homo sapiens
taacccgctcatcactggatgaa

SEQ ID NO: 745060 - DNA, 15 bp, Homo sapiens
taaccctactttgct

SEQ ID NO: 745061 - DNA, 16 bp, Homo sapiens
taaccctctcttccct

SEQ ID NO: 745062 - DNA, 20 bp, Homo sapiens
taaccctgccagtgccaggg

SEQ ID NO: 745063 - DNA, 23 bp, Homo sapiens
taaccctgggctgtccagcctta

SEQ ID NO: 745064 - DNA, 20 bp, Homo sapiens
taaccctggtggttgctgtt

SEQ ID NO: 745065 - DNA, 12 bp, Homo sapiens
taaccctgtgga

SEQ ID NO: 745066 - DNA, 19 bp, Homo sapiens
taaccctgtggaagcatgg

SEQ ID NO: 745067 - DNA, 18 bp, Homo sapiens
taacccttcatcttcctg

SEQ ID NO: 745068 - DNA, 18 bp, Homo sapiens
taacctagaagtattttt

SEQ ID NO: 745069 - DNA, 22 bp, Homo sapiens
taacctatatgatttatagttt

SEQ ID NO: 745070 - DNA, 20 bp, Homo sapiens
taacctatgatattttctgt

SEQ ID NO: 745071 - DNA, 17 bp, Homo sapiens
taacctcagtatttatg

SEQ ID NO: 745072 - DNA, 21 bp, Homo sapiens
taacctcagtatttatgtaat

SEQ ID NO: 745073 - DNA, 14 bp, Homo sapiens
taacctctgcacta

SEQ ID NO: 745074 - DNA, 11 bp, Homo sapiens
taacctctggc

SEQ ID NO: 745075 - DNA, 14 bp, Homo sapiens
taacctctggccct

SEQ ID NO: 745076 - DNA, 18 bp, Homo sapiens
taacctctggcccttgga

SEQ ID NO: 745077 - DNA, 21 bp, Homo sapiens
taacctctggcccttggaata

SEQ ID NO: 745078 - DNA, 22 bp, Homo sapiens
taacctctggcccttggaataa

SEQ ID NO: 745079 - DNA, 17 bp, Homo sapiens
taacctcttttctgcat

SEQ ID NO: 745080 - DNA, 17 bp, Homo sapiens
taacctggacctggaac

SEQ ID NO: 745081 - DNA, 20 bp, Homo sapiens
taacctggccactgtccctg

SEQ ID NO: 745082 - DNA, 12 bp, Homo sapiens
taacctggtgct

SEQ ID NO: 745083 - DNA, 15 bp, Homo sapiens
taacctggtgctgga

SEQ ID NO: 745084 - DNA, 17 bp, Homo sapiens
taacctgttttgttaat

SEQ ID NO: 745085 - DNA, 16 bp, Homo sapiens
taaccttatcaggatg

SEQ ID NO: 745086 - DNA, 19 bp, Homo sapiens
taaccttgaatgctgccag

SEQ ID NO: 745087 - DNA, 18 bp, Homo sapiens
taaccttgagtcagaaaa

SEQ ID NO: 745088 - DNA, 13 bp, Homo sapiens
taacctttgctat

SEQ ID NO: 745089 - DNA, 15 bp, Homo sapiens
taacgaacccctaga

SEQ ID NO: 745090 - DNA, 14 bp, Homo sapiens
taacgacttcaggg

SEQ ID NO: 745091 - DNA, 12 bp, Homo sapiens
taacgataaaag

SEQ ID NO: 745092 - DNA, 15 bp, Homo sapiens
taacgcgtcttcctg

SEQ ID NO: 745093 - DNA, 13 bp, Homo sapiens
taacggctccagg

SEQ ID NO: 745094 - DNA, 15 bp, Homo sapiens
taacgtgcactgtaa

SEQ ID NO: 745095 - DNA, 17 bp, Homo sapiens
taacgtgcccccagagt

SEQ ID NO: 745096 - DNA, 21 bp, Homo sapiens
taacgtggcttgtagaatttt

SEQ ID NO: 745097 - DNA, 22 bp, Homo sapiens
taacgtgtatctttaagaaaaa

SEQ ID NO: 745098 - DNA, 20 bp, Homo sapiens
taactaaaataattttgtaa

SEQ ID NO: 745099 - DNA, 13 bp, Homo sapiens
gaaggggaggaag

SEQ ID NO: 745100 - DNA, 15 bp, Homo sapiens
gaaggggatggaggc

SEQ ID NO: 745101 - DNA, 17 bp, Homo sapiens
gaaggggatggaggcca

SEQ ID NO: 745102 - DNA, 19 bp, Homo sapiens
gaaggggatggaggccaga

SEQ ID NO: 745103 - DNA, 23 bp, Homo sapiens
gaaggggcaaattcttttgaatt

SEQ ID NO: 745104 - DNA, 13 bp, Homo sapiens
gaaggggcacacc

SEQ ID NO: 745105 - DNA, 15 bp, Homo sapiens
gaaggggcagcagga

SEQ ID NO: 745106 - DNA, 18 bp, Homo sapiens
gaaggggcagcaggagga

SEQ ID NO: 745107 - DNA, 16 bp, Homo sapiens
gaaggggcagccctga

SEQ ID NO: 745108 - DNA, 22 bp, Homo sapiens
gaaggggccccggggctggcaa

SEQ ID NO: 745109 - DNA, 20 bp, Homo sapiens
gaaggggccggggagggggc

SEQ ID NO: 745110 - DNA, 21 bp, Homo sapiens
gaaggggcgtctgttccccct

SEQ ID NO: 745111 - DNA, 23 bp, Homo sapiens
gaaggggctcttcatctgcctgc

SEQ ID NO: 745112 - DNA, 15 bp, Homo sapiens
gaagggggaggagtc

SEQ ID NO: 745113 - DNA, 23 bp, Homo sapiens
gaaggggggttgcagtggagagg

SEQ ID NO: 745114 - DNA, 23 bp, Homo sapiens
gaagggggtgcaaagactctgag

SEQ ID NO: 745115 - DNA, 21 bp, Homo sapiens
gaagggggtgtgcgtgcgtgt

SEQ ID NO: 745116 - DNA, 14 bp, Homo sapiens
gaaggggttcctca

SEQ ID NO: 745117 - DNA, 13 bp, Homo sapiens
gaagggtcctgcc

SEQ ID NO: 745118 - DNA, 16 bp, Homo sapiens
gaagggttctgccctg

SEQ ID NO: 745119 - DNA, 18 bp, Homo sapiens
gaagggttctgccctgcc

SEQ ID NO: 745120 - DNA, 21 bp, Homo sapiens
gaagggttctgccctgcctga

SEQ ID NO: 745121 - DNA, 23 bp, Homo sapiens
gaagggttggtgggctggcccag

SEQ ID NO: 745122 - DNA, 16 bp, Homo sapiens
gaagggtttctctatt

SEQ ID NO: 745123 - DNA, 19 bp, Homo sapiens
gaagggtttttagagaatg

SEQ ID NO: 745124 - DNA, 18 bp, Homo sapiens
gaaggtaaaaacccagcg

SEQ ID NO: 745125 - DNA, 13 bp, Homo sapiens
gaaggtaaaattg

SEQ ID NO: 745126 - DNA, 23 bp, Homo sapiens
gaaggtcactcttcctgcaagga

SEQ ID NO: 745127 - DNA, 16 bp, Homo sapiens
gaaggtcctgctatta

SEQ ID NO: 745128 - DNA, 13 bp, Homo sapiens
gaaggtctccaag

SEQ ID NO: 745129 - DNA, 15 bp, Homo sapiens
gaaggtctttgttat

SEQ ID NO: 745130 - DNA, 19 bp, Homo sapiens
gaaggtgaccgcccagctc

SEQ ID NO: 745131 - DNA, 23 bp, Homo sapiens
gaaggtgataagggaaaagataa

SEQ ID NO: 745132 - DNA, 19 bp, Homo sapiens
gaaggtgatgttgccatcc

SEQ ID NO: 745133 - DNA, 15 bp, Homo sapiens
gaaggtgccagaagg

SEQ ID NO: 745134 - DNA, 22 bp, Homo sapiens
gaaggtggatggccccagcaca

SEQ ID NO: 745135 - DNA, 18 bp, Homo sapiens
gaaggtggccacagcaag

SEQ ID NO: 745136 - DNA, 23 bp, Homo sapiens
gaaggtggccacagcaagtacag

SEQ ID NO: 745137 - DNA, 18 bp, Homo sapiens
gaaggtggcctctgtgga

SEQ ID NO: 745138 - DNA, 15 bp, Homo sapiens
gaaggtgtctctggt

SEQ ID NO: 745139 - DNA, 18 bp, Homo sapiens
gaaggtgtctctggtctt

SEQ ID NO: 745140 - DNA, 16 bp, Homo sapiens
gaaggtttgtgttttt

SEQ ID NO: 745141 - DNA, 22 bp, Homo sapiens
gaaggttttttttttaagtgca

SEQ ID NO: 745142 - DNA, 23 bp, Homo sapiens
gaaggttttttttttaagtgcaa

SEQ ID NO: 745143 - DNA, 22 bp, Homo sapiens
gaagtaagtttatccaaatctt

SEQ ID NO: 745144 - DNA, 19 bp, Homo sapiens
gaagtaatatgcacacatt

SEQ ID NO: 745145 - DNA, 13 bp, Homo sapiens
gaagtacaaacat

SEQ ID NO: 745146 - DNA, 16 bp, Homo sapiens
gaagtacaaacatgaa

SEQ ID NO: 745147 - DNA, 16 bp, Homo sapiens
gaagtacacctgtgtg

SEQ ID NO: 745148 - DNA, 13 bp, Homo sapiens
gaagtaccagact

SEQ ID NO: 745149 - DNA, 21 bp, Homo sapiens
gaagtacgttattgttgactt

SEQ ID NO: 745150 - DNA, 19 bp, Homo sapiens
gaagtacttttctgttcat

SEQ ID NO: 745151 - DNA, 19 bp, Homo sapiens
gaagtagcttgctccctgt

SEQ ID NO: 745152 - DNA, 19 bp, Homo sapiens
gaagtagtttgtataactt

SEQ ID NO: 745153 - DNA, 15 bp, Homo sapiens
gaagtatacttttcc

SEQ ID NO: 745154 - DNA, 13 bp, Homo sapiens
gaagtattaaaaa

SEQ ID NO: 745155 - DNA, 22 bp, Homo sapiens
gaagtattaagcctaccgtatt

SEQ ID NO: 745156 - DNA, 15 bp, Homo sapiens
gaagtatttttagaa

SEQ ID NO: 745157 - DNA, 15 bp, Homo sapiens
gaagtcaaacatttc

SEQ ID NO: 745158 - DNA, 20 bp, Homo sapiens
gaagtcaaatgtcacatagg

SEQ ID NO: 745159 - DNA, 18 bp, Homo sapiens
gaagtcacctttctgggc

SEQ ID NO: 745160 - DNA, 16 bp, Homo sapiens
gaagtcactgaacaaa

SEQ ID NO: 745161 - DNA, 13 bp, Homo sapiens
gaagtcagagagg

SEQ ID NO: 745162 - DNA, 19 bp, Homo sapiens
gaagtcagctactctagtt

SEQ ID NO: 745163 - DNA, 23 bp, Homo sapiens
gaagtcagctactctagttctgt

SEQ ID NO: 745164 - DNA, 13 bp, Homo sapiens
gaagtcaggggag

SEQ ID NO: 745165 - DNA, 13 bp, Homo sapiens
gaagtcagtacga

SEQ ID NO: 745166 - DNA, 19 bp, Homo sapiens
gaagtcagtacgatcaagt

SEQ ID NO: 745167 - DNA, 15 bp, Homo sapiens
gaagtcatcttgcta

SEQ ID NO: 745168 - DNA, 21 bp, Homo sapiens
gaagtcattgtcgctcagcaa

SEQ ID NO: 745169 - DNA, 14 bp, Homo sapiens
gaagtccaatgtgg

SEQ ID NO: 745170 - DNA, 17 bp, Homo sapiens
gaagtccaatgtggcaa

SEQ ID NO: 745171 - DNA, 14 bp, Homo sapiens
gaagtccttatgtt

SEQ ID NO: 745172 - DNA, 21 bp, Homo sapiens
gaagtccttcagtgagcccct

SEQ ID NO: 745173 - DNA, 15 bp, Homo sapiens
gaagtctagaatcat

SEQ ID NO: 745174 - DNA, 16 bp, Homo sapiens
gaagtctaggagctgg

SEQ ID NO: 745175 - DNA, 22 bp, Homo sapiens
gaagtctaggagctgggaggaa

SEQ ID NO: 745176 - DNA, 17 bp, Homo sapiens
gaagtctctttttcttc

SEQ ID NO: 745177 - DNA, 12 bp, Homo sapiens
gaagtctggaaa

SEQ ID NO: 745178 - DNA, 18 bp, Homo sapiens
gaagtctgtctttctata

SEQ ID NO: 745179 - DNA, 18 bp, Homo sapiens
gaagtcttagatgtatat

SEQ ID NO: 745180 - DNA, 14 bp, Homo sapiens
gaagtcttccctca

SEQ ID NO: 745181 - DNA, 16 bp, Homo sapiens
gaagtcttccctcaga

SEQ ID NO: 745182 - DNA, 17 bp, Homo sapiens
gaagtcttccctcagat

SEQ ID NO: 745183 - DNA, 14 bp, Homo sapiens
gaagtcttttgttc

SEQ ID NO: 745184 - DNA, 18 bp, Homo sapiens
taactgtaaatgtgacat

SEQ ID NO: 745185 - DNA, 19 bp, Homo sapiens
taactgtatatttgtatga

SEQ ID NO: 745186 - DNA, 16 bp, Homo sapiens
taactgtatttcagta

SEQ ID NO: 745187 - DNA, 18 bp, Homo sapiens
taactgtatttcagtatt

SEQ ID NO: 745188 - DNA, 14 bp, Homo sapiens
taactgtatttgaa

SEQ ID NO: 745189 - DNA, 11 bp, Homo sapiens
taactgtcctg

SEQ ID NO: 745190 - DNA, 17 bp, Homo sapiens
taactgtcctgtcctgc

SEQ ID NO: 745191 - DNA, 13 bp, Homo sapiens
taactgtcttgtt

SEQ ID NO: 745192 - DNA, 14 bp, Homo sapiens
taactgtgatttgt

SEQ ID NO: 745193 - DNA, 15 bp, Homo sapiens
taactgtggaatata

SEQ ID NO: 745194 - DNA, 22 bp, Homo sapiens
taactgtggaatataaatagct

SEQ ID NO: 745195 - DNA, 21 bp, Homo sapiens
taactgtggagggagtgttca

SEQ ID NO: 745196 - DNA, 21 bp, Homo sapiens
taactgttacagtaatgtcat

SEQ ID NO: 745197 - DNA, 16 bp, Homo sapiens
taactgttttagaaat

SEQ ID NO: 745198 - DNA, 18 bp, Homo sapiens
taactgttttagaaattg

SEQ ID NO: 745199 - DNA, 19 bp, Homo sapiens
taacttaaaaatgtaaata

SEQ ID NO: 745200 - DNA, 23 bp, Homo sapiens
taacttaaaaatgtaaatattct

SEQ ID NO: 745201 - DNA, 14 bp, Homo sapiens
taacttaaatagta

SEQ ID NO: 745202 - DNA, 14 bp, Homo sapiens
taacttaactgaag

SEQ ID NO: 745203 - DNA, 16 bp, Homo sapiens
taacttaactgaagaa

SEQ ID NO: 745204 - DNA, 16 bp, Homo sapiens
taacttaatgaaaaca

SEQ ID NO: 745205 - DNA, 15 bp, Homo sapiens
taacttactgtatat

SEQ ID NO: 745206 - DNA, 17 bp, Homo sapiens
taacttactgtatatgt

SEQ ID NO: 745207 - DNA, 15 bp, Homo sapiens
taacttactgtccac

SEQ ID NO: 745208 - DNA, 13 bp, Homo sapiens
taacttagcttta

SEQ ID NO: 745209 - DNA, 17 bp, Homo sapiens
taacttatattgtaaga

SEQ ID NO: 745210 - DNA, 21 bp, Homo sapiens
taacttatattgtaagaaata

SEQ ID NO: 745211 - DNA, 15 bp, Homo sapiens
taacttattcaaaga

SEQ ID NO: 745212 - DNA, 15 bp, Homo sapiens
taacttatttagaga

SEQ ID NO: 745213 - DNA, 22 bp, Homo sapiens
taacttcagtaggatttatgta

SEQ ID NO: 745214 - DNA, 11 bp, Homo sapiens
taacttcctgc

SEQ ID NO: 745215 - DNA, 21 bp, Homo sapiens
taacttcctgctgcaccctgc

SEQ ID NO: 745216 - DNA, 23 bp, Homo sapiens
taacttctatattttaatagaaa

SEQ ID NO: 745217 - DNA, 12 bp, Homo sapiens
taacttctgtaa

SEQ ID NO: 745218 - DNA, 13 bp, Homo sapiens
taacttctgttac

SEQ ID NO: 745219 - DNA, 17 bp, Homo sapiens
taacttcttatggaatt

SEQ ID NO: 745220 - DNA, 19 bp, Homo sapiens
taacttcttgaaaaagatg

SEQ ID NO: 745221 - DNA, 17 bp, Homo sapiens
gaagttagtttgtatat

SEQ ID NO: 745222 - DNA, 20 bp, Homo sapiens
gaagttatctgctgggaaca

SEQ ID NO: 745223 - DNA, 21 bp, Homo sapiens
gaagttattttctacagtggt

SEQ ID NO: 745224 - DNA, 14 bp, Homo sapiens
gaagttcccattat

SEQ ID NO: 745225 - DNA, 16 bp, Homo sapiens
gaagttctaggaaatt

SEQ ID NO: 745226 - DNA, 15 bp, Homo sapiens
gaagttctagtgttt

SEQ ID NO: 745227 - DNA, 16 bp, Homo sapiens
gaagttctagtgtttt

SEQ ID NO: 745228 - DNA, 19 bp, Homo sapiens
gaagttcttcaagaggaaa

SEQ ID NO: 745229 - DNA, 23 bp, Homo sapiens
gaagttgaactatgactggagta

SEQ ID NO: 745230 - DNA, 17 bp, Homo sapiens
gaagttgaagtttagga

SEQ ID NO: 745231 - DNA, 15 bp, Homo sapiens
gaagttggaaatttt

SEQ ID NO: 745232 - DNA, 14 bp, Homo sapiens
gaagttggctgagc

SEQ ID NO: 745233 - DNA, 20 bp, Homo sapiens
gaagttggggcactgggcgt

SEQ ID NO: 745234 - DNA, 16 bp, Homo sapiens
gaagttgtctccttcc

SEQ ID NO: 745235 - DNA, 17 bp, Homo sapiens
gaagttgtctccttcca

SEQ ID NO: 745236 - DNA, 19 bp, Homo sapiens
gaagttgtctccttccatt

SEQ ID NO: 745237 - DNA, 21 bp, Homo sapiens
gaagttgttgctatacatgtt

SEQ ID NO: 745238 - DNA, 16 bp, Homo sapiens
gaagtttatttgagaa

SEQ ID NO: 745239 - DNA, 22 bp, Homo sapiens
gaagtttcaagttttaaagttc

SEQ ID NO: 745240 - DNA, 14 bp, Homo sapiens
gaagtttcagtttc

SEQ ID NO: 745241 - DNA, 11 bp, Homo sapiens
gaagtttcatc

SEQ ID NO: 745242 - DNA, 13 bp, Homo sapiens
gaagtttgaacat

SEQ ID NO: 745243 - DNA, 19 bp, Homo sapiens
gaagtttgatattaaagga

SEQ ID NO: 745244 - DNA, 13 bp, Homo sapiens
gaagtttgtagcc

SEQ ID NO: 745245 - DNA, 17 bp, Homo sapiens
gaagtttgtagccaggt

SEQ ID NO: 745246 - DNA, 11 bp, Homo sapiens
gaagttttcaa

SEQ ID NO: 745247 - DNA, 23 bp, Homo sapiens
gaagttttcaatgatgggcgagc

SEQ ID NO: 745248 - DNA, 12 bp, Homo sapiens
gaagttttccta

SEQ ID NO: 745249 - DNA, 14 bp, Homo sapiens
gaagttttcctgat

SEQ ID NO: 745250 - DNA, 12 bp, Homo sapiens
gaagttttgcat

SEQ ID NO: 745251 - DNA, 14 bp, Homo sapiens
gaagttttttctac

SEQ ID NO: 745252 - DNA, 17 bp, Homo sapiens
gaataaaaaagattcta

SEQ ID NO: 745253 - DNA, 20 bp, Homo sapiens
gaataaaaaggttggcctta

SEQ ID NO: 745254 - DNA, 13 bp, Homo sapiens
gaataaaaagtga

SEQ ID NO: 745255 - DNA, 18 bp, Homo sapiens
gaataaaaattgatgaga

SEQ ID NO: 745256 - DNA, 18 bp, Homo sapiens
gaataaaacactcatccc

SEQ ID NO: 745257 - DNA, 13 bp, Homo sapiens
gaataaaaggctg

SEQ ID NO: 745258 - DNA, 12 bp, Homo sapiens
gaataaaagtgc

SEQ ID NO: 745259 - DNA, 23 bp, Homo sapiens
gaataaaagttcctctcccttcc

SEQ ID NO: 745260 - DNA, 21 bp, Homo sapiens
gaataaaatgttgaaaagtca

SEQ ID NO: 745261 - DNA, 23 bp, Homo sapiens
gaataaaatgttgaaaagtcaaa

SEQ ID NO: 745262 - DNA, 14 bp, Homo sapiens
gaataaaattccta

SEQ ID NO: 745263 - DNA, 13 bp, Homo sapiens
gaataaactgaat

SEQ ID NO: 745264 - DNA, 14 bp, Homo sapiens
gaataaactgaata

SEQ ID NO: 745265 - DNA, 15 bp, Homo sapiens
gaataaaggcagttt

SEQ ID NO: 745266 - DNA, 21 bp, Homo sapiens
gaataaagttctgttttctgt

SEQ ID NO: 745267 - DNA, 14 bp, Homo sapiens
gaataaagttgcag

SEQ ID NO: 745268 - DNA, 15 bp, Homo sapiens
gaataaagttgcaga

SEQ ID NO: 745269 - DNA, 22 bp, Homo sapiens
gaataaataaatgtatcttatt

SEQ ID NO: 745270 - DNA, 16 bp, Homo sapiens
gaataaatcatgactt

SEQ ID NO: 745271 - DNA, 15 bp, Homo sapiens
gaataaatggtttct

SEQ ID NO: 745272 - DNA, 16 bp, Homo sapiens
gaataaattgattttt

SEQ ID NO: 745273 - DNA, 15 bp, Homo sapiens
gaataaattgctcct

SEQ ID NO: 745274 - DNA, 14 bp, Homo sapiens
gaataaatttggga

SEQ ID NO: 745275 - DNA, 22 bp, Homo sapiens
gaataacaactttcagtggctt

SEQ ID NO: 745276 - DNA, 17 bp, Homo sapiens
gaataacatttaaattc

SEQ ID NO: 745277 - DNA, 15 bp, Homo sapiens
gaataacctttcaga

SEQ ID NO: 745278 - DNA, 15 bp, Homo sapiens
gaataacctttctgg

SEQ ID NO: 745279 - DNA, 12 bp, Homo sapiens
gaataacttgaa

SEQ ID NO: 745280 - DNA, 12 bp, Homo sapiens
gaataagaattt

SEQ ID NO: 745281 - DNA, 14 bp, Homo sapiens
gaataagaatttgc

SEQ ID NO: 745282 - DNA, 15 bp, Homo sapiens
gaataagaatttgca

SEQ ID NO: 745283 - DNA, 16 bp, Homo sapiens
gaataagaatttgcat

SEQ ID NO: 745284 - DNA, 20 bp, Homo sapiens
gaataagccattctgactca

SEQ ID NO: 745285 - DNA, 22 bp, Homo sapiens
gaataagccattctgactcata

SEQ ID NO: 745286 - DNA, 23 bp, Homo sapiens
gaataagctctagttcttaacaa

SEQ ID NO: 745287 - DNA, 12 bp, Homo sapiens
gaataaggcctt

SEQ ID NO: 745288 - DNA, 20 bp, Homo sapiens
gaataaggtacaagaagcat

SEQ ID NO: 745289 - DNA, 23 bp, Homo sapiens
gaataaggtacaagaagcatttt

SEQ ID NO: 745290 - DNA, 12 bp, Homo sapiens
gaataagttatt

SEQ ID NO: 745291 - DNA, 14 bp, Homo sapiens
gaataagttattgc

SEQ ID NO: 745292 - DNA, 18 bp, Homo sapiens
gaataagttattgcagtt

SEQ ID NO: 745293 - DNA, 19 bp, Homo sapiens
gaataagttattgcagttt

SEQ ID NO: 745294 - DNA, 12 bp, Homo sapiens
gaataatagaag

SEQ ID NO: 745295 - DNA, 15 bp, Homo sapiens
gaataatagaagaac

SEQ ID NO: 745296 - DNA, 20 bp, Homo sapiens
gaataatcacgctttcctga

SEQ ID NO: 745297 - DNA, 15 bp, Homo sapiens
gaataatctttgggt

SEQ ID NO: 745298 - DNA, 14 bp, Homo sapiens
gaataatgaatgga

SEQ ID NO: 745299 - DNA, 16 bp, Homo sapiens
gaataatgcctttgta

SEQ ID NO: 745300 - DNA, 13 bp, Homo sapiens
gaataatggaaac

SEQ ID NO: 745301 - DNA, 14 bp, Homo sapiens
gaataatggaaaca

SEQ ID NO: 745302 - DNA, 17 bp, Homo sapiens
gaataatgtgggaagaa

SEQ ID NO: 745303 - DNA, 21 bp, Homo sapiens
gaataatgtgggaagaaacaa

SEQ ID NO: 745304 - DNA, 23 bp, Homo sapiens
gaataatttattattaaggtaac

SEQ ID NO: 745305 - DNA, 14 bp, Homo sapiens
gaataatttcttac

SEQ ID NO: 745306 - DNA, 13 bp, Homo sapiens
gaataatttgtaa

SEQ ID NO: 745307 - DNA, 14 bp, Homo sapiens
gaataatttgtaaa

SEQ ID NO: 745308 - DNA, 15 bp, Homo sapiens
gaataatttgtaaat

SEQ ID NO: 745309 - DNA, 17 bp, Homo sapiens
gaataatttgtaaatga

SEQ ID NO: 745310 - DNA, 18 bp, Homo sapiens
gaataatttgtaaatgat

SEQ ID NO: 745311 - DNA, 15 bp, Homo sapiens
gaatacaattaaagg

SEQ ID NO: 745312 - DNA, 19 bp, Homo sapiens
gaatacacagtattcagag

SEQ ID NO: 745313 - DNA, 18 bp, Homo sapiens
taagaattcaaactgggg

SEQ ID NO: 745314 - DNA, 22 bp, Homo sapiens
taagaattcaaactggggcctc

SEQ ID NO: 745315 - DNA, 15 bp, Homo sapiens
taagaattcagacat

SEQ ID NO: 745316 - DNA, 13 bp, Homo sapiens
taagaattgacca

SEQ ID NO: 745317 - DNA, 16 bp, Homo sapiens
taagaattgagtaatg

SEQ ID NO: 745318 - DNA, 19 bp, Homo sapiens
taagaattgagtaatggtg

SEQ ID NO: 745319 - DNA, 23 bp, Homo sapiens
taagaattgtctctgggctgagg

SEQ ID NO: 745320 - DNA, 12 bp, Homo sapiens
taagaatttgca

SEQ ID NO: 745321 - DNA, 18 bp, Homo sapiens
taagaatttgcatactta

SEQ ID NO: 745322 - DNA, 18 bp, Homo sapiens
taagaattttgttttact

SEQ ID NO: 745323 - DNA, 23 bp, Homo sapiens
taagacaaaaagccttgaagaaa

SEQ ID NO: 745324 - DNA, 13 bp, Homo sapiens
taagacactgtga

SEQ ID NO: 745325 - DNA, 15 bp, Homo sapiens
taagacactgtgaga

SEQ ID NO: 745326 - DNA, 19 bp, Homo sapiens
taagacactgtgagagttg

SEQ ID NO: 745327 - DNA, 17 bp, Homo sapiens
taagacagcatgtgtta

SEQ ID NO: 745328 - DNA, 22 bp, Homo sapiens
taagacagggtctcattctatc

SEQ ID NO: 745329 - DNA, 19 bp, Homo sapiens
taagacagtcccatcaaaa

SEQ ID NO: 745330 - DNA, 19 bp, Homo sapiens
taagacatgatttccttga

SEQ ID NO: 745331 - DNA, 12 bp, Homo sapiens
taagacatgtga

SEQ ID NO: 745332 - DNA, 22 bp, Homo sapiens
taagacccttattgctgtcctg

SEQ ID NO: 745333 - DNA, 16 bp, Homo sapiens
taagaccgtgtcccaa

SEQ ID NO: 745334 - DNA, 18 bp, Homo sapiens
taagactcccgccccggg

SEQ ID NO: 745335 - DNA, 20 bp, Homo sapiens
taagactcccgccccgggct

SEQ ID NO: 745336 - DNA, 22 bp, Homo sapiens
taagactgaatgttttatttat

SEQ ID NO: 745337 - DNA, 13 bp, Homo sapiens
taagactgccttc

SEQ ID NO: 745338 - DNA, 15 bp, Homo sapiens
taagactgtgtattc

SEQ ID NO: 745339 - DNA, 21 bp, Homo sapiens
taagacttagtactatctgtg

SEQ ID NO: 745340 - DNA, 17 bp, Homo sapiens
taagacttgacagtgga

SEQ ID NO: 745341 - DNA, 17 bp, Homo sapiens
taagactttctgaaaac

SEQ ID NO: 745342 - DNA, 15 bp, Homo sapiens
taagagaaaagagag

SEQ ID NO: 745343 - DNA, 18 bp, Homo sapiens
taagagaaaagagagaaa

SEQ ID NO: 745344 - DNA, 16 bp, Homo sapiens
gaatatacagagcctt

SEQ ID NO: 745345 - DNA, 22 bp, Homo sapiens
gaatatacagcaggtgctcaat

SEQ ID NO: 745346 - DNA, 16 bp, Homo sapiens
gaatataccttattta

SEQ ID NO: 745347 - DNA, 23 bp, Homo sapiens
gaatataggtctcttctcccaga

SEQ ID NO: 745348 - DNA, 15 bp, Homo sapiens
gaatatagttctgtg

SEQ ID NO: 745349 - DNA, 17 bp, Homo sapiens
gaatatagttctgtgta

SEQ ID NO: 745350 - DNA, 15 bp, Homo sapiens
gaatatataaccagt

SEQ ID NO: 745351 - DNA, 18 bp, Homo sapiens
gaatatatcagaatctgt

SEQ ID NO: 745352 - DNA, 21 bp, Homo sapiens
gaatatatcagtacctctcaa

SEQ ID NO: 745353 - DNA, 21 bp, Homo sapiens
gaatatatggcagagttgtaa

SEQ ID NO: 745354 - DNA, 22 bp, Homo sapiens
gaatatatggcagagttgtaaa

SEQ ID NO: 745355 - DNA, 23 bp, Homo sapiens
gaatatatggcagagttgtaaat

SEQ ID NO: 745356 - DNA, 17 bp, Homo sapiens
gaatatattactgattt

SEQ ID NO: 745357 - DNA, 18 bp, Homo sapiens
gaatatattactgattta

SEQ ID NO: 745358 - DNA, 20 bp, Homo sapiens
gaatatcaatataatgtttt

SEQ ID NO: 745359 - DNA, 16 bp, Homo sapiens
gaatatcgatataaat

SEQ ID NO: 745360 - DNA, 19 bp, Homo sapiens
gaatatcgatataaattgg

SEQ ID NO: 745361 - DNA, 14 bp, Homo sapiens
gaatatctttcgat

SEQ ID NO: 745362 - DNA, 12 bp, Homo sapiens
gaatatgaagtt

SEQ ID NO: 745363 - DNA, 11 bp, Homo sapiens
gaatatgaatg

SEQ ID NO: 745364 - DNA, 12 bp, Homo sapiens
gaatatgaatgt

SEQ ID NO: 745365 - DNA, 17 bp, Homo sapiens
gaatatgacggaagaac

SEQ ID NO: 745366 - DNA, 16 bp, Homo sapiens
gaatatgcaacattgt

SEQ ID NO: 745367 - DNA, 13 bp, Homo sapiens
gaatatggaacat

SEQ ID NO: 745368 - DNA, 17 bp, Homo sapiens
gaatatgggagaaatag

SEQ ID NO: 745369 - DNA, 21 bp, Homo sapiens
gaatatgggagaaatagtgtg

SEQ ID NO: 745370 - DNA, 23 bp, Homo sapiens
gaatatggttggagagccctgga

SEQ ID NO: 745371 - DNA, 15 bp, Homo sapiens
gaatatgttcaatgc

SEQ ID NO: 745372 - DNA, 19 bp, Homo sapiens
gaatatgtttccttgttta

SEQ ID NO: 745373 - DNA, 14 bp, Homo sapiens
gaatattaaaaaac

SEQ ID NO: 745374 - DNA, 18 bp, Homo sapiens
gaatattaattagtttat

SEQ ID NO: 745375 - DNA, 21 bp, Homo sapiens
gaatattagctttactgtttg

SEQ ID NO: 745376 - DNA, 14 bp, Homo sapiens
gaatattcatttta

SEQ ID NO: 745377 - DNA, 22 bp, Homo sapiens
gaatattcattttactcagaat

SEQ ID NO: 745378 - DNA, 13 bp, Homo sapiens
gaatattgcaaaa

SEQ ID NO: 745379 - DNA, 18 bp, Homo sapiens
gaatattgcaaaatacat

SEQ ID NO: 745380 - DNA, 19 bp, Homo sapiens
gaatattggtaattaaaag

SEQ ID NO: 745381 - DNA, 13 bp, Homo sapiens
gaatattgtccat

SEQ ID NO: 745382 - DNA, 13 bp, Homo sapiens
gaatattgtgatt

SEQ ID NO: 745383 - DNA, 12 bp, Homo sapiens
gaatatttacta

SEQ ID NO: 745384 - DNA, 10 bp, Homo sapiens
gaatatttat

SEQ ID NO: 745385 - DNA, 13 bp, Homo sapiens
gaatatttataac

SEQ ID NO: 745386 - DNA, 15 bp, Homo sapiens
gaatatttataacag

SEQ ID NO: 745387 - DNA, 18 bp, Homo sapiens
gaatatttatatttcact

SEQ ID NO: 745388 - DNA, 19 bp, Homo sapiens
gaatatttatatttcacta

SEQ ID NO: 745389 - DNA, 13 bp, Homo sapiens
gaatatttattac

SEQ ID NO: 745390 - DNA, 21 bp, Homo sapiens
gaatatttattacctctgata

SEQ ID NO: 745391 - DNA, 13 bp, Homo sapiens
gaatatttgcttt

SEQ ID NO: 745392 - DNA, 18 bp, Homo sapiens
gaatattttaagtattgc

SEQ ID NO: 745393 - DNA, 19 bp, Homo sapiens
gaatattttggaaactgct

SEQ ID NO: 745394 - DNA, 20 bp, Homo sapiens
gaatattttggaaactgcta

SEQ ID NO: 745395 - DNA, 20 bp, Homo sapiens
gaatatttttatatttcctt

SEQ ID NO: 745396 - DNA, 20 bp, Homo sapiens
gaatattttttatttctaag

SEQ ID NO: 745397 - DNA, 21 bp, Homo sapiens
gaatattttttatttctaagt

SEQ ID NO: 745398 - DNA, 22 bp, Homo sapiens
gaatattttttgaaggtttcag

SEQ ID NO: 745399 - DNA, 13 bp, Homo sapiens
gaatcaaaactct

SEQ ID NO: 745400 - DNA, 15 bp, Homo sapiens
gaatcaaaactctcc

SEQ ID NO: 745401 - DNA, 17 bp, Homo sapiens
gaatcaaagacatggaa

SEQ ID NO: 745402 - DNA, 22 bp, Homo sapiens
gaatcaaagcagttaactttaa

SEQ ID NO: 745403 - DNA, 17 bp, Homo sapiens
gaatcaaataaaaattc

SEQ ID NO: 745404 - DNA, 16 bp, Homo sapiens
gaatcaaatcttacaa

SEQ ID NO: 745405 - DNA, 21 bp, Homo sapiens
gaatcaactaggtatttaaga

SEQ ID NO: 745406 - DNA, 21 bp, Homo sapiens
gaatcaataatatattttctg

SEQ ID NO: 745407 - DNA, 14 bp, Homo sapiens
gaatcaatgaaaaa

SEQ ID NO: 745408 - DNA, 21 bp, Homo sapiens
gaatcactggggatggtggca

SEQ ID NO: 745409 - DNA, 18 bp, Homo sapiens
gaatcacttttctagaca

SEQ ID NO: 745410 - DNA, 14 bp, Homo sapiens
gaatcagaaaagct

SEQ ID NO: 745411 - DNA, 19 bp, Homo sapiens
gaatcagaacagatgctga

SEQ ID NO: 745412 - DNA, 18 bp, Homo sapiens
gaatcagaccctacccca

SEQ ID NO: 745413 - DNA, 16 bp, Homo sapiens
gaatcagctggacata

SEQ ID NO: 745414 - DNA, 21 bp, Homo sapiens
gaatcaggaatattttccaaa

SEQ ID NO: 745415 - DNA, 16 bp, Homo sapiens
gaatcagtatttcctt

SEQ ID NO: 745416 - DNA, 22 bp, Homo sapiens
gaatcagtatttccttccactg

SEQ ID NO: 745417 - DNA, 18 bp, Homo sapiens
gaatcagtcctagaatgt

SEQ ID NO: 745418 - DNA, 14 bp, Homo sapiens
gaatcagtgttaaa

SEQ ID NO: 745419 - DNA, 17 bp, Homo sapiens
gaatcatactgcctact

SEQ ID NO: 745420 - DNA, 18 bp, Homo sapiens
gaatcatacttaacattt

SEQ ID NO: 745421 - DNA, 15 bp, Homo sapiens
gaatcatgagcctgc

SEQ ID NO: 745422 - DNA, 17 bp, Homo sapiens
gaatcatgagcctgctg

SEQ ID NO: 745423 - DNA, 14 bp, Homo sapiens
gaatcatggagaaa

SEQ ID NO: 745424 - DNA, 22 bp, Homo sapiens
gaatcattaatttcaaaattta

SEQ ID NO: 745425 - DNA, 12 bp, Homo sapiens
gaatcattgctt

SEQ ID NO: 745426 - DNA, 13 bp, Homo sapiens
gaatcattggcct

SEQ ID NO: 745427 - DNA, 22 bp, Homo sapiens
gaatcattgttaaccacagctg

SEQ ID NO: 745428 - DNA, 17 bp, Homo sapiens
gaatccaaatctgtcct

SEQ ID NO: 745429 - DNA, 19 bp, Homo sapiens
gaatccaaatctgtcctct

SEQ ID NO: 745430 - DNA, 15 bp, Homo sapiens
gaatccaagattggt

SEQ ID NO: 745431 - DNA, 14 bp, Homo sapiens
gaatccaagcctcc

SEQ ID NO: 745432 - DNA, 17 bp, Homo sapiens
gaatccaagcctccaca

SEQ ID NO: 745433 - DNA, 18 bp, Homo sapiens
gaatccaagctccctgcc

SEQ ID NO: 745434 - DNA, 20 bp, Homo sapiens
gaatccaagctccctgcccc

SEQ ID NO: 745435 - DNA, 22 bp, Homo sapiens
gaatccaagggttgagagccag

SEQ ID NO: 745436 - DNA, 22 bp, Homo sapiens
gaatccagctccctagactgca

SEQ ID NO: 745437 - DNA, 23 bp, Homo sapiens
gaatccatcctgcaaaggccctt

SEQ ID NO: 745438 - DNA, 13 bp, Homo sapiens
gaatccatgcttg

SEQ ID NO: 745439 - DNA, 19 bp, Homo sapiens
gaatccccaacatgcactg

SEQ ID NO: 745440 - DNA, 17 bp, Homo sapiens
taagcctccatttagtt

SEQ ID NO: 745441 - DNA, 18 bp, Homo sapiens
taagcctggaagccatcc

SEQ ID NO: 745442 - DNA, 17 bp, Homo sapiens
taagcctgtccccagac

SEQ ID NO: 745443 - DNA, 19 bp, Homo sapiens
taagcctgtccccagacca

SEQ ID NO: 745444 - DNA, 22 bp, Homo sapiens
taagcggtggaggaaggctctg

SEQ ID NO: 745445 - DNA, 18 bp, Homo sapiens
taagcggtggtttgtaat

SEQ ID NO: 745446 - DNA, 18 bp, Homo sapiens
taagctactagcaaaata

SEQ ID NO: 745447 - DNA, 22 bp, Homo sapiens
taagctatcacctagcagcctc

SEQ ID NO: 745448 - DNA, 14 bp, Homo sapiens
taagctattcagta

SEQ ID NO: 745449 - DNA, 21 bp, Homo sapiens
taagctattcagtaataactc

SEQ ID NO: 745450 - DNA, 19 bp, Homo sapiens
taagctccatgtgcatata

SEQ ID NO: 745451 - DNA, 20 bp, Homo sapiens
taagctccttgagtaaaaag

SEQ ID NO: 745452 - DNA, 21 bp, Homo sapiens
taagctccttgagtaaaaagg

SEQ ID NO: 745453 - DNA, 18 bp, Homo sapiens
taagctgatcctgcggag

SEQ ID NO: 745454 - DNA, 12 bp, Homo sapiens
taagctggagct

SEQ ID NO: 745455 - DNA, 12 bp, Homo sapiens
taagctggctct

SEQ ID NO: 745456 - DNA, 11 bp, Homo sapiens
taagctgtttc

SEQ ID NO: 745457 - DNA, 15 bp, Homo sapiens
taagcttattgcttc

SEQ ID NO: 745458 - DNA, 16 bp, Homo sapiens
taagctttctctcaga

SEQ ID NO: 745459 - DNA, 19 bp, Homo sapiens
taagctttgccagctgctg

SEQ ID NO: 745460 - DNA, 17 bp, Homo sapiens
taagcttttaagaaaaa

SEQ ID NO: 745461 - DNA, 15 bp, Homo sapiens
taaggaaaaggattt

SEQ ID NO: 745462 - DNA, 14 bp, Homo sapiens
taaggaaactttat

SEQ ID NO: 745463 - DNA, 16 bp, Homo sapiens
taaggaaactttattt

SEQ ID NO: 745464 - DNA, 18 bp, Homo sapiens
taaggaaagcaataaatg

SEQ ID NO: 745465 - DNA, 15 bp, Homo sapiens
taaggaaccttcctt

SEQ ID NO: 745466 - DNA, 15 bp, Homo sapiens
gaatctatttaagta

SEQ ID NO: 745467 - DNA, 16 bp, Homo sapiens
gaatctatttaagtaa

SEQ ID NO: 745468 - DNA, 18 bp, Homo sapiens
gaatctcccactccagcg

SEQ ID NO: 745469 - DNA, 12 bp, Homo sapiens
gaatctcccctc

SEQ ID NO: 745470 - DNA, 19 bp, Homo sapiens
gaatctcccctcctcacag

SEQ ID NO: 745471 - DNA, 22 bp, Homo sapiens
gaatctctgcctctcccaggct

SEQ ID NO: 745472 - DNA, 13 bp, Homo sapiens
gaatctcttcact

SEQ ID NO: 745473 - DNA, 17 bp, Homo sapiens
gaatctcttcatgcttg

SEQ ID NO: 745474 - DNA, 18 bp, Homo sapiens
gaatctcttcatgcttga

SEQ ID NO: 745475 - DNA, 16 bp, Homo sapiens
gaatctgaactgctct

SEQ ID NO: 745476 - DNA, 15 bp, Homo sapiens
gaatctgagacatct

SEQ ID NO: 745477 - DNA, 23 bp, Homo sapiens
gaatctgagagatgctgtagaca

SEQ ID NO: 745478 - DNA, 17 bp, Homo sapiens
gaatctgagctgcaggt

SEQ ID NO: 745479 - DNA, 22 bp, Homo sapiens
gaatctgatctttttatacaca

SEQ ID NO: 745480 - DNA, 17 bp, Homo sapiens
gaatctgcagggagcaa

SEQ ID NO: 745481 - DNA, 21 bp, Homo sapiens
gaatctgcctgtggccttgcc

SEQ ID NO: 745482 - DNA, 18 bp, Homo sapiens
gaatctgccttccagccc

SEQ ID NO: 745483 - DNA, 18 bp, Homo sapiens
gaatctggagaccaggga

SEQ ID NO: 745484 - DNA, 13 bp, Homo sapiens
gaatctggattat

SEQ ID NO: 745485 - DNA, 15 bp, Homo sapiens
gaatctggcattcta

SEQ ID NO: 745486 - DNA, 23 bp, Homo sapiens
gaatctggcattctacacctgga

SEQ ID NO: 745487 - DNA, 13 bp, Homo sapiens
gaatctgggggtg

SEQ ID NO: 745488 - DNA, 16 bp, Homo sapiens
gaatctgggggtgagg

SEQ ID NO: 745489 - DNA, 17 bp, Homo sapiens
gaatctgggggtgagga

SEQ ID NO: 745490 - DNA, 16 bp, Homo sapiens
gaatctgtatatattt

SEQ ID NO: 745491 - DNA, 16 bp, Homo sapiens
gaatctgtgcaaacag

SEQ ID NO: 745492 - DNA, 19 bp, Homo sapiens
gaatctgtgggtctgggag

SEQ ID NO: 745493 - DNA, 11 bp, Homo sapiens
gaatctgtgtg

SEQ ID NO: 745494 - DNA, 20 bp, Homo sapiens
gaatctgtgtgcatatttgt

SEQ ID NO: 745495 - DNA, 22 bp, Homo sapiens
gaatctgtgtgcatatttgtta

SEQ ID NO: 745496 - DNA, 20 bp, Homo sapiens
gaatctgtgtggtacaaacc

SEQ ID NO: 745497 - DNA, 23 bp, Homo sapiens
gaatctgtgtggtacaaacctgc

SEQ ID NO: 745498 - DNA, 13 bp, Homo sapiens
gaatctgtttctc

SEQ ID NO: 745499 - DNA, 22 bp, Homo sapiens
gaatcttcacgacaatgttgag

SEQ ID NO: 745500 - DNA, 20 bp, Homo sapiens
gaatcttctcatcttttatc

SEQ ID NO: 745501 - DNA, 22 bp, Homo sapiens
gaatcttctcatcttttatcta

SEQ ID NO: 745502 - DNA, 11 bp, Homo sapiens
gaatcttctgg

SEQ ID NO: 745503 - DNA, 14 bp, Homo sapiens
gaatcttgtctaac

SEQ ID NO: 745504 - DNA, 13 bp, Homo sapiens
gaatcttgttcaa

SEQ ID NO: 745505 - DNA, 16 bp, Homo sapiens
gaatcttgttttgaaa

SEQ ID NO: 745506 - DNA, 18 bp, Homo sapiens
gaatctttattgagaaag

SEQ ID NO: 745507 - DNA, 14 bp, Homo sapiens
gaatctttgttaag

SEQ ID NO: 745508 - DNA, 22 bp, Homo sapiens
gaatcttttataatgattcata

SEQ ID NO: 745509 - DNA, 19 bp, Homo sapiens
gaatgaaaaatttaagcat

SEQ ID NO: 745510 - DNA, 14 bp, Homo sapiens
gaatgaaaacattt

SEQ ID NO: 745511 - DNA, 16 bp, Homo sapiens
gaatgaaaacatttta

SEQ ID NO: 745512 - DNA, 14 bp, Homo sapiens
gaatgaaatgtatg

SEQ ID NO: 745513 - DNA, 21 bp, Homo sapiens
gaatgaaattcctccttcccc

SEQ ID NO: 745514 - DNA, 18 bp, Homo sapiens
gaatgaaccctcctcctt

SEQ ID NO: 745515 - DNA, 23 bp, Homo sapiens
gaatgaaccctcctcctttttaa

SEQ ID NO: 745516 - DNA, 15 bp, Homo sapiens
gaatgaactgtggaa

SEQ ID NO: 745517 - DNA, 21 bp, Homo sapiens
gaatgaactgtggaatttatt

SEQ ID NO: 745518 - DNA, 14 bp, Homo sapiens
gaatgaagttctgc

SEQ ID NO: 745519 - DNA, 14 bp, Homo sapiens
gaatgaattaaata

SEQ ID NO: 745520 - DNA, 17 bp, Homo sapiens
gaatgaatttatcttta

SEQ ID NO: 745521 - DNA, 16 bp, Homo sapiens
gaatgacaacagaagc

SEQ ID NO: 745522 - DNA, 17 bp, Homo sapiens
gaatgaccgctctccct

SEQ ID NO: 745523 - DNA, 18 bp, Homo sapiens
gaatgaccgctctccctt

SEQ ID NO: 745524 - DNA, 19 bp, Homo sapiens
gaatgacggtaagtgttct

SEQ ID NO: 745525 - DNA, 20 bp, Homo sapiens
gaatgactatgtccagattg

SEQ ID NO: 745526 - DNA, 21 bp, Homo sapiens
gaatgactatgtccagattgg

SEQ ID NO: 745527 - DNA, 11 bp, Homo sapiens
gaatgactttt

SEQ ID NO: 745528 - DNA, 14 bp, Homo sapiens
gaatgagaaatgga

SEQ ID NO: 745529 - DNA, 21 bp, Homo sapiens
gaatgagacctggaacaaatc

SEQ ID NO: 745530 - DNA, 19 bp, Homo sapiens
gaatgagagttccttctca

SEQ ID NO: 745531 - DNA, 12 bp, Homo sapiens
gaatgagcccag

SEQ ID NO: 745532 - DNA, 13 bp, Homo sapiens
gaatgagcccaga

SEQ ID NO: 745533 - DNA, 16 bp, Homo sapiens
gaatgagcccagagaa

SEQ ID NO: 745534 - DNA, 19 bp, Homo sapiens
gaatgagcccagagaacag

SEQ ID NO: 745535 - DNA, 22 bp, Homo sapiens
gaatgagcctacgctgaagatg

SEQ ID NO: 745536 - DNA, 13 bp, Homo sapiens
gaatgagcctcgg

SEQ ID NO: 745537 - DNA, 14 bp, Homo sapiens
gaatgagggaggcg

SEQ ID NO: 745538 - DNA, 14 bp, Homo sapiens
gaatgaggtcccag

SEQ ID NO: 745539 - DNA, 15 bp, Homo sapiens
gaatgaggtcccagg

SEQ ID NO: 745540 - DNA, 17 bp, Homo sapiens
gaatgaggtcccaggca

SEQ ID NO: 745541 - DNA, 18 bp, Homo sapiens
gaatgaggtcccaggcag

SEQ ID NO: 745542 - DNA, 21 bp, Homo sapiens
gaatgaggtcccaggcagaga

SEQ ID NO: 745543 - DNA, 13 bp, Homo sapiens
gaatgagtgggaa

SEQ ID NO: 745544 - DNA, 20 bp, Homo sapiens
gaatgatagcccagaacaaa

SEQ ID NO: 745545 - DNA, 16 bp, Homo sapiens
gaatgatctcttcttt

SEQ ID NO: 745546 - DNA, 17 bp, Homo sapiens
gaatgatctcttctttt

SEQ ID NO: 745547 - DNA, 20 bp, Homo sapiens
gaatgatgatcctaggcatt

SEQ ID NO: 745548 - DNA, 22 bp, Homo sapiens
gaatgatgggcttttgttctga

SEQ ID NO: 745549 - DNA, 15 bp, Homo sapiens
gaatgattcatgtta

SEQ ID NO: 745550 - DNA, 20 bp, Homo sapiens
gaatgattggttaaaatgtg

SEQ ID NO: 745551 - DNA, 22 bp, Homo sapiens
gaatgatttccaaagagaaaaa

SEQ ID NO: 745552 - DNA, 16 bp, Homo sapiens
gaatgatttttagatg

SEQ ID NO: 745553 - DNA, 22 bp, Homo sapiens
gaatgcaaaattgttttcactt

SEQ ID NO: 745554 - DNA, 22 bp, Homo sapiens
gaatgcacactagcctctccag

SEQ ID NO: 745555 - DNA, 18 bp, Homo sapiens
gaatgcaccatggagacg

SEQ ID NO: 745556 - DNA, 15 bp, Homo sapiens
gaatgcacctcccca

SEQ ID NO: 745557 - DNA, 19 bp, Homo sapiens
gaatgcagaggtctccaaa

SEQ ID NO: 745558 - DNA, 23 bp, Homo sapiens
gaatgcagattcctgggcctgtc

SEQ ID NO: 745559 - DNA, 18 bp, Homo sapiens
gaatgcagcccaccagga

SEQ ID NO: 745560 - DNA, 19 bp, Homo sapiens
gaatgcagcccaccaggag

SEQ ID NO: 745561 - DNA, 21 bp, Homo sapiens
gaatgcagcccaccaggagca

SEQ ID NO: 745562 - DNA, 22 bp, Homo sapiens
gaatgcagcccaccaggagcac

SEQ ID NO: 745563 - DNA, 17 bp, Homo sapiens
gaatgcagggaagaggg

SEQ ID NO: 745564 - DNA, 22 bp, Homo sapiens
gaatgcagggaatgcaatcctt

SEQ ID NO: 745565 - DNA, 17 bp, Homo sapiens
gaatgcataatgtttaa

SEQ ID NO: 745566 - DNA, 14 bp, Homo sapiens
gaatgcattaaaaa

SEQ ID NO: 745567 - DNA, 22 bp, Homo sapiens
gaatgccactgccttcgcttct

SEQ ID NO: 745568 - DNA, 15 bp, Homo sapiens
taagtcaacagtaaa

SEQ ID NO: 745569 - DNA, 15 bp, Homo sapiens
taagtcaacctgcct

SEQ ID NO: 745570 - DNA, 17 bp, Homo sapiens
taagtcaacctgcctga

SEQ ID NO: 745571 - DNA, 14 bp, Homo sapiens
taagtcatgtatgt

SEQ ID NO: 745572 - DNA, 15 bp, Homo sapiens
taagtcattttgtaa

SEQ ID NO: 745573 - DNA, 22 bp, Homo sapiens
taagtcccttcctattctcctg

SEQ ID NO: 745574 - DNA, 23 bp, Homo sapiens
taagtcctactttacatatgctt

SEQ ID NO: 745575 - DNA, 18 bp, Homo sapiens
taagtctaaatatttcct

SEQ ID NO: 745576 - DNA, 16 bp, Homo sapiens
taagtctacattaaac

SEQ ID NO: 745577 - DNA, 14 bp, Homo sapiens
taagtctcctgtct

SEQ ID NO: 745578 - DNA, 19 bp, Homo sapiens
taagtctcgaatgtaattg

SEQ ID NO: 745579 - DNA, 16 bp, Homo sapiens
taagtcttccttaaat

SEQ ID NO: 745580 - DNA, 19 bp, Homo sapiens
taagtcttttttttttcca

SEQ ID NO: 745581 - DNA, 15 bp, Homo sapiens
taagtgaaaatatag

SEQ ID NO: 745582 - DNA, 15 bp, Homo sapiens
taagtgaaaatctta

SEQ ID NO: 745583 - DNA, 14 bp, Homo sapiens
taagtgaagggaaa

SEQ ID NO: 745584 - DNA, 23 bp, Homo sapiens
taagtgacaaaagcagcacaagg

SEQ ID NO: 745585 - DNA, 21 bp, Homo sapiens
taagtgacaccaataaatgtt

SEQ ID NO: 745586 - DNA, 16 bp, Homo sapiens
taagtgagcagaacag

SEQ ID NO: 745587 - DNA, 19 bp, Homo sapiens
taagtgatgtgctgaattt

SEQ ID NO: 745588 - DNA, 21 bp, Homo sapiens
taagtgcaacatttctgtata

SEQ ID NO: 745589 - DNA, 23 bp, Homo sapiens
taagtgcaacatttctgtatact

SEQ ID NO: 745590 - DNA, 23 bp, Homo sapiens
taagtgcagggaggaaaagtgca

SEQ ID NO: 745591 - DNA, 23 bp, Homo sapiens
taagtgccttggatgagaagtgt

SEQ ID NO: 745592 - DNA, 16 bp, Homo sapiens
taagtgctgcatttaa

SEQ ID NO: 745593 - DNA, 23 bp, Homo sapiens
taagtgctttacctaagtgttga

SEQ ID NO: 745594 - DNA, 15 bp, Homo sapiens
taagtgctttgtaat

SEQ ID NO: 745595 - DNA, 19 bp, Homo sapiens
taagtggaattagagggcc

SEQ ID NO: 745596 - DNA, 19 bp, Homo sapiens
taagtggaggcactttagg

SEQ ID NO: 745597 - DNA, 19 bp, Homo sapiens
taagtgggacattagtaac

SEQ ID NO: 745598 - DNA, 21 bp, Homo sapiens
taagtggggtagactgaggga

SEQ ID NO: 745599 - DNA, 20 bp, Homo sapiens
taagtggggttgcaaccact

SEQ ID NO: 745600 - DNA, 13 bp, Homo sapiens
taagtggtatctg

SEQ ID NO: 745601 - DNA, 20 bp, Homo sapiens
taagtggtgcttagaaaatt

SEQ ID NO: 745602 - DNA, 13 bp, Homo sapiens
taagtgtacaatt

SEQ ID NO: 745603 - DNA, 17 bp, Homo sapiens
taagtgtggttttgtaa

SEQ ID NO: 745604 - DNA, 22 bp, Homo sapiens
taagtgtgtcttcctagaattc

SEQ ID NO: 745605 - DNA, 24 bp, Homo sapiens
taagtgtgtcttcctagaattcga

SEQ ID NO: 745606 - DNA, 20 bp, Homo sapiens
taagtgtgtggtagaaacaa

SEQ ID NO: 745607 - DNA, 21 bp, Homo sapiens
taagtgtgtggtagaaacaaa

SEQ ID NO: 745608 - DNA, 14 bp, Homo sapiens
taagtgttctcatg

SEQ ID NO: 745609 - DNA, 20 bp, Homo sapiens
taagtgttctcatgaagcag

SEQ ID NO: 745610 - DNA, 20 bp, Homo sapiens
taagttaatgtatataaaaa

SEQ ID NO: 745611 - DNA, 17 bp, Homo sapiens
taagttagttccactga

SEQ ID NO: 745612 - DNA, 19 bp, Homo sapiens
taagttagttccactgaga

SEQ ID NO: 745613 - DNA, 20 bp, Homo sapiens
taagttagttccactgagac

SEQ ID NO: 745614 - DNA, 15 bp, Homo sapiens
taagttatcaacttt

SEQ ID NO: 745615 - DNA, 16 bp, Homo sapiens
taagttatgtgtgtgg

SEQ ID NO: 745616 - DNA, 22 bp, Homo sapiens
taagttattaagaggtaagact

SEQ ID NO: 745617 - DNA, 23 bp, Homo sapiens
taagttattaagaggtaagactt

SEQ ID NO: 745618 - DNA, 18 bp, Homo sapiens
taagttattacctctcca

SEQ ID NO: 745619 - DNA, 13 bp, Homo sapiens
taagttcacatta

SEQ ID NO: 745620 - DNA, 17 bp, Homo sapiens
taagttcatgtttgtaa

SEQ ID NO: 745621 - DNA, 14 bp, Homo sapiens
taagttccactgag

SEQ ID NO: 745622 - DNA, 15 bp, Homo sapiens
taagttcctatacct

SEQ ID NO: 745623 - DNA, 20 bp, Homo sapiens
taagttctttgatttgtacc

SEQ ID NO: 745624 - DNA, 21 bp, Homo sapiens
taagttctttgatttgtacca

SEQ ID NO: 745625 - DNA, 22 bp, Homo sapiens
taagttgagatagttttcatcc

SEQ ID NO: 745626 - DNA, 14 bp, Homo sapiens
taagttgctgtaaa

SEQ ID NO: 745627 - DNA, 22 bp, Homo sapiens
taagttgctgtaaaatttgtgt

SEQ ID NO: 745628 - DNA, 23 bp, Homo sapiens
taagttgctgtgtgtctgtcctg

SEQ ID NO: 745629 - DNA, 16 bp, Homo sapiens
taagttgtaccaaaac

SEQ ID NO: 745630 - DNA, 22 bp, Homo sapiens
taagttgtataggctaaatgtt

SEQ ID NO: 745631 - DNA, 19 bp, Homo sapiens
taagttgtcaaagaagctt

SEQ ID NO: 745632 - DNA, 12 bp, Homo sapiens
taagttgtctgt

SEQ ID NO: 745633 - DNA, 17 bp, Homo sapiens
taagttgtctgtctgaa

SEQ ID NO: 745634 - DNA, 19 bp, Homo sapiens
taagttgtctgtctgaatg

SEQ ID NO: 745635 - DNA, 19 bp, Homo sapiens
taagtttaactttaaaact

SEQ ID NO: 745636 - DNA, 16 bp, Homo sapiens
taagtttacaccttta

SEQ ID NO: 745637 - DNA, 23 bp, Homo sapiens
taagtttcaaacttactattttg

SEQ ID NO: 745638 - DNA, 16 bp, Homo sapiens
taagtttgatttcatt

SEQ ID NO: 745639 - DNA, 23 bp, Homo sapiens
taagttttaaataaacctataat

SEQ ID NO: 745640 - DNA, 21 bp, Homo sapiens
taagttttgacacctagatta

SEQ ID NO: 745641 - DNA, 21 bp, Homo sapiens
taagttttgattaatgtttct

SEQ ID NO: 745642 - DNA, 18 bp, Homo sapiens
taagttttgtgtgtatat

SEQ ID NO: 745643 - DNA, 14 bp, Homo sapiens
taagtttttcttta

SEQ ID NO: 745644 - DNA, 16 bp, Homo sapiens
taataaaaagattgaa

SEQ ID NO: 745645 - DNA, 19 bp, Homo sapiens
taataaaacaatactcaaa

SEQ ID NO: 745646 - DNA, 19 bp, Homo sapiens
taataaaagaacatgcttg

SEQ ID NO: 745647 - DNA, 13 bp, Homo sapiens
taataaaagattt

SEQ ID NO: 745648 - DNA, 22 bp, Homo sapiens
taataaaagctttgactccctg

SEQ ID NO: 745649 - DNA, 13 bp, Homo sapiens
taataaaagtgaa

SEQ ID NO: 745650 - DNA, 12 bp, Homo sapiens
taataaaatcac

SEQ ID NO: 745651 - DNA, 15 bp, Homo sapiens
taataaaatgcaaat

SEQ ID NO: 745652 - DNA, 16 bp, Homo sapiens
taataaaatgcaaatg

SEQ ID NO: 745653 - DNA, 15 bp, Homo sapiens
taataaaattcaaca

SEQ ID NO: 745654 - DNA, 22 bp, Homo sapiens
taataaacatccttcaagaact

SEQ ID NO: 745655 - DNA, 20 bp, Homo sapiens
taataaactaataattgcag

SEQ ID NO: 745656 - DNA, 12 bp, Homo sapiens
taataaactgta

SEQ ID NO: 745657 - DNA, 17 bp, Homo sapiens
taataaactttaatata

SEQ ID NO: 745658 - DNA, 13 bp, Homo sapiens
taataaagaaata

SEQ ID NO: 745659 - DNA, 16 bp, Homo sapiens
taataaagatgctctt

SEQ ID NO: 745660 - DNA, 10 bp, Homo sapiens
taataaagca

SEQ ID NO: 745661 - DNA, 11 bp, Homo sapiens
taataaagcat

SEQ ID NO: 745662 - DNA, 19 bp, Homo sapiens
taataaaggctatttcctg

SEQ ID NO: 745663 - DNA, 15 bp, Homo sapiens
taataaagtattcca

SEQ ID NO: 745664 - DNA, 18 bp, Homo sapiens
taataaagtattccacct

SEQ ID NO: 745665 - DNA, 20 bp, Homo sapiens
taataaagtcatttgtgaaa

SEQ ID NO: 745666 - DNA, 22 bp, Homo sapiens
taataaagtgttacgttttatt

SEQ ID NO: 745667 - DNA, 17 bp, Homo sapiens
taataaagttgttttat

SEQ ID NO: 745668 - DNA, 16 bp, Homo sapiens
taataaatacatacgg

SEQ ID NO: 745669 - DNA, 12 bp, Homo sapiens
taataaatagtt

SEQ ID NO: 745670 - DNA, 15 bp, Homo sapiens
taataaatatactat

SEQ ID NO: 745671 - DNA, 19 bp, Homo sapiens
taataaatatactatgaaa

SEQ ID NO: 745672 - DNA, 17 bp, Homo sapiens
taataaatatgtaatat

SEQ ID NO: 745673 - DNA, 16 bp, Homo sapiens
taataaatatttatgt

SEQ ID NO: 745674 - DNA, 18 bp, Homo sapiens
taataaatcatgttttga

SEQ ID NO: 745675 - DNA, 19 bp, Homo sapiens
taataaatgaatgtcactt

SEQ ID NO: 745676 - DNA, 19 bp, Homo sapiens
taataaattccatctatca

SEQ ID NO: 745677 - DNA, 18 bp, Homo sapiens
taataaattgaataggta

SEQ ID NO: 745678 - DNA, 13 bp, Homo sapiens
taataaattgatt

SEQ ID NO: 745679 - DNA, 12 bp, Homo sapiens
taataaattgct

SEQ ID NO: 745680 - DNA, 14 bp, Homo sapiens
taataaattgctta

SEQ ID NO: 745681 - DNA, 20 bp, Homo sapiens
taataacaaggagatttctt

SEQ ID NO: 745682 - DNA, 12 bp, Homo sapiens
taataacatttt

SEQ ID NO: 745683 - DNA, 14 bp, Homo sapiens
taataaccctgcca

SEQ ID NO: 745684 - DNA, 13 bp, Homo sapiens
taataactttatt

SEQ ID NO: 745685 - DNA, 21 bp, Homo sapiens
taataactttattgcatatag

SEQ ID NO: 745686 - DNA, 15 bp, Homo sapiens
taataagaacagatc

SEQ ID NO: 745687 - DNA, 14 bp, Homo sapiens
taataagcacttgc

SEQ ID NO: 745688 - DNA, 21 bp, Homo sapiens
taataagcacttgcctggaat

SEQ ID NO: 745689 - DNA, 21 bp, Homo sapiens
taataaggcatgcgaaatgtt

SEQ ID NO: 745690 - DNA, 16 bp, Homo sapiens
taataagttttgatat

SEQ ID NO: 745691 - DNA, 19 bp, Homo sapiens
taataagttttgatataat

SEQ ID NO: 745692 - DNA, 23 bp, Homo sapiens
gaatgccatttctcacgccctct

SEQ ID NO: 745693 - DNA, 22 bp, Homo sapiens
gaatgcccacaggcaaatgcat

SEQ ID NO: 745694 - DNA, 18 bp, Homo sapiens
gaatgcccccagctggcc

SEQ ID NO: 745695 - DNA, 21 bp, Homo sapiens
gaatgccgcgaactgggttct

SEQ ID NO: 745696 - DNA, 15 bp, Homo sapiens
gaatgcctaggtccc

SEQ ID NO: 745697 - DNA, 17 bp, Homo sapiens
gaatgcctcctgtgggg

SEQ ID NO: 745698 - DNA, 13 bp, Homo sapiens
gaatgcctgtgcc

SEQ ID NO: 745699 - DNA, 14 bp, Homo sapiens
gaatgcctgtgcca

SEQ ID NO: 745700 - DNA, 13 bp, Homo sapiens
gaatgccttggaa

SEQ ID NO: 745701 - DNA, 15 bp, Homo sapiens
gaatgcgctttattg

SEQ ID NO: 745702 - DNA, 16 bp, Homo sapiens
gaatgctatttcactt

SEQ ID NO: 745703 - DNA, 13 bp, Homo sapiens
gaatgctccccca

SEQ ID NO: 745704 - DNA, 21 bp, Homo sapiens
gaatgctcccccatcctcccc

SEQ ID NO: 745705 - DNA, 22 bp, Homo sapiens
gaatgctcccccatcctcccct

SEQ ID NO: 745706 - DNA, 11 bp, Homo sapiens
gaatgctgcca

SEQ ID NO: 745707 - DNA, 13 bp, Homo sapiens
gaatgctgccagt

SEQ ID NO: 745708 - DNA, 18 bp, Homo sapiens
gaatgctggactggaggc

SEQ ID NO: 745709 - DNA, 23 bp, Homo sapiens
gaatgctgggcccccagcctggc

SEQ ID NO: 745710 - DNA, 18 bp, Homo sapiens
taataccaaagactattt

SEQ ID NO: 745711 - DNA, 22 bp, Homo sapiens
taataccacagctatttagaag

SEQ ID NO: 745712 - DNA, 22 bp, Homo sapiens
taataccaccatttaaaaatgt

SEQ ID NO: 745713 - DNA, 23 bp, Homo sapiens
taataccaccatttaaaaatgtt

SEQ ID NO: 745714 - DNA, 22 bp, Homo sapiens
taataccattttttaaggaaac

SEQ ID NO: 745715 - DNA, 19 bp, Homo sapiens
taatacctgattgatcaca

SEQ ID NO: 745716 - DNA, 21 bp, Homo sapiens
taatacgtgccagatataact

SEQ ID NO: 745717 - DNA, 15 bp, Homo sapiens
taatactaccttgaa

SEQ ID NO: 745718 - DNA, 16 bp, Homo sapiens
taatactcaaatgagt

SEQ ID NO: 745719 - DNA, 20 bp, Homo sapiens
taatactcaaatgagtaaca

SEQ ID NO: 745720 - DNA, 13 bp, Homo sapiens
taatactctattt

SEQ ID NO: 745721 - DNA, 17 bp, Homo sapiens
taatactggaataattt

SEQ ID NO: 745722 - DNA, 19 bp, Homo sapiens
taatactggaataatttgt

SEQ ID NO: 745723 - DNA, 21 bp, Homo sapiens
taatactggaataatttgtaa

SEQ ID NO: 745724 - DNA, 22 bp, Homo sapiens
taatactggaataatttgtaaa

SEQ ID NO: 745725 - DNA, 23 bp, Homo sapiens
taatactggaataatttgtaaat

SEQ ID NO: 745726 - DNA, 21 bp, Homo sapiens
taatactggtatttttactta

SEQ ID NO: 745727 - DNA, 20 bp, Homo sapiens
taatacttaaataaacatga

SEQ ID NO: 745728 - DNA, 17 bp, Homo sapiens
taatacttgacctctgt

SEQ ID NO: 745729 - DNA, 20 bp, Homo sapiens
taatactttgtatacaagta

SEQ ID NO: 745730 - DNA, 15 bp, Homo sapiens
taatacttttgtaat

SEQ ID NO: 745731 - DNA, 16 bp, Homo sapiens
taatagaaaactgaaa

SEQ ID NO: 745732 - DNA, 18 bp, Homo sapiens
taatagaaaactgaaaat

SEQ ID NO: 745733 - DNA, 22 bp, Homo sapiens
taatagaataaaggcagttttc

SEQ ID NO: 745734 - DNA, 16 bp, Homo sapiens
taatagacaatttatt

SEQ ID NO: 745735 - DNA, 18 bp, Homo sapiens
taatagacaatttattat

SEQ ID NO: 745736 - DNA, 19 bp, Homo sapiens
taatagacatacagagata

SEQ ID NO: 745737 - DNA, 21 bp, Homo sapiens
taatagactcgctagtcagta

SEQ ID NO: 745738 - DNA, 22 bp, Homo sapiens
taatagactgtaacttccaaat

SEQ ID NO: 745739 - DNA, 14 bp, Homo sapiens
taatagacttctct

SEQ ID NO: 745740 - DNA, 22 bp, Homo sapiens
taatagacttctcttacatttt

SEQ ID NO: 745741 - DNA, 18 bp, Homo sapiens
taatagaggcagtgagac

SEQ ID NO: 745742 - DNA, 13 bp, Homo sapiens
taatagatgatgg

SEQ ID NO: 745743 - DNA, 16 bp, Homo sapiens
taatagatgtttgata

SEQ ID NO: 745744 - DNA, 16 bp, Homo sapiens
taatagattatttcat

SEQ ID NO: 745745 - DNA, 19 bp, Homo sapiens
taatagattgttttgccac

SEQ ID NO: 745746 - DNA, 23 bp, Homo sapiens
taatagattttttcagacttgtc

SEQ ID NO: 745747 - DNA, 20 bp, Homo sapiens
taatagcaacttttgtgtaa

SEQ ID NO: 745748 - DNA, 18 bp, Homo sapiens
taatagcatccactggaa

SEQ ID NO: 745749 - DNA, 12 bp, Homo sapiens
taataggaattc

SEQ ID NO: 745750 - DNA, 15 bp, Homo sapiens
taatagggaatatat

SEQ ID NO: 745751 - DNA, 22 bp, Homo sapiens
taataggtagcctgctgtgggg

SEQ ID NO: 745752 - DNA, 19 bp, Homo sapiens
taataggtagtttggatat

SEQ ID NO: 745753 - DNA, 20 bp, Homo sapiens
taataggtgggggaaaatga

SEQ ID NO: 745754 - DNA, 18 bp, Homo sapiens
taatagtaatttgtaaag

SEQ ID NO: 745755 - DNA, 17 bp, Homo sapiens
taatagtccaatatttg

SEQ ID NO: 745756 - DNA, 19 bp, Homo sapiens
taatagttcagtagaatta

SEQ ID NO: 745757 - DNA, 18 bp, Homo sapiens
taatagtttgtctatttt

SEQ ID NO: 745758 - DNA, 19 bp, Homo sapiens
taatagtttgtctatttta

SEQ ID NO: 745759 - DNA, 16 bp, Homo sapiens
taatagtttttcactt

SEQ ID NO: 745760 - DNA, 19 bp, Homo sapiens
taatatagaaaaaaacatt

SEQ ID NO: 745761 - DNA, 23 bp, Homo sapiens
taatatagtaggggttgaagaaa

SEQ ID NO: 745762 - DNA, 14 bp, Homo sapiens
taatatataaacaa

SEQ ID NO: 745763 - DNA, 15 bp, Homo sapiens
taatatattaaaatt

SEQ ID NO: 745764 - DNA, 14 bp, Homo sapiens
taatatatttcttc

SEQ ID NO: 745765 - DNA, 19 bp, Homo sapiens
taatatatttgtgtattta

SEQ ID NO: 745766 - DNA, 20 bp, Homo sapiens
taatatatttgtgtatttaa

SEQ ID NO: 745767 - DNA, 14 bp, Homo sapiens
taatatcaaataaa

SEQ ID NO: 745768 - DNA, 21 bp, Homo sapiens
taatatcaaatgcagtatatt

SEQ ID NO: 745769 - DNA, 17 bp, Homo sapiens
taatatcactcattaat

SEQ ID NO: 745770 - DNA, 21 bp, Homo sapiens
taatatcactcattaattaac

SEQ ID NO: 745771 - DNA, 17 bp, Homo sapiens
taatatccctacatgta

SEQ ID NO: 745772 - DNA, 14 bp, Homo sapiens
taatatcctaaaca

SEQ ID NO: 745773 - DNA, 15 bp, Homo sapiens
taatatcctgtaata

SEQ ID NO: 745774 - DNA, 16 bp, Homo sapiens
taatatcctgtaataa

SEQ ID NO: 745775 - DNA, 16 bp, Homo sapiens
taatatctaaagttat

SEQ ID NO: 745776 - DNA, 17 bp, Homo sapiens
taatatctggcactgtt

SEQ ID NO: 745777 - DNA, 15 bp, Homo sapiens
taatatgaaaactta

SEQ ID NO: 745778 - DNA, 16 bp, Homo sapiens
taatatgaagcctttg

SEQ ID NO: 745779 - DNA, 12 bp, Homo sapiens
taatatgagctt

SEQ ID NO: 745780 - DNA, 18 bp, Homo sapiens
taatatgctgccaaattt

SEQ ID NO: 745781 - DNA, 18 bp, Homo sapiens
taatatgcttaaaataag

SEQ ID NO: 745782 - DNA, 15 bp, Homo sapiens
taatatggaaatctt

SEQ ID NO: 745783 - DNA, 18 bp, Homo sapiens
taatatggcaaaaatggc

SEQ ID NO: 745784 - DNA, 15 bp, Homo sapiens
taatatgggcattgt

SEQ ID NO: 745785 - DNA, 20 bp, Homo sapiens
taatatgggcattgtagtta

SEQ ID NO: 745786 - DNA, 20 bp, Homo sapiens
taatatgtgctgaacattgt

SEQ ID NO: 745787 - DNA, 21 bp, Homo sapiens
taatatgtgctgaacattgtt

SEQ ID NO: 745788 - DNA, 20 bp, Homo sapiens
taatatgttcttttaaatga

SEQ ID NO: 745789 - DNA, 15 bp, Homo sapiens
taatatgtttaatgt

SEQ ID NO: 745790 - DNA, 14 bp, Homo sapiens
taatattaaaaata

SEQ ID NO: 745791 - DNA, 23 bp, Homo sapiens
taatattaactaaataaacagat

SEQ ID NO: 745792 - DNA, 20 bp, Homo sapiens
taatattcagccagcttaaa

SEQ ID NO: 745793 - DNA, 23 bp, Homo sapiens
taatattctgttttgttaatata

SEQ ID NO: 745794 - DNA, 14 bp, Homo sapiens
taatattgagaaag

SEQ ID NO: 745795 - DNA, 15 bp, Homo sapiens
taatattgagaatca

SEQ ID NO: 745796 - DNA, 14 bp, Homo sapiens
taatattgtaaata

SEQ ID NO: 745797 - DNA, 13 bp, Homo sapiens
taatatttaacat

SEQ ID NO: 745798 - DNA, 21 bp, Homo sapiens
taatatttaacattatttata

SEQ ID NO: 745799 - DNA, 16 bp, Homo sapiens
taatatttacaatgta

SEQ ID NO: 745800 - DNA, 19 bp, Homo sapiens
taatatttacaatgtatta

SEQ ID NO: 745801 - DNA, 16 bp, Homo sapiens
taatatttacataaag

SEQ ID NO: 745802 - DNA, 21 bp, Homo sapiens
taatatttatgtctatttaag

SEQ ID NO: 745803 - DNA, 23 bp, Homo sapiens
taatatttatgtctatttaagcc

SEQ ID NO: 745804 - DNA, 18 bp, Homo sapiens
taatatttcttcaaatat

SEQ ID NO: 745805 - DNA, 14 bp, Homo sapiens
taatattttaagat

SEQ ID NO: 745806 - DNA, 16 bp, Homo sapiens
taatattttacataca

SEQ ID NO: 745807 - DNA, 17 bp, Homo sapiens
taatattttgtaatatt

SEQ ID NO: 745808 - DNA, 20 bp, Homo sapiens
taatattttgtaatattctg

SEQ ID NO: 745809 - DNA, 22 bp, Homo sapiens
taatattttgtaatattctgtt

SEQ ID NO: 745810 - DNA, 19 bp, Homo sapiens
taatattttgtattttcaa

SEQ ID NO: 745811 - DNA, 14 bp, Homo sapiens
taatattttgttct

SEQ ID NO: 745812 - DNA, 14 bp, Homo sapiens
taatcaaaattgtc

SEQ ID NO: 745813 - DNA, 18 bp, Homo sapiens
taatcaaagccagggtct

SEQ ID NO: 745814 - DNA, 22 bp, Homo sapiens
taatcaactgtaggttatttaa

SEQ ID NO: 745815 - DNA, 22 bp, Homo sapiens
taatcaagagaaacttcaaagt

SEQ ID NO: 745816 - DNA, 11 bp, Homo sapiens
taatcaagatt

SEQ ID NO: 745817 - DNA, 22 bp, Homo sapiens
taatcaatatcccaacattctg

SEQ ID NO: 745818 - DNA, 17 bp, Homo sapiens
gaattagaagtctttca

SEQ ID NO: 745819 - DNA, 21 bp, Homo sapiens
gaattagacctttatttttct

SEQ ID NO: 745820 - DNA, 16 bp, Homo sapiens
gaattaggctgtaact

SEQ ID NO: 745821 - DNA, 23 bp, Homo sapiens
gaattaggctgtaactactttat

SEQ ID NO: 745822 - DNA, 12 bp, Homo sapiens
gaattataacag

SEQ ID NO: 745823 - DNA, 14 bp, Homo sapiens
gaattataacagtt

SEQ ID NO: 745824 - DNA, 19 bp, Homo sapiens
gaattataacagttatatt

SEQ ID NO: 745825 - DNA, 22 bp, Homo sapiens
gaattatcatcccaacagccaa

SEQ ID NO: 745826 - DNA, 21 bp, Homo sapiens
gaattatgtaatatattgtac

SEQ ID NO: 745827 - DNA, 19 bp, Homo sapiens
gaattattcagtgaatttg

SEQ ID NO: 745828 - DNA, 16 bp, Homo sapiens
gaattattgacactga

SEQ ID NO: 745829 - DNA, 20 bp, Homo sapiens
gaattattgtaccattttct

SEQ ID NO: 745830 - DNA, 21 bp, Homo sapiens
gaattatttctgtcacagtaa

SEQ ID NO: 745831 - DNA, 15 bp, Homo sapiens
taatcagcctcttaa

SEQ ID NO: 745832 - DNA, 17 bp, Homo sapiens
taatcagctctcctggc

SEQ ID NO: 745833 - DNA, 19 bp, Homo sapiens
taatcagctctcctggctc

SEQ ID NO: 745834 - DNA, 16 bp, Homo sapiens
taatcaggaaaaatga

SEQ ID NO: 745835 - DNA, 14 bp, Homo sapiens
taatcaggcagcct

SEQ ID NO: 745836 - DNA, 15 bp, Homo sapiens
taatcaggcagcctt

SEQ ID NO: 745837 - DNA, 15 bp, Homo sapiens
taatcaggctgaggt

SEQ ID NO: 745838 - DNA, 13 bp, Homo sapiens
taatcagtaaata

SEQ ID NO: 745839 - DNA, 18 bp, Homo sapiens
taatcatacaaactctca

SEQ ID NO: 745840 - DNA, 22 bp, Homo sapiens
taatcatacaaactctcaccat

SEQ ID NO: 745841 - DNA, 18 bp, Homo sapiens
taatcatagattattata

SEQ ID NO: 745842 - DNA, 17 bp, Homo sapiens
taatcatctataaagaa

SEQ ID NO: 745843 - DNA, 23 bp, Homo sapiens
taatcatgagaaaaactgttctt

SEQ ID NO: 745844 - DNA, 19 bp, Homo sapiens
taatcatgctcatgtatat

SEQ ID NO: 745845 - DNA, 17 bp, Homo sapiens
taatcatggattatgtt

SEQ ID NO: 745846 - DNA, 14 bp, Homo sapiens
taatcatgtaaatg

SEQ ID NO: 745847 - DNA, 21 bp, Homo sapiens
taatcatgtgggtgagccagt

SEQ ID NO: 745848 - DNA, 19 bp, Homo sapiens
taatcatttcttgggccct

SEQ ID NO: 745849 - DNA, 19 bp, Homo sapiens
taatcattttaaattccac

SEQ ID NO: 745850 - DNA, 12 bp, Homo sapiens
taatcattttca

SEQ ID NO: 745851 - DNA, 14 bp, Homo sapiens
taatcattttcatt

SEQ ID NO: 745852 - DNA, 15 bp, Homo sapiens
taatcattttgagtt

SEQ ID NO: 745853 - DNA, 19 bp, Homo sapiens
taatccaatgggtttttcc

SEQ ID NO: 745854 - DNA, 14 bp, Homo sapiens
taatccacccccag

SEQ ID NO: 745855 - DNA, 18 bp, Homo sapiens
taatccaggcacagctga

SEQ ID NO: 745856 - DNA, 17 bp, Homo sapiens
taatccattatccttta

SEQ ID NO: 745857 - DNA, 20 bp, Homo sapiens
taatcccagctacttgggaa

SEQ ID NO: 745858 - DNA, 20 bp, Homo sapiens
taatcccagtacgatttgca

SEQ ID NO: 745859 - DNA, 16 bp, Homo sapiens
taatccccatcattac

SEQ ID NO: 745860 - DNA, 22 bp, Homo sapiens
taatccccatcattactggtaa

SEQ ID NO: 745861 - DNA, 15 bp, Homo sapiens
taatcccgtgcccct

SEQ ID NO: 745862 - DNA, 16 bp, Homo sapiens
taatcccgtgcccctt

SEQ ID NO: 745863 - DNA, 13 bp, Homo sapiens
taatccctgcttt

SEQ ID NO: 745864 - DNA, 22 bp, Homo sapiens
taatccctgggcattgctttcc

SEQ ID NO: 745865 - DNA, 21 bp, Homo sapiens
taatcctagcactttgggagg

SEQ ID NO: 745866 - DNA, 15 bp, Homo sapiens
taatcctatctgggg

SEQ ID NO: 745867 - DNA, 22 bp, Homo sapiens
taatccttaaatcttaatgttc

SEQ ID NO: 745868 - DNA, 16 bp, Homo sapiens
taatccttgataatat

SEQ ID NO: 745869 - DNA, 14 bp, Homo sapiens
taatcctttggaaa

SEQ ID NO: 745870 - DNA, 20 bp, Homo sapiens
taatcctttgttttctgact

SEQ ID NO: 745871 - DNA, 22 bp, Homo sapiens
taatcctttgttttctgactaa

SEQ ID NO: 745872 - DNA, 15 bp, Homo sapiens
taatcgatgaatgta

SEQ ID NO: 745873 - DNA, 18 bp, Homo sapiens
taatcgcttaaagatgtt

SEQ ID NO: 745874 - DNA, 15 bp, Homo sapiens
taatcggcccacagc

SEQ ID NO: 745875 - DNA, 22 bp, Homo sapiens
taatcggcccacagctcccacc

SEQ ID NO: 745876 - DNA, 22 bp, Homo sapiens
taatctactccttgtaaagact

SEQ ID NO: 745877 - DNA, 17 bp, Homo sapiens
taatctactttttgtat

SEQ ID NO: 745878 - DNA, 14 bp, Homo sapiens
taatctagaacaca

SEQ ID NO: 745879 - DNA, 15 bp, Homo sapiens
taatctagtttacag

SEQ ID NO: 745880 - DNA, 12 bp, Homo sapiens
taatctatatta

SEQ ID NO: 745881 - DNA, 14 bp, Homo sapiens
taatctatattaaa

SEQ ID NO: 745882 - DNA, 20 bp, Homo sapiens
taatctatgtgtttctgtaa

SEQ ID NO: 745883 - DNA, 24 bp, Homo sapiens
taatctatgtgtttctgtaacaaa

SEQ ID NO: 745884 - DNA, 18 bp, Homo sapiens
taatctattgggttcatt

SEQ ID NO: 745885 - DNA, 20 bp, Homo sapiens
taatctattgggttcattat

SEQ ID NO: 745886 - DNA, 17 bp, Homo sapiens
taatctcaaaggagaaa

SEQ ID NO: 745887 - DNA, 21 bp, Homo sapiens
taatctcatccccccacccga

SEQ ID NO: 745888 - DNA, 14 bp, Homo sapiens
taatctcatgctgt

SEQ ID NO: 745889 - DNA, 12 bp, Homo sapiens
taatctcctgtt

SEQ ID NO: 745890 - DNA, 21 bp, Homo sapiens
taatctctaaatcaagtattt

SEQ ID NO: 745891 - DNA, 17 bp, Homo sapiens
taatctctctgcagctg

SEQ ID NO: 745892 - DNA, 18 bp, Homo sapiens
taatctctctgcagctgc

SEQ ID NO: 745893 - DNA, 18 bp, Homo sapiens
taatctctgtaaagctaa

SEQ ID NO: 745894 - DNA, 14 bp, Homo sapiens
taatctcttcttat

SEQ ID NO: 745895 - DNA, 20 bp, Homo sapiens
taatctgaagatatatttca

SEQ ID NO: 745896 - DNA, 13 bp, Homo sapiens
taatctgaataaa

SEQ ID NO: 745897 - DNA, 17 bp, Homo sapiens
taatctgaataaagtgt

SEQ ID NO: 745898 - DNA, 20 bp, Homo sapiens
taatctgaataaagtgtaac

SEQ ID NO: 745899 - DNA, 22 bp, Homo sapiens
taatctgaataaagtgtaacaa

SEQ ID NO: 745900 - DNA, 23 bp, Homo sapiens
taatctgagattgtgtttgttca

SEQ ID NO: 745901 - DNA, 21 bp, Homo sapiens
taatctgcaaagaatgagaag

SEQ ID NO: 745902 - DNA, 18 bp, Homo sapiens
taatctggactcctctgt

SEQ ID NO: 745903 - DNA, 16 bp, Homo sapiens
taatctggtgacaaat

SEQ ID NO: 745904 - DNA, 20 bp, Homo sapiens
taatctgtagggctggacct

SEQ ID NO: 745905 - DNA, 18 bp, Homo sapiens
taatctgtataatacttt

SEQ ID NO: 745906 - DNA, 11 bp, Homo sapiens
taatctgtcaa

SEQ ID NO: 745907 - DNA, 17 bp, Homo sapiens
taatctgtcaaaacact

SEQ ID NO: 745908 - DNA, 23 bp, Homo sapiens
taatctgtcaaaacactgtggaa

SEQ ID NO: 745909 - DNA, 13 bp, Homo sapiens
taatctgtgtaca

SEQ ID NO: 745910 - DNA, 20 bp, Homo sapiens
taatctgttaggttggggat

SEQ ID NO: 745911 - DNA, 20 bp, Homo sapiens
taatctgttatgtactagtg

SEQ ID NO: 745912 - DNA, 19 bp, Homo sapiens
taatctgtttgtgcaaaca

SEQ ID NO: 745913 - DNA, 13 bp, Homo sapiens
taatcttatacaa

SEQ ID NO: 745914 - DNA, 21 bp, Homo sapiens
taatcttattcattttctcta

SEQ ID NO: 745915 - DNA, 19 bp, Homo sapiens
taatcttcaggtgaacact

SEQ ID NO: 745916 - DNA, 13 bp, Homo sapiens
taatcttcagttt

SEQ ID NO: 745917 - DNA, 20 bp, Homo sapiens
taatcttcagttttatcttt

SEQ ID NO: 745918 - DNA, 14 bp, Homo sapiens
taatcttctgcctt

SEQ ID NO: 745919 - DNA, 15 bp, Homo sapiens
taatcttgaatgttt

SEQ ID NO: 745920 - DNA, 22 bp, Homo sapiens
taatcttgaattgtaactgttc

SEQ ID NO: 745921 - DNA, 15 bp, Homo sapiens
taatcttgctttctt

SEQ ID NO: 745922 - DNA, 22 bp, Homo sapiens
taatcttggcttcttaaaaact

SEQ ID NO: 745923 - DNA, 13 bp, Homo sapiens
taatcttgtccct

SEQ ID NO: 745924 - DNA, 12 bp, Homo sapiens
taatcttgtgta

SEQ ID NO: 745925 - DNA, 19 bp, Homo sapiens
taatcttgtgtagtcttca

SEQ ID NO: 745926 - DNA, 19 bp, Homo sapiens
taatcttgttgataaaaat

SEQ ID NO: 745927 - DNA, 14 bp, Homo sapiens
taatctttcaaacc

SEQ ID NO: 745928 - DNA, 21 bp, Homo sapiens
taatctttcaaaccagcttca

SEQ ID NO: 745929 - DNA, 23 bp, Homo sapiens
taatctttcacttgaaagatttt

SEQ ID NO: 745930 - DNA, 14 bp, Homo sapiens
taatctttctacct

SEQ ID NO: 745931 - DNA, 20 bp, Homo sapiens
taatctttctatagccaact

SEQ ID NO: 745932 - DNA, 23 bp, Homo sapiens
taatctttctttacctgagacca

SEQ ID NO: 745933 - DNA, 16 bp, Homo sapiens
taatctttgtgacagg

SEQ ID NO: 745934 - DNA, 16 bp, Homo sapiens
taatctttttacagtt

SEQ ID NO: 745935 - DNA, 21 bp, Homo sapiens
taatgaaaaacaaaaagctaa

SEQ ID NO: 745936 - DNA, 17 bp, Homo sapiens
taatgaaaagaaacaag

SEQ ID NO: 745937 - DNA, 17 bp, Homo sapiens
taatgaaaataaaacac

SEQ ID NO: 745938 - DNA, 21 bp, Homo sapiens
taatgaaaataaaacacacct

SEQ ID NO: 745939 - DNA, 23 bp, Homo sapiens
taatgaaaataaaacacacctcg

SEQ ID NO: 745940 - DNA, 15 bp, Homo sapiens
taatgaaaatgtcag

SEQ ID NO: 745941 - DNA, 13 bp, Homo sapiens
taatgaaacaaag

SEQ ID NO: 745942 - DNA, 17 bp, Homo sapiens
taatgaaagactgtaca

SEQ ID NO: 745943 - DNA, 19 bp, Homo sapiens
taatgaaagactgtacaaa

SEQ ID NO: 745944 - DNA, 23 bp, Homo sapiens
taatgaaagactgtacaaagtag

SEQ ID NO: 745945 - DNA, 18 bp, Homo sapiens
gaatttgtaacctcagct

SEQ ID NO: 745946 - DNA, 13 bp, Homo sapiens
gaatttgtaagca

SEQ ID NO: 745947 - DNA, 20 bp, Homo sapiens
gaatttgtaagcaacttgct

SEQ ID NO: 745948 - DNA, 16 bp, Homo sapiens
gaatttgtattaaaaa

SEQ ID NO: 745949 - DNA, 19 bp, Homo sapiens
gaatttgtccaattgtgta

SEQ ID NO: 745950 - DNA, 18 bp, Homo sapiens
gaatttgtccattgtaaa

SEQ ID NO: 745951 - DNA, 21 bp, Homo sapiens
gaatttgtgttgaaggaactt

SEQ ID NO: 745952 - DNA, 19 bp, Homo sapiens
taatgaaataatcagtgac

SEQ ID NO: 745953 - DNA, 18 bp, Homo sapiens
taatgaaatgataaagac

SEQ ID NO: 745954 - DNA, 15 bp, Homo sapiens
taatgaaatggagga

SEQ ID NO: 745955 - DNA, 14 bp, Homo sapiens
taatgaacaaatat

SEQ ID NO: 745956 - DNA, 17 bp, Homo sapiens
taatgaacaaatatgct

SEQ ID NO: 745957 - DNA, 13 bp, Homo sapiens
taatgaactttga

SEQ ID NO: 745958 - DNA, 23 bp, Homo sapiens
taatgaagaaagtggaaaacaag

SEQ ID NO: 745959 - DNA, 15 bp, Homo sapiens
taatgaataaactga

SEQ ID NO: 745960 - DNA, 17 bp, Homo sapiens
taatgaatgaaacattt

SEQ ID NO: 745961 - DNA, 13 bp, Homo sapiens
taatgacaacact

SEQ ID NO: 745962 - DNA, 15 bp, Homo sapiens
taatgacagatgcaa

SEQ ID NO: 745963 - DNA, 22 bp, Homo sapiens
taatgacagatgcaagttattt

SEQ ID NO: 745964 - DNA, 20 bp, Homo sapiens
taatgacaggcctgtccaac

SEQ ID NO: 745965 - DNA, 22 bp, Homo sapiens
taatgaccaattgagtaagaac

SEQ ID NO: 745966 - DNA, 18 bp, Homo sapiens
taatgaccatgaaagact

SEQ ID NO: 745967 - DNA, 13 bp, Homo sapiens
taatgagaaaaaa

SEQ ID NO: 745968 - DNA, 17 bp, Homo sapiens
taatgagaaaaaaatat

SEQ ID NO: 745969 - DNA, 23 bp, Homo sapiens
taatgaggagagaaaatatatgt

SEQ ID NO: 745970 - DNA, 17 bp, Homo sapiens
taatgagggaaatctgt

SEQ ID NO: 745971 - DNA, 20 bp, Homo sapiens
taatgagggaaatctgtaaa

SEQ ID NO: 745972 - DNA, 15 bp, Homo sapiens
taatgagggactgga

SEQ ID NO: 745973 - DNA, 11 bp, Homo sapiens
taatgagtaac

SEQ ID NO: 745974 - DNA, 13 bp, Homo sapiens
taatgataaaata

SEQ ID NO: 745975 - DNA, 15 bp, Homo sapiens
taatgataaaataaa

SEQ ID NO: 745976 - DNA, 21 bp, Homo sapiens
taatgataaaataaataattt

SEQ ID NO: 745977 - DNA, 14 bp, Homo sapiens
taatgataaactca

SEQ ID NO: 745978 - DNA, 18 bp, Homo sapiens
taatgataaactcagatc

SEQ ID NO: 745979 - DNA, 14 bp, Homo sapiens
taatgatactgtgt

SEQ ID NO: 745980 - DNA, 18 bp, Homo sapiens
taatgatgttgataattt

SEQ ID NO: 745981 - DNA, 13 bp, Homo sapiens
taatgattcataa

SEQ ID NO: 745982 - DNA, 23 bp, Homo sapiens
taatgcaagcaaagtatcaaaga

SEQ ID NO: 745983 - DNA, 18 bp, Homo sapiens
taatgcactgtttttaat

SEQ ID NO: 745984 - DNA, 21 bp, Homo sapiens
taatgcatgttaggaaaattt

SEQ ID NO: 745985 - DNA, 16 bp, Homo sapiens
taatgcattaaacctg

SEQ ID NO: 745986 - DNA, 18 bp, Homo sapiens
taatgcattaaacctgtc

SEQ ID NO: 745987 - DNA, 15 bp, Homo sapiens
taatgcctttgtaac

SEQ ID NO: 745988 - DNA, 22 bp, Homo sapiens
taatgcgtgcataccacttttg

SEQ ID NO: 745989 - DNA, 14 bp, Homo sapiens
taatgctaagaaat

SEQ ID NO: 745990 - DNA, 14 bp, Homo sapiens
taatgctaccagga

SEQ ID NO: 745991 - DNA, 20 bp, Homo sapiens
taatgctcccatctcctgat

SEQ ID NO: 745992 - DNA, 15 bp, Homo sapiens
taatgctgtctttgt

SEQ ID NO: 745993 - DNA, 16 bp, Homo sapiens
taatgctgtctttgtg

SEQ ID NO: 745994 - DNA, 14 bp, Homo sapiens
taatgctgttgcct

SEQ ID NO: 745995 - DNA, 17 bp, Homo sapiens
taatgctgttgcctcat

SEQ ID NO: 745996 - DNA, 16 bp, Homo sapiens
taatgctgtttctaag

SEQ ID NO: 745997 - DNA, 19 bp, Homo sapiens
taatgcttgtttatgatat

SEQ ID NO: 745998 - DNA, 17 bp, Homo sapiens
taatgctttcacaacat

SEQ ID NO: 745999 - DNA, 15 bp, Homo sapiens
taatggaaaaatagt

SEQ ID NO: 746000 - DNA, 20 bp, Homo sapiens
taatggaaacatttacaata

SEQ ID NO: 746001 - DNA, 22 bp, Homo sapiens
taatggactgtgaatttcaaaa

SEQ ID NO: 746002 - DNA, 23 bp, Homo sapiens
taatggactgtgaatttcaaaaa

SEQ ID NO: 746003 - DNA, 12 bp, Homo sapiens
taatggagaaga

SEQ ID NO: 746004 - DNA, 13 bp, Homo sapiens
taatggagaagac

SEQ ID NO: 746005 - DNA, 14 bp, Homo sapiens
taatggagaatcac

SEQ ID NO: 746006 - DNA, 14 bp, Homo sapiens
taatggcatttctc

SEQ ID NO: 746007 - DNA, 17 bp, Homo sapiens
taatggctagtactgta

SEQ ID NO: 746008 - DNA, 18 bp, Homo sapiens
taatggctagtactgtat

SEQ ID NO: 746009 - DNA, 21 bp, Homo sapiens
taatggctgataattttaaat

SEQ ID NO: 746010 - DNA, 22 bp, Homo sapiens
taatggctgataattttaaatt

SEQ ID NO: 746011 - DNA, 19 bp, Homo sapiens
taatggcttccctctttca

SEQ ID NO: 746012 - DNA, 15 bp, Homo sapiens
taatgggggtagcag

SEQ ID NO: 746013 - DNA, 21 bp, Homo sapiens
taatgggggtagcagctggac

SEQ ID NO: 746014 - DNA, 22 bp, Homo sapiens
taatggggtcctggccatccca

SEQ ID NO: 746015 - DNA, 21 bp, Homo sapiens
taatggtcccatccaggcagt

SEQ ID NO: 746016 - DNA, 13 bp, Homo sapiens
taatggtgtagaa

SEQ ID NO: 746017 - DNA, 17 bp, Homo sapiens
taatggtgtccagtctt

SEQ ID NO: 746018 - DNA, 19 bp, Homo sapiens
taatggttgtgaaatgtaa

SEQ ID NO: 746019 - DNA, 23 bp, Homo sapiens
taatgtaaactttgtcatggttt

SEQ ID NO: 746020 - DNA, 16 bp, Homo sapiens
taatgtaagctctact

SEQ ID NO: 746021 - DNA, 15 bp, Homo sapiens
taatgtaattcagga

SEQ ID NO: 746022 - DNA, 18 bp, Homo sapiens
taatgtaattcaggactc

SEQ ID NO: 746023 - DNA, 16 bp, Homo sapiens
taatgtacaagttttg

SEQ ID NO: 746024 - DNA, 18 bp, Homo sapiens
taatgtacaagttttgta

SEQ ID NO: 746025 - DNA, 19 bp, Homo sapiens
taatgtacaagttttgtat

SEQ ID NO: 746026 - DNA, 15 bp, Homo sapiens
taatgtacagagtgg

SEQ ID NO: 746027 - DNA, 15 bp, Homo sapiens
taatgtacatctggc

SEQ ID NO: 746028 - DNA, 12 bp, Homo sapiens
taatgtactgta

SEQ ID NO: 746029 - DNA, 14 bp, Homo sapiens
taatgtactgtaca

SEQ ID NO: 746030 - DNA, 13 bp, Homo sapiens
taatgtagctatt

SEQ ID NO: 746031 - DNA, 14 bp, Homo sapiens
taatgtagctattt

SEQ ID NO: 746032 - DNA, 15 bp, Homo sapiens
taatgtatataaaaa

SEQ ID NO: 746033 - DNA, 17 bp, Homo sapiens
taatgtatgttaccaaa

SEQ ID NO: 746034 - DNA, 16 bp, Homo sapiens
taatgtattatgagcc

SEQ ID NO: 746035 - DNA, 14 bp, Homo sapiens
taatgtattccctt

SEQ ID NO: 746036 - DNA, 23 bp, Homo sapiens
taatgtcactgtttttattcctt

SEQ ID NO: 746037 - DNA, 15 bp, Homo sapiens
taatgtcagtgacat

SEQ ID NO: 746038 - DNA, 16 bp, Homo sapiens
taatgtcataaagtga

SEQ ID NO: 746039 - DNA, 20 bp, Homo sapiens
taatgtcataaagtgagaaa

SEQ ID NO: 746040 - DNA, 16 bp, Homo sapiens
taatgtcattgctaaa

SEQ ID NO: 746041 - DNA, 19 bp, Homo sapiens
taatgtcttcagtggaaca

SEQ ID NO: 746042 - DNA, 21 bp, Homo sapiens
taatgtgaaaatggtccagga

SEQ ID NO: 746043 - DNA, 13 bp, Homo sapiens
taatgtgaaatgt

SEQ ID NO: 746044 - DNA, 14 bp, Homo sapiens
taatgtgaaatgta

SEQ ID NO: 746045 - DNA, 19 bp, Homo sapiens
taatgtgaaatgtaactgt

SEQ ID NO: 746046 - DNA, 18 bp, Homo sapiens
taatgtgaagacattttt

SEQ ID NO: 746047 - DNA, 10 bp, Homo sapiens
taatgtgaat

SEQ ID NO: 746048 - DNA, 22 bp, Homo sapiens
taatgtgaggaactcacatact

SEQ ID NO: 746049 - DNA, 20 bp, Homo sapiens
taatgtgatcatatgaggac

SEQ ID NO: 746050 - DNA, 20 bp, Homo sapiens
taatgtgatggatggcacaa

SEQ ID NO: 746051 - DNA, 19 bp, Homo sapiens
taatgtgcaaatctgacaa

SEQ ID NO: 746052 - DNA, 16 bp, Homo sapiens
taatgtgcaaattttg

SEQ ID NO: 746053 - DNA, 17 bp, Homo sapiens
taatgtgggaagaaaca

SEQ ID NO: 746054 - DNA, 18 bp, Homo sapiens
taatgtgggaagaaacaa

SEQ ID NO: 746055 - DNA, 17 bp, Homo sapiens
taatgtgtactggtcag

SEQ ID NO: 746056 - DNA, 13 bp, Homo sapiens
taatgtgtctgtg

SEQ ID NO: 746057 - DNA, 18 bp, Homo sapiens
taatgtgtggtggcctca

SEQ ID NO: 746058 - DNA, 21 bp, Homo sapiens
taatgtgttatgagaaattag

SEQ ID NO: 746059 - DNA, 15 bp, Homo sapiens
taatgttaattcagc

SEQ ID NO: 746060 - DNA, 15 bp, Homo sapiens
taatgttacaacaac

SEQ ID NO: 746061 - DNA, 13 bp, Homo sapiens
taatgttactgat

SEQ ID NO: 746062 - DNA, 18 bp, Homo sapiens
taatgttatatcatatgt

SEQ ID NO: 746063 - DNA, 16 bp, Homo sapiens
taatgttcattttctc

SEQ ID NO: 746064 - DNA, 22 bp, Homo sapiens
taatgttctgaataatttctta

SEQ ID NO: 746065 - DNA, 13 bp, Homo sapiens
taatgttgataat

SEQ ID NO: 746066 - DNA, 15 bp, Homo sapiens
taatgttgatcagca

SEQ ID NO: 746067 - DNA, 20 bp, Homo sapiens
taatgttgattttaatcctg

SEQ ID NO: 746068 - DNA, 13 bp, Homo sapiens
taatgttgtccag

SEQ ID NO: 746069 - DNA, 18 bp, Homo sapiens
taatgttgttatttaaag

SEQ ID NO: 746070 - DNA, 11 bp, Homo sapiens
taatgtttaaa

SEQ ID NO: 746071 - DNA, 14 bp, Homo sapiens
taatgtttaaatca

SEQ ID NO: 746072 - DNA, 19 bp, Homo sapiens
taatgtttaaatcatgtat

SEQ ID NO: 746073 - DNA, 20 bp, Homo sapiens
taatgtttaaatcatgtatg

SEQ ID NO: 746074 - DNA, 15 bp, Homo sapiens
taatgtttatgagcc

SEQ ID NO: 746075 - DNA, 17 bp, Homo sapiens
gacagcttcctcacacc

SEQ ID NO: 746076 - DNA, 14 bp, Homo sapiens
gacagcttctctgc

SEQ ID NO: 746077 - DNA, 15 bp, Homo sapiens
gacagcttgagccgg

SEQ ID NO: 746078 - DNA, 13 bp, Homo sapiens
gacagctttctgg

SEQ ID NO: 746079 - DNA, 15 bp, Homo sapiens
taatgtttattaaat

SEQ ID NO: 746080 - DNA, 22 bp, Homo sapiens
taatgtttattaaatgcttcat

SEQ ID NO: 746081 - DNA, 19 bp, Homo sapiens
taatgtttattatttacat

SEQ ID NO: 746082 - DNA, 16 bp, Homo sapiens
taatgtttgatttagt

SEQ ID NO: 746083 - DNA, 13 bp, Homo sapiens
taatgtttgctat

SEQ ID NO: 746084 - DNA, 20 bp, Homo sapiens
taatgttttctttgcaaagt

SEQ ID NO: 746085 - DNA, 21 bp, Homo sapiens
taatgttttctttgcaaagta

SEQ ID NO: 746086 - DNA, 22 bp, Homo sapiens
taatgttttctttgcaaagtat

SEQ ID NO: 746087 - DNA, 17 bp, Homo sapiens
taatgtttttcctttct

SEQ ID NO: 746088 - DNA, 22 bp, Homo sapiens
taattaaaaaaatttttttccc

SEQ ID NO: 746089 - DNA, 12 bp, Homo sapiens
taattaaaaact

SEQ ID NO: 746090 - DNA, 17 bp, Homo sapiens
taattaaaaactttaaa

SEQ ID NO: 746091 - DNA, 22 bp, Homo sapiens
taattaaaaagcgaattatact

SEQ ID NO: 746092 - DNA, 13 bp, Homo sapiens
taattaaaatctg

SEQ ID NO: 746093 - DNA, 14 bp, Homo sapiens
taattaaaatctgg

SEQ ID NO: 746094 - DNA, 15 bp, Homo sapiens
taattaaactgttaa

SEQ ID NO: 746095 - DNA, 12 bp, Homo sapiens
taattaaagatg

SEQ ID NO: 746096 - DNA, 15 bp, Homo sapiens
taattaaagatgcca

SEQ ID NO: 746097 - DNA, 18 bp, Homo sapiens
taattaaagcacactttt

SEQ ID NO: 746098 - DNA, 15 bp, Homo sapiens
taattaaataataca

SEQ ID NO: 746099 - DNA, 17 bp, Homo sapiens
taattaaataatacaac

SEQ ID NO: 746100 - DNA, 21 bp, Homo sapiens
taattaaatctctttaagaat

SEQ ID NO: 746101 - DNA, 13 bp, Homo sapiens
taattaaatgtat

SEQ ID NO: 746102 - DNA, 14 bp, Homo sapiens
taattaaatgtatt

SEQ ID NO: 746103 - DNA, 13 bp, Homo sapiens
taattaaatttaa

SEQ ID NO: 746104 - DNA, 19 bp, Homo sapiens
taattaaccttactaatta

SEQ ID NO: 746105 - DNA, 17 bp, Homo sapiens
taattaacttaactgaa

SEQ ID NO: 746106 - DNA, 19 bp, Homo sapiens
taattaacttaactgaaga

SEQ ID NO: 746107 - DNA, 18 bp, Homo sapiens
taattaagtatctgggat

SEQ ID NO: 746108 - DNA, 14 bp, Homo sapiens
taattaataaagaa

SEQ ID NO: 746109 - DNA, 14 bp, Homo sapiens
taattaattgtaat

SEQ ID NO: 746110 - DNA, 20 bp, Homo sapiens
taattaatttggagcacaaa

SEQ ID NO: 746111 - DNA, 15 bp, Homo sapiens
taattacatacagat

SEQ ID NO: 746112 - DNA, 21 bp, Homo sapiens
taattacattcctaactagaa

SEQ ID NO: 746113 - DNA, 21 bp, Homo sapiens
taattaccaacctgttaccta

SEQ ID NO: 746114 - DNA, 23 bp, Homo sapiens
taattacgtttaaagtgcagtca

SEQ ID NO: 746115 - DNA, 22 bp, Homo sapiens
taattacttattgtatttatgt

SEQ ID NO: 746116 - DNA, 12 bp, Homo sapiens
taattagagaac

SEQ ID NO: 746117 - DNA, 20 bp, Homo sapiens
taattagatccattaattta

SEQ ID NO: 746118 - DNA, 17 bp, Homo sapiens
taattaggcaaggctat

SEQ ID NO: 746119 - DNA, 22 bp, Homo sapiens
taattagtgccacttaatgtat

SEQ ID NO: 746120 - DNA, 24 bp, Homo sapiens
taattagttccagtttctccttga

SEQ ID NO: 746121 - DNA, 12 bp, Homo sapiens
taattagtttat

SEQ ID NO: 746122 - DNA, 20 bp, Homo sapiens
taattagtttatattactct

SEQ ID NO: 746123 - DNA, 21 bp, Homo sapiens
taattagtttatattactctc

SEQ ID NO: 746124 - DNA, 20 bp, Homo sapiens
taattataccccctgcaaag

SEQ ID NO: 746125 - DNA, 23 bp, Homo sapiens
taattatatttctacagagaaaa

SEQ ID NO: 746126 - DNA, 15 bp, Homo sapiens
taattatcagttggt

SEQ ID NO: 746127 - DNA, 18 bp, Homo sapiens
taattatcggaagcagtg

SEQ ID NO: 746128 - DNA, 18 bp, Homo sapiens
taattatcgggaacagtg

SEQ ID NO: 746129 - DNA, 21 bp, Homo sapiens
taattatcgggaacagtgttt

SEQ ID NO: 746130 - DNA, 22 bp, Homo sapiens
taattatgggaataattgcttt

SEQ ID NO: 746131 - DNA, 14 bp, Homo sapiens
taattatgttttca

SEQ ID NO: 746132 - DNA, 19 bp, Homo sapiens
taattattataaaaatatt

SEQ ID NO: 746133 - DNA, 15 bp, Homo sapiens
taattatttaaataa

SEQ ID NO: 746134 - DNA, 13 bp, Homo sapiens
taattattttaaa

SEQ ID NO: 746135 - DNA, 18 bp, Homo sapiens
taattattttattgtgta

SEQ ID NO: 746136 - DNA, 13 bp, Homo sapiens
taattattttggt

SEQ ID NO: 746137 - DNA, 16 bp, Homo sapiens
taattattttggtact

SEQ ID NO: 746138 - DNA, 20 bp, Homo sapiens
taattattttggtactttta

SEQ ID NO: 746139 - DNA, 19 bp, Homo sapiens
taattcaaagcaccaaaat

SEQ ID NO: 746140 - DNA, 12 bp, Homo sapiens
taattcaacatc

SEQ ID NO: 746141 - DNA, 20 bp, Homo sapiens
taattcaagcctctaaacag

SEQ ID NO: 746142 - DNA, 18 bp, Homo sapiens
taattcaaggaatttctt

SEQ ID NO: 746143 - DNA, 16 bp, Homo sapiens
taattcaatgtgaaca

SEQ ID NO: 746144 - DNA, 19 bp, Homo sapiens
taattcaattcaaagctgt

SEQ ID NO: 746145 - DNA, 12 bp, Homo sapiens
taattcaggact

SEQ ID NO: 746146 - DNA, 23 bp, Homo sapiens
taattcagggtggtaaagtatgt

SEQ ID NO: 746147 - DNA, 19 bp, Homo sapiens
taattcaggtttttccttt

SEQ ID NO: 746148 - DNA, 21 bp, Homo sapiens
taattcaggtttttccttttt

SEQ ID NO: 746149 - DNA, 19 bp, Homo sapiens
taattcagtacaacccata

SEQ ID NO: 746150 - DNA, 12 bp, Homo sapiens
taattcatttgt

SEQ ID NO: 746151 - DNA, 15 bp, Homo sapiens
taattccacaccttt

SEQ ID NO: 746152 - DNA, 13 bp, Homo sapiens
taattccacagct

SEQ ID NO: 746153 - DNA, 19 bp, Homo sapiens
taattccacaggtcatcag

SEQ ID NO: 746154 - DNA, 16 bp, Homo sapiens
taattcccaacatttc

SEQ ID NO: 746155 - DNA, 17 bp, Homo sapiens
taattcccattttgcaa

SEQ ID NO: 746156 - DNA, 16 bp, Homo sapiens
taattcctacagcact

SEQ ID NO: 746157 - DNA, 21 bp, Homo sapiens
taattcctacagcactactgg

SEQ ID NO: 746158 - DNA, 15 bp, Homo sapiens
taattcctcttttta

SEQ ID NO: 746159 - DNA, 14 bp, Homo sapiens
taattcctgatctt

SEQ ID NO: 746160 - DNA, 15 bp, Homo sapiens
taattcctggcatga

SEQ ID NO: 746161 - DNA, 12 bp, Homo sapiens
taattccttggt

SEQ ID NO: 746162 - DNA, 19 bp, Homo sapiens
taattctaagttatttact

SEQ ID NO: 746163 - DNA, 14 bp, Homo sapiens
taattctcattaaa

SEQ ID NO: 746164 - DNA, 14 bp, Homo sapiens
taattctcatttgt

SEQ ID NO: 746165 - DNA, 23 bp, Homo sapiens
taattctccctaaggaatctgaa

SEQ ID NO: 746166 - DNA, 17 bp, Homo sapiens
taattctccttcccaga

SEQ ID NO: 746167 - DNA, 19 bp, Homo sapiens
taattctgacgtcagcgca

SEQ ID NO: 746168 - DNA, 17 bp, Homo sapiens
taattctgggaagggag

SEQ ID NO: 746169 - DNA, 13 bp, Homo sapiens
taattctgtaaat

SEQ ID NO: 746170 - DNA, 19 bp, Homo sapiens
taattcttatgactaaatt

SEQ ID NO: 746171 - DNA, 15 bp, Homo sapiens
taattcttcacctgt

SEQ ID NO: 746172 - DNA, 14 bp, Homo sapiens
taattgatttcaag

SEQ ID NO: 746173 - DNA, 15 bp, Homo sapiens
taattgcacattttt

SEQ ID NO: 746174 - DNA, 22 bp, Homo sapiens
taattgcacatttttttctatg

SEQ ID NO: 746175 - DNA, 18 bp, Homo sapiens
taattgcatctcaaaatt

SEQ ID NO: 746176 - DNA, 17 bp, Homo sapiens
taattgcatttctgctc

SEQ ID NO: 746177 - DNA, 22 bp, Homo sapiens
taattgcctacaataaaaagaa

SEQ ID NO: 746178 - DNA, 20 bp, Homo sapiens
taattgcctagaaatatctt

SEQ ID NO: 746179 - DNA, 18 bp, Homo sapiens
taattgcttaaaagacat

SEQ ID NO: 746180 - DNA, 15 bp, Homo sapiens
taattgcttacattt

SEQ ID NO: 746181 - DNA, 16 bp, Homo sapiens
taattgcttacatttt

SEQ ID NO: 746182 - DNA, 23 bp, Homo sapiens
taattgcttacatttttacaata

SEQ ID NO: 746183 - DNA, 12 bp, Homo sapiens
taattgctttga

SEQ ID NO: 746184 - DNA, 13 bp, Homo sapiens
taattgctttgaa

SEQ ID NO: 746185 - DNA, 21 bp, Homo sapiens
taattggaagaaattcctgta

SEQ ID NO: 746186 - DNA, 21 bp, Homo sapiens
taattggaatcttcacctcag

SEQ ID NO: 746187 - DNA, 21 bp, Homo sapiens
taattggcccaagtcattgtt

SEQ ID NO: 746188 - DNA, 20 bp, Homo sapiens
taattgggcactatttattt

SEQ ID NO: 746189 - DNA, 18 bp, Homo sapiens
taattgggccagcttttc

SEQ ID NO: 746190 - DNA, 19 bp, Homo sapiens
taattggtgctatttgaag

SEQ ID NO: 746191 - DNA, 21 bp, Homo sapiens
taattggtgctatttgaagaa

SEQ ID NO: 746192 - DNA, 22 bp, Homo sapiens
taattgtaaatattttgataca

SEQ ID NO: 746193 - DNA, 18 bp, Homo sapiens
taattgtaattccaaaat

SEQ ID NO: 746194 - DNA, 17 bp, Homo sapiens
taattgtagttctgtgt

SEQ ID NO: 746195 - DNA, 22 bp, Homo sapiens
taattgtagttctgtgtacttt

SEQ ID NO: 746196 - DNA, 24 bp, Homo sapiens
taattgtataagtcaagcacatgt

SEQ ID NO: 746197 - DNA, 13 bp, Homo sapiens
gacatcctcttct

SEQ ID NO: 746198 - DNA, 15 bp, Homo sapiens
gacatctcaggattt

SEQ ID NO: 746199 - DNA, 16 bp, Homo sapiens
gacatctcaggggcca

SEQ ID NO: 746200 - DNA, 17 bp, Homo sapiens
gacatctccagtgtgcc

SEQ ID NO: 746201 - DNA, 16 bp, Homo sapiens
gacatctctgactttc

SEQ ID NO: 746202 - DNA, 18 bp, Homo sapiens
gacatctggaatctggag

SEQ ID NO: 746203 - DNA, 15 bp, Homo sapiens
gacatctgtagggaa

SEQ ID NO: 746204 - DNA, 21 bp, Homo sapiens
gacatcttcaaagcttgaaga

SEQ ID NO: 746205 - DNA, 14 bp, Homo sapiens
gacatcttctcaac

SEQ ID NO: 746206 - DNA, 12 bp, Homo sapiens
gacatgaagcat

SEQ ID NO: 746207 - DNA, 16 bp, Homo sapiens
gacatgaagctgttgt

SEQ ID NO: 746208 - DNA, 16 bp, Homo sapiens
gacatgaatgcacact

SEQ ID NO: 746209 - DNA, 15 bp, Homo sapiens
gacatgaccctctgt

SEQ ID NO: 746210 - DNA, 16 bp, Homo sapiens
gacatgaccctctgtc

SEQ ID NO: 746211 - DNA, 22 bp, Homo sapiens
gacatgaccctctgtccccagg

SEQ ID NO: 746212 - DNA, 12 bp, Homo sapiens
gacatgagatgg

SEQ ID NO: 746213 - DNA, 21 bp, Homo sapiens
gacatgatttagggaagcagg

SEQ ID NO: 746214 - DNA, 19 bp, Homo sapiens
gacatgatttccttgaatg

SEQ ID NO: 746215 - DNA, 17 bp, Homo sapiens
gacatgcccaaaactta

SEQ ID NO: 746216 - DNA, 22 bp, Homo sapiens
gacatgccctcccttctccctg

SEQ ID NO: 746217 - DNA, 23 bp, Homo sapiens
gacatgcggctgcccacgctcct

SEQ ID NO: 746218 - DNA, 16 bp, Homo sapiens
gacatgcggtagccag

SEQ ID NO: 746219 - DNA, 19 bp, Homo sapiens
gacatgcggtagccagcac

SEQ ID NO: 746220 - DNA, 22 bp, Homo sapiens
gacatgcgtgtgtcagggatga

SEQ ID NO: 746221 - DNA, 19 bp, Homo sapiens
gacatgctaacctctctga

SEQ ID NO: 746222 - DNA, 20 bp, Homo sapiens
gacatgctctttttttaagt

SEQ ID NO: 746223 - DNA, 14 bp, Homo sapiens
gacatgctgccagg

SEQ ID NO: 746224 - DNA, 16 bp, Homo sapiens
gacatgcttacttttt

SEQ ID NO: 746225 - DNA, 16 bp, Homo sapiens
gacatgcttttctgcc

SEQ ID NO: 746226 - DNA, 14 bp, Homo sapiens
gacatggaaatgaa

SEQ ID NO: 746227 - DNA, 17 bp, Homo sapiens
gacatggagactcctgc

SEQ ID NO: 746228 - DNA, 17 bp, Homo sapiens
gacatggggaaggcaga

SEQ ID NO: 746229 - DNA, 18 bp, Homo sapiens
gacatggggaaggcagag

SEQ ID NO: 746230 - DNA, 22 bp, Homo sapiens
gacatggggaaggcagaggctg

SEQ ID NO: 746231 - DNA, 17 bp, Homo sapiens
gacatggggcaagccag

SEQ ID NO: 746232 - DNA, 20 bp, Homo sapiens
gacatggggcaagccagggc

SEQ ID NO: 746233 - DNA, 23 bp, Homo sapiens
gacatggggcaagccagggccca

SEQ ID NO: 746234 - DNA, 13 bp, Homo sapiens
gacatgggtgggg

SEQ ID NO: 746235 - DNA, 16 bp, Homo sapiens
gacatggtcacagtcc

SEQ ID NO: 746236 - DNA, 19 bp, Homo sapiens
gacatggtcacagtcctat

SEQ ID NO: 746237 - DNA, 23 bp, Homo sapiens
gacatggtgcctgagaggcaggc

SEQ ID NO: 746238 - DNA, 14 bp, Homo sapiens
gacatgtaagaaaa

SEQ ID NO: 746239 - DNA, 19 bp, Homo sapiens
gacatgtaccccctttccc

SEQ ID NO: 746240 - DNA, 16 bp, Homo sapiens
gacatgtctacttttt

SEQ ID NO: 746241 - DNA, 19 bp, Homo sapiens
gacatgtctactttttaat

SEQ ID NO: 746242 - DNA, 17 bp, Homo sapiens
gacatgtctgttctaca

SEQ ID NO: 746243 - DNA, 17 bp, Homo sapiens
gacatgtgaggaggaaa

SEQ ID NO: 746244 - DNA, 22 bp, Homo sapiens
gacatgtgcaattgtgagggac

SEQ ID NO: 746245 - DNA, 15 bp, Homo sapiens
gacatgttatatatt

SEQ ID NO: 746246 - DNA, 21 bp, Homo sapiens
gacatgtttgagaacccccta

SEQ ID NO: 746247 - DNA, 17 bp, Homo sapiens
gacatgttttccgtgaa

SEQ ID NO: 746248 - DNA, 17 bp, Homo sapiens
gacatgtttttatatgt

SEQ ID NO: 746249 - DNA, 21 bp, Homo sapiens
gacattaaatgcaataatttt

SEQ ID NO: 746250 - DNA, 19 bp, Homo sapiens
gacattaacaaataaaaaa

SEQ ID NO: 746251 - DNA, 18 bp, Homo sapiens
gacattaacagttttcca

SEQ ID NO: 746252 - DNA, 21 bp, Homo sapiens
gacattaactcattagactgg

SEQ ID NO: 746253 - DNA, 22 bp, Homo sapiens
gacattaactcattagactgga

SEQ ID NO: 746254 - DNA, 21 bp, Homo sapiens
gacattcacctgccccaactc

SEQ ID NO: 746255 - DNA, 22 bp, Homo sapiens
gacattcctaagagtggaggag

SEQ ID NO: 746256 - DNA, 17 bp, Homo sapiens
gacattccttgtcacca

SEQ ID NO: 746257 - DNA, 20 bp, Homo sapiens
gacattccttgtcaccagca

SEQ ID NO: 746258 - DNA, 23 bp, Homo sapiens
gacattcttagctgtaacttaac

SEQ ID NO: 746259 - DNA, 12 bp, Homo sapiens
gacattctttta

SEQ ID NO: 746260 - DNA, 21 bp, Homo sapiens
gacattgaaatctaggaaaat

SEQ ID NO: 746261 - DNA, 13 bp, Homo sapiens
gacattgcagagt

SEQ ID NO: 746262 - DNA, 18 bp, Homo sapiens
gacattgccaaaaaggat

SEQ ID NO: 746263 - DNA, 21 bp, Homo sapiens
gacattgcgtttgacctttta

SEQ ID NO: 746264 - DNA, 22 bp, Homo sapiens
gacattgctccaagatgttctc

SEQ ID NO: 746265 - DNA, 17 bp, Homo sapiens
gacattgctctcagtgc

SEQ ID NO: 746266 - DNA, 14 bp, Homo sapiens
gacattgctggtca

SEQ ID NO: 746267 - DNA, 19 bp, Homo sapiens
gacattgtagagcttctgg

SEQ ID NO: 746268 - DNA, 20 bp, Homo sapiens
gacattgtatgcagggagca

SEQ ID NO: 746269 - DNA, 12 bp, Homo sapiens
gacattgtcaat

SEQ ID NO: 746270 - DNA, 13 bp, Homo sapiens
gacattgtcaata

SEQ ID NO: 746271 - DNA, 14 bp, Homo sapiens
gacattgtcaataa

SEQ ID NO: 746272 - DNA, 13 bp, Homo sapiens
gacattgtctccc

SEQ ID NO: 746273 - DNA, 15 bp, Homo sapiens
gacatttagaacttt

SEQ ID NO: 746274 - DNA, 15 bp, Homo sapiens
gacatttagaagaaa

SEQ ID NO: 746275 - DNA, 18 bp, Homo sapiens
gacatttatactcttttt

SEQ ID NO: 746276 - DNA, 14 bp, Homo sapiens
gacatttatatttg

SEQ ID NO: 746277 - DNA, 18 bp, Homo sapiens
gacatttcaaaattaata

SEQ ID NO: 746278 - DNA, 13 bp, Homo sapiens
gacatttcatctg

SEQ ID NO: 746279 - DNA, 14 bp, Homo sapiens
gacatttcatctgg

SEQ ID NO: 746280 - DNA, 16 bp, Homo sapiens
gacatttcatctgggt

SEQ ID NO: 746281 - DNA, 11 bp, Homo sapiens
gacatttccca

SEQ ID NO: 746282 - DNA, 18 bp, Homo sapiens
gacatttctaacatatgt

SEQ ID NO: 746283 - DNA, 21 bp, Homo sapiens
gacatttctaacatatgtatt

SEQ ID NO: 746284 - DNA, 16 bp, Homo sapiens
gacatttctctaagag

SEQ ID NO: 746285 - DNA, 15 bp, Homo sapiens
gacatttgccttgct

SEQ ID NO: 746286 - DNA, 13 bp, Homo sapiens
gacatttgtatat

SEQ ID NO: 746287 - DNA, 11 bp, Homo sapiens
gacattttatt

SEQ ID NO: 746288 - DNA, 17 bp, Homo sapiens
gacattttcttttatta

SEQ ID NO: 746289 - DNA, 18 bp, Homo sapiens
gacattttcttttattat

SEQ ID NO: 746290 - DNA, 23 bp, Homo sapiens
gacattttcttttattatcagtt

SEQ ID NO: 746291 - DNA, 19 bp, Homo sapiens
gacatttttccggagaaga

SEQ ID NO: 746292 - DNA, 14 bp, Homo sapiens
gacatttttgtgcc

SEQ ID NO: 746293 - DNA, 23 bp, Homo sapiens
gaccaaaaaacctcactgggcct

SEQ ID NO: 746294 - DNA, 19 bp, Homo sapiens
gaccaaaagttacatgttt

SEQ ID NO: 746295 - DNA, 21 bp, Homo sapiens
gaccaaaatgacaatgatgat

SEQ ID NO: 746296 - DNA, 18 bp, Homo sapiens
gaccaaactacttcattt

SEQ ID NO: 746297 - DNA, 22 bp, Homo sapiens
gaccaaatgtgccatactaatg

SEQ ID NO: 746298 - DNA, 17 bp, Homo sapiens
gaccaacatggagaaac

SEQ ID NO: 746299 - DNA, 16 bp, Homo sapiens
gaccaaccctgggacc

SEQ ID NO: 746300 - DNA, 13 bp, Homo sapiens
gaccaacctgacc

SEQ ID NO: 746301 - DNA, 21 bp, Homo sapiens
gaccaacgttactcagggctc

SEQ ID NO: 746302 - DNA, 12 bp, Homo sapiens
gaccaactggct

SEQ ID NO: 746303 - DNA, 13 bp, Homo sapiens
gaccaactggctt

SEQ ID NO: 746304 - DNA, 14 bp, Homo sapiens
gaccaactgtcact

SEQ ID NO: 746305 - DNA, 13 bp, Homo sapiens
gaccaactgtgtt

SEQ ID NO: 746306 - DNA, 15 bp, Homo sapiens
gaccaagaactgcat

SEQ ID NO: 746307 - DNA, 21 bp, Homo sapiens
gaccaagactgagccagctta

SEQ ID NO: 746308 - DNA, 15 bp, Homo sapiens
gaccaagagagaaag

SEQ ID NO: 746309 - DNA, 16 bp, Homo sapiens
gaccaagagagaaaga

SEQ ID NO: 746310 - DNA, 15 bp, Homo sapiens
gaccaagcatcttgg

SEQ ID NO: 746311 - DNA, 18 bp, Homo sapiens
gaccaaggggtgggccac

SEQ ID NO: 746312 - DNA, 21 bp, Homo sapiens
gaccaagttataaatcaatgt

SEQ ID NO: 746313 - DNA, 18 bp, Homo sapiens
gaccaataaacagctccc

SEQ ID NO: 746314 - DNA, 19 bp, Homo sapiens
gaccaatattgtacagttt

SEQ ID NO: 746315 - DNA, 13 bp, Homo sapiens
gaccaattgtgct

SEQ ID NO: 746316 - DNA, 15 bp, Homo sapiens
gaccaattgtgctgc

SEQ ID NO: 746317 - DNA, 18 bp, Homo sapiens
gaccaatttatgggagaa

SEQ ID NO: 746318 - DNA, 20 bp, Homo sapiens
gaccacacattttatgagag

SEQ ID NO: 746319 - DNA, 16 bp, Homo sapiens
tacaagttctggcaag

SEQ ID NO: 746320 - DNA, 21 bp, Homo sapiens
tacaagttctggcaagagcag

SEQ ID NO: 746321 - DNA, 14 bp, Homo sapiens
tacaagttgagtat

SEQ ID NO: 746322 - DNA, 22 bp, Homo sapiens
tacaagttgttattgttgaaca

SEQ ID NO: 746323 - DNA, 17 bp, Homo sapiens
tacaagtttcagacagg

SEQ ID NO: 746324 - DNA, 15 bp, Homo sapiens
tacaagtttgctaaa

SEQ ID NO: 746325 - DNA, 23 bp, Homo sapiens
tacaagttttttaggattctttt

SEQ ID NO: 746326 - DNA, 13 bp, Homo sapiens
tacaataaaagag

SEQ ID NO: 746327 - DNA, 15 bp, Homo sapiens
tacaataaaagagct

SEQ ID NO: 746328 - DNA, 17 bp, Homo sapiens
tacaataaaagagcttt

SEQ ID NO: 746329 - DNA, 12 bp, Homo sapiens
tacaataaacta

SEQ ID NO: 746330 - DNA, 13 bp, Homo sapiens
tacaataaactat

SEQ ID NO: 746331 - DNA, 19 bp, Homo sapiens
tacaataaactattggaaa

SEQ ID NO: 746332 - DNA, 15 bp, Homo sapiens
tacaataaataatct

SEQ ID NO: 746333 - DNA, 16 bp, Homo sapiens
tacaataaataatctg

SEQ ID NO: 746334 - DNA, 14 bp, Homo sapiens
tacaataaatattc

SEQ ID NO: 746335 - DNA, 14 bp, Homo sapiens
tacaataaattgct

SEQ ID NO: 746336 - DNA, 13 bp, Homo sapiens
tacaataacataa

SEQ ID NO: 746337 - DNA, 23 bp, Homo sapiens
gacccacctgcgcttctgctgga

SEQ ID NO: 746338 - DNA, 18 bp, Homo sapiens
gacccacgtgctagggga

SEQ ID NO: 746339 - DNA, 20 bp, Homo sapiens
gacccactgaaatgaccaag

SEQ ID NO: 746340 - DNA, 16 bp, Homo sapiens
gacccactgatctcta

SEQ ID NO: 746341 - DNA, 21 bp, Homo sapiens
gacccagagccctctgagccg

SEQ ID NO: 746342 - DNA, 22 bp, Homo sapiens
gacccagaggccctgaagcctc

SEQ ID NO: 746343 - DNA, 16 bp, Homo sapiens
gacccagagtcccagg

SEQ ID NO: 746344 - DNA, 17 bp, Homo sapiens
gacccagagtcccaggc

SEQ ID NO: 746345 - DNA, 22 bp, Homo sapiens
gacccagagtggagtctgagtc

SEQ ID NO: 746346 - DNA, 17 bp, Homo sapiens
gacccagcatctcccag

SEQ ID NO: 746347 - DNA, 18 bp, Homo sapiens
gacccagcatctcccagc

SEQ ID NO: 746348 - DNA, 13 bp, Homo sapiens
gacccagccagct

SEQ ID NO: 746349 - DNA, 15 bp, Homo sapiens
gacccagccagctgc

SEQ ID NO: 746350 - DNA, 20 bp, Homo sapiens
gacccagcccgcggcctgga

SEQ ID NO: 746351 - DNA, 19 bp, Homo sapiens
gacccagctactctgtcca

SEQ ID NO: 746352 - DNA, 15 bp, Homo sapiens
gacccagctcctctg

SEQ ID NO: 746353 - DNA, 19 bp, Homo sapiens
gacccagctcctctgagcc

SEQ ID NO: 746354 - DNA, 22 bp, Homo sapiens
gacccaggacaggatccaggcc

SEQ ID NO: 746355 - DNA, 14 bp, Homo sapiens
gacccaggagagac

SEQ ID NO: 746356 - DNA, 13 bp, Homo sapiens
gacccaggccctc

SEQ ID NO: 746357 - DNA, 11 bp, Homo sapiens
gacccaggccg

SEQ ID NO: 746358 - DNA, 17 bp, Homo sapiens
gacccaggccgcagctc

SEQ ID NO: 746359 - DNA, 19 bp, Homo sapiens
gacccaggccgcagctctt

SEQ ID NO: 746360 - DNA, 12 bp, Homo sapiens
gacccagggcct

SEQ ID NO: 746361 - DNA, 13 bp, Homo sapiens
gacccagggggag

SEQ ID NO: 746362 - DNA, 22 bp, Homo sapiens
gacccagtcccacactgtggcc

SEQ ID NO: 746363 - DNA, 22 bp, Homo sapiens
gacccagtgagattacagagga

SEQ ID NO: 746364 - DNA, 23 bp, Homo sapiens
gacccagtgagattacagaggaa

SEQ ID NO: 746365 - DNA, 19 bp, Homo sapiens
gacccatacctttccaggg

SEQ ID NO: 746366 - DNA, 23 bp, Homo sapiens
gacccatagcagctttgtctctg

SEQ ID NO: 746367 - DNA, 19 bp, Homo sapiens
gacccatgtgctgggaaat

SEQ ID NO: 746368 - DNA, 20 bp, Homo sapiens
gacccattctacacagagca

SEQ ID NO: 746369 - DNA, 21 bp, Homo sapiens
gaccccaaagagcctggagaa

SEQ ID NO: 746370 - DNA, 21 bp, Homo sapiens
gaccccaatgcgacaagtagt

SEQ ID NO: 746371 - DNA, 22 bp, Homo sapiens
gaccccacatccttctcactgc

SEQ ID NO: 746372 - DNA, 19 bp, Homo sapiens
gaccccacccaagcttggc

SEQ ID NO: 746373 - DNA, 15 bp, Homo sapiens
gaccccactcccctc

SEQ ID NO: 746374 - DNA, 18 bp, Homo sapiens
gaccccagcggctgagtc

SEQ ID NO: 746375 - DNA, 12 bp, Homo sapiens
gaccccagctgg

SEQ ID NO: 746376 - DNA, 21 bp, Homo sapiens
gaccccagctgggaggcaaga

SEQ ID NO: 746377 - DNA, 12 bp, Homo sapiens
gaccccagggca

SEQ ID NO: 746378 - DNA, 14 bp, Homo sapiens
gaccccagggcctg

SEQ ID NO: 746379 - DNA, 22 bp, Homo sapiens
gaccccaggtcagccctgtgtc

SEQ ID NO: 746380 - DNA, 23 bp, Homo sapiens
gaccccaggtcagccctgtgtct

SEQ ID NO: 746381 - DNA, 18 bp, Homo sapiens
gaccccaggtcaggggct

SEQ ID NO: 746382 - DNA, 23 bp, Homo sapiens
gaccccagtcgtgatgtggagga

SEQ ID NO: 746383 - DNA, 17 bp, Homo sapiens
gaccccatcactcgcag

SEQ ID NO: 746384 - DNA, 16 bp, Homo sapiens
gaccccatctgtgaat

SEQ ID NO: 746385 - DNA, 12 bp, Homo sapiens
gacccccacccc

SEQ ID NO: 746386 - DNA, 19 bp, Homo sapiens
gacccccaccccttcccca

SEQ ID NO: 746387 - DNA, 23 bp, Homo sapiens
gacccccactctcattccccagg

SEQ ID NO: 746388 - DNA, 18 bp, Homo sapiens
gacccccatctgagctgg

SEQ ID NO: 746389 - DNA, 19 bp, Homo sapiens
gacccccatctgagctggg

SEQ ID NO: 746390 - DNA, 23 bp, Homo sapiens
gacccccccccaatcggactgcc

SEQ ID NO: 746391 - DNA, 18 bp, Homo sapiens
gacccccgccccctgccc

SEQ ID NO: 746392 - DNA, 13 bp, Homo sapiens
gacccccgtcagc

SEQ ID NO: 746393 - DNA, 14 bp, Homo sapiens
gaccccctcagcct

SEQ ID NO: 746394 - DNA, 13 bp, Homo sapiens
gaccccctcgcca

SEQ ID NO: 746395 - DNA, 17 bp, Homo sapiens
gaccccctcgccagctt

SEQ ID NO: 746396 - DNA, 18 bp, Homo sapiens
gaccccctcgccagcttg

SEQ ID NO: 746397 - DNA, 13 bp, Homo sapiens
gaccccctgagtc

SEQ ID NO: 746398 - DNA, 18 bp, Homo sapiens
gaccccgagggctgagga

SEQ ID NO: 746399 - DNA, 16 bp, Homo sapiens
gaccccgcactgcaga

SEQ ID NO: 746400 - DNA, 17 bp, Homo sapiens
gaccccgcactgcagac

SEQ ID NO: 746401 - DNA, 17 bp, Homo sapiens
gaccccgcccctgggga

SEQ ID NO: 746402 - DNA, 14 bp, Homo sapiens
gaccccgggccgga

SEQ ID NO: 746403 - DNA, 20 bp, Homo sapiens
gaccccgggccggacctgag

SEQ ID NO: 746404 - DNA, 14 bp, Homo sapiens
gaccccgtggctct

SEQ ID NO: 746405 - DNA, 17 bp, Homo sapiens
gacccctaatgtcagct

SEQ ID NO: 746406 - DNA, 18 bp, Homo sapiens
gacccctaccccctcatc

SEQ ID NO: 746407 - DNA, 20 bp, Homo sapiens
gacccctcaccacccccact

SEQ ID NO: 746408 - DNA, 21 bp, Homo sapiens
gacccctcaccacccccactg

SEQ ID NO: 746409 - DNA, 12 bp, Homo sapiens
gacccctcacct

SEQ ID NO: 746410 - DNA, 13 bp, Homo sapiens
gacccctcacctt

SEQ ID NO: 746411 - DNA, 15 bp, Homo sapiens
gacccctctggccag

SEQ ID NO: 746412 - DNA, 16 bp, Homo sapiens
gacccctctggccagg

SEQ ID NO: 746413 - DNA, 18 bp, Homo sapiens
gacccctctggccaggat

SEQ ID NO: 746414 - DNA, 23 bp, Homo sapiens
gacccctgcctcgagggccgcct

SEQ ID NO: 746415 - DNA, 13 bp, Homo sapiens
gacccctgcctgg

SEQ ID NO: 746416 - DNA, 23 bp, Homo sapiens
gacccctgccttcctctgaggac

SEQ ID NO: 746417 - DNA, 22 bp, Homo sapiens
gacccctgctcccagcctgctg

SEQ ID NO: 746418 - DNA, 20 bp, Homo sapiens
gacccctggaccaccagccc

SEQ ID NO: 746419 - DNA, 22 bp, Homo sapiens
gacccctggaccaccagcccca

SEQ ID NO: 746420 - DNA, 13 bp, Homo sapiens
gacccctggctct

SEQ ID NO: 746421 - DNA, 17 bp, Homo sapiens
gacccctggctctgggc

SEQ ID NO: 746422 - DNA, 20 bp, Homo sapiens
gacccctggggtggccaggg

SEQ ID NO: 746423 - DNA, 23 bp, Homo sapiens
gacccctggggtggccagggctt

SEQ ID NO: 746424 - DNA, 20 bp, Homo sapiens
gaccccttaatcttgctttc

SEQ ID NO: 746425 - DNA, 16 bp, Homo sapiens
gaccccttcctttcct

SEQ ID NO: 746426 - DNA, 12 bp, Homo sapiens
gaccccttctct

SEQ ID NO: 746427 - DNA, 20 bp, Homo sapiens
gaccccttgttgcactgccc

SEQ ID NO: 746428 - DNA, 16 bp, Homo sapiens
gacccgacctggccgc

SEQ ID NO: 746429 - DNA, 13 bp, Homo sapiens
gacccgaggccca

SEQ ID NO: 746430 - DNA, 14 bp, Homo sapiens
gacccgaggcccag

SEQ ID NO: 746431 - DNA, 15 bp, Homo sapiens
gacccgaggcccaga

SEQ ID NO: 746432 - DNA, 16 bp, Homo sapiens
gacccgccagccccgc

SEQ ID NO: 746433 - DNA, 19 bp, Homo sapiens
gacccgccagccccgctcc

SEQ ID NO: 746434 - DNA, 14 bp, Homo sapiens
gacccgctctggac

SEQ ID NO: 746435 - DNA, 16 bp, Homo sapiens
gacccgctctggacca

SEQ ID NO: 746436 - DNA, 17 bp, Homo sapiens
gacccggaggggcctgg

SEQ ID NO: 746437 - DNA, 18 bp, Homo sapiens
gacccggaggggcctggc

SEQ ID NO: 746438 - DNA, 20 bp, Homo sapiens
gacccggaggggcctggcag

SEQ ID NO: 746439 - DNA, 22 bp, Homo sapiens
gacccggctgggtcggccctgc

SEQ ID NO: 746440 - DNA, 16 bp, Homo sapiens
gacccggggtctcctg

SEQ ID NO: 746441 - DNA, 23 bp, Homo sapiens
gacctcagctgcacattcctggc

SEQ ID NO: 746442 - DNA, 16 bp, Homo sapiens
gacctcaggagggcag

SEQ ID NO: 746443 - DNA, 18 bp, Homo sapiens
gacctcaggagggcaggc

SEQ ID NO: 746444 - DNA, 12 bp, Homo sapiens
gacctcaggggc

SEQ ID NO: 746445 - DNA, 13 bp, Homo sapiens
gacctcaggggca

SEQ ID NO: 746446 - DNA, 14 bp, Homo sapiens
gacctcaggggcac

SEQ ID NO: 746447 - DNA, 15 bp, Homo sapiens
gacctcaggggcacc

SEQ ID NO: 746448 - DNA, 13 bp, Homo sapiens
gacctcaggtgat

SEQ ID NO: 746449 - DNA, 20 bp, Homo sapiens
gacctcagttttatcatttt

SEQ ID NO: 746450 - DNA, 21 bp, Homo sapiens
gacctcatcctgctcttttgt

SEQ ID NO: 746451 - DNA, 17 bp, Homo sapiens
gacctcatctgtggagc

SEQ ID NO: 746452 - DNA, 19 bp, Homo sapiens
gacctcatctgtggagctg

SEQ ID NO: 746453 - DNA, 20 bp, Homo sapiens
gacctcatgccatggtcttt

SEQ ID NO: 746454 - DNA, 19 bp, Homo sapiens
gacctcatgcccagctctc

SEQ ID NO: 746455 - DNA, 22 bp, Homo sapiens
gacctcatgcccagctctctga

SEQ ID NO: 746456 - DNA, 22 bp, Homo sapiens
gacctccaataaagtgccttct

SEQ ID NO: 746457 - DNA, 14 bp, Homo sapiens
gacctccaggggct

SEQ ID NO: 746458 - DNA, 21 bp, Homo sapiens
gacctccaggggctcctgggt

SEQ ID NO: 746459 - DNA, 16 bp, Homo sapiens
gacctccatccctgct

SEQ ID NO: 746460 - DNA, 19 bp, Homo sapiens
gacctccatccctgctctg

SEQ ID NO: 746461 - DNA, 14 bp, Homo sapiens
gacctcccagccct

SEQ ID NO: 746462 - DNA, 14 bp, Homo sapiens
gacctcccaggaca

SEQ ID NO: 746463 - DNA, 15 bp, Homo sapiens
gacctcccaggacaa

SEQ ID NO: 746464 - DNA, 16 bp, Homo sapiens
gacctcccctccccag

SEQ ID NO: 746465 - DNA, 22 bp, Homo sapiens
tacactggtatttatatttcaa

SEQ ID NO: 746466 - DNA, 20 bp, Homo sapiens
tacactggtgtgtccctctg

SEQ ID NO: 746467 - DNA, 21 bp, Homo sapiens
tacactgtagtttttgaaaat

SEQ ID NO: 746468 - DNA, 20 bp, Homo sapiens
tacactgtatgttatagaac

SEQ ID NO: 746469 - DNA, 17 bp, Homo sapiens
tacactgtgtaaatacc

SEQ ID NO: 746470 - DNA, 19 bp, Homo sapiens
tacactgtttcaaacttta

SEQ ID NO: 746471 - DNA, 16 bp, Homo sapiens
tacacttacactttat

SEQ ID NO: 746472 - DNA, 18 bp, Homo sapiens
tacacttctggctcacag

SEQ ID NO: 746473 - DNA, 20 bp, Homo sapiens
tacacttctggctcacagga

SEQ ID NO: 746474 - DNA, 15 bp, Homo sapiens
tacacttcttttgaa

SEQ ID NO: 746475 - DNA, 13 bp, Homo sapiens
tacactttatgca

SEQ ID NO: 746476 - DNA, 13 bp, Homo sapiens
tacactttgttgc

SEQ ID NO: 746477 - DNA, 18 bp, Homo sapiens
tacactttgttgcaagat

SEQ ID NO: 746478 - DNA, 22 bp, Homo sapiens
tacactttgttgcaagatgtga

SEQ ID NO: 746479 - DNA, 23 bp, Homo sapiens
tacagaaaaaccccgtttccctg

SEQ ID NO: 746480 - DNA, 14 bp, Homo sapiens
tacagaaaaatctt

SEQ ID NO: 746481 - DNA, 15 bp, Homo sapiens
tacagaaaaatcttg

SEQ ID NO: 746482 - DNA, 21 bp, Homo sapiens
tacagaaaccaggtaagccct

SEQ ID NO: 746483 - DNA, 19 bp, Homo sapiens
tacagaaagaagcagttct

SEQ ID NO: 746484 - DNA, 18 bp, Homo sapiens
tacagaaataacagctgg

SEQ ID NO: 746485 - DNA, 13 bp, Homo sapiens
tacagaaatgact

SEQ ID NO: 746486 - DNA, 13 bp, Homo sapiens
tacagaaatgttt

SEQ ID NO: 746487 - DNA, 19 bp, Homo sapiens
tacagaaatgtttttaaca

SEQ ID NO: 746488 - DNA, 17 bp, Homo sapiens
tacagaaattctgcaag

SEQ ID NO: 746489 - DNA, 22 bp, Homo sapiens
tacagaacagagggccagagct

SEQ ID NO: 746490 - DNA, 12 bp, Homo sapiens
tacagaacctga

SEQ ID NO: 746491 - DNA, 14 bp, Homo sapiens
tacagaacctgagg

SEQ ID NO: 746492 - DNA, 23 bp, Homo sapiens
tacagaacctgagggcaaagatg

SEQ ID NO: 746493 - DNA, 21 bp, Homo sapiens
tacagaagagtaaactggtga

SEQ ID NO: 746494 - DNA, 22 bp, Homo sapiens
tacagaatagggtggcagaagt

SEQ ID NO: 746495 - DNA, 11 bp, Homo sapiens
tacagaatcat

SEQ ID NO: 746496 - DNA, 16 bp, Homo sapiens
tacagaatcattgctt

SEQ ID NO: 746497 - DNA, 18 bp, Homo sapiens
tacagaatgcattaaaaa

SEQ ID NO: 746498 - DNA, 15 bp, Homo sapiens
tacagaattagaaaa

SEQ ID NO: 746499 - DNA, 18 bp, Homo sapiens
tacagaattctgctacct

SEQ ID NO: 746500 - DNA, 20 bp, Homo sapiens
tacagaattgactgcagttg

SEQ ID NO: 746501 - DNA, 15 bp, Homo sapiens
tacagacagacatac

SEQ ID NO: 746502 - DNA, 13 bp, Homo sapiens
tacagacatattt

SEQ ID NO: 746503 - DNA, 13 bp, Homo sapiens
tacagacatgagc

SEQ ID NO: 746504 - DNA, 20 bp, Homo sapiens
tacagaccgaactgttgtat

SEQ ID NO: 746505 - DNA, 23 bp, Homo sapiens
tacagaccgaactgttgtataaa

SEQ ID NO: 746506 - DNA, 21 bp, Homo sapiens
tacagactgcagacattctca

SEQ ID NO: 746507 - DNA, 19 bp, Homo sapiens
tacagactggatgtaccac

SEQ ID NO: 746508 - DNA, 16 bp, Homo sapiens
tacagactgttttact

SEQ ID NO: 746509 - DNA, 18 bp, Homo sapiens
tacagagaaaatgaattt

SEQ ID NO: 746510 - DNA, 19 bp, Homo sapiens
tacagagaaaatgaatttg

SEQ ID NO: 746511 - DNA, 15 bp, Homo sapiens
tacagagaagtgaat

SEQ ID NO: 746512 - DNA, 23 bp, Homo sapiens
tacagagaagtgaataactgcaa

SEQ ID NO: 746513 - DNA, 21 bp, Homo sapiens
tacagagaatttctaaagtaa

SEQ ID NO: 746514 - DNA, 13 bp, Homo sapiens
tacagagactcta

SEQ ID NO: 746515 - DNA, 23 bp, Homo sapiens
tacagagactctattttaatgta

SEQ ID NO: 746516 - DNA, 17 bp, Homo sapiens
tacagagaggatacatt

SEQ ID NO: 746517 - DNA, 12 bp, Homo sapiens
tacagagcacat

SEQ ID NO: 746518 - DNA, 12 bp, Homo sapiens
tacagaggagaa

SEQ ID NO: 746519 - DNA, 14 bp, Homo sapiens
tacagaggaggcct

SEQ ID NO: 746520 - DNA, 17 bp, Homo sapiens
tacagaggaggcctcaa

SEQ ID NO: 746521 - DNA, 20 bp, Homo sapiens
tacagaggatgccttttctg

SEQ ID NO: 746522 - DNA, 22 bp, Homo sapiens
tacagaggatgccttttctgtg

SEQ ID NO: 746523 - DNA, 13 bp, Homo sapiens
tacagaggggaca

SEQ ID NO: 746524 - DNA, 11 bp, Homo sapiens
tacagaggtga

SEQ ID NO: 746525 - DNA, 16 bp, Homo sapiens
tacagagtggcccctc

SEQ ID NO: 746526 - DNA, 16 bp, Homo sapiens
tacagataattcattt

SEQ ID NO: 746527 - DNA, 17 bp, Homo sapiens
tacagataattcatttg

SEQ ID NO: 746528 - DNA, 13 bp, Homo sapiens
tacagatcaagaa

SEQ ID NO: 746529 - DNA, 20 bp, Homo sapiens
tacagatccccaagcctggc

SEQ ID NO: 746530 - DNA, 22 bp, Homo sapiens
tacagatgaatgtatttatttg

SEQ ID NO: 746531 - DNA, 20 bp, Homo sapiens
tacagatggagcaaatgtcc

SEQ ID NO: 746532 - DNA, 22 bp, Homo sapiens
tacagcaacaatttatgaattg

SEQ ID NO: 746533 - DNA, 15 bp, Homo sapiens
tacagcacagaatga

SEQ ID NO: 746534 - DNA, 18 bp, Homo sapiens
tacagcacagaatgagta

SEQ ID NO: 746535 - DNA, 17 bp, Homo sapiens
tacagcacatcacctct

SEQ ID NO: 746536 - DNA, 21 bp, Homo sapiens
tacagcacatcacctctttgc

SEQ ID NO: 746537 - DNA, 16 bp, Homo sapiens
tacagcaccctgtggt

SEQ ID NO: 746538 - DNA, 14 bp, Homo sapiens
tacagcactactct

SEQ ID NO: 746539 - DNA, 18 bp, Homo sapiens
tacagcactactgggtgt

SEQ ID NO: 746540 - DNA, 23 bp, Homo sapiens
tacagcactactgggtgtcattt

SEQ ID NO: 746541 - DNA, 11 bp, Homo sapiens
tacagcagggt

SEQ ID NO: 746542 - DNA, 18 bp, Homo sapiens
tacagcagggtcttgctg

SEQ ID NO: 746543 - DNA, 19 bp, Homo sapiens
tacagcattgactcagata

SEQ ID NO: 746544 - DNA, 19 bp, Homo sapiens
tacagcattgtctttgctg

SEQ ID NO: 746545 - DNA, 19 bp, Homo sapiens
tacagcccctttttcatat

SEQ ID NO: 746546 - DNA, 18 bp, Homo sapiens
tacagcctatagtaaatg

SEQ ID NO: 746547 - DNA, 21 bp, Homo sapiens
tacagcctatagtaaatgtgt

SEQ ID NO: 746548 - DNA, 14 bp, Homo sapiens
tacagcgagaggca

SEQ ID NO: 746549 - DNA, 20 bp, Homo sapiens
tacagcggctcccctctgct

SEQ ID NO: 746550 - DNA, 17 bp, Homo sapiens
tacagcgggctgtgccc

SEQ ID NO: 746551 - DNA, 18 bp, Homo sapiens
tacagctcattaaacttt

SEQ ID NO: 746552 - DNA, 22 bp, Homo sapiens
tacagctcccttccctgcaggg

SEQ ID NO: 746553 - DNA, 13 bp, Homo sapiens
tacagctgcctgc

SEQ ID NO: 746554 - DNA, 18 bp, Homo sapiens
tacagctttcatgattag

SEQ ID NO: 746555 - DNA, 19 bp, Homo sapiens
tacagctttgatccctgac

SEQ ID NO: 746556 - DNA, 21 bp, Homo sapiens
tacaggaaaaaaaattctgtt

SEQ ID NO: 746557 - DNA, 21 bp, Homo sapiens
tacaggaagcaccccatgcca

SEQ ID NO: 746558 - DNA, 17 bp, Homo sapiens
tacaggaaggcaggagg

SEQ ID NO: 746559 - DNA, 15 bp, Homo sapiens
tacaggaaggcttgc

SEQ ID NO: 746560 - DNA, 17 bp, Homo sapiens
tacaggaaggtgcctgg

SEQ ID NO: 746561 - DNA, 18 bp, Homo sapiens
tacaggaaggtgcctggc

SEQ ID NO: 746562 - DNA, 19 bp, Homo sapiens
tacaggaaggtgcctggcc

SEQ ID NO: 746563 - DNA, 13 bp, Homo sapiens
taccaatgcatgc

SEQ ID NO: 746564 - DNA, 13 bp, Homo sapiens
taccaatgctgca

SEQ ID NO: 746565 - DNA, 17 bp, Homo sapiens
taccaatgggaagcagg

SEQ ID NO: 746566 - DNA, 19 bp, Homo sapiens
taccacaaaccctgctgaa

SEQ ID NO: 746567 - DNA, 20 bp, Homo sapiens
taccacaaaccctgctgaac

SEQ ID NO: 746568 - DNA, 13 bp, Homo sapiens
taccacaaggaaa

SEQ ID NO: 746569 - DNA, 13 bp, Homo sapiens
taccacacaaact

SEQ ID NO: 746570 - DNA, 14 bp, Homo sapiens
taccacactgagtt

SEQ ID NO: 746571 - DNA, 23 bp, Homo sapiens
taccacagacacaatatgtatgc

SEQ ID NO: 746572 - DNA, 16 bp, Homo sapiens
taccacagcaactgac

SEQ ID NO: 746573 - DNA, 13 bp, Homo sapiens
taccacagtgtct

SEQ ID NO: 746574 - DNA, 15 bp, Homo sapiens
taccacatggctttt

SEQ ID NO: 746575 - DNA, 20 bp, Homo sapiens
taccaccatgcactgtaaat

SEQ ID NO: 746576 - DNA, 21 bp, Homo sapiens
taccaccatgcactgtaaata

SEQ ID NO: 746577 - DNA, 17 bp, Homo sapiens
taccaccccttcctgtc

SEQ ID NO: 746578 - DNA, 18 bp, Homo sapiens
taccaccccttcctgtcc

SEQ ID NO: 746579 - DNA, 23 bp, Homo sapiens
taccacgaggaaaagaacaaaca

SEQ ID NO: 746580 - DNA, 16 bp, Homo sapiens
taccacgccttgacct

SEQ ID NO: 746581 - DNA, 15 bp, Homo sapiens
taccactatttaagt

SEQ ID NO: 746582 - DNA, 14 bp, Homo sapiens
taccactcaggcca

SEQ ID NO: 746583 - DNA, 17 bp, Homo sapiens
taccactctgtaattgc

SEQ ID NO: 746584 - DNA, 17 bp, Homo sapiens
taccactgctgatattt

SEQ ID NO: 746585 - DNA, 21 bp, Homo sapiens
taccactgctgatattttctc

SEQ ID NO: 746586 - DNA, 20 bp, Homo sapiens
taccactgtggccccaagag

SEQ ID NO: 746587 - DNA, 15 bp, Homo sapiens
taccacttttgcaaa

SEQ ID NO: 746588 - DNA, 17 bp, Homo sapiens
taccacttttgttcttg

SEQ ID NO: 746589 - DNA, 22 bp, Homo sapiens
taccagaagggcttcaaagata

SEQ ID NO: 746590 - DNA, 16 bp, Homo sapiens
taccagatgaacattt

SEQ ID NO: 746591 - DNA, 17 bp, Homo sapiens
taccagcaaacagctga

SEQ ID NO: 746592 - DNA, 20 bp, Homo sapiens
taccagcaaacagctgaaag

SEQ ID NO: 746593 - DNA, 18 bp, Homo sapiens
taccagccagtaaatggg

SEQ ID NO: 746594 - DNA, 15 bp, Homo sapiens
taccagcgaggaggc

SEQ ID NO: 746595 - DNA, 20 bp, Homo sapiens
taccagcgaggaggctccag

SEQ ID NO: 746596 - DNA, 21 bp, Homo sapiens
taccagcgccaaatgttcatc

SEQ ID NO: 746597 - DNA, 18 bp, Homo sapiens
taccagcgcccgctgggc

SEQ ID NO: 746598 - DNA, 13 bp, Homo sapiens
taccagctcaggg

SEQ ID NO: 746599 - DNA, 12 bp, Homo sapiens
gactagcaggca

SEQ ID NO: 746600 - DNA, 12 bp, Homo sapiens
gactagctgcct

SEQ ID NO: 746601 - DNA, 13 bp, Homo sapiens
gactagctgcctt

SEQ ID NO: 746602 - DNA, 14 bp, Homo sapiens
gactaggagcactg

SEQ ID NO: 746603 - DNA, 23 bp, Homo sapiens
gactaggcatgtcagaggacccc

SEQ ID NO: 746604 - DNA, 21 bp, Homo sapiens
gactagtgagtcagcaccttg

SEQ ID NO: 746605 - DNA, 19 bp, Homo sapiens
gactataaagcagtagaca

SEQ ID NO: 746606 - DNA, 17 bp, Homo sapiens
gactatagctgttctaa

SEQ ID NO: 746607 - DNA, 22 bp, Homo sapiens
gactatcaaactgaagccagaa

SEQ ID NO: 746608 - DNA, 16 bp, Homo sapiens
gactatctacaaaaat

SEQ ID NO: 746609 - DNA, 19 bp, Homo sapiens
gactatgaaaatgctggct

SEQ ID NO: 746610 - DNA, 20 bp, Homo sapiens
gactatgaacttctctcaga

SEQ ID NO: 746611 - DNA, 18 bp, Homo sapiens
gactatgcagaggcctgg

SEQ ID NO: 746612 - DNA, 20 bp, Homo sapiens
gactatgcgtggctggaacc

SEQ ID NO: 746613 - DNA, 22 bp, Homo sapiens
gactatttgcttatttaataaa

SEQ ID NO: 746614 - DNA, 18 bp, Homo sapiens
gactcaaaaaaacaaaaa

SEQ ID NO: 746615 - DNA, 18 bp, Homo sapiens
gactcaaaacctggagat

SEQ ID NO: 746616 - DNA, 22 bp, Homo sapiens
gactcaacatgttactgaccag

SEQ ID NO: 746617 - DNA, 19 bp, Homo sapiens
gactcaagaagtgaagaat

SEQ ID NO: 746618 - DNA, 23 bp, Homo sapiens
gactcaagacttatggaacaggg

SEQ ID NO: 746619 - DNA, 21 bp, Homo sapiens
gactcaaggtggacgtgcgtt

SEQ ID NO: 746620 - DNA, 19 bp, Homo sapiens
gactcaagtacccattctg

SEQ ID NO: 746621 - DNA, 22 bp, Homo sapiens
gactcaagtacccattctgttt

SEQ ID NO: 746622 - DNA, 20 bp, Homo sapiens
gactcaattcaacaatgtgg

SEQ ID NO: 746623 - DNA, 18 bp, Homo sapiens
gactcaattgatcctccc

SEQ ID NO: 746624 - DNA, 18 bp, Homo sapiens
gactcacaacctgaacct

SEQ ID NO: 746625 - DNA, 21 bp, Homo sapiens
gactcacaagaagaccagact

SEQ ID NO: 746626 - DNA, 20 bp, Homo sapiens
gactcaccaacttgccacat

SEQ ID NO: 746627 - DNA, 12 bp, Homo sapiens
gactcacccaag

SEQ ID NO: 746628 - DNA, 18 bp, Homo sapiens
gactcaccctccacaaag

SEQ ID NO: 746629 - DNA, 14 bp, Homo sapiens
gactcacctctgcc

SEQ ID NO: 746630 - DNA, 16 bp, Homo sapiens
gactcacctgaaagtt

SEQ ID NO: 746631 - DNA, 23 bp, Homo sapiens
gactcacttatcccaagagaatg

SEQ ID NO: 746632 - DNA, 19 bp, Homo sapiens
gactcacttcaatgtgtca

SEQ ID NO: 746633 - DNA, 18 bp, Homo sapiens
gactcacttctcagctga

SEQ ID NO: 746634 - DNA, 11 bp, Homo sapiens
gactcagcacc

SEQ ID NO: 746635 - DNA, 13 bp, Homo sapiens
gactcagcagtga

SEQ ID NO: 746636 - DNA, 14 bp, Homo sapiens
gactcagcagtgac

SEQ ID NO: 746637 - DNA, 13 bp, Homo sapiens
gactcagccctga

SEQ ID NO: 746638 - DNA, 15 bp, Homo sapiens
gactcagccttcaga

SEQ ID NO: 746639 - DNA, 19 bp, Homo sapiens
gactcagccttcagacaga

SEQ ID NO: 746640 - DNA, 15 bp, Homo sapiens
gactcagctccagaa

SEQ ID NO: 746641 - DNA, 14 bp, Homo sapiens
gactcaggaacttt

SEQ ID NO: 746642 - DNA, 19 bp, Homo sapiens
gactcaggagtctgccact

SEQ ID NO: 746643 - DNA, 17 bp, Homo sapiens
gactcaggatccagtcc

SEQ ID NO: 746644 - DNA, 22 bp, Homo sapiens
gactcaggatttaaaaactgga

SEQ ID NO: 746645 - DNA, 24 bp, Homo sapiens
gactcagggaccggtgctgcagga

SEQ ID NO: 746646 - DNA, 13 bp, Homo sapiens
gactcagggcagc

SEQ ID NO: 746647 - DNA, 16 bp, Homo sapiens
gactcagggcagcgcc

SEQ ID NO: 746648 - DNA, 22 bp, Homo sapiens
gactcagggccatgcctgcccc

SEQ ID NO: 746649 - DNA, 15 bp, Homo sapiens
gactcagggccccag

SEQ ID NO: 746650 - DNA, 14 bp, Homo sapiens
gactcagggctcct

SEQ ID NO: 746651 - DNA, 20 bp, Homo sapiens
gactcaggtctgtaactgcc

SEQ ID NO: 746652 - DNA, 22 bp, Homo sapiens
gactcagtgtctgcctttaaat

SEQ ID NO: 746653 - DNA, 19 bp, Homo sapiens
gactcagttccaggcctga

SEQ ID NO: 746654 - DNA, 15 bp, Homo sapiens
gactcagtttgtcag

SEQ ID NO: 746655 - DNA, 17 bp, Homo sapiens
gactcatccccacagct

SEQ ID NO: 746656 - DNA, 15 bp, Homo sapiens
gactcatggcagctg

SEQ ID NO: 746657 - DNA, 23 bp, Homo sapiens
gactcatggcagctgtttctcat

SEQ ID NO: 746658 - DNA, 13 bp, Homo sapiens
gactcattctgaa

SEQ ID NO: 746659 - DNA, 13 bp, Homo sapiens
gactccaaccaag

SEQ ID NO: 746660 - DNA, 18 bp, Homo sapiens
gactccaaggagctactg

SEQ ID NO: 746661 - DNA, 17 bp, Homo sapiens
gactccagaatctgctg

SEQ ID NO: 746662 - DNA, 22 bp, Homo sapiens
gactccagaatctgctgttgcc

SEQ ID NO: 746663 - DNA, 23 bp, Homo sapiens
gactccagaatctgctgttgcca

SEQ ID NO: 746664 - DNA, 12 bp, Homo sapiens
gactccagagtc

SEQ ID NO: 746665 - DNA, 15 bp, Homo sapiens
gactccagagtctga

SEQ ID NO: 746666 - DNA, 17 bp, Homo sapiens
gactccagagtctgagc

SEQ ID NO: 746667 - DNA, 18 bp, Homo sapiens
gactccagagtctgagcc

SEQ ID NO: 746668 - DNA, 20 bp, Homo sapiens
gactccagagtctgagcccc

SEQ ID NO: 746669 - DNA, 9 bp, Homo sapiens
gactccagc

SEQ ID NO: 746670 - DNA, 12 bp, Homo sapiens
gactccagccag

SEQ ID NO: 746671 - DNA, 21 bp, Homo sapiens
gactccagccagcgcctccct

SEQ ID NO: 746672 - DNA, 15 bp, Homo sapiens
gactccagcccctgg

SEQ ID NO: 746673 - DNA, 16 bp, Homo sapiens
gactccagcccctgga

SEQ ID NO: 746674 - DNA, 19 bp, Homo sapiens
gactccagcccctggaccc

SEQ ID NO: 746675 - DNA, 14 bp, Homo sapiens
gactccaggcccaa

SEQ ID NO: 746676 - DNA, 18 bp, Homo sapiens
gactccaggcccaaggct

SEQ ID NO: 746677 - DNA, 19 bp, Homo sapiens
gactccaggcccaaggctc

SEQ ID NO: 746678 - DNA, 12 bp, Homo sapiens
gactccaggctt

SEQ ID NO: 746679 - DNA, 17 bp, Homo sapiens
gactccatctctcatcc

SEQ ID NO: 746680 - DNA, 23 bp, Homo sapiens
gactccatgagaagccgtgggtg

SEQ ID NO: 746681 - DNA, 22 bp, Homo sapiens
gactcccaagtttccatagcaa

SEQ ID NO: 746682 - DNA, 16 bp, Homo sapiens
gactcccagtgaactt

SEQ ID NO: 746683 - DNA, 18 bp, Homo sapiens
gactccccaggccaggcc

SEQ ID NO: 746684 - DNA, 15 bp, Homo sapiens
gactcccccaaccaa

SEQ ID NO: 746685 - DNA, 12 bp, Homo sapiens
gactgaggacaa

SEQ ID NO: 746686 - DNA, 13 bp, Homo sapiens
gactgaggagtgg

SEQ ID NO: 746687 - DNA, 12 bp, Homo sapiens
gactgagggcag

SEQ ID NO: 746688 - DNA, 17 bp, Homo sapiens
gactgagggcagtgccc

SEQ ID NO: 746689 - DNA, 20 bp, Homo sapiens
gactgaggtataaagacaag

SEQ ID NO: 746690 - DNA, 18 bp, Homo sapiens
gactgagtacgttgtgca

SEQ ID NO: 746691 - DNA, 23 bp, Homo sapiens
gactgagtacgttgtgcatttgg

SEQ ID NO: 746692 - DNA, 16 bp, Homo sapiens
gactgagtgggaagcc

SEQ ID NO: 746693 - DNA, 19 bp, Homo sapiens
gactgagtgtgggagtgca

SEQ ID NO: 746694 - DNA, 21 bp, Homo sapiens
gactgatagcttacactgagg

SEQ ID NO: 746695 - DNA, 16 bp, Homo sapiens
gactgatccctggcca

SEQ ID NO: 746696 - DNA, 22 bp, Homo sapiens
gactgcaaacttttttatatct

SEQ ID NO: 746697 - DNA, 18 bp, Homo sapiens
gactgcacagcggcccct

SEQ ID NO: 746698 - DNA, 16 bp, Homo sapiens
gactgcacaggtgaca

SEQ ID NO: 746699 - DNA, 16 bp, Homo sapiens
gactgcaccagcgccc

SEQ ID NO: 746700 - DNA, 19 bp, Homo sapiens
gactgcaccagcgccccca

SEQ ID NO: 746701 - DNA, 23 bp, Homo sapiens
gactgcagacattctcaaagcct

SEQ ID NO: 746702 - DNA, 15 bp, Homo sapiens
gactgcagctgctga

SEQ ID NO: 746703 - DNA, 13 bp, Homo sapiens
gactgcaggtggg

SEQ ID NO: 746704 - DNA, 20 bp, Homo sapiens
gactgcaggtgggctgggcc

SEQ ID NO: 746705 - DNA, 16 bp, Homo sapiens
gactgcagtgtggagt

SEQ ID NO: 746706 - DNA, 18 bp, Homo sapiens
gactgcatggggaggcag

SEQ ID NO: 746707 - DNA, 21 bp, Homo sapiens
gactgcatgtaccatttgcat

SEQ ID NO: 746708 - DNA, 22 bp, Homo sapiens
gactgcatttaaatttgatttc

SEQ ID NO: 746709 - DNA, 20 bp, Homo sapiens
gactgcattttactgtacag

SEQ ID NO: 746710 - DNA, 13 bp, Homo sapiens
gactgccaggtgg

SEQ ID NO: 746711 - DNA, 14 bp, Homo sapiens
gactgcccagccac

SEQ ID NO: 746712 - DNA, 20 bp, Homo sapiens
gactgcccagccactccaag

SEQ ID NO: 746713 - DNA, 14 bp, Homo sapiens
gactgccccagcca

SEQ ID NO: 746714 - DNA, 15 bp, Homo sapiens
gactgccccagccaa

SEQ ID NO: 746715 - DNA, 16 bp, Homo sapiens
gactgcccggcacaga

SEQ ID NO: 746716 - DNA, 13 bp, Homo sapiens
gactgcccggcag

SEQ ID NO: 746717 - DNA, 20 bp, Homo sapiens
gactgccgaccgaggctgga

SEQ ID NO: 746718 - DNA, 23 bp, Homo sapiens
gactgccgaccgaggctggagct

SEQ ID NO: 746719 - DNA, 11 bp, Homo sapiens
gactgcctccc

SEQ ID NO: 746720 - DNA, 13 bp, Homo sapiens
gactgcctccctc

SEQ ID NO: 746721 - DNA, 22 bp, Homo sapiens
gactgcgggatggtcctggggc

SEQ ID NO: 746722 - DNA, 12 bp, Homo sapiens
gactgctaaata

SEQ ID NO: 746723 - DNA, 14 bp, Homo sapiens
gactgctaaataaa

SEQ ID NO: 746724 - DNA, 15 bp, Homo sapiens
gactgctcagaactt

SEQ ID NO: 746725 - DNA, 20 bp, Homo sapiens
gactgctcagaacttgctgc

SEQ ID NO: 746726 - DNA, 20 bp, Homo sapiens
gactgctccccagccctggc

SEQ ID NO: 746727 - DNA, 23 bp, Homo sapiens
gactgctcccggcccgcctgccc

SEQ ID NO: 746728 - DNA, 14 bp, Homo sapiens
gactgctgctcccc

SEQ ID NO: 746729 - DNA, 18 bp, Homo sapiens
taccctggccgccccctg

SEQ ID NO: 746730 - DNA, 13 bp, Homo sapiens
taccctgtccttt

SEQ ID NO: 746731 - DNA, 16 bp, Homo sapiens
taccctgtctgtccct

SEQ ID NO: 746732 - DNA, 14 bp, Homo sapiens
tacccttaagctag

SEQ ID NO: 746733 - DNA, 20 bp, Homo sapiens
tacccttcacctttggtgca

SEQ ID NO: 746734 - DNA, 14 bp, Homo sapiens
tacccttccacctc

SEQ ID NO: 746735 - DNA, 16 bp, Homo sapiens
tacccttccctgcact

SEQ ID NO: 746736 - DNA, 16 bp, Homo sapiens
taccctttggggagca

SEQ ID NO: 746737 - DNA, 19 bp, Homo sapiens
taccctttttctccagctg

SEQ ID NO: 746738 - DNA, 14 bp, Homo sapiens
taccgaatgtgtct

SEQ ID NO: 746739 - DNA, 16 bp, Homo sapiens
taccgaatgtgtcttt

SEQ ID NO: 746740 - DNA, 23 bp, Homo sapiens
taccgaccatcgtccagccctcc

SEQ ID NO: 746741 - DNA, 15 bp, Homo sapiens
taccgagacatgaat

SEQ ID NO: 746742 - DNA, 17 bp, Homo sapiens
taccgagacatgaatac

SEQ ID NO: 746743 - DNA, 13 bp, Homo sapiens
taccgatggtccc

SEQ ID NO: 746744 - DNA, 12 bp, Homo sapiens
taccgcaggccc

SEQ ID NO: 746745 - DNA, 13 bp, Homo sapiens
taccgcaggcccg

SEQ ID NO: 746746 - DNA, 19 bp, Homo sapiens
taccgccacgggtttccct

SEQ ID NO: 746747 - DNA, 20 bp, Homo sapiens
taccgctcccctctcctccg

SEQ ID NO: 746748 - DNA, 18 bp, Homo sapiens
taccggattctctcttta

SEQ ID NO: 746749 - DNA, 12 bp, Homo sapiens
taccgtatttca

SEQ ID NO: 746750 - DNA, 14 bp, Homo sapiens
taccgtttcttccc

SEQ ID NO: 746751 - DNA, 19 bp, Homo sapiens
tacctaaaaggaaatctca

SEQ ID NO: 746752 - DNA, 19 bp, Homo sapiens
tacctaaacagatataaat

SEQ ID NO: 746753 - DNA, 19 bp, Homo sapiens
tacctaagtgttgattgtg

SEQ ID NO: 746754 - DNA, 15 bp, Homo sapiens
tacctaattgtggat

SEQ ID NO: 746755 - DNA, 15 bp, Homo sapiens
tacctacatacaatt

SEQ ID NO: 746756 - DNA, 18 bp, Homo sapiens
tacctaccacagtgtctg

SEQ ID NO: 746757 - DNA, 15 bp, Homo sapiens
tacctactgagtagg

SEQ ID NO: 746758 - DNA, 13 bp, Homo sapiens
tacctactttgac

SEQ ID NO: 746759 - DNA, 22 bp, Homo sapiens
tacctagtgaaacttttctaga

SEQ ID NO: 746760 - DNA, 23 bp, Homo sapiens
tacctatataataaagctactga

SEQ ID NO: 746761 - DNA, 23 bp, Homo sapiens
tacctatattgatttaaaagtgt

SEQ ID NO: 746762 - DNA, 15 bp, Homo sapiens
tacctatctgtggaa

SEQ ID NO: 746763 - DNA, 13 bp, Homo sapiens
tacctatgacttt

SEQ ID NO: 746764 - DNA, 20 bp, Homo sapiens
tacctatgacttttttaaac

SEQ ID NO: 746765 - DNA, 13 bp, Homo sapiens
tacctatgtaaca

SEQ ID NO: 746766 - DNA, 18 bp, Homo sapiens
tacctattaggtggaaat

SEQ ID NO: 746767 - DNA, 17 bp, Homo sapiens
tacctatttctgatgat

SEQ ID NO: 746768 - DNA, 18 bp, Homo sapiens
tacctcaaagggcagttt

SEQ ID NO: 746769 - DNA, 18 bp, Homo sapiens
tacctcaacaagaagaat

SEQ ID NO: 746770 - DNA, 14 bp, Homo sapiens
tacctcaagttctt

SEQ ID NO: 746771 - DNA, 18 bp, Homo sapiens
tacctcaatttttgtttt

SEQ ID NO: 746772 - DNA, 17 bp, Homo sapiens
tacctcagaacataaaa

SEQ ID NO: 746773 - DNA, 11 bp, Homo sapiens
tacctcagcct

SEQ ID NO: 746774 - DNA, 16 bp, Homo sapiens
tacctcaggcagctca

SEQ ID NO: 746775 - DNA, 17 bp, Homo sapiens
tacctcaggtgtgcctg

SEQ ID NO: 746776 - DNA, 17 bp, Homo sapiens
tacctcatccatgcact

SEQ ID NO: 746777 - DNA, 19 bp, Homo sapiens
tacctcatccatgcacttt

SEQ ID NO: 746778 - DNA, 20 bp, Homo sapiens
tacctcatccatgcacttta

SEQ ID NO: 746779 - DNA, 20 bp, Homo sapiens
tacctccagtcacactcccc

SEQ ID NO: 746780 - DNA, 22 bp, Homo sapiens
tacctccagtcacactccccgc

SEQ ID NO: 746781 - DNA, 14 bp, Homo sapiens
tacctcccctgcct

SEQ ID NO: 746782 - DNA, 14 bp, Homo sapiens
tacctccctccctc

SEQ ID NO: 746783 - DNA, 15 bp, Homo sapiens
tacctccctccctct

SEQ ID NO: 746784 - DNA, 14 bp, Homo sapiens
tacctccctcctca

SEQ ID NO: 746785 - DNA, 15 bp, Homo sapiens
tacctcccttgcctt

SEQ ID NO: 746786 - DNA, 13 bp, Homo sapiens
tacctcctctcag

SEQ ID NO: 746787 - DNA, 13 bp, Homo sapiens
tacctcctgagaa

SEQ ID NO: 746788 - DNA, 21 bp, Homo sapiens
tacctcggggagagggggagg

SEQ ID NO: 746789 - DNA, 22 bp, Homo sapiens
tacctcggggagagggggaggt

SEQ ID NO: 746790 - DNA, 18 bp, Homo sapiens
tacctctagctgttcttt

SEQ ID NO: 746791 - DNA, 15 bp, Homo sapiens
tacctctatatacca

SEQ ID NO: 746792 - DNA, 21 bp, Homo sapiens
tacctctattttaattactgc

SEQ ID NO: 746793 - DNA, 18 bp, Homo sapiens
tacctctctgtcccttgc

SEQ ID NO: 746794 - DNA, 23 bp, Homo sapiens
tacctctcttatagaatatttat

SEQ ID NO: 746795 - DNA, 13 bp, Homo sapiens
tacctctggaacc

SEQ ID NO: 746796 - DNA, 18 bp, Homo sapiens
tacctcttactttgcttg

SEQ ID NO: 746797 - DNA, 17 bp, Homo sapiens
tacctcttattgcaaaa

SEQ ID NO: 746798 - DNA, 21 bp, Homo sapiens
tacctcttgagccttgaactt

SEQ ID NO: 746799 - DNA, 20 bp, Homo sapiens
tacctgaaaacactgtgcac

SEQ ID NO: 746800 - DNA, 20 bp, Homo sapiens
tacctgacactcccttgggc

SEQ ID NO: 746801 - DNA, 17 bp, Homo sapiens
tacctgacctcttgctg

SEQ ID NO: 746802 - DNA, 19 bp, Homo sapiens
tacctgacctcttgctgtc

SEQ ID NO: 746803 - DNA, 16 bp, Homo sapiens
tacctgactcctgact

SEQ ID NO: 746804 - DNA, 15 bp, Homo sapiens
tacctgagcattcag

SEQ ID NO: 746805 - DNA, 23 bp, Homo sapiens
tacctgatggaagtaaagcctca

SEQ ID NO: 746806 - DNA, 16 bp, Homo sapiens
tacctgccttttaagt

SEQ ID NO: 746807 - DNA, 17 bp, Homo sapiens
tactaagggaaagaatt

SEQ ID NO: 746808 - DNA, 17 bp, Homo sapiens
tactaagtgatgctgtg

SEQ ID NO: 746809 - DNA, 22 bp, Homo sapiens
tactaagttcacattagaatta

SEQ ID NO: 746810 - DNA, 20 bp, Homo sapiens
tactaataaactaataattg

SEQ ID NO: 746811 - DNA, 23 bp, Homo sapiens
tactaatagaataaaggcagttt

SEQ ID NO: 746812 - DNA, 15 bp, Homo sapiens
tactaatagacaatt

SEQ ID NO: 746813 - DNA, 20 bp, Homo sapiens
tactaatagacaatttatta

SEQ ID NO: 746814 - DNA, 12 bp, Homo sapiens
tactaatctgag

SEQ ID NO: 746815 - DNA, 13 bp, Homo sapiens
tactaatctgaga

SEQ ID NO: 746816 - DNA, 17 bp, Homo sapiens
tactaatgatgagcatt

SEQ ID NO: 746817 - DNA, 15 bp, Homo sapiens
tactaatgatgtttt

SEQ ID NO: 746818 - DNA, 16 bp, Homo sapiens
tactaatgatgttttc

SEQ ID NO: 746819 - DNA, 16 bp, Homo sapiens
tactacaacttttgtt

SEQ ID NO: 746820 - DNA, 15 bp, Homo sapiens
tactacactgaggag

SEQ ID NO: 746821 - DNA, 22 bp, Homo sapiens
tactacactggtgtgtccctct

SEQ ID NO: 746822 - DNA, 16 bp, Homo sapiens
tactacagaaattctg

SEQ ID NO: 746823 - DNA, 21 bp, Homo sapiens
tactacagttgttttttgaaa

SEQ ID NO: 746824 - DNA, 23 bp, Homo sapiens
tactacagttgttttttgaaaac

SEQ ID NO: 746825 - DNA, 14 bp, Homo sapiens
tactaccatagtga

SEQ ID NO: 746826 - DNA, 21 bp, Homo sapiens
tactacccccacagacctgct

SEQ ID NO: 746827 - DNA, 15 bp, Homo sapiens
tactacccgagccca

SEQ ID NO: 746828 - DNA, 13 bp, Homo sapiens
tactaccctcacc

SEQ ID NO: 746829 - DNA, 15 bp, Homo sapiens
tactaccctttgctg

SEQ ID NO: 746830 - DNA, 23 bp, Homo sapiens
tactacctacgtttgcaccgcct

SEQ ID NO: 746831 - DNA, 14 bp, Homo sapiens
tactacctgtaatg

SEQ ID NO: 746832 - DNA, 13 bp, Homo sapiens
tactaccttgaaa

SEQ ID NO: 746833 - DNA, 20 bp, Homo sapiens
tactaccttgaaaataagaa

SEQ ID NO: 746834 - DNA, 19 bp, Homo sapiens
tactacggagaaactcatc

SEQ ID NO: 746835 - DNA, 20 bp, Homo sapiens
tactacggagaaactcatca

SEQ ID NO: 746836 - DNA, 18 bp, Homo sapiens
tactactagatgtcttta

SEQ ID NO: 746837 - DNA, 13 bp, Homo sapiens
tactactcctgta

SEQ ID NO: 746838 - DNA, 13 bp, Homo sapiens
tactactcctttg

SEQ ID NO: 746839 - DNA, 13 bp, Homo sapiens
tactactctgcca

SEQ ID NO: 746840 - DNA, 16 bp, Homo sapiens
tactactgagggaaat

SEQ ID NO: 746841 - DNA, 17 bp, Homo sapiens
tactactgagggaaata

SEQ ID NO: 746842 - DNA, 19 bp, Homo sapiens
tactacttaaaatgattct

SEQ ID NO: 746843 - DNA, 18 bp, Homo sapiens
tactagagatattttgta

SEQ ID NO: 746844 - DNA, 24 bp, Homo sapiens
tactagagatattttgtaaaatgt

SEQ ID NO: 746845 - DNA, 19 bp, Homo sapiens
tactagatgtctttaggca

SEQ ID NO: 746846 - DNA, 19 bp, Homo sapiens
tactagcaaaataaaacat

SEQ ID NO: 746847 - DNA, 19 bp, Homo sapiens
tactagcatacttaaaata

SEQ ID NO: 746848 - DNA, 13 bp, Homo sapiens
tactaggtaactt

SEQ ID NO: 746849 - DNA, 22 bp, Homo sapiens
tactagttcagacactttggaa

SEQ ID NO: 746850 - DNA, 19 bp, Homo sapiens
tactataagactataaata

SEQ ID NO: 746851 - DNA, 14 bp, Homo sapiens
tactataagtagtt

SEQ ID NO: 746852 - DNA, 23 bp, Homo sapiens
tactataattgtaaatattttga

SEQ ID NO: 746853 - DNA, 13 bp, Homo sapiens
tactatagtacca

SEQ ID NO: 746854 - DNA, 23 bp, Homo sapiens
tactatagtctcttgtttgtctt

SEQ ID NO: 746855 - DNA, 21 bp, Homo sapiens
tactatatttacaaataaaat

SEQ ID NO: 746856 - DNA, 13 bp, Homo sapiens
tactatatttgct

SEQ ID NO: 746857 - DNA, 14 bp, Homo sapiens
tactatatttgcta

SEQ ID NO: 746858 - DNA, 15 bp, Homo sapiens
tactatcatctctta

SEQ ID NO: 746859 - DNA, 15 bp, Homo sapiens
tactatcattctcag

SEQ ID NO: 746860 - DNA, 13 bp, Homo sapiens
gacttcactgtat

SEQ ID NO: 746861 - DNA, 15 bp, Homo sapiens
gacttcactgtatat

SEQ ID NO: 746862 - DNA, 16 bp, Homo sapiens
gacttcactgtatata

SEQ ID NO: 746863 - DNA, 19 bp, Homo sapiens
gacttcactgtatataaac

SEQ ID NO: 746864 - DNA, 14 bp, Homo sapiens
gacttcagctctgt

SEQ ID NO: 746865 - DNA, 15 bp, Homo sapiens
gacttcagctgcctg

SEQ ID NO: 746866 - DNA, 18 bp, Homo sapiens
gacttcagggcagggctc

SEQ ID NO: 746867 - DNA, 22 bp, Homo sapiens
gacttcagggcagggctctgat

SEQ ID NO: 746868 - DNA, 21 bp, Homo sapiens
gacttcagtatgttgtcaaag

SEQ ID NO: 746869 - DNA, 24 bp, Homo sapiens
gacttcatctcccacctagcagca

SEQ ID NO: 746870 - DNA, 14 bp, Homo sapiens
gacttcatttgtgc

SEQ ID NO: 746871 - DNA, 18 bp, Homo sapiens
gacttcatttgtgccaca

SEQ ID NO: 746872 - DNA, 12 bp, Homo sapiens
gacttccacaaa

SEQ ID NO: 746873 - DNA, 13 bp, Homo sapiens
gacttccaccctg

SEQ ID NO: 746874 - DNA, 13 bp, Homo sapiens
gacttcccagcta

SEQ ID NO: 746875 - DNA, 18 bp, Homo sapiens
gacttcccagctaggaag

SEQ ID NO: 746876 - DNA, 13 bp, Homo sapiens
gacttcccagctt

SEQ ID NO: 746877 - DNA, 22 bp, Homo sapiens
gacttccccaaacccagaaaga

SEQ ID NO: 746878 - DNA, 16 bp, Homo sapiens
gacttccctggtcacc

SEQ ID NO: 746879 - DNA, 13 bp, Homo sapiens
gacttccctgtgt

SEQ ID NO: 746880 - DNA, 23 bp, Homo sapiens
gacttcctggtgaggcccagcct

SEQ ID NO: 746881 - DNA, 20 bp, Homo sapiens
gacttccttgagacacggag

SEQ ID NO: 746882 - DNA, 18 bp, Homo sapiens
gacttcgactgtgacctg

SEQ ID NO: 746883 - DNA, 14 bp, Homo sapiens
gacttcggaccgct

SEQ ID NO: 746884 - DNA, 17 bp, Homo sapiens
gacttcggaccgcttgt

SEQ ID NO: 746885 - DNA, 16 bp, Homo sapiens
gacttctagcagagac

SEQ ID NO: 746886 - DNA, 22 bp, Homo sapiens
gacttctcccccgccctgcccc

SEQ ID NO: 746887 - DNA, 17 bp, Homo sapiens
gacttctctgaatcaga

SEQ ID NO: 746888 - DNA, 18 bp, Homo sapiens
gacttctcttacattttc

SEQ ID NO: 746889 - DNA, 13 bp, Homo sapiens
gacttctgagatc

SEQ ID NO: 746890 - DNA, 14 bp, Homo sapiens
gacttctgcctgga

SEQ ID NO: 746891 - DNA, 19 bp, Homo sapiens
gacttctgctgaaggacag

SEQ ID NO: 746892 - DNA, 14 bp, Homo sapiens
gacttctggaaggc

SEQ ID NO: 746893 - DNA, 11 bp, Homo sapiens
gacttcttacc

SEQ ID NO: 746894 - DNA, 21 bp, Homo sapiens
gacttcttggtttggggagaa

SEQ ID NO: 746895 - DNA, 23 bp, Homo sapiens
gacttcttggtttggggagaaat

SEQ ID NO: 746896 - DNA, 21 bp, Homo sapiens
gacttcttggttttctctctg

SEQ ID NO: 746897 - DNA, 18 bp, Homo sapiens
gacttctttactaacact

SEQ ID NO: 746898 - DNA, 12 bp, Homo sapiens
gacttcttttga

SEQ ID NO: 746899 - DNA, 13 bp, Homo sapiens
gacttgaaagaaa

SEQ ID NO: 746900 - DNA, 15 bp, Homo sapiens
gacttgaaagttttc

SEQ ID NO: 746901 - DNA, 17 bp, Homo sapiens
gacttgaagcacagagg

SEQ ID NO: 746902 - DNA, 12 bp, Homo sapiens
gacttgaagttg

SEQ ID NO: 746903 - DNA, 21 bp, Homo sapiens
gacttgaatattcctggactt

SEQ ID NO: 746904 - DNA, 22 bp, Homo sapiens
gacttgaatattcctggactta

SEQ ID NO: 746905 - DNA, 17 bp, Homo sapiens
gacttgaccctttcctc

SEQ ID NO: 746906 - DNA, 22 bp, Homo sapiens
gacttgagaagtctaattcaca

SEQ ID NO: 746907 - DNA, 18 bp, Homo sapiens
gacttgagacaatgtttt

SEQ ID NO: 746908 - DNA, 20 bp, Homo sapiens
gacttgagccactccttcct

SEQ ID NO: 746909 - DNA, 16 bp, Homo sapiens
gacttgcacagggatt

SEQ ID NO: 746910 - DNA, 13 bp, Homo sapiens
gacttgcattttt

SEQ ID NO: 746911 - DNA, 15 bp, Homo sapiens
gacttgcatttttgc

SEQ ID NO: 746912 - DNA, 20 bp, Homo sapiens
gacttgccacccccagttcc

SEQ ID NO: 746913 - DNA, 23 bp, Homo sapiens
gacttgccgtcccctaaggaaat

SEQ ID NO: 746914 - DNA, 22 bp, Homo sapiens
gacttgcgtggacagtcagggt

SEQ ID NO: 746915 - DNA, 23 bp, Homo sapiens
gacttgctaaagcactttgcact

SEQ ID NO: 746916 - DNA, 22 bp, Homo sapiens
gacttgctgtccaggcagctcc

SEQ ID NO: 746917 - DNA, 22 bp, Homo sapiens
gacttgctgtgtgaccctgggc

SEQ ID NO: 746918 - DNA, 20 bp, Homo sapiens
gacttgctgttttgttctgt

SEQ ID NO: 746919 - DNA, 22 bp, Homo sapiens
gacttgctgttttgttctgtgg

SEQ ID NO: 746920 - DNA, 11 bp, Homo sapiens
gacttgcttta

SEQ ID NO: 746921 - DNA, 19 bp, Homo sapiens
gacttggaagaggaggagg

SEQ ID NO: 746922 - DNA, 20 bp, Homo sapiens
gacttggacatctctctggc

SEQ ID NO: 746923 - DNA, 15 bp, Homo sapiens
gacttggacttttga

SEQ ID NO: 746924 - DNA, 18 bp, Homo sapiens
gacttggagactcctggt

SEQ ID NO: 746925 - DNA, 20 bp, Homo sapiens
gacttggagactcctggtct

SEQ ID NO: 746926 - DNA, 21 bp, Homo sapiens
gacttggagactcctggtctg

SEQ ID NO: 746927 - DNA, 14 bp, Homo sapiens
gacttggagagcaa

SEQ ID NO: 746928 - DNA, 18 bp, Homo sapiens
gacttggagagcaaaggc

SEQ ID NO: 746929 - DNA, 16 bp, Homo sapiens
gagaacgccagtctcc

SEQ ID NO: 746930 - DNA, 11 bp, Homo sapiens
gagaactgact

SEQ ID NO: 746931 - DNA, 23 bp, Homo sapiens
gagaactgcagacctcactgtca

SEQ ID NO: 746932 - DNA, 20 bp, Homo sapiens
gagaagaaatagcagagcct

SEQ ID NO: 746933 - DNA, 12 bp, Homo sapiens
gagaagagagga

SEQ ID NO: 746934 - DNA, 13 bp, Homo sapiens
gagaagagccctg

SEQ ID NO: 746935 - DNA, 15 bp, Homo sapiens
gagaagaggaggagg

SEQ ID NO: 746936 - DNA, 16 bp, Homo sapiens
gagaagaggaggaggt

SEQ ID NO: 746937 - DNA, 21 bp, Homo sapiens
gagaagaggctggtgctgtgg

SEQ ID NO: 746938 - DNA, 21 bp, Homo sapiens
gagaagagggcccagcccaga

SEQ ID NO: 746939 - DNA, 13 bp, Homo sapiens
gagaagagtattt

SEQ ID NO: 746940 - DNA, 20 bp, Homo sapiens
gagaagatttcagagctgag

SEQ ID NO: 746941 - DNA, 14 bp, Homo sapiens
gagaagattttata

SEQ ID NO: 746942 - DNA, 22 bp, Homo sapiens
gagaagcaagtaaaaaggctaa

SEQ ID NO: 746943 - DNA, 13 bp, Homo sapiens
gagaagccacctt

SEQ ID NO: 746944 - DNA, 24 bp, Homo sapiens
gagaagccccgcacgggctgtctg

SEQ ID NO: 746945 - DNA, 16 bp, Homo sapiens
gagaagcggctggcag

SEQ ID NO: 746946 - DNA, 17 bp, Homo sapiens
gagaagcggctggcagc

SEQ ID NO: 746947 - DNA, 20 bp, Homo sapiens
gagaagcggtggataactag

SEQ ID NO: 746948 - DNA, 17 bp, Homo sapiens
gagaagctcagctgcat

SEQ ID NO: 746949 - DNA, 17 bp, Homo sapiens
gagaagctgaagccccc

SEQ ID NO: 746950 - DNA, 15 bp, Homo sapiens
gagaagctgaggcct

SEQ ID NO: 746951 - DNA, 12 bp, Homo sapiens
gagaagctgctg

SEQ ID NO: 746952 - DNA, 15 bp, Homo sapiens
gagaagctggggagg

SEQ ID NO: 746953 - DNA, 15 bp, Homo sapiens
gagaaggaaataaaa

SEQ ID NO: 746954 - DNA, 16 bp, Homo sapiens
gagaaggaaataaaat

SEQ ID NO: 746955 - DNA, 19 bp, Homo sapiens
gagaaggaaataaaatcag

SEQ ID NO: 746956 - DNA, 12 bp, Homo sapiens
gagaaggcagga

SEQ ID NO: 746957 - DNA, 21 bp, Homo sapiens
gagaaggcccataccttctgg

SEQ ID NO: 746958 - DNA, 15 bp, Homo sapiens
gagaaggcgaggaga

SEQ ID NO: 746959 - DNA, 20 bp, Homo sapiens
gagaagggaatcctcctcca

SEQ ID NO: 746960 - DNA, 15 bp, Homo sapiens
gagaagggctggggc

SEQ ID NO: 746961 - DNA, 16 bp, Homo sapiens
gagaagggctggggcc

SEQ ID NO: 746962 - DNA, 19 bp, Homo sapiens
gagaagggggctctgcccc

SEQ ID NO: 746963 - DNA, 20 bp, Homo sapiens
gagaagggggctctgcccca

SEQ ID NO: 746964 - DNA, 21 bp, Homo sapiens
gagaagggggctctgccccag

SEQ ID NO: 746965 - DNA, 19 bp, Homo sapiens
gagaagggggtctctgtta

SEQ ID NO: 746966 - DNA, 12 bp, Homo sapiens
gagaagggggtg

SEQ ID NO: 746967 - DNA, 23 bp, Homo sapiens
gagaagggggtgacagtcctcca

SEQ ID NO: 746968 - DNA, 23 bp, Homo sapiens
gagaagggtggatgacagggcag

SEQ ID NO: 746969 - DNA, 23 bp, Homo sapiens
gagaagggtggtaaatattttca

SEQ ID NO: 746970 - DNA, 17 bp, Homo sapiens
gagaagggttctgccct

SEQ ID NO: 746971 - DNA, 23 bp, Homo sapiens
gagaagggttctgccctgcctga

SEQ ID NO: 746972 - DNA, 16 bp, Homo sapiens
gagaaggtctccaagg

SEQ ID NO: 746973 - DNA, 20 bp, Homo sapiens
gagaaggttggcgtgccctg

SEQ ID NO: 746974 - DNA, 16 bp, Homo sapiens
gagaagtatacataag

SEQ ID NO: 746975 - DNA, 14 bp, Homo sapiens
gagaagtcaaacat

SEQ ID NO: 746976 - DNA, 14 bp, Homo sapiens
gagaagtctcagct

SEQ ID NO: 746977 - DNA, 17 bp, Homo sapiens
gagaagtgaatgctggg

SEQ ID NO: 746978 - DNA, 17 bp, Homo sapiens
gagaagtgcccctgctg

SEQ ID NO: 746979 - DNA, 16 bp, Homo sapiens
gagaagttgtaaagta

SEQ ID NO: 746980 - DNA, 16 bp, Homo sapiens
gagaagtttctggccc

SEQ ID NO: 746981 - DNA, 17 bp, Homo sapiens
gagaagtttctggccct

SEQ ID NO: 746982 - DNA, 20 bp, Homo sapiens
gagaagtttgtagccaggta

SEQ ID NO: 746983 - DNA, 23 bp, Homo sapiens
gagaagtttgtagccaggtactg

SEQ ID NO: 746984 - DNA, 16 bp, Homo sapiens
gagaagttttgttttt

SEQ ID NO: 746985 - DNA, 20 bp, Homo sapiens
gagaataaaattcctatctc

SEQ ID NO: 746986 - DNA, 20 bp, Homo sapiens
gagaataaattgatttttat

SEQ ID NO: 746987 - DNA, 13 bp, Homo sapiens
gagaatacataaa

SEQ ID NO: 746988 - DNA, 23 bp, Homo sapiens
gagaataccttggtctcacctat

SEQ ID NO: 746989 - DNA, 17 bp, Homo sapiens
gagaatactttgcttca

SEQ ID NO: 746990 - DNA, 14 bp, Homo sapiens
tactgagggaaata

SEQ ID NO: 746991 - DNA, 18 bp, Homo sapiens
tactgaggggattctcta

SEQ ID NO: 746992 - DNA, 14 bp, Homo sapiens
tactgatatatttt

SEQ ID NO: 746993 - DNA, 18 bp, Homo sapiens
tactgatcatgcattgtt

SEQ ID NO: 746994 - DNA, 12 bp, Homo sapiens
tactgatgaaat

SEQ ID NO: 746995 - DNA, 14 bp, Homo sapiens
tactgatgaaatct

SEQ ID NO: 746996 - DNA, 22 bp, Homo sapiens
tactgatgtgatattctgttgc

SEQ ID NO: 746997 - DNA, 17 bp, Homo sapiens
tactgatgttcctttgg

SEQ ID NO: 746998 - DNA, 22 bp, Homo sapiens
tactgattagagtggttattca

SEQ ID NO: 746999 - DNA, 22 bp, Homo sapiens
tactgattcaattataattgta

SEQ ID NO: 747000 - DNA, 18 bp, Homo sapiens
tactgattcactgcatgg

SEQ ID NO: 747001 - DNA, 15 bp, Homo sapiens
tactgattttaaaat

SEQ ID NO: 747002 - DNA, 18 bp, Homo sapiens
tactgattttaaaatgaa

SEQ ID NO: 747003 - DNA, 15 bp, Homo sapiens
tactgatttttgtga

SEQ ID NO: 747004 - DNA, 16 bp, Homo sapiens
tactgcaaaaagaaaa

SEQ ID NO: 747005 - DNA, 14 bp, Homo sapiens
tactgcaaatcagg

SEQ ID NO: 747006 - DNA, 23 bp, Homo sapiens
tactgcaaatcaggcttttgttt

SEQ ID NO: 747007 - DNA, 17 bp, Homo sapiens
tactgcacagtggcaca

SEQ ID NO: 747008 - DNA, 22 bp, Homo sapiens
tactgcacgtaacactcctcct

SEQ ID NO: 747009 - DNA, 17 bp, Homo sapiens
tactgcactccagcctg

SEQ ID NO: 747010 - DNA, 13 bp, Homo sapiens
tactgcactgagt

SEQ ID NO: 747011 - DNA, 21 bp, Homo sapiens
tactgcagcacctccaggcct

SEQ ID NO: 747012 - DNA, 21 bp, Homo sapiens
tactgcagcctgggctccctc

SEQ ID NO: 747013 - DNA, 18 bp, Homo sapiens
tactgcatactttttaaa

SEQ ID NO: 747014 - DNA, 17 bp, Homo sapiens
tactgcatgtgacttct

SEQ ID NO: 747015 - DNA, 18 bp, Homo sapiens
tactgcattctctcccat

SEQ ID NO: 747016 - DNA, 13 bp, Homo sapiens
tactgcattctga

SEQ ID NO: 747017 - DNA, 21 bp, Homo sapiens
tactgccaagcccctgccctg

SEQ ID NO: 747018 - DNA, 14 bp, Homo sapiens
tactgccactgtgt

SEQ ID NO: 747019 - DNA, 21 bp, Homo sapiens
tactgccatgtactagtttta

SEQ ID NO: 747020 - DNA, 15 bp, Homo sapiens
tactgcccacatttg

SEQ ID NO: 747021 - DNA, 19 bp, Homo sapiens
tactgcccggggcagctgc

SEQ ID NO: 747022 - DNA, 19 bp, Homo sapiens
tactgccgaagaattgtct

SEQ ID NO: 747023 - DNA, 23 bp, Homo sapiens
tactgccgaagaattgtcttgca

SEQ ID NO: 747024 - DNA, 20 bp, Homo sapiens
tactgcctgaataaagagcc

SEQ ID NO: 747025 - DNA, 10 bp, Homo sapiens
tactgcctgt

SEQ ID NO: 747026 - DNA, 12 bp, Homo sapiens
tactgcgacttt

SEQ ID NO: 747027 - DNA, 16 bp, Homo sapiens
tactgcgactttctgc

SEQ ID NO: 747028 - DNA, 20 bp, Homo sapiens
tactgcgactttctgcctgg

SEQ ID NO: 747029 - DNA, 21 bp, Homo sapiens
tactgcgactttctgcctgga

SEQ ID NO: 747030 - DNA, 19 bp, Homo sapiens
tactgctaagtatttccca

SEQ ID NO: 747031 - DNA, 15 bp, Homo sapiens
tactgctactgtaat

SEQ ID NO: 747032 - DNA, 15 bp, Homo sapiens
tactgctcctgtggc

SEQ ID NO: 747033 - DNA, 18 bp, Homo sapiens
tactgctcctgtggcagg

SEQ ID NO: 747034 - DNA, 19 bp, Homo sapiens
tactgctcctgtggcagga

SEQ ID NO: 747035 - DNA, 13 bp, Homo sapiens
tactgctctgaat

SEQ ID NO: 747036 - DNA, 22 bp, Homo sapiens
tactgctctttattgcagaatg

SEQ ID NO: 747037 - DNA, 12 bp, Homo sapiens
tactgctgaggt

SEQ ID NO: 747038 - DNA, 22 bp, Homo sapiens
tactgctgattcttgtaaatct

SEQ ID NO: 747039 - DNA, 12 bp, Homo sapiens
tactgctggagt

SEQ ID NO: 747040 - DNA, 21 bp, Homo sapiens
tactgcttcccattgagtaat

SEQ ID NO: 747041 - DNA, 16 bp, Homo sapiens
tactgcttctctttgt

SEQ ID NO: 747042 - DNA, 18 bp, Homo sapiens
tactgcttctctttgtgc

SEQ ID NO: 747043 - DNA, 17 bp, Homo sapiens
tactgcttttcattagc

SEQ ID NO: 747044 - DNA, 14 bp, Homo sapiens
tactggaaatgtag

SEQ ID NO: 747045 - DNA, 17 bp, Homo sapiens
tactggaagttttgcat

SEQ ID NO: 747046 - DNA, 20 bp, Homo sapiens
tactggaataatttgtaaat

SEQ ID NO: 747047 - DNA, 21 bp, Homo sapiens
tactggaataatttgtaaatg

SEQ ID NO: 747048 - DNA, 16 bp, Homo sapiens
tactggacacactaaa

SEQ ID NO: 747049 - DNA, 14 bp, Homo sapiens
tactggactcagga

SEQ ID NO: 747050 - DNA, 18 bp, Homo sapiens
tactggactcaggaactt

SEQ ID NO: 747051 - DNA, 12 bp, Homo sapiens
tacttgcagttg

SEQ ID NO: 747052 - DNA, 16 bp, Homo sapiens
tacttgcagttgtgat

SEQ ID NO: 747053 - DNA, 22 bp, Homo sapiens
tacttgccaagcagtgcacatt

SEQ ID NO: 747054 - DNA, 23 bp, Homo sapiens
tacttgccttattagagtgtctt

SEQ ID NO: 747055 - DNA, 15 bp, Homo sapiens
tacttgcttcagtgg

SEQ ID NO: 747056 - DNA, 19 bp, Homo sapiens
tacttgcttgtattgtaaa

SEQ ID NO: 747057 - DNA, 23 bp, Homo sapiens
tacttgctttaccttttcagggc

SEQ ID NO: 747058 - DNA, 17 bp, Homo sapiens
tacttggagtaattgca

SEQ ID NO: 747059 - DNA, 14 bp, Homo sapiens
tacttggatttagt

SEQ ID NO: 747060 - DNA, 16 bp, Homo sapiens
tacttgggagcctgag

SEQ ID NO: 747061 - DNA, 19 bp, Homo sapiens
tacttgggagcctgaggca

SEQ ID NO: 747062 - DNA, 13 bp, Homo sapiens
tacttggtttgtg

SEQ ID NO: 747063 - DNA, 20 bp, Homo sapiens
tacttggtttgtgttcttct

SEQ ID NO: 747064 - DNA, 16 bp, Homo sapiens
tacttgtaaaatgctt

SEQ ID NO: 747065 - DNA, 16 bp, Homo sapiens
tacttgtcaaagaagg

SEQ ID NO: 747066 - DNA, 11 bp, Homo sapiens
tacttgtcaat

SEQ ID NO: 747067 - DNA, 21 bp, Homo sapiens
tacttgtcctcagcttgggct

SEQ ID NO: 747068 - DNA, 16 bp, Homo sapiens
tacttgtctgaggcct

SEQ ID NO: 747069 - DNA, 17 bp, Homo sapiens
tacttgtgactgaaggg

SEQ ID NO: 747070 - DNA, 21 bp, Homo sapiens
tacttgtgttacttgccaagc

SEQ ID NO: 747071 - DNA, 16 bp, Homo sapiens
tacttgtgtttgctta

SEQ ID NO: 747072 - DNA, 18 bp, Homo sapiens
tacttgtgtttgcttaaa

SEQ ID NO: 747073 - DNA, 20 bp, Homo sapiens
tacttgtgtttgcttaaaca

SEQ ID NO: 747074 - DNA, 22 bp, Homo sapiens
tacttgtgtttgcttaaacaaa

SEQ ID NO: 747075 - DNA, 22 bp, Homo sapiens
tacttgttcaaaatatgttctt

SEQ ID NO: 747076 - DNA, 13 bp, Homo sapiens
tacttgtttgaat

SEQ ID NO: 747077 - DNA, 14 bp, Homo sapiens
tactttaaaaagga

SEQ ID NO: 747078 - DNA, 20 bp, Homo sapiens
tactttaaaggaaaaaatgt

SEQ ID NO: 747079 - DNA, 14 bp, Homo sapiens
tactttaacagtct

SEQ ID NO: 747080 - DNA, 16 bp, Homo sapiens
tactttacctctctgt

SEQ ID NO: 747081 - DNA, 20 bp, Homo sapiens
tactttataactaacatgtc

SEQ ID NO: 747082 - DNA, 23 bp, Homo sapiens
tactttataactaacatgtcctg

SEQ ID NO: 747083 - DNA, 19 bp, Homo sapiens
tactttattaatatgagtt

SEQ ID NO: 747084 - DNA, 15 bp, Homo sapiens
tactttattagagta

SEQ ID NO: 747085 - DNA, 20 bp, Homo sapiens
tactttatttatacactgtc

SEQ ID NO: 747086 - DNA, 14 bp, Homo sapiens
tactttatttctga

SEQ ID NO: 747087 - DNA, 17 bp, Homo sapiens
tactttcatcttaaact

SEQ ID NO: 747088 - DNA, 18 bp, Homo sapiens
tactttcatcttaaacta

SEQ ID NO: 747089 - DNA, 20 bp, Homo sapiens
tactttcatcttaaactaat

SEQ ID NO: 747090 - DNA, 15 bp, Homo sapiens
tactttcccttgctt

SEQ ID NO: 747091 - DNA, 23 bp, Homo sapiens
tactttcccttgcttttccctct

SEQ ID NO: 747092 - DNA, 17 bp, Homo sapiens
tactttcgtacattggc

SEQ ID NO: 747093 - DNA, 15 bp, Homo sapiens
tactttgaaaacaat

SEQ ID NO: 747094 - DNA, 17 bp, Homo sapiens
tactttgaaaacaattc

SEQ ID NO: 747095 - DNA, 18 bp, Homo sapiens
tactttgaaaacaattca

SEQ ID NO: 747096 - DNA, 19 bp, Homo sapiens
tactttgaaaacaattcag

SEQ ID NO: 747097 - DNA, 17 bp, Homo sapiens
tactttgaaaactgaat

SEQ ID NO: 747098 - DNA, 14 bp, Homo sapiens
tactttgaagtcat

SEQ ID NO: 747099 - DNA, 18 bp, Homo sapiens
tactttgaagtcatacca

SEQ ID NO: 747100 - DNA, 15 bp, Homo sapiens
tactttgacagtgtt

SEQ ID NO: 747101 - DNA, 20 bp, Homo sapiens
tactttgatttttatccatt

SEQ ID NO: 747102 - DNA, 18 bp, Homo sapiens
tactttgcattgtctgtc

SEQ ID NO: 747103 - DNA, 14 bp, Homo sapiens
tactttgcatttct

SEQ ID NO: 747104 - DNA, 13 bp, Homo sapiens
tactttgccattt

SEQ ID NO: 747105 - DNA, 20 bp, Homo sapiens
tactttgccatttttctata

SEQ ID NO: 747106 - DNA, 12 bp, Homo sapiens
tactttgcttga

SEQ ID NO: 747107 - DNA, 17 bp, Homo sapiens
tactttggaattcttag

SEQ ID NO: 747108 - DNA, 22 bp, Homo sapiens
tactttgtaagtgagagagaca

SEQ ID NO: 747109 - DNA, 14 bp, Homo sapiens
tacttttaaactgt

SEQ ID NO: 747110 - DNA, 23 bp, Homo sapiens
tacttttacaagtaacaaaaata

SEQ ID NO: 747111 - DNA, 19 bp, Homo sapiens
tacttttagttgactcaca

SEQ ID NO: 747112 - DNA, 13 bp, Homo sapiens
tacttttattatt

SEQ ID NO: 747113 - DNA, 23 bp, Homo sapiens
tacttttcccctgttaaacagta

SEQ ID NO: 747114 - DNA, 16 bp, Homo sapiens
tacttttcctaaagtt

SEQ ID NO: 747115 - DNA, 16 bp, Homo sapiens
tacttttctaaaatct

SEQ ID NO: 747116 - DNA, 17 bp, Homo sapiens
tacttttctgtttagtt

SEQ ID NO: 747117 - DNA, 12 bp, Homo sapiens
tacttttcttac

SEQ ID NO: 747118 - DNA, 14 bp, Homo sapiens
tacttttgagtgtg

SEQ ID NO: 747119 - DNA, 16 bp, Homo sapiens
tacttttgcaaactgt

SEQ ID NO: 747120 - DNA, 21 bp, Homo sapiens
gagactccactcaggtgcaca

SEQ ID NO: 747121 - DNA, 22 bp, Homo sapiens
gagactccactcaggtgcacac

SEQ ID NO: 747122 - DNA, 20 bp, Homo sapiens
gagactccagaatctgctgt

SEQ ID NO: 747123 - DNA, 16 bp, Homo sapiens
gagactccatgagaag

SEQ ID NO: 747124 - DNA, 12 bp, Homo sapiens
gagactcctggg

SEQ ID NO: 747125 - DNA, 21 bp, Homo sapiens
gagactcctgggcagccgttt

SEQ ID NO: 747126 - DNA, 14 bp, Homo sapiens
gagactcctggtct

SEQ ID NO: 747127 - DNA, 15 bp, Homo sapiens
gagactcctggtctg

SEQ ID NO: 747128 - DNA, 16 bp, Homo sapiens
gagactcctggtctgt

SEQ ID NO: 747129 - DNA, 16 bp, Homo sapiens
gagactctagggtcca

SEQ ID NO: 747130 - DNA, 19 bp, Homo sapiens
gagactctagggtccagtg

SEQ ID NO: 747131 - DNA, 14 bp, Homo sapiens
gagactctatttta

SEQ ID NO: 747132 - DNA, 12 bp, Homo sapiens
gagactctgtgg

SEQ ID NO: 747133 - DNA, 17 bp, Homo sapiens
gagactgagaggcagaa

SEQ ID NO: 747134 - DNA, 16 bp, Homo sapiens
gagactgagcagccgc

SEQ ID NO: 747135 - DNA, 11 bp, Homo sapiens
gagactgcccc

SEQ ID NO: 747136 - DNA, 22 bp, Homo sapiens
gagactgcgggatggtcctggg

SEQ ID NO: 747137 - DNA, 23 bp, Homo sapiens
gagactgcgggatggtcctgggg

SEQ ID NO: 747138 - DNA, 20 bp, Homo sapiens
gagactgcttcccatcctac

SEQ ID NO: 747139 - DNA, 14 bp, Homo sapiens
gagactgggaaggc

SEQ ID NO: 747140 - DNA, 15 bp, Homo sapiens
gagactgggatggga

SEQ ID NO: 747141 - DNA, 20 bp, Homo sapiens
gagactgggctgagggagcc

SEQ ID NO: 747142 - DNA, 16 bp, Homo sapiens
gagactggtcctgtgt

SEQ ID NO: 747143 - DNA, 15 bp, Homo sapiens
gagactgtaaaacaa

SEQ ID NO: 747144 - DNA, 13 bp, Homo sapiens
gagactgtagatt

SEQ ID NO: 747145 - DNA, 23 bp, Homo sapiens
gagactgtagattgcttctgtag

SEQ ID NO: 747146 - DNA, 13 bp, Homo sapiens
gagactgtccctg

SEQ ID NO: 747147 - DNA, 22 bp, Homo sapiens
gagactgtctcaagagggcact

SEQ ID NO: 747148 - DNA, 21 bp, Homo sapiens
gagactgtggtaggggcaggg

SEQ ID NO: 747149 - DNA, 18 bp, Homo sapiens
gagacttagggcaccagg

SEQ ID NO: 747150 - DNA, 15 bp, Homo sapiens
gagacttcctctggt

SEQ ID NO: 747151 - DNA, 18 bp, Homo sapiens
gagacttgagcttgacct

SEQ ID NO: 747152 - DNA, 20 bp, Homo sapiens
gagacttgttcttggttcct

SEQ ID NO: 747153 - DNA, 22 bp, Homo sapiens
gagacttgttcttggttcctgt

SEQ ID NO: 747154 - DNA, 14 bp, Homo sapiens
gagactttaaaagc

SEQ ID NO: 747155 - DNA, 14 bp, Homo sapiens
gagactttgcccag

SEQ ID NO: 747156 - DNA, 13 bp, Homo sapiens
gagactttgtaga

SEQ ID NO: 747157 - DNA, 13 bp, Homo sapiens
gagagaagtgccc

SEQ ID NO: 747158 - DNA, 18 bp, Homo sapiens
gagagaagtgcccctgct

SEQ ID NO: 747159 - DNA, 21 bp, Homo sapiens
gagagaatagagctgccactg

SEQ ID NO: 747160 - DNA, 22 bp, Homo sapiens
gagagaatgtgtgtgtgtggca

SEQ ID NO: 747161 - DNA, 17 bp, Homo sapiens
gagagaattggctcaat

SEQ ID NO: 747162 - DNA, 17 bp, Homo sapiens
gagagacaagaagcaaa

SEQ ID NO: 747163 - DNA, 19 bp, Homo sapiens
gagagacaggcagctcgga

SEQ ID NO: 747164 - DNA, 16 bp, Homo sapiens
gagagaccacacattt

SEQ ID NO: 747165 - DNA, 14 bp, Homo sapiens
gagagaccctcact

SEQ ID NO: 747166 - DNA, 22 bp, Homo sapiens
gagagaccctcactgctgggga

SEQ ID NO: 747167 - DNA, 18 bp, Homo sapiens
gagagactgaaagcagca

SEQ ID NO: 747168 - DNA, 12 bp, Homo sapiens
gagagagaggct

SEQ ID NO: 747169 - DNA, 13 bp, Homo sapiens
gagagagccagga

SEQ ID NO: 747170 - DNA, 14 bp, Homo sapiens
gagagagccatgaa

SEQ ID NO: 747171 - DNA, 18 bp, Homo sapiens
gagagagccatgaagcat

SEQ ID NO: 747172 - DNA, 22 bp, Homo sapiens
gagagaggaggtttgcctgtga

SEQ ID NO: 747173 - DNA, 17 bp, Homo sapiens
gagagtcccagagcagg

SEQ ID NO: 747174 - DNA, 18 bp, Homo sapiens
gagagtcccagagcagga

SEQ ID NO: 747175 - DNA, 12 bp, Homo sapiens
gagagtgcactg

SEQ ID NO: 747176 - DNA, 16 bp, Homo sapiens
gagagtggctcctccc

SEQ ID NO: 747177 - DNA, 21 bp, Homo sapiens
gagagtggctcctcccggtgc

SEQ ID NO: 747178 - DNA, 13 bp, Homo sapiens
gagagtggggaga

SEQ ID NO: 747179 - DNA, 20 bp, Homo sapiens
gagagtgtgaaatagacatt

SEQ ID NO: 747180 - DNA, 16 bp, Homo sapiens
gagagtgtgagcaggg

SEQ ID NO: 747181 - DNA, 12 bp, Homo sapiens
gagagtgtgctc

SEQ ID NO: 747182 - DNA, 17 bp, Homo sapiens
gagagtgtgtgggcagg

SEQ ID NO: 747183 - DNA, 18 bp, Homo sapiens
gagagtgtgtgggcaggg

SEQ ID NO: 747184 - DNA, 14 bp, Homo sapiens
gagagttagcatgt

SEQ ID NO: 747185 - DNA, 23 bp, Homo sapiens
gagagttagcatgtatgaatgta

SEQ ID NO: 747186 - DNA, 16 bp, Homo sapiens
gagagttcaagcctgt

SEQ ID NO: 747187 - DNA, 20 bp, Homo sapiens
gagagttctttgctgcccct

SEQ ID NO: 747188 - DNA, 13 bp, Homo sapiens
gagagttggctca

SEQ ID NO: 747189 - DNA, 19 bp, Homo sapiens
gagagttggctcaggcaga

SEQ ID NO: 747190 - DNA, 21 bp, Homo sapiens
gagagttggctcaggcagaca

SEQ ID NO: 747191 - DNA, 17 bp, Homo sapiens
gagagttttgtcttgaa

SEQ ID NO: 747192 - DNA, 22 bp, Homo sapiens
gagagttttgtcttgaatgtct

SEQ ID NO: 747193 - DNA, 21 bp, Homo sapiens
gagataaaacagaatcttctg

SEQ ID NO: 747194 - DNA, 22 bp, Homo sapiens
gagataaacaccaacccaggaa

SEQ ID NO: 747195 - DNA, 19 bp, Homo sapiens
gagataaaccaataaatcc

SEQ ID NO: 747196 - DNA, 19 bp, Homo sapiens
gagataaatgcacatttca

SEQ ID NO: 747197 - DNA, 15 bp, Homo sapiens
gagataacagcctct

SEQ ID NO: 747198 - DNA, 13 bp, Homo sapiens
gagataataagat

SEQ ID NO: 747199 - DNA, 12 bp, Homo sapiens
gagataattgtt

SEQ ID NO: 747200 - DNA, 12 bp, Homo sapiens
gagatagcattg

SEQ ID NO: 747201 - DNA, 14 bp, Homo sapiens
gagatagctggggc

SEQ ID NO: 747202 - DNA, 13 bp, Homo sapiens
gagataggggagg

SEQ ID NO: 747203 - DNA, 21 bp, Homo sapiens
gagatagtgccaggtggctca

SEQ ID NO: 747204 - DNA, 18 bp, Homo sapiens
gagatatctgagggagga

SEQ ID NO: 747205 - DNA, 16 bp, Homo sapiens
gagatatggcagcgaa

SEQ ID NO: 747206 - DNA, 17 bp, Homo sapiens
gagatatggcagcgaaa

SEQ ID NO: 747207 - DNA, 14 bp, Homo sapiens
gagatattcttatt

SEQ ID NO: 747208 - DNA, 14 bp, Homo sapiens
gagatattgatatt

SEQ ID NO: 747209 - DNA, 22 bp, Homo sapiens
gagatatttacatgaattgcat

SEQ ID NO: 747210 - DNA, 22 bp, Homo sapiens
gagatatttatggggggagaac

SEQ ID NO: 747211 - DNA, 20 bp, Homo sapiens
gagatattttgtaaaatgta

SEQ ID NO: 747212 - DNA, 22 bp, Homo sapiens
gagatattttgtaaaatgtatt

SEQ ID NO: 747213 - DNA, 14 bp, Homo sapiens
gagatcaaagatga

SEQ ID NO: 747214 - DNA, 19 bp, Homo sapiens
gagatcacagcctccaggg

SEQ ID NO: 747215 - DNA, 21 bp, Homo sapiens
gagatcacagcctccagggcc

SEQ ID NO: 747216 - DNA, 16 bp, Homo sapiens
gagatcacgccactgc

SEQ ID NO: 747217 - DNA, 20 bp, Homo sapiens
gagatcacgccactgcactc

SEQ ID NO: 747218 - DNA, 14 bp, Homo sapiens
gagatcagcctggg

SEQ ID NO: 747219 - DNA, 16 bp, Homo sapiens
gagatcagcctgggca

SEQ ID NO: 747220 - DNA, 18 bp, Homo sapiens
gagatccagggcaaggcc

SEQ ID NO: 747221 - DNA, 15 bp, Homo sapiens
gagatcccctgagcc

SEQ ID NO: 747222 - DNA, 12 bp, Homo sapiens
gagatcctcctg

SEQ ID NO: 747223 - DNA, 23 bp, Homo sapiens
gagatcctcctgcagaccacgcc

SEQ ID NO: 747224 - DNA, 21 bp, Homo sapiens
gagatcgacaccatcctggct

SEQ ID NO: 747225 - DNA, 22 bp, Homo sapiens
gagatcgagaccatcctggcta

SEQ ID NO: 747226 - DNA, 21 bp, Homo sapiens
gagatcgcgccattgcactcc

SEQ ID NO: 747227 - DNA, 15 bp, Homo sapiens
gagatcgggaagcag

SEQ ID NO: 747228 - DNA, 19 bp, Homo sapiens
gagatctaagcctttccat

SEQ ID NO: 747229 - DNA, 13 bp, Homo sapiens
gagatctgaaggg

SEQ ID NO: 747230 - DNA, 14 bp, Homo sapiens
gagatctggggagg

SEQ ID NO: 747231 - DNA, 23 bp, Homo sapiens
gagatctggggaggcaggcattc

SEQ ID NO: 747232 - DNA, 12 bp, Homo sapiens
gagatctgtata

SEQ ID NO: 747233 - DNA, 22 bp, Homo sapiens
gagatctttctttccaaaacat

SEQ ID NO: 747234 - DNA, 18 bp, Homo sapiens
gagatgaccagggatgct

SEQ ID NO: 747235 - DNA, 22 bp, Homo sapiens
gagatgaccagggatgctgggc

SEQ ID NO: 747236 - DNA, 17 bp, Homo sapiens
gagatgacccctacccc

SEQ ID NO: 747237 - DNA, 21 bp, Homo sapiens
gagatgacccctaccccctca

SEQ ID NO: 747238 - DNA, 22 bp, Homo sapiens
gagatgacccctaccccctcat

SEQ ID NO: 747239 - DNA, 16 bp, Homo sapiens
gagatgactgagtcct

SEQ ID NO: 747240 - DNA, 21 bp, Homo sapiens
gagatgactgagtcctcgtag

SEQ ID NO: 747241 - DNA, 19 bp, Homo sapiens
gagatgaggagtaaaattc

SEQ ID NO: 747242 - DNA, 17 bp, Homo sapiens
gagatgaggccgccatg

SEQ ID NO: 747243 - DNA, 21 bp, Homo sapiens
gagatgagggatgggcctggc

SEQ ID NO: 747244 - DNA, 15 bp, Homo sapiens
gagatgagttgcagt

SEQ ID NO: 747245 - DNA, 20 bp, Homo sapiens
gagatgagttgcagttttta

SEQ ID NO: 747246 - DNA, 16 bp, Homo sapiens
gagatgagtttctggg

SEQ ID NO: 747247 - DNA, 22 bp, Homo sapiens
gagatgagtttctggggaaaaa

SEQ ID NO: 747248 - DNA, 12 bp, Homo sapiens
gagatgatcagt

SEQ ID NO: 747249 - DNA, 12 bp, Homo sapiens
gagatgatttcc

SEQ ID NO: 747250 - DNA, 19 bp, Homo sapiens
tagaataaaggcagttttc

SEQ ID NO: 747251 - DNA, 14 bp, Homo sapiens
tagaataaatgaag

SEQ ID NO: 747252 - DNA, 15 bp, Homo sapiens
tagaataatctcatc

SEQ ID NO: 747253 - DNA, 23 bp, Homo sapiens
tagaataatgtgggaagaaacaa

SEQ ID NO: 747254 - DNA, 14 bp, Homo sapiens
tagaatagcctgag

SEQ ID NO: 747255 - DNA, 15 bp, Homo sapiens
tagaatagcctgagg

SEQ ID NO: 747256 - DNA, 16 bp, Homo sapiens
tagaataggcacttta

SEQ ID NO: 747257 - DNA, 23 bp, Homo sapiens
tagaatagtgttctgcaaaaata

SEQ ID NO: 747258 - DNA, 15 bp, Homo sapiens
tagaatataattatc

SEQ ID NO: 747259 - DNA, 18 bp, Homo sapiens
tagaatataattatcgga

SEQ ID NO: 747260 - DNA, 14 bp, Homo sapiens
tagaatattcagac

SEQ ID NO: 747261 - DNA, 14 bp, Homo sapiens
tagaatcaatttaa

SEQ ID NO: 747262 - DNA, 15 bp, Homo sapiens
tagaatccaaacttg

SEQ ID NO: 747263 - DNA, 20 bp, Homo sapiens
tagaatctcttcatgcttga

SEQ ID NO: 747264 - DNA, 13 bp, Homo sapiens
tagaatcttttaa

SEQ ID NO: 747265 - DNA, 17 bp, Homo sapiens
tagaatgaatttatctt

SEQ ID NO: 747266 - DNA, 22 bp, Homo sapiens
tagaatgaatttatctttacca

SEQ ID NO: 747267 - DNA, 14 bp, Homo sapiens
tagaatgataaatg

SEQ ID NO: 747268 - DNA, 15 bp, Homo sapiens
tagaatgattaatca

SEQ ID NO: 747269 - DNA, 16 bp, Homo sapiens
tagaatgatttcatgc

SEQ ID NO: 747270 - DNA, 21 bp, Homo sapiens
tagaatgatttcatgctatct

SEQ ID NO: 747271 - DNA, 15 bp, Homo sapiens
tagaatgcatctcat

SEQ ID NO: 747272 - DNA, 17 bp, Homo sapiens
tagaatgcatctcatca

SEQ ID NO: 747273 - DNA, 19 bp, Homo sapiens
tagaatgcatctcatcaac

SEQ ID NO: 747274 - DNA, 19 bp, Homo sapiens
tagaatgcatgtaaggtct

SEQ ID NO: 747275 - DNA, 20 bp, Homo sapiens
tagaatgcatgtaaggtctt

SEQ ID NO: 747276 - DNA, 15 bp, Homo sapiens
tagaatgtcagattt

SEQ ID NO: 747277 - DNA, 17 bp, Homo sapiens
tagaatgtcagatttct

SEQ ID NO: 747278 - DNA, 19 bp, Homo sapiens
tagaatgtcagatttctgg

SEQ ID NO: 747279 - DNA, 20 bp, Homo sapiens
tagaatgtctgaagtacaaa

SEQ ID NO: 747280 - DNA, 23 bp, Homo sapiens
tagaatgtctgaagtacaaacat

SEQ ID NO: 747281 - DNA, 12 bp, Homo sapiens
tagaatgtgatt

SEQ ID NO: 747282 - DNA, 16 bp, Homo sapiens
tagaatgtttcatttg

SEQ ID NO: 747283 - DNA, 14 bp, Homo sapiens
tagaattaaaaaag

SEQ ID NO: 747284 - DNA, 13 bp, Homo sapiens
tagaattaccatt

SEQ ID NO: 747285 - DNA, 17 bp, Homo sapiens
tagaattaccatttgtt

SEQ ID NO: 747286 - DNA, 19 bp, Homo sapiens
tagaattaccatttgttaa

SEQ ID NO: 747287 - DNA, 22 bp, Homo sapiens
tagaattataactgtaaagatg

SEQ ID NO: 747288 - DNA, 19 bp, Homo sapiens
tagaattatctaatttata

SEQ ID NO: 747289 - DNA, 12 bp, Homo sapiens
tagaattattta

SEQ ID NO: 747290 - DNA, 15 bp, Homo sapiens
tagaattatttttca

SEQ ID NO: 747291 - DNA, 21 bp, Homo sapiens
tagaattccttcgaaaggcct

SEQ ID NO: 747292 - DNA, 22 bp, Homo sapiens
tagaattccttcgaaaggcctt

SEQ ID NO: 747293 - DNA, 20 bp, Homo sapiens
tagaattctagtgctgctga

SEQ ID NO: 747294 - DNA, 22 bp, Homo sapiens
tagaattctagtgctgctgaag

SEQ ID NO: 747295 - DNA, 19 bp, Homo sapiens
gagcagcttcttgggctga

SEQ ID NO: 747296 - DNA, 21 bp, Homo sapiens
gagcagctttaaactcaggga

SEQ ID NO: 747297 - DNA, 23 bp, Homo sapiens
gagcaggaagcattcagagagca

SEQ ID NO: 747298 - DNA, 18 bp, Homo sapiens
gagcaggacagccagcag

SEQ ID NO: 747299 - DNA, 23 bp, Homo sapiens
gagcaggacagccagcagcagga

SEQ ID NO: 747300 - DNA, 19 bp, Homo sapiens
gagcaggactccaggccca

SEQ ID NO: 747301 - DNA, 19 bp, Homo sapiens
gagcaggactctattttaa

SEQ ID NO: 747302 - DNA, 17 bp, Homo sapiens
gagcaggagcccctggg

SEQ ID NO: 747303 - DNA, 14 bp, Homo sapiens
gagcaggaggccaa

SEQ ID NO: 747304 - DNA, 16 bp, Homo sapiens
gagcaggaggcccctg

SEQ ID NO: 747305 - DNA, 21 bp, Homo sapiens
gagcaggaggcccctggccca

SEQ ID NO: 747306 - DNA, 21 bp, Homo sapiens
gagcaggcaaaaaagggacag

SEQ ID NO: 747307 - DNA, 18 bp, Homo sapiens
gagcaggctggcagctct

SEQ ID NO: 747308 - DNA, 19 bp, Homo sapiens
gagcaggctggcagctctc

SEQ ID NO: 747309 - DNA, 17 bp, Homo sapiens
gagcagggaaggcctga

SEQ ID NO: 747310 - DNA, 19 bp, Homo sapiens
gagcagggcttgctcctgc

SEQ ID NO: 747311 - DNA, 14 bp, Homo sapiens
gagcaggggagctt

SEQ ID NO: 747312 - DNA, 15 bp, Homo sapiens
gagcaggggagcttg

SEQ ID NO: 747313 - DNA, 12 bp, Homo sapiens
gagcaggggcag

SEQ ID NO: 747314 - DNA, 13 bp, Homo sapiens
gagcaggggctcc

SEQ ID NO: 747315 - DNA, 15 bp, Homo sapiens
gagcaggggctccag

SEQ ID NO: 747316 - DNA, 20 bp, Homo sapiens
gagcaggggtccttggtgtg

SEQ ID NO: 747317 - DNA, 16 bp, Homo sapiens
gagcagggtcaagcct

SEQ ID NO: 747318 - DNA, 12 bp, Homo sapiens
gagcagggtcct

SEQ ID NO: 747319 - DNA, 13 bp, Homo sapiens
gagcagggtcctg

SEQ ID NO: 747320 - DNA, 14 bp, Homo sapiens
gagcagggtggggt

SEQ ID NO: 747321 - DNA, 15 bp, Homo sapiens
gagcagggtggggtc

SEQ ID NO: 747322 - DNA, 19 bp, Homo sapiens
gagcagggtggggtctggg

SEQ ID NO: 747323 - DNA, 21 bp, Homo sapiens
gagcagggtggggtctgggag

SEQ ID NO: 747324 - DNA, 16 bp, Homo sapiens
gagcaggtgactgtgc

SEQ ID NO: 747325 - DNA, 21 bp, Homo sapiens
gagcaggtgactgtgctgtgc

SEQ ID NO: 747326 - DNA, 23 bp, Homo sapiens
gagcaggtgactgtgctgtgcag

SEQ ID NO: 747327 - DNA, 12 bp, Homo sapiens
gagcagtcacaa

SEQ ID NO: 747328 - DNA, 18 bp, Homo sapiens
gagcagtcagagtccagt

SEQ ID NO: 747329 - DNA, 21 bp, Homo sapiens
gagcagtcagagtccagtgct

SEQ ID NO: 747330 - DNA, 14 bp, Homo sapiens
gagcagtgggcagg

SEQ ID NO: 747331 - DNA, 17 bp, Homo sapiens
gagcagtgggcaggtgg

SEQ ID NO: 747332 - DNA, 18 bp, Homo sapiens
gagcagtgggcaggtggc

SEQ ID NO: 747333 - DNA, 19 bp, Homo sapiens
gagcagtgggcaggtggcc

SEQ ID NO: 747334 - DNA, 18 bp, Homo sapiens
gagcagtgtcttccataa

SEQ ID NO: 747335 - DNA, 16 bp, Homo sapiens
gagcagttcagagtgg

SEQ ID NO: 747336 - DNA, 21 bp, Homo sapiens
gagcagttggccaagcagaaa

SEQ ID NO: 747337 - DNA, 19 bp, Homo sapiens
gagcagttttcccctggcc

SEQ ID NO: 747338 - DNA, 17 bp, Homo sapiens
gagcatagaagccacat

SEQ ID NO: 747339 - DNA, 18 bp, Homo sapiens
gagcatagaagccacatc

SEQ ID NO: 747340 - DNA, 23 bp, Homo sapiens
gagcatatctggtatatgtcatt

SEQ ID NO: 747341 - DNA, 15 bp, Homo sapiens
gagcatcaatcttgt

SEQ ID NO: 747342 - DNA, 19 bp, Homo sapiens
gagcatcccggaggaaatc

SEQ ID NO: 747343 - DNA, 21 bp, Homo sapiens
gagcatccggccaaatgcaaa

SEQ ID NO: 747344 - DNA, 18 bp, Homo sapiens
gagcatgtatgtctgcag

SEQ ID NO: 747345 - DNA, 20 bp, Homo sapiens
gagcatgttgttttttcata

SEQ ID NO: 747346 - DNA, 21 bp, Homo sapiens
gagcattaactaaatgctcat

SEQ ID NO: 747347 - DNA, 16 bp, Homo sapiens
gagcattaagcccaat

SEQ ID NO: 747348 - DNA, 15 bp, Homo sapiens
gagcattggcccctg

SEQ ID NO: 747349 - DNA, 17 bp, Homo sapiens
gagcatttaatggcagc

SEQ ID NO: 747350 - DNA, 12 bp, Homo sapiens
gagcatttgcac

SEQ ID NO: 747351 - DNA, 18 bp, Homo sapiens
gagcatttgcacctctgt

SEQ ID NO: 747352 - DNA, 15 bp, Homo sapiens
gagcatttttaaggg

SEQ ID NO: 747353 - DNA, 20 bp, Homo sapiens
gagccaaaatgactttgaac

SEQ ID NO: 747354 - DNA, 20 bp, Homo sapiens
gagccaacagaagcttccat

SEQ ID NO: 747355 - DNA, 16 bp, Homo sapiens
gagccaacctcggctt

SEQ ID NO: 747356 - DNA, 16 bp, Homo sapiens
gagccaaggaggcctg

SEQ ID NO: 747357 - DNA, 22 bp, Homo sapiens
gagccaagggagggaagggcca

SEQ ID NO: 747358 - DNA, 23 bp, Homo sapiens
gagccaagggagggaagggccac

SEQ ID NO: 747359 - DNA, 23 bp, Homo sapiens
gagccaagggttcagagactcag

SEQ ID NO: 747360 - DNA, 20 bp, Homo sapiens
gagccaatccactccttcct

SEQ ID NO: 747361 - DNA, 18 bp, Homo sapiens
gagccacaagctgcactg

SEQ ID NO: 747362 - DNA, 20 bp, Homo sapiens
gagccacaagctgcactgtg

SEQ ID NO: 747363 - DNA, 20 bp, Homo sapiens
gagccacaggaacggccctg

SEQ ID NO: 747364 - DNA, 22 bp, Homo sapiens
gagccaccccatgagctcgggg

SEQ ID NO: 747365 - DNA, 16 bp, Homo sapiens
gagccaccgctgccag

SEQ ID NO: 747366 - DNA, 14 bp, Homo sapiens
gagccacctgcaag

SEQ ID NO: 747367 - DNA, 13 bp, Homo sapiens
gagccacctggat

SEQ ID NO: 747368 - DNA, 14 bp, Homo sapiens
gagccacctggatc

SEQ ID NO: 747369 - DNA, 19 bp, Homo sapiens
gagccacgcagtgcctgga

SEQ ID NO: 747370 - DNA, 22 bp, Homo sapiens
gagccacgcagtgcctggagtt

SEQ ID NO: 747371 - DNA, 20 bp, Homo sapiens
gagccactcagtctcttcca

SEQ ID NO: 747372 - DNA, 15 bp, Homo sapiens
gagccactcctgtcc

SEQ ID NO: 747373 - DNA, 16 bp, Homo sapiens
gagccactcctgtccc

SEQ ID NO: 747374 - DNA, 15 bp, Homo sapiens
gagccactgcacctg

SEQ ID NO: 747375 - DNA, 16 bp, Homo sapiens
gagccactgcgcccag

SEQ ID NO: 747376 - DNA, 13 bp, Homo sapiens
gagccactgggcc

SEQ ID NO: 747377 - DNA, 14 bp, Homo sapiens
gagccacttctccc

SEQ ID NO: 747378 - DNA, 19 bp, Homo sapiens
gagccacttctccccagaa

SEQ ID NO: 747379 - DNA, 17 bp, Homo sapiens
gagccagaaatgggcag

SEQ ID NO: 747380 - DNA, 19 bp, Homo sapiens
gagccagaaatgggcagtt

SEQ ID NO: 747381 - DNA, 23 bp, Homo sapiens
tagattgtccttttgcaaagaaa

SEQ ID NO: 747382 - DNA, 20 bp, Homo sapiens
tagatttagttttgtaactt

SEQ ID NO: 747383 - DNA, 11 bp, Homo sapiens
tagatttatgg

SEQ ID NO: 747384 - DNA, 14 bp, Homo sapiens
tagatttattttac

SEQ ID NO: 747385 - DNA, 15 bp, Homo sapiens
tagatttattttaca

SEQ ID NO: 747386 - DNA, 17 bp, Homo sapiens
tagatttattttacatt

SEQ ID NO: 747387 - DNA, 18 bp, Homo sapiens
tagatttcatagttcaga

SEQ ID NO: 747388 - DNA, 17 bp, Homo sapiens
tagatttgaaaaacttt

SEQ ID NO: 747389 - DNA, 14 bp, Homo sapiens
tagatttgaaaatt

SEQ ID NO: 747390 - DNA, 16 bp, Homo sapiens
tagatttgaaaattgt

SEQ ID NO: 747391 - DNA, 17 bp, Homo sapiens
tagattttattttacta

SEQ ID NO: 747392 - DNA, 13 bp, Homo sapiens
tagattttccaaa

SEQ ID NO: 747393 - DNA, 18 bp, Homo sapiens
tagatttttgattcagct

SEQ ID NO: 747394 - DNA, 21 bp, Homo sapiens
tagatttttgattcagctcat

SEQ ID NO: 747395 - DNA, 14 bp, Homo sapiens
tagcaaaaacatgt

SEQ ID NO: 747396 - DNA, 18 bp, Homo sapiens
tagcaaaaacatgtatgt

SEQ ID NO: 747397 - DNA, 16 bp, Homo sapiens
tagcaaaacaaattca

SEQ ID NO: 747398 - DNA, 21 bp, Homo sapiens
tagcaaaacaaattcaaataa

SEQ ID NO: 747399 - DNA, 23 bp, Homo sapiens
tagcaaaacgcatggagtgtgta

SEQ ID NO: 747400 - DNA, 16 bp, Homo sapiens
tagcaaaagaagaagt

SEQ ID NO: 747401 - DNA, 21 bp, Homo sapiens
tagcaaaataaaacatagcaa

SEQ ID NO: 747402 - DNA, 23 bp, Homo sapiens
tagcaaagaggttggagcaacaa

SEQ ID NO: 747403 - DNA, 21 bp, Homo sapiens
tagcaaagattaaatgtgtca

SEQ ID NO: 747404 - DNA, 19 bp, Homo sapiens
tagcaaatgcagaaccaca

SEQ ID NO: 747405 - DNA, 15 bp, Homo sapiens
tagcaacagagcact

SEQ ID NO: 747406 - DNA, 19 bp, Homo sapiens
tagcaacatatctctgccg

SEQ ID NO: 747407 - DNA, 18 bp, Homo sapiens
tagcaagacacatcccta

SEQ ID NO: 747408 - DNA, 17 bp, Homo sapiens
tagcaagacctgaaaat

SEQ ID NO: 747409 - DNA, 20 bp, Homo sapiens
tagcaagattgcttaaaata

SEQ ID NO: 747410 - DNA, 24 bp, Homo sapiens
tagcaagattgcttaaaatagcaa

SEQ ID NO: 747411 - DNA, 19 bp, Homo sapiens
tagcaagttctagagaaga

SEQ ID NO: 747412 - DNA, 21 bp, Homo sapiens
tagcaagttctagagaagagg

SEQ ID NO: 747413 - DNA, 17 bp, Homo sapiens
tagcaatggccagagcc

SEQ ID NO: 747414 - DNA, 20 bp, Homo sapiens
tagcaatggccagagcctct

SEQ ID NO: 747415 - DNA, 15 bp, Homo sapiens
tagcaattttctttg

SEQ ID NO: 747416 - DNA, 19 bp, Homo sapiens
tagcccttccagcctggga

SEQ ID NO: 747417 - DNA, 22 bp, Homo sapiens
tagcccttccagcctgggacac

SEQ ID NO: 747418 - DNA, 14 bp, Homo sapiens
tagcccttccctga

SEQ ID NO: 747419 - DNA, 14 bp, Homo sapiens
tagccctttctgtg

SEQ ID NO: 747420 - DNA, 17 bp, Homo sapiens
tagccgacctcagcctt

SEQ ID NO: 747421 - DNA, 17 bp, Homo sapiens
tagccgagagcctgctc

SEQ ID NO: 747422 - DNA, 19 bp, Homo sapiens
tagccgagagcctgctccc

SEQ ID NO: 747423 - DNA, 18 bp, Homo sapiens
tagccgtccatggcacca

SEQ ID NO: 747424 - DNA, 19 bp, Homo sapiens
tagccgtccatggcaccag

SEQ ID NO: 747425 - DNA, 20 bp, Homo sapiens
tagcctaaagggcagggccc

SEQ ID NO: 747426 - DNA, 24 bp, Homo sapiens
tagcctaaagtatacaactgcctg

SEQ ID NO: 747427 - DNA, 21 bp, Homo sapiens
tagcctaaggctcctgttttg

SEQ ID NO: 747428 - DNA, 20 bp, Homo sapiens
tagcctaatacaacatgtag

SEQ ID NO: 747429 - DNA, 21 bp, Homo sapiens
tagcctccgtttatgggcctt

SEQ ID NO: 747430 - DNA, 16 bp, Homo sapiens
tagcctctcccacccg

SEQ ID NO: 747431 - DNA, 23 bp, Homo sapiens
tagcctgatttggggtttcttca

SEQ ID NO: 747432 - DNA, 17 bp, Homo sapiens
tagcctgcctcttctct

SEQ ID NO: 747433 - DNA, 16 bp, Homo sapiens
tagcctggatggcccc

SEQ ID NO: 747434 - DNA, 22 bp, Homo sapiens
tagcctggatgtgggccaagtc

SEQ ID NO: 747435 - DNA, 17 bp, Homo sapiens
tagcctggccaccagcc

SEQ ID NO: 747436 - DNA, 14 bp, Homo sapiens
tagcctgtgctgga

SEQ ID NO: 747437 - DNA, 16 bp, Homo sapiens
tagccttatcctctga

SEQ ID NO: 747438 - DNA, 20 bp, Homo sapiens
tagccttatcctctgatctc

SEQ ID NO: 747439 - DNA, 15 bp, Homo sapiens
tagccttgcttgtta

SEQ ID NO: 747440 - DNA, 19 bp, Homo sapiens
tagccttgtgccctgcccc

SEQ ID NO: 747441 - DNA, 18 bp, Homo sapiens
tagcgaacgtatttctcc

SEQ ID NO: 747442 - DNA, 21 bp, Homo sapiens
tagcgaacgtatttctccaga

SEQ ID NO: 747443 - DNA, 14 bp, Homo sapiens
tagcgagctgctct

SEQ ID NO: 747444 - DNA, 18 bp, Homo sapiens
tagcgagctgctctgcta

SEQ ID NO: 747445 - DNA, 15 bp, Homo sapiens
tagcggagcccagcc

SEQ ID NO: 747446 - DNA, 18 bp, Homo sapiens
tagcggagcccagcctgg

SEQ ID NO: 747447 - DNA, 22 bp, Homo sapiens
tagcgggactcagtgagctggg

SEQ ID NO: 747448 - DNA, 15 bp, Homo sapiens
tagcgtcctgaggaa

SEQ ID NO: 747449 - DNA, 19 bp, Homo sapiens
tagcgtcctgaggaataaa

SEQ ID NO: 747450 - DNA, 19 bp, Homo sapiens
tagcgtgcccgtgtgcatg

SEQ ID NO: 747451 - DNA, 14 bp, Homo sapiens
tagcgttctggact

SEQ ID NO: 747452 - DNA, 16 bp, Homo sapiens
tagcgttcttgtaatt

SEQ ID NO: 747453 - DNA, 18 bp, Homo sapiens
tagcgttcttgtaatttt

SEQ ID NO: 747454 - DNA, 22 bp, Homo sapiens
tagcgtttaaggtgagcataaa

SEQ ID NO: 747455 - DNA, 17 bp, Homo sapiens
tagcgttttttaaatgt

SEQ ID NO: 747456 - DNA, 21 bp, Homo sapiens
tagctaataaaaagcttttgt

SEQ ID NO: 747457 - DNA, 22 bp, Homo sapiens
tagctaataaaaagcttttgtc

SEQ ID NO: 747458 - DNA, 13 bp, Homo sapiens
tagctaattattt

SEQ ID NO: 747459 - DNA, 15 bp, Homo sapiens
tagctacaatttgtt

SEQ ID NO: 747460 - DNA, 12 bp, Homo sapiens
tagctacactga

SEQ ID NO: 747461 - DNA, 23 bp, Homo sapiens
tagctacaggaagcaccccatgc

SEQ ID NO: 747462 - DNA, 19 bp, Homo sapiens
tagctagaaatatgatttt

SEQ ID NO: 747463 - DNA, 14 bp, Homo sapiens
tagctagaagtggg

SEQ ID NO: 747464 - DNA, 20 bp, Homo sapiens
tagctagaagtgggccagga

SEQ ID NO: 747465 - DNA, 18 bp, Homo sapiens
tagctagcaccatggcat

SEQ ID NO: 747466 - DNA, 15 bp, Homo sapiens
tagctagccagccaa

SEQ ID NO: 747467 - DNA, 19 bp, Homo sapiens
tagctagtttgctttttgc

SEQ ID NO: 747468 - DNA, 14 bp, Homo sapiens
tagctatatccatg

SEQ ID NO: 747469 - DNA, 20 bp, Homo sapiens
tagctatatccatgtactgt

SEQ ID NO: 747470 - DNA, 21 bp, Homo sapiens
tagctatatccatgtactgta

SEQ ID NO: 747471 - DNA, 17 bp, Homo sapiens
tagctattaagatactt

SEQ ID NO: 747472 - DNA, 14 bp, Homo sapiens
tagctattactgga

SEQ ID NO: 747473 - DNA, 15 bp, Homo sapiens
tagctattactggat

SEQ ID NO: 747474 - DNA, 14 bp, Homo sapiens
tagctattactgtc

SEQ ID NO: 747475 - DNA, 15 bp, Homo sapiens
tagctattactgtct

SEQ ID NO: 747476 - DNA, 18 bp, Homo sapiens
tagctattagcggctcct

SEQ ID NO: 747477 - DNA, 19 bp, Homo sapiens
tagctattagcggctcctc

SEQ ID NO: 747478 - DNA, 18 bp, Homo sapiens
tagctatttatccctttc

SEQ ID NO: 747479 - DNA, 11 bp, Homo sapiens
tagctattttc

SEQ ID NO: 747480 - DNA, 14 bp, Homo sapiens
tagctattttcctt

SEQ ID NO: 747481 - DNA, 22 bp, Homo sapiens
tagctcaagtttaaaagccatg

SEQ ID NO: 747482 - DNA, 17 bp, Homo sapiens
tagctcactgcagcctc

SEQ ID NO: 747483 - DNA, 18 bp, Homo sapiens
tagctcactgcagcctca

SEQ ID NO: 747484 - DNA, 16 bp, Homo sapiens
tagctcaggtgcctta

SEQ ID NO: 747485 - DNA, 11 bp, Homo sapiens
tagctcagtca

SEQ ID NO: 747486 - DNA, 18 bp, Homo sapiens
tagctcagtcatcaaagc

SEQ ID NO: 747487 - DNA, 12 bp, Homo sapiens
tagctcagttta

SEQ ID NO: 747488 - DNA, 12 bp, Homo sapiens
tagctcattctc

SEQ ID NO: 747489 - DNA, 21 bp, Homo sapiens
tagctccataaagtacaaatg

SEQ ID NO: 747490 - DNA, 21 bp, Homo sapiens
tagctccccgcttctgcctgc

SEQ ID NO: 747491 - DNA, 19 bp, Homo sapiens
tagctcccctgctgaggca

SEQ ID NO: 747492 - DNA, 23 bp, Homo sapiens
tagctcccgagctactctcttgc

SEQ ID NO: 747493 - DNA, 23 bp, Homo sapiens
tagctccctgtggggcaggagtg

SEQ ID NO: 747494 - DNA, 13 bp, Homo sapiens
tagctcctgtggc

SEQ ID NO: 747495 - DNA, 22 bp, Homo sapiens
tagctcctgtggccccaccctg

SEQ ID NO: 747496 - DNA, 23 bp, Homo sapiens
tagctctaatctaatatataaaa

SEQ ID NO: 747497 - DNA, 14 bp, Homo sapiens
tagctctctaggcc

SEQ ID NO: 747498 - DNA, 14 bp, Homo sapiens
tagctctgcctccc

SEQ ID NO: 747499 - DNA, 23 bp, Homo sapiens
tagctctggggtgggcagttttt

SEQ ID NO: 747500 - DNA, 23 bp, Homo sapiens
tagctgaaaactaatgtactgta

SEQ ID NO: 747501 - DNA, 23 bp, Homo sapiens
tagctgacccagccccttgagaa

SEQ ID NO: 747502 - DNA, 15 bp, Homo sapiens
tagctgagctttaaa

SEQ ID NO: 747503 - DNA, 12 bp, Homo sapiens
tagctgagggga

SEQ ID NO: 747504 - DNA, 13 bp, Homo sapiens
tagctggcaggac

SEQ ID NO: 747505 - DNA, 22 bp, Homo sapiens
tagctggctctgtgagggtgct

SEQ ID NO: 747506 - DNA, 16 bp, Homo sapiens
tagctgggattacagg

SEQ ID NO: 747507 - DNA, 18 bp, Homo sapiens
tagctgggattacaggca

SEQ ID NO: 747508 - DNA, 18 bp, Homo sapiens
tagctgggggtgggccag

SEQ ID NO: 747509 - DNA, 19 bp, Homo sapiens
tagctggtggttgtgcctt

SEQ ID NO: 747510 - DNA, 18 bp, Homo sapiens
tagctggtgtcagcccct

SEQ ID NO: 747511 - DNA, 17 bp, Homo sapiens
gagccctctgagccgcc

SEQ ID NO: 747512 - DNA, 22 bp, Homo sapiens
gagccctgaccttggctgactg

SEQ ID NO: 747513 - DNA, 22 bp, Homo sapiens
gagccctgactcctggactccg

SEQ ID NO: 747514 - DNA, 12 bp, Homo sapiens
gagccctgagga

SEQ ID NO: 747515 - DNA, 18 bp, Homo sapiens
gagccctgaggacctctc

SEQ ID NO: 747516 - DNA, 22 bp, Homo sapiens
gagccctgaggggctgggctgg

SEQ ID NO: 747517 - DNA, 12 bp, Homo sapiens
gagccctgccct

SEQ ID NO: 747518 - DNA, 12 bp, Homo sapiens
gagccctggctc

SEQ ID NO: 747519 - DNA, 14 bp, Homo sapiens
gagccctggctctg

SEQ ID NO: 747520 - DNA, 17 bp, Homo sapiens
gagccctggctctgccc

SEQ ID NO: 747521 - DNA, 20 bp, Homo sapiens
gagccctggctctgcccctc

SEQ ID NO: 747522 - DNA, 21 bp, Homo sapiens
gagccctggctctgcccctca

SEQ ID NO: 747523 - DNA, 22 bp, Homo sapiens
gagccctgtacccaccccagca

SEQ ID NO: 747524 - DNA, 21 bp, Homo sapiens
gagccctgtggccgccacctg

SEQ ID NO: 747525 - DNA, 17 bp, Homo sapiens
gagccctgttggcagct

SEQ ID NO: 747526 - DNA, 19 bp, Homo sapiens
gagcccttcactgccatga

SEQ ID NO: 747527 - DNA, 16 bp, Homo sapiens
gagcccttctctttga

SEQ ID NO: 747528 - DNA, 23 bp, Homo sapiens
gagcccttgactgtacagagact

SEQ ID NO: 747529 - DNA, 15 bp, Homo sapiens
gagcccttgcctccc

SEQ ID NO: 747530 - DNA, 22 bp, Homo sapiens
gagcccttgcctccccatttcc

SEQ ID NO: 747531 - DNA, 22 bp, Homo sapiens
gagccgacaatgccctgctggc

SEQ ID NO: 747532 - DNA, 21 bp, Homo sapiens
gagccgcatcttctccatctg

SEQ ID NO: 747533 - DNA, 23 bp, Homo sapiens
gagccgccactcccgggccaaga

SEQ ID NO: 747534 - DNA, 22 bp, Homo sapiens
gagccgcgggcgctcgctcagg

SEQ ID NO: 747535 - DNA, 12 bp, Homo sapiens
gagccgcgggga

SEQ ID NO: 747536 - DNA, 21 bp, Homo sapiens
gagccgcggggaagctggctt

SEQ ID NO: 747537 - DNA, 20 bp, Homo sapiens
gagctaagtcacccagagca

SEQ ID NO: 747538 - DNA, 15 bp, Homo sapiens
gagctaagttctaag

SEQ ID NO: 747539 - DNA, 20 bp, Homo sapiens
gagctacaacaaaaggactt

SEQ ID NO: 747540 - DNA, 13 bp, Homo sapiens
gagctactcagaa

SEQ ID NO: 747541 - DNA, 17 bp, Homo sapiens
gagctactctcttgcca

SEQ ID NO: 747542 - DNA, 21 bp, Homo sapiens
gagctactctcttgccagcat

SEQ ID NO: 747543 - DNA, 18 bp, Homo sapiens
gagctactgatgaaatct

SEQ ID NO: 747544 - DNA, 19 bp, Homo sapiens
gagctagaaaaataaaatg

SEQ ID NO: 747545 - DNA, 16 bp, Homo sapiens
gagctagctagcgcac

SEQ ID NO: 747546 - DNA, 17 bp, Homo sapiens
gagctagctagcgcacc

SEQ ID NO: 747547 - DNA, 16 bp, Homo sapiens
gagctagctgccactt

SEQ ID NO: 747548 - DNA, 16 bp, Homo sapiens
gagctagggctgctgc

SEQ ID NO: 747549 - DNA, 17 bp, Homo sapiens
gagctagggctgctgct

SEQ ID NO: 747550 - DNA, 16 bp, Homo sapiens
gagctatgttccctcc

SEQ ID NO: 747551 - DNA, 19 bp, Homo sapiens
gagctatttccattccaga

SEQ ID NO: 747552 - DNA, 20 bp, Homo sapiens
gagctatttccattccagaa

SEQ ID NO: 747553 - DNA, 21 bp, Homo sapiens
gagctatttccattccagaat

SEQ ID NO: 747554 - DNA, 20 bp, Homo sapiens
gagctcaagcccttggggag

SEQ ID NO: 747555 - DNA, 23 bp, Homo sapiens
gagctcaccctgcccgctcccaa

SEQ ID NO: 747556 - DNA, 21 bp, Homo sapiens
gagctcagacccccactctca

SEQ ID NO: 747557 - DNA, 23 bp, Homo sapiens
gagctcagccccgagctgtcccc

SEQ ID NO: 747558 - DNA, 14 bp, Homo sapiens
gagctcatcccccc

SEQ ID NO: 747559 - DNA, 23 bp, Homo sapiens
gagctcatcccccctgctgccca

SEQ ID NO: 747560 - DNA, 14 bp, Homo sapiens
gagctcatgtcagc

SEQ ID NO: 747561 - DNA, 14 bp, Homo sapiens
gagctcattctgtc

SEQ ID NO: 747562 - DNA, 15 bp, Homo sapiens
gagctccacctctgg

SEQ ID NO: 747563 - DNA, 20 bp, Homo sapiens
gagctccacctctggtggct

SEQ ID NO: 747564 - DNA, 12 bp, Homo sapiens
gagctccactct

SEQ ID NO: 747565 - DNA, 16 bp, Homo sapiens
gagctccactctgctt

SEQ ID NO: 747566 - DNA, 18 bp, Homo sapiens
gagctccactctgcttct

SEQ ID NO: 747567 - DNA, 13 bp, Homo sapiens
gagctccagaccc

SEQ ID NO: 747568 - DNA, 18 bp, Homo sapiens
gagctcccacctcccttc

SEQ ID NO: 747569 - DNA, 22 bp, Homo sapiens
gagctccccagatctcccactg

SEQ ID NO: 747570 - DNA, 21 bp, Homo sapiens
gagctcccctccacagctgca

SEQ ID NO: 747571 - DNA, 21 bp, Homo sapiens
gagctcccgaggaagcacagc

SEQ ID NO: 747572 - DNA, 13 bp, Homo sapiens
gagctcctcttcc

SEQ ID NO: 747573 - DNA, 21 bp, Homo sapiens
gagctcctgggacccttggct

SEQ ID NO: 747574 - DNA, 12 bp, Homo sapiens
gagctcctgggg

SEQ ID NO: 747575 - DNA, 17 bp, Homo sapiens
gagctcctggggagctc

SEQ ID NO: 747576 - DNA, 20 bp, Homo sapiens
gagctcctggggagctcctg

SEQ ID NO: 747577 - DNA, 14 bp, Homo sapiens
gagctcgcccctcc

SEQ ID NO: 747578 - DNA, 19 bp, Homo sapiens
gagctcggggtccaccagt

SEQ ID NO: 747579 - DNA, 22 bp, Homo sapiens
gagctcgtgtatcctggggctc

SEQ ID NO: 747580 - DNA, 17 bp, Homo sapiens
gagctctccaggccagg

SEQ ID NO: 747581 - DNA, 19 bp, Homo sapiens
gagctctccaggccaggtg

SEQ ID NO: 747582 - DNA, 22 bp, Homo sapiens
gagctctcccctcctgctgggc

SEQ ID NO: 747583 - DNA, 19 bp, Homo sapiens
gagctctcgaggaaagtgg

SEQ ID NO: 747584 - DNA, 16 bp, Homo sapiens
gagctctgcagagcag

SEQ ID NO: 747585 - DNA, 14 bp, Homo sapiens
gagctctgcgccag

SEQ ID NO: 747586 - DNA, 19 bp, Homo sapiens
gagctctgcgccaggcaga

SEQ ID NO: 747587 - DNA, 13 bp, Homo sapiens
gagctctggggac

SEQ ID NO: 747588 - DNA, 15 bp, Homo sapiens
gagctctggggacag

SEQ ID NO: 747589 - DNA, 18 bp, Homo sapiens
gagctctggggacagctt

SEQ ID NO: 747590 - DNA, 23 bp, Homo sapiens
gagctctggggacagcttcctca

SEQ ID NO: 747591 - DNA, 14 bp, Homo sapiens
gagctctgtaactt

SEQ ID NO: 747592 - DNA, 22 bp, Homo sapiens
gagctctgtaacttacacctgg

SEQ ID NO: 747593 - DNA, 21 bp, Homo sapiens
gagctgaacacatttgcccaa

SEQ ID NO: 747594 - DNA, 15 bp, Homo sapiens
gagctgaaccttgag

SEQ ID NO: 747595 - DNA, 21 bp, Homo sapiens
gagctgagaagaggaggaggt

SEQ ID NO: 747596 - DNA, 22 bp, Homo sapiens
gagctgagaagaggaggaggtg

SEQ ID NO: 747597 - DNA, 17 bp, Homo sapiens
gagctgagcctctcacc

SEQ ID NO: 747598 - DNA, 19 bp, Homo sapiens
gagctgaggatttcctgga

SEQ ID NO: 747599 - DNA, 21 bp, Homo sapiens
gagctgaggatttcctggagt

SEQ ID NO: 747600 - DNA, 17 bp, Homo sapiens
gagctgaggccacactc

SEQ ID NO: 747601 - DNA, 12 bp, Homo sapiens
gagctgagggag

SEQ ID NO: 747602 - DNA, 15 bp, Homo sapiens
gagctgagggaggga

SEQ ID NO: 747603 - DNA, 17 bp, Homo sapiens
gagctgagggagggagc

SEQ ID NO: 747604 - DNA, 20 bp, Homo sapiens
gagctgagggagggagccat

SEQ ID NO: 747605 - DNA, 22 bp, Homo sapiens
gagctgagggagggagccatgg

SEQ ID NO: 747606 - DNA, 15 bp, Homo sapiens
gagctgagggccctg

SEQ ID NO: 747607 - DNA, 14 bp, Homo sapiens
gagctgaggtttca

SEQ ID NO: 747608 - DNA, 15 bp, Homo sapiens
gagctgagtcacctc

SEQ ID NO: 747609 - DNA, 17 bp, Homo sapiens
gagctgagtcacctcct

SEQ ID NO: 747610 - DNA, 15 bp, Homo sapiens
gagctgagtggggga

SEQ ID NO: 747611 - DNA, 21 bp, Homo sapiens
gagctgcacaaagtcagcagg

SEQ ID NO: 747612 - DNA, 14 bp, Homo sapiens
gagctgcagaatga

SEQ ID NO: 747613 - DNA, 13 bp, Homo sapiens
gagctgccacaga

SEQ ID NO: 747614 - DNA, 17 bp, Homo sapiens
gagctgccagaatcagg

SEQ ID NO: 747615 - DNA, 21 bp, Homo sapiens
gagctgcccagagttgctggg

SEQ ID NO: 747616 - DNA, 18 bp, Homo sapiens
gagctgcccggcgcctgc

SEQ ID NO: 747617 - DNA, 22 bp, Homo sapiens
gagctgcccggcgcctgccctg

SEQ ID NO: 747618 - DNA, 14 bp, Homo sapiens
gagctgcctcctgg

SEQ ID NO: 747619 - DNA, 12 bp, Homo sapiens
gagctgcctgca

SEQ ID NO: 747620 - DNA, 20 bp, Homo sapiens
gagctgcctgcagcacatgc

SEQ ID NO: 747621 - DNA, 23 bp, Homo sapiens
gagctgccttccctagctttaga

SEQ ID NO: 747622 - DNA, 18 bp, Homo sapiens
gagctgccttggctcaga

SEQ ID NO: 747623 - DNA, 12 bp, Homo sapiens
gagctgctggct

SEQ ID NO: 747624 - DNA, 17 bp, Homo sapiens
gagctgctgtgcccagc

SEQ ID NO: 747625 - DNA, 16 bp, Homo sapiens
gagctgctttgtgggc

SEQ ID NO: 747626 - DNA, 18 bp, Homo sapiens
gagctggaaggcagggca

SEQ ID NO: 747627 - DNA, 22 bp, Homo sapiens
gagctggaaggggccacgtgga

SEQ ID NO: 747628 - DNA, 22 bp, Homo sapiens
gagctggagatgaggccagacc

SEQ ID NO: 747629 - DNA, 18 bp, Homo sapiens
gagctggagcccccagca

SEQ ID NO: 747630 - DNA, 21 bp, Homo sapiens
gagctggatagacttgggatg

SEQ ID NO: 747631 - DNA, 20 bp, Homo sapiens
gagctggcaaaggtggctct

SEQ ID NO: 747632 - DNA, 22 bp, Homo sapiens
gagctggccaaagagcctttcc

SEQ ID NO: 747633 - DNA, 23 bp, Homo sapiens
gagctggccaaagagcctttcca

SEQ ID NO: 747634 - DNA, 12 bp, Homo sapiens
gagctggcctcc

SEQ ID NO: 747635 - DNA, 15 bp, Homo sapiens
gagctggcctccccc

SEQ ID NO: 747636 - DNA, 16 bp, Homo sapiens
gagctggcctctctag

SEQ ID NO: 747637 - DNA, 17 bp, Homo sapiens
gagctggctctgagcgc

SEQ ID NO: 747638 - DNA, 14 bp, Homo sapiens
gagctggctgtgcc

SEQ ID NO: 747639 - DNA, 19 bp, Homo sapiens
gagctggctgtgcctgctt

SEQ ID NO: 747640 - DNA, 19 bp, Homo sapiens
taggatgtatattttatat

SEQ ID NO: 747641 - DNA, 15 bp, Homo sapiens
taggatgtgatgatg

SEQ ID NO: 747642 - DNA, 15 bp, Homo sapiens
taggatgttgcttct

SEQ ID NO: 747643 - DNA, 17 bp, Homo sapiens
taggatgttgcttctga

SEQ ID NO: 747644 - DNA, 19 bp, Homo sapiens
taggatgttgcttctgaat

SEQ ID NO: 747645 - DNA, 22 bp, Homo sapiens
taggatgttgcttctgaatcac

SEQ ID NO: 747646 - DNA, 13 bp, Homo sapiens
taggattcagatc

SEQ ID NO: 747647 - DNA, 19 bp, Homo sapiens
taggattctgttccctggg

SEQ ID NO: 747648 - DNA, 21 bp, Homo sapiens
taggatttaacagtcatttaa

SEQ ID NO: 747649 - DNA, 22 bp, Homo sapiens
taggattttcacattcttggct

SEQ ID NO: 747650 - DNA, 15 bp, Homo sapiens
taggcaaagtacaaa

SEQ ID NO: 747651 - DNA, 16 bp, Homo sapiens
taggcaaagtacaaaa

SEQ ID NO: 747652 - DNA, 17 bp, Homo sapiens
taggcactttaaaacac

SEQ ID NO: 747653 - DNA, 15 bp, Homo sapiens
taggcagacacaggg

SEQ ID NO: 747654 - DNA, 17 bp, Homo sapiens
taggcagactgggtttc

SEQ ID NO: 747655 - DNA, 13 bp, Homo sapiens
taggcagagcctt

SEQ ID NO: 747656 - DNA, 16 bp, Homo sapiens
taggcagagcctttgg

SEQ ID NO: 747657 - DNA, 12 bp, Homo sapiens
taggcagcctgc

SEQ ID NO: 747658 - DNA, 18 bp, Homo sapiens
gaggacaggctctagaga

SEQ ID NO: 747659 - DNA, 16 bp, Homo sapiens
gaggacatcaaagtgg

SEQ ID NO: 747660 - DNA, 18 bp, Homo sapiens
gaggacatgatggagcgc

SEQ ID NO: 747661 - DNA, 17 bp, Homo sapiens
gaggacatgcgtgtgtc

SEQ ID NO: 747662 - DNA, 15 bp, Homo sapiens
gaggaccagggccct

SEQ ID NO: 747663 - DNA, 15 bp, Homo sapiens
gaggaccagggtgga

SEQ ID NO: 747664 - DNA, 15 bp, Homo sapiens
gaggacccaggacag

SEQ ID NO: 747665 - DNA, 15 bp, Homo sapiens
gaggaccccagggtg

SEQ ID NO: 747666 - DNA, 16 bp, Homo sapiens
gaggaccccagggtgg

SEQ ID NO: 747667 - DNA, 21 bp, Homo sapiens
gaggaccccgagggctgagga

SEQ ID NO: 747668 - DNA, 17 bp, Homo sapiens
gaggacccctgccttcc

SEQ ID NO: 747669 - DNA, 21 bp, Homo sapiens
gaggacccctgccttcctctg

SEQ ID NO: 747670 - DNA, 14 bp, Homo sapiens
gaggaccccttaat

SEQ ID NO: 747671 - DNA, 21 bp, Homo sapiens
gaggacccttacgtgagaaat

SEQ ID NO: 747672 - DNA, 20 bp, Homo sapiens
gaggacctgagtttgggaga

SEQ ID NO: 747673 - DNA, 17 bp, Homo sapiens
gaggacctggggcacag

SEQ ID NO: 747674 - DNA, 19 bp, Homo sapiens
gaggaccttatctgtgcgt

SEQ ID NO: 747675 - DNA, 20 bp, Homo sapiens
gaggacgcacgctcgctgcc

SEQ ID NO: 747676 - DNA, 15 bp, Homo sapiens
gaggacggccctgcc

SEQ ID NO: 747677 - DNA, 17 bp, Homo sapiens
gaggacggccctgcctg

SEQ ID NO: 747678 - DNA, 22 bp, Homo sapiens
gaggacgtcatcggaggctggg

SEQ ID NO: 747679 - DNA, 19 bp, Homo sapiens
gaggacgtgttacccactg

SEQ ID NO: 747680 - DNA, 18 bp, Homo sapiens
gaggactccaggcagcag

SEQ ID NO: 747681 - DNA, 21 bp, Homo sapiens
gaggactcccaaccctggctt

SEQ ID NO: 747682 - DNA, 18 bp, Homo sapiens
gaggactccgggaccatt

SEQ ID NO: 747683 - DNA, 15 bp, Homo sapiens
gaggactcggccact

SEQ ID NO: 747684 - DNA, 16 bp, Homo sapiens
gaggactcggccactg

SEQ ID NO: 747685 - DNA, 18 bp, Homo sapiens
gaggactcggccactgtg

SEQ ID NO: 747686 - DNA, 21 bp, Homo sapiens
gaggactcggccactgtgtct

SEQ ID NO: 747687 - DNA, 13 bp, Homo sapiens
gaggactgagccc

SEQ ID NO: 747688 - DNA, 21 bp, Homo sapiens
gaggactgtcctcccacagac

SEQ ID NO: 747689 - DNA, 15 bp, Homo sapiens
gaggactgtgacaga

SEQ ID NO: 747690 - DNA, 22 bp, Homo sapiens
gaggacttggagggtctggggg

SEQ ID NO: 747691 - DNA, 14 bp, Homo sapiens
gaggacttgtgtct

SEQ ID NO: 747692 - DNA, 16 bp, Homo sapiens
gaggacttgtgtctct

SEQ ID NO: 747693 - DNA, 20 bp, Homo sapiens
gaggagaaaaaaaaagtgaa

SEQ ID NO: 747694 - DNA, 20 bp, Homo sapiens
gaggagaaatgcaataactc

SEQ ID NO: 747695 - DNA, 22 bp, Homo sapiens
gaggagaagaattttcagaccc

SEQ ID NO: 747696 - DNA, 14 bp, Homo sapiens
gaggagaccagcgg

SEQ ID NO: 747697 - DNA, 21 bp, Homo sapiens
gaggagaccagcggtccatgg

SEQ ID NO: 747698 - DNA, 22 bp, Homo sapiens
gaggagaccagcggtccatggg

SEQ ID NO: 747699 - DNA, 13 bp, Homo sapiens
gaggagaccctgg

SEQ ID NO: 747700 - DNA, 23 bp, Homo sapiens
gaggagacgaagtgaaaacaaat

SEQ ID NO: 747701 - DNA, 23 bp, Homo sapiens
gaggagacggaggggagtagaga

SEQ ID NO: 747702 - DNA, 15 bp, Homo sapiens
gaggagagtcccaga

SEQ ID NO: 747703 - DNA, 18 bp, Homo sapiens
gaggagatgttgagggga

SEQ ID NO: 747704 - DNA, 18 bp, Homo sapiens
gaggagcagcagcttggg

SEQ ID NO: 747705 - DNA, 18 bp, Homo sapiens
gaggagccagccaggggt

SEQ ID NO: 747706 - DNA, 18 bp, Homo sapiens
gaggagcccagtgggctg

SEQ ID NO: 747707 - DNA, 16 bp, Homo sapiens
gaggagccttgctggg

SEQ ID NO: 747708 - DNA, 18 bp, Homo sapiens
gaggagccttgctgggcc

SEQ ID NO: 747709 - DNA, 16 bp, Homo sapiens
gaggagcgcaggcagc

SEQ ID NO: 747710 - DNA, 16 bp, Homo sapiens
gaggagctctccccct

SEQ ID NO: 747711 - DNA, 22 bp, Homo sapiens
gaggagctgagggagggagcca

SEQ ID NO: 747712 - DNA, 15 bp, Homo sapiens
gaggagctgctggct

SEQ ID NO: 747713 - DNA, 13 bp, Homo sapiens
gaggagctgggcc

SEQ ID NO: 747714 - DNA, 14 bp, Homo sapiens
gaggaggaaaagaa

SEQ ID NO: 747715 - DNA, 14 bp, Homo sapiens
gaggaggaaaagga

SEQ ID NO: 747716 - DNA, 22 bp, Homo sapiens
gaggaggaacgggcagccacag

SEQ ID NO: 747717 - DNA, 23 bp, Homo sapiens
gaggaggaacgggcagccacagg

SEQ ID NO: 747718 - DNA, 15 bp, Homo sapiens
gaggaggaagaccat

SEQ ID NO: 747719 - DNA, 19 bp, Homo sapiens
gaggaggaagagggtagac

SEQ ID NO: 747720 - DNA, 13 bp, Homo sapiens
gaggaggaagccg

SEQ ID NO: 747721 - DNA, 14 bp, Homo sapiens
gaggaggaagccgt

SEQ ID NO: 747722 - DNA, 13 bp, Homo sapiens
gaggaggaaggca

SEQ ID NO: 747723 - DNA, 16 bp, Homo sapiens
gaggaggaaggcaaga

SEQ ID NO: 747724 - DNA, 14 bp, Homo sapiens
gaggaggagagagt

SEQ ID NO: 747725 - DNA, 15 bp, Homo sapiens
gaggaggaggacaca

SEQ ID NO: 747726 - DNA, 16 bp, Homo sapiens
gaggaggaggacacag

SEQ ID NO: 747727 - DNA, 16 bp, Homo sapiens
gaggaggaggagaagg

SEQ ID NO: 747728 - DNA, 14 bp, Homo sapiens
gaggaggaggagga

SEQ ID NO: 747729 - DNA, 12 bp, Homo sapiens
gaggaggccacc

SEQ ID NO: 747730 - DNA, 16 bp, Homo sapiens
gaggaggccacctctc

SEQ ID NO: 747731 - DNA, 19 bp, Homo sapiens
gaggaggccacctctccaa

SEQ ID NO: 747732 - DNA, 20 bp, Homo sapiens
gaggaggccacctctccaag

SEQ ID NO: 747733 - DNA, 13 bp, Homo sapiens
gaggaggcctgga

SEQ ID NO: 747734 - DNA, 18 bp, Homo sapiens
gaggaggcctggaccgag

SEQ ID NO: 747735 - DNA, 17 bp, Homo sapiens
gaggaggctggtgacag

SEQ ID NO: 747736 - DNA, 17 bp, Homo sapiens
gaggagggagagggagg

SEQ ID NO: 747737 - DNA, 14 bp, Homo sapiens
gaggagggaggcca

SEQ ID NO: 747738 - DNA, 16 bp, Homo sapiens
gaggagggaggccagg

SEQ ID NO: 747739 - DNA, 13 bp, Homo sapiens
gaggagggcagag

SEQ ID NO: 747740 - DNA, 13 bp, Homo sapiens
gaggagggcatgg

SEQ ID NO: 747741 - DNA, 18 bp, Homo sapiens
gaggagggcatgggttgg

SEQ ID NO: 747742 - DNA, 15 bp, Homo sapiens
gaggaggggaagaag

SEQ ID NO: 747743 - DNA, 13 bp, Homo sapiens
gaggaggggaagc

SEQ ID NO: 747744 - DNA, 12 bp, Homo sapiens
gaggaggggagg

SEQ ID NO: 747745 - DNA, 17 bp, Homo sapiens
gaggaggggccgctgcc

SEQ ID NO: 747746 - DNA, 12 bp, Homo sapiens
gaggagggtggg

SEQ ID NO: 747747 - DNA, 17 bp, Homo sapiens
gaggagggtgggggagg

SEQ ID NO: 747748 - DNA, 20 bp, Homo sapiens
gaggaggtggcagccctgta

SEQ ID NO: 747749 - DNA, 15 bp, Homo sapiens
gaggaggtttgcctg

SEQ ID NO: 747750 - DNA, 11 bp, Homo sapiens
gaggagtaaca

SEQ ID NO: 747751 - DNA, 17 bp, Homo sapiens
gaggagtaagtgtacaa

SEQ ID NO: 747752 - DNA, 18 bp, Homo sapiens
gaggagtgacatgaagca

SEQ ID NO: 747753 - DNA, 14 bp, Homo sapiens
gaggagtggaggtg

SEQ ID NO: 747754 - DNA, 18 bp, Homo sapiens
gaggataaaaaggaagga

SEQ ID NO: 747755 - DNA, 21 bp, Homo sapiens
gaggatacatttaataaaact

SEQ ID NO: 747756 - DNA, 16 bp, Homo sapiens
gaggatcactggagcc

SEQ ID NO: 747757 - DNA, 17 bp, Homo sapiens
gaggatcactggagccc

SEQ ID NO: 747758 - DNA, 22 bp, Homo sapiens
gaggatctcttgagcctgggag

SEQ ID NO: 747759 - DNA, 13 bp, Homo sapiens
gaggatgagctgg

SEQ ID NO: 747760 - DNA, 19 bp, Homo sapiens
gaggatgccttttctgtga

SEQ ID NO: 747761 - DNA, 16 bp, Homo sapiens
gaggatgctgcagtga

SEQ ID NO: 747762 - DNA, 12 bp, Homo sapiens
gaggatggagag

SEQ ID NO: 747763 - DNA, 17 bp, Homo sapiens
gaggatgggatgtattt

SEQ ID NO: 747764 - DNA, 22 bp, Homo sapiens
gaggatgggatgtatttttctt

SEQ ID NO: 747765 - DNA, 13 bp, Homo sapiens
gaggatgtccctg

SEQ ID NO: 747766 - DNA, 14 bp, Homo sapiens
gaggatgtgggcag

SEQ ID NO: 747767 - DNA, 22 bp, Homo sapiens
gaggattaagggacgggggtgg

SEQ ID NO: 747768 - DNA, 13 bp, Homo sapiens
gaggattctttcc

SEQ ID NO: 747769 - DNA, 17 bp, Homo sapiens
gaggattctttccccag

SEQ ID NO: 747770 - DNA, 19 bp, Homo sapiens
gaggattgcttgagcccag

SEQ ID NO: 747771 - DNA, 16 bp, Homo sapiens
gaggattgcttgagct

SEQ ID NO: 747772 - DNA, 23 bp, Homo sapiens
gaggattgtggaaaaccaggaaa

SEQ ID NO: 747773 - DNA, 23 bp, Homo sapiens
tagtatttaactacatctgcctc

SEQ ID NO: 747774 - DNA, 13 bp, Homo sapiens
tagtatttctcag

SEQ ID NO: 747775 - DNA, 20 bp, Homo sapiens
tagtatttgattcaaaatat

SEQ ID NO: 747776 - DNA, 23 bp, Homo sapiens
tagtatttgattcaaaatattta

SEQ ID NO: 747777 - DNA, 18 bp, Homo sapiens
tagtattttttacatttt

SEQ ID NO: 747778 - DNA, 18 bp, Homo sapiens
tagtcaatggcttgttca

SEQ ID NO: 747779 - DNA, 18 bp, Homo sapiens
tagtcaccagagacttta

SEQ ID NO: 747780 - DNA, 19 bp, Homo sapiens
tagtgtgacagtttccaaa

SEQ ID NO: 747781 - DNA, 22 bp, Homo sapiens
tagtgtgagtggcagccatgcc

SEQ ID NO: 747782 - DNA, 22 bp, Homo sapiens
tagtgtggaaattaagaagaaa

SEQ ID NO: 747783 - DNA, 19 bp, Homo sapiens
tagtgtgtgtgcatgtgtg

SEQ ID NO: 747784 - DNA, 20 bp, Homo sapiens
tagtgtgttgtgctttcaag

SEQ ID NO: 747785 - DNA, 17 bp, Homo sapiens
tagtgttcacaaactgt

SEQ ID NO: 747786 - DNA, 19 bp, Homo sapiens
tagtgttcacaaactgtga

SEQ ID NO: 747787 - DNA, 20 bp, Homo sapiens
tagtgttcacaaactgtgaa

SEQ ID NO: 747788 - DNA, 15 bp, Homo sapiens
tagtgttctgctcct

SEQ ID NO: 747789 - DNA, 16 bp, Homo sapiens
tagtgttctgctcctg

SEQ ID NO: 747790 - DNA, 17 bp, Homo sapiens
tagtgttctgctcctgc

SEQ ID NO: 747791 - DNA, 19 bp, Homo sapiens
tagtgttctgctcctgctt

SEQ ID NO: 747792 - DNA, 14 bp, Homo sapiens
tagtgtttaactgg

SEQ ID NO: 747793 - DNA, 17 bp, Homo sapiens
tagtgtttctagctaaa

SEQ ID NO: 747794 - DNA, 21 bp, Homo sapiens
tagtgttttcaattttaaaca

SEQ ID NO: 747795 - DNA, 23 bp, Homo sapiens
tagtgtttttttatttctactgt

SEQ ID NO: 747796 - DNA, 19 bp, Homo sapiens
tagttaaaagactgcagct

SEQ ID NO: 747797 - DNA, 16 bp, Homo sapiens
tagttaaataactgtg

SEQ ID NO: 747798 - DNA, 14 bp, Homo sapiens
tagttaacacacta

SEQ ID NO: 747799 - DNA, 19 bp, Homo sapiens
tagttaagacatgatttcc

SEQ ID NO: 747800 - DNA, 23 bp, Homo sapiens
tagttaagacatgatttccttga

SEQ ID NO: 747801 - DNA, 23 bp, Homo sapiens
tagttaatattgtgaagaaaaat

SEQ ID NO: 747802 - DNA, 21 bp, Homo sapiens
tagttaccgagacatgaatac

SEQ ID NO: 747803 - DNA, 21 bp, Homo sapiens
tagttaccttatagttactgt

SEQ ID NO: 747804 - DNA, 22 bp, Homo sapiens
tagttaccttatagttactgtg

SEQ ID NO: 747805 - DNA, 18 bp, Homo sapiens
tagttactgtgtaattag

SEQ ID NO: 747806 - DNA, 19 bp, Homo sapiens
tagttactgtgtaattagt

SEQ ID NO: 747807 - DNA, 22 bp, Homo sapiens
tagttaggaaataaaacctttc

SEQ ID NO: 747808 - DNA, 23 bp, Homo sapiens
tagttaggaaataaaacctttca

SEQ ID NO: 747809 - DNA, 20 bp, Homo sapiens
tagttaggatagcatttttg

SEQ ID NO: 747810 - DNA, 17 bp, Homo sapiens
tagttatagtgtttaac

SEQ ID NO: 747811 - DNA, 15 bp, Homo sapiens
tagttatagtttcag

SEQ ID NO: 747812 - DNA, 15 bp, Homo sapiens
tagttatataattgt

SEQ ID NO: 747813 - DNA, 15 bp, Homo sapiens
tagttcaatacagtg

SEQ ID NO: 747814 - DNA, 19 bp, Homo sapiens
tagttcaatatttgttact

SEQ ID NO: 747815 - DNA, 16 bp, Homo sapiens
tagttcagaatttagt

SEQ ID NO: 747816 - DNA, 19 bp, Homo sapiens
tagttcagacactttggaa

SEQ ID NO: 747817 - DNA, 14 bp, Homo sapiens
tagttcagcaaaac

SEQ ID NO: 747818 - DNA, 19 bp, Homo sapiens
tagttcagtagaattacca

SEQ ID NO: 747819 - DNA, 21 bp, Homo sapiens
tagttccagaaaacctctcct

SEQ ID NO: 747820 - DNA, 20 bp, Homo sapiens
tagttccagtttctccttga

SEQ ID NO: 747821 - DNA, 23 bp, Homo sapiens
tagttccctgaaaacccagagag

SEQ ID NO: 747822 - DNA, 12 bp, Homo sapiens
tagttccctttg

SEQ ID NO: 747823 - DNA, 20 bp, Homo sapiens
tagttccctttgccaacaga

SEQ ID NO: 747824 - DNA, 19 bp, Homo sapiens
tagttccttgccttaataa

SEQ ID NO: 747825 - DNA, 15 bp, Homo sapiens
tagttcgtagctttc

SEQ ID NO: 747826 - DNA, 11 bp, Homo sapiens
tagttctagat

SEQ ID NO: 747827 - DNA, 12 bp, Homo sapiens
tagttctagatg

SEQ ID NO: 747828 - DNA, 20 bp, Homo sapiens
tagttctataagtgaggaag

SEQ ID NO: 747829 - DNA, 22 bp, Homo sapiens
tagttctatcaggaaaacaaat

SEQ ID NO: 747830 - DNA, 19 bp, Homo sapiens
tagttctgctgccctctta

SEQ ID NO: 747831 - DNA, 18 bp, Homo sapiens
tagttctgtgcctccccc

SEQ ID NO: 747832 - DNA, 18 bp, Homo sapiens
tagttctgtgtacttttt

SEQ ID NO: 747833 - DNA, 13 bp, Homo sapiens
tagttctgtgtag

SEQ ID NO: 747834 - DNA, 18 bp, Homo sapiens
tagttcttagctttgaaa

SEQ ID NO: 747835 - DNA, 21 bp, Homo sapiens
tagttcttgaattgttatgaa

SEQ ID NO: 747836 - DNA, 17 bp, Homo sapiens
tagttgaaaataaagtg

SEQ ID NO: 747837 - DNA, 19 bp, Homo sapiens
tagttgaaacgcagacact

SEQ ID NO: 747838 - DNA, 19 bp, Homo sapiens
tagttgaaaggcctcaaga

SEQ ID NO: 747839 - DNA, 20 bp, Homo sapiens
tagttgaaaggcctcaagaa

SEQ ID NO: 747840 - DNA, 19 bp, Homo sapiens
tagttgacaattctgcatg

SEQ ID NO: 747841 - DNA, 12 bp, Homo sapiens
tagttgaggccg

SEQ ID NO: 747842 - DNA, 13 bp, Homo sapiens
tagttgatatgtt

SEQ ID NO: 747843 - DNA, 14 bp, Homo sapiens
tagttgcaattgaa

SEQ ID NO: 747844 - DNA, 16 bp, Homo sapiens
tagttgcaattgaatt

SEQ ID NO: 747845 - DNA, 17 bp, Homo sapiens
tagttgcagaaacattt

SEQ ID NO: 747846 - DNA, 18 bp, Homo sapiens
tagttgcagactcagttt

SEQ ID NO: 747847 - DNA, 14 bp, Homo sapiens
tagttgccaacagt

SEQ ID NO: 747848 - DNA, 13 bp, Homo sapiens
tagttgcttgcct

SEQ ID NO: 747849 - DNA, 22 bp, Homo sapiens
tagttggaatgactgaaagaag

SEQ ID NO: 747850 - DNA, 12 bp, Homo sapiens
tagttggacagt

SEQ ID NO: 747851 - DNA, 16 bp, Homo sapiens
tagttggcagaaatac

SEQ ID NO: 747852 - DNA, 12 bp, Homo sapiens
tagttggctgga

SEQ ID NO: 747853 - DNA, 15 bp, Homo sapiens
tagttgggatgccaa

SEQ ID NO: 747854 - DNA, 21 bp, Homo sapiens
tagttgggatgccaatttcct

SEQ ID NO: 747855 - DNA, 23 bp, Homo sapiens
tagttggtaatgcttggaatggc

SEQ ID NO: 747856 - DNA, 20 bp, Homo sapiens
tagttggtttgtatgagatg

SEQ ID NO: 747857 - DNA, 18 bp, Homo sapiens
tagttgtaaaccaagtga

SEQ ID NO: 747858 - DNA, 20 bp, Homo sapiens
tagttgtggaaagataataa

SEQ ID NO: 747859 - DNA, 17 bp, Homo sapiens
tagttgtgggtgggaga

SEQ ID NO: 747860 - DNA, 19 bp, Homo sapiens
tagtttacagaaaaatctt

SEQ ID NO: 747861 - DNA, 22 bp, Homo sapiens
tagtttacctcatccatgcact

SEQ ID NO: 747862 - DNA, 17 bp, Homo sapiens
tagtttacctctttaaa

SEQ ID NO: 747863 - DNA, 11 bp, Homo sapiens
tagtttactgt

SEQ ID NO: 747864 - DNA, 18 bp, Homo sapiens
tagtttaggagaaaccag

SEQ ID NO: 747865 - DNA, 15 bp, Homo sapiens
tagtttattggaagt

SEQ ID NO: 747866 - DNA, 14 bp, Homo sapiens
tagtttcagtaaat

SEQ ID NO: 747867 - DNA, 13 bp, Homo sapiens
tagtttccttttt

SEQ ID NO: 747868 - DNA, 15 bp, Homo sapiens
tagtttcctttttga

SEQ ID NO: 747869 - DNA, 17 bp, Homo sapiens
tagtttctagaggcctc

SEQ ID NO: 747870 - DNA, 23 bp, Homo sapiens
tagtttctcagggtcactgtcct

SEQ ID NO: 747871 - DNA, 12 bp, Homo sapiens
tagtttcttgtg

SEQ ID NO: 747872 - DNA, 16 bp, Homo sapiens
tagtttgattaaattc

SEQ ID NO: 747873 - DNA, 23 bp, Homo sapiens
tagtttgcaacatatttaagaga

SEQ ID NO: 747874 - DNA, 15 bp, Homo sapiens
tagtttgcatttaag

SEQ ID NO: 747875 - DNA, 17 bp, Homo sapiens
tagtttgcatttaagaa

SEQ ID NO: 747876 - DNA, 21 bp, Homo sapiens
tagtttgcatttaagaattgc

SEQ ID NO: 747877 - DNA, 12 bp, Homo sapiens
tagtttggatat

SEQ ID NO: 747878 - DNA, 11 bp, Homo sapiens
tagtttggatt

SEQ ID NO: 747879 - DNA, 21 bp, Homo sapiens
tagtttggctataagtgctca

SEQ ID NO: 747880 - DNA, 18 bp, Homo sapiens
tagtttggggcaaaaatc

SEQ ID NO: 747881 - DNA, 13 bp, Homo sapiens
tagtttggttcac

SEQ ID NO: 747882 - DNA, 14 bp, Homo sapiens
tagtttgtataact

SEQ ID NO: 747883 - DNA, 17 bp, Homo sapiens
tagtttgtataacttct

SEQ ID NO: 747884 - DNA, 18 bp, Homo sapiens
tagtttgtctattttaaa

SEQ ID NO: 747885 - DNA, 12 bp, Homo sapiens
tagttttacatt

SEQ ID NO: 747886 - DNA, 20 bp, Homo sapiens
tagttttacttttaaactgt

SEQ ID NO: 747887 - DNA, 22 bp, Homo sapiens
tagttttacttttaaactgtgt

SEQ ID NO: 747888 - DNA, 14 bp, Homo sapiens
tagttttagaggca

SEQ ID NO: 747889 - DNA, 13 bp, Homo sapiens
tagttttattctt

SEQ ID NO: 747890 - DNA, 21 bp, Homo sapiens
tagttttgagtgtatacatgt

SEQ ID NO: 747891 - DNA, 15 bp, Homo sapiens
tagttttgattttgg

SEQ ID NO: 747892 - DNA, 14 bp, Homo sapiens
tagttttgtataca

SEQ ID NO: 747893 - DNA, 22 bp, Homo sapiens
tagtttttaattaaaaacttta

SEQ ID NO: 747894 - DNA, 20 bp, Homo sapiens
tagtttttacagctgtgtta

SEQ ID NO: 747895 - DNA, 14 bp, Homo sapiens
tagtttttcagcta

SEQ ID NO: 747896 - DNA, 14 bp, Homo sapiens
tagtttttcattaa

SEQ ID NO: 747897 - DNA, 21 bp, Homo sapiens
tagtttttcattaaataaatt

SEQ ID NO: 747898 - DNA, 14 bp, Homo sapiens
tagtttttgaaaat

SEQ ID NO: 747899 - DNA, 21 bp, Homo sapiens
tagtttttgaaaattatgcaa

SEQ ID NO: 747900 - DNA, 10 bp, Homo sapiens
tagtttttgt

SEQ ID NO: 747901 - DNA, 14 bp, Homo sapiens
tagttttttcatct

SEQ ID NO: 747902 - DNA, 13 bp, Homo sapiens
tataactttagaa

SEQ ID NO: 747903 - DNA, 12 bp, Homo sapiens
tataagaaaaac

SEQ ID NO: 747904 - DNA, 21 bp, Homo sapiens
tataagaaaagtaatgaagaa

SEQ ID NO: 747905 - DNA, 17 bp, Homo sapiens
tataagaagccttaatt

SEQ ID NO: 747906 - DNA, 24 bp, Homo sapiens
tataagagaagtctcattcgcctt

SEQ ID NO: 747907 - DNA, 18 bp, Homo sapiens
tataagccctgcataatg

SEQ ID NO: 747908 - DNA, 20 bp, Homo sapiens
tataagcgtatttagactgt

SEQ ID NO: 747909 - DNA, 14 bp, Homo sapiens
tataagctgggaaa

SEQ ID NO: 747910 - DNA, 23 bp, Homo sapiens
tataaggaaagcaataaatgaat

SEQ ID NO: 747911 - DNA, 23 bp, Homo sapiens
tataaggagagttcaagcctgtg

SEQ ID NO: 747912 - DNA, 20 bp, Homo sapiens
tataagggagagctgagcca

SEQ ID NO: 747913 - DNA, 12 bp, Homo sapiens
tataagggccct

SEQ ID NO: 747914 - DNA, 13 bp, Homo sapiens
tataagggccctg

SEQ ID NO: 747915 - DNA, 14 bp, Homo sapiens
tataagggccctgc

SEQ ID NO: 747916 - DNA, 16 bp, Homo sapiens
tataaggtgctctctt

SEQ ID NO: 747917 - DNA, 17 bp, Homo sapiens
tataaggtttaaaaaga

SEQ ID NO: 747918 - DNA, 18 bp, Homo sapiens
tataagtaagaaaatatt

SEQ ID NO: 747919 - DNA, 16 bp, Homo sapiens
tataagtagtaaatca

SEQ ID NO: 747920 - DNA, 21 bp, Homo sapiens
tataagtagtaaatcagaaag

SEQ ID NO: 747921 - DNA, 22 bp, Homo sapiens
tataagtagttggtttgtatga

SEQ ID NO: 747922 - DNA, 13 bp, Homo sapiens
tataagtcaagca

SEQ ID NO: 747923 - DNA, 23 bp, Homo sapiens
tataagtgtaaatataatcagac

SEQ ID NO: 747924 - DNA, 15 bp, Homo sapiens
tataagtgtacatat

SEQ ID NO: 747925 - DNA, 17 bp, Homo sapiens
tataagttaaaacaaag

SEQ ID NO: 747926 - DNA, 19 bp, Homo sapiens
tataagttgtaccaaaaca

SEQ ID NO: 747927 - DNA, 14 bp, Homo sapiens
tataataaaaggaa

SEQ ID NO: 747928 - DNA, 19 bp, Homo sapiens
tataataaaggactgtaat

SEQ ID NO: 747929 - DNA, 13 bp, Homo sapiens
tataataactgaa

SEQ ID NO: 747930 - DNA, 14 bp, Homo sapiens
tataataactgaac

SEQ ID NO: 747931 - DNA, 17 bp, Homo sapiens
tataataactgaactgt

SEQ ID NO: 747932 - DNA, 16 bp, Homo sapiens
tataataactttattg

SEQ ID NO: 747933 - DNA, 20 bp, Homo sapiens
tataataactttattgcata

SEQ ID NO: 747934 - DNA, 17 bp, Homo sapiens
tataataagcaaaaaga

SEQ ID NO: 747935 - DNA, 20 bp, Homo sapiens
tataataagttttgatataa

SEQ ID NO: 747936 - DNA, 14 bp, Homo sapiens
tataatacttgcaa

SEQ ID NO: 747937 - DNA, 17 bp, Homo sapiens
tataatatactatattt

SEQ ID NO: 747938 - DNA, 20 bp, Homo sapiens
tataatatactatatttatg

SEQ ID NO: 747939 - DNA, 15 bp, Homo sapiens
tataatatatttgtg

SEQ ID NO: 747940 - DNA, 15 bp, Homo sapiens
tataatatcctttgt

SEQ ID NO: 747941 - DNA, 14 bp, Homo sapiens
tataatatctaaag

SEQ ID NO: 747942 - DNA, 21 bp, Homo sapiens
tataatattcagccagcttaa

SEQ ID NO: 747943 - DNA, 18 bp, Homo sapiens
tataatatttcttaattt

SEQ ID NO: 747944 - DNA, 17 bp, Homo sapiens
tataatcatcaagtaat

SEQ ID NO: 747945 - DNA, 18 bp, Homo sapiens
tataatcatgctcatgta

SEQ ID NO: 747946 - DNA, 19 bp, Homo sapiens
tataatccttaaatcttaa

SEQ ID NO: 747947 - DNA, 13 bp, Homo sapiens
tataatctcaaag

SEQ ID NO: 747948 - DNA, 17 bp, Homo sapiens
tataatctcaaaggaga

SEQ ID NO: 747949 - DNA, 15 bp, Homo sapiens
tataatctcttctta

SEQ ID NO: 747950 - DNA, 13 bp, Homo sapiens
tataatctgaaga

SEQ ID NO: 747951 - DNA, 13 bp, Homo sapiens
tataatctgtcaa

SEQ ID NO: 747952 - DNA, 14 bp, Homo sapiens
tataatcttataca

SEQ ID NO: 747953 - DNA, 15 bp, Homo sapiens
tataatcttatacaa

SEQ ID NO: 747954 - DNA, 17 bp, Homo sapiens
tataatcttatacaaca

SEQ ID NO: 747955 - DNA, 16 bp, Homo sapiens
tataatgaaatctgtt

SEQ ID NO: 747956 - DNA, 16 bp, Homo sapiens
tataatgaacaaaatt

SEQ ID NO: 747957 - DNA, 14 bp, Homo sapiens
tataatgaggatga

SEQ ID NO: 747958 - DNA, 18 bp, Homo sapiens
tataatggtgatgtcata

SEQ ID NO: 747959 - DNA, 15 bp, Homo sapiens
tataatggttgactg

SEQ ID NO: 747960 - DNA, 20 bp, Homo sapiens
tataatgtaagctctactga

SEQ ID NO: 747961 - DNA, 12 bp, Homo sapiens
tataatgtattt

SEQ ID NO: 747962 - DNA, 16 bp, Homo sapiens
tataatgtgaaatgta

SEQ ID NO: 747963 - DNA, 14 bp, Homo sapiens
tataatgtgtctgt

SEQ ID NO: 747964 - DNA, 16 bp, Homo sapiens
tataatgtgtctgtgt

SEQ ID NO: 747965 - DNA, 14 bp, Homo sapiens
tataatgtgtgttg

SEQ ID NO: 747966 - DNA, 16 bp, Homo sapiens
tataatgttagtagaa

SEQ ID NO: 747967 - DNA, 19 bp, Homo sapiens
tataatgttgataatatat

SEQ ID NO: 747968 - DNA, 17 bp, Homo sapiens
tataatgttgttattta

SEQ ID NO: 747969 - DNA, 19 bp, Homo sapiens
tataatgttgttatttaaa

SEQ ID NO: 747970 - DNA, 19 bp, Homo sapiens
tataatgtttaaatcatgt

SEQ ID NO: 747971 - DNA, 17 bp, Homo sapiens
tataattaaagatgcca

SEQ ID NO: 747972 - DNA, 19 bp, Homo sapiens
tataattaacttaactgaa

SEQ ID NO: 747973 - DNA, 14 bp, Homo sapiens
tataattaatgctt

SEQ ID NO: 747974 - DNA, 13 bp, Homo sapiens
tataattccctat

SEQ ID NO: 747975 - DNA, 17 bp, Homo sapiens
tataattctactttgag

SEQ ID NO: 747976 - DNA, 15 bp, Homo sapiens
tataattctgtaaat

SEQ ID NO: 747977 - DNA, 19 bp, Homo sapiens
tataattggatttcctaat

SEQ ID NO: 747978 - DNA, 19 bp, Homo sapiens
tataattggtgctatttga

SEQ ID NO: 747979 - DNA, 21 bp, Homo sapiens
tataattggtgctatttgaag

SEQ ID NO: 747980 - DNA, 21 bp, Homo sapiens
tataattgttctcagaatccc

SEQ ID NO: 747981 - DNA, 18 bp, Homo sapiens
tataattgttgatatttt

SEQ ID NO: 747982 - DNA, 13 bp, Homo sapiens
tataattgtttat

SEQ ID NO: 747983 - DNA, 14 bp, Homo sapiens
tataattgtttata

SEQ ID NO: 747984 - DNA, 18 bp, Homo sapiens
tataattgttttatctga

SEQ ID NO: 747985 - DNA, 12 bp, Homo sapiens
tataatttaaat

SEQ ID NO: 747986 - DNA, 11 bp, Homo sapiens
tataatttaat

SEQ ID NO: 747987 - DNA, 22 bp, Homo sapiens
tataatttaataaaaaggaata

SEQ ID NO: 747988 - DNA, 14 bp, Homo sapiens
tataatttacctaa

SEQ ID NO: 747989 - DNA, 16 bp, Homo sapiens
tataatttacctaaga

SEQ ID NO: 747990 - DNA, 15 bp, Homo sapiens
tataatttccattta

SEQ ID NO: 747991 - DNA, 20 bp, Homo sapiens
tataatttgagtgtatatat

SEQ ID NO: 747992 - DNA, 13 bp, Homo sapiens
tataattttcact

SEQ ID NO: 747993 - DNA, 19 bp, Homo sapiens
tataattttttgtaatgtg

SEQ ID NO: 747994 - DNA, 22 bp, Homo sapiens
tataatttttttatgttttgtt

SEQ ID NO: 747995 - DNA, 18 bp, Homo sapiens
tataatttttttcaatat

SEQ ID NO: 747996 - DNA, 17 bp, Homo sapiens
tatacaaaactttatca

SEQ ID NO: 747997 - DNA, 22 bp, Homo sapiens
tatacaaacctaccaaaatgga

SEQ ID NO: 747998 - DNA, 14 bp, Homo sapiens
tatacaaagtgtac

SEQ ID NO: 747999 - DNA, 17 bp, Homo sapiens
tatacaaccttcattta

SEQ ID NO: 748000 - DNA, 22 bp, Homo sapiens
tatacaacgattgtatttgtga

SEQ ID NO: 748001 - DNA, 16 bp, Homo sapiens
tatacaactgcctggg

SEQ ID NO: 748002 - DNA, 23 bp, Homo sapiens
tatacaaggtgagtgtgacttcc

SEQ ID NO: 748003 - DNA, 14 bp, Homo sapiens
tatacacacatata

SEQ ID NO: 748004 - DNA, 18 bp, Homo sapiens
tatacacacatatacata

SEQ ID NO: 748005 - DNA, 20 bp, Homo sapiens
tatacacacatatacatata

SEQ ID NO: 748006 - DNA, 21 bp, Homo sapiens
tatacacacatatacatatat

SEQ ID NO: 748007 - DNA, 15 bp, Homo sapiens
tatacacatacatac

SEQ ID NO: 748008 - DNA, 20 bp, Homo sapiens
tatacacatacatacacata

SEQ ID NO: 748009 - DNA, 16 bp, Homo sapiens
tatacacattgctttt

SEQ ID NO: 748010 - DNA, 21 bp, Homo sapiens
tatacacccagttctgaataa

SEQ ID NO: 748011 - DNA, 19 bp, Homo sapiens
tatacactgttggtggaaa

SEQ ID NO: 748012 - DNA, 22 bp, Homo sapiens
tatacacttctggctcacagga

SEQ ID NO: 748013 - DNA, 20 bp, Homo sapiens
tatacagccataaaaaggaa

SEQ ID NO: 748014 - DNA, 17 bp, Homo sapiens
tatacagggtattaaga

SEQ ID NO: 748015 - DNA, 16 bp, Homo sapiens
tatacagtaactttat

SEQ ID NO: 748016 - DNA, 23 bp, Homo sapiens
tatacagttataaaattaaaagt

SEQ ID NO: 748017 - DNA, 15 bp, Homo sapiens
tatacagttgcaagt

SEQ ID NO: 748018 - DNA, 18 bp, Homo sapiens
tatacagtttgacttttt

SEQ ID NO: 748019 - DNA, 14 bp, Homo sapiens
tatacataaacaag

SEQ ID NO: 748020 - DNA, 13 bp, Homo sapiens
tatacatacatgt

SEQ ID NO: 748021 - DNA, 19 bp, Homo sapiens
tatacatacttacatgtgt

SEQ ID NO: 748022 - DNA, 14 bp, Homo sapiens
tatacatatgagaa

SEQ ID NO: 748023 - DNA, 16 bp, Homo sapiens
tatacatcacgttaaa

SEQ ID NO: 748024 - DNA, 15 bp, Homo sapiens
tatacatgaaaattt

SEQ ID NO: 748025 - DNA, 23 bp, Homo sapiens
gtcccggttcagacccctgcctg

SEQ ID NO: 748026 - DNA, 18 bp, Homo sapiens
gtcccgtcgtgcagtcag

SEQ ID NO: 748027 - DNA, 16 bp, Homo sapiens
gtccctacacccctcc

SEQ ID NO: 748028 - DNA, 23 bp, Homo sapiens
gtccctaccgagtctcttctcca

SEQ ID NO: 748029 - DNA, 19 bp, Homo sapiens
gtccctcactccacagagt

SEQ ID NO: 748030 - DNA, 16 bp, Homo sapiens
gtccctcatggagacc

SEQ ID NO: 748031 - DNA, 12 bp, Homo sapiens
gtccctccaggg

SEQ ID NO: 748032 - DNA, 21 bp, Homo sapiens
gtccctcccatctctacccca

SEQ ID NO: 748033 - DNA, 16 bp, Homo sapiens
gtccctcccccttgtc

SEQ ID NO: 748034 - DNA, 16 bp, Homo sapiens
gtccctccctgcctga

SEQ ID NO: 748035 - DNA, 17 bp, Homo sapiens
gtccctccctgcctgag

SEQ ID NO: 748036 - DNA, 18 bp, Homo sapiens
gtccctccctgcctgagg

SEQ ID NO: 748037 - DNA, 16 bp, Homo sapiens
gtccctccgagcttgg

SEQ ID NO: 748038 - DNA, 16 bp, Homo sapiens
gtccctcggagctgcc

SEQ ID NO: 748039 - DNA, 11 bp, Homo sapiens
gtccctctgcc

SEQ ID NO: 748040 - DNA, 14 bp, Homo sapiens
gtccctctgcccca

SEQ ID NO: 748041 - DNA, 14 bp, Homo sapiens
gtccctctgtgtat

SEQ ID NO: 748042 - DNA, 22 bp, Homo sapiens
gtccctctgtgtatttgctttt

SEQ ID NO: 748043 - DNA, 23 bp, Homo sapiens
gtccctgcacagtgacttctgag

SEQ ID NO: 748044 - DNA, 20 bp, Homo sapiens
gtccctgcagaagccagaag

SEQ ID NO: 748045 - DNA, 20 bp, Homo sapiens
gtccctgccaatgctccagc

SEQ ID NO: 748046 - DNA, 23 bp, Homo sapiens
gtccctgccaatgctccagctgt

SEQ ID NO: 748047 - DNA, 18 bp, Homo sapiens
gtccctgccacactcagt

SEQ ID NO: 748048 - DNA, 15 bp, Homo sapiens
gtccctgccccgccc

SEQ ID NO: 748049 - DNA, 22 bp, Homo sapiens
gtccctgccccgccccccagag

SEQ ID NO: 748050 - DNA, 23 bp, Homo sapiens
gtccctgccccgccccccagagc

SEQ ID NO: 748051 - DNA, 11 bp, Homo sapiens
gtccctgctcc

SEQ ID NO: 748052 - DNA, 12 bp, Homo sapiens
gtccctgctccc

SEQ ID NO: 748053 - DNA, 23 bp, Homo sapiens
gtccctgctgctgccagggcttc

SEQ ID NO: 748054 - DNA, 17 bp, Homo sapiens
gtccctgggggtgcaga

SEQ ID NO: 748055 - DNA, 15 bp, Homo sapiens
gtccctggtaataag

SEQ ID NO: 748056 - DNA, 16 bp, Homo sapiens
gtccctggtccctcgt

SEQ ID NO: 748057 - DNA, 16 bp, Homo sapiens
gtccctgtagctcagt

SEQ ID NO: 748058 - DNA, 20 bp, Homo sapiens
gtccctgtcaggacacatgg

SEQ ID NO: 748059 - DNA, 16 bp, Homo sapiens
gtccctgtccccaggc

SEQ ID NO: 748060 - DNA, 17 bp, Homo sapiens
gtccctgtccccaggcc

SEQ ID NO: 748061 - DNA, 19 bp, Homo sapiens
gtccctgtccccaggccca

SEQ ID NO: 748062 - DNA, 22 bp, Homo sapiens
gtccctgtccccaggcccagcc

SEQ ID NO: 748063 - DNA, 13 bp, Homo sapiens
gtccctgtccccc

SEQ ID NO: 748064 - DNA, 15 bp, Homo sapiens
gtccctgtcccccag

SEQ ID NO: 748065 - DNA, 17 bp, Homo sapiens
gtccctgtcccccagca

SEQ ID NO: 748066 - DNA, 19 bp, Homo sapiens
gtccctgtcccccagcatc

SEQ ID NO: 748067 - DNA, 16 bp, Homo sapiens
gtccctgtccctgccc

SEQ ID NO: 748068 - DNA, 16 bp, Homo sapiens
gtccctgtccttccct

SEQ ID NO: 748069 - DNA, 16 bp, Homo sapiens
gtccctgtgttgtccc

SEQ ID NO: 748070 - DNA, 20 bp, Homo sapiens
gtccctgtgttgtcccatct

SEQ ID NO: 748071 - DNA, 22 bp, Homo sapiens
gtccctgtgttgtcccatctgc

SEQ ID NO: 748072 - DNA, 18 bp, Homo sapiens
gtccctgtttcaaactga

SEQ ID NO: 748073 - DNA, 18 bp, Homo sapiens
gtccctgttttctgagcc

SEQ ID NO: 748074 - DNA, 23 bp, Homo sapiens
gtcccttaataaaaatatatatt

SEQ ID NO: 748075 - DNA, 23 bp, Homo sapiens
gtcccttatgagcgtcactgccc

SEQ ID NO: 748076 - DNA, 18 bp, Homo sapiens
gtcccttcaaggcctccc

SEQ ID NO: 748077 - DNA, 20 bp, Homo sapiens
gtcccttccatgccctggga

SEQ ID NO: 748078 - DNA, 18 bp, Homo sapiens
gtcccttcccctccctgg

SEQ ID NO: 748079 - DNA, 21 bp, Homo sapiens
gtcccttccccttcaccgctc

SEQ ID NO: 748080 - DNA, 19 bp, Homo sapiens
gtcccttcccgacccagcc

SEQ ID NO: 748081 - DNA, 22 bp, Homo sapiens
gtcccttcccgacccagccagc

SEQ ID NO: 748082 - DNA, 24 bp, Homo sapiens
gtcccttcccgacccagccagctg

SEQ ID NO: 748083 - DNA, 23 bp, Homo sapiens
gtcccttcctgcttcctgttacc

SEQ ID NO: 748084 - DNA, 16 bp, Homo sapiens
gtcccttcctttctcc

SEQ ID NO: 748085 - DNA, 16 bp, Homo sapiens
gtcccttgagacctca

SEQ ID NO: 748086 - DNA, 19 bp, Homo sapiens
gtcccttgatgcacagaga

SEQ ID NO: 748087 - DNA, 14 bp, Homo sapiens
gtcccttgcctcaa

SEQ ID NO: 748088 - DNA, 11 bp, Homo sapiens
gtcccttgctg

SEQ ID NO: 748089 - DNA, 23 bp, Homo sapiens
gtccctttcgacttgcatttttg

SEQ ID NO: 748090 - DNA, 22 bp, Homo sapiens
gtccctttcttggccagttatc

SEQ ID NO: 748091 - DNA, 13 bp, Homo sapiens
gtccgcaccagct

SEQ ID NO: 748092 - DNA, 17 bp, Homo sapiens
gtccgcaccagctgctc

SEQ ID NO: 748093 - DNA, 20 bp, Homo sapiens
gtccgcaccagctgctctgc

SEQ ID NO: 748094 - DNA, 19 bp, Homo sapiens
gtccgccatccagggtctg

SEQ ID NO: 748095 - DNA, 21 bp, Homo sapiens
gtccgccctgctcctccctgg

SEQ ID NO: 748096 - DNA, 23 bp, Homo sapiens
gtccgccctgctcctccctggct

SEQ ID NO: 748097 - DNA, 12 bp, Homo sapiens
gtccgcctctgc

SEQ ID NO: 748098 - DNA, 22 bp, Homo sapiens
gtccgcctctgcccgcagagcc

SEQ ID NO: 748099 - DNA, 16 bp, Homo sapiens
gtccgcctgcgcctcc

SEQ ID NO: 748100 - DNA, 23 bp, Homo sapiens
gtccgcgcgccagcacagaaaca

SEQ ID NO: 748101 - DNA, 18 bp, Homo sapiens
gtccgcggcctgcaccga

SEQ ID NO: 748102 - DNA, 16 bp, Homo sapiens
gtccggaaggatggga

SEQ ID NO: 748103 - DNA, 14 bp, Homo sapiens
gtccggaggcagca

SEQ ID NO: 748104 - DNA, 14 bp, Homo sapiens
gtccggatttctaa

SEQ ID NO: 748105 - DNA, 22 bp, Homo sapiens
gtccggcccagtgccagctcca

SEQ ID NO: 748106 - DNA, 21 bp, Homo sapiens
gtccggtccctgtcccagtgc

SEQ ID NO: 748107 - DNA, 22 bp, Homo sapiens
gtccgtagtatcagagatgtcc

SEQ ID NO: 748108 - DNA, 13 bp, Homo sapiens
gtccgtctgtctg

SEQ ID NO: 748109 - DNA, 16 bp, Homo sapiens
gtccgtgcccaggccc

SEQ ID NO: 748110 - DNA, 17 bp, Homo sapiens
gtccgtggttgccctag

SEQ ID NO: 748111 - DNA, 21 bp, Homo sapiens
gtccgtgtgtcccagatgctg

SEQ ID NO: 748112 - DNA, 21 bp, Homo sapiens
gtcctaaaacttggatggact

SEQ ID NO: 748113 - DNA, 18 bp, Homo sapiens
gtcctaacttcctgtgcc

SEQ ID NO: 748114 - DNA, 18 bp, Homo sapiens
gtcctaagagatttatct

SEQ ID NO: 748115 - DNA, 20 bp, Homo sapiens
gtcctaagagatttatcttt

SEQ ID NO: 748116 - DNA, 20 bp, Homo sapiens
gtcctaagtgctaagtgctt

SEQ ID NO: 748117 - DNA, 20 bp, Homo sapiens
gtcctaataatatcccactg

SEQ ID NO: 748118 - DNA, 22 bp, Homo sapiens
gtcctacagtgactccctggga

SEQ ID NO: 748119 - DNA, 19 bp, Homo sapiens
gtcctaccagttgccctag

SEQ ID NO: 748120 - DNA, 20 bp, Homo sapiens
gtcctacgtccaaggtggca

SEQ ID NO: 748121 - DNA, 18 bp, Homo sapiens
gtcctacttctgacttta

SEQ ID NO: 748122 - DNA, 21 bp, Homo sapiens
gtcctactttacatatgcttt

SEQ ID NO: 748123 - DNA, 20 bp, Homo sapiens
gtcctagcccagtgcttctc

SEQ ID NO: 748124 - DNA, 15 bp, Homo sapiens
gtcctagcccttccc

SEQ ID NO: 748125 - DNA, 18 bp, Homo sapiens
gtcctagcccttccctga

SEQ ID NO: 748126 - DNA, 20 bp, Homo sapiens
gtcctaggtcctctgaggca

SEQ ID NO: 748127 - DNA, 22 bp, Homo sapiens
gtcctagtcgggcagggcccct

SEQ ID NO: 748128 - DNA, 17 bp, Homo sapiens
gtcctatggacaactta

SEQ ID NO: 748129 - DNA, 17 bp, Homo sapiens
gtcctatgtacagagct

SEQ ID NO: 748130 - DNA, 21 bp, Homo sapiens
gtcctcacaagcctcttctga

SEQ ID NO: 748131 - DNA, 15 bp, Homo sapiens
gtcctcaccctgtgg

SEQ ID NO: 748132 - DNA, 19 bp, Homo sapiens
gtcctcaccctgtgggacc

SEQ ID NO: 748133 - DNA, 19 bp, Homo sapiens
gtcctcacctggttgaccc

SEQ ID NO: 748134 - DNA, 17 bp, Homo sapiens
gtcctcactcccagtcc

SEQ ID NO: 748135 - DNA, 18 bp, Homo sapiens
gtcctcactcccagtcca

SEQ ID NO: 748136 - DNA, 13 bp, Homo sapiens
gtcctcagagcag

SEQ ID NO: 748137 - DNA, 12 bp, Homo sapiens
gtcctcagatgg

SEQ ID NO: 748138 - DNA, 15 bp, Homo sapiens
gtcctcagcttgggc

SEQ ID NO: 748139 - DNA, 16 bp, Homo sapiens
gtcctcagcttgggct

SEQ ID NO: 748140 - DNA, 23 bp, Homo sapiens
gtcctcagcttgggcttcttcct

SEQ ID NO: 748141 - DNA, 13 bp, Homo sapiens
gtcctcagggagc

SEQ ID NO: 748142 - DNA, 22 bp, Homo sapiens
gtcctcagggagcagggaaggc

SEQ ID NO: 748143 - DNA, 12 bp, Homo sapiens
gtcctcaggtca

SEQ ID NO: 748144 - DNA, 18 bp, Homo sapiens
gtcctcaggtcagctggg

SEQ ID NO: 748145 - DNA, 22 bp, Homo sapiens
gtcctcaggtcagctgggagcc

SEQ ID NO: 748146 - DNA, 14 bp, Homo sapiens
gtcctcaggtggcc

SEQ ID NO: 748147 - DNA, 16 bp, Homo sapiens
gtcctcaggtggccat

SEQ ID NO: 748148 - DNA, 22 bp, Homo sapiens
ctgttagtgttaaaaatctagt

SEQ ID NO: 748149 - DNA, 22 bp, Homo sapiens
ctgttagttttgtaaaaactga

SEQ ID NO: 748150 - DNA, 17 bp, Homo sapiens
ctgttatcagctgggca

SEQ ID NO: 748151 - DNA, 14 bp, Homo sapiens
ctgttatgattctg

SEQ ID NO: 748152 - DNA, 20 bp, Homo sapiens
ctgttatgcactgtggtttc

SEQ ID NO: 748153 - DNA, 14 bp, Homo sapiens
ctgttattatgaag

SEQ ID NO: 748154 - DNA, 17 bp, Homo sapiens
ctgttattatgaaggaa

SEQ ID NO: 748155 - DNA, 14 bp, Homo sapiens
ctgttatttttaag

SEQ ID NO: 748156 - DNA, 13 bp, Homo sapiens
ctgttcaagcaaa

SEQ ID NO: 748157 - DNA, 15 bp, Homo sapiens
ctgttcaagcaaaaa

SEQ ID NO: 748158 - DNA, 17 bp, Homo sapiens
ctgttcaatgtttaatg

SEQ ID NO: 748159 - DNA, 22 bp, Homo sapiens
ctgttcaatgtttttaaaaatc

SEQ ID NO: 748160 - DNA, 16 bp, Homo sapiens
ctgttcacagaaaaag

SEQ ID NO: 748161 - DNA, 15 bp, Homo sapiens
ctgttcacggcagac

SEQ ID NO: 748162 - DNA, 22 bp, Homo sapiens
ctgttcacggtgacacaggtca

SEQ ID NO: 748163 - DNA, 15 bp, Homo sapiens
ctgttcactctactt

SEQ ID NO: 748164 - DNA, 15 bp, Homo sapiens
ctgttcactgcattc

SEQ ID NO: 748165 - DNA, 16 bp, Homo sapiens
ctgttcacttttcctc

SEQ ID NO: 748166 - DNA, 17 bp, Homo sapiens
ctgttcagaaaggggct

SEQ ID NO: 748167 - DNA, 18 bp, Homo sapiens
ctgttcagatgtgcattt

SEQ ID NO: 748168 - DNA, 13 bp, Homo sapiens
ctgttcagcaaac

SEQ ID NO: 748169 - DNA, 18 bp, Homo sapiens
ctgttcagctggttgagg

SEQ ID NO: 748170 - DNA, 19 bp, Homo sapiens
ctgttcagtgagatatcat

SEQ ID NO: 748171 - DNA, 13 bp, Homo sapiens
ctgttcattgtaa

SEQ ID NO: 748172 - DNA, 18 bp, Homo sapiens
ctgttccaaattcagttt

SEQ ID NO: 748173 - DNA, 20 bp, Homo sapiens
ctgttccaaattcagtttca

SEQ ID NO: 748174 - DNA, 21 bp, Homo sapiens
ctgttccaaattcagtttcat

SEQ ID NO: 748175 - DNA, 11 bp, Homo sapiens
ctgttccagac

SEQ ID NO: 748176 - DNA, 22 bp, Homo sapiens
ctgttccagactcaggttccag

SEQ ID NO: 748177 - DNA, 15 bp, Homo sapiens
ctgttccaggccctc

SEQ ID NO: 748178 - DNA, 21 bp, Homo sapiens
ctgttccaggccctccagtgg

SEQ ID NO: 748179 - DNA, 21 bp, Homo sapiens
ctgttccatgttctatttttg

SEQ ID NO: 748180 - DNA, 15 bp, Homo sapiens
ctgttccccagcaac

SEQ ID NO: 748181 - DNA, 14 bp, Homo sapiens
ctgttcccccaccc

SEQ ID NO: 748182 - DNA, 14 bp, Homo sapiens
ctgttcccctctcc

SEQ ID NO: 748183 - DNA, 17 bp, Homo sapiens
ctgttcccctctccctt

SEQ ID NO: 748184 - DNA, 20 bp, Homo sapiens
ctgttcccctctcccttccc

SEQ ID NO: 748185 - DNA, 17 bp, Homo sapiens
ctgttccctcctggtcc

SEQ ID NO: 748186 - DNA, 22 bp, Homo sapiens
ctgttccctcctggtcctggac

SEQ ID NO: 748187 - DNA, 16 bp, Homo sapiens
ctgttccctctggctt

SEQ ID NO: 748188 - DNA, 21 bp, Homo sapiens
ctgttccctctggcttcccat

SEQ ID NO: 748189 - DNA, 18 bp, Homo sapiens
ctgttccctggagtcagg

SEQ ID NO: 748190 - DNA, 21 bp, Homo sapiens
ctgttccctggagtcagggtg

SEQ ID NO: 748191 - DNA, 15 bp, Homo sapiens
ctgttccctgggctg

SEQ ID NO: 748192 - DNA, 17 bp, Homo sapiens
ctgttccctgttctggt

SEQ ID NO: 748193 - DNA, 15 bp, Homo sapiens
ctgttccctttgcct

SEQ ID NO: 748194 - DNA, 23 bp, Homo sapiens
ctgttccctttgccttaaacctg

SEQ ID NO: 748195 - DNA, 19 bp, Homo sapiens
ctgttcctcatgttgctga

SEQ ID NO: 748196 - DNA, 22 bp, Homo sapiens
ctgttcctcatgttgctgaatt

SEQ ID NO: 748197 - DNA, 16 bp, Homo sapiens
ctgttcctgtgttctt

SEQ ID NO: 748198 - DNA, 18 bp, Homo sapiens
ctgttccttcacatcctg

SEQ ID NO: 748199 - DNA, 17 bp, Homo sapiens
ctgttcctttcagatga

SEQ ID NO: 748200 - DNA, 17 bp, Homo sapiens
ctgttccttttctctcc

SEQ ID NO: 748201 - DNA, 22 bp, Homo sapiens
ctgttcggaaggggttcctcaa

SEQ ID NO: 748202 - DNA, 19 bp, Homo sapiens
ctgttctatgcctttagtc

SEQ ID NO: 748203 - DNA, 19 bp, Homo sapiens
ctgttctcaggacagcatc

SEQ ID NO: 748204 - DNA, 23 bp, Homo sapiens
ctgttctcgaactcctgacctca

SEQ ID NO: 748205 - DNA, 12 bp, Homo sapiens
ctgttctctccc

SEQ ID NO: 748206 - DNA, 17 bp, Homo sapiens
ctgttctctcccctcac

SEQ ID NO: 748207 - DNA, 11 bp, Homo sapiens
ctgttctctgc

SEQ ID NO: 748208 - DNA, 23 bp, Homo sapiens
ctgttctcttcacaccaaggaag

SEQ ID NO: 748209 - DNA, 15 bp, Homo sapiens
ctgttctcttgggaa

SEQ ID NO: 748210 - DNA, 20 bp, Homo sapiens
ctgttctgcaaaggtggcaa

SEQ ID NO: 748211 - DNA, 13 bp, Homo sapiens
ctgttctgcttcg

SEQ ID NO: 748212 - DNA, 13 bp, Homo sapiens
ctgttctggagga

SEQ ID NO: 748213 - DNA, 22 bp, Homo sapiens
ctgttctggaggaaagggagga

SEQ ID NO: 748214 - DNA, 23 bp, Homo sapiens
ctgttctggaggaaagggaggag

SEQ ID NO: 748215 - DNA, 19 bp, Homo sapiens
ctgttctgtagctttctgg

SEQ ID NO: 748216 - DNA, 22 bp, Homo sapiens
ctgttctgtagctttctggaat

SEQ ID NO: 748217 - DNA, 21 bp, Homo sapiens
ctgttctgtggttcctctgct

SEQ ID NO: 748218 - DNA, 14 bp, Homo sapiens
ctgttctgtgtctt

SEQ ID NO: 748219 - DNA, 21 bp, Homo sapiens
ctgttcttacatctgtaaaga

SEQ ID NO: 748220 - DNA, 15 bp, Homo sapiens
ctgttcttagagtgt

SEQ ID NO: 748221 - DNA, 16 bp, Homo sapiens
ctgttcttagagtgta

SEQ ID NO: 748222 - DNA, 21 bp, Homo sapiens
ctgttcttagtgacacacact

SEQ ID NO: 748223 - DNA, 14 bp, Homo sapiens
ctgttcttcacttc

SEQ ID NO: 748224 - DNA, 23 bp, Homo sapiens
ctgttcttcctccagctgcacca

SEQ ID NO: 748225 - DNA, 12 bp, Homo sapiens
ctgttcttcctt

SEQ ID NO: 748226 - DNA, 14 bp, Homo sapiens
ctgttcttccttcc

SEQ ID NO: 748227 - DNA, 13 bp, Homo sapiens
ctgttcttggggc

SEQ ID NO: 748228 - DNA, 23 bp, Homo sapiens
ctgttgaaaagcacacacaataa

SEQ ID NO: 748229 - DNA, 18 bp, Homo sapiens
ctgttgaagacttcctct

SEQ ID NO: 748230 - DNA, 22 bp, Homo sapiens
ctgttgaattttgttctctggg

SEQ ID NO: 748231 - DNA, 23 bp, Homo sapiens
ctgttgaattttgttctctggga

SEQ ID NO: 748232 - DNA, 17 bp, Homo sapiens
ctgttgacacaggtctt

SEQ ID NO: 748233 - DNA, 16 bp, Homo sapiens
ctgttgacatatttaa

SEQ ID NO: 748234 - DNA, 17 bp, Homo sapiens
ctgttgacatatttaat

SEQ ID NO: 748235 - DNA, 21 bp, Homo sapiens
ctgttgacatcagcctgcttc

SEQ ID NO: 748236 - DNA, 14 bp, Homo sapiens
ctgttgacctgtgc

SEQ ID NO: 748237 - DNA, 15 bp, Homo sapiens
ctgttgacctgtgca

SEQ ID NO: 748238 - DNA, 15 bp, Homo sapiens
ctgttgagaaaacga

SEQ ID NO: 748239 - DNA, 18 bp, Homo sapiens
ctgttgagccccagtgct

SEQ ID NO: 748240 - DNA, 20 bp, Homo sapiens
ctgttgagctgttttccctg

SEQ ID NO: 748241 - DNA, 11 bp, Homo sapiens
ctgttgaggca

SEQ ID NO: 748242 - DNA, 15 bp, Homo sapiens
ctgttgaggcatcaa

SEQ ID NO: 748243 - DNA, 16 bp, Homo sapiens
ctgttgaggcatcaaa

SEQ ID NO: 748244 - DNA, 19 bp, Homo sapiens
ctgttgagggccacttttt

SEQ ID NO: 748245 - DNA, 18 bp, Homo sapiens
ctgttgataaaaactcag

SEQ ID NO: 748246 - DNA, 17 bp, Homo sapiens
ctgttgatcccacttca

SEQ ID NO: 748247 - DNA, 21 bp, Homo sapiens
ctgttgatcccacttcactgt

SEQ ID NO: 748248 - DNA, 20 bp, Homo sapiens
ctgttgatgaagtatacttt

SEQ ID NO: 748249 - DNA, 15 bp, Homo sapiens
ctgttgatgtatctg

SEQ ID NO: 748250 - DNA, 16 bp, Homo sapiens
ctgttgatgtatctga

SEQ ID NO: 748251 - DNA, 19 bp, Homo sapiens
ctgttgattaatttctgcc

SEQ ID NO: 748252 - DNA, 14 bp, Homo sapiens
ctgttgattatctt

SEQ ID NO: 748253 - DNA, 22 bp, Homo sapiens
ctgttgcaagcccctctttctg

SEQ ID NO: 748254 - DNA, 14 bp, Homo sapiens
ctgttgcacagcca

SEQ ID NO: 748255 - DNA, 12 bp, Homo sapiens
ctgttgcatggg

SEQ ID NO: 748256 - DNA, 16 bp, Homo sapiens
ctgttgcatttacttt

SEQ ID NO: 748257 - DNA, 14 bp, Homo sapiens
ctgttgcccaggct

SEQ ID NO: 748258 - DNA, 15 bp, Homo sapiens
ctgttgcccaggctg

SEQ ID NO: 748259 - DNA, 14 bp, Homo sapiens
ctgttgccccccag

SEQ ID NO: 748260 - DNA, 15 bp, Homo sapiens
ctgttgccccccagg

SEQ ID NO: 748261 - DNA, 17 bp, Homo sapiens
ctgttgcccctgcctcc

SEQ ID NO: 748262 - DNA, 13 bp, Homo sapiens
ctgttgcctttta

SEQ ID NO: 748263 - DNA, 15 bp, Homo sapiens
ctgttgctagggaga

SEQ ID NO: 748264 - DNA, 22 bp, Homo sapiens
ctgttgctcaaatctattcaga

SEQ ID NO: 748265 - DNA, 15 bp, Homo sapiens
ctgttgctggagggg

SEQ ID NO: 748266 - DNA, 16 bp, Homo sapiens
ctgttgctggaggggc

SEQ ID NO: 748267 - DNA, 17 bp, Homo sapiens
ctgttgctggaggggct

SEQ ID NO: 748268 - DNA, 18 bp, Homo sapiens
ctgttgctttaatatgag

SEQ ID NO: 748269 - DNA, 19 bp, Homo sapiens
ctgttgctttaatatgagc

SEQ ID NO: 748270 - DNA, 18 bp, Homo sapiens
ctgttgctttcttcctgc

SEQ ID NO: 748271 - DNA, 19 bp, Homo sapiens
ctgttgctttcttcctgca

SEQ ID NO: 748272 - DNA, 23 bp, Homo sapiens
ctgttggaatggatttttcttta

SEQ ID NO: 748273 - DNA, 22 bp, Homo sapiens
gtcctcatctctgtcgtgcttc

SEQ ID NO: 748274 - DNA, 15 bp, Homo sapiens
gtcctcattataaaa

SEQ ID NO: 748275 - DNA, 20 bp, Homo sapiens
gtcctccactcgacccagaa

SEQ ID NO: 748276 - DNA, 21 bp, Homo sapiens
gtcctccactcgacccagaat

SEQ ID NO: 748277 - DNA, 13 bp, Homo sapiens
gtcctccagaagc

SEQ ID NO: 748278 - DNA, 12 bp, Homo sapiens
gtcctccatcca

SEQ ID NO: 748279 - DNA, 23 bp, Homo sapiens
gtcctccatccacgtggcctctc

SEQ ID NO: 748280 - DNA, 23 bp, Homo sapiens
gtcctccatcccaacagccatgc

SEQ ID NO: 748281 - DNA, 19 bp, Homo sapiens
gtcctccatcttccaggat

SEQ ID NO: 748282 - DNA, 19 bp, Homo sapiens
gtcctcccacagacctgca

SEQ ID NO: 748283 - DNA, 13 bp, Homo sapiens
gtcctcccatccc

SEQ ID NO: 748284 - DNA, 20 bp, Homo sapiens
gtcctcccatcccctcaaca

SEQ ID NO: 748285 - DNA, 18 bp, Homo sapiens
gtcctcccatcccctgga

SEQ ID NO: 748286 - DNA, 21 bp, Homo sapiens
gtcctcccatcccctggactg

SEQ ID NO: 748287 - DNA, 17 bp, Homo sapiens
gtcctccccctgccagt

SEQ ID NO: 748288 - DNA, 14 bp, Homo sapiens
gtcctccccttggg

SEQ ID NO: 748289 - DNA, 21 bp, Homo sapiens
gtcctcccgagctcctcttcc

SEQ ID NO: 748290 - DNA, 22 bp, Homo sapiens
gtcctcccgggccctcccttgg

SEQ ID NO: 748291 - DNA, 20 bp, Homo sapiens
gtcctccctcagcctcccct

SEQ ID NO: 748292 - DNA, 22 bp, Homo sapiens
gtcctccctgatcccaccccct

SEQ ID NO: 748293 - DNA, 13 bp, Homo sapiens
gtcctcctaagtc

SEQ ID NO: 748294 - DNA, 21 bp, Homo sapiens
gtcctcctctacctctctcct

SEQ ID NO: 748295 - DNA, 14 bp, Homo sapiens
gtcctcctctgtga

SEQ ID NO: 748296 - DNA, 15 bp, Homo sapiens
gtcctcctgggagcc

SEQ ID NO: 748297 - DNA, 15 bp, Homo sapiens
gtcctccttcctggg

SEQ ID NO: 748298 - DNA, 17 bp, Homo sapiens
gtcctccttcctgggac

SEQ ID NO: 748299 - DNA, 16 bp, Homo sapiens
gtcctccttttcactt

SEQ ID NO: 748300 - DNA, 20 bp, Homo sapiens
gtcctcggagctggttcctc

SEQ ID NO: 748301 - DNA, 17 bp, Homo sapiens
gtcctcgtagccatctc

SEQ ID NO: 748302 - DNA, 23 bp, Homo sapiens
gtcctctagaaataggttaaact

SEQ ID NO: 748303 - DNA, 17 bp, Homo sapiens
gtcctctagcaggccta

SEQ ID NO: 748304 - DNA, 23 bp, Homo sapiens
gtcctctagcccactccctgcct

SEQ ID NO: 748305 - DNA, 19 bp, Homo sapiens
gtcctctcccaagtccaca

SEQ ID NO: 748306 - DNA, 23 bp, Homo sapiens
gtcctctcccccaaccccctgca

SEQ ID NO: 748307 - DNA, 16 bp, Homo sapiens
gtcctctcccccttca

SEQ ID NO: 748308 - DNA, 13 bp, Homo sapiens
gtcctctctctgt

SEQ ID NO: 748309 - DNA, 21 bp, Homo sapiens
gtcctctctttatgcttgctt

SEQ ID NO: 748310 - DNA, 13 bp, Homo sapiens
gtcctctgaatga

SEQ ID NO: 748311 - DNA, 14 bp, Homo sapiens
gtcctctgcctggg

SEQ ID NO: 748312 - DNA, 10 bp, Homo sapiens
gtcctctgct

SEQ ID NO: 748313 - DNA, 13 bp, Homo sapiens
gtcctctgctcca

SEQ ID NO: 748314 - DNA, 14 bp, Homo sapiens
gtcctctgctccag

SEQ ID NO: 748315 - DNA, 16 bp, Homo sapiens
gtcctctgctccagca

SEQ ID NO: 748316 - DNA, 20 bp, Homo sapiens
gtcctctgtcagtcacagcc

SEQ ID NO: 748317 - DNA, 20 bp, Homo sapiens
gtcctctttacatgaaacta

SEQ ID NO: 748318 - DNA, 23 bp, Homo sapiens
gtcctctttactcccttcctggc

SEQ ID NO: 748319 - DNA, 13 bp, Homo sapiens
gtcctcttttcct

SEQ ID NO: 748320 - DNA, 18 bp, Homo sapiens
gtcctcttttcctggcag

SEQ ID NO: 748321 - DNA, 18 bp, Homo sapiens
gtcctgaaacatgaaccc

SEQ ID NO: 748322 - DNA, 20 bp, Homo sapiens
gtcctgaagaggcgggccag

SEQ ID NO: 748323 - DNA, 21 bp, Homo sapiens
gtcctgaagaggcgggccagc

SEQ ID NO: 748324 - DNA, 23 bp, Homo sapiens
gtcctgaagaggcgggccagcca

SEQ ID NO: 748325 - DNA, 18 bp, Homo sapiens
gtcctgaagcccagcgac

SEQ ID NO: 748326 - DNA, 12 bp, Homo sapiens
gtcctgaccacc

SEQ ID NO: 748327 - DNA, 17 bp, Homo sapiens
gtcctgaccaccctccc

SEQ ID NO: 748328 - DNA, 14 bp, Homo sapiens
gtcctgacgccctg

SEQ ID NO: 748329 - DNA, 16 bp, Homo sapiens
gtcctgacgccctgcg

SEQ ID NO: 748330 - DNA, 16 bp, Homo sapiens
gtcctgagaaagctca

SEQ ID NO: 748331 - DNA, 20 bp, Homo sapiens
gtcctgagatggaaaagtgt

SEQ ID NO: 748332 - DNA, 11 bp, Homo sapiens
gtcctgaggaa

SEQ ID NO: 748333 - DNA, 12 bp, Homo sapiens
gtcctgaggagc

SEQ ID NO: 748334 - DNA, 15 bp, Homo sapiens
gtcctgaggagccct

SEQ ID NO: 748335 - DNA, 14 bp, Homo sapiens
gtcctgatccctcc

SEQ ID NO: 748336 - DNA, 20 bp, Homo sapiens
gtcctgcagcaaacactcca

SEQ ID NO: 748337 - DNA, 21 bp, Homo sapiens
gtcctgcagcaaacactccac

SEQ ID NO: 748338 - DNA, 14 bp, Homo sapiens
gtcctgcaggggga

SEQ ID NO: 748339 - DNA, 22 bp, Homo sapiens
gtcctgcagggggaggaggact

SEQ ID NO: 748340 - DNA, 21 bp, Homo sapiens
gtcctgcatggggcagaggct

SEQ ID NO: 748341 - DNA, 15 bp, Homo sapiens
gtcctgccagctgcc

SEQ ID NO: 748342 - DNA, 22 bp, Homo sapiens
gtcctgccagctgccttcctca

SEQ ID NO: 748343 - DNA, 18 bp, Homo sapiens
gtcctgcccatgccccag

SEQ ID NO: 748344 - DNA, 21 bp, Homo sapiens
gtcctgcccatgtgtcccctc

SEQ ID NO: 748345 - DNA, 16 bp, Homo sapiens
gtcctgccctccggag

SEQ ID NO: 748346 - DNA, 18 bp, Homo sapiens
gtcctgccctccggagga

SEQ ID NO: 748347 - DNA, 13 bp, Homo sapiens
gtcctgccctgcc

SEQ ID NO: 748348 - DNA, 13 bp, Homo sapiens
gtcctgccggtgg

SEQ ID NO: 748349 - DNA, 19 bp, Homo sapiens
gtcctgccggtgggaccct

SEQ ID NO: 748350 - DNA, 13 bp, Homo sapiens
gtcctgcctcctc

SEQ ID NO: 748351 - DNA, 12 bp, Homo sapiens
gtcctgcctctt

SEQ ID NO: 748352 - DNA, 14 bp, Homo sapiens
gtcctgcctcttgt

SEQ ID NO: 748353 - DNA, 22 bp, Homo sapiens
gtcctgcctcttgtttctgtgc

SEQ ID NO: 748354 - DNA, 13 bp, Homo sapiens
gtcctgcctggcc

SEQ ID NO: 748355 - DNA, 15 bp, Homo sapiens
gtcctgcctggccag

SEQ ID NO: 748356 - DNA, 19 bp, Homo sapiens
gtcctgcctggccaggcag

SEQ ID NO: 748357 - DNA, 20 bp, Homo sapiens
gtcctgcctggccaggcaga

SEQ ID NO: 748358 - DNA, 14 bp, Homo sapiens
gtcctgcctgtctg

SEQ ID NO: 748359 - DNA, 21 bp, Homo sapiens
gtcctgctcattatgccactt

SEQ ID NO: 748360 - DNA, 18 bp, Homo sapiens
gtcctgctgtccctgtca

SEQ ID NO: 748361 - DNA, 21 bp, Homo sapiens
gtcctggaagcgcgagggcct

SEQ ID NO: 748362 - DNA, 15 bp, Homo sapiens
gtcctggacacctcc

SEQ ID NO: 748363 - DNA, 16 bp, Homo sapiens
gtcctggacacctccc

SEQ ID NO: 748364 - DNA, 17 bp, Homo sapiens
gtcctggacacctccca

SEQ ID NO: 748365 - DNA, 18 bp, Homo sapiens
gtcctggacacctcccag

SEQ ID NO: 748366 - DNA, 21 bp, Homo sapiens
gtcctggacacctcccagggg

SEQ ID NO: 748367 - DNA, 20 bp, Homo sapiens
gtcctggaggggctggggac

SEQ ID NO: 748368 - DNA, 15 bp, Homo sapiens
gtcctggccatccca

SEQ ID NO: 748369 - DNA, 16 bp, Homo sapiens
gtcctggccatcccac

SEQ ID NO: 748370 - DNA, 18 bp, Homo sapiens
gtcctggccatcccacaa

SEQ ID NO: 748371 - DNA, 11 bp, Homo sapiens
gtcctggccct

SEQ ID NO: 748372 - DNA, 16 bp, Homo sapiens
gtcctggcccttcagt

SEQ ID NO: 748373 - DNA, 14 bp, Homo sapiens
gtcctggctcctga

SEQ ID NO: 748374 - DNA, 16 bp, Homo sapiens
gtcctggctgcactct

SEQ ID NO: 748375 - DNA, 20 bp, Homo sapiens
gtcctggctgcactcttgaa

SEQ ID NO: 748376 - DNA, 21 bp, Homo sapiens
gtcctgggagaacctcaggct

SEQ ID NO: 748377 - DNA, 23 bp, Homo sapiens
gtcctgggaggatcctgagctgc

SEQ ID NO: 748378 - DNA, 12 bp, Homo sapiens
gtcctgggcagg

SEQ ID NO: 748379 - DNA, 21 bp, Homo sapiens
gtcctgggcaggtgggagctg

SEQ ID NO: 748380 - DNA, 14 bp, Homo sapiens
gtcctgggcctgcc

SEQ ID NO: 748381 - DNA, 15 bp, Homo sapiens
gtcctgggcctgccc

SEQ ID NO: 748382 - DNA, 14 bp, Homo sapiens
gtcctgggcgccct

SEQ ID NO: 748383 - DNA, 20 bp, Homo sapiens
gtcctgggcgccctggaagc

SEQ ID NO: 748384 - DNA, 13 bp, Homo sapiens
gtcctgggcgtga

SEQ ID NO: 748385 - DNA, 21 bp, Homo sapiens
gtcctgggcgtgacccgtcca

SEQ ID NO: 748386 - DNA, 20 bp, Homo sapiens
gtcctgggttgtttccagga

SEQ ID NO: 748387 - DNA, 22 bp, Homo sapiens
gtcctgggttgtttccaggaga

SEQ ID NO: 748388 - DNA, 16 bp, Homo sapiens
gtcctggtcctggctg

SEQ ID NO: 748389 - DNA, 11 bp, Homo sapiens
gtcctggtgct

SEQ ID NO: 748390 - DNA, 23 bp, Homo sapiens
gtcctggtggtattttcaatagc

SEQ ID NO: 748391 - DNA, 15 bp, Homo sapiens
gtcctgtacattgtg

SEQ ID NO: 748392 - DNA, 17 bp, Homo sapiens
gtcctgtagcacgctgc

SEQ ID NO: 748393 - DNA, 16 bp, Homo sapiens
gtcctgtcctttcttg

SEQ ID NO: 748394 - DNA, 17 bp, Homo sapiens
gtcctgtcctttcttgc

SEQ ID NO: 748395 - DNA, 18 bp, Homo sapiens
gtcctgtctctgcacaga

SEQ ID NO: 748396 - DNA, 15 bp, Homo sapiens
gtcctgtctctgcct

SEQ ID NO: 748397 - DNA, 16 bp, Homo sapiens
gtcctgtctctgcctg

SEQ ID NO: 748398 - DNA, 19 bp, Homo sapiens
ctgttggacagctgcttgt

SEQ ID NO: 748399 - DNA, 20 bp, Homo sapiens
ctgttggacagctgcttgtg

SEQ ID NO: 748400 - DNA, 18 bp, Homo sapiens
ctgttggacccgctctgg

SEQ ID NO: 748401 - DNA, 18 bp, Homo sapiens
ctgttggagcaaaccatt

SEQ ID NO: 748402 - DNA, 18 bp, Homo sapiens
ctgttggcactcacagac

SEQ ID NO: 748403 - DNA, 13 bp, Homo sapiens
ctgttggcagctc

SEQ ID NO: 748404 - DNA, 20 bp, Homo sapiens
ctgttggcaggcccactccc

SEQ ID NO: 748405 - DNA, 23 bp, Homo sapiens
ctgttggcaggcccactccccag

SEQ ID NO: 748406 - DNA, 16 bp, Homo sapiens
ctgttggcaggctggc

SEQ ID NO: 748407 - DNA, 18 bp, Homo sapiens
ctgttggcaggctggcca

SEQ ID NO: 748408 - DNA, 19 bp, Homo sapiens
ctgttggcaggctggccag

SEQ ID NO: 748409 - DNA, 15 bp, Homo sapiens
ctgttggcctgtggg

SEQ ID NO: 748410 - DNA, 16 bp, Homo sapiens
ctgttggctctctgac

SEQ ID NO: 748411 - DNA, 22 bp, Homo sapiens
ctgttgggtgggtgggccctgc

SEQ ID NO: 748412 - DNA, 17 bp, Homo sapiens
ctgttggtccactgtgt

SEQ ID NO: 748413 - DNA, 18 bp, Homo sapiens
ctgttggtccactgtgtt

SEQ ID NO: 748414 - DNA, 17 bp, Homo sapiens
ctgttgtaatagtccat

SEQ ID NO: 748415 - DNA, 21 bp, Homo sapiens
ctgttgtacgtaaagcttaaa

SEQ ID NO: 748416 - DNA, 12 bp, Homo sapiens
ctgttgtcattg

SEQ ID NO: 748417 - DNA, 14 bp, Homo sapiens
ctgttgtgggcgct

SEQ ID NO: 748418 - DNA, 21 bp, Homo sapiens
ctgttgtgtatagatgcaaga

SEQ ID NO: 748419 - DNA, 12 bp, Homo sapiens
ctgttgttccat

SEQ ID NO: 748420 - DNA, 16 bp, Homo sapiens
ctgttgttccatttta

SEQ ID NO: 748421 - DNA, 23 bp, Homo sapiens
ctgttgttctgtggtcacagtga

SEQ ID NO: 748422 - DNA, 15 bp, Homo sapiens
ctgttgttttgtatg

SEQ ID NO: 748423 - DNA, 20 bp, Homo sapiens
ctgttgttttgttttaaata

SEQ ID NO: 748424 - DNA, 23 bp, Homo sapiens
ctgtttaaaatttgtgctgggtt

SEQ ID NO: 748425 - DNA, 18 bp, Homo sapiens
ctgtttaatatttaaaca

SEQ ID NO: 748426 - DNA, 20 bp, Homo sapiens
ctgtttaatatttaaacagc

SEQ ID NO: 748427 - DNA, 21 bp, Homo sapiens
ctgtttaatatttaaacagca

SEQ ID NO: 748428 - DNA, 16 bp, Homo sapiens
ctgtttacaagaaaaa

SEQ ID NO: 748429 - DNA, 20 bp, Homo sapiens
ctgtttacaagaaaaaatga

SEQ ID NO: 748430 - DNA, 20 bp, Homo sapiens
ctgtttactcccttctgtag

SEQ ID NO: 748431 - DNA, 14 bp, Homo sapiens
ctgtttactgatta

SEQ ID NO: 748432 - DNA, 13 bp, Homo sapiens
ctgtttagaacac

SEQ ID NO: 748433 - DNA, 12 bp, Homo sapiens
ctgtttagataa

SEQ ID NO: 748434 - DNA, 14 bp, Homo sapiens
ctgtttagataata

SEQ ID NO: 748435 - DNA, 20 bp, Homo sapiens
ctgtttagcagcagccttta

SEQ ID NO: 748436 - DNA, 18 bp, Homo sapiens
ctgtttaggttcccctgt

SEQ ID NO: 748437 - DNA, 20 bp, Homo sapiens
ctgtttaggttcccctgtca

SEQ ID NO: 748438 - DNA, 14 bp, Homo sapiens
ctgtttatacttga

SEQ ID NO: 748439 - DNA, 15 bp, Homo sapiens
ctgtttatacttgag

SEQ ID NO: 748440 - DNA, 16 bp, Homo sapiens
ctgtttatacttgaga

SEQ ID NO: 748441 - DNA, 21 bp, Homo sapiens
ctgtttatggccacatttaat

SEQ ID NO: 748442 - DNA, 15 bp, Homo sapiens
ctgtttatggcctca

SEQ ID NO: 748443 - DNA, 22 bp, Homo sapiens
ctgtttatggcctcagctgcct

SEQ ID NO: 748444 - DNA, 16 bp, Homo sapiens
ctgtttattaatctta

SEQ ID NO: 748445 - DNA, 18 bp, Homo sapiens
ctgtttattacttccatg

SEQ ID NO: 748446 - DNA, 20 bp, Homo sapiens
ctgtttattctctgctgcat

SEQ ID NO: 748447 - DNA, 23 bp, Homo sapiens
ctgtttattgaaagaattatcct

SEQ ID NO: 748448 - DNA, 17 bp, Homo sapiens
ctgtttatttattcact

SEQ ID NO: 748449 - DNA, 14 bp, Homo sapiens
ctgtttcaaactga

SEQ ID NO: 748450 - DNA, 17 bp, Homo sapiens
ctgtttcaaactttact

SEQ ID NO: 748451 - DNA, 22 bp, Homo sapiens
ctgtttcaacagatgaccgtgt

SEQ ID NO: 748452 - DNA, 19 bp, Homo sapiens
ctgtttcagacccccccat

SEQ ID NO: 748453 - DNA, 21 bp, Homo sapiens
ctgtttcagagcataaaacct

SEQ ID NO: 748454 - DNA, 17 bp, Homo sapiens
ctgtttcctagctgtgt

SEQ ID NO: 748455 - DNA, 19 bp, Homo sapiens
ctgtttcctgacattgtct

SEQ ID NO: 748456 - DNA, 22 bp, Homo sapiens
ctgtttcgtgtagtggaagagc

SEQ ID NO: 748457 - DNA, 16 bp, Homo sapiens
ctgtttctaggctgtt

SEQ ID NO: 748458 - DNA, 19 bp, Homo sapiens
ctgtttctcaagtgttttg

SEQ ID NO: 748459 - DNA, 15 bp, Homo sapiens
ctgtttctcatgaag

SEQ ID NO: 748460 - DNA, 20 bp, Homo sapiens
ctgtttctcatgaagctaat

SEQ ID NO: 748461 - DNA, 19 bp, Homo sapiens
ctgtttctctttccttggc

SEQ ID NO: 748462 - DNA, 20 bp, Homo sapiens
ctgtttctctttccttggct

SEQ ID NO: 748463 - DNA, 16 bp, Homo sapiens
ctgtttctctttgtct

SEQ ID NO: 748464 - DNA, 20 bp, Homo sapiens
ctgtttctctttgtctgcct

SEQ ID NO: 748465 - DNA, 15 bp, Homo sapiens
ctgtttctgcagccc

SEQ ID NO: 748466 - DNA, 16 bp, Homo sapiens
ctgtttctgcagccct

SEQ ID NO: 748467 - DNA, 12 bp, Homo sapiens
ctgtttctgtag

SEQ ID NO: 748468 - DNA, 14 bp, Homo sapiens
ctgtttctgtagaa

SEQ ID NO: 748469 - DNA, 17 bp, Homo sapiens
ctgtttcttaagggcac

SEQ ID NO: 748470 - DNA, 21 bp, Homo sapiens
ctgtttcttgctctctctccc

SEQ ID NO: 748471 - DNA, 17 bp, Homo sapiens
ctgtttcttgtctgtta

SEQ ID NO: 748472 - DNA, 15 bp, Homo sapiens
ctgtttcttttgtaa

SEQ ID NO: 748473 - DNA, 19 bp, Homo sapiens
ctgtttgaaaacttcagaa

SEQ ID NO: 748474 - DNA, 12 bp, Homo sapiens
ctgtttgaaact

SEQ ID NO: 748475 - DNA, 14 bp, Homo sapiens
ctgtttgaaagtaa

SEQ ID NO: 748476 - DNA, 18 bp, Homo sapiens
ctgtttgaaagtaaaaac

SEQ ID NO: 748477 - DNA, 22 bp, Homo sapiens
ctgtttgaaagtaaaaacctgc

SEQ ID NO: 748478 - DNA, 18 bp, Homo sapiens
ctgtttgatataccaaat

SEQ ID NO: 748479 - DNA, 16 bp, Homo sapiens
ctgtttgatgtatgtg

SEQ ID NO: 748480 - DNA, 22 bp, Homo sapiens
ctgtttgatgtatgtgtgaaac

SEQ ID NO: 748481 - DNA, 13 bp, Homo sapiens
ctgtttgcatgag

SEQ ID NO: 748482 - DNA, 15 bp, Homo sapiens
ctgtttgcatgagaa

SEQ ID NO: 748483 - DNA, 14 bp, Homo sapiens
ctgtttgccacacc

SEQ ID NO: 748484 - DNA, 23 bp, Homo sapiens
ctgtttgccacacccaggtgatt

SEQ ID NO: 748485 - DNA, 12 bp, Homo sapiens
ctgtttgccact

SEQ ID NO: 748486 - DNA, 13 bp, Homo sapiens
ctgtttgccactt

SEQ ID NO: 748487 - DNA, 15 bp, Homo sapiens
ctgtttgccacttga

SEQ ID NO: 748488 - DNA, 14 bp, Homo sapiens
ctgtttggcacttg

SEQ ID NO: 748489 - DNA, 19 bp, Homo sapiens
ctgtttggcacttgtattt

SEQ ID NO: 748490 - DNA, 14 bp, Homo sapiens
ctgtttggcctctc

SEQ ID NO: 748491 - DNA, 20 bp, Homo sapiens
ctgtttggtcgagtctttgt

SEQ ID NO: 748492 - DNA, 22 bp, Homo sapiens
ctgtttggtcgagtctttgtgt

SEQ ID NO: 748493 - DNA, 12 bp, Homo sapiens
ctgtttgtaaat

SEQ ID NO: 748494 - DNA, 11 bp, Homo sapiens
ctgtttgtcat

SEQ ID NO: 748495 - DNA, 22 bp, Homo sapiens
ctgtttgtcctgagatggaaaa

SEQ ID NO: 748496 - DNA, 17 bp, Homo sapiens
ctgtttgtctgaacaaa

SEQ ID NO: 748497 - DNA, 17 bp, Homo sapiens
ctgtttgtgcaaacata

SEQ ID NO: 748498 - DNA, 19 bp, Homo sapiens
ctgtttgtttaagctgagc

SEQ ID NO: 748499 - DNA, 21 bp, Homo sapiens
ctgtttgtttaagctgagcca

SEQ ID NO: 748500 - DNA, 20 bp, Homo sapiens
ctgtttgtttcaagaacctg

SEQ ID NO: 748501 - DNA, 18 bp, Homo sapiens
ctgtttgttttgttttct

SEQ ID NO: 748502 - DNA, 12 bp, Homo sapiens
ctgttttaaatt

SEQ ID NO: 748503 - DNA, 22 bp, Homo sapiens
ctgttttaaatttatttcaaaa

SEQ ID NO: 748504 - DNA, 14 bp, Homo sapiens
ctgttttaattgta

SEQ ID NO: 748505 - DNA, 22 bp, Homo sapiens
ctgttttacaaaaaagaaaaga

SEQ ID NO: 748506 - DNA, 15 bp, Homo sapiens
ctgttttatgttgat

SEQ ID NO: 748507 - DNA, 12 bp, Homo sapiens
ctgttttcaata

SEQ ID NO: 748508 - DNA, 21 bp, Homo sapiens
ctgttttcaataacaaagcac

SEQ ID NO: 748509 - DNA, 13 bp, Homo sapiens
ctgttttccctga

SEQ ID NO: 748510 - DNA, 14 bp, Homo sapiens
ctgttttcctccct

SEQ ID NO: 748511 - DNA, 17 bp, Homo sapiens
ctgttttcctcccttct

SEQ ID NO: 748512 - DNA, 19 bp, Homo sapiens
ctgttttcgtaccttccca

SEQ ID NO: 748513 - DNA, 20 bp, Homo sapiens
ctgttttcgtaccttcccac

SEQ ID NO: 748514 - DNA, 16 bp, Homo sapiens
ctgttttctccctctc

SEQ ID NO: 748515 - DNA, 15 bp, Homo sapiens
ctgttttctgaaaca

SEQ ID NO: 748516 - DNA, 17 bp, Homo sapiens
ctgttttctgaaacaca

SEQ ID NO: 748517 - DNA, 15 bp, Homo sapiens
ctgttttctgagccc

SEQ ID NO: 748518 - DNA, 16 bp, Homo sapiens
ctgttttctgtttctt

SEQ ID NO: 748519 - DNA, 14 bp, Homo sapiens
ctgttttcttaggc

SEQ ID NO: 748520 - DNA, 12 bp, Homo sapiens
ctgttttcttct

SEQ ID NO: 748521 - DNA, 20 bp, Homo sapiens
ctgttttgtacatagattta

SEQ ID NO: 748522 - DNA, 19 bp, Homo sapiens
ctgttttgtggtttggaat

SEQ ID NO: 748523 - DNA, 14 bp, Homo sapiens
gtcctgtctgtcct

SEQ ID NO: 748524 - DNA, 14 bp, Homo sapiens
gtcctgtgcttgct

SEQ ID NO: 748525 - DNA, 14 bp, Homo sapiens
gtcctgtgctttct

SEQ ID NO: 748526 - DNA, 16 bp, Homo sapiens
gtcctgttaatttata

SEQ ID NO: 748527 - DNA, 14 bp, Homo sapiens
gtcctgttgaagac

SEQ ID NO: 748528 - DNA, 20 bp, Homo sapiens
gtcctgttgaagacttcctc

SEQ ID NO: 748529 - DNA, 20 bp, Homo sapiens
gtccttaatgatccgttcca

SEQ ID NO: 748530 - DNA, 20 bp, Homo sapiens
gtccttcagtgagcccctcc

SEQ ID NO: 748531 - DNA, 22 bp, Homo sapiens
gtccttcagtgagcccctcccc

SEQ ID NO: 748532 - DNA, 14 bp, Homo sapiens
gtccttccccttcc

SEQ ID NO: 748533 - DNA, 15 bp, Homo sapiens
gtccttccccttccc

SEQ ID NO: 748534 - DNA, 22 bp, Homo sapiens
gtccttccctcaaagaggcctt

SEQ ID NO: 748535 - DNA, 16 bp, Homo sapiens
gtccttccctgcccca

SEQ ID NO: 748536 - DNA, 16 bp, Homo sapiens
gtccttcctccacaag

SEQ ID NO: 748537 - DNA, 22 bp, Homo sapiens
gtccttctacagaacctgaggg

SEQ ID NO: 748538 - DNA, 15 bp, Homo sapiens
gtccttctgacccca

SEQ ID NO: 748539 - DNA, 16 bp, Homo sapiens
gtccttgaacccaaca

SEQ ID NO: 748540 - DNA, 20 bp, Homo sapiens
gtccttgatgccagagggcc

SEQ ID NO: 748541 - DNA, 14 bp, Homo sapiens
gtccttgccccact

SEQ ID NO: 748542 - DNA, 15 bp, Homo sapiens
gtccttgccccactc

SEQ ID NO: 748543 - DNA, 20 bp, Homo sapiens
gtccttggcaggctgatttc

SEQ ID NO: 748544 - DNA, 23 bp, Homo sapiens
gtccttggttgggtcaaggacag

SEQ ID NO: 748545 - DNA, 22 bp, Homo sapiens
gtccttgtatgaataaaaggct

SEQ ID NO: 748546 - DNA, 20 bp, Homo sapiens
gtccttgttcatggagagct

SEQ ID NO: 748547 - DNA, 21 bp, Homo sapiens
gtccttgttcatggagagctg

SEQ ID NO: 748548 - DNA, 21 bp, Homo sapiens
gtcctttacactcaggctttc

SEQ ID NO: 748549 - DNA, 16 bp, Homo sapiens
gtcctttaggcagcct

SEQ ID NO: 748550 - DNA, 17 bp, Homo sapiens
gtcctttaggcagcctg

SEQ ID NO: 748551 - DNA, 18 bp, Homo sapiens
gtcctttaggcagcctgc

SEQ ID NO: 748552 - DNA, 13 bp, Homo sapiens
gtcctttatgtgg

SEQ ID NO: 748553 - DNA, 16 bp, Homo sapiens
gtcctttatgtggaaa

SEQ ID NO: 748554 - DNA, 20 bp, Homo sapiens
gtcctttatgtggaaaacag

SEQ ID NO: 748555 - DNA, 18 bp, Homo sapiens
gtcctttccaaggcttct

SEQ ID NO: 748556 - DNA, 19 bp, Homo sapiens
gtcctttccatctgtccac

SEQ ID NO: 748557 - DNA, 21 bp, Homo sapiens
gtcctttccatctgtccacat

SEQ ID NO: 748558 - DNA, 18 bp, Homo sapiens
gtcctttctgtgaagcta

SEQ ID NO: 748559 - DNA, 22 bp, Homo sapiens
gtcctttgacaaaagtaaatgg

SEQ ID NO: 748560 - DNA, 15 bp, Homo sapiens
gtccttttcactaca

SEQ ID NO: 748561 - DNA, 18 bp, Homo sapiens
gtccttttcactacacca

SEQ ID NO: 748562 - DNA, 20 bp, Homo sapiens
gtccttttcccctacagaat

SEQ ID NO: 748563 - DNA, 17 bp, Homo sapiens
gtccttttgtaccatgg

SEQ ID NO: 748564 - DNA, 15 bp, Homo sapiens
gtccttttgtgaaat

SEQ ID NO: 748565 - DNA, 15 bp, Homo sapiens
gtcgacaagaatgtc

SEQ ID NO: 748566 - DNA, 16 bp, Homo sapiens
gtcgaccaggaaagcc

SEQ ID NO: 748567 - DNA, 22 bp, Homo sapiens
gtcgagaaagaggcaccaggaa

SEQ ID NO: 748568 - DNA, 18 bp, Homo sapiens
gtcgagattgcactgctg

SEQ ID NO: 748569 - DNA, 15 bp, Homo sapiens
gtcgaggagtaacaa

SEQ ID NO: 748570 - DNA, 15 bp, Homo sapiens
gtcgaggggctctca

SEQ ID NO: 748571 - DNA, 18 bp, Homo sapiens
gtcgatcaagagaatcaa

SEQ ID NO: 748572 - DNA, 14 bp, Homo sapiens
gtcgatgaactatt

SEQ ID NO: 748573 - DNA, 14 bp, Homo sapiens
gtcgattagactgg

SEQ ID NO: 748574 - DNA, 17 bp, Homo sapiens
gtcgcagaccagagctg

SEQ ID NO: 748575 - DNA, 19 bp, Homo sapiens
gtcgcaggatccgctgcca

SEQ ID NO: 748576 - DNA, 20 bp, Homo sapiens
gtcgcaggatccgctgccac

SEQ ID NO: 748577 - DNA, 21 bp, Homo sapiens
gtcgcaggatccgctgccacc

SEQ ID NO: 748578 - DNA, 22 bp, Homo sapiens
gtcgcaggatccgctgccacca

SEQ ID NO: 748579 - DNA, 19 bp, Homo sapiens
gtcgccacctggcattcct

SEQ ID NO: 748580 - DNA, 18 bp, Homo sapiens
gtcgccagtcactgctgc

SEQ ID NO: 748581 - DNA, 17 bp, Homo sapiens
gtcgcccacccagctgg

SEQ ID NO: 748582 - DNA, 23 bp, Homo sapiens
gtcgccccaggccctccctgact

SEQ ID NO: 748583 - DNA, 13 bp, Homo sapiens
gtcgccccagtgg

SEQ ID NO: 748584 - DNA, 15 bp, Homo sapiens
gtcgccctcccaggc

SEQ ID NO: 748585 - DNA, 13 bp, Homo sapiens
gtcgcgctcagca

SEQ ID NO: 748586 - DNA, 16 bp, Homo sapiens
gtcgctcaggctggag

SEQ ID NO: 748587 - DNA, 17 bp, Homo sapiens
gtcgctcagtctgttca

SEQ ID NO: 748588 - DNA, 11 bp, Homo sapiens
gtcgctcctgc

SEQ ID NO: 748589 - DNA, 18 bp, Homo sapiens
gtcgctctgctggcctgg

SEQ ID NO: 748590 - DNA, 17 bp, Homo sapiens
gtcgctgtgccacaggc

SEQ ID NO: 748591 - DNA, 21 bp, Homo sapiens
gtcggaaaacatgctacacac

SEQ ID NO: 748592 - DNA, 12 bp, Homo sapiens
gtcggaatggta

SEQ ID NO: 748593 - DNA, 16 bp, Homo sapiens
gtcggagctgcctgca

SEQ ID NO: 748594 - DNA, 14 bp, Homo sapiens
gtcggatcctgtga

SEQ ID NO: 748595 - DNA, 14 bp, Homo sapiens
gtcggatctcacag

SEQ ID NO: 748596 - DNA, 17 bp, Homo sapiens
gtcggcatgccaggacc

SEQ ID NO: 748597 - DNA, 17 bp, Homo sapiens
gtcggccagaggggctg

SEQ ID NO: 748598 - DNA, 14 bp, Homo sapiens
gtcggctcctgatg

SEQ ID NO: 748599 - DNA, 17 bp, Homo sapiens
gtcgggacttgtaacat

SEQ ID NO: 748600 - DNA, 18 bp, Homo sapiens
gtcgggataacgtggggc

SEQ ID NO: 748601 - DNA, 13 bp, Homo sapiens
gtcgggcagccag

SEQ ID NO: 748602 - DNA, 22 bp, Homo sapiens
gtcgggcatggtggctcatgcc

SEQ ID NO: 748603 - DNA, 23 bp, Homo sapiens
gtcgggcccttcttgctgccctg

SEQ ID NO: 748604 - DNA, 21 bp, Homo sapiens
gtcggggagggggaggcggga

SEQ ID NO: 748605 - DNA, 14 bp, Homo sapiens
gtcgggggagagag

SEQ ID NO: 748606 - DNA, 16 bp, Homo sapiens
gtcgggggctggccta

SEQ ID NO: 748607 - DNA, 22 bp, Homo sapiens
gtcggggttggggtgggagggc

SEQ ID NO: 748608 - DNA, 18 bp, Homo sapiens
gtcggtcctggtgccctg

SEQ ID NO: 748609 - DNA, 20 bp, Homo sapiens
gtcgtagccaaggtgggctg

SEQ ID NO: 748610 - DNA, 21 bp, Homo sapiens
gtcgtgcctccttccacctcc

SEQ ID NO: 748611 - DNA, 15 bp, Homo sapiens
gtcgtgcctgtgtcc

SEQ ID NO: 748612 - DNA, 23 bp, Homo sapiens
gtcgtggacacacacagactatt

SEQ ID NO: 748613 - DNA, 17 bp, Homo sapiens
gtcgtggggtgtgctgg

SEQ ID NO: 748614 - DNA, 14 bp, Homo sapiens
gtcgtggttcttaa

SEQ ID NO: 748615 - DNA, 20 bp, Homo sapiens
gtcgtggttcttaaatgttt

SEQ ID NO: 748616 - DNA, 15 bp, Homo sapiens
gtcgtgtaattggcc

SEQ ID NO: 748617 - DNA, 16 bp, Homo sapiens
gtctaaagccttaact

SEQ ID NO: 748618 - DNA, 22 bp, Homo sapiens
gtctaaataggatcctggaggc

SEQ ID NO: 748619 - DNA, 13 bp, Homo sapiens
gtctaaatatttc

SEQ ID NO: 748620 - DNA, 22 bp, Homo sapiens
gtctaacagtttgcctgctgta

SEQ ID NO: 748621 - DNA, 23 bp, Homo sapiens
gtctaacagtttgcctgctgtat

SEQ ID NO: 748622 - DNA, 14 bp, Homo sapiens
gtctaatcctccca

SEQ ID NO: 748623 - DNA, 22 bp, Homo sapiens
gtctaattaaaacactttcaaa

SEQ ID NO: 748624 - DNA, 13 bp, Homo sapiens
gtctaattttctt

SEQ ID NO: 748625 - DNA, 20 bp, Homo sapiens
gtctacaagtatatgtgaaa

SEQ ID NO: 748626 - DNA, 13 bp, Homo sapiens
gtctacagaaaat

SEQ ID NO: 748627 - DNA, 19 bp, Homo sapiens
gtctacagaaaatgctggc

SEQ ID NO: 748628 - DNA, 14 bp, Homo sapiens
gtctacatgtgcca

SEQ ID NO: 748629 - DNA, 12 bp, Homo sapiens
gtctacatttca

SEQ ID NO: 748630 - DNA, 17 bp, Homo sapiens
gtctacctgagcattca

SEQ ID NO: 748631 - DNA, 21 bp, Homo sapiens
gtctacgggggcacttggagg

SEQ ID NO: 748632 - DNA, 18 bp, Homo sapiens
gtctactcctagaagaac

SEQ ID NO: 748633 - DNA, 22 bp, Homo sapiens
gtctactggacaatcttatgtt

SEQ ID NO: 748634 - DNA, 14 bp, Homo sapiens
gtctactgtggtga

SEQ ID NO: 748635 - DNA, 22 bp, Homo sapiens
gtctactgtggtgatctgtaga

SEQ ID NO: 748636 - DNA, 14 bp, Homo sapiens
gtctacttcttaaa

SEQ ID NO: 748637 - DNA, 22 bp, Homo sapiens
gtctactttttaatttttaaga

SEQ ID NO: 748638 - DNA, 12 bp, Homo sapiens
gtctagaatgtg

SEQ ID NO: 748639 - DNA, 16 bp, Homo sapiens
gtctagaatgtggatt

SEQ ID NO: 748640 - DNA, 14 bp, Homo sapiens
gtctagagagggag

SEQ ID NO: 748641 - DNA, 16 bp, Homo sapiens
gtctagagagggaggc

SEQ ID NO: 748642 - DNA, 15 bp, Homo sapiens
gtctagatggctcct

SEQ ID NO: 748643 - DNA, 19 bp, Homo sapiens
gtctagatggctcctctca

SEQ ID NO: 748644 - DNA, 20 bp, Homo sapiens
gtctagatggctcctctcag

SEQ ID NO: 748645 - DNA, 15 bp, Homo sapiens
gtctagccactccct

SEQ ID NO: 748646 - DNA, 19 bp, Homo sapiens
gtctagccactccctccca

SEQ ID NO: 748647 - DNA, 12 bp, Homo sapiens
ctgttttgtgta

SEQ ID NO: 748648 - DNA, 17 bp, Homo sapiens
ctgttttgtgtatattg

SEQ ID NO: 748649 - DNA, 15 bp, Homo sapiens
ctgttttgttaatat

SEQ ID NO: 748650 - DNA, 17 bp, Homo sapiens
ctgttttgttatataat

SEQ ID NO: 748651 - DNA, 18 bp, Homo sapiens
ctgttttgttatataatt

SEQ ID NO: 748652 - DNA, 20 bp, Homo sapiens
ctgttttgttatataattta

SEQ ID NO: 748653 - DNA, 13 bp, Homo sapiens
ctgttttgttgac

SEQ ID NO: 748654 - DNA, 16 bp, Homo sapiens
ctgttttgttgacatt

SEQ ID NO: 748655 - DNA, 17 bp, Homo sapiens
ctgttttgtttggcaag

SEQ ID NO: 748656 - DNA, 15 bp, Homo sapiens
ctgtttttaagctgt

SEQ ID NO: 748657 - DNA, 19 bp, Homo sapiens
ctgtttttaagctgtttcc

SEQ ID NO: 748658 - DNA, 14 bp, Homo sapiens
ctgtttttagtgct

SEQ ID NO: 748659 - DNA, 16 bp, Homo sapiens
ctgtttttattccttc

SEQ ID NO: 748660 - DNA, 13 bp, Homo sapiens
ctgtttttcacat

SEQ ID NO: 748661 - DNA, 18 bp, Homo sapiens
ctgtttttcctatttggt

SEQ ID NO: 748662 - DNA, 17 bp, Homo sapiens
ctgtttttctaactggg

SEQ ID NO: 748663 - DNA, 15 bp, Homo sapiens
ctgtttttctgggtg

SEQ ID NO: 748664 - DNA, 22 bp, Homo sapiens
ctgtttttgataaagtaataat

SEQ ID NO: 748665 - DNA, 13 bp, Homo sapiens
ctgtttttgttgt

SEQ ID NO: 748666 - DNA, 12 bp, Homo sapiens
ctgttttttaaa

SEQ ID NO: 748667 - DNA, 17 bp, Homo sapiens
cttaaaaaataaaaact

SEQ ID NO: 748668 - DNA, 12 bp, Homo sapiens
cttaaaaactgt

SEQ ID NO: 748669 - DNA, 14 bp, Homo sapiens
cttaaaaactgtgt

SEQ ID NO: 748670 - DNA, 16 bp, Homo sapiens
cttaaaaactgtgtat

SEQ ID NO: 748671 - DNA, 17 bp, Homo sapiens
cttaaaaagtggaaaaa

SEQ ID NO: 748672 - DNA, 23 bp, Homo sapiens
cttaaaaatgttttttcatgtgt

SEQ ID NO: 748673 - DNA, 15 bp, Homo sapiens
cttaaaaatttatta

SEQ ID NO: 748674 - DNA, 13 bp, Homo sapiens
cttaaaaccaaag

SEQ ID NO: 748675 - DNA, 12 bp, Homo sapiens
cttaaaaccaga

SEQ ID NO: 748676 - DNA, 21 bp, Homo sapiens
cttaaaaccagagaatcttaa

SEQ ID NO: 748677 - DNA, 22 bp, Homo sapiens
cttaaaaccagagaatcttaag

SEQ ID NO: 748678 - DNA, 18 bp, Homo sapiens
cttaaaaggggcccaagc

SEQ ID NO: 748679 - DNA, 20 bp, Homo sapiens
cttaaaaggggcccaagccc

SEQ ID NO: 748680 - DNA, 12 bp, Homo sapiens
cttaaaataagc

SEQ ID NO: 748681 - DNA, 13 bp, Homo sapiens
cttaaaataagca

SEQ ID NO: 748682 - DNA, 22 bp, Homo sapiens
cttaaaataatgaatacatttc

SEQ ID NO: 748683 - DNA, 13 bp, Homo sapiens
cttaaaatacaag

SEQ ID NO: 748684 - DNA, 13 bp, Homo sapiens
cttaaaatagaaa

SEQ ID NO: 748685 - DNA, 17 bp, Homo sapiens
cttaaaatatatttcag

SEQ ID NO: 748686 - DNA, 23 bp, Homo sapiens
cttaaaatatctctaaaataggt

SEQ ID NO: 748687 - DNA, 19 bp, Homo sapiens
cttaaaatatgtgaagttt

SEQ ID NO: 748688 - DNA, 24 bp, Homo sapiens
cttaaaatgttcacttttgacaaa

SEQ ID NO: 748689 - DNA, 18 bp, Homo sapiens
cttaaaattcaagaaaat

SEQ ID NO: 748690 - DNA, 11 bp, Homo sapiens
cttaaacaaag

SEQ ID NO: 748691 - DNA, 16 bp, Homo sapiens
cttaaacaaagcagta

SEQ ID NO: 748692 - DNA, 17 bp, Homo sapiens
cttaaacaatgtataaa

SEQ ID NO: 748693 - DNA, 18 bp, Homo sapiens
cttaaacccatacaatgt

SEQ ID NO: 748694 - DNA, 19 bp, Homo sapiens
cttaaacccatacaatgta

SEQ ID NO: 748695 - DNA, 23 bp, Homo sapiens
cttaaacccatacaatgtatgta

SEQ ID NO: 748696 - DNA, 22 bp, Homo sapiens
cttaaacctcctgctgtgcctc

SEQ ID NO: 748697 - DNA, 15 bp, Homo sapiens
cttaaacctggaatc

SEQ ID NO: 748698 - DNA, 19 bp, Homo sapiens
cttaaactaaataatgaat

SEQ ID NO: 748699 - DNA, 21 bp, Homo sapiens
cttaaactctggacactctat

SEQ ID NO: 748700 - DNA, 15 bp, Homo sapiens
cttaaactgtgtgga

SEQ ID NO: 748701 - DNA, 23 bp, Homo sapiens
cttaaagaaaattgcatgaaact

SEQ ID NO: 748702 - DNA, 16 bp, Homo sapiens
cttaaagaaacagctt

SEQ ID NO: 748703 - DNA, 22 bp, Homo sapiens
cttaaagaaacagctttcaagt

SEQ ID NO: 748704 - DNA, 22 bp, Homo sapiens
cttaaagaaagtcgaattaata

SEQ ID NO: 748705 - DNA, 15 bp, Homo sapiens
cttaaagagggacag

SEQ ID NO: 748706 - DNA, 20 bp, Homo sapiens
cttaaagcaaaatagtattg

SEQ ID NO: 748707 - DNA, 14 bp, Homo sapiens
cttaaagcaaacta

SEQ ID NO: 748708 - DNA, 18 bp, Homo sapiens
cttaaagctgcctgtagt

SEQ ID NO: 748709 - DNA, 14 bp, Homo sapiens
cttaaagcttgatt

SEQ ID NO: 748710 - DNA, 15 bp, Homo sapiens
cttaaagcttgattt

SEQ ID NO: 748711 - DNA, 21 bp, Homo sapiens
cttaaagcttgatttgatctt

SEQ ID NO: 748712 - DNA, 21 bp, Homo sapiens
cttaaaggctgtggtagtact

SEQ ID NO: 748713 - DNA, 14 bp, Homo sapiens
cttaaagtgaagga

SEQ ID NO: 748714 - DNA, 15 bp, Homo sapiens
cttaaagtgaaggaa

SEQ ID NO: 748715 - DNA, 16 bp, Homo sapiens
cttaaagtgaaggaaa

SEQ ID NO: 748716 - DNA, 10 bp, Homo sapiens
cttaaataaa

SEQ ID NO: 748717 - DNA, 18 bp, Homo sapiens
cttaaataaaaataatag

SEQ ID NO: 748718 - DNA, 14 bp, Homo sapiens
cttaaataaaacta

SEQ ID NO: 748719 - DNA, 18 bp, Homo sapiens
cttaaataaaactattta

SEQ ID NO: 748720 - DNA, 13 bp, Homo sapiens
cttaaataagaaa

SEQ ID NO: 748721 - DNA, 16 bp, Homo sapiens
cttaaataagaaactt

SEQ ID NO: 748722 - DNA, 21 bp, Homo sapiens
cttaaataataaacagtggaa

SEQ ID NO: 748723 - DNA, 21 bp, Homo sapiens
cttaaataatgcttcagatat

SEQ ID NO: 748724 - DNA, 13 bp, Homo sapiens
cttaaataatgtg

SEQ ID NO: 748725 - DNA, 14 bp, Homo sapiens
cttaaataatgtga

SEQ ID NO: 748726 - DNA, 12 bp, Homo sapiens
cttaaatacaga

SEQ ID NO: 748727 - DNA, 14 bp, Homo sapiens
cttaaatacagata

SEQ ID NO: 748728 - DNA, 19 bp, Homo sapiens
cttaaatatatatttctaa

SEQ ID NO: 748729 - DNA, 22 bp, Homo sapiens
cttaaatatatcccatatattt

SEQ ID NO: 748730 - DNA, 13 bp, Homo sapiens
cttaaatatttcc

SEQ ID NO: 748731 - DNA, 21 bp, Homo sapiens
cttaaatcatagctgtctgac

SEQ ID NO: 748732 - DNA, 21 bp, Homo sapiens
cttaaatgaaagcatgtggca

SEQ ID NO: 748733 - DNA, 19 bp, Homo sapiens
cttaaatgagttacttaga

SEQ ID NO: 748734 - DNA, 18 bp, Homo sapiens
cttaaatgctcattttct

SEQ ID NO: 748735 - DNA, 16 bp, Homo sapiens
cttaaatggaattatt

SEQ ID NO: 748736 - DNA, 23 bp, Homo sapiens
cttaaatggtgtaattttgtcct

SEQ ID NO: 748737 - DNA, 21 bp, Homo sapiens
cttaaatgtagcaatggcact

SEQ ID NO: 748738 - DNA, 18 bp, Homo sapiens
cttaaatgtttatactgt

SEQ ID NO: 748739 - DNA, 20 bp, Homo sapiens
cttaaatgtttatactgtat

SEQ ID NO: 748740 - DNA, 11 bp, Homo sapiens
cttaaattaaa

SEQ ID NO: 748741 - DNA, 14 bp, Homo sapiens
cttaaattaaacaa

SEQ ID NO: 748742 - DNA, 15 bp, Homo sapiens
cttaaattaaacaat

SEQ ID NO: 748743 - DNA, 21 bp, Homo sapiens
cttaaattaaacaatttattt

SEQ ID NO: 748744 - DNA, 16 bp, Homo sapiens
cttaaattatgtttta

SEQ ID NO: 748745 - DNA, 18 bp, Homo sapiens
cttaaattcatttctaga

SEQ ID NO: 748746 - DNA, 22 bp, Homo sapiens
cttaaattcatttctagactca

SEQ ID NO: 748747 - DNA, 23 bp, Homo sapiens
cttaaattcatttctagactcaa

SEQ ID NO: 748748 - DNA, 18 bp, Homo sapiens
cttaaattcctactccct

SEQ ID NO: 748749 - DNA, 20 bp, Homo sapiens
cttaaattcctcaacagtgt

SEQ ID NO: 748750 - DNA, 22 bp, Homo sapiens
cttaaattcctcaacagtgttt

SEQ ID NO: 748751 - DNA, 15 bp, Homo sapiens
cttaaattcttttga

SEQ ID NO: 748752 - DNA, 19 bp, Homo sapiens
cttaaatttcttatgtgac

SEQ ID NO: 748753 - DNA, 23 bp, Homo sapiens
cttaaatttcttggcaaatttta

SEQ ID NO: 748754 - DNA, 14 bp, Homo sapiens
cttaaatttgaatc

SEQ ID NO: 748755 - DNA, 21 bp, Homo sapiens
cttaaatttgaatctgagtga

SEQ ID NO: 748756 - DNA, 15 bp, Homo sapiens
cttaaatttgtttaa

SEQ ID NO: 748757 - DNA, 16 bp, Homo sapiens
cttaaattttaactaa

SEQ ID NO: 748758 - DNA, 18 bp, Homo sapiens
cttaaattttaactaaat

SEQ ID NO: 748759 - DNA, 17 bp, Homo sapiens
cttaaattttaatttat

SEQ ID NO: 748760 - DNA, 17 bp, Homo sapiens
cttaaattttgttttct

SEQ ID NO: 748761 - DNA, 15 bp, Homo sapiens
cttaaatttttgtca

SEQ ID NO: 748762 - DNA, 20 bp, Homo sapiens
cttaacaaaccaacatcttt

SEQ ID NO: 748763 - DNA, 22 bp, Homo sapiens
cttaacagatctttactcttga

SEQ ID NO: 748764 - DNA, 16 bp, Homo sapiens
cttaacagttgtattt

SEQ ID NO: 748765 - DNA, 17 bp, Homo sapiens
cttaacagttgtattta

SEQ ID NO: 748766 - DNA, 15 bp, Homo sapiens
cttaacatccctcct

SEQ ID NO: 748767 - DNA, 13 bp, Homo sapiens
cttaacatgggct

SEQ ID NO: 748768 - DNA, 13 bp, Homo sapiens
cttaacattttcc

SEQ ID NO: 748769 - DNA, 18 bp, Homo sapiens
cttaaccaataatggtca

SEQ ID NO: 748770 - DNA, 14 bp, Homo sapiens
cttaaccagtctct

SEQ ID NO: 748771 - DNA, 21 bp, Homo sapiens
cttaaccccgggatgcaaggt

SEQ ID NO: 748772 - DNA, 20 bp, Homo sapiens
gtctagccactccctcccag

SEQ ID NO: 748773 - DNA, 15 bp, Homo sapiens
gtctaggactgcagt

SEQ ID NO: 748774 - DNA, 20 bp, Homo sapiens
gtctaggactgcagtgtgga

SEQ ID NO: 748775 - DNA, 19 bp, Homo sapiens
gtctaggtctcctcagggt

SEQ ID NO: 748776 - DNA, 15 bp, Homo sapiens
gtctaggttaaagct

SEQ ID NO: 748777 - DNA, 17 bp, Homo sapiens
gtctaggttaaagctaa

SEQ ID NO: 748778 - DNA, 21 bp, Homo sapiens
gtctaggttaaagctaaactg

SEQ ID NO: 748779 - DNA, 22 bp, Homo sapiens
gtctagtcacgcatgcagtgtt

SEQ ID NO: 748780 - DNA, 21 bp, Homo sapiens
gtctagtcttctggttttcta

SEQ ID NO: 748781 - DNA, 14 bp, Homo sapiens
gtctagtttctagt

SEQ ID NO: 748782 - DNA, 17 bp, Homo sapiens
gtctataaaagaaacac

SEQ ID NO: 748783 - DNA, 15 bp, Homo sapiens
gtctataaaataaac

SEQ ID NO: 748784 - DNA, 19 bp, Homo sapiens
gtctataaaataaacttct

SEQ ID NO: 748785 - DNA, 20 bp, Homo sapiens
gtctataaaataaacttctt

SEQ ID NO: 748786 - DNA, 22 bp, Homo sapiens
gtctataaaataaacttcttaa

SEQ ID NO: 748787 - DNA, 18 bp, Homo sapiens
gtctataatggaaacatt

SEQ ID NO: 748788 - DNA, 15 bp, Homo sapiens
gtctatatacacaga

SEQ ID NO: 748789 - DNA, 19 bp, Homo sapiens
gtctatatacacagacatg

SEQ ID NO: 748790 - DNA, 17 bp, Homo sapiens
gtctatatgaaaaacaa

SEQ ID NO: 748791 - DNA, 14 bp, Homo sapiens
gtctatcaaatgaa

SEQ ID NO: 748792 - DNA, 20 bp, Homo sapiens
gtctatctggtattaaatgc

SEQ ID NO: 748793 - DNA, 9 bp, Homo sapiens
gtctatgaa

SEQ ID NO: 748794 - DNA, 12 bp, Homo sapiens
gtctatgaagtt

SEQ ID NO: 748795 - DNA, 15 bp, Homo sapiens
gtctatgaagttgct

SEQ ID NO: 748796 - DNA, 18 bp, Homo sapiens
gtctatgtcgagagctgg

SEQ ID NO: 748797 - DNA, 22 bp, Homo sapiens
gtctatgtcgagagctggccaa

SEQ ID NO: 748798 - DNA, 16 bp, Homo sapiens
gtctatgttcaaagac

SEQ ID NO: 748799 - DNA, 17 bp, Homo sapiens
gtctatgttcaaagact

SEQ ID NO: 748800 - DNA, 16 bp, Homo sapiens
gtctattctgagcctt

SEQ ID NO: 748801 - DNA, 18 bp, Homo sapiens
gtctattctgagccttga

SEQ ID NO: 748802 - DNA, 16 bp, Homo sapiens
gtctatttaagcctca

SEQ ID NO: 748803 - DNA, 16 bp, Homo sapiens
gtctatttttgtctta

SEQ ID NO: 748804 - DNA, 19 bp, Homo sapiens
gtctatttttttaactgaa

SEQ ID NO: 748805 - DNA, 20 bp, Homo sapiens
gtctcaaacttgtggcctca

SEQ ID NO: 748806 - DNA, 21 bp, Homo sapiens
gtctcaaacttgtggcctcaa

SEQ ID NO: 748807 - DNA, 22 bp, Homo sapiens
gtctcaaacttgtggcctcaag

SEQ ID NO: 748808 - DNA, 15 bp, Homo sapiens
gtctcaatgaaatag

SEQ ID NO: 748809 - DNA, 13 bp, Homo sapiens
gtctcacagccct

SEQ ID NO: 748810 - DNA, 19 bp, Homo sapiens
gtctcacagtgttgcccag

SEQ ID NO: 748811 - DNA, 20 bp, Homo sapiens
gtctcaccggctctcacctg

SEQ ID NO: 748812 - DNA, 14 bp, Homo sapiens
gtctcactcctgag

SEQ ID NO: 748813 - DNA, 14 bp, Homo sapiens
gtctcactctctgg

SEQ ID NO: 748814 - DNA, 14 bp, Homo sapiens
gtctcactgcttga

SEQ ID NO: 748815 - DNA, 20 bp, Homo sapiens
gtctcgttttgttgccaaag

SEQ ID NO: 748816 - DNA, 18 bp, Homo sapiens
gtctctagagcagggatt

SEQ ID NO: 748817 - DNA, 18 bp, Homo sapiens
gtctctagtgctgtgaaa

SEQ ID NO: 748818 - DNA, 17 bp, Homo sapiens
gtctctatgccagctca

SEQ ID NO: 748819 - DNA, 23 bp, Homo sapiens
gtctctatgccagctcagtccca

SEQ ID NO: 748820 - DNA, 19 bp, Homo sapiens
gtctctccccctctgtctt

SEQ ID NO: 748821 - DNA, 20 bp, Homo sapiens
gtctctcctagcccctctct

SEQ ID NO: 748822 - DNA, 18 bp, Homo sapiens
gtctctctccatgttggc

SEQ ID NO: 748823 - DNA, 12 bp, Homo sapiens
gtctctctccct

SEQ ID NO: 748824 - DNA, 13 bp, Homo sapiens
gtctctctcccta

SEQ ID NO: 748825 - DNA, 23 bp, Homo sapiens
gtctctctccctacctccctcct

SEQ ID NO: 748826 - DNA, 13 bp, Homo sapiens
gtctctctccctc

SEQ ID NO: 748827 - DNA, 14 bp, Homo sapiens
gtctctctccctct

SEQ ID NO: 748828 - DNA, 18 bp, Homo sapiens
gtctctctccctctgtct

SEQ ID NO: 748829 - DNA, 15 bp, Homo sapiens
gtctctctgggctgc

SEQ ID NO: 748830 - DNA, 21 bp, Homo sapiens
gtctctctggggccacacaga

SEQ ID NO: 748831 - DNA, 14 bp, Homo sapiens
gtctctctgtgaat

SEQ ID NO: 748832 - DNA, 18 bp, Homo sapiens
gtctctcttctcagagtg

SEQ ID NO: 748833 - DNA, 19 bp, Homo sapiens
gtctctcttctcagagtgg

SEQ ID NO: 748834 - DNA, 15 bp, Homo sapiens
gtctctcttctctcc

SEQ ID NO: 748835 - DNA, 20 bp, Homo sapiens
gtctctcttctctccagctg

SEQ ID NO: 748836 - DNA, 12 bp, Homo sapiens
gtctctgaaggg

SEQ ID NO: 748837 - DNA, 21 bp, Homo sapiens
gtctctgaaggtaagatcatt

SEQ ID NO: 748838 - DNA, 15 bp, Homo sapiens
gtctctgagtccttt

SEQ ID NO: 748839 - DNA, 13 bp, Homo sapiens
gtctctgccaccc

SEQ ID NO: 748840 - DNA, 14 bp, Homo sapiens
gtctctgccaccca

SEQ ID NO: 748841 - DNA, 12 bp, Homo sapiens
gtctctgcctcc

SEQ ID NO: 748842 - DNA, 13 bp, Homo sapiens
gtctctgctccta

SEQ ID NO: 748843 - DNA, 20 bp, Homo sapiens
gtctctgctcctacatccag

SEQ ID NO: 748844 - DNA, 11 bp, Homo sapiens
gtctctgctgg

SEQ ID NO: 748845 - DNA, 15 bp, Homo sapiens
gtctctgcttccatg

SEQ ID NO: 748846 - DNA, 22 bp, Homo sapiens
gtctctgctttccttttctctg

SEQ ID NO: 748847 - DNA, 16 bp, Homo sapiens
gtctctggcagttctg

SEQ ID NO: 748848 - DNA, 21 bp, Homo sapiens
gtctctggcagttctggaatg

SEQ ID NO: 748849 - DNA, 13 bp, Homo sapiens
gtctctgggccac

SEQ ID NO: 748850 - DNA, 19 bp, Homo sapiens
gtctctgggccacttggag

SEQ ID NO: 748851 - DNA, 15 bp, Homo sapiens
gtctctgggcctgtg

SEQ ID NO: 748852 - DNA, 14 bp, Homo sapiens
gtctctgggctgag

SEQ ID NO: 748853 - DNA, 17 bp, Homo sapiens
gtctctgggctgaggaa

SEQ ID NO: 748854 - DNA, 12 bp, Homo sapiens
gtctctggggac

SEQ ID NO: 748855 - DNA, 20 bp, Homo sapiens
gtctctggggaccctccaga

SEQ ID NO: 748856 - DNA, 11 bp, Homo sapiens
gtctctggggc

SEQ ID NO: 748857 - DNA, 17 bp, Homo sapiens
gtctctggggcagatcc

SEQ ID NO: 748858 - DNA, 16 bp, Homo sapiens
gtctctggtagcctgc

SEQ ID NO: 748859 - DNA, 17 bp, Homo sapiens
gtctctgtcgtggacac

SEQ ID NO: 748860 - DNA, 14 bp, Homo sapiens
gtctctgtgctttg

SEQ ID NO: 748861 - DNA, 20 bp, Homo sapiens
gtctctgttcagatgtgcat

SEQ ID NO: 748862 - DNA, 18 bp, Homo sapiens
gtctctgttggtccactg

SEQ ID NO: 748863 - DNA, 20 bp, Homo sapiens
gtctctgttggtccactgtg

SEQ ID NO: 748864 - DNA, 15 bp, Homo sapiens
gtctctgtttcctga

SEQ ID NO: 748865 - DNA, 22 bp, Homo sapiens
gtctcttcaagcatcctcagaa

SEQ ID NO: 748866 - DNA, 11 bp, Homo sapiens
gtctcttcaga

SEQ ID NO: 748867 - DNA, 17 bp, Homo sapiens
gtctcttccacaggaag

SEQ ID NO: 748868 - DNA, 13 bp, Homo sapiens
gtctcttcctctg

SEQ ID NO: 748869 - DNA, 18 bp, Homo sapiens
gtctcttcggcagggagg

SEQ ID NO: 748870 - DNA, 22 bp, Homo sapiens
gtctcttctcccagaatcccag

SEQ ID NO: 748871 - DNA, 22 bp, Homo sapiens
gtctcttctgagctatttcatc

SEQ ID NO: 748872 - DNA, 22 bp, Homo sapiens
gtctcttgagcatcaatcttgt

SEQ ID NO: 748873 - DNA, 19 bp, Homo sapiens
gtctcttgtattaaactct

SEQ ID NO: 748874 - DNA, 20 bp, Homo sapiens
gtctcttgtgactcagcaga

SEQ ID NO: 748875 - DNA, 13 bp, Homo sapiens
gtctctttaagtt

SEQ ID NO: 748876 - DNA, 18 bp, Homo sapiens
gtctctttaatcttcagt

SEQ ID NO: 748877 - DNA, 16 bp, Homo sapiens
gtctctttcttccttt

SEQ ID NO: 748878 - DNA, 17 bp, Homo sapiens
gtctctttcttcctttc

SEQ ID NO: 748879 - DNA, 12 bp, Homo sapiens
gtctctttgttc

SEQ ID NO: 748880 - DNA, 14 bp, Homo sapiens
gtctctttgttcaa

SEQ ID NO: 748881 - DNA, 15 bp, Homo sapiens
gtctctttgttcaat

SEQ ID NO: 748882 - DNA, 14 bp, Homo sapiens
gtctcttttctctt

SEQ ID NO: 748883 - DNA, 16 bp, Homo sapiens
gtctctttttcttcct

SEQ ID NO: 748884 - DNA, 22 bp, Homo sapiens
gtctcttttttattctgttttc

SEQ ID NO: 748885 - DNA, 13 bp, Homo sapiens
gtctgaacccttg

SEQ ID NO: 748886 - DNA, 15 bp, Homo sapiens
gtctgaacccttgtg

SEQ ID NO: 748887 - DNA, 19 bp, Homo sapiens
gtctgaaggaatagccaga

SEQ ID NO: 748888 - DNA, 22 bp, Homo sapiens
gtctgaaggaatagccagagag

SEQ ID NO: 748889 - DNA, 23 bp, Homo sapiens
gtctgaaggaatagccagagagg

SEQ ID NO: 748890 - DNA, 20 bp, Homo sapiens
gtctgaaggacacttcctgc

SEQ ID NO: 748891 - DNA, 14 bp, Homo sapiens
gtctgaagtacaaa

SEQ ID NO: 748892 - DNA, 21 bp, Homo sapiens
gtctgaagtacaaacatgaaa

SEQ ID NO: 748893 - DNA, 16 bp, Homo sapiens
gtctgaagtcactgca

SEQ ID NO: 748894 - DNA, 14 bp, Homo sapiens
gtctgaatgatctt

SEQ ID NO: 748895 - DNA, 20 bp, Homo sapiens
gtctgaatgttctgacatta

SEQ ID NO: 748896 - DNA, 22 bp, Homo sapiens
gtctgacacgcaagtgtgtgag

SEQ ID NO: 748897 - DNA, 16 bp, Homo sapiens
gtctgactccagagtc

SEQ ID NO: 748898 - DNA, 18 bp, Homo sapiens
gtctgactccagagtctg

SEQ ID NO: 748899 - DNA, 18 bp, Homo sapiens
gtctgactccctccccac

SEQ ID NO: 748900 - DNA, 19 bp, Homo sapiens
gtctgactccctccccacc

SEQ ID NO: 748901 - DNA, 21 bp, Homo sapiens
gtctgactccctccccaccca

SEQ ID NO: 748902 - DNA, 22 bp, Homo sapiens
gtctgactccctccccacccaa

SEQ ID NO: 748903 - DNA, 20 bp, Homo sapiens
cttacaagcttaaagcttga

SEQ ID NO: 748904 - DNA, 20 bp, Homo sapiens
cttacaattccctgctgtcg

SEQ ID NO: 748905 - DNA, 16 bp, Homo sapiens
cttacaattgcactgc

SEQ ID NO: 748906 - DNA, 21 bp, Homo sapiens
cttacacacccccagagagag

SEQ ID NO: 748907 - DNA, 18 bp, Homo sapiens
cttacacctggaatgtta

SEQ ID NO: 748908 - DNA, 16 bp, Homo sapiens
cttacactgaaaatgt

SEQ ID NO: 748909 - DNA, 12 bp, Homo sapiens
cttacactgagg

SEQ ID NO: 748910 - DNA, 14 bp, Homo sapiens
cttacactgaggac

SEQ ID NO: 748911 - DNA, 16 bp, Homo sapiens
cttacacttggagccc

SEQ ID NO: 748912 - DNA, 18 bp, Homo sapiens
cttacacttggagcccgt

SEQ ID NO: 748913 - DNA, 19 bp, Homo sapiens
cttacagaaatgactgccg

SEQ ID NO: 748914 - DNA, 12 bp, Homo sapiens
cttacagagcct

SEQ ID NO: 748915 - DNA, 15 bp, Homo sapiens
cttacagagccttga

SEQ ID NO: 748916 - DNA, 16 bp, Homo sapiens
cttacagcctctgact

SEQ ID NO: 748917 - DNA, 20 bp, Homo sapiens
cttacagttaagaagccctg

SEQ ID NO: 748918 - DNA, 15 bp, Homo sapiens
cttacataaagctcc

SEQ ID NO: 748919 - DNA, 19 bp, Homo sapiens
cttacatctgtaaagaaaa

SEQ ID NO: 748920 - DNA, 14 bp, Homo sapiens
cttacatcttttct

SEQ ID NO: 748921 - DNA, 22 bp, Homo sapiens
cttacattagcagtttgctttg

SEQ ID NO: 748922 - DNA, 22 bp, Homo sapiens
cttacatttccatttattgttt

SEQ ID NO: 748923 - DNA, 14 bp, Homo sapiens
cttacatttgtact

SEQ ID NO: 748924 - DNA, 20 bp, Homo sapiens
cttacattttactttttcct

SEQ ID NO: 748925 - DNA, 17 bp, Homo sapiens
cttacatttttacaata

SEQ ID NO: 748926 - DNA, 14 bp, Homo sapiens
cttaccaactttct

SEQ ID NO: 748927 - DNA, 14 bp, Homo sapiens
cttaccagatgcta

SEQ ID NO: 748928 - DNA, 22 bp, Homo sapiens
cttaccagatgctactggactt

SEQ ID NO: 748929 - DNA, 19 bp, Homo sapiens
cttaccaggcaccaaaaga

SEQ ID NO: 748930 - DNA, 17 bp, Homo sapiens
cttaccagtctcctccc

SEQ ID NO: 748931 - DNA, 13 bp, Homo sapiens
cttaccattaaag

SEQ ID NO: 748932 - DNA, 15 bp, Homo sapiens
cttacccaagctgtg

SEQ ID NO: 748933 - DNA, 22 bp, Homo sapiens
cttacccaagctgtggcagccg

SEQ ID NO: 748934 - DNA, 22 bp, Homo sapiens
cttacccaatgggaccgtgccc

SEQ ID NO: 748935 - DNA, 16 bp, Homo sapiens
cttaccccgagacctc

SEQ ID NO: 748936 - DNA, 17 bp, Homo sapiens
cttaccccgagacctca

SEQ ID NO: 748937 - DNA, 18 bp, Homo sapiens
gtctgcattgttattgtg

SEQ ID NO: 748938 - DNA, 18 bp, Homo sapiens
gtctgccaccatcctgct

SEQ ID NO: 748939 - DNA, 16 bp, Homo sapiens
gtctgccagccagcag

SEQ ID NO: 748940 - DNA, 13 bp, Homo sapiens
gtctgccaggcac

SEQ ID NO: 748941 - DNA, 20 bp, Homo sapiens
gtctgccaggcactctcatc

SEQ ID NO: 748942 - DNA, 12 bp, Homo sapiens
gtctgccaggcc

SEQ ID NO: 748943 - DNA, 14 bp, Homo sapiens
gtctgccaggccca

SEQ ID NO: 748944 - DNA, 22 bp, Homo sapiens
gtctgccaggggtaacctggcc

SEQ ID NO: 748945 - DNA, 21 bp, Homo sapiens
gtctgccatgttgcccctttc

SEQ ID NO: 748946 - DNA, 18 bp, Homo sapiens
gtctgccgcccacctcgc

SEQ ID NO: 748947 - DNA, 13 bp, Homo sapiens
gtctgcctgtatt

SEQ ID NO: 748948 - DNA, 14 bp, Homo sapiens
gtctgcctgtattt

SEQ ID NO: 748949 - DNA, 13 bp, Homo sapiens
gtctgccttaaag

SEQ ID NO: 748950 - DNA, 21 bp, Homo sapiens
gtctgcgttaggcagggcagg

SEQ ID NO: 748951 - DNA, 18 bp, Homo sapiens
gtctgctaggcgctgggg

SEQ ID NO: 748952 - DNA, 13 bp, Homo sapiens
gtctgctccacca

SEQ ID NO: 748953 - DNA, 19 bp, Homo sapiens
gtctgctctttctctgcca

SEQ ID NO: 748954 - DNA, 22 bp, Homo sapiens
gtctgctctttctctgccagtg

SEQ ID NO: 748955 - DNA, 13 bp, Homo sapiens
gtctgcttagaaa

SEQ ID NO: 748956 - DNA, 11 bp, Homo sapiens
gtctgcttctg

SEQ ID NO: 748957 - DNA, 12 bp, Homo sapiens
gtctgcttctgt

SEQ ID NO: 748958 - DNA, 23 bp, Homo sapiens
gtctgctttaaagggcctgcctg

SEQ ID NO: 748959 - DNA, 12 bp, Homo sapiens
gtctggaccccg

SEQ ID NO: 748960 - DNA, 18 bp, Homo sapiens
gtctggactgacagcatg

SEQ ID NO: 748961 - DNA, 22 bp, Homo sapiens
gtctggagaagctcccaggaac

SEQ ID NO: 748962 - DNA, 13 bp, Homo sapiens
gtctggagtccca

SEQ ID NO: 748963 - DNA, 19 bp, Homo sapiens
gtctggatcagtaaaatta

SEQ ID NO: 748964 - DNA, 22 bp, Homo sapiens
gtctggatctgggaccctttcc

SEQ ID NO: 748965 - DNA, 19 bp, Homo sapiens
gtctggatgggaggagagc

SEQ ID NO: 748966 - DNA, 15 bp, Homo sapiens
gtctggcccaccagg

SEQ ID NO: 748967 - DNA, 14 bp, Homo sapiens
gtctggccctgggg

SEQ ID NO: 748968 - DNA, 21 bp, Homo sapiens
gtctgggagaaattgacagat

SEQ ID NO: 748969 - DNA, 13 bp, Homo sapiens
gtctgggagagcc

SEQ ID NO: 748970 - DNA, 14 bp, Homo sapiens
gtctgggagagcct

SEQ ID NO: 748971 - DNA, 17 bp, Homo sapiens
gtctgggagagcctggc

SEQ ID NO: 748972 - DNA, 10 bp, Homo sapiens
gtctgggagg

SEQ ID NO: 748973 - DNA, 19 bp, Homo sapiens
gtctgggatatggctgccc

SEQ ID NO: 748974 - DNA, 17 bp, Homo sapiens
gtctgggatgtagaact

SEQ ID NO: 748975 - DNA, 23 bp, Homo sapiens
gtctgggcaagtagcaggactag

SEQ ID NO: 748976 - DNA, 14 bp, Homo sapiens
gtctgggcagtgcc

SEQ ID NO: 748977 - DNA, 15 bp, Homo sapiens
gtctgggcagtgcca

SEQ ID NO: 748978 - DNA, 20 bp, Homo sapiens
gtctgggcagtgccacagcc

SEQ ID NO: 748979 - DNA, 14 bp, Homo sapiens
gtctgggcctctga

SEQ ID NO: 748980 - DNA, 15 bp, Homo sapiens
gtctgggcctctgac

SEQ ID NO: 748981 - DNA, 20 bp, Homo sapiens
gtctgggcgtccagctcagc

SEQ ID NO: 748982 - DNA, 15 bp, Homo sapiens
gtctgggctgggcac

SEQ ID NO: 748983 - DNA, 14 bp, Homo sapiens
gtctggggacaggc

SEQ ID NO: 748984 - DNA, 14 bp, Homo sapiens
gtctggggccccat

SEQ ID NO: 748985 - DNA, 14 bp, Homo sapiens
gtctgggggcagct

SEQ ID NO: 748986 - DNA, 15 bp, Homo sapiens
gtctgggggcagctg

SEQ ID NO: 748987 - DNA, 16 bp, Homo sapiens
gtctgggggcagctgt

SEQ ID NO: 748988 - DNA, 17 bp, Homo sapiens
gtctgggggcagctgtc

SEQ ID NO: 748989 - DNA, 18 bp, Homo sapiens
gtctgggggcagctgtcc

SEQ ID NO: 748990 - DNA, 15 bp, Homo sapiens
gtctggggtgtgggg

SEQ ID NO: 748991 - DNA, 18 bp, Homo sapiens
gtctggggttcagcccct

SEQ ID NO: 748992 - DNA, 16 bp, Homo sapiens
gtctgggtgcagctgg

SEQ ID NO: 748993 - DNA, 19 bp, Homo sapiens
gtctgggtttggcccaaga

SEQ ID NO: 748994 - DNA, 20 bp, Homo sapiens
gtctgggtttggcccaagac

SEQ ID NO: 748995 - DNA, 14 bp, Homo sapiens
gtctggtaaatatg

SEQ ID NO: 748996 - DNA, 15 bp, Homo sapiens
gtctggtgaggtggc

SEQ ID NO: 748997 - DNA, 20 bp, Homo sapiens
gtctggtggccccgtttctg

SEQ ID NO: 748998 - DNA, 20 bp, Homo sapiens
gtctggtttatataagacca

SEQ ID NO: 748999 - DNA, 14 bp, Homo sapiens
gtctggtttctaga

SEQ ID NO: 749000 - DNA, 16 bp, Homo sapiens
gtctgtaaaaccagca

SEQ ID NO: 749001 - DNA, 15 bp, Homo sapiens
gtctgtaaaatacat

SEQ ID NO: 749002 - DNA, 19 bp, Homo sapiens
gtctgtaactgcccagccc

SEQ ID NO: 749003 - DNA, 12 bp, Homo sapiens
gtctgtaatgac

SEQ ID NO: 749004 - DNA, 10 bp, Homo sapiens
gtctgtacat

SEQ ID NO: 749005 - DNA, 12 bp, Homo sapiens
gtctgtacatac

SEQ ID NO: 749006 - DNA, 17 bp, Homo sapiens
gtctgtatatacatttc

SEQ ID NO: 749007 - DNA, 20 bp, Homo sapiens
gtctgtatcggagacagtga

SEQ ID NO: 749008 - DNA, 12 bp, Homo sapiens
gtctgtatttca

SEQ ID NO: 749009 - DNA, 18 bp, Homo sapiens
gtctgtatttcatgtggc

SEQ ID NO: 749010 - DNA, 21 bp, Homo sapiens
gtctgtatttcatgtggctgt

SEQ ID NO: 749011 - DNA, 13 bp, Homo sapiens
gtctgtcaaatgt

SEQ ID NO: 749012 - DNA, 16 bp, Homo sapiens
gtctgtcaatcacagt

SEQ ID NO: 749013 - DNA, 20 bp, Homo sapiens
gtctgtcacaggctgggtca

SEQ ID NO: 749014 - DNA, 19 bp, Homo sapiens
gtctgtcatcctctggaag

SEQ ID NO: 749015 - DNA, 22 bp, Homo sapiens
gtctgtcatgaacatgttcctg

SEQ ID NO: 749016 - DNA, 18 bp, Homo sapiens
gtctgtcctacccgcccg

SEQ ID NO: 749017 - DNA, 17 bp, Homo sapiens
gtctgtcctcagagcag

SEQ ID NO: 749018 - DNA, 21 bp, Homo sapiens
gtctgtcctcagagcaggggc

SEQ ID NO: 749019 - DNA, 23 bp, Homo sapiens
gtctgtccttctgaagtgtgtcc

SEQ ID NO: 749020 - DNA, 15 bp, Homo sapiens
gtctgtctactgtgg

SEQ ID NO: 749021 - DNA, 21 bp, Homo sapiens
gtctgtctccatcgtctcatc

SEQ ID NO: 749022 - DNA, 23 bp, Homo sapiens
gtctgtctccatcgtctcatcct

SEQ ID NO: 749023 - DNA, 22 bp, Homo sapiens
gtctgtctctccatctgtttgg

SEQ ID NO: 749024 - DNA, 21 bp, Homo sapiens
gtctgtctgaatgatcttgtg

SEQ ID NO: 749025 - DNA, 13 bp, Homo sapiens
gtctgtctgcttt

SEQ ID NO: 749026 - DNA, 18 bp, Homo sapiens
gtctgtctgtcgcccttc

SEQ ID NO: 749027 - DNA, 15 bp, Homo sapiens
gtctgtctgtgggct

SEQ ID NO: 749028 - DNA, 16 bp, Homo sapiens
gtctgtctttcctgaa

SEQ ID NO: 749029 - DNA, 15 bp, Homo sapiens
gtctgtctttgtggg

SEQ ID NO: 749030 - DNA, 18 bp, Homo sapiens
gtctgtgaacagagagac

SEQ ID NO: 749031 - DNA, 14 bp, Homo sapiens
cttagatctctcct

SEQ ID NO: 749032 - DNA, 19 bp, Homo sapiens
cttagatgtatatatttcc

SEQ ID NO: 749033 - DNA, 17 bp, Homo sapiens
cttagatgttaaatgtt

SEQ ID NO: 749034 - DNA, 18 bp, Homo sapiens
cttagatgttctaagtct

SEQ ID NO: 749035 - DNA, 18 bp, Homo sapiens
cttagattagctctggac

SEQ ID NO: 749036 - DNA, 15 bp, Homo sapiens
cttagattcagggga

SEQ ID NO: 749037 - DNA, 17 bp, Homo sapiens
cttagattcaggggaag

SEQ ID NO: 749038 - DNA, 16 bp, Homo sapiens
cttagcacagagaggg

SEQ ID NO: 749039 - DNA, 16 bp, Homo sapiens
cttagcaccttcaggg

SEQ ID NO: 749040 - DNA, 16 bp, Homo sapiens
cttagcagcttccaga

SEQ ID NO: 749041 - DNA, 18 bp, Homo sapiens
cttagcagcttccagatt

SEQ ID NO: 749042 - DNA, 11 bp, Homo sapiens
cttagcatgtg

SEQ ID NO: 749043 - DNA, 21 bp, Homo sapiens
cttagcatgtgactcctgaag

SEQ ID NO: 749044 - DNA, 18 bp, Homo sapiens
cttagcatgtgttgaaaa

SEQ ID NO: 749045 - DNA, 15 bp, Homo sapiens
cttagccattgaaat

SEQ ID NO: 749046 - DNA, 12 bp, Homo sapiens
cttagcccaaga

SEQ ID NO: 749047 - DNA, 17 bp, Homo sapiens
cttagcccaagaggtct

SEQ ID NO: 749048 - DNA, 21 bp, Homo sapiens
cttagccccgctgagcttgga

SEQ ID NO: 749049 - DNA, 15 bp, Homo sapiens
cttagccgcaccctg

SEQ ID NO: 749050 - DNA, 22 bp, Homo sapiens
cttagccgcaccctgcacctgc

SEQ ID NO: 749051 - DNA, 14 bp, Homo sapiens
cttagcctccctga

SEQ ID NO: 749052 - DNA, 15 bp, Homo sapiens
cttagcctctcccac

SEQ ID NO: 749053 - DNA, 16 bp, Homo sapiens
cttagcctctcccacc

SEQ ID NO: 749054 - DNA, 15 bp, Homo sapiens
cttagcctgcctcac

SEQ ID NO: 749055 - DNA, 18 bp, Homo sapiens
cttagcctggatttcctt

SEQ ID NO: 749056 - DNA, 15 bp, Homo sapiens
cttagccttgtgccc

SEQ ID NO: 749057 - DNA, 23 bp, Homo sapiens
cttagccttgtgccctgccccca

SEQ ID NO: 749058 - DNA, 16 bp, Homo sapiens
cttagcgctctggaca

SEQ ID NO: 749059 - DNA, 12 bp, Homo sapiens
cttagcgggaca

SEQ ID NO: 749060 - DNA, 14 bp, Homo sapiens
cttatcttatgcca

SEQ ID NO: 749061 - DNA, 14 bp, Homo sapiens
cttatctttctttc

SEQ ID NO: 749062 - DNA, 21 bp, Homo sapiens
cttatgacatcacttgtacaa

SEQ ID NO: 749063 - DNA, 18 bp, Homo sapiens
cttatgactaaattttct

SEQ ID NO: 749064 - DNA, 13 bp, Homo sapiens
cttatgagatggg

SEQ ID NO: 749065 - DNA, 19 bp, Homo sapiens
cttatgagcgtcactgccc

SEQ ID NO: 749066 - DNA, 23 bp, Homo sapiens
cttatgatagcaaatggcctcat

SEQ ID NO: 749067 - DNA, 23 bp, Homo sapiens
cttatgccacccccgctggagga

SEQ ID NO: 749068 - DNA, 16 bp, Homo sapiens
cttatgcggttaattt

SEQ ID NO: 749069 - DNA, 15 bp, Homo sapiens
cttatgctgctgtga

SEQ ID NO: 749070 - DNA, 13 bp, Homo sapiens
cttatgcttatga

SEQ ID NO: 749071 - DNA, 20 bp, Homo sapiens
cttatggaattgatttgcat

SEQ ID NO: 749072 - DNA, 23 bp, Homo sapiens
cttatggaattgatttgcattga

SEQ ID NO: 749073 - DNA, 16 bp, Homo sapiens
cttatggacactgcct

SEQ ID NO: 749074 - DNA, 20 bp, Homo sapiens
cttatgggatcatttttcca

SEQ ID NO: 749075 - DNA, 19 bp, Homo sapiens
cttatgggtggctttcaag

SEQ ID NO: 749076 - DNA, 13 bp, Homo sapiens
cttatgtaaagta

SEQ ID NO: 749077 - DNA, 19 bp, Homo sapiens
cttatgtagcaggaaataa

SEQ ID NO: 749078 - DNA, 21 bp, Homo sapiens
cttatgtgaaaaattaacttt

SEQ ID NO: 749079 - DNA, 23 bp, Homo sapiens
cttatgtgacattaacaaataaa

SEQ ID NO: 749080 - DNA, 18 bp, Homo sapiens
cttatgttgaaaaaattt

SEQ ID NO: 749081 - DNA, 16 bp, Homo sapiens
cttattaaaaaatttg

SEQ ID NO: 749082 - DNA, 15 bp, Homo sapiens
cttattaaagtattc

SEQ ID NO: 749083 - DNA, 12 bp, Homo sapiens
cttattaatttc

SEQ ID NO: 749084 - DNA, 14 bp, Homo sapiens
cttattactattat

SEQ ID NO: 749085 - DNA, 15 bp, Homo sapiens
cttattactattatt

SEQ ID NO: 749086 - DNA, 21 bp, Homo sapiens
cttattagagtgtctttccac

SEQ ID NO: 749087 - DNA, 17 bp, Homo sapiens
cttattcattttctcta

SEQ ID NO: 749088 - DNA, 19 bp, Homo sapiens
cttattccctcatcctttc

SEQ ID NO: 749089 - DNA, 15 bp, Homo sapiens
cttattctcctccct

SEQ ID NO: 749090 - DNA, 18 bp, Homo sapiens
cttattctgacataaaat

SEQ ID NO: 749091 - DNA, 12 bp, Homo sapiens
cttattctgtag

SEQ ID NO: 749092 - DNA, 12 bp, Homo sapiens
cttattcttaag

SEQ ID NO: 749093 - DNA, 13 bp, Homo sapiens
cttattcttctca

SEQ ID NO: 749094 - DNA, 11 bp, Homo sapiens
cttattgaaaa

SEQ ID NO: 749095 - DNA, 23 bp, Homo sapiens
cttattgaaaaaaaaaatgttga

SEQ ID NO: 749096 - DNA, 13 bp, Homo sapiens
cttattgaatata

SEQ ID NO: 749097 - DNA, 23 bp, Homo sapiens
cttattgatattctaagaaatat

SEQ ID NO: 749098 - DNA, 12 bp, Homo sapiens
cttattgcaaaa

SEQ ID NO: 749099 - DNA, 13 bp, Homo sapiens
cttattgccaaaa

SEQ ID NO: 749100 - DNA, 11 bp, Homo sapiens
cttattgctgc

SEQ ID NO: 749101 - DNA, 15 bp, Homo sapiens
cttattgctgccaaa

SEQ ID NO: 749102 - DNA, 15 bp, Homo sapiens
cttattggaactctg

SEQ ID NO: 749103 - DNA, 22 bp, Homo sapiens
cttattgggatatcattttaaa

SEQ ID NO: 749104 - DNA, 18 bp, Homo sapiens
cttattgtacctctctta

SEQ ID NO: 749105 - DNA, 15 bp, Homo sapiens
cttattgttccaaga

SEQ ID NO: 749106 - DNA, 20 bp, Homo sapiens
cttattgttccaagacattg

SEQ ID NO: 749107 - DNA, 15 bp, Homo sapiens
cttatttaaaaatat

SEQ ID NO: 749108 - DNA, 19 bp, Homo sapiens
cttatttaaaaatatttca

SEQ ID NO: 749109 - DNA, 13 bp, Homo sapiens
cttatttatgaat

SEQ ID NO: 749110 - DNA, 12 bp, Homo sapiens
cttatttattta

SEQ ID NO: 749111 - DNA, 12 bp, Homo sapiens
cttatttccaag

SEQ ID NO: 749112 - DNA, 15 bp, Homo sapiens
cttatttctctctcc

SEQ ID NO: 749113 - DNA, 18 bp, Homo sapiens
cttatttctgctctggaa

SEQ ID NO: 749114 - DNA, 12 bp, Homo sapiens
cttatttcttaa

SEQ ID NO: 749115 - DNA, 17 bp, Homo sapiens
cttatttgcttcattgt

SEQ ID NO: 749116 - DNA, 18 bp, Homo sapiens
cttatttggcgtgacccg

SEQ ID NO: 749117 - DNA, 13 bp, Homo sapiens
cttatttgtctgt

SEQ ID NO: 749118 - DNA, 17 bp, Homo sapiens
cttattttagattgcta

SEQ ID NO: 749119 - DNA, 18 bp, Homo sapiens
cttattttaggaaattta

SEQ ID NO: 749120 - DNA, 14 bp, Homo sapiens
cttattttagtata

SEQ ID NO: 749121 - DNA, 23 bp, Homo sapiens
cttattttatcttctttcctcaa

SEQ ID NO: 749122 - DNA, 19 bp, Homo sapiens
cttattttcaagaaactga

SEQ ID NO: 749123 - DNA, 15 bp, Homo sapiens
cttattttctctgtg

SEQ ID NO: 749124 - DNA, 18 bp, Homo sapiens
cttattttgcattccaga

SEQ ID NO: 749125 - DNA, 20 bp, Homo sapiens
cttattttgtcttattctta

SEQ ID NO: 749126 - DNA, 23 bp, Homo sapiens
cttatttttataacatctttatt

SEQ ID NO: 749127 - DNA, 17 bp, Homo sapiens
cttatttttcaccaggt

SEQ ID NO: 749128 - DNA, 19 bp, Homo sapiens
cttattttttcccaaagcc

SEQ ID NO: 749129 - DNA, 19 bp, Homo sapiens
cttcaaaaagcagagtgga

SEQ ID NO: 749130 - DNA, 17 bp, Homo sapiens
cttcaaaatgttctatt

SEQ ID NO: 749131 - DNA, 18 bp, Homo sapiens
cttcaaaatgttctattt

SEQ ID NO: 749132 - DNA, 21 bp, Homo sapiens
cttcaaaccctcaagagggga

SEQ ID NO: 749133 - DNA, 23 bp, Homo sapiens
cttcaaactagggccaagcccag

SEQ ID NO: 749134 - DNA, 14 bp, Homo sapiens
cttcaaactttcac

SEQ ID NO: 749135 - DNA, 17 bp, Homo sapiens
cttcaaactttcacttt

SEQ ID NO: 749136 - DNA, 14 bp, Homo sapiens
cttcaaagcagagt

SEQ ID NO: 749137 - DNA, 16 bp, Homo sapiens
cttcaaagcttaaaaa

SEQ ID NO: 749138 - DNA, 16 bp, Homo sapiens
cttcaaagcttgaaga

SEQ ID NO: 749139 - DNA, 18 bp, Homo sapiens
cttcaaagcttgaagatc

SEQ ID NO: 749140 - DNA, 16 bp, Homo sapiens
cttcaaataattaaat

SEQ ID NO: 749141 - DNA, 17 bp, Homo sapiens
cttcaaatccatccaga

SEQ ID NO: 749142 - DNA, 16 bp, Homo sapiens
cttcaaatctcagcaa

SEQ ID NO: 749143 - DNA, 14 bp, Homo sapiens
cttcaaatgaaaat

SEQ ID NO: 749144 - DNA, 24 bp, Homo sapiens
cttcaaatgggagactctttgaaa

SEQ ID NO: 749145 - DNA, 13 bp, Homo sapiens
cttcaaattagaa

SEQ ID NO: 749146 - DNA, 19 bp, Homo sapiens
cttcaaattagaagacatt

SEQ ID NO: 749147 - DNA, 21 bp, Homo sapiens
cttcaaattcaaggccttcca

SEQ ID NO: 749148 - DNA, 18 bp, Homo sapiens
cttcaacaactttgtgct

SEQ ID NO: 749149 - DNA, 12 bp, Homo sapiens
cttcaacatgac

SEQ ID NO: 749150 - DNA, 19 bp, Homo sapiens
cttcaacatgctccaaata

SEQ ID NO: 749151 - DNA, 16 bp, Homo sapiens
cttcaaccattcccca

SEQ ID NO: 749152 - DNA, 16 bp, Homo sapiens
cttcaactccctgccc

SEQ ID NO: 749153 - DNA, 14 bp, Homo sapiens
cttcaactcctggc

SEQ ID NO: 749154 - DNA, 17 bp, Homo sapiens
cttcaactcctggctcc

SEQ ID NO: 749155 - DNA, 18 bp, Homo sapiens
cttcaagaactctgggct

SEQ ID NO: 749156 - DNA, 14 bp, Homo sapiens
cttcaagcatcctc

SEQ ID NO: 749157 - DNA, 20 bp, Homo sapiens
cttcaagcgctccagggccg

SEQ ID NO: 749158 - DNA, 14 bp, Homo sapiens
cttcaagctgtccc

SEQ ID NO: 749159 - DNA, 15 bp, Homo sapiens
cttcaagctgtcccc

SEQ ID NO: 749160 - DNA, 18 bp, Homo sapiens
cttcaaggactgtttcag

SEQ ID NO: 749161 - DNA, 13 bp, Homo sapiens
cttcaaggcctcc

SEQ ID NO: 749162 - DNA, 20 bp, Homo sapiens
cttcaaggtggcagctgtta

SEQ ID NO: 749163 - DNA, 18 bp, Homo sapiens
gtcttggtctgttgccca

SEQ ID NO: 749164 - DNA, 20 bp, Homo sapiens
gtcttgtaaaaaggggagga

SEQ ID NO: 749165 - DNA, 23 bp, Homo sapiens
gtcttgtggatggaaatgtagtg

SEQ ID NO: 749166 - DNA, 20 bp, Homo sapiens
gtcttgtgtttctttagttt

SEQ ID NO: 749167 - DNA, 13 bp, Homo sapiens
gtcttgttagaaa

SEQ ID NO: 749168 - DNA, 20 bp, Homo sapiens
gtcttgttgttattgatgtt

SEQ ID NO: 749169 - DNA, 14 bp, Homo sapiens
gtcttgtttcagtg

SEQ ID NO: 749170 - DNA, 18 bp, Homo sapiens
gtctttaaaggcccagcc

SEQ ID NO: 749171 - DNA, 20 bp, Homo sapiens
gtctttaaaggcccagcccc

SEQ ID NO: 749172 - DNA, 12 bp, Homo sapiens
gtctttaatcat

SEQ ID NO: 749173 - DNA, 13 bp, Homo sapiens
gtctttaatcatt

SEQ ID NO: 749174 - DNA, 21 bp, Homo sapiens
gtctttagatagccctgtcct

SEQ ID NO: 749175 - DNA, 24 bp, Homo sapiens
gtctttagatagccctgtcctggt

SEQ ID NO: 749176 - DNA, 16 bp, Homo sapiens
gtctttagctattact

SEQ ID NO: 749177 - DNA, 15 bp, Homo sapiens
gtctttcacagctcc

SEQ ID NO: 749178 - DNA, 11 bp, Homo sapiens
gtctttcagta

SEQ ID NO: 749179 - DNA, 19 bp, Homo sapiens
gtctttcattgctaagact

SEQ ID NO: 749180 - DNA, 22 bp, Homo sapiens
gtctttccaaattatttcttaa

SEQ ID NO: 749181 - DNA, 14 bp, Homo sapiens
gtctttccactctg

SEQ ID NO: 749182 - DNA, 16 bp, Homo sapiens
gtctttctctcagtga

SEQ ID NO: 749183 - DNA, 14 bp, Homo sapiens
gtgagaactcagaa

SEQ ID NO: 749184 - DNA, 18 bp, Homo sapiens
gtgagaactctctccctg

SEQ ID NO: 749185 - DNA, 13 bp, Homo sapiens
gtgagaacttcca

SEQ ID NO: 749186 - DNA, 15 bp, Homo sapiens
gtgagaagctgaggc

SEQ ID NO: 749187 - DNA, 20 bp, Homo sapiens
gtgagaagtgaatgctggga

SEQ ID NO: 749188 - DNA, 21 bp, Homo sapiens
gtgagaagtgaatgctgggac

SEQ ID NO: 749189 - DNA, 22 bp, Homo sapiens
gtgagaagtgaatgctgggact

SEQ ID NO: 749190 - DNA, 18 bp, Homo sapiens
gtgagaatcctgcctctc

SEQ ID NO: 749191 - DNA, 18 bp, Homo sapiens
gtgagacagtctggaaag

SEQ ID NO: 749192 - DNA, 18 bp, Homo sapiens
gtgagaccatgtttcaaa

SEQ ID NO: 749193 - DNA, 15 bp, Homo sapiens
gtgagacccagtgca

SEQ ID NO: 749194 - DNA, 14 bp, Homo sapiens
gtgagacccccaca

SEQ ID NO: 749195 - DNA, 21 bp, Homo sapiens
gtgagaccccgcactgcagac

SEQ ID NO: 749196 - DNA, 22 bp, Homo sapiens
gtgagaccctgtctcaaaaaaa

SEQ ID NO: 749197 - DNA, 17 bp, Homo sapiens
gtgagactgcaggtggg

SEQ ID NO: 749198 - DNA, 16 bp, Homo sapiens
gtgagagaatctgcct

SEQ ID NO: 749199 - DNA, 17 bp, Homo sapiens
gtgagagaatctgcctg

SEQ ID NO: 749200 - DNA, 23 bp, Homo sapiens
gtgagagaatgtattttcataga

SEQ ID NO: 749201 - DNA, 14 bp, Homo sapiens
gtgagagattctgt

SEQ ID NO: 749202 - DNA, 15 bp, Homo sapiens
gtgagagccagcagc

SEQ ID NO: 749203 - DNA, 16 bp, Homo sapiens
gtgagaggcaggaatg

SEQ ID NO: 749204 - DNA, 22 bp, Homo sapiens
gtgagaggcaggaatgggggtc

SEQ ID NO: 749205 - DNA, 12 bp, Homo sapiens
gtgagaggggag

SEQ ID NO: 749206 - DNA, 18 bp, Homo sapiens
gtgagaggggagggaggg

SEQ ID NO: 749207 - DNA, 20 bp, Homo sapiens
gtgagaggggagggctcctg

SEQ ID NO: 749208 - DNA, 16 bp, Homo sapiens
gtgagagtctgggtcc

SEQ ID NO: 749209 - DNA, 21 bp, Homo sapiens
gtgagatgagggatgggcctg

SEQ ID NO: 749210 - DNA, 16 bp, Homo sapiens
gtgagatggtatgaaa

SEQ ID NO: 749211 - DNA, 13 bp, Homo sapiens
gtgagcagctact

SEQ ID NO: 749212 - DNA, 22 bp, Homo sapiens
gtgagcagctactgtaactttt

SEQ ID NO: 749213 - DNA, 21 bp, Homo sapiens
gtgagcagggtcaagcctctt

SEQ ID NO: 749214 - DNA, 14 bp, Homo sapiens
gtgagcagggtggg

SEQ ID NO: 749215 - DNA, 18 bp, Homo sapiens
gtgagcagggtggggtct

SEQ ID NO: 749216 - DNA, 23 bp, Homo sapiens
gtgagcagggtggggtctgggag

SEQ ID NO: 749217 - DNA, 20 bp, Homo sapiens
gtgagcatggaacacttcga

SEQ ID NO: 749218 - DNA, 16 bp, Homo sapiens
gtgagcatgggtgtgc

SEQ ID NO: 749219 - DNA, 19 bp, Homo sapiens
gtgagcatgggtgtgccct

SEQ ID NO: 749220 - DNA, 14 bp, Homo sapiens
gtgagccaccgctg

SEQ ID NO: 749221 - DNA, 18 bp, Homo sapiens
gtgagccaccgctgccag

SEQ ID NO: 749222 - DNA, 24 bp, Homo sapiens
gtgagccaccgctgccagcacaga

SEQ ID NO: 749223 - DNA, 18 bp, Homo sapiens
gtgagccaccgtgcctgg

SEQ ID NO: 749224 - DNA, 19 bp, Homo sapiens
gtgagccactcagtctctt

SEQ ID NO: 749225 - DNA, 20 bp, Homo sapiens
gtgagccaggtaatgaggga

SEQ ID NO: 749226 - DNA, 16 bp, Homo sapiens
gtgagccatgcctccc

SEQ ID NO: 749227 - DNA, 18 bp, Homo sapiens
gtgagccatgcctccctg

SEQ ID NO: 749228 - DNA, 15 bp, Homo sapiens
gtgagcccagctggg

SEQ ID NO: 749229 - DNA, 20 bp, Homo sapiens
gtgagcccagctgggtcagg

SEQ ID NO: 749230 - DNA, 18 bp, Homo sapiens
gtgagcccctccccagcc

SEQ ID NO: 749231 - DNA, 19 bp, Homo sapiens
gtgagcccctccccagcca

SEQ ID NO: 749232 - DNA, 17 bp, Homo sapiens
gtgagcccctggtcctg

SEQ ID NO: 749233 - DNA, 16 bp, Homo sapiens
gtgagccctctagggc

SEQ ID NO: 749234 - DNA, 22 bp, Homo sapiens
gtgagccctctagggcagggtg

SEQ ID NO: 749235 - DNA, 23 bp, Homo sapiens
gtgagccctctagggcagggtgg

SEQ ID NO: 749236 - DNA, 12 bp, Homo sapiens
gtgagccgcatc

SEQ ID NO: 749237 - DNA, 17 bp, Homo sapiens
gtgagcctagccctggg

SEQ ID NO: 749238 - DNA, 13 bp, Homo sapiens
gtgagcctgggca

SEQ ID NO: 749239 - DNA, 20 bp, Homo sapiens
gtgagcctgggcagcttctg

SEQ ID NO: 749240 - DNA, 14 bp, Homo sapiens
gtgagcctgggcca

SEQ ID NO: 749241 - DNA, 19 bp, Homo sapiens
gtgagctggggactcaggg

SEQ ID NO: 749242 - DNA, 13 bp, Homo sapiens
gtgagctggggcc

SEQ ID NO: 749243 - DNA, 22 bp, Homo sapiens
gtgagctgtgactgctttgctg

SEQ ID NO: 749244 - DNA, 15 bp, Homo sapiens
gtgagctttgctgct

SEQ ID NO: 749245 - DNA, 21 bp, Homo sapiens
gtgaggaagtgtggaaaaata

SEQ ID NO: 749246 - DNA, 20 bp, Homo sapiens
gtgaggaatagttgagcccc

SEQ ID NO: 749247 - DNA, 11 bp, Homo sapiens
gtgaggagctg

SEQ ID NO: 749248 - DNA, 15 bp, Homo sapiens
gtgaggagctgctgg

SEQ ID NO: 749249 - DNA, 14 bp, Homo sapiens
gtgaggaggacaag

SEQ ID NO: 749250 - DNA, 17 bp, Homo sapiens
gtgaggcaggggcggag

SEQ ID NO: 749251 - DNA, 13 bp, Homo sapiens
gtgaggcccaagg

SEQ ID NO: 749252 - DNA, 16 bp, Homo sapiens
gtgaggcccagcctgt

SEQ ID NO: 749253 - DNA, 11 bp, Homo sapiens
gtgaggcctgg

SEQ ID NO: 749254 - DNA, 14 bp, Homo sapiens
gtgaggcctggcca

SEQ ID NO: 749255 - DNA, 16 bp, Homo sapiens
gtgaggcgttctcctg

SEQ ID NO: 749256 - DNA, 14 bp, Homo sapiens
gtgaggctgtcctg

SEQ ID NO: 749257 - DNA, 17 bp, Homo sapiens
gtgaggctgtgtctctg

SEQ ID NO: 749258 - DNA, 15 bp, Homo sapiens
gtgaggcttccaggc

SEQ ID NO: 749259 - DNA, 22 bp, Homo sapiens
gtgagggacatgctcacctcta

SEQ ID NO: 749260 - DNA, 13 bp, Homo sapiens
gtgagggcaagag

SEQ ID NO: 749261 - DNA, 19 bp, Homo sapiens
gtgagggcctcagagcctg

SEQ ID NO: 749262 - DNA, 12 bp, Homo sapiens
gtgagggctggg

SEQ ID NO: 749263 - DNA, 16 bp, Homo sapiens
gtgaggggcaggacct

SEQ ID NO: 749264 - DNA, 15 bp, Homo sapiens
gtgagggtcctgcag

SEQ ID NO: 749265 - DNA, 11 bp, Homo sapiens
gtgaggtggcc

SEQ ID NO: 749266 - DNA, 19 bp, Homo sapiens
gtgaggtggcccaggcccc

SEQ ID NO: 749267 - DNA, 20 bp, Homo sapiens
gtgaggtgggttttcttccc

SEQ ID NO: 749268 - DNA, 22 bp, Homo sapiens
gtgagtcaatacatagtgctgc

SEQ ID NO: 749269 - DNA, 23 bp, Homo sapiens
gtgagtcacctgctccagaagat

SEQ ID NO: 749270 - DNA, 14 bp, Homo sapiens
gtgagtcagaatgt

SEQ ID NO: 749271 - DNA, 22 bp, Homo sapiens
gtgagtcatttaaatgtgtaca

SEQ ID NO: 749272 - DNA, 18 bp, Homo sapiens
gtgagtctggtggaggag

SEQ ID NO: 749273 - DNA, 16 bp, Homo sapiens
gtgagtcttggcggca

SEQ ID NO: 749274 - DNA, 18 bp, Homo sapiens
gtgagtcttggcggcagc

SEQ ID NO: 749275 - DNA, 21 bp, Homo sapiens
gtgagtcttggcggcagcagc

SEQ ID NO: 749276 - DNA, 15 bp, Homo sapiens
gtgagtgccatgctt

SEQ ID NO: 749277 - DNA, 12 bp, Homo sapiens
gtgagtgccttt

SEQ ID NO: 749278 - DNA, 22 bp, Homo sapiens
gtgagtgcttgtcatggaaaat

SEQ ID NO: 749279 - DNA, 12 bp, Homo sapiens
gtgagtggcagc

SEQ ID NO: 749280 - DNA, 13 bp, Homo sapiens
gtgagtgtaaata

SEQ ID NO: 749281 - DNA, 17 bp, Homo sapiens
gtgagtgtatgtgtgtg

SEQ ID NO: 749282 - DNA, 15 bp, Homo sapiens
gtgagtgtgacaggg

SEQ ID NO: 749283 - DNA, 16 bp, Homo sapiens
gtgagtgtgacagggc

SEQ ID NO: 749284 - DNA, 19 bp, Homo sapiens
gtgagtgtgacagggccag

SEQ ID NO: 749285 - DNA, 17 bp, Homo sapiens
gtgagtgtgagtgtgag

SEQ ID NO: 749286 - DNA, 18 bp, Homo sapiens
gtgagtgtgtatgtcagt

SEQ ID NO: 749287 - DNA, 13 bp, Homo sapiens
gtgagtgtgtgtg

SEQ ID NO: 749288 - DNA, 18 bp, Homo sapiens
gtgagtgtgtgtgcatgg

SEQ ID NO: 749289 - DNA, 17 bp, Homo sapiens
gtgagtgtttttatctt

SEQ ID NO: 749290 - DNA, 17 bp, Homo sapiens
gtgagttacagcgagag

SEQ ID NO: 749291 - DNA, 15 bp, Homo sapiens
gtgagtttcctgcta

SEQ ID NO: 749292 - DNA, 15 bp, Homo sapiens
gtgagtttgagctgc

SEQ ID NO: 749293 - DNA, 18 bp, Homo sapiens
gtgagtttgagctgcctt

SEQ ID NO: 749294 - DNA, 14 bp, Homo sapiens
gtgagttttgttca

SEQ ID NO: 749295 - DNA, 16 bp, Homo sapiens
gtgataaaactgggtt

SEQ ID NO: 749296 - DNA, 13 bp, Homo sapiens
gtgataaggggcc

SEQ ID NO: 749297 - DNA, 14 bp, Homo sapiens
cttcagggccagaa

SEQ ID NO: 749298 - DNA, 21 bp, Homo sapiens
cttcagggccagaaggagggc

SEQ ID NO: 749299 - DNA, 22 bp, Homo sapiens
cttcagggccagaaggagggca

SEQ ID NO: 749300 - DNA, 19 bp, Homo sapiens
cttcagggctgagttctgg

SEQ ID NO: 749301 - DNA, 22 bp, Homo sapiens
cttcaggggagtcccgtcagga

SEQ ID NO: 749302 - DNA, 17 bp, Homo sapiens
cttcaggggcacttcat

SEQ ID NO: 749303 - DNA, 23 bp, Homo sapiens
cttcaggtaaagggcaaataatg

SEQ ID NO: 749304 - DNA, 17 bp, Homo sapiens
cttcaggtcgtagcatt

SEQ ID NO: 749305 - DNA, 17 bp, Homo sapiens
cttccaggaaactccac

SEQ ID NO: 749306 - DNA, 16 bp, Homo sapiens
cttccaggcccccacc

SEQ ID NO: 749307 - DNA, 14 bp, Homo sapiens
cttccaggctcttc

SEQ ID NO: 749308 - DNA, 20 bp, Homo sapiens
cttccagggcagcggctcca

SEQ ID NO: 749309 - DNA, 19 bp, Homo sapiens
cttccaggggaacctgcca

SEQ ID NO: 749310 - DNA, 19 bp, Homo sapiens
cttccaggtgttactgtaa

SEQ ID NO: 749311 - DNA, 22 bp, Homo sapiens
cttccaggtgttactgtaattc

SEQ ID NO: 749312 - DNA, 15 bp, Homo sapiens
cttccagtgaacatt

SEQ ID NO: 749313 - DNA, 22 bp, Homo sapiens
cttccagtggctcgctccctgt

SEQ ID NO: 749314 - DNA, 23 bp, Homo sapiens
cttccataatgtataaagaacaa

SEQ ID NO: 749315 - DNA, 11 bp, Homo sapiens
cttccataatt

SEQ ID NO: 749316 - DNA, 14 bp, Homo sapiens
cttccataattatg

SEQ ID NO: 749317 - DNA, 18 bp, Homo sapiens
cttccatacacagaggag

SEQ ID NO: 749318 - DNA, 14 bp, Homo sapiens
cttccatagcctaa

SEQ ID NO: 749319 - DNA, 23 bp, Homo sapiens
cttccatatccctgcccagcctg

SEQ ID NO: 749320 - DNA, 15 bp, Homo sapiens
cttccatccctaccc

SEQ ID NO: 749321 - DNA, 19 bp, Homo sapiens
cttccatccctacccccta

SEQ ID NO: 749322 - DNA, 16 bp, Homo sapiens
cttccatctctgactt

SEQ ID NO: 749323 - DNA, 20 bp, Homo sapiens
cttccatcttgtggggccag

SEQ ID NO: 749324 - DNA, 21 bp, Homo sapiens
cttccatcttgtggggccagg

SEQ ID NO: 749325 - DNA, 23 bp, Homo sapiens
cttccatcttgtggggccaggac

SEQ ID NO: 749326 - DNA, 18 bp, Homo sapiens
cttccatgaattttaaaa

SEQ ID NO: 749327 - DNA, 23 bp, Homo sapiens
cttccatggcttcctgagaaagc

SEQ ID NO: 749328 - DNA, 15 bp, Homo sapiens
cttccatgtcgcctc

SEQ ID NO: 749329 - DNA, 17 bp, Homo sapiens
cttccatgtcgcctctg

SEQ ID NO: 749330 - DNA, 18 bp, Homo sapiens
cttccatgtcgcctctgc

SEQ ID NO: 749331 - DNA, 16 bp, Homo sapiens
cttccatgtctccatt

SEQ ID NO: 749332 - DNA, 18 bp, Homo sapiens
cttccatgtggagaaagg

SEQ ID NO: 749333 - DNA, 16 bp, Homo sapiens
cttccattattgagtt

SEQ ID NO: 749334 - DNA, 14 bp, Homo sapiens
cttccattggttct

SEQ ID NO: 749335 - DNA, 19 bp, Homo sapiens
cttccattggttcttcctt

SEQ ID NO: 749336 - DNA, 16 bp, Homo sapiens
cttccatttgtgtgtg

SEQ ID NO: 749337 - DNA, 17 bp, Homo sapiens
cttcccaaacccagtct

SEQ ID NO: 749338 - DNA, 21 bp, Homo sapiens
cttcccaaacccagtctcctc

SEQ ID NO: 749339 - DNA, 17 bp, Homo sapiens
cttcccacccccaggca

SEQ ID NO: 749340 - DNA, 19 bp, Homo sapiens
cttcccacccccaggcaag

SEQ ID NO: 749341 - DNA, 16 bp, Homo sapiens
cttcccacctactgca

SEQ ID NO: 749342 - DNA, 13 bp, Homo sapiens
cttcccagagaga

SEQ ID NO: 749343 - DNA, 21 bp, Homo sapiens
cttcccagcaacactccggtc

SEQ ID NO: 749344 - DNA, 11 bp, Homo sapiens
cttcccagccc

SEQ ID NO: 749345 - DNA, 22 bp, Homo sapiens
cttcccagcggttcctgtgcag

SEQ ID NO: 749346 - DNA, 23 bp, Homo sapiens
cttcccagcggttcctgtgcaga

SEQ ID NO: 749347 - DNA, 16 bp, Homo sapiens
cttcccagctaggaag

SEQ ID NO: 749348 - DNA, 14 bp, Homo sapiens
cttcccaggccttt

SEQ ID NO: 749349 - DNA, 17 bp, Homo sapiens
cttcccaggcctttgga

SEQ ID NO: 749350 - DNA, 20 bp, Homo sapiens
cttcccagggaccagcacct

SEQ ID NO: 749351 - DNA, 15 bp, Homo sapiens
cttcccagtgaatcc

SEQ ID NO: 749352 - DNA, 23 bp, Homo sapiens
cttcccagttcaggagtcccaag

SEQ ID NO: 749353 - DNA, 19 bp, Homo sapiens
cttcccatacttgcataca

SEQ ID NO: 749354 - DNA, 16 bp, Homo sapiens
cttcccatagtggggc

SEQ ID NO: 749355 - DNA, 22 bp, Homo sapiens
cttcccatagtggggcctggga

SEQ ID NO: 749356 - DNA, 23 bp, Homo sapiens
cttcccatagtggggcctgggag

SEQ ID NO: 749357 - DNA, 17 bp, Homo sapiens
cttcccatcactggagc

SEQ ID NO: 749358 - DNA, 16 bp, Homo sapiens
cttcccatcctaccct

SEQ ID NO: 749359 - DNA, 15 bp, Homo sapiens
cttcccatcgctgtc

SEQ ID NO: 749360 - DNA, 18 bp, Homo sapiens
cttcccatctccagggaa

SEQ ID NO: 749361 - DNA, 17 bp, Homo sapiens
cttcccatgactgcacc

SEQ ID NO: 749362 - DNA, 20 bp, Homo sapiens
cttcccatggccatttctgt

SEQ ID NO: 749363 - DNA, 15 bp, Homo sapiens
cttcccatttctcta

SEQ ID NO: 749364 - DNA, 18 bp, Homo sapiens
cttcccatttctctacac

SEQ ID NO: 749365 - DNA, 16 bp, Homo sapiens
cttccccaaataatat

SEQ ID NO: 749366 - DNA, 20 bp, Homo sapiens
cttccccaacttccctagtc

SEQ ID NO: 749367 - DNA, 15 bp, Homo sapiens
cttccccaagggcca

SEQ ID NO: 749368 - DNA, 22 bp, Homo sapiens
cttccccaccccagtttttgtt

SEQ ID NO: 749369 - DNA, 11 bp, Homo sapiens
cttccccactg

SEQ ID NO: 749370 - DNA, 23 bp, Homo sapiens
cttccccactgcacacacctcag

SEQ ID NO: 749371 - DNA, 19 bp, Homo sapiens
cttccccactgcctgccca

SEQ ID NO: 749372 - DNA, 20 bp, Homo sapiens
cttccccacttctgtgccac

SEQ ID NO: 749373 - DNA, 13 bp, Homo sapiens
cttccccagactc

SEQ ID NO: 749374 - DNA, 19 bp, Homo sapiens
cttccccagactcagctcc

SEQ ID NO: 749375 - DNA, 14 bp, Homo sapiens
cttccccagccctt

SEQ ID NO: 749376 - DNA, 17 bp, Homo sapiens
cttccccaggcccacca

SEQ ID NO: 749377 - DNA, 19 bp, Homo sapiens
cttccccaggcccaccatc

SEQ ID NO: 749378 - DNA, 23 bp, Homo sapiens
cttcccccaccggtccagctggc

SEQ ID NO: 749379 - DNA, 13 bp, Homo sapiens
cttcccccatccc

SEQ ID NO: 749380 - DNA, 15 bp, Homo sapiens
cttccccccatctct

SEQ ID NO: 749381 - DNA, 19 bp, Homo sapiens
cttccccccatctctgagt

SEQ ID NO: 749382 - DNA, 16 bp, Homo sapiens
cttcccccctctcctc

SEQ ID NO: 749383 - DNA, 15 bp, Homo sapiens
cttccccgtcccctg

SEQ ID NO: 749384 - DNA, 22 bp, Homo sapiens
cttccccgtcccctgcagcctg

SEQ ID NO: 749385 - DNA, 23 bp, Homo sapiens
cttccccgtcccctgcagcctgg

SEQ ID NO: 749386 - DNA, 18 bp, Homo sapiens
cttcccctacacctccct

SEQ ID NO: 749387 - DNA, 21 bp, Homo sapiens
cttcccctcccgacagcccat

SEQ ID NO: 749388 - DNA, 13 bp, Homo sapiens
cttcccctcccta

SEQ ID NO: 749389 - DNA, 14 bp, Homo sapiens
cttcccctccctgt

SEQ ID NO: 749390 - DNA, 13 bp, Homo sapiens
cttcccctgagag

SEQ ID NO: 749391 - DNA, 21 bp, Homo sapiens
cttcccctgagagtttcctca

SEQ ID NO: 749392 - DNA, 18 bp, Homo sapiens
cttcccctgcacctggcc

SEQ ID NO: 749393 - DNA, 16 bp, Homo sapiens
cttcccctgctgacct

SEQ ID NO: 749394 - DNA, 21 bp, Homo sapiens
cttcccctgggatgctgaccc

SEQ ID NO: 749395 - DNA, 22 bp, Homo sapiens
cttcccctgggatgctgaccca

SEQ ID NO: 749396 - DNA, 12 bp, Homo sapiens
cttccccttcct

SEQ ID NO: 749397 - DNA, 13 bp, Homo sapiens
cttccccttcctg

SEQ ID NO: 749398 - DNA, 14 bp, Homo sapiens
cttccccttcctgt

SEQ ID NO: 749399 - DNA, 18 bp, Homo sapiens
cttccccttctgtgtcac

SEQ ID NO: 749400 - DNA, 13 bp, Homo sapiens
cttccccttgccc

SEQ ID NO: 749401 - DNA, 17 bp, Homo sapiens
cttcccctttgtcctgc

SEQ ID NO: 749402 - DNA, 18 bp, Homo sapiens
cttccccttttgcctggc

SEQ ID NO: 749403 - DNA, 20 bp, Homo sapiens
cttccccttttgcctggctg

SEQ ID NO: 749404 - DNA, 21 bp, Homo sapiens
cttccccttttgcctggctgt

SEQ ID NO: 749405 - DNA, 22 bp, Homo sapiens
cttcccgacccagccagctgca

SEQ ID NO: 749406 - DNA, 19 bp, Homo sapiens
cttcccgcaaggcctctca

SEQ ID NO: 749407 - DNA, 14 bp, Homo sapiens
cttcccgccttcca

SEQ ID NO: 749408 - DNA, 17 bp, Homo sapiens
cttcccgctcagccctc

SEQ ID NO: 749409 - DNA, 17 bp, Homo sapiens
cttcccgggccagggct

SEQ ID NO: 749410 - DNA, 18 bp, Homo sapiens
cttcccgggccagggctg

SEQ ID NO: 749411 - DNA, 15 bp, Homo sapiens
cttccctaaactgca

SEQ ID NO: 749412 - DNA, 12 bp, Homo sapiens
cttccctaatct

SEQ ID NO: 749413 - DNA, 16 bp, Homo sapiens
cttccctacctcaggc

SEQ ID NO: 749414 - DNA, 20 bp, Homo sapiens
cttccctacctcaggcagga

SEQ ID NO: 749415 - DNA, 13 bp, Homo sapiens
cttccctatttat

SEQ ID NO: 749416 - DNA, 12 bp, Homo sapiens
cttccctcaccc

SEQ ID NO: 749417 - DNA, 11 bp, Homo sapiens
cttccctcaga

SEQ ID NO: 749418 - DNA, 16 bp, Homo sapiens
cttccctcatctctcc

SEQ ID NO: 749419 - DNA, 11 bp, Homo sapiens
cttccctccaa

SEQ ID NO: 749420 - DNA, 15 bp, Homo sapiens
cttccctccctatct

SEQ ID NO: 749421 - DNA, 13 bp, Homo sapiens
cttccctcctccc

SEQ ID NO: 749422 - DNA, 13 bp, Homo sapiens
cttccctcctgct

SEQ ID NO: 749423 - DNA, 15 bp, Homo sapiens
cttccctcctgcttt

SEQ ID NO: 749424 - DNA, 15 bp, Homo sapiens
cttccctcggggagc

SEQ ID NO: 749425 - DNA, 13 bp, Homo sapiens
cttccctctctga

SEQ ID NO: 749426 - DNA, 20 bp, Homo sapiens
cttccctctgatttttcctt

SEQ ID NO: 749427 - DNA, 23 bp, Homo sapiens
gtgccagcagcctcgcacaggcc

SEQ ID NO: 749428 - DNA, 20 bp, Homo sapiens
gtgccagcccggaggggact

SEQ ID NO: 749429 - DNA, 13 bp, Homo sapiens
gtgccagccttcc

SEQ ID NO: 749430 - DNA, 11 bp, Homo sapiens
gtgccagctcc

SEQ ID NO: 749431 - DNA, 23 bp, Homo sapiens
gtagcacagattttgaatctgtg

SEQ ID NO: 749432 - DNA, 11 bp, Homo sapiens
gtagcactgag

SEQ ID NO: 749433 - DNA, 17 bp, Homo sapiens
gtagcagagttaaatct

SEQ ID NO: 749434 - DNA, 15 bp, Homo sapiens
gtagcagcaggctca

SEQ ID NO: 749435 - DNA, 19 bp, Homo sapiens
gtagcagggtcgggaaagg

SEQ ID NO: 749436 - DNA, 17 bp, Homo sapiens
gtagcaggtaccactga

SEQ ID NO: 749437 - DNA, 18 bp, Homo sapiens
gtagcataaataaaactg

SEQ ID NO: 749438 - DNA, 20 bp, Homo sapiens
gtagcataaataaaactgaa

SEQ ID NO: 749439 - DNA, 13 bp, Homo sapiens
gtagcatcttcct

SEQ ID NO: 749440 - DNA, 17 bp, Homo sapiens
gtagcatcttcctctgc

SEQ ID NO: 749441 - DNA, 18 bp, Homo sapiens
gtagcatggactctgggt

SEQ ID NO: 749442 - DNA, 21 bp, Homo sapiens
gtagcatgggtccaagagaca

SEQ ID NO: 749443 - DNA, 22 bp, Homo sapiens
gtagcatgggtccaagagacat

SEQ ID NO: 749444 - DNA, 23 bp, Homo sapiens
gtagcatgttctatgtgttttta

SEQ ID NO: 749445 - DNA, 23 bp, Homo sapiens
ctgggggccagggctggatggac

SEQ ID NO: 749446 - DNA, 16 bp, Homo sapiens
ctgggggccatgagct

SEQ ID NO: 749447 - DNA, 17 bp, Homo sapiens
ctgggggccatgagctc

SEQ ID NO: 749448 - DNA, 23 bp, Homo sapiens
ctgggggccatgagctccagacc

SEQ ID NO: 749449 - DNA, 15 bp, Homo sapiens
ctgggggcccgacag

SEQ ID NO: 749450 - DNA, 22 bp, Homo sapiens
ctgggggctggctcccagggtg

SEQ ID NO: 749451 - DNA, 17 bp, Homo sapiens
ctggggggaacggatgc

SEQ ID NO: 749452 - DNA, 14 bp, Homo sapiens
ctggggggccacca

SEQ ID NO: 749453 - DNA, 22 bp, Homo sapiens
ctggggggccaccatgacccct

SEQ ID NO: 749454 - DNA, 18 bp, Homo sapiens
ctggggggtggggaggag

SEQ ID NO: 749455 - DNA, 19 bp, Homo sapiens
ctggggggtggggaggagg

SEQ ID NO: 749456 - DNA, 14 bp, Homo sapiens
ctgggggtagcctg

SEQ ID NO: 749457 - DNA, 15 bp, Homo sapiens
ctgggggtagcctgg

SEQ ID NO: 749458 - DNA, 18 bp, Homo sapiens
ctgggggtcccttgctta

SEQ ID NO: 749459 - DNA, 13 bp, Homo sapiens
ctgggggtggcag

SEQ ID NO: 749460 - DNA, 16 bp, Homo sapiens
ctgggggtggcaggca

SEQ ID NO: 749461 - DNA, 16 bp, Homo sapiens
ctgggggtgggccagg

SEQ ID NO: 749462 - DNA, 16 bp, Homo sapiens
ctggggtacacagtga

SEQ ID NO: 749463 - DNA, 16 bp, Homo sapiens
ctggggtacaggtttg

SEQ ID NO: 749464 - DNA, 15 bp, Homo sapiens
ctggggtatgtgtgt

SEQ ID NO: 749465 - DNA, 19 bp, Homo sapiens
ctggggtcaccctctccag

SEQ ID NO: 749466 - DNA, 18 bp, Homo sapiens
ctggggtcaggtgccact

SEQ ID NO: 749467 - DNA, 13 bp, Homo sapiens
ctggggtccccca

SEQ ID NO: 749468 - DNA, 17 bp, Homo sapiens
ctggggtctgggcagtg

SEQ ID NO: 749469 - DNA, 20 bp, Homo sapiens
ctggggtctgggcagtgcca

SEQ ID NO: 749470 - DNA, 16 bp, Homo sapiens
ctggggtgagagagga

SEQ ID NO: 749471 - DNA, 14 bp, Homo sapiens
ctggggtgagcctg

SEQ ID NO: 749472 - DNA, 18 bp, Homo sapiens
ctggggtgagcctgactg

SEQ ID NO: 749473 - DNA, 23 bp, Homo sapiens
ctggggtgagcctgactgccagg

SEQ ID NO: 749474 - DNA, 15 bp, Homo sapiens
ctggggtggccacca

SEQ ID NO: 749475 - DNA, 15 bp, Homo sapiens
ctggggtggccaggg

SEQ ID NO: 749476 - DNA, 16 bp, Homo sapiens
ctggggtggccagggc

SEQ ID NO: 749477 - DNA, 17 bp, Homo sapiens
ctggggtggccagggct

SEQ ID NO: 749478 - DNA, 20 bp, Homo sapiens
ctggggtggccagggcttcc

SEQ ID NO: 749479 - DNA, 15 bp, Homo sapiens
ctggggtgggacagg

SEQ ID NO: 749480 - DNA, 23 bp, Homo sapiens
ctggggtgggacagggagggccg

SEQ ID NO: 749481 - DNA, 21 bp, Homo sapiens
ctggggtgggaggtcttgcta

SEQ ID NO: 749482 - DNA, 22 bp, Homo sapiens
ctggggtgggagtaacagggca

SEQ ID NO: 749483 - DNA, 21 bp, Homo sapiens
ctggggtgggatctgagctcc

SEQ ID NO: 749484 - DNA, 14 bp, Homo sapiens
ctggggtggggtca

SEQ ID NO: 749485 - DNA, 13 bp, Homo sapiens
ctggggttcagcc

SEQ ID NO: 749486 - DNA, 15 bp, Homo sapiens
ctggggttcagcccc

SEQ ID NO: 749487 - DNA, 22 bp, Homo sapiens
ctggggttcagcccctcctctg

SEQ ID NO: 749488 - DNA, 19 bp, Homo sapiens
ctggggttcccgagggagc

SEQ ID NO: 749489 - DNA, 21 bp, Homo sapiens
ctggggttcccgagggagctg

SEQ ID NO: 749490 - DNA, 22 bp, Homo sapiens
ctggggttgcgtctgaggcctg

SEQ ID NO: 749491 - DNA, 22 bp, Homo sapiens
ctgggtaactagggaagataat

SEQ ID NO: 749492 - DNA, 16 bp, Homo sapiens
ctgggtaatttataaa

SEQ ID NO: 749493 - DNA, 17 bp, Homo sapiens
ctgggtactgaaagcct

SEQ ID NO: 749494 - DNA, 14 bp, Homo sapiens
ctgggtagctgtaa

SEQ ID NO: 749495 - DNA, 19 bp, Homo sapiens
ctgggtaggaaagaggaag

SEQ ID NO: 749496 - DNA, 20 bp, Homo sapiens
ctgggtatcccctgcctcct

SEQ ID NO: 749497 - DNA, 19 bp, Homo sapiens
ctgggtatgctctgtgaca

SEQ ID NO: 749498 - DNA, 17 bp, Homo sapiens
ctgggtatgttcctaag

SEQ ID NO: 749499 - DNA, 16 bp, Homo sapiens
ctgggtccaggcctgg

SEQ ID NO: 749500 - DNA, 14 bp, Homo sapiens
ctgggtcccagcct

SEQ ID NO: 749501 - DNA, 14 bp, Homo sapiens
ctgggtccctcctc

SEQ ID NO: 749502 - DNA, 14 bp, Homo sapiens
ctgggtccctcgga

SEQ ID NO: 749503 - DNA, 15 bp, Homo sapiens
ctgggtccctcggag

SEQ ID NO: 749504 - DNA, 18 bp, Homo sapiens
ctgggtccctcggagctg

SEQ ID NO: 749505 - DNA, 18 bp, Homo sapiens
ctgggtccctgctcccct

SEQ ID NO: 749506 - DNA, 14 bp, Homo sapiens
ctgggtccttggct

SEQ ID NO: 749507 - DNA, 16 bp, Homo sapiens
ctgggtctcactcctg

SEQ ID NO: 749508 - DNA, 22 bp, Homo sapiens
ctgggtctcccactttctgttc

SEQ ID NO: 749509 - DNA, 17 bp, Homo sapiens
ctgggtctcccaggaca

SEQ ID NO: 749510 - DNA, 14 bp, Homo sapiens
ctgggtctggatgg

SEQ ID NO: 749511 - DNA, 17 bp, Homo sapiens
ctgggtctgtgtctctt

SEQ ID NO: 749512 - DNA, 21 bp, Homo sapiens
ctgggtgaaagggatactttt

SEQ ID NO: 749513 - DNA, 13 bp, Homo sapiens
ctgggtgacagag

SEQ ID NO: 749514 - DNA, 22 bp, Homo sapiens
ctgggtgacagagcaagactct

SEQ ID NO: 749515 - DNA, 19 bp, Homo sapiens
ctgggtgaccgactacccc

SEQ ID NO: 749516 - DNA, 18 bp, Homo sapiens
ctgggtgagagaggaata

SEQ ID NO: 749517 - DNA, 19 bp, Homo sapiens
ctgggtgccattcccagcg

SEQ ID NO: 749518 - DNA, 12 bp, Homo sapiens
ctgggtgccctg

SEQ ID NO: 749519 - DNA, 15 bp, Homo sapiens
ctgggtgccctggct

SEQ ID NO: 749520 - DNA, 22 bp, Homo sapiens
ctgggtgcctcccacacttgct

SEQ ID NO: 749521 - DNA, 12 bp, Homo sapiens
ctgggtgcctgc

SEQ ID NO: 749522 - DNA, 20 bp, Homo sapiens
ctgggtggcaccagcagcct

SEQ ID NO: 749523 - DNA, 23 bp, Homo sapiens
ctgggtggcaccagcagcctgga

SEQ ID NO: 749524 - DNA, 23 bp, Homo sapiens
ctgggtggccatcctacccagcg

SEQ ID NO: 749525 - DNA, 19 bp, Homo sapiens
ctgggtggcctcgggacac

SEQ ID NO: 749526 - DNA, 17 bp, Homo sapiens
ctgggtgggagcatagg

SEQ ID NO: 749527 - DNA, 14 bp, Homo sapiens
ctgggtgggctctg

SEQ ID NO: 749528 - DNA, 15 bp, Homo sapiens
ctgggtgggctctgt

SEQ ID NO: 749529 - DNA, 13 bp, Homo sapiens
ctgggtggggaca

SEQ ID NO: 749530 - DNA, 13 bp, Homo sapiens
ctgggtggggctg

SEQ ID NO: 749531 - DNA, 21 bp, Homo sapiens
ctgggtggggctgctcctcca

SEQ ID NO: 749532 - DNA, 16 bp, Homo sapiens
ctgggtggggtgagga

SEQ ID NO: 749533 - DNA, 18 bp, Homo sapiens
ctgggtgggtggtgggga

SEQ ID NO: 749534 - DNA, 20 bp, Homo sapiens
ctgggtggtattctggtagg

SEQ ID NO: 749535 - DNA, 16 bp, Homo sapiens
ctgggtgtaaacacat

SEQ ID NO: 749536 - DNA, 18 bp, Homo sapiens
ctgggtgtccgccatcca

SEQ ID NO: 749537 - DNA, 19 bp, Homo sapiens
ctgggtgtccgccatccag

SEQ ID NO: 749538 - DNA, 20 bp, Homo sapiens
ctgggttagggtgtgtgttc

SEQ ID NO: 749539 - DNA, 14 bp, Homo sapiens
ctgggttaggtggc

SEQ ID NO: 749540 - DNA, 24 bp, Homo sapiens
ctgggttaggtggccgctcctccc

SEQ ID NO: 749541 - DNA, 18 bp, Homo sapiens
ctgggttcagaaatgctg

SEQ ID NO: 749542 - DNA, 23 bp, Homo sapiens
ctgggttcagaaatgctgcctgc

SEQ ID NO: 749543 - DNA, 16 bp, Homo sapiens
ctgggttccctttcct

SEQ ID NO: 749544 - DNA, 18 bp, Homo sapiens
ctgggttccgggaggcag

SEQ ID NO: 749545 - DNA, 22 bp, Homo sapiens
ctgggttccttcctctgagcct

SEQ ID NO: 749546 - DNA, 18 bp, Homo sapiens
ctgggttcgttggggaca

SEQ ID NO: 749547 - DNA, 14 bp, Homo sapiens
ctgggttctggggc

SEQ ID NO: 749548 - DNA, 16 bp, Homo sapiens
ctgggttctggggcat

SEQ ID NO: 749549 - DNA, 17 bp, Homo sapiens
ctgggttcttgttttat

SEQ ID NO: 749550 - DNA, 20 bp, Homo sapiens
ctgggttgccatggcaatgg

SEQ ID NO: 749551 - DNA, 22 bp, Homo sapiens
ctgggttggagggaaccaccag

SEQ ID NO: 749552 - DNA, 13 bp, Homo sapiens
ctgggttgggggc

SEQ ID NO: 749553 - DNA, 19 bp, Homo sapiens
ctgggttgtttccaggaga

SEQ ID NO: 749554 - DNA, 22 bp, Homo sapiens
ctgggttgtttccaggagaaag

SEQ ID NO: 749555 - DNA, 22 bp, Homo sapiens
ctgggtttattacatggcagtg

SEQ ID NO: 749556 - DNA, 13 bp, Homo sapiens
ctgggtttcaaga

SEQ ID NO: 749557 - DNA, 17 bp, Homo sapiens
ctgggtttccagggcac

SEQ ID NO: 749558 - DNA, 23 bp, Homo sapiens
gtagtattttttgtataattgga

SEQ ID NO: 749559 - DNA, 17 bp, Homo sapiens
gtagtcaagattgtgtt

SEQ ID NO: 749560 - DNA, 16 bp, Homo sapiens
gtagtcacaaactgat

SEQ ID NO: 749561 - DNA, 12 bp, Homo sapiens
gtagtcccagct

SEQ ID NO: 749562 - DNA, 22 bp, Homo sapiens
gtagtccgtgctgacagctgct

SEQ ID NO: 749563 - DNA, 23 bp, Homo sapiens
gtagtccgtgctgacagctgctc

SEQ ID NO: 749564 - DNA, 20 bp, Homo sapiens
gtagtctcactgcttgaact

SEQ ID NO: 749565 - DNA, 19 bp, Homo sapiens
gtagtgcatttttaaactt

SEQ ID NO: 749566 - DNA, 20 bp, Homo sapiens
gtagtgccccacctcccgcc

SEQ ID NO: 749567 - DNA, 15 bp, Homo sapiens
gtagtggaagagcag

SEQ ID NO: 749568 - DNA, 18 bp, Homo sapiens
gtagtggcttcttttgaa

SEQ ID NO: 749569 - DNA, 21 bp, Homo sapiens
gtagttacattaatgcccagc

SEQ ID NO: 749570 - DNA, 13 bp, Homo sapiens
gtagttagtagca

SEQ ID NO: 749571 - DNA, 16 bp, Homo sapiens
gtagttagtagcatgt

SEQ ID NO: 749572 - DNA, 17 bp, Homo sapiens
gtagttccctgaaaacc

SEQ ID NO: 749573 - DNA, 17 bp, Homo sapiens
gtagttctgtgcctccc

SEQ ID NO: 749574 - DNA, 17 bp, Homo sapiens
gtagttctgtgtacttt

SEQ ID NO: 749575 - DNA, 21 bp, Homo sapiens
gtagttctgtttggtgtgtcc

SEQ ID NO: 749576 - DNA, 15 bp, Homo sapiens
gtagttcttgtgcat

SEQ ID NO: 749577 - DNA, 18 bp, Homo sapiens
gtagtttagttctgttga

SEQ ID NO: 749578 - DNA, 21 bp, Homo sapiens
gtagtttatggcagaagggaa

SEQ ID NO: 749579 - DNA, 12 bp, Homo sapiens
gtagtttgatca

SEQ ID NO: 749580 - DNA, 20 bp, Homo sapiens
gtagtttggatatttttgta

SEQ ID NO: 749581 - DNA, 17 bp, Homo sapiens
gtagttttcaaaacaca

SEQ ID NO: 749582 - DNA, 13 bp, Homo sapiens
gtagtttttacaa

SEQ ID NO: 749583 - DNA, 20 bp, Homo sapiens
gtagtttttatatgttgtaa

SEQ ID NO: 749584 - DNA, 19 bp, Homo sapiens
gtagtttttcagctagttt

SEQ ID NO: 749585 - DNA, 17 bp, Homo sapiens
gtagttttttcatcttc

SEQ ID NO: 749586 - DNA, 23 bp, Homo sapiens
gtagttttttttttttttatgtg

SEQ ID NO: 749587 - DNA, 12 bp, Homo sapiens
gtataaaaagga

SEQ ID NO: 749588 - DNA, 13 bp, Homo sapiens
gtataaaaaggaa

SEQ ID NO: 749589 - DNA, 14 bp, Homo sapiens
gtataaaaaggaaa

SEQ ID NO: 749590 - DNA, 20 bp, Homo sapiens
gtataaaaattatcaaaaag

SEQ ID NO: 749591 - DNA, 21 bp, Homo sapiens
gtataaaactttcctcgcctg

SEQ ID NO: 749592 - DNA, 14 bp, Homo sapiens
gtataaaagacaaa

SEQ ID NO: 749593 - DNA, 18 bp, Homo sapiens
gtataaactgctgtcaat

SEQ ID NO: 749594 - DNA, 14 bp, Homo sapiens
gtataaagaaaagt

SEQ ID NO: 749595 - DNA, 23 bp, Homo sapiens
gtataaagcaactgttatgaaat

SEQ ID NO: 749596 - DNA, 14 bp, Homo sapiens
gtataaataataaa

SEQ ID NO: 749597 - DNA, 23 bp, Homo sapiens
gtataaatgtacatttccaaatg

SEQ ID NO: 749598 - DNA, 14 bp, Homo sapiens
gtataaattattca

SEQ ID NO: 749599 - DNA, 16 bp, Homo sapiens
gtataaccaagtgtgc

SEQ ID NO: 749600 - DNA, 16 bp, Homo sapiens
gtataagatttttgaa

SEQ ID NO: 749601 - DNA, 15 bp, Homo sapiens
gtataagtaagaaaa

SEQ ID NO: 749602 - DNA, 22 bp, Homo sapiens
gtataatactttgtatacaagt

SEQ ID NO: 749603 - DNA, 15 bp, Homo sapiens
gtataatattgaaaa

SEQ ID NO: 749604 - DNA, 21 bp, Homo sapiens
gtataatctcctctgctcatt

SEQ ID NO: 749605 - DNA, 17 bp, Homo sapiens
gtataatctttctatag

SEQ ID NO: 749606 - DNA, 14 bp, Homo sapiens
gtataatgctttct

SEQ ID NO: 749607 - DNA, 16 bp, Homo sapiens
gtataatgctttctga

SEQ ID NO: 749608 - DNA, 15 bp, Homo sapiens
gtataatgtgtctgt

SEQ ID NO: 749609 - DNA, 18 bp, Homo sapiens
gtataattaacttaactg

SEQ ID NO: 749610 - DNA, 18 bp, Homo sapiens
gtataattaattgtcatt

SEQ ID NO: 749611 - DNA, 20 bp, Homo sapiens
gtataattggatttcctaat

SEQ ID NO: 749612 - DNA, 16 bp, Homo sapiens
gtatacaacaggagag

SEQ ID NO: 749613 - DNA, 19 bp, Homo sapiens
gtatacaacaggagagaga

SEQ ID NO: 749614 - DNA, 19 bp, Homo sapiens
gtatacaaccctggcatta

SEQ ID NO: 749615 - DNA, 17 bp, Homo sapiens
gtatacaactgcctggg

SEQ ID NO: 749616 - DNA, 19 bp, Homo sapiens
gtatacacacatatacata

SEQ ID NO: 749617 - DNA, 23 bp, Homo sapiens
gtatacacacatatacatatata

SEQ ID NO: 749618 - DNA, 23 bp, Homo sapiens
gtatacagagaagaaaacctcaa

SEQ ID NO: 749619 - DNA, 21 bp, Homo sapiens
gtataccaatgtgttttctgt

SEQ ID NO: 749620 - DNA, 13 bp, Homo sapiens
gtataccacctgt

SEQ ID NO: 749621 - DNA, 16 bp, Homo sapiens
gtataccacctgtaca

SEQ ID NO: 749622 - DNA, 14 bp, Homo sapiens
gtatacctggcttt

SEQ ID NO: 749623 - DNA, 21 bp, Homo sapiens
gtatacctggctttttaaaat

SEQ ID NO: 749624 - DNA, 20 bp, Homo sapiens
gtatacgtataaatatcagt

SEQ ID NO: 749625 - DNA, 15 bp, Homo sapiens
gtatactgtaaaagt

SEQ ID NO: 749626 - DNA, 16 bp, Homo sapiens
gtatactgtaaaagtt

SEQ ID NO: 749627 - DNA, 15 bp, Homo sapiens
gtatactgtaggcac

SEQ ID NO: 749628 - DNA, 15 bp, Homo sapiens
gtatagaaatgctgg

SEQ ID NO: 749629 - DNA, 13 bp, Homo sapiens
gtatagaataaac

SEQ ID NO: 749630 - DNA, 20 bp, Homo sapiens
gtatagatataatgaacaaa

SEQ ID NO: 749631 - DNA, 16 bp, Homo sapiens
gtatagatgcaagata

SEQ ID NO: 749632 - DNA, 20 bp, Homo sapiens
gtatagcatgaaataaaata

SEQ ID NO: 749633 - DNA, 17 bp, Homo sapiens
gtatagctttatactct

SEQ ID NO: 749634 - DNA, 15 bp, Homo sapiens
gtataggatgtcaga

SEQ ID NO: 749635 - DNA, 21 bp, Homo sapiens
gtataggtctcaatatttatt

SEQ ID NO: 749636 - DNA, 13 bp, Homo sapiens
gtatagtgtaaaa

SEQ ID NO: 749637 - DNA, 14 bp, Homo sapiens
gtatagtgtaaaat

SEQ ID NO: 749638 - DNA, 16 bp, Homo sapiens
gtatagtgttcacaaa

SEQ ID NO: 749639 - DNA, 18 bp, Homo sapiens
gtatagtgttcacaaact

SEQ ID NO: 749640 - DNA, 17 bp, Homo sapiens
gtatagttgcttgcctg

SEQ ID NO: 749641 - DNA, 18 bp, Homo sapiens
gtatagttgcttgcctga

SEQ ID NO: 749642 - DNA, 16 bp, Homo sapiens
gtatataaccttcatt

SEQ ID NO: 749643 - DNA, 18 bp, Homo sapiens
gtatataagttgctgtgt

SEQ ID NO: 749644 - DNA, 14 bp, Homo sapiens
gtatataataactt

SEQ ID NO: 749645 - DNA, 18 bp, Homo sapiens
gtatataatatgtcacct

SEQ ID NO: 749646 - DNA, 21 bp, Homo sapiens
gtatataatttttttatgttt

SEQ ID NO: 749647 - DNA, 16 bp, Homo sapiens
gtatatacgcatctat

SEQ ID NO: 749648 - DNA, 15 bp, Homo sapiens
gtatatacttaagaa

SEQ ID NO: 749649 - DNA, 13 bp, Homo sapiens
gtatatacttttt

SEQ ID NO: 749650 - DNA, 16 bp, Homo sapiens
gtatatagtatattta

SEQ ID NO: 749651 - DNA, 18 bp, Homo sapiens
gtatatagtatatttata

SEQ ID NO: 749652 - DNA, 23 bp, Homo sapiens
gtatatatatatatatgtacagt

SEQ ID NO: 749653 - DNA, 21 bp, Homo sapiens
gtatatatatgccatgatgga

SEQ ID NO: 749654 - DNA, 21 bp, Homo sapiens
gtatatatctattattcaaaa

SEQ ID NO: 749655 - DNA, 19 bp, Homo sapiens
gtatatatcttataactgt

SEQ ID NO: 749656 - DNA, 18 bp, Homo sapiens
gtatatatgtgtgtttaa

SEQ ID NO: 749657 - DNA, 20 bp, Homo sapiens
gtatatatgtgtgtttaaat

SEQ ID NO: 749658 - DNA, 13 bp, Homo sapiens
gtatatattccca

SEQ ID NO: 749659 - DNA, 14 bp, Homo sapiens
gtatatatttaaaa

SEQ ID NO: 749660 - DNA, 16 bp, Homo sapiens
gtatatattttatatg

SEQ ID NO: 749661 - DNA, 22 bp, Homo sapiens
gtatatattttatatgttcata

SEQ ID NO: 749662 - DNA, 14 bp, Homo sapiens
gtatatcagaaaag

SEQ ID NO: 749663 - DNA, 16 bp, Homo sapiens
gtatatcattctacag

SEQ ID NO: 749664 - DNA, 19 bp, Homo sapiens
gtatatctcaacagaatta

SEQ ID NO: 749665 - DNA, 21 bp, Homo sapiens
gtatatctggacaagccaact

SEQ ID NO: 749666 - DNA, 18 bp, Homo sapiens
gtatatgatctaatacaa

SEQ ID NO: 749667 - DNA, 16 bp, Homo sapiens
gtatatgattctctgt

SEQ ID NO: 749668 - DNA, 12 bp, Homo sapiens
gtatatgtatta

SEQ ID NO: 749669 - DNA, 13 bp, Homo sapiens
gtatatgtattcc

SEQ ID NO: 749670 - DNA, 24 bp, Homo sapiens
gtatatgtatttaagatgtacatt

SEQ ID NO: 749671 - DNA, 22 bp, Homo sapiens
gtatatgtcaagccataattgt

SEQ ID NO: 749672 - DNA, 15 bp, Homo sapiens
gtatatgtctcaggt

SEQ ID NO: 749673 - DNA, 21 bp, Homo sapiens
gtatatgtctcaggtccctgc

SEQ ID NO: 749674 - DNA, 19 bp, Homo sapiens
gtatatgtgagaaatcaga

SEQ ID NO: 749675 - DNA, 17 bp, Homo sapiens
gtatatgtttatatact

SEQ ID NO: 749676 - DNA, 19 bp, Homo sapiens
gtatatgtttatatactgg

SEQ ID NO: 749677 - DNA, 19 bp, Homo sapiens
gtatattaaaaaagagaca

SEQ ID NO: 749678 - DNA, 16 bp, Homo sapiens
gtatattaaaatagca

SEQ ID NO: 749679 - DNA, 11 bp, Homo sapiens
gtatattaaac

SEQ ID NO: 749680 - DNA, 14 bp, Homo sapiens
gtatattacaatga

SEQ ID NO: 749681 - DNA, 17 bp, Homo sapiens
gtatattacaatgatca

SEQ ID NO: 749682 - DNA, 19 bp, Homo sapiens
gtatattatataactcttt

SEQ ID NO: 749683 - DNA, 18 bp, Homo sapiens
ctgggtttccagggcaca

SEQ ID NO: 749684 - DNA, 14 bp, Homo sapiens
ctgggtttgcccag

SEQ ID NO: 749685 - DNA, 15 bp, Homo sapiens
ctgggtttgcccagt

SEQ ID NO: 749686 - DNA, 21 bp, Homo sapiens
ctgggtttgcccagtcctggg

SEQ ID NO: 749687 - DNA, 22 bp, Homo sapiens
ctgggtttgcccagtcctgggt

SEQ ID NO: 749688 - DNA, 15 bp, Homo sapiens
ctgggtttggacccc

SEQ ID NO: 749689 - DNA, 16 bp, Homo sapiens
ctgggtttggacccca

SEQ ID NO: 749690 - DNA, 20 bp, Homo sapiens
ctgggtttggaccccagctg

SEQ ID NO: 749691 - DNA, 21 bp, Homo sapiens
ctgggtttggaccccagctgg

SEQ ID NO: 749692 - DNA, 14 bp, Homo sapiens
ctgggtttggccca

SEQ ID NO: 749693 - DNA, 17 bp, Homo sapiens
ctgggtttggcccaaga

SEQ ID NO: 749694 - DNA, 22 bp, Homo sapiens
ctgggtttgtacttccacctcc

SEQ ID NO: 749695 - DNA, 20 bp, Homo sapiens
ctgggttttgtattctctga

SEQ ID NO: 749696 - DNA, 20 bp, Homo sapiens
ctggtaaaaagatccaggga

SEQ ID NO: 749697 - DNA, 12 bp, Homo sapiens
ctggtaaaaatg

SEQ ID NO: 749698 - DNA, 23 bp, Homo sapiens
ctggtaaaattaagcacactaaa

SEQ ID NO: 749699 - DNA, 23 bp, Homo sapiens
ctggtaaacattcctccagcctc

SEQ ID NO: 749700 - DNA, 22 bp, Homo sapiens
ctggtaaccaaatattaaagat

SEQ ID NO: 749701 - DNA, 19 bp, Homo sapiens
ctggtaactggaaggcctt

SEQ ID NO: 749702 - DNA, 15 bp, Homo sapiens
ctggtaagattgtta

SEQ ID NO: 749703 - DNA, 22 bp, Homo sapiens
ctggtaagattgttattaaatg

SEQ ID NO: 749704 - DNA, 23 bp, Homo sapiens
ctggtaagattgttattaaatgt

SEQ ID NO: 749705 - DNA, 15 bp, Homo sapiens
ctggtacagcagggt

SEQ ID NO: 749706 - DNA, 14 bp, Homo sapiens
ctggtacccagcca

SEQ ID NO: 749707 - DNA, 23 bp, Homo sapiens
ctggtacccagccatctgcccag

SEQ ID NO: 749708 - DNA, 14 bp, Homo sapiens
ctggtaccctcctg

SEQ ID NO: 749709 - DNA, 16 bp, Homo sapiens
ctggtaccctcctggc

SEQ ID NO: 749710 - DNA, 15 bp, Homo sapiens
ctggtactcaagcca

SEQ ID NO: 749711 - DNA, 22 bp, Homo sapiens
ctggtactcaagccagcctgta

SEQ ID NO: 749712 - DNA, 16 bp, Homo sapiens
ctggtactctcctaga

SEQ ID NO: 749713 - DNA, 21 bp, Homo sapiens
ctggtactctggcaaatgatg

SEQ ID NO: 749714 - DNA, 19 bp, Homo sapiens
ctggtacttcctttctccc

SEQ ID NO: 749715 - DNA, 23 bp, Homo sapiens
ctggtagaaaaaggggcctgagt

SEQ ID NO: 749716 - DNA, 15 bp, Homo sapiens
ctggtagagaccccc

SEQ ID NO: 749717 - DNA, 15 bp, Homo sapiens
ctggtagatagaaat

SEQ ID NO: 749718 - DNA, 20 bp, Homo sapiens
ctggtagcacatgtctgtcc

SEQ ID NO: 749719 - DNA, 14 bp, Homo sapiens
ctggtagcagcagg

SEQ ID NO: 749720 - DNA, 20 bp, Homo sapiens
ctggtagcagcaggctcagg

SEQ ID NO: 749721 - DNA, 23 bp, Homo sapiens
ctggtagcataaataaaactgaa

SEQ ID NO: 749722 - DNA, 17 bp, Homo sapiens
ctggtagctgaggggac

SEQ ID NO: 749723 - DNA, 15 bp, Homo sapiens
ctggtaggaccaagc

SEQ ID NO: 749724 - DNA, 20 bp, Homo sapiens
ctggtagtgtagctgtgtgg

SEQ ID NO: 749725 - DNA, 16 bp, Homo sapiens
ctggtatatgtcatta

SEQ ID NO: 749726 - DNA, 17 bp, Homo sapiens
ctggtatatgtcattat

SEQ ID NO: 749727 - DNA, 19 bp, Homo sapiens
ctggtatctcagaaagtgc

SEQ ID NO: 749728 - DNA, 22 bp, Homo sapiens
ctggtatctcagaaagtgcctg

SEQ ID NO: 749729 - DNA, 23 bp, Homo sapiens
ctggtatctcagaaagtgcctga

SEQ ID NO: 749730 - DNA, 22 bp, Homo sapiens
ctggtatgtaaaagaaaatcca

SEQ ID NO: 749731 - DNA, 11 bp, Homo sapiens
ctggtattaaa

SEQ ID NO: 749732 - DNA, 15 bp, Homo sapiens
ctggtattaaatgcc

SEQ ID NO: 749733 - DNA, 16 bp, Homo sapiens
ctggtattaaatgcca

SEQ ID NO: 749734 - DNA, 19 bp, Homo sapiens
ctggtattaaatgccaagg

SEQ ID NO: 749735 - DNA, 12 bp, Homo sapiens
ctggtattcaca

SEQ ID NO: 749736 - DNA, 15 bp, Homo sapiens
ctggtattctgttct

SEQ ID NO: 749737 - DNA, 19 bp, Homo sapiens
ctggtattctgttctggag

SEQ ID NO: 749738 - DNA, 13 bp, Homo sapiens
ctggtatttatat

SEQ ID NO: 749739 - DNA, 18 bp, Homo sapiens
ctggtatttatatttcaa

SEQ ID NO: 749740 - DNA, 13 bp, Homo sapiens
ctggtatttctaa

SEQ ID NO: 749741 - DNA, 22 bp, Homo sapiens
ctggtattttaagagaaaactg

SEQ ID NO: 749742 - DNA, 18 bp, Homo sapiens
ctggtcaaacaaactctc

SEQ ID NO: 749743 - DNA, 15 bp, Homo sapiens
ctggtcaacctcctg

SEQ ID NO: 749744 - DNA, 16 bp, Homo sapiens
ctggtcaacctcctgg

SEQ ID NO: 749745 - DNA, 20 bp, Homo sapiens
ctggtcaagttgagattttt

SEQ ID NO: 749746 - DNA, 19 bp, Homo sapiens
ctggtcacaggactctgcc

SEQ ID NO: 749747 - DNA, 23 bp, Homo sapiens
ctggtcacaggactctgcctcct

SEQ ID NO: 749748 - DNA, 20 bp, Homo sapiens
ctggtcaccctggggctgct

SEQ ID NO: 749749 - DNA, 20 bp, Homo sapiens
ctggtcaccttgcactcctc

SEQ ID NO: 749750 - DNA, 21 bp, Homo sapiens
ctggtcactctgccctctgct

SEQ ID NO: 749751 - DNA, 22 bp, Homo sapiens
ctggtcactctgccctctgctg

SEQ ID NO: 749752 - DNA, 14 bp, Homo sapiens
ctggtcagcttgct

SEQ ID NO: 749753 - DNA, 14 bp, Homo sapiens
ctggtcagggcagt

SEQ ID NO: 749754 - DNA, 22 bp, Homo sapiens
ctggtcagggcagtggccaagc

SEQ ID NO: 749755 - DNA, 19 bp, Homo sapiens
ctggtcagtctttgctcag

SEQ ID NO: 749756 - DNA, 21 bp, Homo sapiens
ctggtcattaatgtgtcccct

SEQ ID NO: 749757 - DNA, 14 bp, Homo sapiens
ctggtccagctctg

SEQ ID NO: 749758 - DNA, 22 bp, Homo sapiens
ctggtccagctctgacatccct

SEQ ID NO: 749759 - DNA, 23 bp, Homo sapiens
ctggtccagctctgacatccctt

SEQ ID NO: 749760 - DNA, 16 bp, Homo sapiens
ctggtccaggccctgt

SEQ ID NO: 749761 - DNA, 20 bp, Homo sapiens
ctggtccaggtcttcagttt

SEQ ID NO: 749762 - DNA, 19 bp, Homo sapiens
ctggtccatgatggagtca

SEQ ID NO: 749763 - DNA, 19 bp, Homo sapiens
ctggtccccactgctgagc

SEQ ID NO: 749764 - DNA, 19 bp, Homo sapiens
ctggtcccggggccagcac

SEQ ID NO: 749765 - DNA, 23 bp, Homo sapiens
ctggtccctcgtccacaggggca

SEQ ID NO: 749766 - DNA, 22 bp, Homo sapiens
ctggtccctcttctctcctcag

SEQ ID NO: 749767 - DNA, 21 bp, Homo sapiens
ctggtcccttgcagctagttt

SEQ ID NO: 749768 - DNA, 19 bp, Homo sapiens
ctggtccgtgggacggtgc

SEQ ID NO: 749769 - DNA, 17 bp, Homo sapiens
ctggtcctacccatccc

SEQ ID NO: 749770 - DNA, 22 bp, Homo sapiens
ctggtcctacccatccccgcag

SEQ ID NO: 749771 - DNA, 15 bp, Homo sapiens
ctggtcctaggtcct

SEQ ID NO: 749772 - DNA, 15 bp, Homo sapiens
ctggtcctccacttt

SEQ ID NO: 749773 - DNA, 21 bp, Homo sapiens
ctggtcctcggagctggttcc

SEQ ID NO: 749774 - DNA, 23 bp, Homo sapiens
ctggtcctcggagctggttcctc

SEQ ID NO: 749775 - DNA, 19 bp, Homo sapiens
ctggtcctgagggtcccca

SEQ ID NO: 749776 - DNA, 21 bp, Homo sapiens
ctggtcctgagggtccccacc

SEQ ID NO: 749777 - DNA, 14 bp, Homo sapiens
ctggtcctggacac

SEQ ID NO: 749778 - DNA, 22 bp, Homo sapiens
ctggtcctggacacctcccagg

SEQ ID NO: 749779 - DNA, 15 bp, Homo sapiens
ctggtcctggcctcc

SEQ ID NO: 749780 - DNA, 19 bp, Homo sapiens
ctggtcctggctgcactct

SEQ ID NO: 749781 - DNA, 14 bp, Homo sapiens
ctggtcctgtgtgc

SEQ ID NO: 749782 - DNA, 17 bp, Homo sapiens
ctggtccttctgacccc

SEQ ID NO: 749783 - DNA, 19 bp, Homo sapiens
ctggtccttctgaccccac

SEQ ID NO: 749784 - DNA, 20 bp, Homo sapiens
ctggtccttctgaccccact

SEQ ID NO: 749785 - DNA, 22 bp, Homo sapiens
ctggtcctttttggtcgaggag

SEQ ID NO: 749786 - DNA, 13 bp, Homo sapiens
ctggtcgctcctg

SEQ ID NO: 749787 - DNA, 18 bp, Homo sapiens
ctggtcgctcctgcccac

SEQ ID NO: 749788 - DNA, 23 bp, Homo sapiens
ctggtctcaaacttgtggcctca

SEQ ID NO: 749789 - DNA, 17 bp, Homo sapiens
ctggtctcttcaccact

SEQ ID NO: 749790 - DNA, 20 bp, Homo sapiens
ctggtctgatgacttgctta

SEQ ID NO: 749791 - DNA, 16 bp, Homo sapiens
ctggtctggagtccca

SEQ ID NO: 749792 - DNA, 14 bp, Homo sapiens
ctggtctgtaggga

SEQ ID NO: 749793 - DNA, 12 bp, Homo sapiens
ctggtctgtctt

SEQ ID NO: 749794 - DNA, 11 bp, Homo sapiens
ctggtctgtga

SEQ ID NO: 749795 - DNA, 13 bp, Homo sapiens
ctggtctgtggag

SEQ ID NO: 749796 - DNA, 22 bp, Homo sapiens
ctggtctgtggagatggactca

SEQ ID NO: 749797 - DNA, 15 bp, Homo sapiens
ctggtcttctctaca

SEQ ID NO: 749798 - DNA, 20 bp, Homo sapiens
ctggtcttgtggaattggga

SEQ ID NO: 749799 - DNA, 15 bp, Homo sapiens
ctggtcttgttagaa

SEQ ID NO: 749800 - DNA, 15 bp, Homo sapiens
ctggtctttcctctg

SEQ ID NO: 749801 - DNA, 15 bp, Homo sapiens
ctggtcttttctcct

SEQ ID NO: 749802 - DNA, 15 bp, Homo sapiens
ctggtgaagctcact

SEQ ID NO: 749803 - DNA, 15 bp, Homo sapiens
ctggtgacctcctgt

SEQ ID NO: 749804 - DNA, 16 bp, Homo sapiens
ctggtgacctcctgtc

SEQ ID NO: 749805 - DNA, 19 bp, Homo sapiens
ctggtgacctcctgtcact

SEQ ID NO: 749806 - DNA, 23 bp, Homo sapiens
gtatattcaggacttgaaagaaa

SEQ ID NO: 749807 - DNA, 15 bp, Homo sapiens
gtatattccaccatt

SEQ ID NO: 749808 - DNA, 14 bp, Homo sapiens
gtatattctggaaa

SEQ ID NO: 749809 - DNA, 15 bp, Homo sapiens
gtatattctggaaaa

SEQ ID NO: 749810 - DNA, 23 bp, Homo sapiens
gtatattcttattggaaatgtac

SEQ ID NO: 749811 - DNA, 14 bp, Homo sapiens
gtatattgagaatc

SEQ ID NO: 749812 - DNA, 12 bp, Homo sapiens
gtatattgctaa

SEQ ID NO: 749813 - DNA, 20 bp, Homo sapiens
gtatattggtgtatattata

SEQ ID NO: 749814 - DNA, 22 bp, Homo sapiens
gtatattgtataggggcaactg

SEQ ID NO: 749815 - DNA, 19 bp, Homo sapiens
gtatattgtgagttttcta

SEQ ID NO: 749816 - DNA, 20 bp, Homo sapiens
gtatattgtggatgtgttca

SEQ ID NO: 749817 - DNA, 13 bp, Homo sapiens
gtatattgtgttt

SEQ ID NO: 749818 - DNA, 22 bp, Homo sapiens
gtatatttatagtcacaagagc

SEQ ID NO: 749819 - DNA, 13 bp, Homo sapiens
gtatatttgctgc

SEQ ID NO: 749820 - DNA, 14 bp, Homo sapiens
gtatatttgctgca

SEQ ID NO: 749821 - DNA, 19 bp, Homo sapiens
gtatatttgctgcaaagag

SEQ ID NO: 749822 - DNA, 13 bp, Homo sapiens
gtatatttgcttc

SEQ ID NO: 749823 - DNA, 14 bp, Homo sapiens
gtatatttgtacaa

SEQ ID NO: 749824 - DNA, 18 bp, Homo sapiens
gtatatttgtatgatatt

SEQ ID NO: 749825 - DNA, 14 bp, Homo sapiens
gtatattttcctat

SEQ ID NO: 749826 - DNA, 15 bp, Homo sapiens
gtatattttcctata

SEQ ID NO: 749827 - DNA, 21 bp, Homo sapiens
gtatattttgggaatcttttc

SEQ ID NO: 749828 - DNA, 19 bp, Homo sapiens
gtatatttttttaatttaa

SEQ ID NO: 749829 - DNA, 21 bp, Homo sapiens
gtatcaaaatagtttaggaaa

SEQ ID NO: 749830 - DNA, 15 bp, Homo sapiens
gtatcaaaattacat

SEQ ID NO: 749831 - DNA, 13 bp, Homo sapiens
gtatcaaatacat

SEQ ID NO: 749832 - DNA, 21 bp, Homo sapiens
gtatcaggaaatatatatgtg

SEQ ID NO: 749833 - DNA, 18 bp, Homo sapiens
gtatcaggacccagagga

SEQ ID NO: 749834 - DNA, 17 bp, Homo sapiens
gtatcaggacgagaatg

SEQ ID NO: 749835 - DNA, 19 bp, Homo sapiens
gtatcataattaccaagtg

SEQ ID NO: 749836 - DNA, 14 bp, Homo sapiens
gtatcatctccatc

SEQ ID NO: 749837 - DNA, 18 bp, Homo sapiens
gtatcatgccctgtgcaa

SEQ ID NO: 749838 - DNA, 19 bp, Homo sapiens
gtatccacacaaattcagt

SEQ ID NO: 749839 - DNA, 12 bp, Homo sapiens
gtatccagagct

SEQ ID NO: 749840 - DNA, 18 bp, Homo sapiens
gtatccccccatcttgct

SEQ ID NO: 749841 - DNA, 14 bp, Homo sapiens
gtatcccctgcctc

SEQ ID NO: 749842 - DNA, 16 bp, Homo sapiens
gtatcctaaactttag

SEQ ID NO: 749843 - DNA, 16 bp, Homo sapiens
gtatcctccctgccca

SEQ ID NO: 749844 - DNA, 17 bp, Homo sapiens
gtatcctccctgcccat

SEQ ID NO: 749845 - DNA, 18 bp, Homo sapiens
gtatcctgcccagtgttg

SEQ ID NO: 749846 - DNA, 17 bp, Homo sapiens
gtatcctggccctgggg

SEQ ID NO: 749847 - DNA, 19 bp, Homo sapiens
gtatcgctcctattgaaag

SEQ ID NO: 749848 - DNA, 14 bp, Homo sapiens
gtatcggagacagt

SEQ ID NO: 749849 - DNA, 21 bp, Homo sapiens
gtatctaaaggatggaaaaat

SEQ ID NO: 749850 - DNA, 17 bp, Homo sapiens
gtatctacagtaatgaa

SEQ ID NO: 749851 - DNA, 22 bp, Homo sapiens
gtatctacctggaaacagcttt

SEQ ID NO: 749852 - DNA, 23 bp, Homo sapiens
gtatctatgcaaagcactctctg

SEQ ID NO: 749853 - DNA, 15 bp, Homo sapiens
gtatctatttgtaca

SEQ ID NO: 749854 - DNA, 18 bp, Homo sapiens
gtatctatttgtacaatt

SEQ ID NO: 749855 - DNA, 20 bp, Homo sapiens
gtatctcagaaagtgcctga

SEQ ID NO: 749856 - DNA, 18 bp, Homo sapiens
gtatctccctggagaagc

SEQ ID NO: 749857 - DNA, 20 bp, Homo sapiens
gtatctccctggagaagcac

SEQ ID NO: 749858 - DNA, 17 bp, Homo sapiens
gtatctctgaagcatgt

SEQ ID NO: 749859 - DNA, 17 bp, Homo sapiens
gtatctgagttgccaag

SEQ ID NO: 749860 - DNA, 23 bp, Homo sapiens
gtatctgagttgccaagacaaat

SEQ ID NO: 749861 - DNA, 17 bp, Homo sapiens
gtatctgcaggcagaca

SEQ ID NO: 749862 - DNA, 18 bp, Homo sapiens
gtatctgcaggcagacac

SEQ ID NO: 749863 - DNA, 13 bp, Homo sapiens
gtatctgtaaccc

SEQ ID NO: 749864 - DNA, 15 bp, Homo sapiens
gtatctgtaaccctt

SEQ ID NO: 749865 - DNA, 14 bp, Homo sapiens
gtatctgtcacaat

SEQ ID NO: 749866 - DNA, 17 bp, Homo sapiens
gtatctgtcacaataaa

SEQ ID NO: 749867 - DNA, 19 bp, Homo sapiens
gtatctgtctttccactct

SEQ ID NO: 749868 - DNA, 20 bp, Homo sapiens
gtatcttacctgtaaagtct

SEQ ID NO: 749869 - DNA, 17 bp, Homo sapiens
gtatcttactttcctct

SEQ ID NO: 749870 - DNA, 15 bp, Homo sapiens
gtatcttctattttt

SEQ ID NO: 749871 - DNA, 22 bp, Homo sapiens
gtatcttctatttttatcatga

SEQ ID NO: 749872 - DNA, 22 bp, Homo sapiens
gtatcttgatgtttagaaaagt

SEQ ID NO: 749873 - DNA, 22 bp, Homo sapiens
gtatctttaacaattgtcttaa

SEQ ID NO: 749874 - DNA, 23 bp, Homo sapiens
gtatctttaacaattgtcttaaa

SEQ ID NO: 749875 - DNA, 15 bp, Homo sapiens
gtatctttatgctgt

SEQ ID NO: 749876 - DNA, 23 bp, Homo sapiens
gtatctttgacaattctgggtgc

SEQ ID NO: 749877 - DNA, 16 bp, Homo sapiens
gtatcttttttcaaaa

SEQ ID NO: 749878 - DNA, 11 bp, Homo sapiens
gtatgaaatat

SEQ ID NO: 749879 - DNA, 13 bp, Homo sapiens
gtatgaacttgag

SEQ ID NO: 749880 - DNA, 13 bp, Homo sapiens
gtatgaaggcttt

SEQ ID NO: 749881 - DNA, 13 bp, Homo sapiens
gtatgaagtatct

SEQ ID NO: 749882 - DNA, 22 bp, Homo sapiens
gtatgaataaaaggctggaaac

SEQ ID NO: 749883 - DNA, 23 bp, Homo sapiens
gtatgaataatgaaaataaaaca

SEQ ID NO: 749884 - DNA, 15 bp, Homo sapiens
gtatgaatctatgcc

SEQ ID NO: 749885 - DNA, 12 bp, Homo sapiens
gtatgaatttga

SEQ ID NO: 749886 - DNA, 13 bp, Homo sapiens
gtatgacataggc

SEQ ID NO: 749887 - DNA, 17 bp, Homo sapiens
gtatgacttctgctgaa

SEQ ID NO: 749888 - DNA, 16 bp, Homo sapiens
gtatgagatggttaaa

SEQ ID NO: 749889 - DNA, 17 bp, Homo sapiens
gtatgagcgaaattgtc

SEQ ID NO: 749890 - DNA, 12 bp, Homo sapiens
gtatgagctgag

SEQ ID NO: 749891 - DNA, 14 bp, Homo sapiens
gtatgagctgaggg

SEQ ID NO: 749892 - DNA, 19 bp, Homo sapiens
gtatgaggtcctcaggtca

SEQ ID NO: 749893 - DNA, 20 bp, Homo sapiens
gtatgagtcaatgtgcagtg

SEQ ID NO: 749894 - DNA, 21 bp, Homo sapiens
gtatgagtgtgagtgtgtgtg

SEQ ID NO: 749895 - DNA, 24 bp, Homo sapiens
gtatgataggttattttgatgtaa

SEQ ID NO: 749896 - DNA, 22 bp, Homo sapiens
gtatgatgaaaataattttcca

SEQ ID NO: 749897 - DNA, 13 bp, Homo sapiens
gtatgatgtgttg

SEQ ID NO: 749898 - DNA, 21 bp, Homo sapiens
gtatgattactggcctttttc

SEQ ID NO: 749899 - DNA, 15 bp, Homo sapiens
gtatgattccaatct

SEQ ID NO: 749900 - DNA, 23 bp, Homo sapiens
gtatgatttataaacagacaata

SEQ ID NO: 749901 - DNA, 23 bp, Homo sapiens
gtatgatttgttttgaattttgt

SEQ ID NO: 749902 - DNA, 14 bp, Homo sapiens
gtatgcacacacat

SEQ ID NO: 749903 - DNA, 15 bp, Homo sapiens
gtatgcagtgtagat

SEQ ID NO: 749904 - DNA, 20 bp, Homo sapiens
gtatgcagttgataagagga

SEQ ID NO: 749905 - DNA, 12 bp, Homo sapiens
gtatgcatgtga

SEQ ID NO: 749906 - DNA, 17 bp, Homo sapiens
gtatgcatgtgaagaaa

SEQ ID NO: 749907 - DNA, 15 bp, Homo sapiens
gtatgccttctgtat

SEQ ID NO: 749908 - DNA, 21 bp, Homo sapiens
gtatgccttctgtattttaat

SEQ ID NO: 749909 - DNA, 21 bp, Homo sapiens
gtatgcgtgtccgtctgtctg

SEQ ID NO: 749910 - DNA, 19 bp, Homo sapiens
gtatgctggccagcaccct

SEQ ID NO: 749911 - DNA, 17 bp, Homo sapiens
gtatgctttccctgagg

SEQ ID NO: 749912 - DNA, 18 bp, Homo sapiens
gtatgctttccctgagga

SEQ ID NO: 749913 - DNA, 13 bp, Homo sapiens
gtatggaaataaa

SEQ ID NO: 749914 - DNA, 18 bp, Homo sapiens
gtatggaatacagtgtta

SEQ ID NO: 749915 - DNA, 16 bp, Homo sapiens
gtatggaatattcatt

SEQ ID NO: 749916 - DNA, 18 bp, Homo sapiens
gtatggactatctgtctg

SEQ ID NO: 749917 - DNA, 22 bp, Homo sapiens
gtatggcactggcattgtccct

SEQ ID NO: 749918 - DNA, 14 bp, Homo sapiens
gtatggcagaggtg

SEQ ID NO: 749919 - DNA, 13 bp, Homo sapiens
gtatggcccaggc

SEQ ID NO: 749920 - DNA, 17 bp, Homo sapiens
gtatggcccaggcagcc

SEQ ID NO: 749921 - DNA, 19 bp, Homo sapiens
gtatggcccaggcagcctc

SEQ ID NO: 749922 - DNA, 20 bp, Homo sapiens
gtatggcccaggcagcctca

SEQ ID NO: 749923 - DNA, 21 bp, Homo sapiens
gtatggctctgcacccctctg

SEQ ID NO: 749924 - DNA, 14 bp, Homo sapiens
gtatgggaagccat

SEQ ID NO: 749925 - DNA, 23 bp, Homo sapiens
gtatgggaagccatattcacacc

SEQ ID NO: 749926 - DNA, 20 bp, Homo sapiens
gtatgggggaaggcgctggg

SEQ ID NO: 749927 - DNA, 22 bp, Homo sapiens
gtatggtaggggagggcaggct

SEQ ID NO: 749928 - DNA, 15 bp, Homo sapiens
gtatggttctcagat

SEQ ID NO: 749929 - DNA, 15 bp, Homo sapiens
gtatggttgacacta

SEQ ID NO: 749930 - DNA, 14 bp, Homo sapiens
ctggtgactttggg

SEQ ID NO: 749931 - DNA, 16 bp, Homo sapiens
ctggttgtatttctat

SEQ ID NO: 749932 - DNA, 22 bp, Homo sapiens
ctggttgtatttctatatttat

SEQ ID NO: 749933 - DNA, 12 bp, Homo sapiens
gtatgtaaatgt

SEQ ID NO: 749934 - DNA, 16 bp, Homo sapiens
gtatgtacaatacaat

SEQ ID NO: 749935 - DNA, 21 bp, Homo sapiens
gtatgtacaatacaatgtaca

SEQ ID NO: 749936 - DNA, 23 bp, Homo sapiens
gtatgtacttagctgtactataa

SEQ ID NO: 749937 - DNA, 9 bp, Homo sapiens
gtatgtata

SEQ ID NO: 749938 - DNA, 11 bp, Homo sapiens
gtatgtataat

SEQ ID NO: 749939 - DNA, 15 bp, Homo sapiens
gtatgtataattcaa

SEQ ID NO: 749940 - DNA, 17 bp, Homo sapiens
gtatgtatacacacata

SEQ ID NO: 749941 - DNA, 23 bp, Homo sapiens
gtatgtatattaaaaaagagaca

SEQ ID NO: 749942 - DNA, 13 bp, Homo sapiens
gtatgtcaaagct

SEQ ID NO: 749943 - DNA, 22 bp, Homo sapiens
gtatgtcaataaacaacagctg

SEQ ID NO: 749944 - DNA, 14 bp, Homo sapiens
gtatgtcagtggtt

SEQ ID NO: 749945 - DNA, 13 bp, Homo sapiens
gtatgtctccagt

SEQ ID NO: 749946 - DNA, 14 bp, Homo sapiens
gtatgtctctttaa

SEQ ID NO: 749947 - DNA, 22 bp, Homo sapiens
gtatgtctctttaagttttgat

SEQ ID NO: 749948 - DNA, 20 bp, Homo sapiens
gtatgtctgcaggtgtctga

SEQ ID NO: 749949 - DNA, 13 bp, Homo sapiens
gtatgtgccaggc

SEQ ID NO: 749950 - DNA, 14 bp, Homo sapiens
gtatgtgccaggct

SEQ ID NO: 749951 - DNA, 22 bp, Homo sapiens
gtatgtgccaggcttgcctggg

SEQ ID NO: 749952 - DNA, 15 bp, Homo sapiens
gtatgtgtaataaat

SEQ ID NO: 749953 - DNA, 18 bp, Homo sapiens
gtatgtgtcaactgagag

SEQ ID NO: 749954 - DNA, 11 bp, Homo sapiens
gtatgtgtgtg

SEQ ID NO: 749955 - DNA, 13 bp, Homo sapiens
gtatgtgtgtgtg

SEQ ID NO: 749956 - DNA, 15 bp, Homo sapiens
gtatgttatgaacat

SEQ ID NO: 749957 - DNA, 20 bp, Homo sapiens
gtatgtttctctttgattat

SEQ ID NO: 749958 - DNA, 18 bp, Homo sapiens
gtatgtttcttctttctt

SEQ ID NO: 749959 - DNA, 21 bp, Homo sapiens
gtatgtttgcacacttgtgtg

SEQ ID NO: 749960 - DNA, 15 bp, Homo sapiens
gtattaaaaaaaaca

SEQ ID NO: 749961 - DNA, 17 bp, Homo sapiens
gtattaaacttgtcaga

SEQ ID NO: 749962 - DNA, 15 bp, Homo sapiens
gtattaaatcttaaa

SEQ ID NO: 749963 - DNA, 17 bp, Homo sapiens
gtattaaatcttaaaca

SEQ ID NO: 749964 - DNA, 22 bp, Homo sapiens
gtattaaatcttaaacaatgta

SEQ ID NO: 749965 - DNA, 23 bp, Homo sapiens
gtattaaatcttaaacaatgtat

SEQ ID NO: 749966 - DNA, 12 bp, Homo sapiens
gtattaagaaag

SEQ ID NO: 749967 - DNA, 14 bp, Homo sapiens
gtattaagaaagga

SEQ ID NO: 749968 - DNA, 21 bp, Homo sapiens
gtattaagcccacagtatatt

SEQ ID NO: 749969 - DNA, 23 bp, Homo sapiens
gtattaagggtaggatgttgctt

SEQ ID NO: 749970 - DNA, 22 bp, Homo sapiens
gtattaagttgttaataaaagt

SEQ ID NO: 749971 - DNA, 11 bp, Homo sapiens
gtattaataaa

SEQ ID NO: 749972 - DNA, 15 bp, Homo sapiens
gtattaataaagcat

SEQ ID NO: 749973 - DNA, 21 bp, Homo sapiens
gtattaataaagcattcttta

SEQ ID NO: 749974 - DNA, 20 bp, Homo sapiens
gtattaatctctgtgtgttt

SEQ ID NO: 749975 - DNA, 14 bp, Homo sapiens
gtattacaaacaag

SEQ ID NO: 749976 - DNA, 22 bp, Homo sapiens
gtattactgaataatatcaaat

SEQ ID NO: 749977 - DNA, 22 bp, Homo sapiens
gtattacttaggttattttgct

SEQ ID NO: 749978 - DNA, 23 bp, Homo sapiens
gtattacttaggttattttgctt

SEQ ID NO: 749979 - DNA, 17 bp, Homo sapiens
gtattactttctgccgc

SEQ ID NO: 749980 - DNA, 14 bp, Homo sapiens
gtattagtttttga

SEQ ID NO: 749981 - DNA, 22 bp, Homo sapiens
gtattataataagcaaaaagat

SEQ ID NO: 749982 - DNA, 19 bp, Homo sapiens
gtattataggccaaactgg

SEQ ID NO: 749983 - DNA, 16 bp, Homo sapiens
gtattatcacatcaag

SEQ ID NO: 749984 - DNA, 19 bp, Homo sapiens
gtattatcattgctcccct

SEQ ID NO: 749985 - DNA, 20 bp, Homo sapiens
gtattatcttgttcaggaaa

SEQ ID NO: 749986 - DNA, 13 bp, Homo sapiens
gtattatgctgtt

SEQ ID NO: 749987 - DNA, 15 bp, Homo sapiens
gtattattacaaata

SEQ ID NO: 749988 - DNA, 19 bp, Homo sapiens
gtattattacaaatattgt

SEQ ID NO: 749989 - DNA, 15 bp, Homo sapiens
gtattattattattg

SEQ ID NO: 749990 - DNA, 14 bp, Homo sapiens
gtattatttggagt

SEQ ID NO: 749991 - DNA, 23 bp, Homo sapiens
gtattcaccccacacccagggct

SEQ ID NO: 749992 - DNA, 16 bp, Homo sapiens
gtattcagaaattaaa

SEQ ID NO: 749993 - DNA, 20 bp, Homo sapiens
gtattcagaccctgggtcag

SEQ ID NO: 749994 - DNA, 19 bp, Homo sapiens
gtattcagaggcagtgatg

SEQ ID NO: 749995 - DNA, 21 bp, Homo sapiens
gtattcatgaaaactgttttt

SEQ ID NO: 749996 - DNA, 14 bp, Homo sapiens
gtattccaccttaa

SEQ ID NO: 749997 - DNA, 22 bp, Homo sapiens
gtattccaccttaaattaaaca

SEQ ID NO: 749998 - DNA, 20 bp, Homo sapiens
gtattcccactcaccagccc

SEQ ID NO: 749999 - DNA, 11 bp, Homo sapiens
gtattccctta

SEQ ID NO: 750000 - DNA, 23 bp, Homo sapiens
gtattccttttgtgtacagtgtg

SEQ ID NO: 750001 - DNA, 23 bp, Homo sapiens
gtattctattctaataactgctt

SEQ ID NO: 750002 - DNA, 13 bp, Homo sapiens
gtattctcaaaga

SEQ ID NO: 750003 - DNA, 12 bp, Homo sapiens
gtattctcagag

SEQ ID NO: 750004 - DNA, 18 bp, Homo sapiens
gtattctcataggagact

SEQ ID NO: 750005 - DNA, 18 bp, Homo sapiens
gtattctctcctgtacct

SEQ ID NO: 750006 - DNA, 12 bp, Homo sapiens
gtattctctgag

SEQ ID NO: 750007 - DNA, 12 bp, Homo sapiens
gtattctgtttg

SEQ ID NO: 750008 - DNA, 18 bp, Homo sapiens
gtattcttctgtatttct

SEQ ID NO: 750009 - DNA, 14 bp, Homo sapiens
gtattcttgtcaaa

SEQ ID NO: 750010 - DNA, 11 bp, Homo sapiens
gtattcttttt

SEQ ID NO: 750011 - DNA, 13 bp, Homo sapiens
gtattgactttat

SEQ ID NO: 750012 - DNA, 16 bp, Homo sapiens
gtattgagatttctta

SEQ ID NO: 750013 - DNA, 18 bp, Homo sapiens
gtattgatgcaatataag

SEQ ID NO: 750014 - DNA, 20 bp, Homo sapiens
gtattgattacaaataaaca

SEQ ID NO: 750015 - DNA, 13 bp, Homo sapiens
gtattgcacattg

SEQ ID NO: 750016 - DNA, 16 bp, Homo sapiens
gtattgcacattgtaa

SEQ ID NO: 750017 - DNA, 21 bp, Homo sapiens
gtattgcccccatggggtcct

SEQ ID NO: 750018 - DNA, 16 bp, Homo sapiens
gtattgcgaatgtgca

SEQ ID NO: 750019 - DNA, 23 bp, Homo sapiens
gtattgcgaatgtgcagaaagca

SEQ ID NO: 750020 - DNA, 14 bp, Homo sapiens
gtattgctgtgtct

SEQ ID NO: 750021 - DNA, 21 bp, Homo sapiens
gtattgctgtgtctcctctca

SEQ ID NO: 750022 - DNA, 17 bp, Homo sapiens
gtattgcttattttatt

SEQ ID NO: 750023 - DNA, 20 bp, Homo sapiens
gtattgctttagtatgctgg

SEQ ID NO: 750024 - DNA, 16 bp, Homo sapiens
gtattggaagacttgg

SEQ ID NO: 750025 - DNA, 23 bp, Homo sapiens
gtattggacggtttctagcctct

SEQ ID NO: 750026 - DNA, 23 bp, Homo sapiens
gtattggagcacatgttactgct

SEQ ID NO: 750027 - DNA, 15 bp, Homo sapiens
gtattggcctgttca

SEQ ID NO: 750028 - DNA, 22 bp, Homo sapiens
gtattggctagaggttcaaaga

SEQ ID NO: 750029 - DNA, 17 bp, Homo sapiens
gtattggctatgatggt

SEQ ID NO: 750030 - DNA, 12 bp, Homo sapiens
gtattgtaaatt

SEQ ID NO: 750031 - DNA, 21 bp, Homo sapiens
gtattgtaagtggaaaatgca

SEQ ID NO: 750032 - DNA, 22 bp, Homo sapiens
gtattgtcagccatcgtcctgg

SEQ ID NO: 750033 - DNA, 17 bp, Homo sapiens
gtattgttagatgtttg

SEQ ID NO: 750034 - DNA, 14 bp, Homo sapiens
gtattgttcccagt

SEQ ID NO: 750035 - DNA, 15 bp, Homo sapiens
gtattgttgtccttt

SEQ ID NO: 750036 - DNA, 12 bp, Homo sapiens
gtatttaaagtt

SEQ ID NO: 750037 - DNA, 13 bp, Homo sapiens
gtatttaaagttg

SEQ ID NO: 750038 - DNA, 16 bp, Homo sapiens
gtatttaacaaaaagt

SEQ ID NO: 750039 - DNA, 20 bp, Homo sapiens
gtatttaactacatctgcct

SEQ ID NO: 750040 - DNA, 21 bp, Homo sapiens
gtatttaactacatctgcctc

SEQ ID NO: 750041 - DNA, 14 bp, Homo sapiens
gtatttaagactga

SEQ ID NO: 750042 - DNA, 21 bp, Homo sapiens
gtatttaaggaatcaaatctt

SEQ ID NO: 750043 - DNA, 15 bp, Homo sapiens
gtatttacactatga

SEQ ID NO: 750044 - DNA, 13 bp, Homo sapiens
gtatttacagaca

SEQ ID NO: 750045 - DNA, 16 bp, Homo sapiens
gtatttacgctttgat

SEQ ID NO: 750046 - DNA, 17 bp, Homo sapiens
gtatttacgctttgatt

SEQ ID NO: 750047 - DNA, 19 bp, Homo sapiens
gtatttacgctttgattca

SEQ ID NO: 750048 - DNA, 11 bp, Homo sapiens
gtatttataat

SEQ ID NO: 750049 - DNA, 17 bp, Homo sapiens
gtatttatataagtctg

SEQ ID NO: 750050 - DNA, 12 bp, Homo sapiens
gtatttatatat

SEQ ID NO: 750051 - DNA, 14 bp, Homo sapiens
gtatttatatttgg

SEQ ID NO: 750052 - DNA, 17 bp, Homo sapiens
gtatttatgtaatttgt

SEQ ID NO: 750053 - DNA, 14 bp, Homo sapiens
ctgtacccagctcc

SEQ ID NO: 750054 - DNA, 13 bp, Homo sapiens
ctgtacccttcca

SEQ ID NO: 750055 - DNA, 16 bp, Homo sapiens
ctgtacccttccacct

SEQ ID NO: 750056 - DNA, 15 bp, Homo sapiens
ctgtacctgttcctc

SEQ ID NO: 750057 - DNA, 20 bp, Homo sapiens
ctgtaccttttgaggagccc

SEQ ID NO: 750058 - DNA, 19 bp, Homo sapiens
ctgtacgaaaaagagcata

SEQ ID NO: 750059 - DNA, 17 bp, Homo sapiens
ctgtacgacacgggtgg

SEQ ID NO: 750060 - DNA, 15 bp, Homo sapiens
ctgtactataagtag

SEQ ID NO: 750061 - DNA, 18 bp, Homo sapiens
gtatttcccttccaaaga

SEQ ID NO: 750062 - DNA, 15 bp, Homo sapiens
gtatttccttccact

SEQ ID NO: 750063 - DNA, 22 bp, Homo sapiens
gtatttccttccactgtagcta

SEQ ID NO: 750064 - DNA, 16 bp, Homo sapiens
gtatttcgaaactgcc

SEQ ID NO: 750065 - DNA, 12 bp, Homo sapiens
gtatttctatat

SEQ ID NO: 750066 - DNA, 18 bp, Homo sapiens
gtatttgagaagataatc

SEQ ID NO: 750067 - DNA, 19 bp, Homo sapiens
gtatttggaaataaagtca

SEQ ID NO: 750068 - DNA, 20 bp, Homo sapiens
gtatttggaaataaagtcag

SEQ ID NO: 750069 - DNA, 19 bp, Homo sapiens
gtatttggaatatttgaat

SEQ ID NO: 750070 - DNA, 22 bp, Homo sapiens
gtatttggctatggatctgatt

SEQ ID NO: 750071 - DNA, 13 bp, Homo sapiens
gtatttgtattaa

SEQ ID NO: 750072 - DNA, 16 bp, Homo sapiens
gtatttgtattaataa

SEQ ID NO: 750073 - DNA, 17 bp, Homo sapiens
gtatttgtattaataaa

SEQ ID NO: 750074 - DNA, 17 bp, Homo sapiens
gtatttgttaatttaga

SEQ ID NO: 750075 - DNA, 18 bp, Homo sapiens
gtatttgttaatttagaa

SEQ ID NO: 750076 - DNA, 22 bp, Homo sapiens
gtatttgttaatttagaaaact

SEQ ID NO: 750077 - DNA, 18 bp, Homo sapiens
gtattttaacactttgta

SEQ ID NO: 750078 - DNA, 21 bp, Homo sapiens
gtattttatgatacttgaatt

SEQ ID NO: 750079 - DNA, 20 bp, Homo sapiens
gtattttattcagtagtttg

SEQ ID NO: 750080 - DNA, 13 bp, Homo sapiens
gtattttcaatag

SEQ ID NO: 750081 - DNA, 13 bp, Homo sapiens
gtattttcatagt

SEQ ID NO: 750082 - DNA, 22 bp, Homo sapiens
gtattttcccccttttctgcat

SEQ ID NO: 750083 - DNA, 13 bp, Homo sapiens
gtattttcctgga

SEQ ID NO: 750084 - DNA, 18 bp, Homo sapiens
gtattttctttctctact

SEQ ID NO: 750085 - DNA, 14 bp, Homo sapiens
gtattttgcatact

SEQ ID NO: 750086 - DNA, 19 bp, Homo sapiens
gtattttggctttctccct

SEQ ID NO: 750087 - DNA, 16 bp, Homo sapiens
gtattttgtcccattt

SEQ ID NO: 750088 - DNA, 22 bp, Homo sapiens
gtatttttaatgggggtagcag

SEQ ID NO: 750089 - DNA, 15 bp, Homo sapiens
gtatttttactatta

SEQ ID NO: 750090 - DNA, 18 bp, Homo sapiens
gtatttttatacaaacct

SEQ ID NO: 750091 - DNA, 18 bp, Homo sapiens
gtatttttcaataaagca

SEQ ID NO: 750092 - DNA, 19 bp, Homo sapiens
gtatttttcaataataaaa

SEQ ID NO: 750093 - DNA, 20 bp, Homo sapiens
gtatttttcaggtaggccct

SEQ ID NO: 750094 - DNA, 19 bp, Homo sapiens
gtatttttctgacttttac

SEQ ID NO: 750095 - DNA, 13 bp, Homo sapiens
gtatttttcttga

SEQ ID NO: 750096 - DNA, 17 bp, Homo sapiens
gtatttttgctgcttct

SEQ ID NO: 750097 - DNA, 17 bp, Homo sapiens
gtattttttaaaacact

SEQ ID NO: 750098 - DNA, 18 bp, Homo sapiens
gtattttttaaaacacta

SEQ ID NO: 750099 - DNA, 22 bp, Homo sapiens
gtattttttaaaacactaaaag

SEQ ID NO: 750100 - DNA, 15 bp, Homo sapiens
gtattttttaaagct

SEQ ID NO: 750101 - DNA, 23 bp, Homo sapiens
gtattttttacttttcacactgt

SEQ ID NO: 750102 - DNA, 14 bp, Homo sapiens
gtattttttccttt

SEQ ID NO: 750103 - DNA, 17 bp, Homo sapiens
gtatttttttaaatcaa

SEQ ID NO: 750104 - DNA, 15 bp, Homo sapiens
gtatttttttactaa

SEQ ID NO: 750105 - DNA, 17 bp, Homo sapiens
gtatttttttactaata

SEQ ID NO: 750106 - DNA, 21 bp, Homo sapiens
gtatttttttactaatagaca

SEQ ID NO: 750107 - DNA, 18 bp, Homo sapiens
gtatttttttttctaaga

SEQ ID NO: 750108 - DNA, 22 bp, Homo sapiens
gtatttttttttctaagagaag

SEQ ID NO: 750109 - DNA, 23 bp, Homo sapiens
gtcaaaaagggcttgaggtgaat

SEQ ID NO: 750110 - DNA, 15 bp, Homo sapiens
gtcaaaacagattgt

SEQ ID NO: 750111 - DNA, 15 bp, Homo sapiens
gtcaaaactggttta

SEQ ID NO: 750112 - DNA, 21 bp, Homo sapiens
gtcaaaagagccctggctctg

SEQ ID NO: 750113 - DNA, 13 bp, Homo sapiens
gtcaaaagcctgg

SEQ ID NO: 750114 - DNA, 15 bp, Homo sapiens
gtcaaaaggtgcctg

SEQ ID NO: 750115 - DNA, 16 bp, Homo sapiens
gtcaaaaggtgcctgt

SEQ ID NO: 750116 - DNA, 23 bp, Homo sapiens
gtcaaaataaaggataactctgt

SEQ ID NO: 750117 - DNA, 13 bp, Homo sapiens
gtcaaaatttgct

SEQ ID NO: 750118 - DNA, 20 bp, Homo sapiens
gtcaaacaaactctctgaac

SEQ ID NO: 750119 - DNA, 22 bp, Homo sapiens
gtcaaaccgcactcacccatgt

SEQ ID NO: 750120 - DNA, 23 bp, Homo sapiens
gtcaaactccctagtctccacct

SEQ ID NO: 750121 - DNA, 20 bp, Homo sapiens
gtcaaactgtagaaatgatg

SEQ ID NO: 750122 - DNA, 13 bp, Homo sapiens
gtcaaacttggat

SEQ ID NO: 750123 - DNA, 21 bp, Homo sapiens
gtcaaacttggatacttggat

SEQ ID NO: 750124 - DNA, 14 bp, Homo sapiens
gtcaaactttttcc

SEQ ID NO: 750125 - DNA, 16 bp, Homo sapiens
gtcaaactttttccag

SEQ ID NO: 750126 - DNA, 12 bp, Homo sapiens
gtcaaagaaatg

SEQ ID NO: 750127 - DNA, 12 bp, Homo sapiens
gtcaaagaagac

SEQ ID NO: 750128 - DNA, 12 bp, Homo sapiens
gtcaaagaagct

SEQ ID NO: 750129 - DNA, 15 bp, Homo sapiens
gtcaaagaagcttcc

SEQ ID NO: 750130 - DNA, 14 bp, Homo sapiens
gtcaaagatgcccc

SEQ ID NO: 750131 - DNA, 23 bp, Homo sapiens
gtcaaagcaggggagtatgcaaa

SEQ ID NO: 750132 - DNA, 21 bp, Homo sapiens
gtcaaatcccaaaccattact

SEQ ID NO: 750133 - DNA, 14 bp, Homo sapiens
gtcaaatgaacttt

SEQ ID NO: 750134 - DNA, 21 bp, Homo sapiens
gtcaaatgccaaacactagct

SEQ ID NO: 750135 - DNA, 16 bp, Homo sapiens
gtcaaatgggaaaaaa

SEQ ID NO: 750136 - DNA, 18 bp, Homo sapiens
gtcaaatgggaaaaaaac

SEQ ID NO: 750137 - DNA, 16 bp, Homo sapiens
gtcaaatgtttcctta

SEQ ID NO: 750138 - DNA, 21 bp, Homo sapiens
gtcaacactatataaataagc

SEQ ID NO: 750139 - DNA, 19 bp, Homo sapiens
gtcaacacttaagggtttt

SEQ ID NO: 750140 - DNA, 22 bp, Homo sapiens
gtcaacacttaagggttttaga

SEQ ID NO: 750141 - DNA, 18 bp, Homo sapiens
gtcaacagagaaggcagg

SEQ ID NO: 750142 - DNA, 13 bp, Homo sapiens
gtcaacagtaaac

SEQ ID NO: 750143 - DNA, 12 bp, Homo sapiens
gtcaacattgtg

SEQ ID NO: 750144 - DNA, 18 bp, Homo sapiens
gtcaacccaagctctggg

SEQ ID NO: 750145 - DNA, 13 bp, Homo sapiens
gtcaacctcctgg

SEQ ID NO: 750146 - DNA, 16 bp, Homo sapiens
gtcaacctcctggaca

SEQ ID NO: 750147 - DNA, 20 bp, Homo sapiens
gtcaacctttgtgtggctcc

SEQ ID NO: 750148 - DNA, 23 bp, Homo sapiens
gtcaacctttgtgtggctcctgg

SEQ ID NO: 750149 - DNA, 17 bp, Homo sapiens
gtcaactctttgttatt

SEQ ID NO: 750150 - DNA, 20 bp, Homo sapiens
gtcaactggagcaagaagga

SEQ ID NO: 750151 - DNA, 14 bp, Homo sapiens
gtcaactggctggc

SEQ ID NO: 750152 - DNA, 18 bp, Homo sapiens
gtcaactggctggccagt

SEQ ID NO: 750153 - DNA, 17 bp, Homo sapiens
gtcaacttctggctcct

SEQ ID NO: 750154 - DNA, 18 bp, Homo sapiens
gtcaagaaacagccagca

SEQ ID NO: 750155 - DNA, 14 bp, Homo sapiens
gtcaagaaaggagg

SEQ ID NO: 750156 - DNA, 18 bp, Homo sapiens
gtcaagaaaggaggggag

SEQ ID NO: 750157 - DNA, 12 bp, Homo sapiens
gtcaagaagaat

SEQ ID NO: 750158 - DNA, 21 bp, Homo sapiens
gtcaagaatagcattgtaaaa

SEQ ID NO: 750159 - DNA, 14 bp, Homo sapiens
gtcaagacatttgc

SEQ ID NO: 750160 - DNA, 15 bp, Homo sapiens
gtcaagaccagcctg

SEQ ID NO: 750161 - DNA, 17 bp, Homo sapiens
gtcaagatcaacattcc

SEQ ID NO: 750162 - DNA, 22 bp, Homo sapiens
gtcaagcaatggggaatacaag

SEQ ID NO: 750163 - DNA, 14 bp, Homo sapiens
gtcaagcacatgta

SEQ ID NO: 750164 - DNA, 23 bp, Homo sapiens
gtcaagcctcttattccaggaga

SEQ ID NO: 750165 - DNA, 20 bp, Homo sapiens
gtcaagctcctcctccctgc

SEQ ID NO: 750166 - DNA, 14 bp, Homo sapiens
gtcaagctgctctg

SEQ ID NO: 750167 - DNA, 18 bp, Homo sapiens
gtcaagctgctctgagcc

SEQ ID NO: 750168 - DNA, 12 bp, Homo sapiens
gtcaaggaacct

SEQ ID NO: 750169 - DNA, 19 bp, Homo sapiens
gtcaaggacagggctgagc

SEQ ID NO: 750170 - DNA, 21 bp, Homo sapiens
gtcaaggccgagggccaggca

SEQ ID NO: 750171 - DNA, 16 bp, Homo sapiens
gtcaaggtgatatata

SEQ ID NO: 750172 - DNA, 14 bp, Homo sapiens
gtcaaggtgtggaa

SEQ ID NO: 750173 - DNA, 17 bp, Homo sapiens
gtcaagtctctgctggc

SEQ ID NO: 750174 - DNA, 16 bp, Homo sapiens
gtcaagtgaaaaagga

SEQ ID NO: 750175 - DNA, 16 bp, Homo sapiens
ctgtatggcccaggca

SEQ ID NO: 750176 - DNA, 18 bp, Homo sapiens
ctgtatggcccaggcagc

SEQ ID NO: 750177 - DNA, 20 bp, Homo sapiens
ctgtatggctgtatttgctg

SEQ ID NO: 750178 - DNA, 13 bp, Homo sapiens
ctgtatgtgagct

SEQ ID NO: 750179 - DNA, 19 bp, Homo sapiens
ctgtatgtgagctgtaaaa

SEQ ID NO: 750180 - DNA, 14 bp, Homo sapiens
ctgtattaaatctt

SEQ ID NO: 750181 - DNA, 23 bp, Homo sapiens
ctgtattaaatcttaaacaatgt

SEQ ID NO: 750182 - DNA, 15 bp, Homo sapiens
ctgtattaagtgact

SEQ ID NO: 750183 - DNA, 23 bp, Homo sapiens
ctgtattaatccccatcattact

SEQ ID NO: 750184 - DNA, 17 bp, Homo sapiens
ctgtattacagctttca

SEQ ID NO: 750185 - DNA, 17 bp, Homo sapiens
ctgtattacataaataa

SEQ ID NO: 750186 - DNA, 23 bp, Homo sapiens
ctgtattcttgctttagaaaaca

SEQ ID NO: 750187 - DNA, 19 bp, Homo sapiens
ctgtattcttgtttgaatt

SEQ ID NO: 750188 - DNA, 14 bp, Homo sapiens
gtcaatattaaata

SEQ ID NO: 750189 - DNA, 15 bp, Homo sapiens
gtcaatattaaatac

SEQ ID NO: 750190 - DNA, 16 bp, Homo sapiens
gtcaatattaaataca

SEQ ID NO: 750191 - DNA, 17 bp, Homo sapiens
gtcaatattaaatacag

SEQ ID NO: 750192 - DNA, 23 bp, Homo sapiens
gtcaatattaaatacagacacta

SEQ ID NO: 750193 - DNA, 12 bp, Homo sapiens
gtcaatatttaa

SEQ ID NO: 750194 - DNA, 14 bp, Homo sapiens
gtcaatcagccttt

SEQ ID NO: 750195 - DNA, 15 bp, Homo sapiens
gtcaatcagccttta

SEQ ID NO: 750196 - DNA, 19 bp, Homo sapiens
gtcaattaaacagctggtc

SEQ ID NO: 750197 - DNA, 21 bp, Homo sapiens
gtcaattaccagaaagataac

SEQ ID NO: 750198 - DNA, 17 bp, Homo sapiens
gtcaatttatgaatata

SEQ ID NO: 750199 - DNA, 21 bp, Homo sapiens
gtcaatttgctgaaaacatta

SEQ ID NO: 750200 - DNA, 17 bp, Homo sapiens
gtcacaagagcccagca

SEQ ID NO: 750201 - DNA, 11 bp, Homo sapiens
gtcacacactg

SEQ ID NO: 750202 - DNA, 12 bp, Homo sapiens
gtcacacactgg

SEQ ID NO: 750203 - DNA, 16 bp, Homo sapiens
gtcacacactggaccc

SEQ ID NO: 750204 - DNA, 20 bp, Homo sapiens
gtcacacactggaccccact

SEQ ID NO: 750205 - DNA, 19 bp, Homo sapiens
gtcacacattacaaagtta

SEQ ID NO: 750206 - DNA, 13 bp, Homo sapiens
gtcacacctgtgc

SEQ ID NO: 750207 - DNA, 20 bp, Homo sapiens
gtcacactggtgctgagtga

SEQ ID NO: 750208 - DNA, 22 bp, Homo sapiens
gtcacactgtgtgaggctgtgt

SEQ ID NO: 750209 - DNA, 12 bp, Homo sapiens
gtcacagctgca

SEQ ID NO: 750210 - DNA, 19 bp, Homo sapiens
gtcacagctgcagctgggc

SEQ ID NO: 750211 - DNA, 17 bp, Homo sapiens
gtcacaggactctgcct

SEQ ID NO: 750212 - DNA, 19 bp, Homo sapiens
gtcacaggactctgcctcc

SEQ ID NO: 750213 - DNA, 15 bp, Homo sapiens
gtcacagggccaact

SEQ ID NO: 750214 - DNA, 18 bp, Homo sapiens
gtcacagggcctggggag

SEQ ID NO: 750215 - DNA, 20 bp, Homo sapiens
gtcacagtaaaaataaaata

SEQ ID NO: 750216 - DNA, 19 bp, Homo sapiens
gtcacagtcctatgtacag

SEQ ID NO: 750217 - DNA, 14 bp, Homo sapiens
gtcacagtttcagg

SEQ ID NO: 750218 - DNA, 22 bp, Homo sapiens
gtcacattatttattaaaaatg

SEQ ID NO: 750219 - DNA, 14 bp, Homo sapiens
gtcacattctgctt

SEQ ID NO: 750220 - DNA, 16 bp, Homo sapiens
gtcacatttgaattct

SEQ ID NO: 750221 - DNA, 14 bp, Homo sapiens
gtcaccaaatttgt

SEQ ID NO: 750222 - DNA, 15 bp, Homo sapiens
gtcaccaaggcagtg

SEQ ID NO: 750223 - DNA, 17 bp, Homo sapiens
gtcaccaaggcagtgca

SEQ ID NO: 750224 - DNA, 19 bp, Homo sapiens
gtcaccaaggcagtgcatg

SEQ ID NO: 750225 - DNA, 21 bp, Homo sapiens
gtcaccaaggcagtgcatgca

SEQ ID NO: 750226 - DNA, 13 bp, Homo sapiens
gtcaccaccaccc

SEQ ID NO: 750227 - DNA, 14 bp, Homo sapiens
gtcaccaccacccc

SEQ ID NO: 750228 - DNA, 14 bp, Homo sapiens
gtcaccaccttccc

SEQ ID NO: 750229 - DNA, 12 bp, Homo sapiens
gtcaccacgtgg

SEQ ID NO: 750230 - DNA, 16 bp, Homo sapiens
gtcaccagagacttta

SEQ ID NO: 750231 - DNA, 18 bp, Homo sapiens
gtcaccagctatctgtca

SEQ ID NO: 750232 - DNA, 16 bp, Homo sapiens
gtcaccagctgctgtg

SEQ ID NO: 750233 - DNA, 12 bp, Homo sapiens
gtcaccatcctc

SEQ ID NO: 750234 - DNA, 14 bp, Homo sapiens
gtcaccatcctcag

SEQ ID NO: 750235 - DNA, 20 bp, Homo sapiens
gtcaccatcctcagaggctg

SEQ ID NO: 750236 - DNA, 20 bp, Homo sapiens
gtcaccatctcaggccacct

SEQ ID NO: 750237 - DNA, 13 bp, Homo sapiens
gtcacccaaacac

SEQ ID NO: 750238 - DNA, 22 bp, Homo sapiens
gtcacccaaacacttctgcttt

SEQ ID NO: 750239 - DNA, 22 bp, Homo sapiens
gtcacccaaagcctgtcccagg

SEQ ID NO: 750240 - DNA, 17 bp, Homo sapiens
gtcacccagagcacagg

SEQ ID NO: 750241 - DNA, 23 bp, Homo sapiens
gtcacccaggctctggagccaga

SEQ ID NO: 750242 - DNA, 13 bp, Homo sapiens
gtcacccctccct

SEQ ID NO: 750243 - DNA, 13 bp, Homo sapiens
gtcaccctgcaga

SEQ ID NO: 750244 - DNA, 15 bp, Homo sapiens
gtcaccctgcagagc

SEQ ID NO: 750245 - DNA, 17 bp, Homo sapiens
gtcaccctggggatagt

SEQ ID NO: 750246 - DNA, 13 bp, Homo sapiens
gtcaccctgtggg

SEQ ID NO: 750247 - DNA, 23 bp, Homo sapiens
gtcaccctgtgggtgtctccctc

SEQ ID NO: 750248 - DNA, 15 bp, Homo sapiens
gtcacccttctgggc

SEQ ID NO: 750249 - DNA, 22 bp, Homo sapiens
gtcaccgcggacgtgctggcct

SEQ ID NO: 750250 - DNA, 15 bp, Homo sapiens
gtcacctagcaagct

SEQ ID NO: 750251 - DNA, 14 bp, Homo sapiens
gtcacctcagctga

SEQ ID NO: 750252 - DNA, 16 bp, Homo sapiens
gtcacctcgtctccct

SEQ ID NO: 750253 - DNA, 13 bp, Homo sapiens
gtcacctgcaagc

SEQ ID NO: 750254 - DNA, 19 bp, Homo sapiens
gtcacctgcaagccccagg

SEQ ID NO: 750255 - DNA, 22 bp, Homo sapiens
gtcacctgcaagccccagggcc

SEQ ID NO: 750256 - DNA, 24 bp, Homo sapiens
gtcacctgctcacagggatgctgg

SEQ ID NO: 750257 - DNA, 13 bp, Homo sapiens
gtcacctggctgc

SEQ ID NO: 750258 - DNA, 17 bp, Homo sapiens
gtcacctggctgctagg

SEQ ID NO: 750259 - DNA, 18 bp, Homo sapiens
gtcaccttgcactcctca

SEQ ID NO: 750260 - DNA, 15 bp, Homo sapiens
gtcacctttctgggc

SEQ ID NO: 750261 - DNA, 22 bp, Homo sapiens
gtcaccttttctgtggctggct

SEQ ID NO: 750262 - DNA, 16 bp, Homo sapiens
gtcacgagcacaatgg

SEQ ID NO: 750263 - DNA, 16 bp, Homo sapiens
gtcacgctccctgact

SEQ ID NO: 750264 - DNA, 22 bp, Homo sapiens
gtcacgcttgcctggtcaccct

SEQ ID NO: 750265 - DNA, 19 bp, Homo sapiens
gtcacgctttcatgaccac

SEQ ID NO: 750266 - DNA, 16 bp, Homo sapiens
gtcactacagggagaa

SEQ ID NO: 750267 - DNA, 17 bp, Homo sapiens
gtcactactcacagtct

SEQ ID NO: 750268 - DNA, 19 bp, Homo sapiens
gtcactatgggatgagaaa

SEQ ID NO: 750269 - DNA, 21 bp, Homo sapiens
gtcactattttcactagggct

SEQ ID NO: 750270 - DNA, 14 bp, Homo sapiens
gtcactcactgagg

SEQ ID NO: 750271 - DNA, 17 bp, Homo sapiens
gtcactcactgaggcca

SEQ ID NO: 750272 - DNA, 20 bp, Homo sapiens
gtcactcattaatgaatcac

SEQ ID NO: 750273 - DNA, 16 bp, Homo sapiens
gtcactccaccatccc

SEQ ID NO: 750274 - DNA, 21 bp, Homo sapiens
gtcactccaccatccccaccc

SEQ ID NO: 750275 - DNA, 19 bp, Homo sapiens
gtcactccctctgccttca

SEQ ID NO: 750276 - DNA, 16 bp, Homo sapiens
gtcactcctctctagg

SEQ ID NO: 750277 - DNA, 19 bp, Homo sapiens
gtcactcttcctgcaagga

SEQ ID NO: 750278 - DNA, 17 bp, Homo sapiens
gtcactcttggtccctg

SEQ ID NO: 750279 - DNA, 14 bp, Homo sapiens
gtcactgaacaaaa

SEQ ID NO: 750280 - DNA, 12 bp, Homo sapiens
gtcactgagacc

SEQ ID NO: 750281 - DNA, 23 bp, Homo sapiens
gtcactgcacagtgcatctcagc

SEQ ID NO: 750282 - DNA, 9 bp, Homo sapiens
gtcactgcc

SEQ ID NO: 750283 - DNA, 16 bp, Homo sapiens
gtcactgcccaccaaa

SEQ ID NO: 750284 - DNA, 17 bp, Homo sapiens
gtcactgcccaccaaag

SEQ ID NO: 750285 - DNA, 12 bp, Homo sapiens
gtcactgctgta

SEQ ID NO: 750286 - DNA, 10 bp, Homo sapiens
gtcactgctt

SEQ ID NO: 750287 - DNA, 15 bp, Homo sapiens
gtcactgcttaactt

SEQ ID NO: 750288 - DNA, 18 bp, Homo sapiens
gtcactggaggttgaagc

SEQ ID NO: 750289 - DNA, 23 bp, Homo sapiens
gtcactggaggttgaagccaagt

SEQ ID NO: 750290 - DNA, 16 bp, Homo sapiens
gtcactggcagagcac

SEQ ID NO: 750291 - DNA, 21 bp, Homo sapiens
gtcactggcagagcacagccc

SEQ ID NO: 750292 - DNA, 12 bp, Homo sapiens
gtcactggctct

SEQ ID NO: 750293 - DNA, 21 bp, Homo sapiens
gtcactggtagaccaaaataa

SEQ ID NO: 750294 - DNA, 18 bp, Homo sapiens
gtcactggtcagggcagt

SEQ ID NO: 750295 - DNA, 21 bp, Homo sapiens
gtcactggtcagggcagtggc

SEQ ID NO: 750296 - DNA, 14 bp, Homo sapiens
gtcactgtcactgc

SEQ ID NO: 750297 - DNA, 12 bp, Homo sapiens
ctgtccacatcc

SEQ ID NO: 750298 - DNA, 17 bp, Homo sapiens
ctgtccacatccccaga

SEQ ID NO: 750299 - DNA, 18 bp, Homo sapiens
ctgtccacatccccagag

SEQ ID NO: 750300 - DNA, 18 bp, Homo sapiens
ctgtccaccagacccacc

SEQ ID NO: 750301 - DNA, 16 bp, Homo sapiens
ctgtccaccagtttat

SEQ ID NO: 750302 - DNA, 19 bp, Homo sapiens
ctgtccaccagtttataca

SEQ ID NO: 750303 - DNA, 22 bp, Homo sapiens
ctgtccaccagtttatacagaa

SEQ ID NO: 750304 - DNA, 13 bp, Homo sapiens
ctgtccaccctgc

SEQ ID NO: 750305 - DNA, 14 bp, Homo sapiens
ctgtccaccctgcc

SEQ ID NO: 750306 - DNA, 23 bp, Homo sapiens
ctgtccaccctgccaagactcct

SEQ ID NO: 750307 - DNA, 15 bp, Homo sapiens
ctgtccacctcggcc

SEQ ID NO: 750308 - DNA, 15 bp, Homo sapiens
ctgtccacctgtgct

SEQ ID NO: 750309 - DNA, 17 bp, Homo sapiens
ctgtccacctgtgctgc

SEQ ID NO: 750310 - DNA, 20 bp, Homo sapiens
ctgtccacctgtgctgctgc

SEQ ID NO: 750311 - DNA, 14 bp, Homo sapiens
ctgtccactctcgg

SEQ ID NO: 750312 - DNA, 11 bp, Homo sapiens
ctgtccagaga

SEQ ID NO: 750313 - DNA, 18 bp, Homo sapiens
ctgtccagagagagaagt

SEQ ID NO: 750314 - DNA, 18 bp, Homo sapiens
ctgtccagcccccagtgc

SEQ ID NO: 750315 - DNA, 14 bp, Homo sapiens
ctgtccagccttaa

SEQ ID NO: 750316 - DNA, 19 bp, Homo sapiens
gtcagaaccagagggcatg

SEQ ID NO: 750317 - DNA, 16 bp, Homo sapiens
gtcagaatggaatcca

SEQ ID NO: 750318 - DNA, 20 bp, Homo sapiens
gtcagaatggaatccatctg

SEQ ID NO: 750319 - DNA, 21 bp, Homo sapiens
gtcagaatggaatccatctgt

SEQ ID NO: 750320 - DNA, 15 bp, Homo sapiens
gtcagaattcttcat

SEQ ID NO: 750321 - DNA, 17 bp, Homo sapiens
gtcagacacgattgaga

SEQ ID NO: 750322 - DNA, 20 bp, Homo sapiens
gtcagacactacatgatgac

SEQ ID NO: 750323 - DNA, 18 bp, Homo sapiens
gtcagacagaacttgaat

SEQ ID NO: 750324 - DNA, 15 bp, Homo sapiens
gtcagaccctggagg

SEQ ID NO: 750325 - DNA, 16 bp, Homo sapiens
gtcagaccctggaggc

SEQ ID NO: 750326 - DNA, 16 bp, Homo sapiens
gtcagacgcctgagga

SEQ ID NO: 750327 - DNA, 18 bp, Homo sapiens
gtcagacgcctgaggaac

SEQ ID NO: 750328 - DNA, 15 bp, Homo sapiens
gtcagactgctggga

SEQ ID NO: 750329 - DNA, 20 bp, Homo sapiens
gtcagactgctgggactggc

SEQ ID NO: 750330 - DNA, 19 bp, Homo sapiens
gtcagacttccaaatcctg

SEQ ID NO: 750331 - DNA, 22 bp, Homo sapiens
gtcagactttgtgttcatttca

SEQ ID NO: 750332 - DNA, 23 bp, Homo sapiens
gtcagactttgtgttcatttcat

SEQ ID NO: 750333 - DNA, 20 bp, Homo sapiens
gtcagagagacctcatcctg

SEQ ID NO: 750334 - DNA, 12 bp, Homo sapiens
gtcagagcccag

SEQ ID NO: 750335 - DNA, 14 bp, Homo sapiens
gtcagagcccaggg

SEQ ID NO: 750336 - DNA, 17 bp, Homo sapiens
gtcagagccctggctgg

SEQ ID NO: 750337 - DNA, 13 bp, Homo sapiens
gtcagagctatgt

SEQ ID NO: 750338 - DNA, 12 bp, Homo sapiens
gtcagagctggg

SEQ ID NO: 750339 - DNA, 15 bp, Homo sapiens
gtcagagctgggagt

SEQ ID NO: 750340 - DNA, 16 bp, Homo sapiens
gtcagaggaccccagg

SEQ ID NO: 750341 - DNA, 20 bp, Homo sapiens
gtcagaggaccccagggtgg

SEQ ID NO: 750342 - DNA, 21 bp, Homo sapiens
gtcagaggaccccagggtggt

SEQ ID NO: 750343 - DNA, 14 bp, Homo sapiens
gtcagaggagaaga

SEQ ID NO: 750344 - DNA, 23 bp, Homo sapiens
gtcagaggagtgattgaaccagc

SEQ ID NO: 750345 - DNA, 16 bp, Homo sapiens
gtcagagtccagtgct

SEQ ID NO: 750346 - DNA, 22 bp, Homo sapiens
gtcagagtggcgtgagctgccc

SEQ ID NO: 750347 - DNA, 18 bp, Homo sapiens
gtcagataagtgtaaata

SEQ ID NO: 750348 - DNA, 19 bp, Homo sapiens
gtcagataagtgtaaatag

SEQ ID NO: 750349 - DNA, 17 bp, Homo sapiens
gtcagatcctgttactt

SEQ ID NO: 750350 - DNA, 14 bp, Homo sapiens
gtcagatgagaaca

SEQ ID NO: 750351 - DNA, 22 bp, Homo sapiens
gtcagatggaggttctcagagc

SEQ ID NO: 750352 - DNA, 20 bp, Homo sapiens
gtcagcaaaaagcaaaatca

SEQ ID NO: 750353 - DNA, 22 bp, Homo sapiens
gtcagcaaaaagcaaaatcatt

SEQ ID NO: 750354 - DNA, 15 bp, Homo sapiens
gtcagcaccttggcc

SEQ ID NO: 750355 - DNA, 19 bp, Homo sapiens
gtcagcaccttggcccagg

SEQ ID NO: 750356 - DNA, 20 bp, Homo sapiens
gtcagcaccttggcccagga

SEQ ID NO: 750357 - DNA, 16 bp, Homo sapiens
gtcagcagatgctgtt

SEQ ID NO: 750358 - DNA, 13 bp, Homo sapiens
gtcagcaggcagg

SEQ ID NO: 750359 - DNA, 14 bp, Homo sapiens
gtcagcaggcaggc

SEQ ID NO: 750360 - DNA, 13 bp, Homo sapiens
gtcagccacactg

SEQ ID NO: 750361 - DNA, 14 bp, Homo sapiens
gtcagccacctccc

SEQ ID NO: 750362 - DNA, 20 bp, Homo sapiens
gtcagccaggagctgtcacc

SEQ ID NO: 750363 - DNA, 15 bp, Homo sapiens
gtcagccagggccag

SEQ ID NO: 750364 - DNA, 16 bp, Homo sapiens
gtcagccagggccagg

SEQ ID NO: 750365 - DNA, 23 bp, Homo sapiens
gtcagccatcagccatggccctc

SEQ ID NO: 750366 - DNA, 19 bp, Homo sapiens
gtcagccatcgtcctggga

SEQ ID NO: 750367 - DNA, 18 bp, Homo sapiens
gtcagcccctcttccctt

SEQ ID NO: 750368 - DNA, 19 bp, Homo sapiens
gtcagcccgaatgcctgtc

SEQ ID NO: 750369 - DNA, 22 bp, Homo sapiens
gtcagccctagggtggagagcc

SEQ ID NO: 750370 - DNA, 20 bp, Homo sapiens
gtcagccctgtgtctgtcac

SEQ ID NO: 750371 - DNA, 20 bp, Homo sapiens
gtcagcccttggcttctgct

SEQ ID NO: 750372 - DNA, 16 bp, Homo sapiens
gtcagccgggccctga

SEQ ID NO: 750373 - DNA, 22 bp, Homo sapiens
gtcagccttgcatcaagggctt

SEQ ID NO: 750374 - DNA, 17 bp, Homo sapiens
gtcagcctttgttaacc

SEQ ID NO: 750375 - DNA, 20 bp, Homo sapiens
gtcagcctttgttaacctta

SEQ ID NO: 750376 - DNA, 13 bp, Homo sapiens
gtcagcgactgga

SEQ ID NO: 750377 - DNA, 16 bp, Homo sapiens
gtcagcgagaaggagt

SEQ ID NO: 750378 - DNA, 20 bp, Homo sapiens
gtcagctactctagttctgt

SEQ ID NO: 750379 - DNA, 15 bp, Homo sapiens
gtcagctctctgccc

SEQ ID NO: 750380 - DNA, 18 bp, Homo sapiens
gtcagctctctgccctgt

SEQ ID NO: 750381 - DNA, 13 bp, Homo sapiens
gtcagctgcttct

SEQ ID NO: 750382 - DNA, 16 bp, Homo sapiens
gtcagctgggagccag

SEQ ID NO: 750383 - DNA, 19 bp, Homo sapiens
gtcagctgggagccagtgt

SEQ ID NO: 750384 - DNA, 14 bp, Homo sapiens
gtcagctttcagag

SEQ ID NO: 750385 - DNA, 19 bp, Homo sapiens
gtcagctttcagagccagt

SEQ ID NO: 750386 - DNA, 21 bp, Homo sapiens
gtcagctttcagagccagtga

SEQ ID NO: 750387 - DNA, 23 bp, Homo sapiens
gtcagctttgccttccacgctgt

SEQ ID NO: 750388 - DNA, 19 bp, Homo sapiens
gtcaggaacagtggctggg

SEQ ID NO: 750389 - DNA, 23 bp, Homo sapiens
gtcaggacggctcctcagagcgc

SEQ ID NO: 750390 - DNA, 21 bp, Homo sapiens
gtcaggagttgtttctgaccc

SEQ ID NO: 750391 - DNA, 22 bp, Homo sapiens
gtcaggatgcacatttctggat

SEQ ID NO: 750392 - DNA, 14 bp, Homo sapiens
gtcaggcaattgat

SEQ ID NO: 750393 - DNA, 20 bp, Homo sapiens
gtcaggcagccagtgagatg

SEQ ID NO: 750394 - DNA, 13 bp, Homo sapiens
gtcaggcaggttt

SEQ ID NO: 750395 - DNA, 13 bp, Homo sapiens
gtcaggccaggtg

SEQ ID NO: 750396 - DNA, 16 bp, Homo sapiens
gtcaggccaggtgggc

SEQ ID NO: 750397 - DNA, 18 bp, Homo sapiens
gtcaggcccgtcggagct

SEQ ID NO: 750398 - DNA, 20 bp, Homo sapiens
gtcaggcccgtcggagctgc

SEQ ID NO: 750399 - DNA, 14 bp, Homo sapiens
gtcaggccctctgc

SEQ ID NO: 750400 - DNA, 20 bp, Homo sapiens
gtcaggccctctgcctgcac

SEQ ID NO: 750401 - DNA, 21 bp, Homo sapiens
gtcaggcccttattttcaaga

SEQ ID NO: 750402 - DNA, 23 bp, Homo sapiens
gtcaggcctgtgtgtgaaaggaa

SEQ ID NO: 750403 - DNA, 15 bp, Homo sapiens
gtcaggctgggacag

SEQ ID NO: 750404 - DNA, 16 bp, Homo sapiens
gtcagggaccaaggac

SEQ ID NO: 750405 - DNA, 13 bp, Homo sapiens
gtcagggagaggt

SEQ ID NO: 750406 - DNA, 15 bp, Homo sapiens
gtcagggagggccag

SEQ ID NO: 750407 - DNA, 22 bp, Homo sapiens
gtcagggagggccagggaggca

SEQ ID NO: 750408 - DNA, 13 bp, Homo sapiens
gtcagggagtgct

SEQ ID NO: 750409 - DNA, 19 bp, Homo sapiens
gtcagggagtgctggctca

SEQ ID NO: 750410 - DNA, 22 bp, Homo sapiens
gtcagggatgagttgaggtgat

SEQ ID NO: 750411 - DNA, 19 bp, Homo sapiens
gtcagggcacagctgccct

SEQ ID NO: 750412 - DNA, 20 bp, Homo sapiens
gtcagggcacagctgccctg

SEQ ID NO: 750413 - DNA, 20 bp, Homo sapiens
gtcagggccagactggaaga

SEQ ID NO: 750414 - DNA, 21 bp, Homo sapiens
gtcagggcccaagtccctgtt

SEQ ID NO: 750415 - DNA, 13 bp, Homo sapiens
gtcagggctcaga

SEQ ID NO: 750416 - DNA, 19 bp, Homo sapiens
gtcaggggagaagctgaag

SEQ ID NO: 750417 - DNA, 15 bp, Homo sapiens
gtcaggggctctgtg

SEQ ID NO: 750418 - DNA, 19 bp, Homo sapiens
ctgtcctcaaataagtctt

SEQ ID NO: 750419 - DNA, 14 bp, Homo sapiens
ctgtcctcaccctg

SEQ ID NO: 750420 - DNA, 18 bp, Homo sapiens
ctgtcctcaccctgtggg

SEQ ID NO: 750421 - DNA, 21 bp, Homo sapiens
ctgtcctcaccctgtgggacc

SEQ ID NO: 750422 - DNA, 15 bp, Homo sapiens
ctgtcctcaccgtct

SEQ ID NO: 750423 - DNA, 15 bp, Homo sapiens
ctgtcctcagagcag

SEQ ID NO: 750424 - DNA, 16 bp, Homo sapiens
ctgtcctcaggtggcc

SEQ ID NO: 750425 - DNA, 15 bp, Homo sapiens
ctgtcctccaacacc

SEQ ID NO: 750426 - DNA, 13 bp, Homo sapiens
ctgtcctcccaca

SEQ ID NO: 750427 - DNA, 15 bp, Homo sapiens
ctgtcctcccacaga

SEQ ID NO: 750428 - DNA, 19 bp, Homo sapiens
ctgtcctcccacagacctg

SEQ ID NO: 750429 - DNA, 23 bp, Homo sapiens
ctgtcctcccacagacctgcagt

SEQ ID NO: 750430 - DNA, 14 bp, Homo sapiens
ctgtcctcccatcc

SEQ ID NO: 750431 - DNA, 16 bp, Homo sapiens
ctgtcctcccatcccc

SEQ ID NO: 750432 - DNA, 23 bp, Homo sapiens
ctgtcctcctcggatcaccgaga

SEQ ID NO: 750433 - DNA, 11 bp, Homo sapiens
ctgtcctcctt

SEQ ID NO: 750434 - DNA, 13 bp, Homo sapiens
ctgtcctccttcc

SEQ ID NO: 750435 - DNA, 15 bp, Homo sapiens
ctgtcctccttcctg

SEQ ID NO: 750436 - DNA, 19 bp, Homo sapiens
ctgtcctccttcctgggac

SEQ ID NO: 750437 - DNA, 21 bp, Homo sapiens
ctgtcctccttcctgggaccc

SEQ ID NO: 750438 - DNA, 14 bp, Homo sapiens
ctgtcctccttggc

SEQ ID NO: 750439 - DNA, 15 bp, Homo sapiens
ctgtcctctccccct

SEQ ID NO: 750440 - DNA, 19 bp, Homo sapiens
ctgtcctctcccccttcag

SEQ ID NO: 750441 - DNA, 17 bp, Homo sapiens
ctgtcctctcgagccca

SEQ ID NO: 750442 - DNA, 19 bp, Homo sapiens
ctgtcctctcgagcccaga

SEQ ID NO: 750443 - DNA, 20 bp, Homo sapiens
gtcagttcccggagcacagc

SEQ ID NO: 750444 - DNA, 21 bp, Homo sapiens
gtcagttcccggagcacagcc

SEQ ID NO: 750445 - DNA, 22 bp, Homo sapiens
gtcagttcttggtgctctgtgt

SEQ ID NO: 750446 - DNA, 13 bp, Homo sapiens
gtcagttgtaata

SEQ ID NO: 750447 - DNA, 18 bp, Homo sapiens
gtcagtttcactccctct

SEQ ID NO: 750448 - DNA, 16 bp, Homo sapiens
gtcataaatactgtca

SEQ ID NO: 750449 - DNA, 14 bp, Homo sapiens
gtcataaattacac

SEQ ID NO: 750450 - DNA, 15 bp, Homo sapiens
gtcataataaagttg

SEQ ID NO: 750451 - DNA, 19 bp, Homo sapiens
gtcatacaaatttataaag

SEQ ID NO: 750452 - DNA, 16 bp, Homo sapiens
gtcataccaatgaaaa

SEQ ID NO: 750453 - DNA, 20 bp, Homo sapiens
gtcatatcactaaataaaca

SEQ ID NO: 750454 - DNA, 22 bp, Homo sapiens
gtcatcaatgttcagttcaaaa

SEQ ID NO: 750455 - DNA, 16 bp, Homo sapiens
gtcatcactccctgga

SEQ ID NO: 750456 - DNA, 18 bp, Homo sapiens
gtcatcactccctggatg

SEQ ID NO: 750457 - DNA, 15 bp, Homo sapiens
gtcatcacttttcag

SEQ ID NO: 750458 - DNA, 19 bp, Homo sapiens
gtcatcagaggggagcagc

SEQ ID NO: 750459 - DNA, 23 bp, Homo sapiens
gtcatcagaggggagcagcggct

SEQ ID NO: 750460 - DNA, 14 bp, Homo sapiens
gtcatcatcagggc

SEQ ID NO: 750461 - DNA, 21 bp, Homo sapiens
gtcatccaacaagaagaaata

SEQ ID NO: 750462 - DNA, 17 bp, Homo sapiens
gtcatccatgccctccc

SEQ ID NO: 750463 - DNA, 22 bp, Homo sapiens
gtcatccatgccctcccaggac

SEQ ID NO: 750464 - DNA, 20 bp, Homo sapiens
gtcatcccctctcaggagag

SEQ ID NO: 750465 - DNA, 13 bp, Homo sapiens
gtcatcctccctt

SEQ ID NO: 750466 - DNA, 22 bp, Homo sapiens
gtcatcctcccttgccccaggc

SEQ ID NO: 750467 - DNA, 18 bp, Homo sapiens
gtcatcctgccctgcagc

SEQ ID NO: 750468 - DNA, 21 bp, Homo sapiens
gtcatcctgccctgcagcacg

SEQ ID NO: 750469 - DNA, 18 bp, Homo sapiens
gtcatccttggtgctctt

SEQ ID NO: 750470 - DNA, 19 bp, Homo sapiens
gtcatcggaggctgggccc

SEQ ID NO: 750471 - DNA, 23 bp, Homo sapiens
gtcatctagcgcaattgaaggat

SEQ ID NO: 750472 - DNA, 18 bp, Homo sapiens
gtcatctcattccactgt

SEQ ID NO: 750473 - DNA, 23 bp, Homo sapiens
gtcatctctctggggccctgggc

SEQ ID NO: 750474 - DNA, 14 bp, Homo sapiens
gtcatctgtaagag

SEQ ID NO: 750475 - DNA, 13 bp, Homo sapiens
gtcatctgtttaa

SEQ ID NO: 750476 - DNA, 22 bp, Homo sapiens
gtcatcttgctaccagtattta

SEQ ID NO: 750477 - DNA, 18 bp, Homo sapiens
gtcatcttgtgagtggat

SEQ ID NO: 750478 - DNA, 20 bp, Homo sapiens
gtcatgaaactgtacatact

SEQ ID NO: 750479 - DNA, 20 bp, Homo sapiens
gtcatgaattcttatgctta

SEQ ID NO: 750480 - DNA, 10 bp, Homo sapiens
gtcatgacag

SEQ ID NO: 750481 - DNA, 17 bp, Homo sapiens
gtcatgacagtgcttgc

SEQ ID NO: 750482 - DNA, 16 bp, Homo sapiens
gtcatgatctccctgc

SEQ ID NO: 750483 - DNA, 17 bp, Homo sapiens
gtcatgatctccctgcc

SEQ ID NO: 750484 - DNA, 20 bp, Homo sapiens
gtcatgatctccctgccgcc

SEQ ID NO: 750485 - DNA, 22 bp, Homo sapiens
gtcatgatctccctgccgcctc

SEQ ID NO: 750486 - DNA, 24 bp, Homo sapiens
gtcatgcacagtatttgtaattaa

SEQ ID NO: 750487 - DNA, 17 bp, Homo sapiens
gtcatgccctcctctcc

SEQ ID NO: 750488 - DNA, 18 bp, Homo sapiens
gtcatgccctcctctccc

SEQ ID NO: 750489 - DNA, 13 bp, Homo sapiens
gtcatgcttttgc

SEQ ID NO: 750490 - DNA, 21 bp, Homo sapiens
gtcatggagaatctgctgcat

SEQ ID NO: 750491 - DNA, 15 bp, Homo sapiens
gtcatggcttaatgt

SEQ ID NO: 750492 - DNA, 15 bp, Homo sapiens
gtcatgggaacgcag

SEQ ID NO: 750493 - DNA, 14 bp, Homo sapiens
gtcatggtactacc

SEQ ID NO: 750494 - DNA, 16 bp, Homo sapiens
gtcatggtagattttt

SEQ ID NO: 750495 - DNA, 16 bp, Homo sapiens
gtcatgtaccatcaat

SEQ ID NO: 750496 - DNA, 17 bp, Homo sapiens
gtcatgtaccatcaata

SEQ ID NO: 750497 - DNA, 13 bp, Homo sapiens
gtcatgtatgttt

SEQ ID NO: 750498 - DNA, 14 bp, Homo sapiens
gtcatgtctctaaa

SEQ ID NO: 750499 - DNA, 12 bp, Homo sapiens
gtcatgtctgta

SEQ ID NO: 750500 - DNA, 11 bp, Homo sapiens
gtcatgtgacc

SEQ ID NO: 750501 - DNA, 22 bp, Homo sapiens
gtcatgtgcatctggtgtagga

SEQ ID NO: 750502 - DNA, 18 bp, Homo sapiens
gtcatgtgggtcttccag

SEQ ID NO: 750503 - DNA, 20 bp, Homo sapiens
gtcatgtgggtcttccaggg

SEQ ID NO: 750504 - DNA, 14 bp, Homo sapiens
gtcatgtgtgcatg

SEQ ID NO: 750505 - DNA, 16 bp, Homo sapiens
gtcatgtgtgcatgtg

SEQ ID NO: 750506 - DNA, 17 bp, Homo sapiens
gtcatgtgtgcatgtga

SEQ ID NO: 750507 - DNA, 13 bp, Homo sapiens
gtcatgtttatct

SEQ ID NO: 750508 - DNA, 15 bp, Homo sapiens
gtcatgtttgcaggg

SEQ ID NO: 750509 - DNA, 11 bp, Homo sapiens
gtcattaaatg

SEQ ID NO: 750510 - DNA, 19 bp, Homo sapiens
gtcattatccttgctatga

SEQ ID NO: 750511 - DNA, 21 bp, Homo sapiens
gtcattatgggttaggcatta

SEQ ID NO: 750512 - DNA, 18 bp, Homo sapiens
gtcattcaagcctgtgaa

SEQ ID NO: 750513 - DNA, 12 bp, Homo sapiens
gtcattcatatt

SEQ ID NO: 750514 - DNA, 18 bp, Homo sapiens
gtcattctaggatgtgga

SEQ ID NO: 750515 - DNA, 19 bp, Homo sapiens
gtcattctaggatgtggag

SEQ ID NO: 750516 - DNA, 12 bp, Homo sapiens
gtcattctgcct

SEQ ID NO: 750517 - DNA, 13 bp, Homo sapiens
gtcattctgcctg

SEQ ID NO: 750518 - DNA, 16 bp, Homo sapiens
gtcattctgcctgctc

SEQ ID NO: 750519 - DNA, 18 bp, Homo sapiens
gtcattctgcctgctcca

SEQ ID NO: 750520 - DNA, 15 bp, Homo sapiens
gtcattctttattct

SEQ ID NO: 750521 - DNA, 17 bp, Homo sapiens
gtcattctttattcttt

SEQ ID NO: 750522 - DNA, 14 bp, Homo sapiens
gtcattgagcctgg

SEQ ID NO: 750523 - DNA, 18 bp, Homo sapiens
gtcattgcacctatctca

SEQ ID NO: 750524 - DNA, 18 bp, Homo sapiens
gtcattgcagtttaagag

SEQ ID NO: 750525 - DNA, 12 bp, Homo sapiens
gtcattgtcata

SEQ ID NO: 750526 - DNA, 16 bp, Homo sapiens
gtcattgtccagctgg

SEQ ID NO: 750527 - DNA, 14 bp, Homo sapiens
gtcatttataaaac

SEQ ID NO: 750528 - DNA, 12 bp, Homo sapiens
gtcatttcaggc

SEQ ID NO: 750529 - DNA, 12 bp, Homo sapiens
gtcatttcattc

SEQ ID NO: 750530 - DNA, 15 bp, Homo sapiens
gtcatttcattccat

SEQ ID NO: 750531 - DNA, 16 bp, Homo sapiens
gtcatttcattccatt

SEQ ID NO: 750532 - DNA, 12 bp, Homo sapiens
gtcatttccaga

SEQ ID NO: 750533 - DNA, 23 bp, Homo sapiens
gtcatttccgtccccccccaggc

SEQ ID NO: 750534 - DNA, 22 bp, Homo sapiens
gtcatttgactgtctcactttt

SEQ ID NO: 750535 - DNA, 17 bp, Homo sapiens
gtcatttgagtctctta

SEQ ID NO: 750536 - DNA, 22 bp, Homo sapiens
gtcatttgctgagcatgtactg

SEQ ID NO: 750537 - DNA, 15 bp, Homo sapiens
gtcattttgtaatat

SEQ ID NO: 750538 - DNA, 16 bp, Homo sapiens
gtcatttttaatgtat

SEQ ID NO: 750539 - DNA, 19 bp, Homo sapiens
gtcatttttaatgtatcta

SEQ ID NO: 750540 - DNA, 23 bp, Homo sapiens
gtcatttttaatgtatctatttg

SEQ ID NO: 750541 - DNA, 23 bp, Homo sapiens
gtccatttttacaagttatagta

SEQ ID NO: 750542 - DNA, 23 bp, Homo sapiens
gtcccaaaatcccctcagcctct

SEQ ID NO: 750543 - DNA, 13 bp, Homo sapiens
gtcccaagcagcc

SEQ ID NO: 750544 - DNA, 15 bp, Homo sapiens
gtcccaattaaaata

SEQ ID NO: 750545 - DNA, 13 bp, Homo sapiens
gtcccacactgtg

SEQ ID NO: 750546 - DNA, 17 bp, Homo sapiens
gtcccaccaactctgca

SEQ ID NO: 750547 - DNA, 19 bp, Homo sapiens
gtcccaccaactctgcact

SEQ ID NO: 750548 - DNA, 21 bp, Homo sapiens
gtcccaccaactctgcactcc

SEQ ID NO: 750549 - DNA, 17 bp, Homo sapiens
gtcccacccacacagct

SEQ ID NO: 750550 - DNA, 22 bp, Homo sapiens
gtcccacccacacagctgccct

SEQ ID NO: 750551 - DNA, 23 bp, Homo sapiens
gtcccacccacacagctgcccta

SEQ ID NO: 750552 - DNA, 13 bp, Homo sapiens
gtcccacccaccc

SEQ ID NO: 750553 - DNA, 14 bp, Homo sapiens
gtcccacccccacc

SEQ ID NO: 750554 - DNA, 15 bp, Homo sapiens
gtcccacccccaccc

SEQ ID NO: 750555 - DNA, 14 bp, Homo sapiens
gtcccacctcttct

SEQ ID NO: 750556 - DNA, 22 bp, Homo sapiens
gtcccacctcttctcttcctgt

SEQ ID NO: 750557 - DNA, 23 bp, Homo sapiens
gtcccacctcttctcttcctgta

SEQ ID NO: 750558 - DNA, 13 bp, Homo sapiens
gtcccacctggct

SEQ ID NO: 750559 - DNA, 13 bp, Homo sapiens
gtcccacgtgtct

SEQ ID NO: 750560 - DNA, 14 bp, Homo sapiens
gtcccacgtgtctt

SEQ ID NO: 750561 - DNA, 17 bp, Homo sapiens
gtcccactatctgggtg

SEQ ID NO: 750562 - DNA, 22 bp, Homo sapiens
gtcccagactaaaggatccaga

SEQ ID NO: 750563 - DNA, 18 bp, Homo sapiens
gtcccagagcacctcacc

SEQ ID NO: 750564 - DNA, 16 bp, Homo sapiens
gtcccagagcaggagg

SEQ ID NO: 750565 - DNA, 20 bp, Homo sapiens
gtcccagaggttatctgcct

SEQ ID NO: 750566 - DNA, 23 bp, Homo sapiens
gtcccagaggttatctgcctggc

SEQ ID NO: 750567 - DNA, 17 bp, Homo sapiens
gtcccagatacttgggg

SEQ ID NO: 750568 - DNA, 16 bp, Homo sapiens
gtcccagatcgtctcc

SEQ ID NO: 750569 - DNA, 16 bp, Homo sapiens
gtcccagcatccctgg

SEQ ID NO: 750570 - DNA, 20 bp, Homo sapiens
gtcccagcatccctggagca

SEQ ID NO: 750571 - DNA, 17 bp, Homo sapiens
ggtctttaataaaacaa

SEQ ID NO: 750572 - DNA, 20 bp, Homo sapiens
ggtctttcagtactttttta

SEQ ID NO: 750573 - DNA, 19 bp, Homo sapiens
ggtctttcctaaggctgca

SEQ ID NO: 750574 - DNA, 19 bp, Homo sapiens
ggtctttcctatcatggag

SEQ ID NO: 750575 - DNA, 18 bp, Homo sapiens
ggtctttctaatgtagct

SEQ ID NO: 750576 - DNA, 17 bp, Homo sapiens
ggtctttctcctcagga

SEQ ID NO: 750577 - DNA, 20 bp, Homo sapiens
ggtctttctcctcaggacaa

SEQ ID NO: 750578 - DNA, 15 bp, Homo sapiens
ggtctttgctccaga

SEQ ID NO: 750579 - DNA, 20 bp, Homo sapiens
ggtcttttaccctgtgtcag

SEQ ID NO: 750580 - DNA, 21 bp, Homo sapiens
ggtcttttaccctgtgtcaga

SEQ ID NO: 750581 - DNA, 16 bp, Homo sapiens
ggtcttttataattct

SEQ ID NO: 750582 - DNA, 16 bp, Homo sapiens
ggtcttttcatctggg

SEQ ID NO: 750583 - DNA, 17 bp, Homo sapiens
ggtctttttctcttctg

SEQ ID NO: 750584 - DNA, 18 bp, Homo sapiens
ggtctttttctcttctgt

SEQ ID NO: 750585 - DNA, 17 bp, Homo sapiens
ggtgaaacgactcaaaa

SEQ ID NO: 750586 - DNA, 22 bp, Homo sapiens
ggtgaaacgactcaaaatgaca

SEQ ID NO: 750587 - DNA, 14 bp, Homo sapiens
ggtgaaagggagct

SEQ ID NO: 750588 - DNA, 19 bp, Homo sapiens
ggtgaaataataaaatgca

SEQ ID NO: 750589 - DNA, 20 bp, Homo sapiens
ggtgaaataataaaatgcaa

SEQ ID NO: 750590 - DNA, 23 bp, Homo sapiens
ggtgaaccatgtcagcaaaaagc

SEQ ID NO: 750591 - DNA, 16 bp, Homo sapiens
ggtgaagaaaactcct

SEQ ID NO: 750592 - DNA, 22 bp, Homo sapiens
ggtgaagaggaggggaagaggc

SEQ ID NO: 750593 - DNA, 18 bp, Homo sapiens
ggtgaagaggctgcttct

SEQ ID NO: 750594 - DNA, 17 bp, Homo sapiens
ggtgaagctatttatct

SEQ ID NO: 750595 - DNA, 18 bp, Homo sapiens
ggtgaagctatttatctg

SEQ ID NO: 750596 - DNA, 21 bp, Homo sapiens
ggtgaagctcacttctgggct

SEQ ID NO: 750597 - DNA, 15 bp, Homo sapiens
ggtgaaggatccagg

SEQ ID NO: 750598 - DNA, 16 bp, Homo sapiens
ggtgaagggagagcca

SEQ ID NO: 750599 - DNA, 13 bp, Homo sapiens
ggtgaagggatgg

SEQ ID NO: 750600 - DNA, 20 bp, Homo sapiens
ggtgaagggatgggggaaga

SEQ ID NO: 750601 - DNA, 13 bp, Homo sapiens
ggtgaagtgtggc

SEQ ID NO: 750602 - DNA, 23 bp, Homo sapiens
ggtgaagttaaaacacctttcct

SEQ ID NO: 750603 - DNA, 16 bp, Homo sapiens
ggtgaatcttgtctaa

SEQ ID NO: 750604 - DNA, 19 bp, Homo sapiens
ggtgaattttcaaggcctt

SEQ ID NO: 750605 - DNA, 14 bp, Homo sapiens
ggtgacaagagcct

SEQ ID NO: 750606 - DNA, 15 bp, Homo sapiens
ggtgacacaggtcag

SEQ ID NO: 750607 - DNA, 17 bp, Homo sapiens
ggtgacacctccccctt

SEQ ID NO: 750608 - DNA, 12 bp, Homo sapiens
ggtgacagtcat

SEQ ID NO: 750609 - DNA, 14 bp, Homo sapiens
ggtgacagtcctcc

SEQ ID NO: 750610 - DNA, 13 bp, Homo sapiens
ggtgacagtgaga

SEQ ID NO: 750611 - DNA, 12 bp, Homo sapiens
ggtgacagtggc

SEQ ID NO: 750612 - DNA, 13 bp, Homo sapiens
ggtgacccacagc

SEQ ID NO: 750613 - DNA, 21 bp, Homo sapiens
ggtgacccacagctctgggcc

SEQ ID NO: 750614 - DNA, 22 bp, Homo sapiens
ggtgacccacagctctgggcct

SEQ ID NO: 750615 - DNA, 12 bp, Homo sapiens
ggtgacgcccag

SEQ ID NO: 750616 - DNA, 19 bp, Homo sapiens
ggtgacggccctcatctat

SEQ ID NO: 750617 - DNA, 23 bp, Homo sapiens
ggtgacggtcctttaggcagcct

SEQ ID NO: 750618 - DNA, 12 bp, Homo sapiens
ggtgactctgtc

SEQ ID NO: 750619 - DNA, 17 bp, Homo sapiens
ggtgactggaagttgtg

SEQ ID NO: 750620 - DNA, 12 bp, Homo sapiens
ggtgactgtccc

SEQ ID NO: 750621 - DNA, 23 bp, Homo sapiens
ggtgactgtgtaactttctctta

SEQ ID NO: 750622 - DNA, 17 bp, Homo sapiens
ggtgacttccctggtca

SEQ ID NO: 750623 - DNA, 17 bp, Homo sapiens
ggtgagaggcaggaatg

SEQ ID NO: 750624 - DNA, 16 bp, Homo sapiens
ggtgagatcacagcct

SEQ ID NO: 750625 - DNA, 16 bp, Homo sapiens
ggtgagatgcagctgg

SEQ ID NO: 750626 - DNA, 12 bp, Homo sapiens
ggtgagccagtg

SEQ ID NO: 750627 - DNA, 12 bp, Homo sapiens
ggtgagcctggg

SEQ ID NO: 750628 - DNA, 23 bp, Homo sapiens
ggtgaggaaagtgcgttctccca

SEQ ID NO: 750629 - DNA, 18 bp, Homo sapiens
ggtgaggaccactcctgt

SEQ ID NO: 750630 - DNA, 15 bp, Homo sapiens
ggtgaggaggacaag

SEQ ID NO: 750631 - DNA, 20 bp, Homo sapiens
ggtgaggcatggcaattctg

SEQ ID NO: 750632 - DNA, 13 bp, Homo sapiens
ggtgaggcccagc

SEQ ID NO: 750633 - DNA, 21 bp, Homo sapiens
ggtgaggcgttctcctgcttg

SEQ ID NO: 750634 - DNA, 13 bp, Homo sapiens
ggtgagggatgtg

SEQ ID NO: 750635 - DNA, 19 bp, Homo sapiens
ggtgaggggaggggcctcc

SEQ ID NO: 750636 - DNA, 17 bp, Homo sapiens
ggtgaggggctggcact

SEQ ID NO: 750637 - DNA, 16 bp, Homo sapiens
ggtgaggggctttctc

SEQ ID NO: 750638 - DNA, 16 bp, Homo sapiens
ggtgagggttggcgct

SEQ ID NO: 750639 - DNA, 17 bp, Homo sapiens
ggtgaggtggcccaggc

SEQ ID NO: 750640 - DNA, 18 bp, Homo sapiens
ggtgagtcccctactccc

SEQ ID NO: 750641 - DNA, 23 bp, Homo sapiens
ggtgagtcttggcggcagcagcc

SEQ ID NO: 750642 - DNA, 20 bp, Homo sapiens
ggtgagtcttggttctaaag

SEQ ID NO: 750643 - DNA, 23 bp, Homo sapiens
ggtgagtcttggttctaaaggta

SEQ ID NO: 750644 - DNA, 19 bp, Homo sapiens
ggtgagtttgagctgcctt

SEQ ID NO: 750645 - DNA, 20 bp, Homo sapiens
ggtgatatataatttcctca

SEQ ID NO: 750646 - DNA, 20 bp, Homo sapiens
ggtgatatttttatgtgcag

SEQ ID NO: 750647 - DNA, 21 bp, Homo sapiens
ggtgatatttttatgtgcagc

SEQ ID NO: 750648 - DNA, 23 bp, Homo sapiens
ggtgatcctctattttgtgatga

SEQ ID NO: 750649 - DNA, 19 bp, Homo sapiens
ggtgatctgtagacttctg

SEQ ID NO: 750650 - DNA, 20 bp, Homo sapiens
ggtgatgcttttgctgctgc

SEQ ID NO: 750651 - DNA, 20 bp, Homo sapiens
ggtgatgttgaaatatgcat

SEQ ID NO: 750652 - DNA, 19 bp, Homo sapiens
ggtgattcttacatatgat

SEQ ID NO: 750653 - DNA, 12 bp, Homo sapiens
ggtgatttcctc

SEQ ID NO: 750654 - DNA, 22 bp, Homo sapiens
ggtgatttcctctaaagaaact

SEQ ID NO: 750655 - DNA, 14 bp, Homo sapiens
ggtgcaaaaaaaaa

SEQ ID NO: 750656 - DNA, 15 bp, Homo sapiens
ggtgcaaagactctg

SEQ ID NO: 750657 - DNA, 19 bp, Homo sapiens
ggtgcaaagactctgagcc

SEQ ID NO: 750658 - DNA, 22 bp, Homo sapiens
ggtgcaaagactctgagccaag

SEQ ID NO: 750659 - DNA, 17 bp, Homo sapiens
ggtgcaaagtattgtaa

SEQ ID NO: 750660 - DNA, 16 bp, Homo sapiens
ggtgcaacccttaccc

SEQ ID NO: 750661 - DNA, 13 bp, Homo sapiens
ggtgcaaggaaaa

SEQ ID NO: 750662 - DNA, 20 bp, Homo sapiens
ggtgcaatgggggagggagg

SEQ ID NO: 750663 - DNA, 16 bp, Homo sapiens
ggtgcacacatcacca

SEQ ID NO: 750664 - DNA, 20 bp, Homo sapiens
ggtgcacacatcaccaggtg

SEQ ID NO: 750665 - DNA, 15 bp, Homo sapiens
ggtgcacagtgattt

SEQ ID NO: 750666 - DNA, 14 bp, Homo sapiens
ggtgcacccacctg

SEQ ID NO: 750667 - DNA, 19 bp, Homo sapiens
ggtgcacccactcaccagg

SEQ ID NO: 750668 - DNA, 16 bp, Homo sapiens
ggtgcacgcctgagcg

SEQ ID NO: 750669 - DNA, 23 bp, Homo sapiens
ggtgcagagggtttgtgcccagt

SEQ ID NO: 750670 - DNA, 20 bp, Homo sapiens
ggtgcagatggtactgctga

SEQ ID NO: 750671 - DNA, 21 bp, Homo sapiens
ggtgcagatggtactgctgag

SEQ ID NO: 750672 - DNA, 14 bp, Homo sapiens
ggtgcagccccagg

SEQ ID NO: 750673 - DNA, 15 bp, Homo sapiens
ggtgcagccttcccc

SEQ ID NO: 750674 - DNA, 21 bp, Homo sapiens
ggtgcagccttcccctccctg

SEQ ID NO: 750675 - DNA, 15 bp, Homo sapiens
ggtgcagctcctcag

SEQ ID NO: 750676 - DNA, 16 bp, Homo sapiens
ggtgcagctgggtggg

SEQ ID NO: 750677 - DNA, 17 bp, Homo sapiens
ggtgcagctgggtgggg

SEQ ID NO: 750678 - DNA, 12 bp, Homo sapiens
ggtgcatcctcc

SEQ ID NO: 750679 - DNA, 17 bp, Homo sapiens
ggtgcatgatcttgagc

SEQ ID NO: 750680 - DNA, 19 bp, Homo sapiens
ggtgcattctgtttcctct

SEQ ID NO: 750681 - DNA, 21 bp, Homo sapiens
ggtgcatttgagagaagccac

SEQ ID NO: 750682 - DNA, 21 bp, Homo sapiens
ggtgcatttgaggtctgttct

SEQ ID NO: 750683 - DNA, 18 bp, Homo sapiens
ggtgccaaatagccccag

SEQ ID NO: 750684 - DNA, 21 bp, Homo sapiens
ggtgccaaatagccccagact

SEQ ID NO: 750685 - DNA, 15 bp, Homo sapiens
ggtgccaactggtgt

SEQ ID NO: 750686 - DNA, 18 bp, Homo sapiens
ggtgccaagggccccagg

SEQ ID NO: 750687 - DNA, 19 bp, Homo sapiens
ggtgccaagggccccaggg

SEQ ID NO: 750688 - DNA, 21 bp, Homo sapiens
ggtgccaagggccccaggggc

SEQ ID NO: 750689 - DNA, 23 bp, Homo sapiens
ggtgccaagggccccaggggcag

SEQ ID NO: 750690 - DNA, 15 bp, Homo sapiens
ggtgccagcaactga

SEQ ID NO: 750691 - DNA, 23 bp, Homo sapiens
ggtgcccaaacaccagtcacctc

SEQ ID NO: 750692 - DNA, 17 bp, Homo sapiens
ggtgcccaagccagagg

SEQ ID NO: 750693 - DNA, 23 bp, Homo sapiens
ggtgcccaagccagaggctgggt

SEQ ID NO: 750694 - DNA, 13 bp, Homo sapiens
ggtgcccacaggc

SEQ ID NO: 750695 - DNA, 18 bp, Homo sapiens
ctggatatagctaggtga

SEQ ID NO: 750696 - DNA, 12 bp, Homo sapiens
ctggatcagtaa

SEQ ID NO: 750697 - DNA, 13 bp, Homo sapiens
ctggatcagtaaa

SEQ ID NO: 750698 - DNA, 13 bp, Homo sapiens
ctggatcagtcct

SEQ ID NO: 750699 - DNA, 17 bp, Homo sapiens
ctggatccatcaggcca

SEQ ID NO: 750700 - DNA, 19 bp, Homo sapiens
ctggatccatcaggccact

SEQ ID NO: 750701 - DNA, 22 bp, Homo sapiens
ctggatccatcttgagccacag

SEQ ID NO: 750702 - DNA, 15 bp, Homo sapiens
ctggatcctcacact

SEQ ID NO: 750703 - DNA, 23 bp, Homo sapiens
ctggatcctcacactacagatca

SEQ ID NO: 750704 - DNA, 14 bp, Homo sapiens
ctggatcctgcact

SEQ ID NO: 750705 - DNA, 10 bp, Homo sapiens
ctggatctac

SEQ ID NO: 750706 - DNA, 12 bp, Homo sapiens
ctggatctcctg

SEQ ID NO: 750707 - DNA, 23 bp, Homo sapiens
ctggatctcctgctgccttttct

SEQ ID NO: 750708 - DNA, 15 bp, Homo sapiens
ctggatctgaccctc

SEQ ID NO: 750709 - DNA, 14 bp, Homo sapiens
ctggatctggctta

SEQ ID NO: 750710 - DNA, 15 bp, Homo sapiens
ctggatctgttcctt

SEQ ID NO: 750711 - DNA, 16 bp, Homo sapiens
ctggatgatttcatct

SEQ ID NO: 750712 - DNA, 13 bp, Homo sapiens
ctggatgcccagg

SEQ ID NO: 750713 - DNA, 12 bp, Homo sapiens
ctggatgctcgc

SEQ ID NO: 750714 - DNA, 13 bp, Homo sapiens
ctggatgctcgcc

SEQ ID NO: 750715 - DNA, 14 bp, Homo sapiens
ctggatgctcgcca

SEQ ID NO: 750716 - DNA, 15 bp, Homo sapiens
ctggatggaacgggc

SEQ ID NO: 750717 - DNA, 22 bp, Homo sapiens
ctggatggaacgggcatgggcc

SEQ ID NO: 750718 - DNA, 16 bp, Homo sapiens
ctggatggacagacac

SEQ ID NO: 750719 - DNA, 23 bp, Homo sapiens
ctggatggacagacacctccccc

SEQ ID NO: 750720 - DNA, 18 bp, Homo sapiens
ctggatggcacctcaggc

SEQ ID NO: 750721 - DNA, 20 bp, Homo sapiens
ctggatgggaggagagccac

SEQ ID NO: 750722 - DNA, 15 bp, Homo sapiens
ctggatgggcattgg

SEQ ID NO: 750723 - DNA, 20 bp, Homo sapiens
ctggatgggcattgggctga

SEQ ID NO: 750724 - DNA, 15 bp, Homo sapiens
ctggatgtaccacca

SEQ ID NO: 750725 - DNA, 17 bp, Homo sapiens
ctggatgtcccctgtcc

SEQ ID NO: 750726 - DNA, 19 bp, Homo sapiens
ctggatgtcccctgtccca

SEQ ID NO: 750727 - DNA, 21 bp, Homo sapiens
ctggatgtcccctgtcccacc

SEQ ID NO: 750728 - DNA, 22 bp, Homo sapiens
ctggatgtcccctgtcccacca

SEQ ID NO: 750729 - DNA, 14 bp, Homo sapiens
ctggattaaaacaa

SEQ ID NO: 750730 - DNA, 18 bp, Homo sapiens
ctggattaggagggtgac

SEQ ID NO: 750731 - DNA, 19 bp, Homo sapiens
ctggattaggagggtgaca

SEQ ID NO: 750732 - DNA, 15 bp, Homo sapiens
ctggattcagccttc

SEQ ID NO: 750733 - DNA, 16 bp, Homo sapiens
ctggattcattgtctc

SEQ ID NO: 750734 - DNA, 13 bp, Homo sapiens
ctggattcccttt

SEQ ID NO: 750735 - DNA, 16 bp, Homo sapiens
ctggattcccttttga

SEQ ID NO: 750736 - DNA, 22 bp, Homo sapiens
ctggattcctttggaaaaccaa

SEQ ID NO: 750737 - DNA, 16 bp, Homo sapiens
ctggattctaaacaac

SEQ ID NO: 750738 - DNA, 18 bp, Homo sapiens
ctggattctgggaggcaa

SEQ ID NO: 750739 - DNA, 22 bp, Homo sapiens
ctggattgatcggagcctcctc

SEQ ID NO: 750740 - DNA, 22 bp, Homo sapiens
ctggattgggacgcacagtgca

SEQ ID NO: 750741 - DNA, 21 bp, Homo sapiens
ctggatttatagtatgtgact

SEQ ID NO: 750742 - DNA, 19 bp, Homo sapiens
ctggattttgccctctcct

SEQ ID NO: 750743 - DNA, 20 bp, Homo sapiens
ctggattttttatgtacaac

SEQ ID NO: 750744 - DNA, 22 bp, Homo sapiens
ctggcaaaatagttctgcaggt

SEQ ID NO: 750745 - DNA, 22 bp, Homo sapiens
ctggcaaacatgaaaaatcggc

SEQ ID NO: 750746 - DNA, 15 bp, Homo sapiens
ctggcaaaccctccc

SEQ ID NO: 750747 - DNA, 19 bp, Homo sapiens
ctggcaaagcttttagaaa

SEQ ID NO: 750748 - DNA, 22 bp, Homo sapiens
ctggcaaaggtggctctccagt

SEQ ID NO: 750749 - DNA, 15 bp, Homo sapiens
ctggcaacagagcga

SEQ ID NO: 750750 - DNA, 17 bp, Homo sapiens
ctggcaacatctttatc

SEQ ID NO: 750751 - DNA, 18 bp, Homo sapiens
ctggcaagaaagcttgag

SEQ ID NO: 750752 - DNA, 13 bp, Homo sapiens
ctggcaagcaggg

SEQ ID NO: 750753 - DNA, 17 bp, Homo sapiens
ctggcaaggcattcctc

SEQ ID NO: 750754 - DNA, 15 bp, Homo sapiens
ctggcaatagtgtgt

SEQ ID NO: 750755 - DNA, 20 bp, Homo sapiens
ctggcaatcccaccaaatca

SEQ ID NO: 750756 - DNA, 22 bp, Homo sapiens
ctggcaatgaaaaattctcagt

SEQ ID NO: 750757 - DNA, 15 bp, Homo sapiens
ctggcacagaaacct

SEQ ID NO: 750758 - DNA, 19 bp, Homo sapiens
ctggcacagaccaggcctt

SEQ ID NO: 750759 - DNA, 15 bp, Homo sapiens
ctggcacagggcagt

SEQ ID NO: 750760 - DNA, 16 bp, Homo sapiens
ctggcacagggcagtg

SEQ ID NO: 750761 - DNA, 21 bp, Homo sapiens
ctggcacagtgatgccgggcg

SEQ ID NO: 750762 - DNA, 14 bp, Homo sapiens
ctggcacatcagaa

SEQ ID NO: 750763 - DNA, 11 bp, Homo sapiens
ctggcaccaca

SEQ ID NO: 750764 - DNA, 14 bp, Homo sapiens
ctggcaccacacta

SEQ ID NO: 750765 - DNA, 18 bp, Homo sapiens
ctggcaccacactaggga

SEQ ID NO: 750766 - DNA, 11 bp, Homo sapiens
ctggcaccatg

SEQ ID NO: 750767 - DNA, 13 bp, Homo sapiens
ctggcacccaccg

SEQ ID NO: 750768 - DNA, 15 bp, Homo sapiens
ctggcacccaccgtc

SEQ ID NO: 750769 - DNA, 22 bp, Homo sapiens
ctggcacccaccgtctcggccc

SEQ ID NO: 750770 - DNA, 20 bp, Homo sapiens
ctggcaccctgtcatcacca

SEQ ID NO: 750771 - DNA, 12 bp, Homo sapiens
ctggcacgccct

SEQ ID NO: 750772 - DNA, 15 bp, Homo sapiens
ctggcacgccctact

SEQ ID NO: 750773 - DNA, 18 bp, Homo sapiens
ctggcacgccctactcca

SEQ ID NO: 750774 - DNA, 23 bp, Homo sapiens
ctggcacgccctactccactgcc

SEQ ID NO: 750775 - DNA, 16 bp, Homo sapiens
ctggcacgtgacaggc

SEQ ID NO: 750776 - DNA, 15 bp, Homo sapiens
ctggcactataatgt

SEQ ID NO: 750777 - DNA, 17 bp, Homo sapiens
ctggcactgagcctgct

SEQ ID NO: 750778 - DNA, 21 bp, Homo sapiens
ctggcactggatgcagaaaca

SEQ ID NO: 750779 - DNA, 21 bp, Homo sapiens
ctggcagaactgagctcctct

SEQ ID NO: 750780 - DNA, 13 bp, Homo sapiens
ctggcagacacaa

SEQ ID NO: 750781 - DNA, 22 bp, Homo sapiens
ctggcagactcaaggggctgga

SEQ ID NO: 750782 - DNA, 22 bp, Homo sapiens
ctggcagacttgcccaggtcac

SEQ ID NO: 750783 - DNA, 12 bp, Homo sapiens
ctggcagagcct

SEQ ID NO: 750784 - DNA, 11 bp, Homo sapiens
ctggcagccca

SEQ ID NO: 750785 - DNA, 16 bp, Homo sapiens
ctggcagcccagagac

SEQ ID NO: 750786 - DNA, 22 bp, Homo sapiens
ctggcagcccagagactttgta

SEQ ID NO: 750787 - DNA, 17 bp, Homo sapiens
ctggcagccgtgccttc

SEQ ID NO: 750788 - DNA, 18 bp, Homo sapiens
ctggcagccgtgccttca

SEQ ID NO: 750789 - DNA, 21 bp, Homo sapiens
ctggcagccgtgccttcagct

SEQ ID NO: 750790 - DNA, 20 bp, Homo sapiens
ctggcagcctcccatccagg

SEQ ID NO: 750791 - DNA, 18 bp, Homo sapiens
ctggcagctcctctcctt

SEQ ID NO: 750792 - DNA, 21 bp, Homo sapiens
ctggcagctcctctccttggg

SEQ ID NO: 750793 - DNA, 22 bp, Homo sapiens
ctggcagctcctctccttgggc

SEQ ID NO: 750794 - DNA, 13 bp, Homo sapiens
ctggcagctctcc

SEQ ID NO: 750795 - DNA, 15 bp, Homo sapiens
ctggcagctctccag

SEQ ID NO: 750796 - DNA, 18 bp, Homo sapiens
ctggcagctctccagtca

SEQ ID NO: 750797 - DNA, 11 bp, Homo sapiens
ctggcagctgc

SEQ ID NO: 750798 - DNA, 13 bp, Homo sapiens
ctggcagctgccc

SEQ ID NO: 750799 - DNA, 13 bp, Homo sapiens
ctggcaggacctg

SEQ ID NO: 750800 - DNA, 12 bp, Homo sapiens
ctggcaggaggg

SEQ ID NO: 750801 - DNA, 14 bp, Homo sapiens
ctggcaggagggtg

SEQ ID NO: 750802 - DNA, 20 bp, Homo sapiens
ctggcaggcttcccccttga

SEQ ID NO: 750803 - DNA, 17 bp, Homo sapiens
ctggcagggccacctgc

SEQ ID NO: 750804 - DNA, 15 bp, Homo sapiens
ctggcagggccaggg

SEQ ID NO: 750805 - DNA, 19 bp, Homo sapiens
ctggcagggccagggcaat

SEQ ID NO: 750806 - DNA, 20 bp, Homo sapiens
ctggcagggccagggcaatg

SEQ ID NO: 750807 - DNA, 18 bp, Homo sapiens
ctggcagggctcacactc

SEQ ID NO: 750808 - DNA, 19 bp, Homo sapiens
ctggcaggggagacaggag

SEQ ID NO: 750809 - DNA, 20 bp, Homo sapiens
ctggcaggggagacaggagc

SEQ ID NO: 750810 - DNA, 22 bp, Homo sapiens
ctggcaggggagacaggagcct

SEQ ID NO: 750811 - DNA, 17 bp, Homo sapiens
ctggcagggtgggatgg

SEQ ID NO: 750812 - DNA, 23 bp, Homo sapiens
ctggcaggtgcagatgggctgtt

SEQ ID NO: 750813 - DNA, 21 bp, Homo sapiens
ctggcagtggctctcagagca

SEQ ID NO: 750814 - DNA, 19 bp, Homo sapiens
ctggcagtttaaaaaaatt

SEQ ID NO: 750815 - DNA, 15 bp, Homo sapiens
ctggcagttttccat

SEQ ID NO: 750816 - DNA, 19 bp, Homo sapiens
ctggcataatttttacagt

SEQ ID NO: 750817 - DNA, 22 bp, Homo sapiens
ctggcatcaagaggtgggaggg

SEQ ID NO: 750818 - DNA, 18 bp, Homo sapiens
ctggcatcaggtctgggc

SEQ ID NO: 750819 - DNA, 16 bp, Homo sapiens
ctggcatcgcagcttc

SEQ ID NO: 750820 - DNA, 14 bp, Homo sapiens
ggtgcccacaggcc

SEQ ID NO: 750821 - DNA, 19 bp, Homo sapiens
ggtgccccctcctctccca

SEQ ID NO: 750822 - DNA, 17 bp, Homo sapiens
ggtgccctctcaggtgg

SEQ ID NO: 750823 - DNA, 19 bp, Homo sapiens
ggtgccctctgctcaggcc

SEQ ID NO: 750824 - DNA, 21 bp, Homo sapiens
ggtgcccttggtagcagcctg

SEQ ID NO: 750825 - DNA, 17 bp, Homo sapiens
ggtgccggggaggggca

SEQ ID NO: 750826 - DNA, 17 bp, Homo sapiens
ggtgcctccaggtgtgc

SEQ ID NO: 750827 - DNA, 23 bp, Homo sapiens
ggtgcctcccacacttgctgggg

SEQ ID NO: 750828 - DNA, 11 bp, Homo sapiens
ggtgcctcctg

SEQ ID NO: 750829 - DNA, 12 bp, Homo sapiens
ggtgcctctgtg

SEQ ID NO: 750830 - DNA, 13 bp, Homo sapiens
ggtgcctctgtgc

SEQ ID NO: 750831 - DNA, 14 bp, Homo sapiens
ggtgcctgaggtct

SEQ ID NO: 750832 - DNA, 17 bp, Homo sapiens
ggtgcctgctcaggtgc

SEQ ID NO: 750833 - DNA, 10 bp, Homo sapiens
ggtgcctggc

SEQ ID NO: 750834 - DNA, 18 bp, Homo sapiens
ggtgcctgggtggggctg

SEQ ID NO: 750835 - DNA, 21 bp, Homo sapiens
ggtgcctgtccttgaaaaaca

SEQ ID NO: 750836 - DNA, 17 bp, Homo sapiens
ggtgcctgtgaggcagg

SEQ ID NO: 750837 - DNA, 21 bp, Homo sapiens
ggtgcctgtgaggcaggggcg

SEQ ID NO: 750838 - DNA, 20 bp, Homo sapiens
ggtgccttacatcttttcta

SEQ ID NO: 750839 - DNA, 19 bp, Homo sapiens
ggtgcctttcaaatttaga

SEQ ID NO: 750840 - DNA, 19 bp, Homo sapiens
ggtgcggcggtcccagctc

SEQ ID NO: 750841 - DNA, 12 bp, Homo sapiens
ggtgcgtggctg

SEQ ID NO: 750842 - DNA, 13 bp, Homo sapiens
ggtgcgtggctgt

SEQ ID NO: 750843 - DNA, 17 bp, Homo sapiens
ggtgcgtggctgtggca

SEQ ID NO: 750844 - DNA, 18 bp, Homo sapiens
ggtgcgtggctgtggcac

SEQ ID NO: 750845 - DNA, 13 bp, Homo sapiens
ggtgcgtgtgtct

SEQ ID NO: 750846 - DNA, 20 bp, Homo sapiens
ggtgctaaatggtcgcccag

SEQ ID NO: 750847 - DNA, 22 bp, Homo sapiens
ggtgctaaatggtcgcccagga

SEQ ID NO: 750848 - DNA, 22 bp, Homo sapiens
ggtgctacacccttttccagct

SEQ ID NO: 750849 - DNA, 23 bp, Homo sapiens
ggtgctagtgggccctctctctg

SEQ ID NO: 750850 - DNA, 19 bp, Homo sapiens
ggtgctataggctggagaa

SEQ ID NO: 750851 - DNA, 19 bp, Homo sapiens
ggtgctatgtcccaagagc

SEQ ID NO: 750852 - DNA, 20 bp, Homo sapiens
ggtgctatgtcccaagagcc

SEQ ID NO: 750853 - DNA, 15 bp, Homo sapiens
ggtgctccctctgtc

SEQ ID NO: 750854 - DNA, 21 bp, Homo sapiens
ggtgctcggagaagagcgcag

SEQ ID NO: 750855 - DNA, 15 bp, Homo sapiens
ggtgctcgggaaggg

SEQ ID NO: 750856 - DNA, 16 bp, Homo sapiens
ggtgctctctttctgt

SEQ ID NO: 750857 - DNA, 10 bp, Homo sapiens
ggtgctctgg

SEQ ID NO: 750858 - DNA, 20 bp, Homo sapiens
ggtgctctggcggcttcctg

SEQ ID NO: 750859 - DNA, 13 bp, Homo sapiens
ggtgctctgtgtt

SEQ ID NO: 750860 - DNA, 17 bp, Homo sapiens
ggtgctgaactgtgcat

SEQ ID NO: 750861 - DNA, 16 bp, Homo sapiens
ggtgctgaatgaagct

SEQ ID NO: 750862 - DNA, 21 bp, Homo sapiens
ggtgctgacttcatctcccac

SEQ ID NO: 750863 - DNA, 23 bp, Homo sapiens
ggtgctgagtgaccgggggctgc

SEQ ID NO: 750864 - DNA, 18 bp, Homo sapiens
ggtgctgatgggaaggag

SEQ ID NO: 750865 - DNA, 14 bp, Homo sapiens
ggtgctgcaggagt

SEQ ID NO: 750866 - DNA, 23 bp, Homo sapiens
ggtgctgccatgacagaggctgc

SEQ ID NO: 750867 - DNA, 13 bp, Homo sapiens
ggtgctgctcagg

SEQ ID NO: 750868 - DNA, 21 bp, Homo sapiens
ggtgctggaagtctccatgaa

SEQ ID NO: 750869 - DNA, 12 bp, Homo sapiens
ggtgctggagga

SEQ ID NO: 750870 - DNA, 12 bp, Homo sapiens
ggtgctgggact

SEQ ID NO: 750871 - DNA, 19 bp, Homo sapiens
ggtgctgggactgagccag

SEQ ID NO: 750872 - DNA, 15 bp, Homo sapiens
ggtgctgggaggagg

SEQ ID NO: 750873 - DNA, 17 bp, Homo sapiens
ggtgctggggccagggc

SEQ ID NO: 750874 - DNA, 20 bp, Homo sapiens
ggtgctgtcctcaggtggcc

SEQ ID NO: 750875 - DNA, 14 bp, Homo sapiens
ggtgctgtgaggga

SEQ ID NO: 750876 - DNA, 17 bp, Homo sapiens
ggtgctgtttaaagtca

SEQ ID NO: 750877 - DNA, 18 bp, Homo sapiens
ggtgcttaagcagaagca

SEQ ID NO: 750878 - DNA, 20 bp, Homo sapiens
ggtgcttaagcagaagcatt

SEQ ID NO: 750879 - DNA, 15 bp, Homo sapiens
ggtgcttcagccctg

SEQ ID NO: 750880 - DNA, 18 bp, Homo sapiens
ggtgcttccaacaaggac

SEQ ID NO: 750881 - DNA, 21 bp, Homo sapiens
ggtgcttggtgagtcttggtt

SEQ ID NO: 750882 - DNA, 18 bp, Homo sapiens
ggtgctttttataaaaag

SEQ ID NO: 750883 - DNA, 16 bp, Homo sapiens
ggtggaaaacagggtg

SEQ ID NO: 750884 - DNA, 19 bp, Homo sapiens
ggtggaagaagggagaaga

SEQ ID NO: 750885 - DNA, 19 bp, Homo sapiens
ggtggaagccctccttcca

SEQ ID NO: 750886 - DNA, 16 bp, Homo sapiens
ggtggaagttgcagtg

SEQ ID NO: 750887 - DNA, 18 bp, Homo sapiens
ggtggacagtcctgggag

SEQ ID NO: 750888 - DNA, 21 bp, Homo sapiens
ggtggaccacgccgccctcca

SEQ ID NO: 750889 - DNA, 21 bp, Homo sapiens
ggtggagaaaattggaactct

SEQ ID NO: 750890 - DNA, 16 bp, Homo sapiens
ggtggagaagtgtcgt

SEQ ID NO: 750891 - DNA, 13 bp, Homo sapiens
ggtggagcagcca

SEQ ID NO: 750892 - DNA, 17 bp, Homo sapiens
ggtggagcagccagagc

SEQ ID NO: 750893 - DNA, 12 bp, Homo sapiens
ggtggagccagg

SEQ ID NO: 750894 - DNA, 17 bp, Homo sapiens
ggtggaggaaggctctg

SEQ ID NO: 750895 - DNA, 14 bp, Homo sapiens
ggtggagggcactt

SEQ ID NO: 750896 - DNA, 13 bp, Homo sapiens
ggtggagggccac

SEQ ID NO: 750897 - DNA, 20 bp, Homo sapiens
ggtggaggttgcagtgagct

SEQ ID NO: 750898 - DNA, 15 bp, Homo sapiens
ggtggagtttctctg

SEQ ID NO: 750899 - DNA, 16 bp, Homo sapiens
ggtggatcacaaggtc

SEQ ID NO: 750900 - DNA, 15 bp, Homo sapiens
ggtggatcacagagg

SEQ ID NO: 750901 - DNA, 22 bp, Homo sapiens
ggtggatcacgaggtcaggaga

SEQ ID NO: 750902 - DNA, 18 bp, Homo sapiens
ggtggatctaagaagggc

SEQ ID NO: 750903 - DNA, 17 bp, Homo sapiens
ggtggatgacagggcag

SEQ ID NO: 750904 - DNA, 23 bp, Homo sapiens
ggtggattctccctgggcctcag

SEQ ID NO: 750905 - DNA, 17 bp, Homo sapiens
ggtggcacacgcctgta

SEQ ID NO: 750906 - DNA, 16 bp, Homo sapiens
ggtggcacaggcactg

SEQ ID NO: 750907 - DNA, 14 bp, Homo sapiens
ggtggcaccagcag

SEQ ID NO: 750908 - DNA, 20 bp, Homo sapiens
ggtggcacctcctgagaagg

SEQ ID NO: 750909 - DNA, 20 bp, Homo sapiens
ggtggcactgagccccccca

SEQ ID NO: 750910 - DNA, 21 bp, Homo sapiens
ggtggcagatgtcttccctgg

SEQ ID NO: 750911 - DNA, 13 bp, Homo sapiens
ggtggcagcaaca

SEQ ID NO: 750912 - DNA, 15 bp, Homo sapiens
ggtggcagccctgta

SEQ ID NO: 750913 - DNA, 14 bp, Homo sapiens
ggtggcaggaccag

SEQ ID NO: 750914 - DNA, 14 bp, Homo sapiens
ggtggcaggtcact

SEQ ID NO: 750915 - DNA, 18 bp, Homo sapiens
ggtggcagtggaggtggg

SEQ ID NO: 750916 - DNA, 15 bp, Homo sapiens
ggtggcatacgcctg

SEQ ID NO: 750917 - DNA, 13 bp, Homo sapiens
ggtggccacagca

SEQ ID NO: 750918 - DNA, 17 bp, Homo sapiens
ggtggccacagcgccag

SEQ ID NO: 750919 - DNA, 16 bp, Homo sapiens
ggtggccacagcgtgc

SEQ ID NO: 750920 - DNA, 17 bp, Homo sapiens
ggtggccacagcgtgct

SEQ ID NO: 750921 - DNA, 20 bp, Homo sapiens
ggtggccactccagacccct

SEQ ID NO: 750922 - DNA, 22 bp, Homo sapiens
ggtggccactccagacccctgg

SEQ ID NO: 750923 - DNA, 11 bp, Homo sapiens
ggtggccaggg

SEQ ID NO: 750924 - DNA, 10 bp, Homo sapiens
ggtggccatg

SEQ ID NO: 750925 - DNA, 13 bp, Homo sapiens
ggtggcccaggcc

SEQ ID NO: 750926 - DNA, 15 bp, Homo sapiens
ggtggcccaggcccc

SEQ ID NO: 750927 - DNA, 16 bp, Homo sapiens
ggtggcccgacagcct

SEQ ID NO: 750928 - DNA, 11 bp, Homo sapiens
ggtggccctga

SEQ ID NO: 750929 - DNA, 20 bp, Homo sapiens
ggtggcccttgtttacagtg

SEQ ID NO: 750930 - DNA, 18 bp, Homo sapiens
ggtggccgctcctccctg

SEQ ID NO: 750931 - DNA, 19 bp, Homo sapiens
ggtggccgctcctccctgc

SEQ ID NO: 750932 - DNA, 22 bp, Homo sapiens
ggtggcctcaagaaaggcccgg

SEQ ID NO: 750933 - DNA, 12 bp, Homo sapiens
ggtggcctcagc

SEQ ID NO: 750934 - DNA, 12 bp, Homo sapiens
ggtggcctcggg

SEQ ID NO: 750935 - DNA, 21 bp, Homo sapiens
ggtggcgactctatagactct

SEQ ID NO: 750936 - DNA, 17 bp, Homo sapiens
ggtggcgctttctcctg

SEQ ID NO: 750937 - DNA, 17 bp, Homo sapiens
ggtggcgttatggcagc

SEQ ID NO: 750938 - DNA, 18 bp, Homo sapiens
ggtggcgttatggcagcc

SEQ ID NO: 750939 - DNA, 21 bp, Homo sapiens
ggtggctagtcaagctcctcc

SEQ ID NO: 750940 - DNA, 22 bp, Homo sapiens
ggtggctagtcaagctcctcct

SEQ ID NO: 750941 - DNA, 23 bp, Homo sapiens
ggtggctagtcaagctcctcctc

SEQ ID NO: 750942 - DNA, 15 bp, Homo sapiens
ggtggctagtcagag

SEQ ID NO: 750943 - DNA, 18 bp, Homo sapiens
ggtggctcactactgaac

SEQ ID NO: 750944 - DNA, 18 bp, Homo sapiens
ggtggctccccctctgct

SEQ ID NO: 750945 - DNA, 17 bp, Homo sapiens
ctggcatcgcagcttcc

SEQ ID NO: 750946 - DNA, 22 bp, Homo sapiens
ctggcatcgcagcttcctgtct

SEQ ID NO: 750947 - DNA, 17 bp, Homo sapiens
ctggcatctgacacaaa

SEQ ID NO: 750948 - DNA, 13 bp, Homo sapiens
ctggcatctgtgc

SEQ ID NO: 750949 - DNA, 17 bp, Homo sapiens
ctggcatggattaatag

SEQ ID NO: 750950 - DNA, 20 bp, Homo sapiens
ctggcatgttcaaagccaca

SEQ ID NO: 750951 - DNA, 16 bp, Homo sapiens
ctggcattacagctgg

SEQ ID NO: 750952 - DNA, 19 bp, Homo sapiens
ctggcattagaattattta

SEQ ID NO: 750953 - DNA, 22 bp, Homo sapiens
ctggcattagaattatttaaac

SEQ ID NO: 750954 - DNA, 18 bp, Homo sapiens
ctggcattctacacctgg

SEQ ID NO: 750955 - DNA, 20 bp, Homo sapiens
ctggcattctacacctggac

SEQ ID NO: 750956 - DNA, 21 bp, Homo sapiens
ctggcattctacacctggacc

SEQ ID NO: 750957 - DNA, 17 bp, Homo sapiens
ctggcattgtccctgtg

SEQ ID NO: 750958 - DNA, 18 bp, Homo sapiens
ctggcatttgctgatttc

SEQ ID NO: 750959 - DNA, 18 bp, Homo sapiens
ctggccaaacccttgctt

SEQ ID NO: 750960 - DNA, 19 bp, Homo sapiens
ctggccaaagagcctttcc

SEQ ID NO: 750961 - DNA, 15 bp, Homo sapiens
ctggccacatcagcc

SEQ ID NO: 750962 - DNA, 14 bp, Homo sapiens
ctggccaccagcca

SEQ ID NO: 750963 - DNA, 13 bp, Homo sapiens
ctggccaccaggc

SEQ ID NO: 750964 - DNA, 17 bp, Homo sapiens
ctggccaccaggctggc

SEQ ID NO: 750965 - DNA, 18 bp, Homo sapiens
ctggccaccaggctggcg

SEQ ID NO: 750966 - DNA, 19 bp, Homo sapiens
ctggccaccaggctggcgc

SEQ ID NO: 750967 - DNA, 20 bp, Homo sapiens
ctggccaccaggctggcgca

SEQ ID NO: 750968 - DNA, 22 bp, Homo sapiens
ctggccaccaggctggcgcagc

SEQ ID NO: 750969 - DNA, 23 bp, Homo sapiens
ctggccaccaggctggcgcagcc

SEQ ID NO: 750970 - DNA, 10 bp, Homo sapiens
ctggccaccc

SEQ ID NO: 750971 - DNA, 14 bp, Homo sapiens
ctggccacccctcc

SEQ ID NO: 750972 - DNA, 14 bp, Homo sapiens
ctggccacccttgg

SEQ ID NO: 750973 - DNA, 22 bp, Homo sapiens
ctggccacccttggcctgtcca

SEQ ID NO: 750974 - DNA, 20 bp, Homo sapiens
ctggccacctgaggtgggcc

SEQ ID NO: 750975 - DNA, 20 bp, Homo sapiens
ctggccactaaagcttcaga

SEQ ID NO: 750976 - DNA, 22 bp, Homo sapiens
ctggccactaaagcttcagact

SEQ ID NO: 750977 - DNA, 12 bp, Homo sapiens
ctggccactgtc

SEQ ID NO: 750978 - DNA, 17 bp, Homo sapiens
ctggccactgtccctgt

SEQ ID NO: 750979 - DNA, 16 bp, Homo sapiens
ctggccagacgctgcc

SEQ ID NO: 750980 - DNA, 11 bp, Homo sapiens
ctggccagaga

SEQ ID NO: 750981 - DNA, 15 bp, Homo sapiens
ctggccagagagggc

SEQ ID NO: 750982 - DNA, 19 bp, Homo sapiens
ctggccagagagggcccag

SEQ ID NO: 750983 - DNA, 13 bp, Homo sapiens
ctggccagcaccc

SEQ ID NO: 750984 - DNA, 14 bp, Homo sapiens
ctggccagcaccct

SEQ ID NO: 750985 - DNA, 22 bp, Homo sapiens
ctggccagcaccctctcctggg

SEQ ID NO: 750986 - DNA, 23 bp, Homo sapiens
ctggccagcaccctctcctgggg

SEQ ID NO: 750987 - DNA, 16 bp, Homo sapiens
ctggccagctctgagg

SEQ ID NO: 750988 - DNA, 22 bp, Homo sapiens
ctggccagctctgaggggaggc

SEQ ID NO: 750989 - DNA, 23 bp, Homo sapiens
ctggccagctctgaggggaggca

SEQ ID NO: 750990 - DNA, 12 bp, Homo sapiens
ctggccaggagc

SEQ ID NO: 750991 - DNA, 13 bp, Homo sapiens
ctggccaggagct

SEQ ID NO: 750992 - DNA, 17 bp, Homo sapiens
ctggccaggagctcttc

SEQ ID NO: 750993 - DNA, 20 bp, Homo sapiens
ctggccaggagctcttcagg

SEQ ID NO: 750994 - DNA, 22 bp, Homo sapiens
ctggccaggagctcttcaggcc

SEQ ID NO: 750995 - DNA, 17 bp, Homo sapiens
ctggccaggcactgcct

SEQ ID NO: 750996 - DNA, 17 bp, Homo sapiens
ctggccagggccacgct

SEQ ID NO: 750997 - DNA, 22 bp, Homo sapiens
ctggccagggccacgctccagc

SEQ ID NO: 750998 - DNA, 23 bp, Homo sapiens
ctggccagggccacgctccagct

SEQ ID NO: 750999 - DNA, 23 bp, Homo sapiens
ctggccagtcctggtcctggctg

SEQ ID NO: 751000 - DNA, 23 bp, Homo sapiens
ctggccatctcaacgcctctcct

SEQ ID NO: 751001 - DNA, 21 bp, Homo sapiens
ctggccatctccctccccaga

SEQ ID NO: 751002 - DNA, 23 bp, Homo sapiens
ctggccatgaatctctgcctctc

SEQ ID NO: 751003 - DNA, 17 bp, Homo sapiens
ctggccatgctgtccct

SEQ ID NO: 751004 - DNA, 19 bp, Homo sapiens
ctggccatttggccccagg

SEQ ID NO: 751005 - DNA, 22 bp, Homo sapiens
ctggccatttggccccagggga

SEQ ID NO: 751006 - DNA, 13 bp, Homo sapiens
ctggcccaaagca

SEQ ID NO: 751007 - DNA, 13 bp, Homo sapiens
ctggcccaccagg

SEQ ID NO: 751008 - DNA, 19 bp, Homo sapiens
ctggcccaccccccagcct

SEQ ID NO: 751009 - DNA, 23 bp, Homo sapiens
ctggcccaccccccagcctccag

SEQ ID NO: 751010 - DNA, 22 bp, Homo sapiens
ctggcccacgtagggggctctg

SEQ ID NO: 751011 - DNA, 12 bp, Homo sapiens
ctggcccactgc

SEQ ID NO: 751012 - DNA, 20 bp, Homo sapiens
ctggcccagccaactgcccc

SEQ ID NO: 751013 - DNA, 12 bp, Homo sapiens
ctggcccagccg

SEQ ID NO: 751014 - DNA, 13 bp, Homo sapiens
ctggcccagccgg

SEQ ID NO: 751015 - DNA, 14 bp, Homo sapiens
ctggcccagccggc

SEQ ID NO: 751016 - DNA, 18 bp, Homo sapiens
ctggcccagccggcctct

SEQ ID NO: 751017 - DNA, 13 bp, Homo sapiens
ctggcccagcggc

SEQ ID NO: 751018 - DNA, 14 bp, Homo sapiens
ctggcccagcggcc

SEQ ID NO: 751019 - DNA, 12 bp, Homo sapiens
ctggcccaggcc

SEQ ID NO: 751020 - DNA, 20 bp, Homo sapiens
ctggcccatctcagcctcct

SEQ ID NO: 751021 - DNA, 16 bp, Homo sapiens
ctggcccattcttgag

SEQ ID NO: 751022 - DNA, 18 bp, Homo sapiens
ctggccccagcctgggcc

SEQ ID NO: 751023 - DNA, 21 bp, Homo sapiens
ctggccccaggacctggctgc

SEQ ID NO: 751024 - DNA, 21 bp, Homo sapiens
ctggccccagtgcggttcctc

SEQ ID NO: 751025 - DNA, 17 bp, Homo sapiens
ctggccccatggtcagc

SEQ ID NO: 751026 - DNA, 19 bp, Homo sapiens
ctggccccatgtctctcag

SEQ ID NO: 751027 - DNA, 17 bp, Homo sapiens
ctggcccccaacctcag

SEQ ID NO: 751028 - DNA, 22 bp, Homo sapiens
ctggcccccaacctcagggctc

SEQ ID NO: 751029 - DNA, 23 bp, Homo sapiens
ctggcccccaacctcagggctcc

SEQ ID NO: 751030 - DNA, 17 bp, Homo sapiens
ctggcccccagccctgg

SEQ ID NO: 751031 - DNA, 14 bp, Homo sapiens
ctggccccctcatt

SEQ ID NO: 751032 - DNA, 22 bp, Homo sapiens
ctggccccgccgcctggtactc

SEQ ID NO: 751033 - DNA, 23 bp, Homo sapiens
ctggccccgccgcctggtactca

SEQ ID NO: 751034 - DNA, 14 bp, Homo sapiens
ctggccccgcctgc

SEQ ID NO: 751035 - DNA, 18 bp, Homo sapiens
ctggccccgcttggtggc

SEQ ID NO: 751036 - DNA, 18 bp, Homo sapiens
ctggccccggatcagagc

SEQ ID NO: 751037 - DNA, 24 bp, Homo sapiens
ctggccccggatcagagcaggacc

SEQ ID NO: 751038 - DNA, 23 bp, Homo sapiens
ctggccccgggctctggccaccc

SEQ ID NO: 751039 - DNA, 13 bp, Homo sapiens
ctggcccctcacc

SEQ ID NO: 751040 - DNA, 22 bp, Homo sapiens
ctggcccctcacctgggcacct

SEQ ID NO: 751041 - DNA, 21 bp, Homo sapiens
ctggcccctccagaccctgcc

SEQ ID NO: 751042 - DNA, 22 bp, Homo sapiens
ctggcccctccagaccctgcct

SEQ ID NO: 751043 - DNA, 24 bp, Homo sapiens
ctggcccctcgcctgtggagctca

SEQ ID NO: 751044 - DNA, 17 bp, Homo sapiens
ctggcccctggcctgcc

SEQ ID NO: 751045 - DNA, 19 bp, Homo sapiens
ctggcccctgtggggaaca

SEQ ID NO: 751046 - DNA, 18 bp, Homo sapiens
ctggcccgccctcacctc

SEQ ID NO: 751047 - DNA, 22 bp, Homo sapiens
ctggcccgccctcacctctgat

SEQ ID NO: 751048 - DNA, 18 bp, Homo sapiens
ctggcccgtcatgttcct

SEQ ID NO: 751049 - DNA, 22 bp, Homo sapiens
ctggcccgtcatgttcctcaaa

SEQ ID NO: 751050 - DNA, 15 bp, Homo sapiens
ctggcccgtgacaga

SEQ ID NO: 751051 - DNA, 23 bp, Homo sapiens
ctggcccgtgacagactcctgag

SEQ ID NO: 751052 - DNA, 22 bp, Homo sapiens
ctggccctccccacaatgccag

SEQ ID NO: 751053 - DNA, 19 bp, Homo sapiens
ctggccctccctccctagc

SEQ ID NO: 751054 - DNA, 13 bp, Homo sapiens
ctggccctcctgg

SEQ ID NO: 751055 - DNA, 17 bp, Homo sapiens
ctggccctcctggctgt

SEQ ID NO: 751056 - DNA, 19 bp, Homo sapiens
ctggccctcgacactcacc

SEQ ID NO: 751057 - DNA, 11 bp, Homo sapiens
ctggccctgac

SEQ ID NO: 751058 - DNA, 14 bp, Homo sapiens
ctggccctgaggtg

SEQ ID NO: 751059 - DNA, 17 bp, Homo sapiens
ctggccctgaggtgtgg

SEQ ID NO: 751060 - DNA, 13 bp, Homo sapiens
ctggccctggggg

SEQ ID NO: 751061 - DNA, 14 bp, Homo sapiens
ctggccctgtgcag

SEQ ID NO: 751062 - DNA, 15 bp, Homo sapiens
ctggccctgtgcaga

SEQ ID NO: 751063 - DNA, 15 bp, Homo sapiens
ctggccctgttctcc

SEQ ID NO: 751064 - DNA, 19 bp, Homo sapiens
ctggcccttggaataaagt

SEQ ID NO: 751065 - DNA, 19 bp, Homo sapiens
ctggccgagggtcctggct

SEQ ID NO: 751066 - DNA, 16 bp, Homo sapiens
ctggccgagtccaagc

SEQ ID NO: 751067 - DNA, 18 bp, Homo sapiens
ctggccgagtccaagctg

SEQ ID NO: 751068 - DNA, 13 bp, Homo sapiens
ggtggctcctcct

SEQ ID NO: 751069 - DNA, 15 bp, Homo sapiens
ggtggctgacccagt

SEQ ID NO: 751070 - DNA, 16 bp, Homo sapiens
ggtggctgccccggcc

SEQ ID NO: 751071 - DNA, 22 bp, Homo sapiens
ggtggctgcctttgatcacagg

SEQ ID NO: 751072 - DNA, 23 bp, Homo sapiens
ggtggctgcctttgatcacagga

SEQ ID NO: 751073 - DNA, 18 bp, Homo sapiens
ggtggctttcaaggctgg

SEQ ID NO: 751074 - DNA, 22 bp, Homo sapiens
ggtggctttcaaggctggggca

SEQ ID NO: 751075 - DNA, 15 bp, Homo sapiens
ggtgggaaggggagc

SEQ ID NO: 751076 - DNA, 13 bp, Homo sapiens
ggtgggacaggga

SEQ ID NO: 751077 - DNA, 22 bp, Homo sapiens
ggtgggaccctgtccggcccag

SEQ ID NO: 751078 - DNA, 16 bp, Homo sapiens
ggtgggaggaaagggc

SEQ ID NO: 751079 - DNA, 20 bp, Homo sapiens
ggtgggaggattgcttgagc

SEQ ID NO: 751080 - DNA, 18 bp, Homo sapiens
ggtgggaggtaggctgtg

SEQ ID NO: 751081 - DNA, 17 bp, Homo sapiens
ggtgggagtgtgtctgc

SEQ ID NO: 751082 - DNA, 18 bp, Homo sapiens
ggtgggatccagaatgga

SEQ ID NO: 751083 - DNA, 18 bp, Homo sapiens
ggtgggcacccaccctgg

SEQ ID NO: 751084 - DNA, 20 bp, Homo sapiens
ggtgggcagatcatgggtca

SEQ ID NO: 751085 - DNA, 23 bp, Homo sapiens
ggtgggcagcagcatcccagcct

SEQ ID NO: 751086 - DNA, 12 bp, Homo sapiens
ggtgggcagctg

SEQ ID NO: 751087 - DNA, 13 bp, Homo sapiens
ggtgggcagctgg

SEQ ID NO: 751088 - DNA, 18 bp, Homo sapiens
ggtgggcagctgggcccc

SEQ ID NO: 751089 - DNA, 17 bp, Homo sapiens
ggtgggcagggaggggc

SEQ ID NO: 751090 - DNA, 21 bp, Homo sapiens
ggtgggcagggaggggctggg

SEQ ID NO: 751091 - DNA, 16 bp, Homo sapiens
ggtgggcatgccaccc

SEQ ID NO: 751092 - DNA, 12 bp, Homo sapiens
ggtgggccactc

SEQ ID NO: 751093 - DNA, 15 bp, Homo sapiens
ggtgggccactctcc

SEQ ID NO: 751094 - DNA, 12 bp, Homo sapiens
ggtgggccagag

SEQ ID NO: 751095 - DNA, 15 bp, Homo sapiens
ggtgggccagagctg

SEQ ID NO: 751096 - DNA, 12 bp, Homo sapiens
ggtgggccaggc

SEQ ID NO: 751097 - DNA, 20 bp, Homo sapiens
ggtgggccatatgcctacag

SEQ ID NO: 751098 - DNA, 14 bp, Homo sapiens
ggtgggcctggcct

SEQ ID NO: 751099 - DNA, 15 bp, Homo sapiens
ggtgggcctggcctg

SEQ ID NO: 751100 - DNA, 13 bp, Homo sapiens
ggtgggcctggcg

SEQ ID NO: 751101 - DNA, 22 bp, Homo sapiens
ggtgggcctggcggcctgtggg

SEQ ID NO: 751102 - DNA, 17 bp, Homo sapiens
ggtgggctggcccagcc

SEQ ID NO: 751103 - DNA, 13 bp, Homo sapiens
ggtgggctgggga

SEQ ID NO: 751104 - DNA, 18 bp, Homo sapiens
ggtgggctggggactctg

SEQ ID NO: 751105 - DNA, 20 bp, Homo sapiens
ggtggggaaggagggacttg

SEQ ID NO: 751106 - DNA, 13 bp, Homo sapiens
ggtggggaatgtt

SEQ ID NO: 751107 - DNA, 20 bp, Homo sapiens
ggtggggacattgctctctg

SEQ ID NO: 751108 - DNA, 23 bp, Homo sapiens
ggtggggacattgctctctgggc

SEQ ID NO: 751109 - DNA, 14 bp, Homo sapiens
ggtggggaggagga

SEQ ID NO: 751110 - DNA, 15 bp, Homo sapiens
ggtggggaggaggaa

SEQ ID NO: 751111 - DNA, 21 bp, Homo sapiens
ggtggggcctcagcctggggc

SEQ ID NO: 751112 - DNA, 17 bp, Homo sapiens
ggtggggctgctcctcc

SEQ ID NO: 751113 - DNA, 22 bp, Homo sapiens
ggtggggctgctcctccagggc

SEQ ID NO: 751114 - DNA, 18 bp, Homo sapiens
ggtgggggaaggggagga

SEQ ID NO: 751115 - DNA, 21 bp, Homo sapiens
ggtgggggagaaaaaatcact

SEQ ID NO: 751116 - DNA, 12 bp, Homo sapiens
ggtgggggagga

SEQ ID NO: 751117 - DNA, 20 bp, Homo sapiens
ggtgggggccacctgcctgc

SEQ ID NO: 751118 - DNA, 13 bp, Homo sapiens
ggtgggggccagg

SEQ ID NO: 751119 - DNA, 15 bp, Homo sapiens
ggtgggggcctcctc

SEQ ID NO: 751120 - DNA, 17 bp, Homo sapiens
ggtgggggcctcctcag

SEQ ID NO: 751121 - DNA, 14 bp, Homo sapiens
ggtgggggtgggca

SEQ ID NO: 751122 - DNA, 15 bp, Homo sapiens
ggtggggtcatgccc

SEQ ID NO: 751123 - DNA, 23 bp, Homo sapiens
ggtggggtcatgccctcctctcc

SEQ ID NO: 751124 - DNA, 23 bp, Homo sapiens
ggtggggtcctggagcagaccac

SEQ ID NO: 751125 - DNA, 15 bp, Homo sapiens
ggtggggtctgggag

SEQ ID NO: 751126 - DNA, 19 bp, Homo sapiens
ggtggggtgatggccagag

SEQ ID NO: 751127 - DNA, 18 bp, Homo sapiens
ggtggggtgcactcgcca

SEQ ID NO: 751128 - DNA, 14 bp, Homo sapiens
ggtgggtccatggg

SEQ ID NO: 751129 - DNA, 13 bp, Homo sapiens
ggtgggtctgagc

SEQ ID NO: 751130 - DNA, 17 bp, Homo sapiens
ggtgggtctgagctgga

SEQ ID NO: 751131 - DNA, 19 bp, Homo sapiens
ggtgggtctttaataaaac

SEQ ID NO: 751132 - DNA, 12 bp, Homo sapiens
ggtgggtgctca

SEQ ID NO: 751133 - DNA, 17 bp, Homo sapiens
ggtgggtgggcagggag

SEQ ID NO: 751134 - DNA, 15 bp, Homo sapiens
ggtgggtgtggccag

SEQ ID NO: 751135 - DNA, 17 bp, Homo sapiens
ggtgggttttcttccca

SEQ ID NO: 751136 - DNA, 16 bp, Homo sapiens
ggtggtattctgtcat

SEQ ID NO: 751137 - DNA, 13 bp, Homo sapiens
ggtggtattttca

SEQ ID NO: 751138 - DNA, 20 bp, Homo sapiens
ggtggtattttcaatagcca

SEQ ID NO: 751139 - DNA, 19 bp, Homo sapiens
ggtggtcctgactcaacat

SEQ ID NO: 751140 - DNA, 22 bp, Homo sapiens
ggtggtctgttggcaggctggc

SEQ ID NO: 751141 - DNA, 17 bp, Homo sapiens
ggtggtgcccgtgcccg

SEQ ID NO: 751142 - DNA, 17 bp, Homo sapiens
ggtggtggcactgagcc

SEQ ID NO: 751143 - DNA, 14 bp, Homo sapiens
ggtggtggcctggt

SEQ ID NO: 751144 - DNA, 17 bp, Homo sapiens
ggtggtttcagaaatgt

SEQ ID NO: 751145 - DNA, 15 bp, Homo sapiens
ggtggtttgccatgt

SEQ ID NO: 751146 - DNA, 15 bp, Homo sapiens
ggtgtaacttcctgc

SEQ ID NO: 751147 - DNA, 16 bp, Homo sapiens
ggtgtaacttcctgct

SEQ ID NO: 751148 - DNA, 17 bp, Homo sapiens
ggtgtaacttcctgctg

SEQ ID NO: 751149 - DNA, 24 bp, Homo sapiens
ggtgtaacttcctgctgcaccctg

SEQ ID NO: 751150 - DNA, 20 bp, Homo sapiens
ggtgtagatttctgacatca

SEQ ID NO: 751151 - DNA, 13 bp, Homo sapiens
ggtgtataaatgt

SEQ ID NO: 751152 - DNA, 23 bp, Homo sapiens
ggtgtatagtgttcacaaactgt

SEQ ID NO: 751153 - DNA, 22 bp, Homo sapiens
ggtgtatatgtgccacattttc

SEQ ID NO: 751154 - DNA, 16 bp, Homo sapiens
ggtgtatattatataa

SEQ ID NO: 751155 - DNA, 20 bp, Homo sapiens
ggtgtatcctggccctgggg

SEQ ID NO: 751156 - DNA, 17 bp, Homo sapiens
ggtgtatttattttcct

SEQ ID NO: 751157 - DNA, 22 bp, Homo sapiens
ggtgtatttattttcctcccca

SEQ ID NO: 751158 - DNA, 13 bp, Homo sapiens
ggtgtcaactaaa

SEQ ID NO: 751159 - DNA, 13 bp, Homo sapiens
ggtgtcagaagct

SEQ ID NO: 751160 - DNA, 23 bp, Homo sapiens
ggtgtcagaccctggaggcccca

SEQ ID NO: 751161 - DNA, 12 bp, Homo sapiens
ggtgtcaggcag

SEQ ID NO: 751162 - DNA, 13 bp, Homo sapiens
ggtgtcaggcagg

SEQ ID NO: 751163 - DNA, 23 bp, Homo sapiens
ggtgtcaggcccgtcggagctgc

SEQ ID NO: 751164 - DNA, 16 bp, Homo sapiens
ggtgtcaggtcccagc

SEQ ID NO: 751165 - DNA, 20 bp, Homo sapiens
ggtgtcaggtcccagcgagc

SEQ ID NO: 751166 - DNA, 17 bp, Homo sapiens
ggtgtcagtatccaggc

SEQ ID NO: 751167 - DNA, 23 bp, Homo sapiens
ggtgtcatggctgaagttggcca

SEQ ID NO: 751168 - DNA, 20 bp, Homo sapiens
ggtgtcattctgcctgctcc

SEQ ID NO: 751169 - DNA, 14 bp, Homo sapiens
ggtgtcatttcatt

SEQ ID NO: 751170 - DNA, 23 bp, Homo sapiens
ggtgtccccaacgtcccctccgc

SEQ ID NO: 751171 - DNA, 17 bp, Homo sapiens
ggtgtccccttcccctg

SEQ ID NO: 751172 - DNA, 19 bp, Homo sapiens
ggtgtccgccatccagggt

SEQ ID NO: 751173 - DNA, 12 bp, Homo sapiens
ggtgtcctgacc

SEQ ID NO: 751174 - DNA, 19 bp, Homo sapiens
ggtgtcctgcctgtctgcc

SEQ ID NO: 751175 - DNA, 21 bp, Homo sapiens
ggtgtcctgcctgtctgcccc

SEQ ID NO: 751176 - DNA, 12 bp, Homo sapiens
ggtgtccttccc

SEQ ID NO: 751177 - DNA, 13 bp, Homo sapiens
ggtgtccttccct

SEQ ID NO: 751178 - DNA, 21 bp, Homo sapiens
ggtgtcgctctgctggcctgg

SEQ ID NO: 751179 - DNA, 14 bp, Homo sapiens
ggtgtctccctcgg

SEQ ID NO: 751180 - DNA, 15 bp, Homo sapiens
ggtgtctctgggcct

SEQ ID NO: 751181 - DNA, 16 bp, Homo sapiens
ggtgtctgcacccagg

SEQ ID NO: 751182 - DNA, 15 bp, Homo sapiens
ggtgtgaacccggga

SEQ ID NO: 751183 - DNA, 18 bp, Homo sapiens
ggtgtgactcgggagctg

SEQ ID NO: 751184 - DNA, 23 bp, Homo sapiens
ggtgtgactcgggagctgcacac

SEQ ID NO: 751185 - DNA, 18 bp, Homo sapiens
ggtgtgatcgtctgactg

SEQ ID NO: 751186 - DNA, 13 bp, Homo sapiens
ggtgtgcctgcag

SEQ ID NO: 751187 - DNA, 15 bp, Homo sapiens
ggtgtgcgtgcgtgt

SEQ ID NO: 751188 - DNA, 19 bp, Homo sapiens
ggtgtgctgggagctccac

SEQ ID NO: 751189 - DNA, 22 bp, Homo sapiens
ggtgtgctgggagctccactct

SEQ ID NO: 751190 - DNA, 16 bp, Homo sapiens
ggtgtggagccgaggc

SEQ ID NO: 751191 - DNA, 11 bp, Homo sapiens
ggtgtggcccg

SEQ ID NO: 751192 - DNA, 15 bp, Homo sapiens
ggtgtgggacacctg

SEQ ID NO: 751193 - DNA, 13 bp, Homo sapiens
ctggccgcagggc

SEQ ID NO: 751194 - DNA, 16 bp, Homo sapiens
ctggccgccaccccca

SEQ ID NO: 751195 - DNA, 19 bp, Homo sapiens
ctggccgccacccccatct

SEQ ID NO: 751196 - DNA, 16 bp, Homo sapiens
ctggccgctaagttgc

SEQ ID NO: 751197 - DNA, 18 bp, Homo sapiens
ctggccggcaaccccagt

SEQ ID NO: 751198 - DNA, 18 bp, Homo sapiens
ctggccgggtcaccctgt

SEQ ID NO: 751199 - DNA, 20 bp, Homo sapiens
ctggccgggtcaccctgtga

SEQ ID NO: 751200 - DNA, 19 bp, Homo sapiens
ctggcctagaccagcagac

SEQ ID NO: 751201 - DNA, 20 bp, Homo sapiens
ctggcctagaccagcagaca

SEQ ID NO: 751202 - DNA, 14 bp, Homo sapiens
ctggcctagcatac

SEQ ID NO: 751203 - DNA, 22 bp, Homo sapiens
ctggcctatccgctgccagcct

SEQ ID NO: 751204 - DNA, 16 bp, Homo sapiens
ctggcctcaaagcaag

SEQ ID NO: 751205 - DNA, 21 bp, Homo sapiens
ctggcctcaaagcaagcattc

SEQ ID NO: 751206 - DNA, 14 bp, Homo sapiens
ctggcctcactggc

SEQ ID NO: 751207 - DNA, 17 bp, Homo sapiens
ctggcctcactggctgg

SEQ ID NO: 751208 - DNA, 15 bp, Homo sapiens
ctggcctcagttccc

SEQ ID NO: 751209 - DNA, 14 bp, Homo sapiens
ctggcctccagcct

SEQ ID NO: 751210 - DNA, 19 bp, Homo sapiens
ctggcctccagcctttgct

SEQ ID NO: 751211 - DNA, 12 bp, Homo sapiens
ctggcctcccac

SEQ ID NO: 751212 - DNA, 13 bp, Homo sapiens
ctggcctcccaca

SEQ ID NO: 751213 - DNA, 19 bp, Homo sapiens
ctggcctcccacagactca

SEQ ID NO: 751214 - DNA, 15 bp, Homo sapiens
ctggcctcccacccg

SEQ ID NO: 751215 - DNA, 22 bp, Homo sapiens
ctggcctcccacccgatgctgc

SEQ ID NO: 751216 - DNA, 17 bp, Homo sapiens
ctggcctcccctgccac

SEQ ID NO: 751217 - DNA, 17 bp, Homo sapiens
ctggcctccttttgctg

SEQ ID NO: 751218 - DNA, 15 bp, Homo sapiens
ctggcctcgcctgcc

SEQ ID NO: 751219 - DNA, 12 bp, Homo sapiens
ctggcctctgtg

SEQ ID NO: 751220 - DNA, 14 bp, Homo sapiens
ctggcctctgtgat

SEQ ID NO: 751221 - DNA, 13 bp, Homo sapiens
ctggcctctgtgc

SEQ ID NO: 751222 - DNA, 15 bp, Homo sapiens
ctggcctctgtgcct

SEQ ID NO: 751223 - DNA, 16 bp, Homo sapiens
ctggcctctgtgcctt

SEQ ID NO: 751224 - DNA, 20 bp, Homo sapiens
ctggcctctgtgccttcttt

SEQ ID NO: 751225 - DNA, 18 bp, Homo sapiens
ctggcctgaactgaggag

SEQ ID NO: 751226 - DNA, 13 bp, Homo sapiens
ctggcctgactgg

SEQ ID NO: 751227 - DNA, 15 bp, Homo sapiens
ctggcctgagagtca

SEQ ID NO: 751228 - DNA, 12 bp, Homo sapiens
ctggcctgagca

SEQ ID NO: 751229 - DNA, 13 bp, Homo sapiens
ctggcctgagctg

SEQ ID NO: 751230 - DNA, 15 bp, Homo sapiens
ctggcctgagctggg

SEQ ID NO: 751231 - DNA, 19 bp, Homo sapiens
ctggcctgagctggggcca

SEQ ID NO: 751232 - DNA, 20 bp, Homo sapiens
ctggcctgctgggctctcca

SEQ ID NO: 751233 - DNA, 22 bp, Homo sapiens
ctggcctggatctccccactct

SEQ ID NO: 751234 - DNA, 13 bp, Homo sapiens
ctggcctggctcc

SEQ ID NO: 751235 - DNA, 18 bp, Homo sapiens
ctggcctgggccacacct

SEQ ID NO: 751236 - DNA, 22 bp, Homo sapiens
ctggcctgggccacacctgagc

SEQ ID NO: 751237 - DNA, 12 bp, Homo sapiens
ctggcctgttat

SEQ ID NO: 751238 - DNA, 17 bp, Homo sapiens
ctggccttaaaaggggc

SEQ ID NO: 751239 - DNA, 20 bp, Homo sapiens
ctggccttaaagagggacag

SEQ ID NO: 751240 - DNA, 21 bp, Homo sapiens
ctggccttaaagagggacagg

SEQ ID NO: 751241 - DNA, 15 bp, Homo sapiens
ctggccttctcctac

SEQ ID NO: 751242 - DNA, 19 bp, Homo sapiens
ctggccttctgaactccat

SEQ ID NO: 751243 - DNA, 14 bp, Homo sapiens
ctggccttgtactt

SEQ ID NO: 751244 - DNA, 19 bp, Homo sapiens
ctggccttgtcctcagcca

SEQ ID NO: 751245 - DNA, 21 bp, Homo sapiens
ctggccttgtcctcagccagt

SEQ ID NO: 751246 - DNA, 20 bp, Homo sapiens
ctggccttgtgtggcttgga

SEQ ID NO: 751247 - DNA, 14 bp, Homo sapiens
ctggcctttcactt

SEQ ID NO: 751248 - DNA, 17 bp, Homo sapiens
ctggcgacaagagtgag

SEQ ID NO: 751249 - DNA, 13 bp, Homo sapiens
ctggcgacacact

SEQ ID NO: 751250 - DNA, 18 bp, Homo sapiens
ctggcgacacactccgtc

SEQ ID NO: 751251 - DNA, 22 bp, Homo sapiens
ctggcgacacgtagcagcttag

SEQ ID NO: 751252 - DNA, 19 bp, Homo sapiens
ctggcgacagttttccttc

SEQ ID NO: 751253 - DNA, 22 bp, Homo sapiens
ctggcgagttctctttggaaat

SEQ ID NO: 751254 - DNA, 13 bp, Homo sapiens
ctggcgcagccaa

SEQ ID NO: 751255 - DNA, 15 bp, Homo sapiens
ctggcgcagccaagg

SEQ ID NO: 751256 - DNA, 19 bp, Homo sapiens
ctggcgcagccaaggccga

SEQ ID NO: 751257 - DNA, 15 bp, Homo sapiens
ctggcgcttggatct

SEQ ID NO: 751258 - DNA, 20 bp, Homo sapiens
ctggcgcttggatctggggt

SEQ ID NO: 751259 - DNA, 15 bp, Homo sapiens
ctggcggccccaact

SEQ ID NO: 751260 - DNA, 22 bp, Homo sapiens
ctggcggccccaactcgggctc

SEQ ID NO: 751261 - DNA, 14 bp, Homo sapiens
ctggcggcctgtgg

SEQ ID NO: 751262 - DNA, 15 bp, Homo sapiens
ctggcggcctgtggg

SEQ ID NO: 751263 - DNA, 16 bp, Homo sapiens
ctggcggcgcagaggg

SEQ ID NO: 751264 - DNA, 22 bp, Homo sapiens
ctggcggctactcagcagccct

SEQ ID NO: 751265 - DNA, 14 bp, Homo sapiens
ctggcggcttcctg

SEQ ID NO: 751266 - DNA, 19 bp, Homo sapiens
ctggcggcttcctgtccac

SEQ ID NO: 751267 - DNA, 15 bp, Homo sapiens
ctggcggtggccaca

SEQ ID NO: 751268 - DNA, 14 bp, Homo sapiens
ctggcgtctgtctt

SEQ ID NO: 751269 - DNA, 15 bp, Homo sapiens
ctggcgtctgtcttc

SEQ ID NO: 751270 - DNA, 13 bp, Homo sapiens
ctggcgtgctcag

SEQ ID NO: 751271 - DNA, 18 bp, Homo sapiens
ctggcgtgctcagaccca

SEQ ID NO: 751272 - DNA, 22 bp, Homo sapiens
ctggcgttcacctccctgctca

SEQ ID NO: 751273 - DNA, 22 bp, Homo sapiens
ctggcgttctcaagaatctaga

SEQ ID NO: 751274 - DNA, 12 bp, Homo sapiens
ctggctacatcc

SEQ ID NO: 751275 - DNA, 16 bp, Homo sapiens
ctggctacatcccagc

SEQ ID NO: 751276 - DNA, 20 bp, Homo sapiens
ctggctagaggccagcccca

SEQ ID NO: 751277 - DNA, 23 bp, Homo sapiens
ctggctagaggccagccccaccc

SEQ ID NO: 751278 - DNA, 16 bp, Homo sapiens
ctggctagagtcctca

SEQ ID NO: 751279 - DNA, 22 bp, Homo sapiens
ctggctagagtcctcactccca

SEQ ID NO: 751280 - DNA, 14 bp, Homo sapiens
ctggctagtccttt

SEQ ID NO: 751281 - DNA, 18 bp, Homo sapiens
ctggctatagatgtcttt

SEQ ID NO: 751282 - DNA, 16 bp, Homo sapiens
ctggctatgcatttga

SEQ ID NO: 751283 - DNA, 15 bp, Homo sapiens
ctggctcacagtaca

SEQ ID NO: 751284 - DNA, 16 bp, Homo sapiens
ctggctcacagtacag

SEQ ID NO: 751285 - DNA, 22 bp, Homo sapiens
ctggctcacagtacagcatgtg

SEQ ID NO: 751286 - DNA, 24 bp, Homo sapiens
ctggctcacagtacagcatgtgcc

SEQ ID NO: 751287 - DNA, 23 bp, Homo sapiens
ctggctcacgccccgctgtgtcc

SEQ ID NO: 751288 - DNA, 13 bp, Homo sapiens
ctggctcatctct

SEQ ID NO: 751289 - DNA, 14 bp, Homo sapiens
ctggctccagatgc

SEQ ID NO: 751290 - DNA, 21 bp, Homo sapiens
ctggctccagatgcagggcag

SEQ ID NO: 751291 - DNA, 15 bp, Homo sapiens
ctggctcccacaggc

SEQ ID NO: 751292 - DNA, 19 bp, Homo sapiens
ctggctcccacaggccctt

SEQ ID NO: 751293 - DNA, 14 bp, Homo sapiens
ctggctcccacctg

SEQ ID NO: 751294 - DNA, 15 bp, Homo sapiens
ctggctcccacctgt

SEQ ID NO: 751295 - DNA, 16 bp, Homo sapiens
ctggctcccagggtgg

SEQ ID NO: 751296 - DNA, 21 bp, Homo sapiens
ctggctccccacgagtcacct

SEQ ID NO: 751297 - DNA, 22 bp, Homo sapiens
ctggctccccctccccaggctg

SEQ ID NO: 751298 - DNA, 15 bp, Homo sapiens
ctggctccccgaggg

SEQ ID NO: 751299 - DNA, 18 bp, Homo sapiens
ctggctccctcctccagg

SEQ ID NO: 751300 - DNA, 21 bp, Homo sapiens
ctggctccctcctccaggcct

SEQ ID NO: 751301 - DNA, 16 bp, Homo sapiens
ctggctccctgggcag

SEQ ID NO: 751302 - DNA, 12 bp, Homo sapiens
ctggctcctcaa

SEQ ID NO: 751303 - DNA, 15 bp, Homo sapiens
ctggctcctccgtct

SEQ ID NO: 751304 - DNA, 14 bp, Homo sapiens
ctggctcctgaggg

SEQ ID NO: 751305 - DNA, 21 bp, Homo sapiens
ctggctccttgcagcagggct

SEQ ID NO: 751306 - DNA, 22 bp, Homo sapiens
ctggctccttgcagcagggctg

SEQ ID NO: 751307 - DNA, 19 bp, Homo sapiens
ctggctcggacccacccca

SEQ ID NO: 751308 - DNA, 15 bp, Homo sapiens
ctggctctaattcac

SEQ ID NO: 751309 - DNA, 22 bp, Homo sapiens
ctggctctaccctgtctgtccc

SEQ ID NO: 751310 - DNA, 16 bp, Homo sapiens
ctggctctaccttcct

SEQ ID NO: 751311 - DNA, 18 bp, Homo sapiens
ctggctctaccttcctgt

SEQ ID NO: 751312 - DNA, 17 bp, Homo sapiens
ctggctctccaagtgcc

SEQ ID NO: 751313 - DNA, 19 bp, Homo sapiens
ctggctctccaagtgccag

SEQ ID NO: 751314 - DNA, 15 bp, Homo sapiens
ctggctctccacctt

SEQ ID NO: 751315 - DNA, 16 bp, Homo sapiens
ctggctctctccagga

SEQ ID NO: 751316 - DNA, 13 bp, Homo sapiens
ctggctctgagcg

SEQ ID NO: 751317 - DNA, 24 bp, Homo sapiens
ctggctctgagcgcctccatccaa

SEQ ID NO: 751318 - DNA, 23 bp, Homo sapiens
ggtgtggggctgccgatgggaaa

SEQ ID NO: 751319 - DNA, 15 bp, Homo sapiens
ggtgtggtgcagtgt

SEQ ID NO: 751320 - DNA, 17 bp, Homo sapiens
ggtgtggtgcagtgtga

SEQ ID NO: 751321 - DNA, 22 bp, Homo sapiens
ggtgtggtgtttgtaggctgtg

SEQ ID NO: 751322 - DNA, 21 bp, Homo sapiens
ggtgtgtcctctgtgcccacg

SEQ ID NO: 751323 - DNA, 21 bp, Homo sapiens
ggtgtgtccttgaactgaggc

SEQ ID NO: 751324 - DNA, 12 bp, Homo sapiens
ggtgtgtctgct

SEQ ID NO: 751325 - DNA, 22 bp, Homo sapiens
ggtgtgtggcccgaggaagctg

SEQ ID NO: 751326 - DNA, 19 bp, Homo sapiens
ggtgtgtggtgaggggctt

SEQ ID NO: 751327 - DNA, 23 bp, Homo sapiens
ggtgtgtgtgtgtgttttaattt

SEQ ID NO: 751328 - DNA, 19 bp, Homo sapiens
ggtgtgttccaactgcccc

SEQ ID NO: 751329 - DNA, 21 bp, Homo sapiens
ggtgtgttggacagagaaggg

SEQ ID NO: 751330 - DNA, 21 bp, Homo sapiens
ggtgtgtttggcttggccttg

SEQ ID NO: 751331 - DNA, 22 bp, Homo sapiens
ggtgttatttggaaccttgttt

SEQ ID NO: 751332 - DNA, 12 bp, Homo sapiens
ggtgttctgaag

SEQ ID NO: 751333 - DNA, 16 bp, Homo sapiens
ggtgttctttcctgcc

SEQ ID NO: 751334 - DNA, 17 bp, Homo sapiens
ggtgttctttcctgccc

SEQ ID NO: 751335 - DNA, 15 bp, Homo sapiens
ggtgttgacacacca

SEQ ID NO: 751336 - DNA, 22 bp, Homo sapiens
ggtgttgccaaatatgtcctgg

SEQ ID NO: 751337 - DNA, 14 bp, Homo sapiens
ggtgttgggagccc

SEQ ID NO: 751338 - DNA, 15 bp, Homo sapiens
ggtgttgtatgcctt

SEQ ID NO: 751339 - DNA, 17 bp, Homo sapiens
ggtgttgtatgccttta

SEQ ID NO: 751340 - DNA, 22 bp, Homo sapiens
ggtgtttattacaagtggctcc

SEQ ID NO: 751341 - DNA, 16 bp, Homo sapiens
ggtgttttatttccta

SEQ ID NO: 751342 - DNA, 17 bp, Homo sapiens
ggtgttttatttcctat

SEQ ID NO: 751343 - DNA, 22 bp, Homo sapiens
ggtgttttttatgaagtgcgtg

SEQ ID NO: 751344 - DNA, 17 bp, Homo sapiens
ggtgttttttgttactg

SEQ ID NO: 751345 - DNA, 16 bp, Homo sapiens
ggttaaagcagacagt

SEQ ID NO: 751346 - DNA, 15 bp, Homo sapiens
ggttaaatcatttgg

SEQ ID NO: 751347 - DNA, 12 bp, Homo sapiens
ggttaagtgttt

SEQ ID NO: 751348 - DNA, 18 bp, Homo sapiens
ggttaatgttgatttaaa

SEQ ID NO: 751349 - DNA, 19 bp, Homo sapiens
ggttaatttttcctgcatg

SEQ ID NO: 751350 - DNA, 18 bp, Homo sapiens
ggttacagtgcagacagg

SEQ ID NO: 751351 - DNA, 19 bp, Homo sapiens
ggttaccgagtatctgtaa

SEQ ID NO: 751352 - DNA, 21 bp, Homo sapiens
ggttaccgagtatctgtaacc

SEQ ID NO: 751353 - DNA, 17 bp, Homo sapiens
ggttactaagatgaaat

SEQ ID NO: 751354 - DNA, 15 bp, Homo sapiens
ggttacttcttctct

SEQ ID NO: 751355 - DNA, 13 bp, Homo sapiens
ggttactttgtgt

SEQ ID NO: 751356 - DNA, 14 bp, Homo sapiens
ggttagaaaggcag

SEQ ID NO: 751357 - DNA, 19 bp, Homo sapiens
ggttagaaaggcagccctc

SEQ ID NO: 751358 - DNA, 15 bp, Homo sapiens
ggttagggaggggta

SEQ ID NO: 751359 - DNA, 17 bp, Homo sapiens
ggttagtcgggtgccag

SEQ ID NO: 751360 - DNA, 15 bp, Homo sapiens
ggttagtgatgcagt

SEQ ID NO: 751361 - DNA, 23 bp, Homo sapiens
ggttatacaataacccagttact

SEQ ID NO: 751362 - DNA, 17 bp, Homo sapiens
ggttatcactttaagtt

SEQ ID NO: 751363 - DNA, 22 bp, Homo sapiens
ggttatcctttcattaggcaaa

SEQ ID NO: 751364 - DNA, 13 bp, Homo sapiens
ggttatctgcctg

SEQ ID NO: 751365 - DNA, 17 bp, Homo sapiens
ggttatggtttaatgtt

SEQ ID NO: 751366 - DNA, 15 bp, Homo sapiens
ggttattacttctgt

SEQ ID NO: 751367 - DNA, 18 bp, Homo sapiens
ggttattagcaaggctgg

SEQ ID NO: 751368 - DNA, 20 bp, Homo sapiens
ggttattagcaaggctgggt

SEQ ID NO: 751369 - DNA, 20 bp, Homo sapiens
ggttattgaaaatatgatgt

SEQ ID NO: 751370 - DNA, 12 bp, Homo sapiens
ggttatttaaaa

SEQ ID NO: 751371 - DNA, 23 bp, Homo sapiens
ggttatttagtaaagtttgttga

SEQ ID NO: 751372 - DNA, 13 bp, Homo sapiens
ggttatttctctg

SEQ ID NO: 751373 - DNA, 14 bp, Homo sapiens
ggttattttgcttt

SEQ ID NO: 751374 - DNA, 17 bp, Homo sapiens
ggttatttttattaaat

SEQ ID NO: 751375 - DNA, 21 bp, Homo sapiens
ggttatttttattaaatgtat

SEQ ID NO: 751376 - DNA, 15 bp, Homo sapiens
ggttatttttctctt

SEQ ID NO: 751377 - DNA, 21 bp, Homo sapiens
ggttcaaagatattttgcttt

SEQ ID NO: 751378 - DNA, 23 bp, Homo sapiens
ggttcaaggaatccatcctgcaa

SEQ ID NO: 751379 - DNA, 19 bp, Homo sapiens
ggttcaagtgactctcctg

SEQ ID NO: 751380 - DNA, 23 bp, Homo sapiens
ggttcaagtgactctcctgcctc

SEQ ID NO: 751381 - DNA, 16 bp, Homo sapiens
ggttcactgagctccc

SEQ ID NO: 751382 - DNA, 19 bp, Homo sapiens
ggttcagaattaaactttt

SEQ ID NO: 751383 - DNA, 19 bp, Homo sapiens
ggttcagacacagctcttc

SEQ ID NO: 751384 - DNA, 17 bp, Homo sapiens
ggttcagacccctgcct

SEQ ID NO: 751385 - DNA, 18 bp, Homo sapiens
ggttcagacccctgcctg

SEQ ID NO: 751386 - DNA, 18 bp, Homo sapiens
ggttcagggaactgcttg

SEQ ID NO: 751387 - DNA, 13 bp, Homo sapiens
ggttcagtgcctt

SEQ ID NO: 751388 - DNA, 21 bp, Homo sapiens
ggttcataggtcactggctct

SEQ ID NO: 751389 - DNA, 10 bp, Homo sapiens
ggttccaaac

SEQ ID NO: 751390 - DNA, 11 bp, Homo sapiens
ggttccaaacc

SEQ ID NO: 751391 - DNA, 13 bp, Homo sapiens
ggttccatgcctg

SEQ ID NO: 751392 - DNA, 15 bp, Homo sapiens
ggttccatgcctgag

SEQ ID NO: 751393 - DNA, 16 bp, Homo sapiens
ggttccatgcctgagg

SEQ ID NO: 751394 - DNA, 13 bp, Homo sapiens
ggttcccaagctc

SEQ ID NO: 751395 - DNA, 18 bp, Homo sapiens
ggttcccaataaaagtga

SEQ ID NO: 751396 - DNA, 19 bp, Homo sapiens
ggttccccacacagggcac

SEQ ID NO: 751397 - DNA, 21 bp, Homo sapiens
ggttcccttgagggctgcagt

SEQ ID NO: 751398 - DNA, 22 bp, Homo sapiens
ggttccctttccttccatccct

SEQ ID NO: 751399 - DNA, 16 bp, Homo sapiens
ggttccgggaggcaga

SEQ ID NO: 751400 - DNA, 14 bp, Homo sapiens
ggttcctctctccc

SEQ ID NO: 751401 - DNA, 15 bp, Homo sapiens
ggttcctctctccca

SEQ ID NO: 751402 - DNA, 15 bp, Homo sapiens
ggttcctctgcctgc

SEQ ID NO: 751403 - DNA, 19 bp, Homo sapiens
ggttcctggggccgcctgc

SEQ ID NO: 751404 - DNA, 20 bp, Homo sapiens
ggttcctggggccgcctgcc

SEQ ID NO: 751405 - DNA, 23 bp, Homo sapiens
ggttcctggggccgcctgccctg

SEQ ID NO: 751406 - DNA, 18 bp, Homo sapiens
ggttcctgtgcagatgct

SEQ ID NO: 751407 - DNA, 13 bp, Homo sapiens
ggttcctgtttga

SEQ ID NO: 751408 - DNA, 19 bp, Homo sapiens
ggttccttcctatgcccag

SEQ ID NO: 751409 - DNA, 20 bp, Homo sapiens
ggttccttcctctgagcctt

SEQ ID NO: 751410 - DNA, 13 bp, Homo sapiens
ggttccttctctg

SEQ ID NO: 751411 - DNA, 17 bp, Homo sapiens
ggttcgagacccaaacc

SEQ ID NO: 751412 - DNA, 16 bp, Homo sapiens
ggttcggctgctttta

SEQ ID NO: 751413 - DNA, 18 bp, Homo sapiens
ggttcggttgcagggctg

SEQ ID NO: 751414 - DNA, 16 bp, Homo sapiens
ggttctaaaggtacca

SEQ ID NO: 751415 - DNA, 10 bp, Homo sapiens
ggttctagac

SEQ ID NO: 751416 - DNA, 18 bp, Homo sapiens
ggttctaggcatctctgt

SEQ ID NO: 751417 - DNA, 21 bp, Homo sapiens
ggttctaggcatctctgtact

SEQ ID NO: 751418 - DNA, 17 bp, Homo sapiens
ggttctataataagttt

SEQ ID NO: 751419 - DNA, 22 bp, Homo sapiens
ggttctattttactttgtactt

SEQ ID NO: 751420 - DNA, 13 bp, Homo sapiens
ggttctcaatgaa

SEQ ID NO: 751421 - DNA, 14 bp, Homo sapiens
ggttctcaatgaaa

SEQ ID NO: 751422 - DNA, 13 bp, Homo sapiens
ggttctcatttct

SEQ ID NO: 751423 - DNA, 13 bp, Homo sapiens
ggttctcatttgg

SEQ ID NO: 751424 - DNA, 20 bp, Homo sapiens
ggttctccgttagctcctgt

SEQ ID NO: 751425 - DNA, 20 bp, Homo sapiens
ggttctctctgacctttcat

SEQ ID NO: 751426 - DNA, 16 bp, Homo sapiens
ggttctctttttgtat

SEQ ID NO: 751427 - DNA, 21 bp, Homo sapiens
ggttctgacactttctgctgg

SEQ ID NO: 751428 - DNA, 16 bp, Homo sapiens
ggttctgccctgcctg

SEQ ID NO: 751429 - DNA, 18 bp, Homo sapiens
ggttctgccctgcctgag

SEQ ID NO: 751430 - DNA, 21 bp, Homo sapiens
ggttctgcccttatggagctc

SEQ ID NO: 751431 - DNA, 16 bp, Homo sapiens
ggttctgcctgctttg

SEQ ID NO: 751432 - DNA, 23 bp, Homo sapiens
ggttctggcaggacctgcctagc

SEQ ID NO: 751433 - DNA, 12 bp, Homo sapiens
ggttctggggcc

SEQ ID NO: 751434 - DNA, 19 bp, Homo sapiens
ggttctgtgtcctctgcct

SEQ ID NO: 751435 - DNA, 16 bp, Homo sapiens
ggttcttagtgtcact

SEQ ID NO: 751436 - DNA, 23 bp, Homo sapiens
ggttcttattttgcattccagaa

SEQ ID NO: 751437 - DNA, 19 bp, Homo sapiens
ggttcttcagggccagtcc

SEQ ID NO: 751438 - DNA, 13 bp, Homo sapiens
ggttcttcccttt

SEQ ID NO: 751439 - DNA, 16 bp, Homo sapiens
ggttcttcctttccct

SEQ ID NO: 751440 - DNA, 21 bp, Homo sapiens
ggttcttgcaaatgggagctg

SEQ ID NO: 751441 - DNA, 16 bp, Homo sapiens
ggttcttgcctttctt

SEQ ID NO: 751442 - DNA, 23 bp, Homo sapiens
gggctcacttttcatccttcccc

SEQ ID NO: 751443 - DNA, 18 bp, Homo sapiens
gggctcagcaaaagatgc

SEQ ID NO: 751444 - DNA, 22 bp, Homo sapiens
gggctcagcaaaagatgcttct

SEQ ID NO: 751445 - DNA, 13 bp, Homo sapiens
gggctcagcctgg

SEQ ID NO: 751446 - DNA, 12 bp, Homo sapiens
gggctcagggct

SEQ ID NO: 751447 - DNA, 23 bp, Homo sapiens
ctgctccgtggaggaggttggga

SEQ ID NO: 751448 - DNA, 14 bp, Homo sapiens
ctgctcctagaggg

SEQ ID NO: 751449 - DNA, 17 bp, Homo sapiens
ctgctcctagagggagg

SEQ ID NO: 751450 - DNA, 13 bp, Homo sapiens
ctgctcctcaccc

SEQ ID NO: 751451 - DNA, 12 bp, Homo sapiens
ctgctcctcatg

SEQ ID NO: 751452 - DNA, 14 bp, Homo sapiens
ctgctcctcatggt

SEQ ID NO: 751453 - DNA, 11 bp, Homo sapiens
ctgctcctcca

SEQ ID NO: 751454 - DNA, 17 bp, Homo sapiens
ctgctcctccagggcca

SEQ ID NO: 751455 - DNA, 17 bp, Homo sapiens
ctgctcctccctgcccc

SEQ ID NO: 751456 - DNA, 20 bp, Homo sapiens
ctgctcctccctgcccccca

SEQ ID NO: 751457 - DNA, 16 bp, Homo sapiens
ctgctcctccctggct

SEQ ID NO: 751458 - DNA, 15 bp, Homo sapiens
ctgctcctcctgccc

SEQ ID NO: 751459 - DNA, 13 bp, Homo sapiens
ctgctcctctcca

SEQ ID NO: 751460 - DNA, 15 bp, Homo sapiens
ctgctcctctccagg

SEQ ID NO: 751461 - DNA, 17 bp, Homo sapiens
ctgctcctctccaggca

SEQ ID NO: 751462 - DNA, 18 bp, Homo sapiens
ctgctcctctttcccctc

SEQ ID NO: 751463 - DNA, 10 bp, Homo sapiens
ctgctcctgc

SEQ ID NO: 751464 - DNA, 15 bp, Homo sapiens
ggggtccatcccctt

SEQ ID NO: 751465 - DNA, 13 bp, Homo sapiens
ggggtcccagtgg

SEQ ID NO: 751466 - DNA, 13 bp, Homo sapiens
ggggtcccctctg

SEQ ID NO: 751467 - DNA, 21 bp, Homo sapiens
ggggtcctcctcgctcctcct

SEQ ID NO: 751468 - DNA, 13 bp, Homo sapiens
ggggtcctggcca

SEQ ID NO: 751469 - DNA, 22 bp, Homo sapiens
ggggtccttcaagttagctcag

SEQ ID NO: 751470 - DNA, 14 bp, Homo sapiens
ggggtctccctggc

SEQ ID NO: 751471 - DNA, 13 bp, Homo sapiens
ggggtctgggagg

SEQ ID NO: 751472 - DNA, 13 bp, Homo sapiens
ggggtctgggcag

SEQ ID NO: 751473 - DNA, 14 bp, Homo sapiens
ggggtctgggcagt

SEQ ID NO: 751474 - DNA, 13 bp, Homo sapiens
ggggtctgtgctg

SEQ ID NO: 751475 - DNA, 12 bp, Homo sapiens
ggggtctttgtg

SEQ ID NO: 751476 - DNA, 13 bp, Homo sapiens
ggggtgactggaa

SEQ ID NO: 751477 - DNA, 21 bp, Homo sapiens
ggggtgagcctgactgccagg

SEQ ID NO: 751478 - DNA, 13 bp, Homo sapiens
ggggtgaggacca

SEQ ID NO: 751479 - DNA, 15 bp, Homo sapiens
ggggtgataaggggc

SEQ ID NO: 751480 - DNA, 16 bp, Homo sapiens
ggggtgataaggggcc

SEQ ID NO: 751481 - DNA, 17 bp, Homo sapiens
ggggtgatggccagagg

SEQ ID NO: 751482 - DNA, 18 bp, Homo sapiens
ggggtgcaaagactctga

SEQ ID NO: 751483 - DNA, 22 bp, Homo sapiens
ggggtgcaaagactctgagcca

SEQ ID NO: 751484 - DNA, 16 bp, Homo sapiens
ggggtgcagaggctgt

SEQ ID NO: 751485 - DNA, 23 bp, Homo sapiens
ggggtgcatcctcctcagccccc

SEQ ID NO: 751486 - DNA, 15 bp, Homo sapiens
ggggtgcattctggc

SEQ ID NO: 751487 - DNA, 17 bp, Homo sapiens
ggggtggaggcttcctg

SEQ ID NO: 751488 - DNA, 15 bp, Homo sapiens
ggggtggcctggccc

SEQ ID NO: 751489 - DNA, 12 bp, Homo sapiens
ggggtgggaggg

SEQ ID NO: 751490 - DNA, 15 bp, Homo sapiens
ggggtgggcagcagc

SEQ ID NO: 751491 - DNA, 13 bp, Homo sapiens
ggggtgggccagg

SEQ ID NO: 751492 - DNA, 13 bp, Homo sapiens
ggggtgggctgga

SEQ ID NO: 751493 - DNA, 23 bp, Homo sapiens
ggggtgggctggagtcctctcca

SEQ ID NO: 751494 - DNA, 14 bp, Homo sapiens
ggggtggggagatg

SEQ ID NO: 751495 - DNA, 14 bp, Homo sapiens
ggggtggtgtcaga

SEQ ID NO: 751496 - DNA, 16 bp, Homo sapiens
ggggtgtaacttcctg

SEQ ID NO: 751497 - DNA, 15 bp, Homo sapiens
ggggtgtcagaagct

SEQ ID NO: 751498 - DNA, 16 bp, Homo sapiens
ggggttagagccaagc

SEQ ID NO: 751499 - DNA, 21 bp, Homo sapiens
ggggttagagccaagctgcac

SEQ ID NO: 751500 - DNA, 22 bp, Homo sapiens
ggggttcagcccctcctctgcc

SEQ ID NO: 751501 - DNA, 23 bp, Homo sapiens
ggggttcagcccctcctctgcca

SEQ ID NO: 751502 - DNA, 13 bp, Homo sapiens
ggggttccctcct

SEQ ID NO: 751503 - DNA, 13 bp, Homo sapiens
ggggttctggcag

SEQ ID NO: 751504 - DNA, 13 bp, Homo sapiens
ggggttggctggg

SEQ ID NO: 751505 - DNA, 21 bp, Homo sapiens
ggggttgggattgggggctgg

SEQ ID NO: 751506 - DNA, 17 bp, Homo sapiens
ggggttggggcaaagcc

SEQ ID NO: 751507 - DNA, 15 bp, Homo sapiens
ggggttgtgttgtca

SEQ ID NO: 751508 - DNA, 16 bp, Homo sapiens
gggtaaaaagtggctg

SEQ ID NO: 751509 - DNA, 12 bp, Homo sapiens
gggtaagacaat

SEQ ID NO: 751510 - DNA, 14 bp, Homo sapiens
gggtaaggtgcctt

SEQ ID NO: 751511 - DNA, 22 bp, Homo sapiens
gggtaatcagcattattcttca

SEQ ID NO: 751512 - DNA, 20 bp, Homo sapiens
gggtacagcgcggaggagga

SEQ ID NO: 751513 - DNA, 12 bp, Homo sapiens
gggtacaggcag

SEQ ID NO: 751514 - DNA, 19 bp, Homo sapiens
gggtacctggtccccactg

SEQ ID NO: 751515 - DNA, 20 bp, Homo sapiens
gggtactcttgatgtgaaga

SEQ ID NO: 751516 - DNA, 18 bp, Homo sapiens
gggtagaaaactccaggg

SEQ ID NO: 751517 - DNA, 15 bp, Homo sapiens
gggtagactgaggga

SEQ ID NO: 751518 - DNA, 14 bp, Homo sapiens
gggtagcagctgga

SEQ ID NO: 751519 - DNA, 15 bp, Homo sapiens
gggtagcagctggac

SEQ ID NO: 751520 - DNA, 17 bp, Homo sapiens
gggtagcagctggacta

SEQ ID NO: 751521 - DNA, 17 bp, Homo sapiens
gggtagccccgccccag

SEQ ID NO: 751522 - DNA, 19 bp, Homo sapiens
gggtagccccgccccagcc

SEQ ID NO: 751523 - DNA, 11 bp, Homo sapiens
gggtagcctgg

SEQ ID NO: 751524 - DNA, 17 bp, Homo sapiens
gggtaggagagcactgc

SEQ ID NO: 751525 - DNA, 21 bp, Homo sapiens
gggtaggagagcactgcctct

SEQ ID NO: 751526 - DNA, 16 bp, Homo sapiens
gggtaggagcccttct

SEQ ID NO: 751527 - DNA, 15 bp, Homo sapiens
gggtagggaataaaa

SEQ ID NO: 751528 - DNA, 17 bp, Homo sapiens
gggtataagttgctgta

SEQ ID NO: 751529 - DNA, 19 bp, Homo sapiens
gggtatccaagttggactg

SEQ ID NO: 751530 - DNA, 20 bp, Homo sapiens
gggtatccaagttggactgg

SEQ ID NO: 751531 - DNA, 21 bp, Homo sapiens
gggtatccaagttggactggg

SEQ ID NO: 751532 - DNA, 10 bp, Homo sapiens
gggtatcctg

SEQ ID NO: 751533 - DNA, 15 bp, Homo sapiens
gggtatgaagagctg

SEQ ID NO: 751534 - DNA, 21 bp, Homo sapiens
gggtatgaagagcttgctttg

SEQ ID NO: 751535 - DNA, 12 bp, Homo sapiens
gggtcaagcctc

SEQ ID NO: 751536 - DNA, 17 bp, Homo sapiens
gggtcaccctctccagc

SEQ ID NO: 751537 - DNA, 12 bp, Homo sapiens
gggtcaccctgg

SEQ ID NO: 751538 - DNA, 14 bp, Homo sapiens
gggtcaccctgtga

SEQ ID NO: 751539 - DNA, 18 bp, Homo sapiens
gggtcagaagaagtggga

SEQ ID NO: 751540 - DNA, 22 bp, Homo sapiens
gggtcagccccaagggctgggg

SEQ ID NO: 751541 - DNA, 11 bp, Homo sapiens
gggtcaggaac

SEQ ID NO: 751542 - DNA, 15 bp, Homo sapiens
gggtcaggcagccag

SEQ ID NO: 751543 - DNA, 21 bp, Homo sapiens
gggtcagggccagactggaag

SEQ ID NO: 751544 - DNA, 18 bp, Homo sapiens
gggtcaggtgtcaggccc

SEQ ID NO: 751545 - DNA, 19 bp, Homo sapiens
gggtcaggtgtcaggcccg

SEQ ID NO: 751546 - DNA, 17 bp, Homo sapiens
gggtcaggttcttgcct

SEQ ID NO: 751547 - DNA, 15 bp, Homo sapiens
gggtccaagagacat

SEQ ID NO: 751548 - DNA, 21 bp, Homo sapiens
gggtccaccagtgtgtggggg

SEQ ID NO: 751549 - DNA, 11 bp, Homo sapiens
gggtccaggaa

SEQ ID NO: 751550 - DNA, 16 bp, Homo sapiens
gggtccagggagcagg

SEQ ID NO: 751551 - DNA, 12 bp, Homo sapiens
gggtccagggcc

SEQ ID NO: 751552 - DNA, 14 bp, Homo sapiens
gggtccagggctgt

SEQ ID NO: 751553 - DNA, 11 bp, Homo sapiens
gggtcccaccc

SEQ ID NO: 751554 - DNA, 14 bp, Homo sapiens
gggtcccaccccca

SEQ ID NO: 751555 - DNA, 16 bp, Homo sapiens
gggtcccagccacccc

SEQ ID NO: 751556 - DNA, 22 bp, Homo sapiens
gggtccccatcatcccagctgc

SEQ ID NO: 751557 - DNA, 17 bp, Homo sapiens
gggtcccctccccagct

SEQ ID NO: 751558 - DNA, 14 bp, Homo sapiens
gggtcccctccgcc

SEQ ID NO: 751559 - DNA, 23 bp, Homo sapiens
gggtccctcctctcacctctccc

SEQ ID NO: 751560 - DNA, 11 bp, Homo sapiens
gggtccctgct

SEQ ID NO: 751561 - DNA, 16 bp, Homo sapiens
gggtccgcaccagctg

SEQ ID NO: 751562 - DNA, 14 bp, Homo sapiens
gggtcctagcccag

SEQ ID NO: 751563 - DNA, 14 bp, Homo sapiens
gggtcctagccctt

SEQ ID NO: 751564 - DNA, 15 bp, Homo sapiens
gggtcctagcccttc

SEQ ID NO: 751565 - DNA, 23 bp, Homo sapiens
gggtcctcctaagtcccttccta

SEQ ID NO: 751566 - DNA, 18 bp, Homo sapiens
gggtcctgcagcctgcag

SEQ ID NO: 751567 - DNA, 13 bp, Homo sapiens
gggtcctgcaggg

SEQ ID NO: 751568 - DNA, 13 bp, Homo sapiens
gggtcctgggcag

SEQ ID NO: 751569 - DNA, 13 bp, Homo sapiens
gggtcctgtgcct

SEQ ID NO: 751570 - DNA, 18 bp, Homo sapiens
gggtccttgatgccagag

SEQ ID NO: 751571 - DNA, 15 bp, Homo sapiens
ctgctgccccagctg

SEQ ID NO: 751572 - DNA, 22 bp, Homo sapiens
ctgctgcccccaccccggggac

SEQ ID NO: 751573 - DNA, 16 bp, Homo sapiens
ctgctgcccccttccc

SEQ ID NO: 751574 - DNA, 23 bp, Homo sapiens
ctgctgcccccttccccagccct

SEQ ID NO: 751575 - DNA, 13 bp, Homo sapiens
ctgctgccctcca

SEQ ID NO: 751576 - DNA, 17 bp, Homo sapiens
ctgctgccctccatccc

SEQ ID NO: 751577 - DNA, 14 bp, Homo sapiens
ctgctgccgcctcc

SEQ ID NO: 751578 - DNA, 16 bp, Homo sapiens
ctgctgcctctgtgga

SEQ ID NO: 751579 - DNA, 17 bp, Homo sapiens
ctgctgcctctgtggaa

SEQ ID NO: 751580 - DNA, 21 bp, Homo sapiens
ctgctgcctctttccctagga

SEQ ID NO: 751581 - DNA, 12 bp, Homo sapiens
ctgctgcctggc

SEQ ID NO: 751582 - DNA, 21 bp, Homo sapiens
ctgctgcctggccactgctcc

SEQ ID NO: 751583 - DNA, 13 bp, Homo sapiens
ctgctgccttgtt

SEQ ID NO: 751584 - DNA, 20 bp, Homo sapiens
ctgctgccttttctggagtt

SEQ ID NO: 751585 - DNA, 20 bp, Homo sapiens
ctgctgctattgctgtctgg

SEQ ID NO: 751586 - DNA, 16 bp, Homo sapiens
ctgctgctccccaccc

SEQ ID NO: 751587 - DNA, 15 bp, Homo sapiens
ctgctgctcctcttt

SEQ ID NO: 751588 - DNA, 19 bp, Homo sapiens
ctgctgctcctctttcccc

SEQ ID NO: 751589 - DNA, 17 bp, Homo sapiens
ctgctgctctgaccttc

SEQ ID NO: 751590 - DNA, 19 bp, Homo sapiens
ctgctgctctgaccttcca

SEQ ID NO: 751591 - DNA, 15 bp, Homo sapiens
ctgctgctgcgccct

SEQ ID NO: 751592 - DNA, 14 bp, Homo sapiens
ctgctgctgctgtg

SEQ ID NO: 751593 - DNA, 14 bp, Homo sapiens
gggtctgattttct

SEQ ID NO: 751594 - DNA, 20 bp, Homo sapiens
gggtctgctctttctctgcc

SEQ ID NO: 751595 - DNA, 22 bp, Homo sapiens
gggtctgctctttctctgccag

SEQ ID NO: 751596 - DNA, 18 bp, Homo sapiens
gggtctggactaaccctg

SEQ ID NO: 751597 - DNA, 17 bp, Homo sapiens
gggtctggatgggagga

SEQ ID NO: 751598 - DNA, 15 bp, Homo sapiens
gggtctggcagagcc

SEQ ID NO: 751599 - DNA, 22 bp, Homo sapiens
gggtctggcagagcctctgaga

SEQ ID NO: 751600 - DNA, 15 bp, Homo sapiens
gggtctggctgagct

SEQ ID NO: 751601 - DNA, 13 bp, Homo sapiens
gggtctgggaggg

SEQ ID NO: 751602 - DNA, 21 bp, Homo sapiens
gggtctgggcagtgccacagc

SEQ ID NO: 751603 - DNA, 19 bp, Homo sapiens
gggtctggggacaggcccg

SEQ ID NO: 751604 - DNA, 20 bp, Homo sapiens
gggtctggggacaggcccgc

SEQ ID NO: 751605 - DNA, 15 bp, Homo sapiens
gggtctgggggcagc

SEQ ID NO: 751606 - DNA, 23 bp, Homo sapiens
gggtcttccctacctcaggcagg

SEQ ID NO: 751607 - DNA, 21 bp, Homo sapiens
gggtcttgctatgttgcccaa

SEQ ID NO: 751608 - DNA, 18 bp, Homo sapiens
gggtctttaataaaacaa

SEQ ID NO: 751609 - DNA, 21 bp, Homo sapiens
gggtctttctgatgacgcctg

SEQ ID NO: 751610 - DNA, 14 bp, Homo sapiens
gggtctttcttggg

SEQ ID NO: 751611 - DNA, 19 bp, Homo sapiens
gggtcttttaccctgtgtc

SEQ ID NO: 751612 - DNA, 21 bp, Homo sapiens
gggtcttttcatctgggaaag

SEQ ID NO: 751613 - DNA, 18 bp, Homo sapiens
gggtctttttctcttctg

SEQ ID NO: 751614 - DNA, 20 bp, Homo sapiens
gggtgaacaaagcagccacg

SEQ ID NO: 751615 - DNA, 19 bp, Homo sapiens
gggtgaagagaaccgagca

SEQ ID NO: 751616 - DNA, 17 bp, Homo sapiens
gggtgaagtgaagacaa

SEQ ID NO: 751617 - DNA, 13 bp, Homo sapiens
gggtgacaagata

SEQ ID NO: 751618 - DNA, 19 bp, Homo sapiens
gggtgacagtcctccatcc

SEQ ID NO: 751619 - DNA, 22 bp, Homo sapiens
gggtgaccgactaccccagtcc

SEQ ID NO: 751620 - DNA, 14 bp, Homo sapiens
gggtgacgcccagc

SEQ ID NO: 751621 - DNA, 18 bp, Homo sapiens
gggtgacgcctgagacag

SEQ ID NO: 751622 - DNA, 23 bp, Homo sapiens
gggtgacgcctgagacagcacca

SEQ ID NO: 751623 - DNA, 18 bp, Homo sapiens
gggtgacggccctcatct

SEQ ID NO: 751624 - DNA, 20 bp, Homo sapiens
gggtgactgaatttgggcct

SEQ ID NO: 751625 - DNA, 21 bp, Homo sapiens
gggtgactgaatttgggcctc

SEQ ID NO: 751626 - DNA, 12 bp, Homo sapiens
gggtgagagagg

SEQ ID NO: 751627 - DNA, 13 bp, Homo sapiens
gggtgagagagga

SEQ ID NO: 751628 - DNA, 23 bp, Homo sapiens
gggtgagcagggtcaagcctctt

SEQ ID NO: 751629 - DNA, 11 bp, Homo sapiens
gggtgagccag

SEQ ID NO: 751630 - DNA, 15 bp, Homo sapiens
gggtgaggaccactc

SEQ ID NO: 751631 - DNA, 17 bp, Homo sapiens
gggtgagggtcccatgt

SEQ ID NO: 751632 - DNA, 18 bp, Homo sapiens
gggtgaggtaggcgggaa

SEQ ID NO: 751633 - DNA, 19 bp, Homo sapiens
gggtgagtccattctccca

SEQ ID NO: 751634 - DNA, 16 bp, Homo sapiens
gggtgataaggggcct

SEQ ID NO: 751635 - DNA, 20 bp, Homo sapiens
gggtgatgcttttgctgctg

SEQ ID NO: 751636 - DNA, 23 bp, Homo sapiens
gggtgcaaagactctgagccaag

SEQ ID NO: 751637 - DNA, 14 bp, Homo sapiens
gggtgcacccactc

SEQ ID NO: 751638 - DNA, 14 bp, Homo sapiens
gggtgcagaccctg

SEQ ID NO: 751639 - DNA, 22 bp, Homo sapiens
gggtgcagatggtactgctgag

SEQ ID NO: 751640 - DNA, 19 bp, Homo sapiens
gggtgcagccctcttgccc

SEQ ID NO: 751641 - DNA, 21 bp, Homo sapiens
gggtgcagctgggtggggcag

SEQ ID NO: 751642 - DNA, 12 bp, Homo sapiens
gggtgcaggtgg

SEQ ID NO: 751643 - DNA, 18 bp, Homo sapiens
gggtgcatcctcctcagc

SEQ ID NO: 751644 - DNA, 20 bp, Homo sapiens
gggtgcatcctcctcagccc

SEQ ID NO: 751645 - DNA, 20 bp, Homo sapiens
gggtgcatttgagagaagcc

SEQ ID NO: 751646 - DNA, 21 bp, Homo sapiens
gggtgccccccttgccagaca

SEQ ID NO: 751647 - DNA, 15 bp, Homo sapiens
gggtgccccctcctc

SEQ ID NO: 751648 - DNA, 20 bp, Homo sapiens
gggtgccccgcctgagtcag

SEQ ID NO: 751649 - DNA, 22 bp, Homo sapiens
gggtgccctctgctcaggcctc

SEQ ID NO: 751650 - DNA, 12 bp, Homo sapiens
gggtgccctgaa

SEQ ID NO: 751651 - DNA, 14 bp, Homo sapiens
gggtgcccttttcc

SEQ ID NO: 751652 - DNA, 13 bp, Homo sapiens
gggtgcctcagag

SEQ ID NO: 751653 - DNA, 19 bp, Homo sapiens
gggtgcctcagagcaggct

SEQ ID NO: 751654 - DNA, 16 bp, Homo sapiens
gggtgcctcaggacct

SEQ ID NO: 751655 - DNA, 13 bp, Homo sapiens
gggtgcctcctgc

SEQ ID NO: 751656 - DNA, 12 bp, Homo sapiens
gggtgctcagaa

SEQ ID NO: 751657 - DNA, 17 bp, Homo sapiens
gggtgctctgaggtcaa

SEQ ID NO: 751658 - DNA, 23 bp, Homo sapiens
gggtgctctgaggtcaataaagc

SEQ ID NO: 751659 - DNA, 17 bp, Homo sapiens
gggtgctggcccccagg

SEQ ID NO: 751660 - DNA, 14 bp, Homo sapiens
gggtgctggggcca

SEQ ID NO: 751661 - DNA, 15 bp, Homo sapiens
gggtgctggggccag

SEQ ID NO: 751662 - DNA, 20 bp, Homo sapiens
gggtggacgcaattgtggga

SEQ ID NO: 751663 - DNA, 14 bp, Homo sapiens
gggtggagaagtgt

SEQ ID NO: 751664 - DNA, 22 bp, Homo sapiens
gggtggagactgcttcccatcc

SEQ ID NO: 751665 - DNA, 17 bp, Homo sapiens
gggtggagcactggact

SEQ ID NO: 751666 - DNA, 22 bp, Homo sapiens
gggtggaggaaggtgctgagct

SEQ ID NO: 751667 - DNA, 13 bp, Homo sapiens
gggtggcagcaac

SEQ ID NO: 751668 - DNA, 18 bp, Homo sapiens
gggtggcaggtcactgtc

SEQ ID NO: 751669 - DNA, 20 bp, Homo sapiens
gggtggccacagcgccagcc

SEQ ID NO: 751670 - DNA, 12 bp, Homo sapiens
gggtggccaggg

SEQ ID NO: 751671 - DNA, 13 bp, Homo sapiens
gggtggccagggc

SEQ ID NO: 751672 - DNA, 14 bp, Homo sapiens
gggtggccagggct

SEQ ID NO: 751673 - DNA, 21 bp, Homo sapiens
gggtggccgctgagtggcagg

SEQ ID NO: 751674 - DNA, 11 bp, Homo sapiens
gggtggcctcg

SEQ ID NO: 751675 - DNA, 16 bp, Homo sapiens
gggtggctgccagccc

SEQ ID NO: 751676 - DNA, 19 bp, Homo sapiens
gggtggctttaattgtata

SEQ ID NO: 751677 - DNA, 17 bp, Homo sapiens
gggtggctttcaaggct

SEQ ID NO: 751678 - DNA, 19 bp, Homo sapiens
gggtggctttcaaggctgg

SEQ ID NO: 751679 - DNA, 14 bp, Homo sapiens
gggtgggaagaaag

SEQ ID NO: 751680 - DNA, 15 bp, Homo sapiens
gggtgggaagagaag

SEQ ID NO: 751681 - DNA, 18 bp, Homo sapiens
gggtgggaattggggagg

SEQ ID NO: 751682 - DNA, 12 bp, Homo sapiens
gggtgggacagg

SEQ ID NO: 751683 - DNA, 16 bp, Homo sapiens
gggtgggagagccagc

SEQ ID NO: 751684 - DNA, 20 bp, Homo sapiens
gggtgggagggcgtcaggca

SEQ ID NO: 751685 - DNA, 14 bp, Homo sapiens
gggtgggaggtagg

SEQ ID NO: 751686 - DNA, 15 bp, Homo sapiens
gggtgggcagttttt

SEQ ID NO: 751687 - DNA, 12 bp, Homo sapiens
gggtgggccagc

SEQ ID NO: 751688 - DNA, 13 bp, Homo sapiens
gggtgggccagca

SEQ ID NO: 751689 - DNA, 19 bp, Homo sapiens
gggtgggccaggctgatgg

SEQ ID NO: 751690 - DNA, 15 bp, Homo sapiens
gggtgggcccagaac

SEQ ID NO: 751691 - DNA, 21 bp, Homo sapiens
gggtgggcccagaactgcccc

SEQ ID NO: 751692 - DNA, 14 bp, Homo sapiens
gggtgggcctgact

SEQ ID NO: 751693 - DNA, 12 bp, Homo sapiens
gggtgggcctgg

SEQ ID NO: 751694 - DNA, 13 bp, Homo sapiens
gggtgggcctggc

SEQ ID NO: 751695 - DNA, 14 bp, Homo sapiens
gggtgggcctggcc

SEQ ID NO: 751696 - DNA, 19 bp, Homo sapiens
gggtgggcctggcctgagc

SEQ ID NO: 751697 - DNA, 23 bp, Homo sapiens
gggtgggcctggcctgagctggg

SEQ ID NO: 751698 - DNA, 20 bp, Homo sapiens
gggtgggctgctggccatga

SEQ ID NO: 751699 - DNA, 13 bp, Homo sapiens
gggtgggctgggg

SEQ ID NO: 751700 - DNA, 16 bp, Homo sapiens
gggtgggctggggact

SEQ ID NO: 751701 - DNA, 22 bp, Homo sapiens
gggtggggaatgtttgggcaga

SEQ ID NO: 751702 - DNA, 12 bp, Homo sapiens
gggtggggaggg

SEQ ID NO: 751703 - DNA, 13 bp, Homo sapiens
gggtggggagggt

SEQ ID NO: 751704 - DNA, 14 bp, Homo sapiens
gggtggggcagcac

SEQ ID NO: 751705 - DNA, 23 bp, Homo sapiens
gggtgggggagaaaaaatcactg

SEQ ID NO: 751706 - DNA, 21 bp, Homo sapiens
gggtgggggctgtggccctgc

SEQ ID NO: 751707 - DNA, 16 bp, Homo sapiens
gggtggggtagggctg

SEQ ID NO: 751708 - DNA, 15 bp, Homo sapiens
gggtgggtgctcaga

SEQ ID NO: 751709 - DNA, 16 bp, Homo sapiens
gggtgggtgctcagaa

SEQ ID NO: 751710 - DNA, 18 bp, Homo sapiens
gggtggtattctggtagg

SEQ ID NO: 751711 - DNA, 13 bp, Homo sapiens
gggtggtcctgac

SEQ ID NO: 751712 - DNA, 18 bp, Homo sapiens
gggtggtgctgggactga

SEQ ID NO: 751713 - DNA, 19 bp, Homo sapiens
gggtggtggggaggggcgc

SEQ ID NO: 751714 - DNA, 15 bp, Homo sapiens
gggtggttcagtcac

SEQ ID NO: 751715 - DNA, 22 bp, Homo sapiens
gggtgtaacttcctgctgcacc

SEQ ID NO: 751716 - DNA, 23 bp, Homo sapiens
gggtgtaacttcctgctgcaccc

SEQ ID NO: 751717 - DNA, 15 bp, Homo sapiens
gggtgtattctctgt

SEQ ID NO: 751718 - DNA, 15 bp, Homo sapiens
ctgctgctggatcac

SEQ ID NO: 751719 - DNA, 14 bp, Homo sapiens
ctgctgctgtccct

SEQ ID NO: 751720 - DNA, 17 bp, Homo sapiens
ctgctgctgtgcttttg

SEQ ID NO: 751721 - DNA, 12 bp, Homo sapiens
ctgctgcttctg

SEQ ID NO: 751722 - DNA, 19 bp, Homo sapiens
ctgctgcttctgctccagc

SEQ ID NO: 751723 - DNA, 23 bp, Homo sapiens
ctgctgcttctgctccagcccct

SEQ ID NO: 751724 - DNA, 13 bp, Homo sapiens
ctgctgcttcttg

SEQ ID NO: 751725 - DNA, 14 bp, Homo sapiens
ctgctggaaacaca

SEQ ID NO: 751726 - DNA, 15 bp, Homo sapiens
ctgctggaagcccag

SEQ ID NO: 751727 - DNA, 22 bp, Homo sapiens
ctgctggaagctgtcaggctgg

SEQ ID NO: 751728 - DNA, 16 bp, Homo sapiens
ctgctggaggagggga

SEQ ID NO: 751729 - DNA, 22 bp, Homo sapiens
ctgctggaggaggggaagctgg

SEQ ID NO: 751730 - DNA, 23 bp, Homo sapiens
ctgctggaggaggggaagctggg

SEQ ID NO: 751731 - DNA, 16 bp, Homo sapiens
ctgctggaggcctcag

SEQ ID NO: 751732 - DNA, 14 bp, Homo sapiens
ctgctggatcttgc

SEQ ID NO: 751733 - DNA, 16 bp, Homo sapiens
ctgctggatcttgcct

SEQ ID NO: 751734 - DNA, 14 bp, Homo sapiens
ctgctggcacccac

SEQ ID NO: 751735 - DNA, 12 bp, Homo sapiens
ctgctggcaggg

SEQ ID NO: 751736 - DNA, 13 bp, Homo sapiens
ctgctggcagggc

SEQ ID NO: 751737 - DNA, 16 bp, Homo sapiens
ctgctggcagggccag

SEQ ID NO: 751738 - DNA, 17 bp, Homo sapiens
ctgctggcagggccagg

SEQ ID NO: 751739 - DNA, 22 bp, Homo sapiens
ctgctggcatcaggtctgggca

SEQ ID NO: 751740 - DNA, 23 bp, Homo sapiens
ctgctggccatgaatctctgcct

SEQ ID NO: 751741 - DNA, 11 bp, Homo sapiens
ctgctggcccc

SEQ ID NO: 751742 - DNA, 16 bp, Homo sapiens
ctgctggcccctcacc

SEQ ID NO: 751743 - DNA, 12 bp, Homo sapiens
ctgctggcctgg

SEQ ID NO: 751744 - DNA, 14 bp, Homo sapiens
ctgctggcctggat

SEQ ID NO: 751745 - DNA, 15 bp, Homo sapiens
ctgctggctgcctta

SEQ ID NO: 751746 - DNA, 15 bp, Homo sapiens
ctgctggctgcggcc

SEQ ID NO: 751747 - DNA, 19 bp, Homo sapiens
ctgctggctgcggccccct

SEQ ID NO: 751748 - DNA, 18 bp, Homo sapiens
ctgctggcttcagggagg

SEQ ID NO: 751749 - DNA, 14 bp, Homo sapiens
ctgctggcttgcag

SEQ ID NO: 751750 - DNA, 16 bp, Homo sapiens
ctgctggcttgcagtg

SEQ ID NO: 751751 - DNA, 21 bp, Homo sapiens
ctgctgggaacacttgcattt

SEQ ID NO: 751752 - DNA, 18 bp, Homo sapiens
ctgctgggaaccccgcag

SEQ ID NO: 751753 - DNA, 23 bp, Homo sapiens
ctgctgggaacctagcacacctg

SEQ ID NO: 751754 - DNA, 12 bp, Homo sapiens
ctgctgggactg

SEQ ID NO: 751755 - DNA, 17 bp, Homo sapiens
ctgctgggactggccag

SEQ ID NO: 751756 - DNA, 18 bp, Homo sapiens
ctgctgggagcagaacag

SEQ ID NO: 751757 - DNA, 21 bp, Homo sapiens
ctgctgggcgtgtgtgacact

SEQ ID NO: 751758 - DNA, 21 bp, Homo sapiens
ctgctgggctctccacctcag

SEQ ID NO: 751759 - DNA, 15 bp, Homo sapiens
ctgctggggagacaa

SEQ ID NO: 751760 - DNA, 12 bp, Homo sapiens
ctgctggggagt

SEQ ID NO: 751761 - DNA, 14 bp, Homo sapiens
ctgctggggagtcc

SEQ ID NO: 751762 - DNA, 15 bp, Homo sapiens
ctgctggggcatgtg

SEQ ID NO: 751763 - DNA, 20 bp, Homo sapiens
ctgctggggcatgtgtgcct

SEQ ID NO: 751764 - DNA, 23 bp, Homo sapiens
ctgctggggctaagcggtggagg

SEQ ID NO: 751765 - DNA, 17 bp, Homo sapiens
ctgctggggctgaacat

SEQ ID NO: 751766 - DNA, 16 bp, Homo sapiens
ctgctggtaacagtgg

SEQ ID NO: 751767 - DNA, 16 bp, Homo sapiens
ctgctggtccgtggga

SEQ ID NO: 751768 - DNA, 17 bp, Homo sapiens
ctgctggtccgtgggac

SEQ ID NO: 751769 - DNA, 14 bp, Homo sapiens
ctgctggtcttcaa

SEQ ID NO: 751770 - DNA, 21 bp, Homo sapiens
ctgctggttttaacaactgtg

SEQ ID NO: 751771 - DNA, 17 bp, Homo sapiens
ctgctgtaactgctgag

SEQ ID NO: 751772 - DNA, 21 bp, Homo sapiens
ctgctgtaactgctgagccac

SEQ ID NO: 751773 - DNA, 14 bp, Homo sapiens
ctgctgtatgtgag

SEQ ID NO: 751774 - DNA, 16 bp, Homo sapiens
ctgctgtatgtgagct

SEQ ID NO: 751775 - DNA, 16 bp, Homo sapiens
ctgctgtatttatagt

SEQ ID NO: 751776 - DNA, 11 bp, Homo sapiens
ctgctgtcaat

SEQ ID NO: 751777 - DNA, 15 bp, Homo sapiens
ctgctgtcaataaat

SEQ ID NO: 751778 - DNA, 16 bp, Homo sapiens
ctgctgtcaataaatg

SEQ ID NO: 751779 - DNA, 19 bp, Homo sapiens
ctgctgtcaataaatgaca

SEQ ID NO: 751780 - DNA, 23 bp, Homo sapiens
ctgctgtcaataaatgacaccca

SEQ ID NO: 751781 - DNA, 21 bp, Homo sapiens
ctgctgtccacatgacctcca

SEQ ID NO: 751782 - DNA, 22 bp, Homo sapiens
ctgctgtccacatgacctccat

SEQ ID NO: 751783 - DNA, 13 bp, Homo sapiens
ctgctgtccctgt

SEQ ID NO: 751784 - DNA, 16 bp, Homo sapiens
ctgctgtcctctcccc

SEQ ID NO: 751785 - DNA, 14 bp, Homo sapiens
ctgctgtcctttta

SEQ ID NO: 751786 - DNA, 14 bp, Homo sapiens
ctgctgtctctctg

SEQ ID NO: 751787 - DNA, 16 bp, Homo sapiens
ctgctgtctctctggg

SEQ ID NO: 751788 - DNA, 17 bp, Homo sapiens
ctgctgtctctctgggc

SEQ ID NO: 751789 - DNA, 12 bp, Homo sapiens
ctgctgtcttcc

SEQ ID NO: 751790 - DNA, 17 bp, Homo sapiens
ctgctgtgaaccctggg

SEQ ID NO: 751791 - DNA, 22 bp, Homo sapiens
ctgctgtgaaccctggggcctg

SEQ ID NO: 751792 - DNA, 22 bp, Homo sapiens
ctgctgtgatgccgtcctgctg

SEQ ID NO: 751793 - DNA, 17 bp, Homo sapiens
ctgctgtgccatgctgg

SEQ ID NO: 751794 - DNA, 19 bp, Homo sapiens
ctgctgtgccatgctgggc

SEQ ID NO: 751795 - DNA, 23 bp, Homo sapiens
ctgctgtgccatgctgggccact

SEQ ID NO: 751796 - DNA, 21 bp, Homo sapiens
ctgctgtgcccagcctccatg

SEQ ID NO: 751797 - DNA, 17 bp, Homo sapiens
ctgctgtgccccaccac

SEQ ID NO: 751798 - DNA, 21 bp, Homo sapiens
ctgctgtgccccaccacgtct

SEQ ID NO: 751799 - DNA, 19 bp, Homo sapiens
ctgctgtgctctggggatt

SEQ ID NO: 751800 - DNA, 18 bp, Homo sapiens
ctgctgtggccccctgtc

SEQ ID NO: 751801 - DNA, 23 bp, Homo sapiens
ctgctgtggggtatacagcattg

SEQ ID NO: 751802 - DNA, 22 bp, Homo sapiens
ctgctgtggtctataaaataaa

SEQ ID NO: 751803 - DNA, 22 bp, Homo sapiens
ctgctgtgtgctttttttgtgt

SEQ ID NO: 751804 - DNA, 14 bp, Homo sapiens
ctgctgtgtgtgag

SEQ ID NO: 751805 - DNA, 23 bp, Homo sapiens
ctgctgtgtgtgagcagtggaca

SEQ ID NO: 751806 - DNA, 23 bp, Homo sapiens
ctgctgttctcaggacagcatcc

SEQ ID NO: 751807 - DNA, 18 bp, Homo sapiens
ctgcttaaacttgaccca

SEQ ID NO: 751808 - DNA, 22 bp, Homo sapiens
ctgcttaaagttggtattaata

SEQ ID NO: 751809 - DNA, 18 bp, Homo sapiens
ctgcttaaagttgtaaca

SEQ ID NO: 751810 - DNA, 20 bp, Homo sapiens
ctgcttaacttcacatattg

SEQ ID NO: 751811 - DNA, 16 bp, Homo sapiens
ctgcttaatcctaccc

SEQ ID NO: 751812 - DNA, 20 bp, Homo sapiens
ctgcttacaattccctgctg

SEQ ID NO: 751813 - DNA, 22 bp, Homo sapiens
ctgcttacaattccctgctgtc

SEQ ID NO: 751814 - DNA, 19 bp, Homo sapiens
ctgcttactaatgtgcccc

SEQ ID NO: 751815 - DNA, 15 bp, Homo sapiens
ggtacagacatggag

SEQ ID NO: 751816 - DNA, 16 bp, Homo sapiens
ggtacagcgcggagga

SEQ ID NO: 751817 - DNA, 12 bp, Homo sapiens
ggtacagtttgg

SEQ ID NO: 751818 - DNA, 17 bp, Homo sapiens
ggtacatggcccgcagt

SEQ ID NO: 751819 - DNA, 14 bp, Homo sapiens
ggtacatttctctg

SEQ ID NO: 751820 - DNA, 14 bp, Homo sapiens
ggtaccactgattt

SEQ ID NO: 751821 - DNA, 21 bp, Homo sapiens
ggtaccagcagaaaggttagt

SEQ ID NO: 751822 - DNA, 20 bp, Homo sapiens
ggtacccagccatctgccca

SEQ ID NO: 751823 - DNA, 21 bp, Homo sapiens
ggtacccagccatctgcccag

SEQ ID NO: 751824 - DNA, 16 bp, Homo sapiens
ggtaccttcagccctg

SEQ ID NO: 751825 - DNA, 18 bp, Homo sapiens
ggtaccttcagccctggc

SEQ ID NO: 751826 - DNA, 18 bp, Homo sapiens
ggtacctttctagcctta

SEQ ID NO: 751827 - DNA, 13 bp, Homo sapiens
ggtactaccccag

SEQ ID NO: 751828 - DNA, 23 bp, Homo sapiens
ggtactataaaagctttctgcca

SEQ ID NO: 751829 - DNA, 14 bp, Homo sapiens
ggtactatatttgc

SEQ ID NO: 751830 - DNA, 21 bp, Homo sapiens
ggtactcgttggatgtctgtg

SEQ ID NO: 751831 - DNA, 14 bp, Homo sapiens
ggtactgagacagg

SEQ ID NO: 751832 - DNA, 19 bp, Homo sapiens
ggtactgcattctctccca

SEQ ID NO: 751833 - DNA, 22 bp, Homo sapiens
ggtactgcattctctcccatcc

SEQ ID NO: 751834 - DNA, 12 bp, Homo sapiens
ggtactgctgag

SEQ ID NO: 751835 - DNA, 17 bp, Homo sapiens
ggtactgctgtcttcca

SEQ ID NO: 751836 - DNA, 14 bp, Homo sapiens
ggtactgtagcagg

SEQ ID NO: 751837 - DNA, 14 bp, Homo sapiens
ggtacttcctcctg

SEQ ID NO: 751838 - DNA, 15 bp, Homo sapiens
ggtacttcctcctga

SEQ ID NO: 751839 - DNA, 23 bp, Homo sapiens
ggtacttttatgatgtatattta

SEQ ID NO: 751840 - DNA, 20 bp, Homo sapiens
ggtagaaaaattattagaac

SEQ ID NO: 751841 - DNA, 22 bp, Homo sapiens
ggtagaaaaattattagaacat

SEQ ID NO: 751842 - DNA, 20 bp, Homo sapiens
ggtagaaagagatacagagg

SEQ ID NO: 751843 - DNA, 11 bp, Homo sapiens
ggtagaagcca

SEQ ID NO: 751844 - DNA, 14 bp, Homo sapiens
ggtagaagtagttt

SEQ ID NO: 751845 - DNA, 14 bp, Homo sapiens
ggtagaagtgagag

SEQ ID NO: 751846 - DNA, 14 bp, Homo sapiens
ctgcttctctttgt

SEQ ID NO: 751847 - DNA, 13 bp, Homo sapiens
ctgcttctctttt

SEQ ID NO: 751848 - DNA, 18 bp, Homo sapiens
ctgcttctgctccagccc

SEQ ID NO: 751849 - DNA, 22 bp, Homo sapiens
ctgcttctgtgtaccacttctg

SEQ ID NO: 751850 - DNA, 18 bp, Homo sapiens
ctgcttcttctctccaca

SEQ ID NO: 751851 - DNA, 18 bp, Homo sapiens
ctgcttgacagactcaag

SEQ ID NO: 751852 - DNA, 12 bp, Homo sapiens
ctgcttgaggaa

SEQ ID NO: 751853 - DNA, 20 bp, Homo sapiens
ctgcttgaggcaactcatct

SEQ ID NO: 751854 - DNA, 21 bp, Homo sapiens
ctgcttgaggcaactcatctt

SEQ ID NO: 751855 - DNA, 16 bp, Homo sapiens
ctgcttgatgaagcaa

SEQ ID NO: 751856 - DNA, 20 bp, Homo sapiens
ctgcttgatgaagcaaggaa

SEQ ID NO: 751857 - DNA, 13 bp, Homo sapiens
ctgcttgattttt

SEQ ID NO: 751858 - DNA, 18 bp, Homo sapiens
ctgcttgcacacttcccc

SEQ ID NO: 751859 - DNA, 14 bp, Homo sapiens
ctgcttgcagccag

SEQ ID NO: 751860 - DNA, 15 bp, Homo sapiens
ctgcttgcagccagg

SEQ ID NO: 751861 - DNA, 16 bp, Homo sapiens
ctgcttgcagccagga

SEQ ID NO: 751862 - DNA, 17 bp, Homo sapiens
ctgcttgcagccaggag

SEQ ID NO: 751863 - DNA, 21 bp, Homo sapiens
ctgcttgccaaggcagaggcc

SEQ ID NO: 751864 - DNA, 14 bp, Homo sapiens
ctgcttgcctagcc

SEQ ID NO: 751865 - DNA, 20 bp, Homo sapiens
ctgcttgcttgctttttaat

SEQ ID NO: 751866 - DNA, 17 bp, Homo sapiens
ctgcttgcttttgcctc

SEQ ID NO: 751867 - DNA, 13 bp, Homo sapiens
ctgcttggccaga

SEQ ID NO: 751868 - DNA, 22 bp, Homo sapiens
ctgcttgggacgtgtacagcac

SEQ ID NO: 751869 - DNA, 23 bp, Homo sapiens
ctgcttggtctttcattgctaag

SEQ ID NO: 751870 - DNA, 19 bp, Homo sapiens
ctgcttgtactaagccagg

SEQ ID NO: 751871 - DNA, 23 bp, Homo sapiens
ctgcttgtactaagccaggaggc

SEQ ID NO: 751872 - DNA, 16 bp, Homo sapiens
ctgcttgtcctgctct

SEQ ID NO: 751873 - DNA, 14 bp, Homo sapiens
ctgcttgtgcctcc

SEQ ID NO: 751874 - DNA, 16 bp, Homo sapiens
ctgcttgtgcctccct

SEQ ID NO: 751875 - DNA, 19 bp, Homo sapiens
ctgcttgtgcctcccttcc

SEQ ID NO: 751876 - DNA, 19 bp, Homo sapiens
ctgctttaaagggcctgcc

SEQ ID NO: 751877 - DNA, 13 bp, Homo sapiens
ctgctttaatcag

SEQ ID NO: 751878 - DNA, 16 bp, Homo sapiens
ctgctttatcttttca

SEQ ID NO: 751879 - DNA, 21 bp, Homo sapiens
ctgctttcacttaagtgtctg

SEQ ID NO: 751880 - DNA, 17 bp, Homo sapiens
ctgctttcccctgtggg

SEQ ID NO: 751881 - DNA, 16 bp, Homo sapiens
ctgctttctgttgtca

SEQ ID NO: 751882 - DNA, 13 bp, Homo sapiens
ctgctttgaataa

SEQ ID NO: 751883 - DNA, 23 bp, Homo sapiens
ctgctttgagctacaggacaaag

SEQ ID NO: 751884 - DNA, 14 bp, Homo sapiens
ctgctttgcaaaga

SEQ ID NO: 751885 - DNA, 22 bp, Homo sapiens
ctgctttgccaagttgctgtca

SEQ ID NO: 751886 - DNA, 21 bp, Homo sapiens
ctgctttgcgtgcccggggca

SEQ ID NO: 751887 - DNA, 23 bp, Homo sapiens
ctgctttgcgtgcccggggcagc

SEQ ID NO: 751888 - DNA, 17 bp, Homo sapiens
ctgctttggcctttcct

SEQ ID NO: 751889 - DNA, 20 bp, Homo sapiens
ctgctttgggaagccgtgct

SEQ ID NO: 751890 - DNA, 22 bp, Homo sapiens
ctgctttgggctgccctggtgc

SEQ ID NO: 751891 - DNA, 14 bp, Homo sapiens
ctgctttgtccagg

SEQ ID NO: 751892 - DNA, 13 bp, Homo sapiens
ctgctttgtgcat

SEQ ID NO: 751893 - DNA, 14 bp, Homo sapiens
ctgctttgtgggct

SEQ ID NO: 751894 - DNA, 17 bp, Homo sapiens
ctgcttttaactctaga

SEQ ID NO: 751895 - DNA, 14 bp, Homo sapiens
ctgcttttaccatg

SEQ ID NO: 751896 - DNA, 24 bp, Homo sapiens
ctgcttttaggagaattcacagaa

SEQ ID NO: 751897 - DNA, 23 bp, Homo sapiens
ctgcttttcattagcagttgctc

SEQ ID NO: 751898 - DNA, 16 bp, Homo sapiens
ctgcttttccaggatc

SEQ ID NO: 751899 - DNA, 18 bp, Homo sapiens
ctgcttttccctttgtga

SEQ ID NO: 751900 - DNA, 19 bp, Homo sapiens
ctgcttttccctttgtgag

SEQ ID NO: 751901 - DNA, 22 bp, Homo sapiens
ctgcttttccctttgtgagtca

SEQ ID NO: 751902 - DNA, 20 bp, Homo sapiens
ctgcttttcctcaagcaata

SEQ ID NO: 751903 - DNA, 20 bp, Homo sapiens
ctgcttttctgccctggctg

SEQ ID NO: 751904 - DNA, 24 bp, Homo sapiens
ctgcttttctgccctggctgctgc

SEQ ID NO: 751905 - DNA, 12 bp, Homo sapiens
ctgcttttctgt

SEQ ID NO: 751906 - DNA, 13 bp, Homo sapiens
ctgcttttctgtc

SEQ ID NO: 751907 - DNA, 11 bp, Homo sapiens
ctgcttttctt

SEQ ID NO: 751908 - DNA, 13 bp, Homo sapiens
ctgcttttcttaa

SEQ ID NO: 751909 - DNA, 19 bp, Homo sapiens
ctgcttttgatgatgtcta

SEQ ID NO: 751910 - DNA, 22 bp, Homo sapiens
ctgctttttaaagaatgctctt

SEQ ID NO: 751911 - DNA, 22 bp, Homo sapiens
ctgctttttccaactcagaaat

SEQ ID NO: 751912 - DNA, 16 bp, Homo sapiens
ctgctttttggaaagt

SEQ ID NO: 751913 - DNA, 17 bp, Homo sapiens
ctgctttttttcttaaa

SEQ ID NO: 751914 - DNA, 19 bp, Homo sapiens
ctgctttttttcttaaaag

SEQ ID NO: 751915 - DNA, 21 bp, Homo sapiens
ctgcttttttttttccagcaa

SEQ ID NO: 751916 - DNA, 22 bp, Homo sapiens
ctgcttttttttttccagcaag

SEQ ID NO: 751917 - DNA, 23 bp, Homo sapiens
ctgcttttttttttccagcaagt

SEQ ID NO: 751918 - DNA, 17 bp, Homo sapiens
ctggaaaaaaaatatat

SEQ ID NO: 751919 - DNA, 15 bp, Homo sapiens
ctggaaaaaaataca

SEQ ID NO: 751920 - DNA, 22 bp, Homo sapiens
ctggaaaaaaatacaaaaagca

SEQ ID NO: 751921 - DNA, 14 bp, Homo sapiens
ctggaaaacagaac

SEQ ID NO: 751922 - DNA, 16 bp, Homo sapiens
ctggaaaacagaacac

SEQ ID NO: 751923 - DNA, 19 bp, Homo sapiens
ctggaaaacagacgggtct

SEQ ID NO: 751924 - DNA, 21 bp, Homo sapiens
ctggaaaactattgagccttg

SEQ ID NO: 751925 - DNA, 23 bp, Homo sapiens
ctggaaaagaagaaactttgcct

SEQ ID NO: 751926 - DNA, 15 bp, Homo sapiens
ctggaaaagaggagt

SEQ ID NO: 751927 - DNA, 22 bp, Homo sapiens
ctggaaaagggtcttgggaaat

SEQ ID NO: 751928 - DNA, 19 bp, Homo sapiens
ctggaaaagtgatgtattt

SEQ ID NO: 751929 - DNA, 16 bp, Homo sapiens
ctggaaacacagtcac

SEQ ID NO: 751930 - DNA, 17 bp, Homo sapiens
ctggaaacacagtcact

SEQ ID NO: 751931 - DNA, 14 bp, Homo sapiens
ctggaaaccaagtc

SEQ ID NO: 751932 - DNA, 16 bp, Homo sapiens
ctggaaacctctggag

SEQ ID NO: 751933 - DNA, 19 bp, Homo sapiens
ctggaaagaggctctggac

SEQ ID NO: 751934 - DNA, 21 bp, Homo sapiens
ctggaaaggctcagtctcagg

SEQ ID NO: 751935 - DNA, 23 bp, Homo sapiens
ctggaaaggctcagtctcaggag

SEQ ID NO: 751936 - DNA, 16 bp, Homo sapiens
ctggactccggaggac

SEQ ID NO: 751937 - DNA, 18 bp, Homo sapiens
ctggactccggaggactg

SEQ ID NO: 751938 - DNA, 22 bp, Homo sapiens
ctggactccggaggactgagcc

SEQ ID NO: 751939 - DNA, 18 bp, Homo sapiens
ctggactccggccctcct

SEQ ID NO: 751940 - DNA, 17 bp, Homo sapiens
ctggactcctctgtcca

SEQ ID NO: 751941 - DNA, 15 bp, Homo sapiens
ctggactctgcatcc

SEQ ID NO: 751942 - DNA, 24 bp, Homo sapiens
ctggactctgcatcccagcacctg

SEQ ID NO: 751943 - DNA, 13 bp, Homo sapiens
ctggactctgccc

SEQ ID NO: 751944 - DNA, 16 bp, Homo sapiens
ctggactctggacttt

SEQ ID NO: 751945 - DNA, 19 bp, Homo sapiens
ctggactgaagcctgcagg

SEQ ID NO: 751946 - DNA, 15 bp, Homo sapiens
ctggactgacagcat

SEQ ID NO: 751947 - DNA, 21 bp, Homo sapiens
ctggactgaccctgcaggttg

SEQ ID NO: 751948 - DNA, 23 bp, Homo sapiens
ctggactgagccaaggaggcctg

SEQ ID NO: 751949 - DNA, 19 bp, Homo sapiens
ctggactggaggcccctgg

SEQ ID NO: 751950 - DNA, 22 bp, Homo sapiens
ctggactggaggtgggcatgcc

SEQ ID NO: 751951 - DNA, 13 bp, Homo sapiens
ctggactggccat

SEQ ID NO: 751952 - DNA, 20 bp, Homo sapiens
ctggactggcctgtctggcc

SEQ ID NO: 751953 - DNA, 14 bp, Homo sapiens
ctggactgggaggt

SEQ ID NO: 751954 - DNA, 19 bp, Homo sapiens
ctggactgtcatagaaatt

SEQ ID NO: 751955 - DNA, 14 bp, Homo sapiens
ctggactgttccag

SEQ ID NO: 751956 - DNA, 15 bp, Homo sapiens
ctggactgttccagg

SEQ ID NO: 751957 - DNA, 16 bp, Homo sapiens
ctggactgttccaggc

SEQ ID NO: 751958 - DNA, 18 bp, Homo sapiens
ctggacttaagcatctgg

SEQ ID NO: 751959 - DNA, 19 bp, Homo sapiens
ctggacttacaaaatgcca

SEQ ID NO: 751960 - DNA, 15 bp, Homo sapiens
ctggacttctacctg

SEQ ID NO: 751961 - DNA, 20 bp, Homo sapiens
ctggacttgagcttggcagc

SEQ ID NO: 751962 - DNA, 19 bp, Homo sapiens
ctggactttaaaaaaacaa

SEQ ID NO: 751963 - DNA, 20 bp, Homo sapiens
ctggactttaaaaaaacaat

SEQ ID NO: 751964 - DNA, 18 bp, Homo sapiens
ctggagaaaaaggtgcca

SEQ ID NO: 751965 - DNA, 18 bp, Homo sapiens
ctggagaagctcacccaa

SEQ ID NO: 751966 - DNA, 20 bp, Homo sapiens
ctggagaagctcccaggaac

SEQ ID NO: 751967 - DNA, 22 bp, Homo sapiens
ctggagaagctcccaggaacaa

SEQ ID NO: 751968 - DNA, 15 bp, Homo sapiens
ctggagaagctgatg

SEQ ID NO: 751969 - DNA, 22 bp, Homo sapiens
ctggagaagtcttagacttgaa

SEQ ID NO: 751970 - DNA, 16 bp, Homo sapiens
ctggagacaaggtgct

SEQ ID NO: 751971 - DNA, 18 bp, Homo sapiens
ctggagacaaggtgctaa

SEQ ID NO: 751972 - DNA, 13 bp, Homo sapiens
ctggagaccacac

SEQ ID NO: 751973 - DNA, 17 bp, Homo sapiens
ctggagaccagggagcc

SEQ ID NO: 751974 - DNA, 22 bp, Homo sapiens
ctggagacccccccccaactcc

SEQ ID NO: 751975 - DNA, 20 bp, Homo sapiens
ggtcagggctcagagtgacc

SEQ ID NO: 751976 - DNA, 16 bp, Homo sapiens
ggtcaggggctcccta

SEQ ID NO: 751977 - DNA, 12 bp, Homo sapiens
ggtcaggtcccc

SEQ ID NO: 751978 - DNA, 18 bp, Homo sapiens
ggtcaggtgtcaggcccg

SEQ ID NO: 751979 - DNA, 19 bp, Homo sapiens
ggtcaggtgttcaagacca

SEQ ID NO: 751980 - DNA, 16 bp, Homo sapiens
ggtcaggttcttgcct

SEQ ID NO: 751981 - DNA, 17 bp, Homo sapiens
ggtcaggttcttgcctt

SEQ ID NO: 751982 - DNA, 14 bp, Homo sapiens
ggtcaggtttaaca

SEQ ID NO: 751983 - DNA, 18 bp, Homo sapiens
ggtcaggtttaacatttg

SEQ ID NO: 751984 - DNA, 19 bp, Homo sapiens
ggtcaggtttaacatttgc

SEQ ID NO: 751985 - DNA, 18 bp, Homo sapiens
ggtcagtctttgctcagt

SEQ ID NO: 751986 - DNA, 12 bp, Homo sapiens
ggtcagtgcctt

SEQ ID NO: 751987 - DNA, 13 bp, Homo sapiens
ggtcagtgccttt

SEQ ID NO: 751988 - DNA, 21 bp, Homo sapiens
ggtcagtgctgcctgtcccca

SEQ ID NO: 751989 - DNA, 15 bp, Homo sapiens
ggtcagtgtggagag

SEQ ID NO: 751990 - DNA, 15 bp, Homo sapiens
ggtcagttgtaataa

SEQ ID NO: 751991 - DNA, 23 bp, Homo sapiens
ggtcataaatcagaaagtttaga

SEQ ID NO: 751992 - DNA, 23 bp, Homo sapiens
ggtcatagcccagatcagctcct

SEQ ID NO: 751993 - DNA, 21 bp, Homo sapiens
ggtcatcagatgcctgcttga

SEQ ID NO: 751994 - DNA, 15 bp, Homo sapiens
ggtcatgaagggctg

SEQ ID NO: 751995 - DNA, 17 bp, Homo sapiens
ggtcatgcagttcctgg

SEQ ID NO: 751996 - DNA, 14 bp, Homo sapiens
ggtcatgtgtgcat

SEQ ID NO: 751997 - DNA, 15 bp, Homo sapiens
ggtcattgagggacc

SEQ ID NO: 751998 - DNA, 21 bp, Homo sapiens
ggtcattgagggaccaaaaaa

SEQ ID NO: 751999 - DNA, 21 bp, Homo sapiens
ggtccaaaaaaaggaaaaata

SEQ ID NO: 752000 - DNA, 14 bp, Homo sapiens
ggtccaagagacat

SEQ ID NO: 752001 - DNA, 14 bp, Homo sapiens
ggtccaagggccat

SEQ ID NO: 752002 - DNA, 12 bp, Homo sapiens
ggtccactgtgt

SEQ ID NO: 752003 - DNA, 13 bp, Homo sapiens
ggtccactgtgtt

SEQ ID NO: 752004 - DNA, 18 bp, Homo sapiens
ggtccagagaccacacca

SEQ ID NO: 752005 - DNA, 12 bp, Homo sapiens
ggtccagctctg

SEQ ID NO: 752006 - DNA, 15 bp, Homo sapiens
ggtccagctctgaca

SEQ ID NO: 752007 - DNA, 15 bp, Homo sapiens
ggtccagctctggag

SEQ ID NO: 752008 - DNA, 15 bp, Homo sapiens
ggtccagctggcctg

SEQ ID NO: 752009 - DNA, 17 bp, Homo sapiens
ggtccagcttgctcttc

SEQ ID NO: 752010 - DNA, 18 bp, Homo sapiens
ggtccagcttgctcttca

SEQ ID NO: 752011 - DNA, 14 bp, Homo sapiens
ggtccaggaaggca

SEQ ID NO: 752012 - DNA, 21 bp, Homo sapiens
ggtccaggaaggcagctgctc

SEQ ID NO: 752013 - DNA, 19 bp, Homo sapiens
ggtccaggccagtgggcct

SEQ ID NO: 752014 - DNA, 20 bp, Homo sapiens
ggtccaggccagtgggcctg

SEQ ID NO: 752015 - DNA, 12 bp, Homo sapiens
ggtccaggcccg

SEQ ID NO: 752016 - DNA, 14 bp, Homo sapiens
ggtccagggcctga

SEQ ID NO: 752017 - DNA, 15 bp, Homo sapiens
ggtccagggcctgac

SEQ ID NO: 752018 - DNA, 22 bp, Homo sapiens
ggtccagggcctgacaccccct

SEQ ID NO: 752019 - DNA, 12 bp, Homo sapiens
ggtccagggcta

SEQ ID NO: 752020 - DNA, 18 bp, Homo sapiens
ggtccagtggatgccaca

SEQ ID NO: 752021 - DNA, 13 bp, Homo sapiens
ggtccatgggcag

SEQ ID NO: 752022 - DNA, 16 bp, Homo sapiens
ggtccatgggcagagc

SEQ ID NO: 752023 - DNA, 18 bp, Homo sapiens
ggtccatttgttcctgct

SEQ ID NO: 752024 - DNA, 16 bp, Homo sapiens
ggtcccacccccaacc

SEQ ID NO: 752025 - DNA, 16 bp, Homo sapiens
ggtcccacctccagcc

SEQ ID NO: 752026 - DNA, 22 bp, Homo sapiens
ggtcccacgaatttgctgggga

SEQ ID NO: 752027 - DNA, 20 bp, Homo sapiens
ggtcccagcgagccacagga

SEQ ID NO: 752028 - DNA, 20 bp, Homo sapiens
ggtcccaggaagcagggaga

SEQ ID NO: 752029 - DNA, 14 bp, Homo sapiens
ggtcccaggaagcc

SEQ ID NO: 752030 - DNA, 12 bp, Homo sapiens
ggtcccagggct

SEQ ID NO: 752031 - DNA, 15 bp, Homo sapiens
ggtcccagtgggagg

SEQ ID NO: 752032 - DNA, 20 bp, Homo sapiens
ggtcccagtgggaggggcag

SEQ ID NO: 752033 - DNA, 21 bp, Homo sapiens
ggtcccagtgggaggggcagg

SEQ ID NO: 752034 - DNA, 12 bp, Homo sapiens
ggtcccatccag

SEQ ID NO: 752035 - DNA, 16 bp, Homo sapiens
ggtcccattgtgcaga

SEQ ID NO: 752036 - DNA, 16 bp, Homo sapiens
ggtccccacctgggac

SEQ ID NO: 752037 - DNA, 20 bp, Homo sapiens
ggtccccactgctgagctgg

SEQ ID NO: 752038 - DNA, 18 bp, Homo sapiens
ggtccccatcatcccagc

SEQ ID NO: 752039 - DNA, 14 bp, Homo sapiens
ggtccccatcccca

SEQ ID NO: 752040 - DNA, 18 bp, Homo sapiens
ggtcccccgaccaatccc

SEQ ID NO: 752041 - DNA, 23 bp, Homo sapiens
ggtcccccgactgcctgtctcca

SEQ ID NO: 752042 - DNA, 19 bp, Homo sapiens
ggtcccctccacatcccag

SEQ ID NO: 752043 - DNA, 14 bp, Homo sapiens
ggtcccctccccag

SEQ ID NO: 752044 - DNA, 13 bp, Homo sapiens
ggtcccctccccc

SEQ ID NO: 752045 - DNA, 20 bp, Homo sapiens
ggtcccctcccccatcccca

SEQ ID NO: 752046 - DNA, 22 bp, Homo sapiens
ggtcccctccctcgtgggcttg

SEQ ID NO: 752047 - DNA, 20 bp, Homo sapiens
ggtcccgcactctgccccca

SEQ ID NO: 752048 - DNA, 14 bp, Homo sapiens
ggtccctccacccc

SEQ ID NO: 752049 - DNA, 11 bp, Homo sapiens
ggtccctcctc

SEQ ID NO: 752050 - DNA, 12 bp, Homo sapiens
ggtccctctcag

SEQ ID NO: 752051 - DNA, 14 bp, Homo sapiens
ggtccctctgtgta

SEQ ID NO: 752052 - DNA, 14 bp, Homo sapiens
ggtccctcttctct

SEQ ID NO: 752053 - DNA, 13 bp, Homo sapiens
ggtccctgggagg

SEQ ID NO: 752054 - DNA, 23 bp, Homo sapiens
ggtccctgggaggaaatttgaat

SEQ ID NO: 752055 - DNA, 19 bp, Homo sapiens
ggtcccttcaaggcctccc

SEQ ID NO: 752056 - DNA, 22 bp, Homo sapiens
ggtcccttcccgacccagccag

SEQ ID NO: 752057 - DNA, 16 bp, Homo sapiens
ggtccgcaccagctgc

SEQ ID NO: 752058 - DNA, 21 bp, Homo sapiens
ctggaggccttccagctgctg

SEQ ID NO: 752059 - DNA, 17 bp, Homo sapiens
ctggaggcggtgcggca

SEQ ID NO: 752060 - DNA, 19 bp, Homo sapiens
ctggaggcggtgcggcagg

SEQ ID NO: 752061 - DNA, 18 bp, Homo sapiens
ctggaggctggggatggt

SEQ ID NO: 752062 - DNA, 13 bp, Homo sapiens
ctggagggacttt

SEQ ID NO: 752063 - DNA, 16 bp, Homo sapiens
ctggagggacttttaa

SEQ ID NO: 752064 - DNA, 17 bp, Homo sapiens
ctggagggcacttcctc

SEQ ID NO: 752065 - DNA, 14 bp, Homo sapiens
ctggaggggctgtc

SEQ ID NO: 752066 - DNA, 20 bp, Homo sapiens
ctggaggggctgtcctcctt

SEQ ID NO: 752067 - DNA, 20 bp, Homo sapiens
ctggaggggtgtggctcctt

SEQ ID NO: 752068 - DNA, 22 bp, Homo sapiens
ctggaggtcacattcaggaaga

SEQ ID NO: 752069 - DNA, 15 bp, Homo sapiens
ctggaggtgctgctc

SEQ ID NO: 752070 - DNA, 18 bp, Homo sapiens
ctggaggtgctgctctag

SEQ ID NO: 752071 - DNA, 20 bp, Homo sapiens
ctggaggtgctggtagctga

SEQ ID NO: 752072 - DNA, 23 bp, Homo sapiens
ctggaggtgggcatgccaccctc

SEQ ID NO: 752073 - DNA, 15 bp, Homo sapiens
ctggaggtggggttg

SEQ ID NO: 752074 - DNA, 20 bp, Homo sapiens
ctggaggtggggttgggatt

SEQ ID NO: 752075 - DNA, 16 bp, Homo sapiens
ctggaggttgaagcca

SEQ ID NO: 752076 - DNA, 17 bp, Homo sapiens
ctggaggttgaagccaa

SEQ ID NO: 752077 - DNA, 18 bp, Homo sapiens
ctggagtcccaaatgtca

SEQ ID NO: 752078 - DNA, 21 bp, Homo sapiens
ctggagtcccacccggacagg

SEQ ID NO: 752079 - DNA, 16 bp, Homo sapiens
ctggagtcctctccag

SEQ ID NO: 752080 - DNA, 21 bp, Homo sapiens
ctggagtctccagatgttaat

SEQ ID NO: 752081 - DNA, 14 bp, Homo sapiens
ctggagtctccagt

SEQ ID NO: 752082 - DNA, 15 bp, Homo sapiens
ctggagtctccagtg

SEQ ID NO: 752083 - DNA, 15 bp, Homo sapiens
ctggagtctcctgag

SEQ ID NO: 752084 - DNA, 16 bp, Homo sapiens
ctggagtgaggcttcc

SEQ ID NO: 752085 - DNA, 18 bp, Homo sapiens
ctggagtgaggcttccag

SEQ ID NO: 752086 - DNA, 19 bp, Homo sapiens
ctggagtgaggcttccagg

SEQ ID NO: 752087 - DNA, 16 bp, Homo sapiens
ctggagtgagggcctc

SEQ ID NO: 752088 - DNA, 19 bp, Homo sapiens
ctggagtgagggcctcaga

SEQ ID NO: 752089 - DNA, 17 bp, Homo sapiens
ctggagtgcgctcttgg

SEQ ID NO: 752090 - DNA, 24 bp, Homo sapiens
ctggagtgcgctcttggtccctgg

SEQ ID NO: 752091 - DNA, 23 bp, Homo sapiens
ctggagtgctgcttgtgcctccc

SEQ ID NO: 752092 - DNA, 20 bp, Homo sapiens
ctggagtggaaggtctattg

SEQ ID NO: 752093 - DNA, 21 bp, Homo sapiens
ctggagtggaaggtctattgg

SEQ ID NO: 752094 - DNA, 23 bp, Homo sapiens
ctggagtgtcggatcctgtgagt

SEQ ID NO: 752095 - DNA, 22 bp, Homo sapiens
ctggagtgtgcatttcagcttg

SEQ ID NO: 752096 - DNA, 16 bp, Homo sapiens
ctggagttacattaat

SEQ ID NO: 752097 - DNA, 15 bp, Homo sapiens
ctggagttcccaccc

SEQ ID NO: 752098 - DNA, 17 bp, Homo sapiens
ctggagttccggcctgg

SEQ ID NO: 752099 - DNA, 23 bp, Homo sapiens
ctggagttccggcctgggcacca

SEQ ID NO: 752100 - DNA, 18 bp, Homo sapiens
ctggataaaccaccctct

SEQ ID NO: 752101 - DNA, 23 bp, Homo sapiens
ctggataaaccaccctctgggga

SEQ ID NO: 752102 - DNA, 15 bp, Homo sapiens
ctggatactggacac

SEQ ID NO: 752103 - DNA, 23 bp, Homo sapiens
ggtccttgatgccagagggccag

SEQ ID NO: 752104 - DNA, 16 bp, Homo sapiens
ggtccttgcacccctc

SEQ ID NO: 752105 - DNA, 18 bp, Homo sapiens
ggtccttgcctcctggaa

SEQ ID NO: 752106 - DNA, 13 bp, Homo sapiens
ggtccttggcccc

SEQ ID NO: 752107 - DNA, 16 bp, Homo sapiens
ggtccttggccccctt

SEQ ID NO: 752108 - DNA, 22 bp, Homo sapiens
ggtccttggccccctttcccgg

SEQ ID NO: 752109 - DNA, 22 bp, Homo sapiens
ggtcctttacactcaggctttc

SEQ ID NO: 752110 - DNA, 21 bp, Homo sapiens
ggtcctttaggcagcctgccg

SEQ ID NO: 752111 - DNA, 22 bp, Homo sapiens
ggtcgaggagtaacaatacaaa

SEQ ID NO: 752112 - DNA, 13 bp, Homo sapiens
ggtcgcccaggag

SEQ ID NO: 752113 - DNA, 22 bp, Homo sapiens
ggtcgcttactttgagtgatcc

SEQ ID NO: 752114 - DNA, 13 bp, Homo sapiens
ggtcggaaaacat

SEQ ID NO: 752115 - DNA, 17 bp, Homo sapiens
ggtcggaagcctgtcct

SEQ ID NO: 752116 - DNA, 15 bp, Homo sapiens
ggtcggatctcacag

SEQ ID NO: 752117 - DNA, 23 bp, Homo sapiens
ggtcggccgccatagccccagta

SEQ ID NO: 752118 - DNA, 15 bp, Homo sapiens
ggtcggctcctgatg

SEQ ID NO: 752119 - DNA, 20 bp, Homo sapiens
ggtcggtaggttcagccaag

SEQ ID NO: 752120 - DNA, 17 bp, Homo sapiens
ggtcgtctttgtgtatg

SEQ ID NO: 752121 - DNA, 14 bp, Homo sapiens
ggtcgtgggccagt

SEQ ID NO: 752122 - DNA, 13 bp, Homo sapiens
ggtctaatgtttg

SEQ ID NO: 752123 - DNA, 13 bp, Homo sapiens
ggtctataaaata

SEQ ID NO: 752124 - DNA, 16 bp, Homo sapiens
ggtctataaaataaac

SEQ ID NO: 752125 - DNA, 19 bp, Homo sapiens
ggtctataaaataaacttc

SEQ ID NO: 752126 - DNA, 20 bp, Homo sapiens
ggtctatgtcgagagctggc

SEQ ID NO: 752127 - DNA, 22 bp, Homo sapiens
ggtctatgtcgagagctggcca

SEQ ID NO: 752128 - DNA, 16 bp, Homo sapiens
ggtctatgttccccag

SEQ ID NO: 752129 - DNA, 20 bp, Homo sapiens
ggtctcaaggttctcatttc

SEQ ID NO: 752130 - DNA, 16 bp, Homo sapiens
ggtctcatctcttcag

SEQ ID NO: 752131 - DNA, 19 bp, Homo sapiens
ggtctcattgcttctgact

SEQ ID NO: 752132 - DNA, 15 bp, Homo sapiens
ggtctccaaactgat

SEQ ID NO: 752133 - DNA, 16 bp, Homo sapiens
ggtctcccacgtggga

SEQ ID NO: 752134 - DNA, 15 bp, Homo sapiens
ggtctcccctcctgc

SEQ ID NO: 752135 - DNA, 16 bp, Homo sapiens
ggtctcccctcctgca

SEQ ID NO: 752136 - DNA, 19 bp, Homo sapiens
ggtctccctctcctgccta

SEQ ID NO: 752137 - DNA, 15 bp, Homo sapiens
ggtctccctggctcc

SEQ ID NO: 752138 - DNA, 16 bp, Homo sapiens
ggtctccctggctccc

SEQ ID NO: 752139 - DNA, 20 bp, Homo sapiens
ggtctcccttccgtccatcc

SEQ ID NO: 752140 - DNA, 20 bp, Homo sapiens
ggtctcccttctctacactc

SEQ ID NO: 752141 - DNA, 12 bp, Homo sapiens
ggtctcctccca

SEQ ID NO: 752142 - DNA, 17 bp, Homo sapiens
ggtctcctcccagcggc

SEQ ID NO: 752143 - DNA, 18 bp, Homo sapiens
ggtctccttactctgagc

SEQ ID NO: 752144 - DNA, 19 bp, Homo sapiens
ggtctccttactctgagcc

SEQ ID NO: 752145 - DNA, 20 bp, Homo sapiens
ggtctccttactctgagccc

SEQ ID NO: 752146 - DNA, 22 bp, Homo sapiens
ggtctccttactctgagcccag

SEQ ID NO: 752147 - DNA, 14 bp, Homo sapiens
ggtctcgcagcctg

SEQ ID NO: 752148 - DNA, 20 bp, Homo sapiens
ggtctcgctttgttgcccag

SEQ ID NO: 752149 - DNA, 17 bp, Homo sapiens
ggtctcgtcttccgtct

SEQ ID NO: 752150 - DNA, 17 bp, Homo sapiens
ggtctctccctcaggtg

SEQ ID NO: 752151 - DNA, 21 bp, Homo sapiens
ggtctctctccctacctccct

SEQ ID NO: 752152 - DNA, 23 bp, Homo sapiens
ggtctctctccctacctccctcc

SEQ ID NO: 752153 - DNA, 12 bp, Homo sapiens
ggtctctgctgg

SEQ ID NO: 752154 - DNA, 19 bp, Homo sapiens
ggtctctgctggggaaggg

SEQ ID NO: 752155 - DNA, 20 bp, Homo sapiens
ggtctctgctggggaagggt

SEQ ID NO: 752156 - DNA, 13 bp, Homo sapiens
ggtctctggggac

SEQ ID NO: 752157 - DNA, 21 bp, Homo sapiens
ggtctcttcctttgctctgag

SEQ ID NO: 752158 - DNA, 18 bp, Homo sapiens
ggtctcttcttctttctg

SEQ ID NO: 752159 - DNA, 15 bp, Homo sapiens
ggtctcttgagggag

SEQ ID NO: 752160 - DNA, 21 bp, Homo sapiens
ggtctcttgagggagcttagc

SEQ ID NO: 752161 - DNA, 22 bp, Homo sapiens
ggtctgaaggaatagccagaga

SEQ ID NO: 752162 - DNA, 15 bp, Homo sapiens
ggtctgaaggactgg

SEQ ID NO: 752163 - DNA, 22 bp, Homo sapiens
ggtctgaatgttctgacattaa

SEQ ID NO: 752164 - DNA, 22 bp, Homo sapiens
ggtctgaccgatgtgtctccca

SEQ ID NO: 752165 - DNA, 16 bp, Homo sapiens
ggtctgagcaccccct

SEQ ID NO: 752166 - DNA, 18 bp, Homo sapiens
ggtctgagcaccccctca

SEQ ID NO: 752167 - DNA, 16 bp, Homo sapiens
ggtctgagccctggtg

SEQ ID NO: 752168 - DNA, 14 bp, Homo sapiens
ggtctgagctggac

SEQ ID NO: 752169 - DNA, 19 bp, Homo sapiens
ggtctgagtctatgttcaa

SEQ ID NO: 752170 - DNA, 20 bp, Homo sapiens
ggtctgagtctatgttcaaa

SEQ ID NO: 752171 - DNA, 17 bp, Homo sapiens
ggtctgcaagggcccag

SEQ ID NO: 752172 - DNA, 18 bp, Homo sapiens
ggtctgcaagggcccaga

SEQ ID NO: 752173 - DNA, 19 bp, Homo sapiens
ggtctgcaagggcccagag

SEQ ID NO: 752174 - DNA, 20 bp, Homo sapiens
ggtctgcagcctgctggggc

SEQ ID NO: 752175 - DNA, 12 bp, Homo sapiens
ggtctgccctgc

SEQ ID NO: 752176 - DNA, 13 bp, Homo sapiens
ggtctgccctgcc

SEQ ID NO: 752177 - DNA, 15 bp, Homo sapiens
ggtctgccctgccca

SEQ ID NO: 752178 - DNA, 20 bp, Homo sapiens
ggtctgctctttctctgcca

SEQ ID NO: 752179 - DNA, 20 bp, Homo sapiens
gggccatggtggagggcact

SEQ ID NO: 752180 - DNA, 16 bp, Homo sapiens
gggccatgtccaaaga

SEQ ID NO: 752181 - DNA, 21 bp, Homo sapiens
gggccatgtccaaagaggctg

SEQ ID NO: 752182 - DNA, 16 bp, Homo sapiens
gggccattctccacag

SEQ ID NO: 752183 - DNA, 16 bp, Homo sapiens
gggcccaaaggcccag

SEQ ID NO: 752184 - DNA, 16 bp, Homo sapiens
gggcccaagaactgca

SEQ ID NO: 752185 - DNA, 23 bp, Homo sapiens
gggcccaagacagatgccccaga

SEQ ID NO: 752186 - DNA, 16 bp, Homo sapiens
gggcccaagtggggtg

SEQ ID NO: 752187 - DNA, 18 bp, Homo sapiens
gggcccacagagcctggc

SEQ ID NO: 752188 - DNA, 18 bp, Homo sapiens
gggcccacccatgtcacc

SEQ ID NO: 752189 - DNA, 16 bp, Homo sapiens
gggcccaccctctgcc

SEQ ID NO: 752190 - DNA, 21 bp, Homo sapiens
gggcccagaactgcccccact

SEQ ID NO: 752191 - DNA, 14 bp, Homo sapiens
gggcccagagcagg

SEQ ID NO: 752192 - DNA, 18 bp, Homo sapiens
gggcccagagcccttgac

SEQ ID NO: 752193 - DNA, 13 bp, Homo sapiens
gggcccagatctg

SEQ ID NO: 752194 - DNA, 18 bp, Homo sapiens
gggcccagccaggagcag

SEQ ID NO: 752195 - DNA, 13 bp, Homo sapiens
gggcccagcccag

SEQ ID NO: 752196 - DNA, 13 bp, Homo sapiens
gggcccagcccct

SEQ ID NO: 752197 - DNA, 19 bp, Homo sapiens
ctagagatattttgtaaaa

SEQ ID NO: 752198 - DNA, 22 bp, Homo sapiens
ctagagatgtgcctgtgggagg

SEQ ID NO: 752199 - DNA, 21 bp, Homo sapiens
ctagagcaacccctgtaccca

SEQ ID NO: 752200 - DNA, 18 bp, Homo sapiens
ctagaggcagggagggga

SEQ ID NO: 752201 - DNA, 17 bp, Homo sapiens
ctagaggccagccccac

SEQ ID NO: 752202 - DNA, 18 bp, Homo sapiens
ctagaggccagccccacc

SEQ ID NO: 752203 - DNA, 20 bp, Homo sapiens
ctagaggccagccccaccca

SEQ ID NO: 752204 - DNA, 23 bp, Homo sapiens
ctagaggccagccccacccagga

SEQ ID NO: 752205 - DNA, 16 bp, Homo sapiens
ctagaggcctgaggat

SEQ ID NO: 752206 - DNA, 20 bp, Homo sapiens
ctagaggcctgaggatgagc

SEQ ID NO: 752207 - DNA, 15 bp, Homo sapiens
ctagagggacctctc

SEQ ID NO: 752208 - DNA, 15 bp, Homo sapiens
ctagagggaggggcc

SEQ ID NO: 752209 - DNA, 16 bp, Homo sapiens
ctagagggaggggcct

SEQ ID NO: 752210 - DNA, 21 bp, Homo sapiens
ctagagggaggggcctaggcc

SEQ ID NO: 752211 - DNA, 21 bp, Homo sapiens
ctagagggcccatcaggcagt

SEQ ID NO: 752212 - DNA, 22 bp, Homo sapiens
ctagagggcccatcaggcagtg

SEQ ID NO: 752213 - DNA, 15 bp, Homo sapiens
ctagagggttcctgt

SEQ ID NO: 752214 - DNA, 18 bp, Homo sapiens
ctagagggttgctgcctt

SEQ ID NO: 752215 - DNA, 15 bp, Homo sapiens
ctagaggtgagaaat

SEQ ID NO: 752216 - DNA, 19 bp, Homo sapiens
ctagaggtgagaaatttaa

SEQ ID NO: 752217 - DNA, 14 bp, Homo sapiens
ctagaggtgggcag

SEQ ID NO: 752218 - DNA, 15 bp, Homo sapiens
ctagaggtgggcagc

SEQ ID NO: 752219 - DNA, 16 bp, Homo sapiens
ctagaggtgggcagct

SEQ ID NO: 752220 - DNA, 17 bp, Homo sapiens
ctagaggtgggcagctg

SEQ ID NO: 752221 - DNA, 18 bp, Homo sapiens
ctagaggtgggcagctgg

SEQ ID NO: 752222 - DNA, 19 bp, Homo sapiens
ctagaggtgggcagctggg

SEQ ID NO: 752223 - DNA, 21 bp, Homo sapiens
ctagaggttctgggttttctg

SEQ ID NO: 752224 - DNA, 14 bp, Homo sapiens
ctagagtcatgtga

SEQ ID NO: 752225 - DNA, 16 bp, Homo sapiens
ctagagtctcactgct

SEQ ID NO: 752226 - DNA, 17 bp, Homo sapiens
ctagagtgaacttgggc

SEQ ID NO: 752227 - DNA, 22 bp, Homo sapiens
ctagagtgctctgaccctgggc

SEQ ID NO: 752228 - DNA, 22 bp, Homo sapiens
ctagagtgtagcctaaagggca

SEQ ID NO: 752229 - DNA, 15 bp, Homo sapiens
ctagagttatcttct

SEQ ID NO: 752230 - DNA, 15 bp, Homo sapiens
ctagataaaaagatg

SEQ ID NO: 752231 - DNA, 14 bp, Homo sapiens
ctagatacaataaa

SEQ ID NO: 752232 - DNA, 16 bp, Homo sapiens
ctagatacaataaatt

SEQ ID NO: 752233 - DNA, 23 bp, Homo sapiens
ctagatacagaagcccatgtctt

SEQ ID NO: 752234 - DNA, 14 bp, Homo sapiens
ctagatactggaaa

SEQ ID NO: 752235 - DNA, 16 bp, Homo sapiens
ctagatactgtatcat

SEQ ID NO: 752236 - DNA, 14 bp, Homo sapiens
ctagatatcgactt

SEQ ID NO: 752237 - DNA, 17 bp, Homo sapiens
ctagatcatatttaaag

SEQ ID NO: 752238 - DNA, 18 bp, Homo sapiens
ctagatccacacacagag

SEQ ID NO: 752239 - DNA, 23 bp, Homo sapiens
ctagatccacgtgtggcctccgt

SEQ ID NO: 752240 - DNA, 17 bp, Homo sapiens
ctagatgaagttttaca

SEQ ID NO: 752241 - DNA, 15 bp, Homo sapiens
ctagatgattgaata

SEQ ID NO: 752242 - DNA, 14 bp, Homo sapiens
ctagatgatttttt

SEQ ID NO: 752243 - DNA, 22 bp, Homo sapiens
ctagatgcacgtggggcccact

SEQ ID NO: 752244 - DNA, 18 bp, Homo sapiens
ctagatggacctgcctgc

SEQ ID NO: 752245 - DNA, 22 bp, Homo sapiens
gcctcccacacttgctggggct

SEQ ID NO: 752246 - DNA, 13 bp, Homo sapiens
gcctcccacagac

SEQ ID NO: 752247 - DNA, 12 bp, Homo sapiens
gcctcccaccag

SEQ ID NO: 752248 - DNA, 16 bp, Homo sapiens
gcctcccaccagagcc

SEQ ID NO: 752249 - DNA, 20 bp, Homo sapiens
gcctcccaccagagccggga

SEQ ID NO: 752250 - DNA, 17 bp, Homo sapiens
gcctcccacccccatct

SEQ ID NO: 752251 - DNA, 12 bp, Homo sapiens
gcctcccacccg

SEQ ID NO: 752252 - DNA, 14 bp, Homo sapiens
gcctcccacgactg

SEQ ID NO: 752253 - DNA, 21 bp, Homo sapiens
gcctcccacgactgcccggca

SEQ ID NO: 752254 - DNA, 13 bp, Homo sapiens
gcctcccacggca

SEQ ID NO: 752255 - DNA, 12 bp, Homo sapiens
gcctcccactgg

SEQ ID NO: 752256 - DNA, 19 bp, Homo sapiens
gcctcccagagtgctggga

SEQ ID NO: 752257 - DNA, 13 bp, Homo sapiens
gcctcccagcctg

SEQ ID NO: 752258 - DNA, 14 bp, Homo sapiens
gcctcccaggcaag

SEQ ID NO: 752259 - DNA, 20 bp, Homo sapiens
gcctcccaggcaagcagctg

SEQ ID NO: 752260 - DNA, 16 bp, Homo sapiens
gcctcccattctgcac

SEQ ID NO: 752261 - DNA, 20 bp, Homo sapiens
gcctcccattctgcaccaca

SEQ ID NO: 752262 - DNA, 22 bp, Homo sapiens
gcctccccaaccctgcccctgc

SEQ ID NO: 752263 - DNA, 18 bp, Homo sapiens
gcctccccaatccaggcc

SEQ ID NO: 752264 - DNA, 20 bp, Homo sapiens
gcctccccaatccaggccaa

SEQ ID NO: 752265 - DNA, 21 bp, Homo sapiens
gcctccccaccctcctcttgg

SEQ ID NO: 752266 - DNA, 17 bp, Homo sapiens
gcctccccatctgtcca

SEQ ID NO: 752267 - DNA, 18 bp, Homo sapiens
gcctccccatttcccatc

SEQ ID NO: 752268 - DNA, 19 bp, Homo sapiens
gcctccccatttcccatct

SEQ ID NO: 752269 - DNA, 21 bp, Homo sapiens
gcctccccatttcccatctgc

SEQ ID NO: 752270 - DNA, 19 bp, Homo sapiens
gcctcccccaacacctgct

SEQ ID NO: 752271 - DNA, 14 bp, Homo sapiens
gcctccccccagac

SEQ ID NO: 752272 - DNA, 16 bp, Homo sapiens
gcctcccctcccctgg

SEQ ID NO: 752273 - DNA, 19 bp, Homo sapiens
gcctcccctctccttcctg

SEQ ID NO: 752274 - DNA, 21 bp, Homo sapiens
gcctcccctctccttcctgtg

SEQ ID NO: 752275 - DNA, 14 bp, Homo sapiens
gcctcccctgccac

SEQ ID NO: 752276 - DNA, 15 bp, Homo sapiens
gcctcccctgctgaa

SEQ ID NO: 752277 - DNA, 12 bp, Homo sapiens
gcctccccttct

SEQ ID NO: 752278 - DNA, 21 bp, Homo sapiens
gcctcccgagtagctgggatt

SEQ ID NO: 752279 - DNA, 14 bp, Homo sapiens
gcctcccggggccc

SEQ ID NO: 752280 - DNA, 20 bp, Homo sapiens
gcctcccggggcccaggact

SEQ ID NO: 752281 - DNA, 18 bp, Homo sapiens
gcctccctcaccctgagc

SEQ ID NO: 752282 - DNA, 21 bp, Homo sapiens
gcctccctcagcccccaggat

SEQ ID NO: 752283 - DNA, 15 bp, Homo sapiens
gcctccctccacccc

SEQ ID NO: 752284 - DNA, 17 bp, Homo sapiens
gcctccctccaccccag

SEQ ID NO: 752285 - DNA, 18 bp, Homo sapiens
gcctccctccaccccagg

SEQ ID NO: 752286 - DNA, 23 bp, Homo sapiens
gcctccctctccatatctccttc

SEQ ID NO: 752287 - DNA, 15 bp, Homo sapiens
gcctccctctcttcc

SEQ ID NO: 752288 - DNA, 20 bp, Homo sapiens
gcctccctctgacctgcagg

SEQ ID NO: 752289 - DNA, 21 bp, Homo sapiens
gcctccctctgacctgcaggc

SEQ ID NO: 752290 - DNA, 11 bp, Homo sapiens
gcctccctgag

SEQ ID NO: 752291 - DNA, 15 bp, Homo sapiens
gcctccctgagcctg

SEQ ID NO: 752292 - DNA, 16 bp, Homo sapiens
gcctccctgagcctgc

SEQ ID NO: 752293 - DNA, 11 bp, Homo sapiens
gcctccctgct

SEQ ID NO: 752294 - DNA, 17 bp, Homo sapiens
gcctccctgggccacct

SEQ ID NO: 752295 - DNA, 21 bp, Homo sapiens
gcctccctgggccacctccta

SEQ ID NO: 752296 - DNA, 16 bp, Homo sapiens
gcctccctggtccctt

SEQ ID NO: 752297 - DNA, 15 bp, Homo sapiens
gcctccctgtctcca

SEQ ID NO: 752298 - DNA, 16 bp, Homo sapiens
gcctcccttttctcct

SEQ ID NO: 752299 - DNA, 18 bp, Homo sapiens
gcctccgacgctgcctct

SEQ ID NO: 752300 - DNA, 15 bp, Homo sapiens
gcctccgagagggag

SEQ ID NO: 752301 - DNA, 18 bp, Homo sapiens
gcctccgaggctccccgc

SEQ ID NO: 752302 - DNA, 21 bp, Homo sapiens
gcctccgatgcctggcctgcc

SEQ ID NO: 752303 - DNA, 23 bp, Homo sapiens
gcctccgatgcctggcctgccag

SEQ ID NO: 752304 - DNA, 12 bp, Homo sapiens
gcctccggcctc

SEQ ID NO: 752305 - DNA, 16 bp, Homo sapiens
gcctccggcctcccct

SEQ ID NO: 752306 - DNA, 14 bp, Homo sapiens
gcctccggcgtctt

SEQ ID NO: 752307 - DNA, 14 bp, Homo sapiens
gcctccgtcatcca

SEQ ID NO: 752308 - DNA, 21 bp, Homo sapiens
gcctccgtcatccatgccctc

SEQ ID NO: 752309 - DNA, 22 bp, Homo sapiens
gcctccgtcctgtcactgatgg

SEQ ID NO: 752310 - DNA, 16 bp, Homo sapiens
gcctccgtggaacatt

SEQ ID NO: 752311 - DNA, 18 bp, Homo sapiens
gcctccgtttatgggcct

SEQ ID NO: 752312 - DNA, 16 bp, Homo sapiens
gcctcctagagtgcag

SEQ ID NO: 752313 - DNA, 17 bp, Homo sapiens
gcctcctaggctggaag

SEQ ID NO: 752314 - DNA, 20 bp, Homo sapiens
gcctcctaggggaagggggt

SEQ ID NO: 752315 - DNA, 16 bp, Homo sapiens
gcctcctcacccccag

SEQ ID NO: 752316 - DNA, 18 bp, Homo sapiens
gcctcctcacccccagct

SEQ ID NO: 752317 - DNA, 19 bp, Homo sapiens
gcctcctcacccccagctt

SEQ ID NO: 752318 - DNA, 17 bp, Homo sapiens
gcctcctcagcctctgc

SEQ ID NO: 752319 - DNA, 23 bp, Homo sapiens
gcccccaacctcagggctcccag

SEQ ID NO: 752320 - DNA, 20 bp, Homo sapiens
gcccccaactccgcccagcc

SEQ ID NO: 752321 - DNA, 23 bp, Homo sapiens
gcccccaactccgcccagcctct

SEQ ID NO: 752322 - DNA, 11 bp, Homo sapiens
gcccccaagtc

SEQ ID NO: 752323 - DNA, 18 bp, Homo sapiens
gcccccaataaaggcagc

SEQ ID NO: 752324 - DNA, 23 bp, Homo sapiens
gcccccaataaaggcagctgcct

SEQ ID NO: 752325 - DNA, 16 bp, Homo sapiens
gcccccaccagcagca

SEQ ID NO: 752326 - DNA, 12 bp, Homo sapiens
gcccccaccagg

SEQ ID NO: 752327 - DNA, 17 bp, Homo sapiens
gcccccaccccggggac

SEQ ID NO: 752328 - DNA, 19 bp, Homo sapiens
gcccccaccccttccccag

SEQ ID NO: 752329 - DNA, 10 bp, Homo sapiens
gcccccaccg

SEQ ID NO: 752330 - DNA, 21 bp, Homo sapiens
gcccccaccgaggttcccagg

SEQ ID NO: 752331 - DNA, 18 bp, Homo sapiens
gcccccaccgggctgcag

SEQ ID NO: 752332 - DNA, 17 bp, Homo sapiens
gcccccaccgtgggcag

SEQ ID NO: 752333 - DNA, 18 bp, Homo sapiens
gcccccaccgtgggcagg

SEQ ID NO: 752334 - DNA, 22 bp, Homo sapiens
gcccccaccgtgggcagggagc

SEQ ID NO: 752335 - DNA, 17 bp, Homo sapiens
gcccccacttgcctctt

SEQ ID NO: 752336 - DNA, 21 bp, Homo sapiens
gcccccacttgcctcttcctt

SEQ ID NO: 752337 - DNA, 16 bp, Homo sapiens
gcccccagaaagcctc

SEQ ID NO: 752338 - DNA, 19 bp, Homo sapiens
gcccccagaaagcctcctg

SEQ ID NO: 752339 - DNA, 21 bp, Homo sapiens
gcccccagaaagcctcctgcc

SEQ ID NO: 752340 - DNA, 22 bp, Homo sapiens
gcccccagagtgtagggggcct

SEQ ID NO: 752341 - DNA, 17 bp, Homo sapiens
gcccccagatagagctg

SEQ ID NO: 752342 - DNA, 15 bp, Homo sapiens
gcccccagccctggg

SEQ ID NO: 752343 - DNA, 18 bp, Homo sapiens
gcccccagccctgggaac

SEQ ID NO: 752344 - DNA, 21 bp, Homo sapiens
gcccccagccctgggaaccac

SEQ ID NO: 752345 - DNA, 14 bp, Homo sapiens
gcccccagcctcag

SEQ ID NO: 752346 - DNA, 19 bp, Homo sapiens
gcccccagcctcagcccaa

SEQ ID NO: 752347 - DNA, 17 bp, Homo sapiens
gcccccagcctggccag

SEQ ID NO: 752348 - DNA, 19 bp, Homo sapiens
gcccccagcctggccagac

SEQ ID NO: 752349 - DNA, 11 bp, Homo sapiens
gcccccagctt

SEQ ID NO: 752350 - DNA, 12 bp, Homo sapiens
gcccccagcttc

SEQ ID NO: 752351 - DNA, 22 bp, Homo sapiens
gcccccagcttctctctccctg

SEQ ID NO: 752352 - DNA, 21 bp, Homo sapiens
gcccccaggaacgctctcctc

SEQ ID NO: 752353 - DNA, 22 bp, Homo sapiens
gcccccaggattcccccagcca

SEQ ID NO: 752354 - DNA, 12 bp, Homo sapiens
gcccccagggcc

SEQ ID NO: 752355 - DNA, 13 bp, Homo sapiens
gcccccagggccc

SEQ ID NO: 752356 - DNA, 15 bp, Homo sapiens
gcccccagggcctcc

SEQ ID NO: 752357 - DNA, 19 bp, Homo sapiens
gcccccagggcctccaggg

SEQ ID NO: 752358 - DNA, 17 bp, Homo sapiens
ctaatgaggagagaaaa

SEQ ID NO: 752359 - DNA, 13 bp, Homo sapiens
ctaatgatgcttt

SEQ ID NO: 752360 - DNA, 12 bp, Homo sapiens
ctaatgatgttt

SEQ ID NO: 752361 - DNA, 20 bp, Homo sapiens
ctaatgattcaaatgtttta

SEQ ID NO: 752362 - DNA, 16 bp, Homo sapiens
ctaatgcaaattaaaa

SEQ ID NO: 752363 - DNA, 14 bp, Homo sapiens
ctaatgctaagaaa

SEQ ID NO: 752364 - DNA, 18 bp, Homo sapiens
ctaatggtagtcagattt

SEQ ID NO: 752365 - DNA, 18 bp, Homo sapiens
ctaatgtagctatttttc

SEQ ID NO: 752366 - DNA, 16 bp, Homo sapiens
ctaatgtaggactgta

SEQ ID NO: 752367 - DNA, 18 bp, Homo sapiens
ctaatgtaggactgtata

SEQ ID NO: 752368 - DNA, 18 bp, Homo sapiens
ctaatgtattatgagcca

SEQ ID NO: 752369 - DNA, 21 bp, Homo sapiens
ctaatgtctcactgttctgca

SEQ ID NO: 752370 - DNA, 19 bp, Homo sapiens
ctaatgtctcttcctctgt

SEQ ID NO: 752371 - DNA, 23 bp, Homo sapiens
ctaatgtctcttcctctgttcta

SEQ ID NO: 752372 - DNA, 19 bp, Homo sapiens
ctaatgtcttcatttcatt

SEQ ID NO: 752373 - DNA, 23 bp, Homo sapiens
ctaatgtgaaaatcatcactcaa

SEQ ID NO: 752374 - DNA, 20 bp, Homo sapiens
ctaatgtgagtgtgaagctt

SEQ ID NO: 752375 - DNA, 16 bp, Homo sapiens
ctaatgtgcagggata

SEQ ID NO: 752376 - DNA, 23 bp, Homo sapiens
ctaatgtgttatgagaaattagt

SEQ ID NO: 752377 - DNA, 18 bp, Homo sapiens
ctaatgtttatgagccag

SEQ ID NO: 752378 - DNA, 16 bp, Homo sapiens
ctaatgttttgcttaa

SEQ ID NO: 752379 - DNA, 15 bp, Homo sapiens
ctaattaaaatctgg

SEQ ID NO: 752380 - DNA, 15 bp, Homo sapiens
gccgcccctgaggct

SEQ ID NO: 752381 - DNA, 14 bp, Homo sapiens
gccgccctccatcc

SEQ ID NO: 752382 - DNA, 12 bp, Homo sapiens
gccgccctgggc

SEQ ID NO: 752383 - DNA, 24 bp, Homo sapiens
gccgccctgggctgtctgtcacca

SEQ ID NO: 752384 - DNA, 17 bp, Homo sapiens
gccgccgacctgtgact

SEQ ID NO: 752385 - DNA, 16 bp, Homo sapiens
gccgccgggcaggcct

SEQ ID NO: 752386 - DNA, 14 bp, Homo sapiens
gccgccgtgaccta

SEQ ID NO: 752387 - DNA, 13 bp, Homo sapiens
gccgcctcccacg

SEQ ID NO: 752388 - DNA, 15 bp, Homo sapiens
gccgcctgccctgcc

SEQ ID NO: 752389 - DNA, 17 bp, Homo sapiens
gccgcctgccctgcctt

SEQ ID NO: 752390 - DNA, 12 bp, Homo sapiens
gccgcctgcctt

SEQ ID NO: 752391 - DNA, 15 bp, Homo sapiens
gccgcctgctcctca

SEQ ID NO: 752392 - DNA, 18 bp, Homo sapiens
gccgcctgctcctcactg

SEQ ID NO: 752393 - DNA, 19 bp, Homo sapiens
gccgcctgctcctcactgg

SEQ ID NO: 752394 - DNA, 15 bp, Homo sapiens
gccgcctggtactca

SEQ ID NO: 752395 - DNA, 18 bp, Homo sapiens
gccgcctggtactcaagc

SEQ ID NO: 752396 - DNA, 22 bp, Homo sapiens
gccgccttctcccctctcccag

SEQ ID NO: 752397 - DNA, 16 bp, Homo sapiens
gccgcgcgtccagctg

SEQ ID NO: 752398 - DNA, 18 bp, Homo sapiens
gccgcgcgtccagctgcc

SEQ ID NO: 752399 - DNA, 21 bp, Homo sapiens
gccgcgctccgaaccccgggc

SEQ ID NO: 752400 - DNA, 16 bp, Homo sapiens
gccgcggcccagaccc

SEQ ID NO: 752401 - DNA, 17 bp, Homo sapiens
gccgcggcctccccgag

SEQ ID NO: 752402 - DNA, 15 bp, Homo sapiens
gccgcgggacagcca

SEQ ID NO: 752403 - DNA, 19 bp, Homo sapiens
gccgcgggcgctcgctcag

SEQ ID NO: 752404 - DNA, 13 bp, Homo sapiens
gccgctagaggcc

SEQ ID NO: 752405 - DNA, 15 bp, Homo sapiens
gccgctagaggcctg

SEQ ID NO: 752406 - DNA, 13 bp, Homo sapiens
gccgctaggagag

SEQ ID NO: 752407 - DNA, 19 bp, Homo sapiens
gccgctaggagagactgaa

SEQ ID NO: 752408 - DNA, 19 bp, Homo sapiens
gccgctccccttggacctc

SEQ ID NO: 752409 - DNA, 23 bp, Homo sapiens
gccgctccccttggacctccagg

SEQ ID NO: 752410 - DNA, 21 bp, Homo sapiens
gccgctccgtgttcctcggtg

SEQ ID NO: 752411 - DNA, 15 bp, Homo sapiens
gccgctcctccctgc

SEQ ID NO: 752412 - DNA, 12 bp, Homo sapiens
gccgctctgatt

SEQ ID NO: 752413 - DNA, 21 bp, Homo sapiens
gccgctgagcgcccccgagcc

SEQ ID NO: 752414 - DNA, 16 bp, Homo sapiens
gccgctgagtggcagg

SEQ ID NO: 752415 - DNA, 12 bp, Homo sapiens
gccgctgccacc

SEQ ID NO: 752416 - DNA, 17 bp, Homo sapiens
gccgctgccacccacct

SEQ ID NO: 752417 - DNA, 13 bp, Homo sapiens
gccgctggctggt

SEQ ID NO: 752418 - DNA, 17 bp, Homo sapiens
gccgctggctggtgggc

SEQ ID NO: 752419 - DNA, 15 bp, Homo sapiens
gccgctgtcaaggcc

SEQ ID NO: 752420 - DNA, 23 bp, Homo sapiens
gccgctgtcaaggccgagggcca

SEQ ID NO: 752421 - DNA, 15 bp, Homo sapiens
gccgctgttcaccca

SEQ ID NO: 752422 - DNA, 16 bp, Homo sapiens
gccgctgttcacccac

SEQ ID NO: 752423 - DNA, 16 bp, Homo sapiens
gccggacagagtgggg

SEQ ID NO: 752424 - DNA, 16 bp, Homo sapiens
gccggacctctgagca

SEQ ID NO: 752425 - DNA, 21 bp, Homo sapiens
gccggacctgagcccgcagcc

SEQ ID NO: 752426 - DNA, 14 bp, Homo sapiens
gccggagagctggt

SEQ ID NO: 752427 - DNA, 16 bp, Homo sapiens
gccggagagctggtga

SEQ ID NO: 752428 - DNA, 14 bp, Homo sapiens
gccggagcccagat

SEQ ID NO: 752429 - DNA, 15 bp, Homo sapiens
gccggaggaggagat

SEQ ID NO: 752430 - DNA, 23 bp, Homo sapiens
gccggaggccttggggtgggggc

SEQ ID NO: 752431 - DNA, 21 bp, Homo sapiens
gccggagggacgcggaggagg

SEQ ID NO: 752432 - DNA, 15 bp, Homo sapiens
gccggatctgaggga

SEQ ID NO: 752433 - DNA, 15 bp, Homo sapiens
gccggcaagcgagca

SEQ ID NO: 752434 - DNA, 17 bp, Homo sapiens
gccggccagtggccttc

SEQ ID NO: 752435 - DNA, 15 bp, Homo sapiens
gccggcccagatgtg

SEQ ID NO: 752436 - DNA, 16 bp, Homo sapiens
gccggccgagctgcct

SEQ ID NO: 752437 - DNA, 20 bp, Homo sapiens
gccggccgccttctcccctc

SEQ ID NO: 752438 - DNA, 22 bp, Homo sapiens
gccggccgccttctcccctctc

SEQ ID NO: 752439 - DNA, 14 bp, Homo sapiens
gccggcctctctgg

SEQ ID NO: 752440 - DNA, 16 bp, Homo sapiens
gccggcctctctggcc

SEQ ID NO: 752441 - DNA, 18 bp, Homo sapiens
gccggcctctctggcctc

SEQ ID NO: 752442 - DNA, 19 bp, Homo sapiens
gccggcctctctggcctcc

SEQ ID NO: 752443 - DNA, 20 bp, Homo sapiens
gccggcctctctggcctccc

SEQ ID NO: 752444 - DNA, 23 bp, Homo sapiens
gccggcctctctggcctcccacc

SEQ ID NO: 752445 - DNA, 14 bp, Homo sapiens
gccggcctctgctg

SEQ ID NO: 752446 - DNA, 17 bp, Homo sapiens
gccggcctctgctgccc

SEQ ID NO: 752447 - DNA, 17 bp, Homo sapiens
gccggcggcccaagccc

SEQ ID NO: 752448 - DNA, 13 bp, Homo sapiens
gccggcggctctg

SEQ ID NO: 752449 - DNA, 22 bp, Homo sapiens
gccggctggaaatgctgggctg

SEQ ID NO: 752450 - DNA, 16 bp, Homo sapiens
gccggctgtggagcaa

SEQ ID NO: 752451 - DNA, 20 bp, Homo sapiens
gccgggaacagacaacagaa

SEQ ID NO: 752452 - DNA, 18 bp, Homo sapiens
gccgggaagagccacctg

SEQ ID NO: 752453 - DNA, 15 bp, Homo sapiens
gccgggagaggactc

SEQ ID NO: 752454 - DNA, 17 bp, Homo sapiens
gccgggcagggtgtggg

SEQ ID NO: 752455 - DNA, 17 bp, Homo sapiens
gccgggcccctgggctt

SEQ ID NO: 752456 - DNA, 19 bp, Homo sapiens
gccgggcccctgggcttgg

SEQ ID NO: 752457 - DNA, 12 bp, Homo sapiens
gccgggcctggg

SEQ ID NO: 752458 - DNA, 15 bp, Homo sapiens
gccgggcgccaggac

SEQ ID NO: 752459 - DNA, 16 bp, Homo sapiens
gccgggcgccaggaca

SEQ ID NO: 752460 - DNA, 18 bp, Homo sapiens
gccgggcgccaggacagc

SEQ ID NO: 752461 - DNA, 16 bp, Homo sapiens
gccgggcgcggtggct

SEQ ID NO: 752462 - DNA, 21 bp, Homo sapiens
gccgggcgcggtggctcacgc

SEQ ID NO: 752463 - DNA, 21 bp, Homo sapiens
gccgggcgtggtggcaggcac

SEQ ID NO: 752464 - DNA, 15 bp, Homo sapiens
gccggggagggggca

SEQ ID NO: 752465 - DNA, 16 bp, Homo sapiens
gccggggagggggcac

SEQ ID NO: 752466 - DNA, 23 bp, Homo sapiens
gccggggagggggcacggcaggc

SEQ ID NO: 752467 - DNA, 14 bp, Homo sapiens
gccgggggaggggc

SEQ ID NO: 752468 - DNA, 14 bp, Homo sapiens
gccggggggagggg

SEQ ID NO: 752469 - DNA, 15 bp, Homo sapiens
gccggggggagggga

SEQ ID NO: 752470 - DNA, 22 bp, Homo sapiens
gccggggggggtaggagaggag

SEQ ID NO: 752471 - DNA, 16 bp, Homo sapiens
gccggggtccaggccc

SEQ ID NO: 752472 - DNA, 18 bp, Homo sapiens
gccggggtgtaacttcct

SEQ ID NO: 752473 - DNA, 22 bp, Homo sapiens
gccggggtgtaacttcctgctg

SEQ ID NO: 752474 - DNA, 15 bp, Homo sapiens
gccgggtgcgaaagg

SEQ ID NO: 752475 - DNA, 16 bp, Homo sapiens
gccgggtgcggtggct

SEQ ID NO: 752476 - DNA, 12 bp, Homo sapiens
gccggtcatttt

SEQ ID NO: 752477 - DNA, 15 bp, Homo sapiens
gccggtccggcgccc

SEQ ID NO: 752478 - DNA, 17 bp, Homo sapiens
gccggtccggcgccccg

SEQ ID NO: 752479 - DNA, 17 bp, Homo sapiens
gccggtcgggcagccag

SEQ ID NO: 752480 - DNA, 17 bp, Homo sapiens
gcctaggggtcagggac

SEQ ID NO: 752481 - DNA, 22 bp, Homo sapiens
gcctaggggtcagggaccaagg

SEQ ID NO: 752482 - DNA, 18 bp, Homo sapiens
gcctaggggtggcgctca

SEQ ID NO: 752483 - DNA, 14 bp, Homo sapiens
gcctaggtcccttc

SEQ ID NO: 752484 - DNA, 17 bp, Homo sapiens
gcctagtcgggacttgt

SEQ ID NO: 752485 - DNA, 22 bp, Homo sapiens
gcctagtggggtctccctctcc

SEQ ID NO: 752486 - DNA, 21 bp, Homo sapiens
gcctagttatcaaggggatga

SEQ ID NO: 752487 - DNA, 21 bp, Homo sapiens
gcctagttcatccaatcctca

SEQ ID NO: 752488 - DNA, 17 bp, Homo sapiens
gcctataaaatgcccat

SEQ ID NO: 752489 - DNA, 18 bp, Homo sapiens
gcctataatacttgcaac

SEQ ID NO: 752490 - DNA, 18 bp, Homo sapiens
gcctataatcttatacaa

SEQ ID NO: 752491 - DNA, 19 bp, Homo sapiens
gcctataatcttatacaac

SEQ ID NO: 752492 - DNA, 18 bp, Homo sapiens
gcctatacgtttctgtgg

SEQ ID NO: 752493 - DNA, 20 bp, Homo sapiens
gcctatcagagttgctgcaa

SEQ ID NO: 752494 - DNA, 19 bp, Homo sapiens
gcctatgggggctctcgga

SEQ ID NO: 752495 - DNA, 20 bp, Homo sapiens
gcctattatattaaaatatg

SEQ ID NO: 752496 - DNA, 21 bp, Homo sapiens
gcctattccaggaattcctct

SEQ ID NO: 752497 - DNA, 15 bp, Homo sapiens
gcctattgatacttg

SEQ ID NO: 752498 - DNA, 13 bp, Homo sapiens
gcctattgtaata

SEQ ID NO: 752499 - DNA, 20 bp, Homo sapiens
gcctcaaagcaacccgctgg

SEQ ID NO: 752500 - DNA, 21 bp, Homo sapiens
gcctcaaagcaacccgctgga

SEQ ID NO: 752501 - DNA, 14 bp, Homo sapiens
gcctcaaccctccc

SEQ ID NO: 752502 - DNA, 15 bp, Homo sapiens
gcctcaaccctccct

SEQ ID NO: 752503 - DNA, 16 bp, Homo sapiens
gcctcaacctcctggg

SEQ ID NO: 752504 - DNA, 18 bp, Homo sapiens
gcctcaagaaaggcccgg

SEQ ID NO: 752505 - DNA, 13 bp, Homo sapiens
gcctcaaggactt

SEQ ID NO: 752506 - DNA, 12 bp, Homo sapiens
gcctcaaggccc

SEQ ID NO: 752507 - DNA, 16 bp, Homo sapiens
gcctcaatctaaggcc

SEQ ID NO: 752508 - DNA, 23 bp, Homo sapiens
gcctcaatctaaggccttccctg

SEQ ID NO: 752509 - DNA, 15 bp, Homo sapiens
gcctcacagaagaat

SEQ ID NO: 752510 - DNA, 15 bp, Homo sapiens
gcctcacagcagtga

SEQ ID NO: 752511 - DNA, 13 bp, Homo sapiens
ctacagttgaaaa

SEQ ID NO: 752512 - DNA, 22 bp, Homo sapiens
ctacagttgaaaaacagctgag

SEQ ID NO: 752513 - DNA, 15 bp, Homo sapiens
ctacagttgtcctga

SEQ ID NO: 752514 - DNA, 22 bp, Homo sapiens
ctacagttgttttttgaaaaca

SEQ ID NO: 752515 - DNA, 15 bp, Homo sapiens
ctacataaactgact

SEQ ID NO: 752516 - DNA, 13 bp, Homo sapiens
ctacataacacat

SEQ ID NO: 752517 - DNA, 14 bp, Homo sapiens
ctacatattgtctg

SEQ ID NO: 752518 - DNA, 14 bp, Homo sapiens
ctacatccagctcc

SEQ ID NO: 752519 - DNA, 14 bp, Homo sapiens
ctacatcccagcct

SEQ ID NO: 752520 - DNA, 17 bp, Homo sapiens
ctacatcccagcctgtg

SEQ ID NO: 752521 - DNA, 19 bp, Homo sapiens
ctacatcccagcctgtggt

SEQ ID NO: 752522 - DNA, 16 bp, Homo sapiens
ctacatctttttttct

SEQ ID NO: 752523 - DNA, 10 bp, Homo sapiens
ctacatgaaa

SEQ ID NO: 752524 - DNA, 12 bp, Homo sapiens
ctacatgactgg

SEQ ID NO: 752525 - DNA, 14 bp, Homo sapiens
ctacatgactgggc

SEQ ID NO: 752526 - DNA, 15 bp, Homo sapiens
ctacatgactgggcc

SEQ ID NO: 752527 - DNA, 15 bp, Homo sapiens
ctacatgcagcccat

SEQ ID NO: 752528 - DNA, 21 bp, Homo sapiens
ctacatgcagcccatgcccac

SEQ ID NO: 752529 - DNA, 17 bp, Homo sapiens
ctacatgccccctccct

SEQ ID NO: 752530 - DNA, 18 bp, Homo sapiens
ctacatgccccctccctt

SEQ ID NO: 752531 - DNA, 18 bp, Homo sapiens
ctacatggagtatatgtc

SEQ ID NO: 752532 - DNA, 13 bp, Homo sapiens
ctacatgtattgc

SEQ ID NO: 752533 - DNA, 22 bp, Homo sapiens
ctacatgtattgcacattgtaa

SEQ ID NO: 752534 - DNA, 12 bp, Homo sapiens
ctacattcattt

SEQ ID NO: 752535 - DNA, 15 bp, Homo sapiens
ctacattccccagag

SEQ ID NO: 752536 - DNA, 23 bp, Homo sapiens
ctacattccccagagtgggatcc

SEQ ID NO: 752537 - DNA, 15 bp, Homo sapiens
ctacattccctctcc

SEQ ID NO: 752538 - DNA, 13 bp, Homo sapiens
ctacattcctcag

SEQ ID NO: 752539 - DNA, 16 bp, Homo sapiens
ctacattcctcagctg

SEQ ID NO: 752540 - DNA, 19 bp, Homo sapiens
ctacattcctcagctgcca

SEQ ID NO: 752541 - DNA, 13 bp, Homo sapiens
ctacattctgtta

SEQ ID NO: 752542 - DNA, 14 bp, Homo sapiens
ctacattctgttaa

SEQ ID NO: 752543 - DNA, 13 bp, Homo sapiens
ctacattcttggt

SEQ ID NO: 752544 - DNA, 23 bp, Homo sapiens
ctacatttcacctactttgtaag

SEQ ID NO: 752545 - DNA, 17 bp, Homo sapiens
ctacattttttaaaact

SEQ ID NO: 752546 - DNA, 16 bp, Homo sapiens
ctaccaaacactcagt

SEQ ID NO: 752547 - DNA, 18 bp, Homo sapiens
ctaccaaacactcagtcc

SEQ ID NO: 752548 - DNA, 20 bp, Homo sapiens
ctaccaaggtcttcttaata

SEQ ID NO: 752549 - DNA, 13 bp, Homo sapiens
ctaccaatgcatg

SEQ ID NO: 752550 - DNA, 21 bp, Homo sapiens
ctaccactgtggccccaagag

SEQ ID NO: 752551 - DNA, 16 bp, Homo sapiens
ctaccagatgtgcttt

SEQ ID NO: 752552 - DNA, 18 bp, Homo sapiens
ctaccagatgtgctttta

SEQ ID NO: 752553 - DNA, 16 bp, Homo sapiens
ctaccagcaaacagct

SEQ ID NO: 752554 - DNA, 18 bp, Homo sapiens
ctaccagcaaacagctga

SEQ ID NO: 752555 - DNA, 19 bp, Homo sapiens
ctaccagcgcccgctgggc

SEQ ID NO: 752556 - DNA, 18 bp, Homo sapiens
ctaccagctcctccagcc

SEQ ID NO: 752557 - DNA, 19 bp, Homo sapiens
ctaccagctcctccagccc

SEQ ID NO: 752558 - DNA, 15 bp, Homo sapiens
ctaccatcagggaca

SEQ ID NO: 752559 - DNA, 22 bp, Homo sapiens
ctaccatgtgaaactctaccct

SEQ ID NO: 752560 - DNA, 20 bp, Homo sapiens
ctaccatttgcagagtcctg

SEQ ID NO: 752561 - DNA, 17 bp, Homo sapiens
ctacccaaaccctaggt

SEQ ID NO: 752562 - DNA, 13 bp, Homo sapiens
ctacccaaccact

SEQ ID NO: 752563 - DNA, 17 bp, Homo sapiens
ctacccaccgatggagc

SEQ ID NO: 752564 - DNA, 19 bp, Homo sapiens
ctacccattgttcccttcc

SEQ ID NO: 752565 - DNA, 16 bp, Homo sapiens
ctaccccaaggccagt

SEQ ID NO: 752566 - DNA, 12 bp, Homo sapiens
ctaccccacacc

SEQ ID NO: 752567 - DNA, 12 bp, Homo sapiens
ctaccccagtcc

SEQ ID NO: 752568 - DNA, 17 bp, Homo sapiens
ctaccccctaagagcca

SEQ ID NO: 752569 - DNA, 13 bp, Homo sapiens
ctaccccctcatc

SEQ ID NO: 752570 - DNA, 17 bp, Homo sapiens
ctaccccctcatccccc

SEQ ID NO: 752571 - DNA, 20 bp, Homo sapiens
ctaccccgcagacaccttgg

SEQ ID NO: 752572 - DNA, 14 bp, Homo sapiens
ctacccctcttcca

SEQ ID NO: 752573 - DNA, 23 bp, Homo sapiens
ctacccctgctcccattcctccc

SEQ ID NO: 752574 - DNA, 12 bp, Homo sapiens
ctacccctggct

SEQ ID NO: 752575 - DNA, 15 bp, Homo sapiens
ctaccccttcctgtc

SEQ ID NO: 752576 - DNA, 14 bp, Homo sapiens
ctaccccttgtggg

SEQ ID NO: 752577 - DNA, 16 bp, Homo sapiens
ctacccgagcccagct

SEQ ID NO: 752578 - DNA, 17 bp, Homo sapiens
ctacccgcatcttctgt

SEQ ID NO: 752579 - DNA, 11 bp, Homo sapiens
ctaccctcacc

SEQ ID NO: 752580 - DNA, 15 bp, Homo sapiens
ctaccctccagagtg

SEQ ID NO: 752581 - DNA, 12 bp, Homo sapiens
ctaccctcggaa

SEQ ID NO: 752582 - DNA, 17 bp, Homo sapiens
ctaccctcgggcccacc

SEQ ID NO: 752583 - DNA, 23 bp, Homo sapiens
ctaccctcgggcccacctggcca

SEQ ID NO: 752584 - DNA, 17 bp, Homo sapiens
ctaccctcttagaaaaa

SEQ ID NO: 752585 - DNA, 13 bp, Homo sapiens
ctaccctggtgaa

SEQ ID NO: 752586 - DNA, 13 bp, Homo sapiens
ctaccctgtcctt

SEQ ID NO: 752587 - DNA, 16 bp, Homo sapiens
ctaccctgtcctttgc

SEQ ID NO: 752588 - DNA, 14 bp, Homo sapiens
ctaccctgtctgtc

SEQ ID NO: 752589 - DNA, 23 bp, Homo sapiens
ctaccctgtctgtcccttttctt

SEQ ID NO: 752590 - DNA, 19 bp, Homo sapiens
ctacccttcctgcatttct

SEQ ID NO: 752591 - DNA, 19 bp, Homo sapiens
ctaccgagtctcttctcca

SEQ ID NO: 752592 - DNA, 22 bp, Homo sapiens
ctaccgagtctcttctccactg

SEQ ID NO: 752593 - DNA, 12 bp, Homo sapiens
ctaccgccctgg

SEQ ID NO: 752594 - DNA, 14 bp, Homo sapiens
ctaccgccctgggc

SEQ ID NO: 752595 - DNA, 20 bp, Homo sapiens
ctaccgccctgggctggact

SEQ ID NO: 752596 - DNA, 21 bp, Homo sapiens
ctaccgccctgggctggactg

SEQ ID NO: 752597 - DNA, 16 bp, Homo sapiens
ctaccgtactccctgc

SEQ ID NO: 752598 - DNA, 13 bp, Homo sapiens
ctaccgtatttca

SEQ ID NO: 752599 - DNA, 21 bp, Homo sapiens
ctacctcaagttcttggacca

SEQ ID NO: 752600 - DNA, 11 bp, Homo sapiens
ctacctcagcc

SEQ ID NO: 752601 - DNA, 15 bp, Homo sapiens
ctacctcagcctaga

SEQ ID NO: 752602 - DNA, 20 bp, Homo sapiens
ctacctcaggcaggaagggc

SEQ ID NO: 752603 - DNA, 12 bp, Homo sapiens
ctactgtaactt

SEQ ID NO: 752604 - DNA, 16 bp, Homo sapiens
ctactgtaatttgtga

SEQ ID NO: 752605 - DNA, 17 bp, Homo sapiens
ctactgtaattttatat

SEQ ID NO: 752606 - DNA, 13 bp, Homo sapiens
ctactgtacattt

SEQ ID NO: 752607 - DNA, 15 bp, Homo sapiens
ctactgtactattta

SEQ ID NO: 752608 - DNA, 16 bp, Homo sapiens
ctactgtactttgcca

SEQ ID NO: 752609 - DNA, 17 bp, Homo sapiens
ctactgtactttgccat

SEQ ID NO: 752610 - DNA, 15 bp, Homo sapiens
ctactgtagaaagat

SEQ ID NO: 752611 - DNA, 20 bp, Homo sapiens
ctactgtcaaatgatgtgca

SEQ ID NO: 752612 - DNA, 14 bp, Homo sapiens
ctactgtcctggaa

SEQ ID NO: 752613 - DNA, 24 bp, Homo sapiens
ctactgtctcctccctgggctaag

SEQ ID NO: 752614 - DNA, 11 bp, Homo sapiens
ctactgtgggg

SEQ ID NO: 752615 - DNA, 13 bp, Homo sapiens
ctactgtggggag

SEQ ID NO: 752616 - DNA, 13 bp, Homo sapiens
ctactgttactct

SEQ ID NO: 752617 - DNA, 19 bp, Homo sapiens
ctactgttactctaaatag

SEQ ID NO: 752618 - DNA, 15 bp, Homo sapiens
ctactgttcctttca

SEQ ID NO: 752619 - DNA, 23 bp, Homo sapiens
ctacttaatgtaattcaggactc

SEQ ID NO: 752620 - DNA, 19 bp, Homo sapiens
ctacttaattcctttctca

SEQ ID NO: 752621 - DNA, 19 bp, Homo sapiens
ctacttaccatatgtgctt

SEQ ID NO: 752622 - DNA, 17 bp, Homo sapiens
ctacttagcatgtccct

SEQ ID NO: 752623 - DNA, 22 bp, Homo sapiens
ctacttagcatgtccctaccga

SEQ ID NO: 752624 - DNA, 20 bp, Homo sapiens
ctacttagtaaaaattgatt

SEQ ID NO: 752625 - DNA, 19 bp, Homo sapiens
ctacttcatagctccttgg

SEQ ID NO: 752626 - DNA, 17 bp, Homo sapiens
ctacttccaagaaaaat

SEQ ID NO: 752627 - DNA, 14 bp, Homo sapiens
ctacttccaggatg

SEQ ID NO: 752628 - DNA, 13 bp, Homo sapiens
ctacttcccctgg

SEQ ID NO: 752629 - DNA, 16 bp, Homo sapiens
ctacttcccctgggat

SEQ ID NO: 752630 - DNA, 13 bp, Homo sapiens
ctacttccccttc

SEQ ID NO: 752631 - DNA, 20 bp, Homo sapiens
ctacttctgactttacttgt

SEQ ID NO: 752632 - DNA, 13 bp, Homo sapiens
ctacttcttaaaa

SEQ ID NO: 752633 - DNA, 20 bp, Homo sapiens
ctacttgataatattagtga

SEQ ID NO: 752634 - DNA, 23 bp, Homo sapiens
ctacttgataatattagtgattc

SEQ ID NO: 752635 - DNA, 16 bp, Homo sapiens
ctacttgggaggctga

SEQ ID NO: 752636 - DNA, 13 bp, Homo sapiens
ctacttggtttgt

SEQ ID NO: 752637 - DNA, 18 bp, Homo sapiens
ctacttgtaaaatgcttt

SEQ ID NO: 752638 - DNA, 16 bp, Homo sapiens
ctacttgttcatttgg

SEQ ID NO: 752639 - DNA, 16 bp, Homo sapiens
ctactttcatcttaaa

SEQ ID NO: 752640 - DNA, 18 bp, Homo sapiens
ctactttcatcttaaact

SEQ ID NO: 752641 - DNA, 15 bp, Homo sapiens
ctactttgattctga

SEQ ID NO: 752642 - DNA, 20 bp, Homo sapiens
ctacttttctttattagctt

SEQ ID NO: 752643 - DNA, 23 bp, Homo sapiens
ctacttttctttattagctttct

SEQ ID NO: 752644 - DNA, 16 bp, Homo sapiens
ggctcggacccacccc

SEQ ID NO: 752645 - DNA, 17 bp, Homo sapiens
ggctcggacccacccca

SEQ ID NO: 752646 - DNA, 19 bp, Homo sapiens
ggctcggacccaccccaac

SEQ ID NO: 752647 - DNA, 22 bp, Homo sapiens
ggctcgtcagccacctgggaac

SEQ ID NO: 752648 - DNA, 13 bp, Homo sapiens
ggctcgtggcctt

SEQ ID NO: 752649 - DNA, 14 bp, Homo sapiens
ggctcgtggccttc

SEQ ID NO: 752650 - DNA, 18 bp, Homo sapiens
ggctcgttgactggctgt

SEQ ID NO: 752651 - DNA, 17 bp, Homo sapiens
ggctctaccctgtctgt

SEQ ID NO: 752652 - DNA, 13 bp, Homo sapiens
ggctctacctctc

SEQ ID NO: 752653 - DNA, 14 bp, Homo sapiens
ggctctacctctct

SEQ ID NO: 752654 - DNA, 14 bp, Homo sapiens
ggctctaccttcct

SEQ ID NO: 752655 - DNA, 15 bp, Homo sapiens
ggctctaccttcctg

SEQ ID NO: 752656 - DNA, 16 bp, Homo sapiens
ggctctaccttcctgt

SEQ ID NO: 752657 - DNA, 21 bp, Homo sapiens
ggctctaccttcctgtccctg

SEQ ID NO: 752658 - DNA, 15 bp, Homo sapiens
ggctctagagagagg

SEQ ID NO: 752659 - DNA, 21 bp, Homo sapiens
ggctctatgcctgcactggga

SEQ ID NO: 752660 - DNA, 18 bp, Homo sapiens
ggctctcagagcagcaga

SEQ ID NO: 752661 - DNA, 23 bp, Homo sapiens
ggctctcatgttttcaactgcca

SEQ ID NO: 752662 - DNA, 18 bp, Homo sapiens
ggctctccaaaggggctg

SEQ ID NO: 752663 - DNA, 20 bp, Homo sapiens
ggctctccaagtgccagagg

SEQ ID NO: 752664 - DNA, 19 bp, Homo sapiens
ggctctccacctcagcctt

SEQ ID NO: 752665 - DNA, 22 bp, Homo sapiens
ggctctccacctcagccttgga

SEQ ID NO: 752666 - DNA, 13 bp, Homo sapiens
ggctctccagtta

SEQ ID NO: 752667 - DNA, 11 bp, Homo sapiens
ggctctcccac

SEQ ID NO: 752668 - DNA, 13 bp, Homo sapiens
ggctctcccaccc

SEQ ID NO: 752669 - DNA, 12 bp, Homo sapiens
ggctctccgggc

SEQ ID NO: 752670 - DNA, 19 bp, Homo sapiens
ggctctctcacccagcctg

SEQ ID NO: 752671 - DNA, 17 bp, Homo sapiens
ggctctctgtaggcaca

SEQ ID NO: 752672 - DNA, 10 bp, Homo sapiens
ggctctgaga

SEQ ID NO: 752673 - DNA, 17 bp, Homo sapiens
ggctctgagcaggggca

SEQ ID NO: 752674 - DNA, 12 bp, Homo sapiens
ggctctgagccc

SEQ ID NO: 752675 - DNA, 14 bp, Homo sapiens
ggctctgagcgcct

SEQ ID NO: 752676 - DNA, 20 bp, Homo sapiens
ggctctgaggtgcctgtccc

SEQ ID NO: 752677 - DNA, 23 bp, Homo sapiens
ggctctgaggtgcctgtcccacc

SEQ ID NO: 752678 - DNA, 15 bp, Homo sapiens
ggctctgattggctg

SEQ ID NO: 752679 - DNA, 12 bp, Homo sapiens
ggctctgcacag

SEQ ID NO: 752680 - DNA, 16 bp, Homo sapiens
ggctctgcacccctct

SEQ ID NO: 752681 - DNA, 14 bp, Homo sapiens
ggctctgcaggcca

SEQ ID NO: 752682 - DNA, 12 bp, Homo sapiens
ggctctgcagtc

SEQ ID NO: 752683 - DNA, 14 bp, Homo sapiens
ggctctgcagtcct

SEQ ID NO: 752684 - DNA, 21 bp, Homo sapiens
ggctctgcccacctctctttt

SEQ ID NO: 752685 - DNA, 13 bp, Homo sapiens
ggctctgccccag

SEQ ID NO: 752686 - DNA, 20 bp, Homo sapiens
ggctctgccccagctctggc

SEQ ID NO: 752687 - DNA, 23 bp, Homo sapiens
ggctctgccccagctctggcttc

SEQ ID NO: 752688 - DNA, 21 bp, Homo sapiens
ggctctgcctgtctggtgcct

SEQ ID NO: 752689 - DNA, 14 bp, Homo sapiens
ggctctggccaccc

SEQ ID NO: 752690 - DNA, 14 bp, Homo sapiens
ggctctgggagagc

SEQ ID NO: 752691 - DNA, 17 bp, Homo sapiens
ggctctgggagagccag

SEQ ID NO: 752692 - DNA, 14 bp, Homo sapiens
ggctctgggcacag

SEQ ID NO: 752693 - DNA, 20 bp, Homo sapiens
ggctctgggcacagtgctgc

SEQ ID NO: 752694 - DNA, 19 bp, Homo sapiens
ggctctgggccgggcctgg

SEQ ID NO: 752695 - DNA, 16 bp, Homo sapiens
ggctctgggcggcccg

SEQ ID NO: 752696 - DNA, 19 bp, Homo sapiens
ggctctgggctcagggctg

SEQ ID NO: 752697 - DNA, 17 bp, Homo sapiens
ctgaggggctgggctgg

SEQ ID NO: 752698 - DNA, 17 bp, Homo sapiens
ctgaggggctggggagg

SEQ ID NO: 752699 - DNA, 18 bp, Homo sapiens
ctgagggtccccacctgg

SEQ ID NO: 752700 - DNA, 18 bp, Homo sapiens
ctgagggtctgggcggcg

SEQ ID NO: 752701 - DNA, 15 bp, Homo sapiens
ctgagggtgcccttt

SEQ ID NO: 752702 - DNA, 17 bp, Homo sapiens
ctgagggtgggaggcaa

SEQ ID NO: 752703 - DNA, 15 bp, Homo sapiens
ctgaggtatggccat

SEQ ID NO: 752704 - DNA, 13 bp, Homo sapiens
ctgaggtcaataa

SEQ ID NO: 752705 - DNA, 14 bp, Homo sapiens
ctgaggtcaataaa

SEQ ID NO: 752706 - DNA, 15 bp, Homo sapiens
ctgaggtcaataaag

SEQ ID NO: 752707 - DNA, 17 bp, Homo sapiens
ctgaggtcaataaagca

SEQ ID NO: 752708 - DNA, 18 bp, Homo sapiens
ctgaggtcaataaagcag

SEQ ID NO: 752709 - DNA, 21 bp, Homo sapiens
ctgaggtcaataaagcagagc

SEQ ID NO: 752710 - DNA, 22 bp, Homo sapiens
ctgaggtcaataaagcagagcc

SEQ ID NO: 752711 - DNA, 12 bp, Homo sapiens
ctgaggtgcctg

SEQ ID NO: 752712 - DNA, 13 bp, Homo sapiens
ctgaggtgcctgc

SEQ ID NO: 752713 - DNA, 15 bp, Homo sapiens
ctgaggtgcctgctc

SEQ ID NO: 752714 - DNA, 21 bp, Homo sapiens
ctgaggtgcctgctcaggtgc

SEQ ID NO: 752715 - DNA, 22 bp, Homo sapiens
ctgaggtgcctgtcccaccccc

SEQ ID NO: 752716 - DNA, 13 bp, Homo sapiens
ctgaggtgtgggg

SEQ ID NO: 752717 - DNA, 16 bp, Homo sapiens
ctgaggtgtgggggct

SEQ ID NO: 752718 - DNA, 20 bp, Homo sapiens
ctgaggtgtgggggctgcag

SEQ ID NO: 752719 - DNA, 19 bp, Homo sapiens
ctgaggttaaacggtgccc

SEQ ID NO: 752720 - DNA, 21 bp, Homo sapiens
ctgaggttaaacggtgcccat

SEQ ID NO: 752721 - DNA, 22 bp, Homo sapiens
ctgaggttaaacggtgcccatc

SEQ ID NO: 752722 - DNA, 16 bp, Homo sapiens
ctgaggttagagagat

SEQ ID NO: 752723 - DNA, 17 bp, Homo sapiens
ctgaggttttgaataaa

SEQ ID NO: 752724 - DNA, 18 bp, Homo sapiens
ctgaggttttgaataaaa

SEQ ID NO: 752725 - DNA, 14 bp, Homo sapiens
ctgagtaagtgtgt

SEQ ID NO: 752726 - DNA, 17 bp, Homo sapiens
ctgagtacgttgtgcat

SEQ ID NO: 752727 - DNA, 19 bp, Homo sapiens
ctgagtagctggattacag

SEQ ID NO: 752728 - DNA, 20 bp, Homo sapiens
ctgagtagctggattacagg

SEQ ID NO: 752729 - DNA, 17 bp, Homo sapiens
ctgagtagctgggcctg

SEQ ID NO: 752730 - DNA, 20 bp, Homo sapiens
ctgagtagctgggcctgtgc

SEQ ID NO: 752731 - DNA, 20 bp, Homo sapiens
ctgagtaggtctgggatgga

SEQ ID NO: 752732 - DNA, 20 bp, Homo sapiens
ctgagtatgttaagctcttt

SEQ ID NO: 752733 - DNA, 17 bp, Homo sapiens
ctgagtcaactggagca

SEQ ID NO: 752734 - DNA, 15 bp, Homo sapiens
ctgagtcaagttgtt

SEQ ID NO: 752735 - DNA, 19 bp, Homo sapiens
ctgagtcacaggtgtggga

SEQ ID NO: 752736 - DNA, 20 bp, Homo sapiens
ctgagtcacaggtgtgggat

SEQ ID NO: 752737 - DNA, 24 bp, Homo sapiens
ctgagtcacaggtgtgggatggag

SEQ ID NO: 752738 - DNA, 22 bp, Homo sapiens
ctgagtcaccctacctgtgcct

SEQ ID NO: 752739 - DNA, 23 bp, Homo sapiens
ctgagtcaccctacctgtgcctg

SEQ ID NO: 752740 - DNA, 18 bp, Homo sapiens
ctgagtcacctcctccac

SEQ ID NO: 752741 - DNA, 23 bp, Homo sapiens
ctgagtcagtgctctcagctggc

SEQ ID NO: 752742 - DNA, 21 bp, Homo sapiens
ctgagtcatctgttagggcct

SEQ ID NO: 752743 - DNA, 21 bp, Homo sapiens
ctgagtccaagagggtccttt

SEQ ID NO: 752744 - DNA, 18 bp, Homo sapiens
ctgagtccactgctccat

SEQ ID NO: 752745 - DNA, 20 bp, Homo sapiens
ctgagtccagctccccccaa

SEQ ID NO: 752746 - DNA, 17 bp, Homo sapiens
ctgagtcccaggagctg

SEQ ID NO: 752747 - DNA, 22 bp, Homo sapiens
ctgagtccgcctgcgcctccat

SEQ ID NO: 752748 - DNA, 19 bp, Homo sapiens
ctgagtcctgtctctgcct

SEQ ID NO: 752749 - DNA, 20 bp, Homo sapiens
ctgagtcggccccacatggg

SEQ ID NO: 752750 - DNA, 21 bp, Homo sapiens
ctgagtcggccccacatggga

SEQ ID NO: 752751 - DNA, 19 bp, Homo sapiens
ctgagtcgtacagaaagct

SEQ ID NO: 752752 - DNA, 23 bp, Homo sapiens
ctgagtcgtacagaaagctgcct

SEQ ID NO: 752753 - DNA, 18 bp, Homo sapiens
ctgagtctatgttcaaag

SEQ ID NO: 752754 - DNA, 14 bp, Homo sapiens
ctgagtctgagtcc

SEQ ID NO: 752755 - DNA, 19 bp, Homo sapiens
ctgagtctgagtcctgtct

SEQ ID NO: 752756 - DNA, 14 bp, Homo sapiens
ctgagtctggacct

SEQ ID NO: 752757 - DNA, 15 bp, Homo sapiens
ctgagtctggacctc

SEQ ID NO: 752758 - DNA, 16 bp, Homo sapiens
ctgagtctggacctcc

SEQ ID NO: 752759 - DNA, 13 bp, Homo sapiens
ctgagtgaaaaat

SEQ ID NO: 752760 - DNA, 14 bp, Homo sapiens
ctgagtgacacaag

SEQ ID NO: 752761 - DNA, 23 bp, Homo sapiens
ctgagtgaccgggggctgctggg

SEQ ID NO: 752762 - DNA, 13 bp, Homo sapiens
ctgagtgactgta

SEQ ID NO: 752763 - DNA, 14 bp, Homo sapiens
ctgagtgcagccaa

SEQ ID NO: 752764 - DNA, 18 bp, Homo sapiens
ctgagtgcagccaaaggg

SEQ ID NO: 752765 - DNA, 20 bp, Homo sapiens
ctgagtgcgggctgaggcca

SEQ ID NO: 752766 - DNA, 16 bp, Homo sapiens
ggctgatgatccagaa

SEQ ID NO: 752767 - DNA, 17 bp, Homo sapiens
ggctgatgatccagaac

SEQ ID NO: 752768 - DNA, 16 bp, Homo sapiens
ggctgatggaggaaaa

SEQ ID NO: 752769 - DNA, 18 bp, Homo sapiens
ggctgatgtcaatttctg

SEQ ID NO: 752770 - DNA, 24 bp, Homo sapiens
ggctgatgtcaatttctgtgttgc

SEQ ID NO: 752771 - DNA, 18 bp, Homo sapiens
ggctgatgtggactgtct

SEQ ID NO: 752772 - DNA, 15 bp, Homo sapiens
ggctgattactgaaa

SEQ ID NO: 752773 - DNA, 14 bp, Homo sapiens
ggctgatttctagg

SEQ ID NO: 752774 - DNA, 13 bp, Homo sapiens
ggctgcaaaatta

SEQ ID NO: 752775 - DNA, 13 bp, Homo sapiens
ggctgcacaggct

SEQ ID NO: 752776 - DNA, 20 bp, Homo sapiens
ggctgcacctcctaccctcc

SEQ ID NO: 752777 - DNA, 23 bp, Homo sapiens
ggctgcacgtaggttccccagag

SEQ ID NO: 752778 - DNA, 12 bp, Homo sapiens
ggctgcactgca

SEQ ID NO: 752779 - DNA, 16 bp, Homo sapiens
ggctgcagagcccggc

SEQ ID NO: 752780 - DNA, 19 bp, Homo sapiens
ggctgcagagtctgcccca

SEQ ID NO: 752781 - DNA, 19 bp, Homo sapiens
ggctgcagctggacagagg

SEQ ID NO: 752782 - DNA, 14 bp, Homo sapiens
ggctgcaggagggc

SEQ ID NO: 752783 - DNA, 16 bp, Homo sapiens
ggctgcaggagggcac

SEQ ID NO: 752784 - DNA, 13 bp, Homo sapiens
ggctgcaggcagg

SEQ ID NO: 752785 - DNA, 15 bp, Homo sapiens
ggctgcagtgagcca

SEQ ID NO: 752786 - DNA, 17 bp, Homo sapiens
ggctgcagttctactca

SEQ ID NO: 752787 - DNA, 23 bp, Homo sapiens
ggctgcatctgggattcccacca

SEQ ID NO: 752788 - DNA, 22 bp, Homo sapiens
ggctgcatgatgtttgcccaaa

SEQ ID NO: 752789 - DNA, 21 bp, Homo sapiens
ggctgcatgctctggaagcct

SEQ ID NO: 752790 - DNA, 15 bp, Homo sapiens
ggctgccacacccag

SEQ ID NO: 752791 - DNA, 23 bp, Homo sapiens
ggctgccagcccactgcctcctg

SEQ ID NO: 752792 - DNA, 11 bp, Homo sapiens
ggctgccaggc

SEQ ID NO: 752793 - DNA, 13 bp, Homo sapiens
ggctgcccaggag

SEQ ID NO: 752794 - DNA, 19 bp, Homo sapiens
ggctgcccatcatgtggcc

SEQ ID NO: 752795 - DNA, 23 bp, Homo sapiens
ggctgccccacctgccgcatgct

SEQ ID NO: 752796 - DNA, 12 bp, Homo sapiens
ggctgccccagg

SEQ ID NO: 752797 - DNA, 15 bp, Homo sapiens
ggctgccccaggccg

SEQ ID NO: 752798 - DNA, 16 bp, Homo sapiens
ggctgccccaggccgg

SEQ ID NO: 752799 - DNA, 13 bp, Homo sapiens
ggctgcccccatc

SEQ ID NO: 752800 - DNA, 23 bp, Homo sapiens
ggctgcccccatcacctctactg

SEQ ID NO: 752801 - DNA, 18 bp, Homo sapiens
ggctgcccccatccagcc

SEQ ID NO: 752802 - DNA, 20 bp, Homo sapiens
ggctgcccccatccagccac

SEQ ID NO: 752803 - DNA, 23 bp, Homo sapiens
ggctgcccccatccagccacgga

SEQ ID NO: 752804 - DNA, 20 bp, Homo sapiens
ggctgcccctaatctctgta

SEQ ID NO: 752805 - DNA, 20 bp, Homo sapiens
ggctgcccctcgcacacagg

SEQ ID NO: 752806 - DNA, 22 bp, Homo sapiens
ggctgcccctcgcacacagggc

SEQ ID NO: 752807 - DNA, 21 bp, Homo sapiens
ggctgccctgagaagctgctc

SEQ ID NO: 752808 - DNA, 11 bp, Homo sapiens
ggctgccctgg

SEQ ID NO: 752809 - DNA, 15 bp, Homo sapiens
ggctgccctggccct

SEQ ID NO: 752810 - DNA, 22 bp, Homo sapiens
ggctgccctggccctgaggtgt

SEQ ID NO: 752811 - DNA, 19 bp, Homo sapiens
ggctgccctggtgctgcca

SEQ ID NO: 752812 - DNA, 22 bp, Homo sapiens
ggctgccctggtgctgccacac

SEQ ID NO: 752813 - DNA, 17 bp, Homo sapiens
ggctgccgactccccca

SEQ ID NO: 752814 - DNA, 19 bp, Homo sapiens
ggctgccgagacagaccct

SEQ ID NO: 752815 - DNA, 22 bp, Homo sapiens
ggctgccgagacagaccctctg

SEQ ID NO: 752816 - DNA, 17 bp, Homo sapiens
ggctgcctagccctccc

SEQ ID NO: 752817 - DNA, 13 bp, Homo sapiens
ggctgcctcagcc

SEQ ID NO: 752818 - DNA, 15 bp, Homo sapiens
ggctgcctcagccag

SEQ ID NO: 752819 - DNA, 20 bp, Homo sapiens
ggctgcctcccttgtggcag

SEQ ID NO: 752820 - DNA, 14 bp, Homo sapiens
ggctgcctcctttg

SEQ ID NO: 752821 - DNA, 19 bp, Homo sapiens
ggctgcctcggactccatg

SEQ ID NO: 752822 - DNA, 11 bp, Homo sapiens
ggctgcctggg

SEQ ID NO: 752823 - DNA, 19 bp, Homo sapiens
ggctgcctgtgggcttccc

SEQ ID NO: 752824 - DNA, 16 bp, Homo sapiens
ggctgccttagaacct

SEQ ID NO: 752825 - DNA, 16 bp, Homo sapiens
ggctgccttctggcct

SEQ ID NO: 752826 - DNA, 11 bp, Homo sapiens
ggctgcctttg

SEQ ID NO: 752827 - DNA, 23 bp, Homo sapiens
ggctgcctttgatcacaggagca

SEQ ID NO: 752828 - DNA, 22 bp, Homo sapiens
ggctgcctttgtggtgggcgct

SEQ ID NO: 752829 - DNA, 15 bp, Homo sapiens
ggctgcgcactgtgt

SEQ ID NO: 752830 - DNA, 17 bp, Homo sapiens
ggctgcgcccccagctt

SEQ ID NO: 752831 - DNA, 18 bp, Homo sapiens
ggctgcgcccccagcttc

SEQ ID NO: 752832 - DNA, 15 bp, Homo sapiens
ggctgcgctagcagc

SEQ ID NO: 752833 - DNA, 18 bp, Homo sapiens
ggctgcgctagcagccct

SEQ ID NO: 752834 - DNA, 23 bp, Homo sapiens
ggctgcgctagcagcccttgtgt

SEQ ID NO: 752835 - DNA, 18 bp, Homo sapiens
ggctgcgtccctccgagc

SEQ ID NO: 752836 - DNA, 19 bp, Homo sapiens
ggctgcgtccctccgagct

SEQ ID NO: 752837 - DNA, 19 bp, Homo sapiens
ggctgctccagtgggcagg

SEQ ID NO: 752838 - DNA, 11 bp, Homo sapiens
ggctgctcccc

SEQ ID NO: 752839 - DNA, 16 bp, Homo sapiens
ggctgctcctccagcc

SEQ ID NO: 752840 - DNA, 17 bp, Homo sapiens
ggctgctcctccagccc

SEQ ID NO: 752841 - DNA, 18 bp, Homo sapiens
ggctgctcctccagggcc

SEQ ID NO: 752842 - DNA, 16 bp, Homo sapiens
ggctgctctgcctgtg

SEQ ID NO: 752843 - DNA, 10 bp, Homo sapiens
ggctgctgcc

SEQ ID NO: 752844 - DNA, 13 bp, Homo sapiens
ggctgctgccccc

SEQ ID NO: 752845 - DNA, 21 bp, Homo sapiens
ggctgctgccggaatcacttc

SEQ ID NO: 752846 - DNA, 13 bp, Homo sapiens
ggctgctgcttct

SEQ ID NO: 752847 - DNA, 19 bp, Homo sapiens
ggctgctgcttctgctcca

SEQ ID NO: 752848 - DNA, 22 bp, Homo sapiens
ggctgctgcttctgctccagcc

SEQ ID NO: 752849 - DNA, 17 bp, Homo sapiens
ggctgctggaaacacag

SEQ ID NO: 752850 - DNA, 12 bp, Homo sapiens
ggctgctggctt

SEQ ID NO: 752851 - DNA, 14 bp, Homo sapiens
ggctgctggcttca

SEQ ID NO: 752852 - DNA, 15 bp, Homo sapiens
ggctgctggcttcag

SEQ ID NO: 752853 - DNA, 18 bp, Homo sapiens
ggctgctgggcgtctgtt

SEQ ID NO: 752854 - DNA, 13 bp, Homo sapiens
ggctgctggggca

SEQ ID NO: 752855 - DNA, 23 bp, Homo sapiens
ggctgctggggcatgtgtgcctg

SEQ ID NO: 752856 - DNA, 24 bp, Homo sapiens
ggctgctggggcatgtgtgcctgt

SEQ ID NO: 752857 - DNA, 21 bp, Homo sapiens
ggctgctggggcctcagacga

SEQ ID NO: 752858 - DNA, 15 bp, Homo sapiens
ggctgctgtgtggac

SEQ ID NO: 752859 - DNA, 17 bp, Homo sapiens
ggctgcttcctcctgga

SEQ ID NO: 752860 - DNA, 19 bp, Homo sapiens
ggctgcttcctcctggaaa

SEQ ID NO: 752861 - DNA, 17 bp, Homo sapiens
ggctgcttctctacaga

SEQ ID NO: 752862 - DNA, 17 bp, Homo sapiens
ggctgcttgcagccagg

SEQ ID NO: 752863 - DNA, 20 bp, Homo sapiens
ggctgcttgcagccaggaga

SEQ ID NO: 752864 - DNA, 17 bp, Homo sapiens
ggctgcttgcttttgcc

SEQ ID NO: 752865 - DNA, 16 bp, Homo sapiens
ggctggaaagcagagc

SEQ ID NO: 752866 - DNA, 22 bp, Homo sapiens
ggctggaaagcagagcctcctg

SEQ ID NO: 752867 - DNA, 15 bp, Homo sapiens
ggctggaagatcctg

SEQ ID NO: 752868 - DNA, 19 bp, Homo sapiens
ggctggaagatcctgcggg

SEQ ID NO: 752869 - DNA, 14 bp, Homo sapiens
ggctggaatctcat

SEQ ID NO: 752870 - DNA, 20 bp, Homo sapiens
ggctggaatgcagtggtgtg

SEQ ID NO: 752871 - DNA, 21 bp, Homo sapiens
ggctggaatgggagacctgtt

SEQ ID NO: 752872 - DNA, 22 bp, Homo sapiens
ggctggacctatgtcctaagga

SEQ ID NO: 752873 - DNA, 13 bp, Homo sapiens
ggctggactggag

SEQ ID NO: 752874 - DNA, 18 bp, Homo sapiens
ggctggactggaggtggg

SEQ ID NO: 752875 - DNA, 12 bp, Homo sapiens
ggctggactggc

SEQ ID NO: 752876 - DNA, 21 bp, Homo sapiens
ggctggacttctacctgccct

SEQ ID NO: 752877 - DNA, 13 bp, Homo sapiens
ggctggagacccc

SEQ ID NO: 752878 - DNA, 14 bp, Homo sapiens
ggctggagctggcc

SEQ ID NO: 752879 - DNA, 13 bp, Homo sapiens
ggctggaggcagg

SEQ ID NO: 752880 - DNA, 17 bp, Homo sapiens
ggctggaggcagggcct

SEQ ID NO: 752881 - DNA, 13 bp, Homo sapiens
ggctggaggccca

SEQ ID NO: 752882 - DNA, 19 bp, Homo sapiens
ggctggaggcccaggctgg

SEQ ID NO: 752883 - DNA, 13 bp, Homo sapiens
ggctggaggtgct

SEQ ID NO: 752884 - DNA, 15 bp, Homo sapiens
ggctggaggtgctgg

SEQ ID NO: 752885 - DNA, 21 bp, Homo sapiens
ggctggaggtgctggtagctg

SEQ ID NO: 752886 - DNA, 14 bp, Homo sapiens
ggctggagtgcagt

SEQ ID NO: 752887 - DNA, 21 bp, Homo sapiens
ggctggagtgcagtggcacaa

SEQ ID NO: 752888 - DNA, 18 bp, Homo sapiens
ctgatgagtttcactgta

SEQ ID NO: 752889 - DNA, 23 bp, Homo sapiens
ctgatgagtttcactgtactgca

SEQ ID NO: 752890 - DNA, 20 bp, Homo sapiens
ctgatgatcaaaacctgtgc

SEQ ID NO: 752891 - DNA, 21 bp, Homo sapiens
ctgatgatcaaaacctgtgcc

SEQ ID NO: 752892 - DNA, 23 bp, Homo sapiens
ctgatgatcaaaacctgtgccag

SEQ ID NO: 752893 - DNA, 12 bp, Homo sapiens
ctgatgatgtcg

SEQ ID NO: 752894 - DNA, 17 bp, Homo sapiens
ctgatgcagcctgtggc

SEQ ID NO: 752895 - DNA, 12 bp, Homo sapiens
ctgatgcagctt

SEQ ID NO: 752896 - DNA, 16 bp, Homo sapiens
ctgatgcagcttatac

SEQ ID NO: 752897 - DNA, 20 bp, Homo sapiens
ctgatgccataaatacaaga

SEQ ID NO: 752898 - DNA, 14 bp, Homo sapiens
ctgatgcccctgac

SEQ ID NO: 752899 - DNA, 15 bp, Homo sapiens
ctgatgcccctgaca

SEQ ID NO: 752900 - DNA, 14 bp, Homo sapiens
ctgatgccccttcc

SEQ ID NO: 752901 - DNA, 19 bp, Homo sapiens
ctgatgccccttccccaag

SEQ ID NO: 752902 - DNA, 22 bp, Homo sapiens
ctgatgccccttctccccttcc

SEQ ID NO: 752903 - DNA, 16 bp, Homo sapiens
ctgatgccctcttctc

SEQ ID NO: 752904 - DNA, 19 bp, Homo sapiens
ctgatgccctcttctcctt

SEQ ID NO: 752905 - DNA, 20 bp, Homo sapiens
ctgatgccgtgatcctgagc

SEQ ID NO: 752906 - DNA, 19 bp, Homo sapiens
ctgatgctccctcccctgc

SEQ ID NO: 752907 - DNA, 24 bp, Homo sapiens
ctgatgctccctcccctgccctgg

SEQ ID NO: 752908 - DNA, 17 bp, Homo sapiens
ctgatgctcctccgggt

SEQ ID NO: 752909 - DNA, 11 bp, Homo sapiens
ctgatgctgcc

SEQ ID NO: 752910 - DNA, 13 bp, Homo sapiens
ctgatgctgcccc

SEQ ID NO: 752911 - DNA, 14 bp, Homo sapiens
ctgatgctgccccg

SEQ ID NO: 752912 - DNA, 15 bp, Homo sapiens
ctgatgctgtcatgt

SEQ ID NO: 752913 - DNA, 17 bp, Homo sapiens
ctgatgctttgcttcaa

SEQ ID NO: 752914 - DNA, 21 bp, Homo sapiens
ctgatggaagatggtccgtgc

SEQ ID NO: 752915 - DNA, 22 bp, Homo sapiens
ctgatggaagatggtccgtgcc

SEQ ID NO: 752916 - DNA, 22 bp, Homo sapiens
ctgatggaatgtgccacctgtc

SEQ ID NO: 752917 - DNA, 22 bp, Homo sapiens
ctgatggaccgggtgggcctgg

SEQ ID NO: 752918 - DNA, 23 bp, Homo sapiens
ctgatggaccgggtgggcctggc

SEQ ID NO: 752919 - DNA, 17 bp, Homo sapiens
ctgatggaggaaaaagg

SEQ ID NO: 752920 - DNA, 20 bp, Homo sapiens
ctgatggagtgtgcagacag

SEQ ID NO: 752921 - DNA, 22 bp, Homo sapiens
ctgatggagtgtgcagacagcc

SEQ ID NO: 752922 - DNA, 12 bp, Homo sapiens
ctgatggcagct

SEQ ID NO: 752923 - DNA, 14 bp, Homo sapiens
ctgatggcagctgg

SEQ ID NO: 752924 - DNA, 15 bp, Homo sapiens
ctgatggccaaaata

SEQ ID NO: 752925 - DNA, 15 bp, Homo sapiens
ctgatggccaagagc

SEQ ID NO: 752926 - DNA, 18 bp, Homo sapiens
ctgatggccaagggggtg

SEQ ID NO: 752927 - DNA, 20 bp, Homo sapiens
ctgatggccaagggggtgga

SEQ ID NO: 752928 - DNA, 21 bp, Homo sapiens
ctgatggccaagggggtggac

SEQ ID NO: 752929 - DNA, 19 bp, Homo sapiens
ctgatggcctggctgcctg

SEQ ID NO: 752930 - DNA, 21 bp, Homo sapiens
ctgatggccttaatttccttt

SEQ ID NO: 752931 - DNA, 15 bp, Homo sapiens
ctgatggcctttgga

SEQ ID NO: 752932 - DNA, 23 bp, Homo sapiens
ctgatggcctttggacccagggc

SEQ ID NO: 752933 - DNA, 23 bp, Homo sapiens
ctgatggctgctagattttaatt

SEQ ID NO: 752934 - DNA, 15 bp, Homo sapiens
ctgatggcttgacat

SEQ ID NO: 752935 - DNA, 19 bp, Homo sapiens
ctgatggcttgacatgtgc

SEQ ID NO: 752936 - DNA, 13 bp, Homo sapiens
ctgatgggaagga

SEQ ID NO: 752937 - DNA, 15 bp, Homo sapiens
ctgatgggctggggc

SEQ ID NO: 752938 - DNA, 19 bp, Homo sapiens
ctgatgggctggggcaggg

SEQ ID NO: 752939 - DNA, 21 bp, Homo sapiens
ctgatgggctggggcaggggc

SEQ ID NO: 752940 - DNA, 23 bp, Homo sapiens
ctgatgggctggggcaggggcct

SEQ ID NO: 752941 - DNA, 21 bp, Homo sapiens
ctgatggtgtcattctgcctg

SEQ ID NO: 752942 - DNA, 16 bp, Homo sapiens
ctgatgtagcttgaga

SEQ ID NO: 752943 - DNA, 21 bp, Homo sapiens
ctgatgtattacatgactgtt

SEQ ID NO: 752944 - DNA, 20 bp, Homo sapiens
ctgatgtcaatttctgtgtt

SEQ ID NO: 752945 - DNA, 14 bp, Homo sapiens
ctgatgtcccagtg

SEQ ID NO: 752946 - DNA, 15 bp, Homo sapiens
ctgatgtcccagtgc

SEQ ID NO: 752947 - DNA, 15 bp, Homo sapiens
ctgatgtggactgtc

SEQ ID NO: 752948 - DNA, 17 bp, Homo sapiens
ctgatgtggactgtctt

SEQ ID NO: 752949 - DNA, 15 bp, Homo sapiens
ctgatgttactgaga

SEQ ID NO: 752950 - DNA, 22 bp, Homo sapiens
ctgatgttgagggaacagacag

SEQ ID NO: 752951 - DNA, 14 bp, Homo sapiens
ggctgggggctgcc

SEQ ID NO: 752952 - DNA, 18 bp, Homo sapiens
ggctgggggtagcctgga

SEQ ID NO: 752953 - DNA, 17 bp, Homo sapiens
ggctggggtgagagagg

SEQ ID NO: 752954 - DNA, 16 bp, Homo sapiens
ggctggggtgagcctg

SEQ ID NO: 752955 - DNA, 12 bp, Homo sapiens
ggctgggtgctg

SEQ ID NO: 752956 - DNA, 21 bp, Homo sapiens
ggctggtagaaaaaggggcct

SEQ ID NO: 752957 - DNA, 21 bp, Homo sapiens
ggctggtagcagcaggctcag

SEQ ID NO: 752958 - DNA, 23 bp, Homo sapiens
ggctggtagcagcaggctcaggc

SEQ ID NO: 752959 - DNA, 16 bp, Homo sapiens
ggctggtattctctct

SEQ ID NO: 752960 - DNA, 13 bp, Homo sapiens
ggctggtccaggg

SEQ ID NO: 752961 - DNA, 13 bp, Homo sapiens
ggctggtctcaaa

SEQ ID NO: 752962 - DNA, 21 bp, Homo sapiens
ggctggtcttggggaggcagg

SEQ ID NO: 752963 - DNA, 13 bp, Homo sapiens
ggctggtgcccca

SEQ ID NO: 752964 - DNA, 15 bp, Homo sapiens
ggctggtgccccaca

SEQ ID NO: 752965 - DNA, 18 bp, Homo sapiens
ggctggtgccccacagct

SEQ ID NO: 752966 - DNA, 14 bp, Homo sapiens
ggctggtggcaagt

SEQ ID NO: 752967 - DNA, 14 bp, Homo sapiens
ggctggtggcccag

SEQ ID NO: 752968 - DNA, 15 bp, Homo sapiens
ggctggtggccttgg

SEQ ID NO: 752969 - DNA, 13 bp, Homo sapiens
ggctggtgggccc

SEQ ID NO: 752970 - DNA, 22 bp, Homo sapiens
ggctggtgtccccttcccctgc

SEQ ID NO: 752971 - DNA, 22 bp, Homo sapiens
ggctgtaaatcctagacttgaa

SEQ ID NO: 752972 - DNA, 20 bp, Homo sapiens
ggctgtactgctcaggctgc

SEQ ID NO: 752973 - DNA, 17 bp, Homo sapiens
ggctgtagatcaggttt

SEQ ID NO: 752974 - DNA, 18 bp, Homo sapiens
ggctgtagatcaggtttg

SEQ ID NO: 752975 - DNA, 22 bp, Homo sapiens
ggctgtatttatctctgaggca

SEQ ID NO: 752976 - DNA, 14 bp, Homo sapiens
ggctgtatttgctg

SEQ ID NO: 752977 - DNA, 17 bp, Homo sapiens
ggctgtcatctgtgcac

SEQ ID NO: 752978 - DNA, 17 bp, Homo sapiens
ggctgtcctccttcctg

SEQ ID NO: 752979 - DNA, 22 bp, Homo sapiens
ggctgtcctccttcctgggacc

SEQ ID NO: 752980 - DNA, 13 bp, Homo sapiens
ggctgtcctgtac

SEQ ID NO: 752981 - DNA, 15 bp, Homo sapiens
ggctgtccttcccct

SEQ ID NO: 752982 - DNA, 21 bp, Homo sapiens
ggctgtcgggggctgtggatg

SEQ ID NO: 752983 - DNA, 14 bp, Homo sapiens
ggctgtctgggtgt

SEQ ID NO: 752984 - DNA, 16 bp, Homo sapiens
ggctgtctgtgccatg

SEQ ID NO: 752985 - DNA, 17 bp, Homo sapiens
ggctgtctgttgtattc

SEQ ID NO: 752986 - DNA, 22 bp, Homo sapiens
ggctgtctttgcagggcacaga

SEQ ID NO: 752987 - DNA, 22 bp, Homo sapiens
ggctgtgacaaccctggcctca

SEQ ID NO: 752988 - DNA, 19 bp, Homo sapiens
ggctgtgactctgggcagg

SEQ ID NO: 752989 - DNA, 11 bp, Homo sapiens
ggctgtgccaa

SEQ ID NO: 752990 - DNA, 16 bp, Homo sapiens
ggctgtgcccagcagg

SEQ ID NO: 752991 - DNA, 14 bp, Homo sapiens
ggctgtgcccggcc

SEQ ID NO: 752992 - DNA, 15 bp, Homo sapiens
ggctgtgcctgcttc

SEQ ID NO: 752993 - DNA, 15 bp, Homo sapiens
ggctgtgctcagaga

SEQ ID NO: 752994 - DNA, 12 bp, Homo sapiens
ggctgtggagca

SEQ ID NO: 752995 - DNA, 21 bp, Homo sapiens
ggctgtggagcaaaaggcagc

SEQ ID NO: 752996 - DNA, 17 bp, Homo sapiens
ggctgtggaggcctgat

SEQ ID NO: 752997 - DNA, 22 bp, Homo sapiens
ggctgtggaggcctgatgctgc

SEQ ID NO: 752998 - DNA, 14 bp, Homo sapiens
ggctgtggcacaga

SEQ ID NO: 752999 - DNA, 19 bp, Homo sapiens
ggctgtggcatttccaaac

SEQ ID NO: 753000 - DNA, 12 bp, Homo sapiens
ggctgtggccct

SEQ ID NO: 753001 - DNA, 22 bp, Homo sapiens
ggctgtggccgtctcctccctc

SEQ ID NO: 753002 - DNA, 16 bp, Homo sapiens
ggctgtggctggtgag

SEQ ID NO: 753003 - DNA, 21 bp, Homo sapiens
ggctgtgggcctcaaggactt

SEQ ID NO: 753004 - DNA, 15 bp, Homo sapiens
ggctgtggggtgggc

SEQ ID NO: 753005 - DNA, 13 bp, Homo sapiens
ggctgtgggtgtg

SEQ ID NO: 753006 - DNA, 18 bp, Homo sapiens
ggctgtgtaaccttgggt

SEQ ID NO: 753007 - DNA, 20 bp, Homo sapiens
ggctgtgtaagatttgtttt

SEQ ID NO: 753008 - DNA, 19 bp, Homo sapiens
ggctgtgtcctaaggccca

SEQ ID NO: 753009 - DNA, 12 bp, Homo sapiens
ggctgtgtctct

SEQ ID NO: 753010 - DNA, 21 bp, Homo sapiens
ggctttgcccacccctcactc

SEQ ID NO: 753011 - DNA, 22 bp, Homo sapiens
ggctttgggcccaagaactgca

SEQ ID NO: 753012 - DNA, 15 bp, Homo sapiens
ggctttggggtccta

SEQ ID NO: 753013 - DNA, 18 bp, Homo sapiens
ggctttggttccttctct

SEQ ID NO: 753014 - DNA, 15 bp, Homo sapiens
ggctttgtgcttggg

SEQ ID NO: 753015 - DNA, 13 bp, Homo sapiens
ggcttttaagaaa

SEQ ID NO: 753016 - DNA, 19 bp, Homo sapiens
ggcttttattaatgcactt

SEQ ID NO: 753017 - DNA, 10 bp, Homo sapiens
ggcttttgtg

SEQ ID NO: 753018 - DNA, 17 bp, Homo sapiens
ggctttttttttctctt

SEQ ID NO: 753019 - DNA, 13 bp, Homo sapiens
gggaaaaaaaaaa

SEQ ID NO: 753020 - DNA, 15 bp, Homo sapiens
gggaaaaaaaagaaa

SEQ ID NO: 753021 - DNA, 17 bp, Homo sapiens
gggaaaaaaaagaaaaa

SEQ ID NO: 753022 - DNA, 21 bp, Homo sapiens
gggaaaaaagttttgatgaaa

SEQ ID NO: 753023 - DNA, 22 bp, Homo sapiens
gggaaaatggccatgcaggagg

SEQ ID NO: 753024 - DNA, 22 bp, Homo sapiens
gggaaaatgtgaaatctcagaa

SEQ ID NO: 753025 - DNA, 19 bp, Homo sapiens
gggaaacaatgaaaacaaa

SEQ ID NO: 753026 - DNA, 10 bp, Homo sapiens
gggaaacacc

SEQ ID NO: 753027 - DNA, 23 bp, Homo sapiens
gggaaacagagtccaatttaagg

SEQ ID NO: 753028 - DNA, 21 bp, Homo sapiens
gggaaaccctggagccatccc

SEQ ID NO: 753029 - DNA, 22 bp, Homo sapiens
gggaaacctgcctttgtatgtg

SEQ ID NO: 753030 - DNA, 14 bp, Homo sapiens
gggaaactggctga

SEQ ID NO: 753031 - DNA, 14 bp, Homo sapiens
gggaaacttggctc

SEQ ID NO: 753032 - DNA, 14 bp, Homo sapiens
gggaaagaagaaac

SEQ ID NO: 753033 - DNA, 21 bp, Homo sapiens
gggaaagacatccataaagaa

SEQ ID NO: 753034 - DNA, 15 bp, Homo sapiens
gggaaagagggagca

SEQ ID NO: 753035 - DNA, 11 bp, Homo sapiens
gggaaaggaaa

SEQ ID NO: 753036 - DNA, 23 bp, Homo sapiens
gggaaagtcagctttcagagcca

SEQ ID NO: 753037 - DNA, 20 bp, Homo sapiens
gggaaagtgcatatgaaatc

SEQ ID NO: 753038 - DNA, 16 bp, Homo sapiens
gggaaatgcagaaatc

SEQ ID NO: 753039 - DNA, 16 bp, Homo sapiens
gggaaatgtaatactg

SEQ ID NO: 753040 - DNA, 23 bp, Homo sapiens
gggaaatgtaatactggaataat

SEQ ID NO: 753041 - DNA, 20 bp, Homo sapiens
gggaaattgaagtgtcttct

SEQ ID NO: 753042 - DNA, 14 bp, Homo sapiens
gggaacaatttggc

SEQ ID NO: 753043 - DNA, 17 bp, Homo sapiens
gggaacactcatccctg

SEQ ID NO: 753044 - DNA, 16 bp, Homo sapiens
gggaacagacaggaga

SEQ ID NO: 753045 - DNA, 18 bp, Homo sapiens
gggaacagacaggagaaa

SEQ ID NO: 753046 - DNA, 13 bp, Homo sapiens
gggaacaggcccc

SEQ ID NO: 753047 - DNA, 21 bp, Homo sapiens
gggaacagtaaagaaagcaga

SEQ ID NO: 753048 - DNA, 15 bp, Homo sapiens
gggaacatgccccct

SEQ ID NO: 753049 - DNA, 22 bp, Homo sapiens
gggaaccaagctattcctttcc

SEQ ID NO: 753050 - DNA, 18 bp, Homo sapiens
gggaaccatgaagacagg

SEQ ID NO: 753051 - DNA, 16 bp, Homo sapiens
gggaaccccagggggc

SEQ ID NO: 753052 - DNA, 17 bp, Homo sapiens
gggaaccccgcagcccg

SEQ ID NO: 753053 - DNA, 20 bp, Homo sapiens
gggaacctagtactctctgc

SEQ ID NO: 753054 - DNA, 21 bp, Homo sapiens
gggaacctagtactctctgct

SEQ ID NO: 753055 - DNA, 14 bp, Homo sapiens
gggaacctgtgtcc

SEQ ID NO: 753056 - DNA, 14 bp, Homo sapiens
gggaacgcagcctc

SEQ ID NO: 753057 - DNA, 14 bp, Homo sapiens
gggaacgtgactgc

SEQ ID NO: 753058 - DNA, 20 bp, Homo sapiens
gggaagaaacactttctctt

SEQ ID NO: 753059 - DNA, 14 bp, Homo sapiens
gggaagagaagaca

SEQ ID NO: 753060 - DNA, 15 bp, Homo sapiens
gggaagagaagacaa

SEQ ID NO: 753061 - DNA, 21 bp, Homo sapiens
gggaagagacaaagtgggtgt

SEQ ID NO: 753062 - DNA, 17 bp, Homo sapiens
gggaagaggactgtgtg

SEQ ID NO: 753063 - DNA, 23 bp, Homo sapiens
gggaagaggactgtgtgagaggg

SEQ ID NO: 753064 - DNA, 12 bp, Homo sapiens
gggaagaggcct

SEQ ID NO: 753065 - DNA, 18 bp, Homo sapiens
gggaagaggggctggggc

SEQ ID NO: 753066 - DNA, 17 bp, Homo sapiens
gggaagagtggaggtgg

SEQ ID NO: 753067 - DNA, 22 bp, Homo sapiens
gggaagagtttttgtgatgggg

SEQ ID NO: 753068 - DNA, 18 bp, Homo sapiens
gggaagatgaactttgtc

SEQ ID NO: 753069 - DNA, 21 bp, Homo sapiens
gggaagattttatgcacagcc

SEQ ID NO: 753070 - DNA, 19 bp, Homo sapiens
gggaagcaaaggggggagg

SEQ ID NO: 753071 - DNA, 22 bp, Homo sapiens
gggaagcagaatagcaaggtgc

SEQ ID NO: 753072 - DNA, 13 bp, Homo sapiens
gggaagccagtga

SEQ ID NO: 753073 - DNA, 13 bp, Homo sapiens
gggaagcccaccc

SEQ ID NO: 753074 - DNA, 19 bp, Homo sapiens
gggaagcctgtgccagcac

SEQ ID NO: 753075 - DNA, 23 bp, Homo sapiens
gggaagcggaggttgcagggagc

SEQ ID NO: 753076 - DNA, 20 bp, Homo sapiens
gggaagctgccacccctctt

SEQ ID NO: 753077 - DNA, 15 bp, Homo sapiens
gggaagctggcctga

SEQ ID NO: 753078 - DNA, 14 bp, Homo sapiens
gggaagctggcttt

SEQ ID NO: 753079 - DNA, 12 bp, Homo sapiens
gggaaggaaaaa

SEQ ID NO: 753080 - DNA, 17 bp, Homo sapiens
gggaaggagggacttgg

SEQ ID NO: 753081 - DNA, 18 bp, Homo sapiens
ctgcaaggtactctggtg

SEQ ID NO: 753082 - DNA, 18 bp, Homo sapiens
ctgcaaggtttaggctgg

SEQ ID NO: 753083 - DNA, 20 bp, Homo sapiens
ctgcaataaaaaaattaccc

SEQ ID NO: 753084 - DNA, 12 bp, Homo sapiens
ctgcaatagaga

SEQ ID NO: 753085 - DNA, 15 bp, Homo sapiens
ctgcaatagagactg

SEQ ID NO: 753086 - DNA, 16 bp, Homo sapiens
ctgcaatagagactgt

SEQ ID NO: 753087 - DNA, 19 bp, Homo sapiens
ctgcaatagagactgtaga

SEQ ID NO: 753088 - DNA, 16 bp, Homo sapiens
ctgcaatatttgaatt

SEQ ID NO: 753089 - DNA, 19 bp, Homo sapiens
ctgcaatatttgaatttta

SEQ ID NO: 753090 - DNA, 16 bp, Homo sapiens
ctgcaatcctgtcttt

SEQ ID NO: 753091 - DNA, 23 bp, Homo sapiens
ctgcaatcctgtctttctgagca

SEQ ID NO: 753092 - DNA, 14 bp, Homo sapiens
ctgcaatgcctaga

SEQ ID NO: 753093 - DNA, 16 bp, Homo sapiens
ctgcaatggcagcatt

SEQ ID NO: 753094 - DNA, 17 bp, Homo sapiens
ctgcaatgggcactggg

SEQ ID NO: 753095 - DNA, 16 bp, Homo sapiens
ctgcaatgttttcctt

SEQ ID NO: 753096 - DNA, 23 bp, Homo sapiens
ctgcaattaaagtgatactgaaa

SEQ ID NO: 753097 - DNA, 14 bp, Homo sapiens
ctgcaattccctgg

SEQ ID NO: 753098 - DNA, 15 bp, Homo sapiens
ctgcaattgcttagg

SEQ ID NO: 753099 - DNA, 16 bp, Homo sapiens
ctgcaattgcttagga

SEQ ID NO: 753100 - DNA, 23 bp, Homo sapiens
ctgcacaaaagcagatacttgag

SEQ ID NO: 753101 - DNA, 16 bp, Homo sapiens
ctgcacaacagccctg

SEQ ID NO: 753102 - DNA, 17 bp, Homo sapiens
ctgcacaacagccctgc

SEQ ID NO: 753103 - DNA, 21 bp, Homo sapiens
ctgcacaagccatgctggctc

SEQ ID NO: 753104 - DNA, 22 bp, Homo sapiens
ctgcacaagctgcaccctcagg

SEQ ID NO: 753105 - DNA, 14 bp, Homo sapiens
ctgcacacaaatat

SEQ ID NO: 753106 - DNA, 15 bp, Homo sapiens
ctgcacacacagctc

SEQ ID NO: 753107 - DNA, 13 bp, Homo sapiens
ctgcacacacctg

SEQ ID NO: 753108 - DNA, 19 bp, Homo sapiens
ctgcacacagaatgctcag

SEQ ID NO: 753109 - DNA, 20 bp, Homo sapiens
ctgcacacagaatgctcagg

SEQ ID NO: 753110 - DNA, 21 bp, Homo sapiens
ctgcacacagaatgctcaggg

SEQ ID NO: 753111 - DNA, 19 bp, Homo sapiens
ctgcacacagacggcctag

SEQ ID NO: 753112 - DNA, 16 bp, Homo sapiens
ctgcacacaggacagc

SEQ ID NO: 753113 - DNA, 18 bp, Homo sapiens
ctgcacacaggacagcgg

SEQ ID NO: 753114 - DNA, 23 bp, Homo sapiens
ctgcacaccagcccagctcccgt

SEQ ID NO: 753115 - DNA, 21 bp, Homo sapiens
ctgcacaccttgaatctgcct

SEQ ID NO: 753116 - DNA, 16 bp, Homo sapiens
ctgcacactatttccc

SEQ ID NO: 753117 - DNA, 17 bp, Homo sapiens
ctgcacagaagggctct

SEQ ID NO: 753118 - DNA, 18 bp, Homo sapiens
ctgcacagaagggctctt

SEQ ID NO: 753119 - DNA, 12 bp, Homo sapiens
ctgcacagatgg

SEQ ID NO: 753120 - DNA, 22 bp, Homo sapiens
ctgcacagcaggacctgtgctt

SEQ ID NO: 753121 - DNA, 20 bp, Homo sapiens
ctgcacaggcacacagggcc

SEQ ID NO: 753122 - DNA, 18 bp, Homo sapiens
ctgcacagtgcatctcag

SEQ ID NO: 753123 - DNA, 18 bp, Homo sapiens
ctgcacagtgctgttggt

SEQ ID NO: 753124 - DNA, 15 bp, Homo sapiens
ctgcacagtttagaa

SEQ ID NO: 753125 - DNA, 20 bp, Homo sapiens
ctgcacagtttagaacagag

SEQ ID NO: 753126 - DNA, 24 bp, Homo sapiens
ctgcacagtttagaacagagggac

SEQ ID NO: 753127 - DNA, 11 bp, Homo sapiens
ctgcacatcta

SEQ ID NO: 753128 - DNA, 17 bp, Homo sapiens
ctgcacatctacacaca

SEQ ID NO: 753129 - DNA, 22 bp, Homo sapiens
ctgcacatgactcgggggtggg

SEQ ID NO: 753130 - DNA, 23 bp, Homo sapiens
ctgcacatgactcgggggtgggg

SEQ ID NO: 753131 - DNA, 16 bp, Homo sapiens
ctgcagatagcccagg

SEQ ID NO: 753132 - DNA, 21 bp, Homo sapiens
ctgcagatagcccaggagcaa

SEQ ID NO: 753133 - DNA, 16 bp, Homo sapiens
ctgcagatgccaccct

SEQ ID NO: 753134 - DNA, 19 bp, Homo sapiens
ctgcagatgccaccctagc

SEQ ID NO: 753135 - DNA, 22 bp, Homo sapiens
ctgcagatgccaccctagccaa

SEQ ID NO: 753136 - DNA, 18 bp, Homo sapiens
ctgcagattgagacctac

SEQ ID NO: 753137 - DNA, 17 bp, Homo sapiens
ctgcagcaaacactcca

SEQ ID NO: 753138 - DNA, 18 bp, Homo sapiens
ctgcagcaaacactccac

SEQ ID NO: 753139 - DNA, 15 bp, Homo sapiens
ctgcagcaataaagc

SEQ ID NO: 753140 - DNA, 12 bp, Homo sapiens
ctgcagcacctc

SEQ ID NO: 753141 - DNA, 19 bp, Homo sapiens
ctgcagcacctccaggcct

SEQ ID NO: 753142 - DNA, 18 bp, Homo sapiens
ctgcagcacgcggccttg

SEQ ID NO: 753143 - DNA, 19 bp, Homo sapiens
ctgcagcactttaaccctc

SEQ ID NO: 753144 - DNA, 22 bp, Homo sapiens
ctgcagcagccggaatagagcc

SEQ ID NO: 753145 - DNA, 21 bp, Homo sapiens
ctgcagcaggagtggtgcaga

SEQ ID NO: 753146 - DNA, 15 bp, Homo sapiens
ctgcagcaggtgctg

SEQ ID NO: 753147 - DNA, 19 bp, Homo sapiens
ctgcagcaggtgctgggct

SEQ ID NO: 753148 - DNA, 17 bp, Homo sapiens
ctgcagcatgacctgtg

SEQ ID NO: 753149 - DNA, 22 bp, Homo sapiens
ctgcagcatgacctgtgaccag

SEQ ID NO: 753150 - DNA, 23 bp, Homo sapiens
ctgcagcatggtccctgccttag

SEQ ID NO: 753151 - DNA, 22 bp, Homo sapiens
ctgcagcatgttgctgaggagt

SEQ ID NO: 753152 - DNA, 12 bp, Homo sapiens
ctgcagccagcc

SEQ ID NO: 753153 - DNA, 23 bp, Homo sapiens
ctgcagccagcccagcccagctg

SEQ ID NO: 753154 - DNA, 14 bp, Homo sapiens
ctgcagccatcccg

SEQ ID NO: 753155 - DNA, 23 bp, Homo sapiens
ctgcagcccaaaacccagggcaa

SEQ ID NO: 753156 - DNA, 19 bp, Homo sapiens
ctgcagcccaccagacgtc

SEQ ID NO: 753157 - DNA, 21 bp, Homo sapiens
ctgcagcccaccagacgtcag

SEQ ID NO: 753158 - DNA, 15 bp, Homo sapiens
ctgcagcccttgggc

SEQ ID NO: 753159 - DNA, 20 bp, Homo sapiens
ctgcagccggaggaggagat

SEQ ID NO: 753160 - DNA, 14 bp, Homo sapiens
ctgcagcctcaacc

SEQ ID NO: 753161 - DNA, 20 bp, Homo sapiens
ctgcagcctcatactcctgg

SEQ ID NO: 753162 - DNA, 21 bp, Homo sapiens
ctgcagcctcatactcctggg

SEQ ID NO: 753163 - DNA, 16 bp, Homo sapiens
ctgcagcctcctcctg

SEQ ID NO: 753164 - DNA, 12 bp, Homo sapiens
ctgcagcctctc

SEQ ID NO: 753165 - DNA, 20 bp, Homo sapiens
ctgcagcctctctggctggt

SEQ ID NO: 753166 - DNA, 16 bp, Homo sapiens
ctgcagcctctgcctc

SEQ ID NO: 753167 - DNA, 12 bp, Homo sapiens
ctgcagcctgca

SEQ ID NO: 753168 - DNA, 14 bp, Homo sapiens
ctgcagcctgcagg

SEQ ID NO: 753169 - DNA, 18 bp, Homo sapiens
ctgcagcctgctggggct

SEQ ID NO: 753170 - DNA, 19 bp, Homo sapiens
ctgcagcctgctggggcta

SEQ ID NO: 753171 - DNA, 11 bp, Homo sapiens
ctgcagcctgg

SEQ ID NO: 753172 - DNA, 13 bp, Homo sapiens
ctgcagcctgggt

SEQ ID NO: 753173 - DNA, 14 bp, Homo sapiens
ctgcagcctgggtc

SEQ ID NO: 753174 - DNA, 17 bp, Homo sapiens
ctgcagccttgaactcc

SEQ ID NO: 753175 - DNA, 20 bp, Homo sapiens
ctgcagccttgaactcctgg

SEQ ID NO: 753176 - DNA, 18 bp, Homo sapiens
ctgcagcctttgcctccc

SEQ ID NO: 753177 - DNA, 18 bp, Homo sapiens
ctgcagcgcctcccttgt

SEQ ID NO: 753178 - DNA, 15 bp, Homo sapiens
ctgcagcgcgcacac

SEQ ID NO: 753179 - DNA, 15 bp, Homo sapiens
ctgcagcgcgctcct

SEQ ID NO: 753180 - DNA, 13 bp, Homo sapiens
ctgcagctgacct

SEQ ID NO: 753181 - DNA, 15 bp, Homo sapiens
ctgcagctgcaccag

SEQ ID NO: 753182 - DNA, 13 bp, Homo sapiens
ctgcagctgccgg

SEQ ID NO: 753183 - DNA, 11 bp, Homo sapiens
ctgcagctgct

SEQ ID NO: 753184 - DNA, 12 bp, Homo sapiens
ctgcagctgctg

SEQ ID NO: 753185 - DNA, 15 bp, Homo sapiens
ctgcagctgctgaag

SEQ ID NO: 753186 - DNA, 22 bp, Homo sapiens
ctgcagctgctgaagttctgag

SEQ ID NO: 753187 - DNA, 18 bp, Homo sapiens
ctgcagctggacagaggg

SEQ ID NO: 753188 - DNA, 13 bp, Homo sapiens
ctgcagctgggcc

SEQ ID NO: 753189 - DNA, 20 bp, Homo sapiens
ctgcagctgggccccatgct

SEQ ID NO: 753190 - DNA, 24 bp, Homo sapiens
ctgcagctgggccccatgctctgc

SEQ ID NO: 753191 - DNA, 13 bp, Homo sapiens
ctgcagctgtttg

SEQ ID NO: 753192 - DNA, 21 bp, Homo sapiens
ctgcagcttctaactggtaaa

SEQ ID NO: 753193 - DNA, 12 bp, Homo sapiens
ctgcagctttac

SEQ ID NO: 753194 - DNA, 21 bp, Homo sapiens
ctgcagctttacatgcaattt

SEQ ID NO: 753195 - DNA, 15 bp, Homo sapiens
ctgcaggaacgagca

SEQ ID NO: 753196 - DNA, 18 bp, Homo sapiens
ctgcaggaacgagcactg

SEQ ID NO: 753197 - DNA, 20 bp, Homo sapiens
ctgcaggaacgagcactggc

SEQ ID NO: 753198 - DNA, 21 bp, Homo sapiens
ctgcaggaacgagcactggcc

SEQ ID NO: 753199 - DNA, 22 bp, Homo sapiens
ctgcaggaacgagcactggcca

SEQ ID NO: 753200 - DNA, 24 bp, Homo sapiens
ctgcaggaacgagcactggccaga

SEQ ID NO: 753201 - DNA, 21 bp, Homo sapiens
ctgcaggacagtcaaggtgat

SEQ ID NO: 753202 - DNA, 19 bp, Homo sapiens
ctgcaggacttgagaagac

SEQ ID NO: 753203 - DNA, 17 bp, Homo sapiens
ctgcaggagagagcagc

SEQ ID NO: 753204 - DNA, 13 bp, Homo sapiens
ctgcaggagcagg

SEQ ID NO: 753205 - DNA, 13 bp, Homo sapiens
ctgcaggagggca

SEQ ID NO: 753206 - DNA, 15 bp, Homo sapiens
ctgcaggagggcact

SEQ ID NO: 753207 - DNA, 17 bp, Homo sapiens
ctgcaggagggcactgg

SEQ ID NO: 753208 - DNA, 21 bp, Homo sapiens
ctgcaggcaccgggctggctg

SEQ ID NO: 753209 - DNA, 13 bp, Homo sapiens
ctgcaggcagaca

SEQ ID NO: 753210 - DNA, 15 bp, Homo sapiens
ctgcaggcagacacg

SEQ ID NO: 753211 - DNA, 23 bp, Homo sapiens
gggactgagagatgcagaaatat

SEQ ID NO: 753212 - DNA, 13 bp, Homo sapiens
gggactgagccag

SEQ ID NO: 753213 - DNA, 21 bp, Homo sapiens
gggactgccttgtctctagta

SEQ ID NO: 753214 - DNA, 21 bp, Homo sapiens
gggactgctgctgcctggcca

SEQ ID NO: 753215 - DNA, 17 bp, Homo sapiens
gggactgggagtcagag

SEQ ID NO: 753216 - DNA, 19 bp, Homo sapiens
gggactgtcacactggtgc

SEQ ID NO: 753217 - DNA, 21 bp, Homo sapiens
gggactgtctttcagatacat

SEQ ID NO: 753218 - DNA, 15 bp, Homo sapiens
gggacttccttgctc

SEQ ID NO: 753219 - DNA, 19 bp, Homo sapiens
gggacttcttacccaaagc

SEQ ID NO: 753220 - DNA, 17 bp, Homo sapiens
gggacttggagagcaaa

SEQ ID NO: 753221 - DNA, 21 bp, Homo sapiens
gggacttggctgtccttcccc

SEQ ID NO: 753222 - DNA, 13 bp, Homo sapiens
gggacttgtgtct

SEQ ID NO: 753223 - DNA, 14 bp, Homo sapiens
gggacttgtgtctg

SEQ ID NO: 753224 - DNA, 15 bp, Homo sapiens
gggagaaaaagaaac

SEQ ID NO: 753225 - DNA, 19 bp, Homo sapiens
gggagaaaaagaaacacaa

SEQ ID NO: 753226 - DNA, 10 bp, Homo sapiens
gggagaaaac

SEQ ID NO: 753227 - DNA, 11 bp, Homo sapiens
gggagaaaaga

SEQ ID NO: 753228 - DNA, 20 bp, Homo sapiens
gggagaaaatcatcaagaag

SEQ ID NO: 753229 - DNA, 16 bp, Homo sapiens
gggagaacctcaggct

SEQ ID NO: 753230 - DNA, 23 bp, Homo sapiens
gggagaagcgggctgggggtagc

SEQ ID NO: 753231 - DNA, 14 bp, Homo sapiens
gggagaagctgaag

SEQ ID NO: 753232 - DNA, 23 bp, Homo sapiens
gggagaatcacttaagcctggaa

SEQ ID NO: 753233 - DNA, 17 bp, Homo sapiens
gggagaatgcagcccac

SEQ ID NO: 753234 - DNA, 18 bp, Homo sapiens
gggagacagaagcctgga

SEQ ID NO: 753235 - DNA, 13 bp, Homo sapiens
gggagacagcagc

SEQ ID NO: 753236 - DNA, 21 bp, Homo sapiens
gggagacagcttctctgcagt

SEQ ID NO: 753237 - DNA, 19 bp, Homo sapiens
gggagacagggctgctccc

SEQ ID NO: 753238 - DNA, 20 bp, Homo sapiens
gggagacagttgagagcggg

SEQ ID NO: 753239 - DNA, 17 bp, Homo sapiens
gggagacatggaccagc

SEQ ID NO: 753240 - DNA, 21 bp, Homo sapiens
gggagaccccttgttgcactg

SEQ ID NO: 753241 - DNA, 18 bp, Homo sapiens
gggagacctgttggcctg

SEQ ID NO: 753242 - DNA, 19 bp, Homo sapiens
gggagactgggctgaggga

SEQ ID NO: 753243 - DNA, 20 bp, Homo sapiens
gggagactgggctgagggag

SEQ ID NO: 753244 - DNA, 23 bp, Homo sapiens
gggagactgtggtaggggcaggg

SEQ ID NO: 753245 - DNA, 13 bp, Homo sapiens
gggagagacacag

SEQ ID NO: 753246 - DNA, 19 bp, Homo sapiens
gggagagagaaccaccact

SEQ ID NO: 753247 - DNA, 14 bp, Homo sapiens
gggagagagagaga

SEQ ID NO: 753248 - DNA, 23 bp, Homo sapiens
gggagagagagagagagaggaca

SEQ ID NO: 753249 - DNA, 23 bp, Homo sapiens
gggagagcaggctggcagctctc

SEQ ID NO: 753250 - DNA, 12 bp, Homo sapiens
gggagagccagc

SEQ ID NO: 753251 - DNA, 15 bp, Homo sapiens
gggagagccagctcc

SEQ ID NO: 753252 - DNA, 15 bp, Homo sapiens
gggagagccagctct

SEQ ID NO: 753253 - DNA, 17 bp, Homo sapiens
ctgccaatgtgggctgc

SEQ ID NO: 753254 - DNA, 18 bp, Homo sapiens
ctgccaatgtgggctgcc

SEQ ID NO: 753255 - DNA, 17 bp, Homo sapiens
ctgccacaacaccagcc

SEQ ID NO: 753256 - DNA, 20 bp, Homo sapiens
ctgccacaaccagccaggca

SEQ ID NO: 753257 - DNA, 12 bp, Homo sapiens
ctgccacacagg

SEQ ID NO: 753258 - DNA, 17 bp, Homo sapiens
ctgccacacttcaggct

SEQ ID NO: 753259 - DNA, 23 bp, Homo sapiens
ctgccacagcctcccctgccagg

SEQ ID NO: 753260 - DNA, 19 bp, Homo sapiens
ctgccacataataaagtgg

SEQ ID NO: 753261 - DNA, 14 bp, Homo sapiens
ctgccacatccagc

SEQ ID NO: 753262 - DNA, 14 bp, Homo sapiens
ctgccacatggagc

SEQ ID NO: 753263 - DNA, 16 bp, Homo sapiens
ctgccaccacgtctgc

SEQ ID NO: 753264 - DNA, 17 bp, Homo sapiens
ctgccaccacgtctgcc

SEQ ID NO: 753265 - DNA, 21 bp, Homo sapiens
ctgccaccacgtctgccaggc

SEQ ID NO: 753266 - DNA, 14 bp, Homo sapiens
ctgccaccagcccc

SEQ ID NO: 753267 - DNA, 15 bp, Homo sapiens
ctgccaccagccccc

SEQ ID NO: 753268 - DNA, 14 bp, Homo sapiens
ctgccaccaggcca

SEQ ID NO: 753269 - DNA, 17 bp, Homo sapiens
ctgccaccaggccacct

SEQ ID NO: 753270 - DNA, 13 bp, Homo sapiens
ctgccaccaggga

SEQ ID NO: 753271 - DNA, 12 bp, Homo sapiens
ctgccaccatgc

SEQ ID NO: 753272 - DNA, 17 bp, Homo sapiens
ctgccacccacctccct

SEQ ID NO: 753273 - DNA, 18 bp, Homo sapiens
ctgccacccacctccctg

SEQ ID NO: 753274 - DNA, 19 bp, Homo sapiens
ctgccacccacctccctgc

SEQ ID NO: 753275 - DNA, 23 bp, Homo sapiens
ctgccacccacctccctgcctcc

SEQ ID NO: 753276 - DNA, 13 bp, Homo sapiens
ctgccacccactc

SEQ ID NO: 753277 - DNA, 17 bp, Homo sapiens
ctgccacccccaggtct

SEQ ID NO: 753278 - DNA, 21 bp, Homo sapiens
ctgccacccccaggtcttcct

SEQ ID NO: 753279 - DNA, 22 bp, Homo sapiens
ctgccacccccaggtcttcctg

SEQ ID NO: 753280 - DNA, 24 bp, Homo sapiens
ctgccacccccaggtcttcctgct

SEQ ID NO: 753281 - DNA, 12 bp, Homo sapiens
ctgccaccccta

SEQ ID NO: 753282 - DNA, 16 bp, Homo sapiens
ctgccaccccttcctc

SEQ ID NO: 753283 - DNA, 19 bp, Homo sapiens
ctgccaccctacctgttca

SEQ ID NO: 753284 - DNA, 22 bp, Homo sapiens
ctgccaccctgccccttgccat

SEQ ID NO: 753285 - DNA, 16 bp, Homo sapiens
ctgccaccgactgccc

SEQ ID NO: 753286 - DNA, 18 bp, Homo sapiens
ctgccaccgactgcccag

SEQ ID NO: 753287 - DNA, 23 bp, Homo sapiens
ctgccaccggaggtcactccacc

SEQ ID NO: 753288 - DNA, 11 bp, Homo sapiens
ctgccacctcc

SEQ ID NO: 753289 - DNA, 13 bp, Homo sapiens
ctgccacctcccc

SEQ ID NO: 753290 - DNA, 22 bp, Homo sapiens
ctgccacctcccctatccaccc

SEQ ID NO: 753291 - DNA, 18 bp, Homo sapiens
ctgccacctccctgaccc

SEQ ID NO: 753292 - DNA, 15 bp, Homo sapiens
ctgccaccttgtggc

SEQ ID NO: 753293 - DNA, 13 bp, Homo sapiens
ctgccactcaccc

SEQ ID NO: 753294 - DNA, 21 bp, Homo sapiens
ctgccactcacccttcctggc

SEQ ID NO: 753295 - DNA, 19 bp, Homo sapiens
ctgccactcactaggcccc

SEQ ID NO: 753296 - DNA, 19 bp, Homo sapiens
ctgccactctctgggactc

SEQ ID NO: 753297 - DNA, 23 bp, Homo sapiens
ctgccactctctgggactctcct

SEQ ID NO: 753298 - DNA, 13 bp, Homo sapiens
ctgccactgccgc

SEQ ID NO: 753299 - DNA, 10 bp, Homo sapiens
ctgccactgg

SEQ ID NO: 753300 - DNA, 14 bp, Homo sapiens
ctgccactgggcac

SEQ ID NO: 753301 - DNA, 16 bp, Homo sapiens
ctgccactgggcacct

SEQ ID NO: 753302 - DNA, 18 bp, Homo sapiens
ctgccactgggcacctgc

SEQ ID NO: 753303 - DNA, 15 bp, Homo sapiens
ctgccactgggctct

SEQ ID NO: 753304 - DNA, 19 bp, Homo sapiens
ctgccactgggctctggac

SEQ ID NO: 753305 - DNA, 12 bp, Homo sapiens
ctgccactgtgt

SEQ ID NO: 753306 - DNA, 18 bp, Homo sapiens
ctgccacttctgcgggct

SEQ ID NO: 753307 - DNA, 20 bp, Homo sapiens
ctgccacttctgcgggctcc

SEQ ID NO: 753308 - DNA, 21 bp, Homo sapiens
ctgccacttctgcgggctccc

SEQ ID NO: 753309 - DNA, 22 bp, Homo sapiens
ctgccacttctgcgggctccct

SEQ ID NO: 753310 - DNA, 24 bp, Homo sapiens
ctgccacttctgcgggctccctcc

SEQ ID NO: 753311 - DNA, 21 bp, Homo sapiens
ctgccactttcacgtggcctc

SEQ ID NO: 753312 - DNA, 19 bp, Homo sapiens
ctgccagaaaaaaataact

SEQ ID NO: 753313 - DNA, 22 bp, Homo sapiens
ctgccagaccttaataaaggcc

SEQ ID NO: 753314 - DNA, 11 bp, Homo sapiens
ctgccagagaa

SEQ ID NO: 753315 - DNA, 15 bp, Homo sapiens
ctgccagcacagagc

SEQ ID NO: 753316 - DNA, 12 bp, Homo sapiens
ctgccagcagca

SEQ ID NO: 753317 - DNA, 13 bp, Homo sapiens
ctgccagcagcag

SEQ ID NO: 753318 - DNA, 15 bp, Homo sapiens
ctgccagcagcagca

SEQ ID NO: 753319 - DNA, 19 bp, Homo sapiens
ctgccagcagcagcaggtg

SEQ ID NO: 753320 - DNA, 12 bp, Homo sapiens
ctgccagccaca

SEQ ID NO: 753321 - DNA, 18 bp, Homo sapiens
ctgccagccagcagccag

SEQ ID NO: 753322 - DNA, 17 bp, Homo sapiens
ctgccagcccactgcct

SEQ ID NO: 753323 - DNA, 15 bp, Homo sapiens
ctgccagccgaccct

SEQ ID NO: 753324 - DNA, 21 bp, Homo sapiens
ctgccagccgaccctcctggc

SEQ ID NO: 753325 - DNA, 12 bp, Homo sapiens
ctgccagcctga

SEQ ID NO: 753326 - DNA, 16 bp, Homo sapiens
ctgccagcctgagcgg

SEQ ID NO: 753327 - DNA, 19 bp, Homo sapiens
ctgccagcctgagcggagg

SEQ ID NO: 753328 - DNA, 22 bp, Homo sapiens
ctgccagcctggcttctggagc

SEQ ID NO: 753329 - DNA, 15 bp, Homo sapiens
ctgccagccttgagc

SEQ ID NO: 753330 - DNA, 14 bp, Homo sapiens
ctgccagctgcctt

SEQ ID NO: 753331 - DNA, 15 bp, Homo sapiens
ctgccagctgccttc

SEQ ID NO: 753332 - DNA, 16 bp, Homo sapiens
ctgccagctgccttcc

SEQ ID NO: 753333 - DNA, 17 bp, Homo sapiens
ctgccaggaccccaggt

SEQ ID NO: 753334 - DNA, 15 bp, Homo sapiens
ctgccaggagctttg

SEQ ID NO: 753335 - DNA, 21 bp, Homo sapiens
ctgccaggcaacttttaaagc

SEQ ID NO: 753336 - DNA, 20 bp, Homo sapiens
ctgccaggcacacacagccc

SEQ ID NO: 753337 - DNA, 15 bp, Homo sapiens
ctgccaggcacctgg

SEQ ID NO: 753338 - DNA, 16 bp, Homo sapiens
ctgccaggcacctggc

SEQ ID NO: 753339 - DNA, 22 bp, Homo sapiens
ctgccaggcacctggcctgctg

SEQ ID NO: 753340 - DNA, 15 bp, Homo sapiens
ctgccaggcaggggt

SEQ ID NO: 753341 - DNA, 11 bp, Homo sapiens
ctgccaggcat

SEQ ID NO: 753342 - DNA, 16 bp, Homo sapiens
ctgccaggccagcctc

SEQ ID NO: 753343 - DNA, 22 bp, Homo sapiens
ctgccaggccagcctccgagag

SEQ ID NO: 753344 - DNA, 17 bp, Homo sapiens
ctgccaggcggccctgg

SEQ ID NO: 753345 - DNA, 14 bp, Homo sapiens
gggcaaaggcaggg

SEQ ID NO: 753346 - DNA, 15 bp, Homo sapiens
gggcaaaggcagggc

SEQ ID NO: 753347 - DNA, 16 bp, Homo sapiens
gggcaaaggcagggcc

SEQ ID NO: 753348 - DNA, 20 bp, Homo sapiens
gggcaaccaactgccccagg

SEQ ID NO: 753349 - DNA, 18 bp, Homo sapiens
gggcaagagggggacctg

SEQ ID NO: 753350 - DNA, 14 bp, Homo sapiens
gggcaagccagggc

SEQ ID NO: 753351 - DNA, 15 bp, Homo sapiens
gggcaagccagggcc

SEQ ID NO: 753352 - DNA, 18 bp, Homo sapiens
gggcaagccagggcccag

SEQ ID NO: 753353 - DNA, 19 bp, Homo sapiens
gggcaagccagggcccaga

SEQ ID NO: 753354 - DNA, 23 bp, Homo sapiens
gggcaagtgagaggggagggagg

SEQ ID NO: 753355 - DNA, 18 bp, Homo sapiens
gggcaatgccatcagccc

SEQ ID NO: 753356 - DNA, 20 bp, Homo sapiens
gggcaatgccatcagcccct

SEQ ID NO: 753357 - DNA, 18 bp, Homo sapiens
gggcacaaactgcagctg

SEQ ID NO: 753358 - DNA, 19 bp, Homo sapiens
gggcacaaactgcagctgt

SEQ ID NO: 753359 - DNA, 23 bp, Homo sapiens
gggcacaaactgcagctgtgagt

SEQ ID NO: 753360 - DNA, 18 bp, Homo sapiens
gggcacacacacccgccc

SEQ ID NO: 753361 - DNA, 11 bp, Homo sapiens
gggcacaccac

SEQ ID NO: 753362 - DNA, 21 bp, Homo sapiens
gggcacaccactgccctgcct

SEQ ID NO: 753363 - DNA, 15 bp, Homo sapiens
gggcacacgcctccc

SEQ ID NO: 753364 - DNA, 15 bp, Homo sapiens
gggcacagctgtctg

SEQ ID NO: 753365 - DNA, 13 bp, Homo sapiens
gggcacagtccag

SEQ ID NO: 753366 - DNA, 14 bp, Homo sapiens
gggcacagtccaga

SEQ ID NO: 753367 - DNA, 15 bp, Homo sapiens
gggcacagtccagga

SEQ ID NO: 753368 - DNA, 13 bp, Homo sapiens
gggcacagtgctg

SEQ ID NO: 753369 - DNA, 15 bp, Homo sapiens
gggcacagtgctgcc

SEQ ID NO: 753370 - DNA, 20 bp, Homo sapiens
gggcacagtgctgccccttg

SEQ ID NO: 753371 - DNA, 20 bp, Homo sapiens
gggcacattgcccatggctg

SEQ ID NO: 753372 - DNA, 15 bp, Homo sapiens
gggcaccagccagcg

SEQ ID NO: 753373 - DNA, 22 bp, Homo sapiens
gggcacccaccagaaattccag

SEQ ID NO: 753374 - DNA, 18 bp, Homo sapiens
gggcacctggggagtggg

SEQ ID NO: 753375 - DNA, 21 bp, Homo sapiens
gcgtgatggctatgccttgca

SEQ ID NO: 753376 - DNA, 13 bp, Homo sapiens
gcgtgcacatctg

SEQ ID NO: 753377 - DNA, 11 bp, Homo sapiens
gcgtgcagatg

SEQ ID NO: 753378 - DNA, 19 bp, Homo sapiens
gcgtgcagggacaaagagg

SEQ ID NO: 753379 - DNA, 16 bp, Homo sapiens
gcgtgcccccctcctc

SEQ ID NO: 753380 - DNA, 18 bp, Homo sapiens
gcgtgcccccctcctcca

SEQ ID NO: 753381 - DNA, 22 bp, Homo sapiens
gcgtgcccccctcctccagtac

SEQ ID NO: 753382 - DNA, 14 bp, Homo sapiens
gcgtgcccggggca

SEQ ID NO: 753383 - DNA, 17 bp, Homo sapiens
gcgtgccgcctgctcct

SEQ ID NO: 753384 - DNA, 14 bp, Homo sapiens
gcgtgccgtgtgag

SEQ ID NO: 753385 - DNA, 22 bp, Homo sapiens
gcgtgccgtgtgagtgtgacag

SEQ ID NO: 753386 - DNA, 24 bp, Homo sapiens
gcgtgccgtgtgagtgtgacaggg

SEQ ID NO: 753387 - DNA, 17 bp, Homo sapiens
gcgtgctgagaggcgag

SEQ ID NO: 753388 - DNA, 15 bp, Homo sapiens
gcgtggactggttgg

SEQ ID NO: 753389 - DNA, 17 bp, Homo sapiens
gcgtggaggagaggaga

SEQ ID NO: 753390 - DNA, 17 bp, Homo sapiens
gcgtggccacgggggca

SEQ ID NO: 753391 - DNA, 22 bp, Homo sapiens
gcgtggccacgggggcagtgtg

SEQ ID NO: 753392 - DNA, 12 bp, Homo sapiens
gcgtggcctccc

SEQ ID NO: 753393 - DNA, 19 bp, Homo sapiens
gcgtggcctccccatgggc

SEQ ID NO: 753394 - DNA, 15 bp, Homo sapiens
gcgtggcgtggcccg

SEQ ID NO: 753395 - DNA, 19 bp, Homo sapiens
gcgtggctgtggcacagac

SEQ ID NO: 753396 - DNA, 15 bp, Homo sapiens
gcgtgggctctgcca

SEQ ID NO: 753397 - DNA, 14 bp, Homo sapiens
gcgtgggtctctgg

SEQ ID NO: 753398 - DNA, 17 bp, Homo sapiens
gcgtgggtctctgggga

SEQ ID NO: 753399 - DNA, 16 bp, Homo sapiens
gcgtggtggctcatgc

SEQ ID NO: 753400 - DNA, 15 bp, Homo sapiens
gcgtggtgtggcccg

SEQ ID NO: 753401 - DNA, 19 bp, Homo sapiens
gcgtgtagcgtcctgagga

SEQ ID NO: 753402 - DNA, 20 bp, Homo sapiens
gcgtgtagcgtcctgaggaa

SEQ ID NO: 753403 - DNA, 13 bp, Homo sapiens
gcgtgtgaagaac

SEQ ID NO: 753404 - DNA, 13 bp, Homo sapiens
gcgtgtgcacgtg

SEQ ID NO: 753405 - DNA, 21 bp, Homo sapiens
gcgtgtgcatagcgtcctgcc

SEQ ID NO: 753406 - DNA, 22 bp, Homo sapiens
gcgtgtgcatagcgtcctgccc

SEQ ID NO: 753407 - DNA, 16 bp, Homo sapiens
gcgtgtgccaggcaga

SEQ ID NO: 753408 - DNA, 18 bp, Homo sapiens
gcgtgtgcgtgcatgtgc

SEQ ID NO: 753409 - DNA, 16 bp, Homo sapiens
gcgtgtgcgtgcgtgt

SEQ ID NO: 753410 - DNA, 12 bp, Homo sapiens
gcgtgtggcagc

SEQ ID NO: 753411 - DNA, 22 bp, Homo sapiens
gcgtgtggcagccacacgcagg

SEQ ID NO: 753412 - DNA, 11 bp, Homo sapiens
gcgtgtggctc

SEQ ID NO: 753413 - DNA, 22 bp, Homo sapiens
gcgtgtgggtcccgcactctgc

SEQ ID NO: 753414 - DNA, 18 bp, Homo sapiens
gcgtgtgtacacgggact

SEQ ID NO: 753415 - DNA, 15 bp, Homo sapiens
gcgtgtgtcagggat

SEQ ID NO: 753416 - DNA, 18 bp, Homo sapiens
gcgtgtgtccatgtgtgt

SEQ ID NO: 753417 - DNA, 23 bp, Homo sapiens
gcgtgtgtccatgtgtgtgcaag

SEQ ID NO: 753418 - DNA, 21 bp, Homo sapiens
gcgtgttagtgtgtgtgcatg

SEQ ID NO: 753419 - DNA, 20 bp, Homo sapiens
gcgttatggcagcccggctg

SEQ ID NO: 753420 - DNA, 22 bp, Homo sapiens
gcgttcatatgctctgctttta

SEQ ID NO: 753421 - DNA, 14 bp, Homo sapiens
gcgttcccttctcc

SEQ ID NO: 753422 - DNA, 15 bp, Homo sapiens
gcgttcccttctccc

SEQ ID NO: 753423 - DNA, 11 bp, Homo sapiens
gcgttcctggc

SEQ ID NO: 753424 - DNA, 15 bp, Homo sapiens
gcgttcctttctttt

SEQ ID NO: 753425 - DNA, 16 bp, Homo sapiens
gcgttctcctgcttgt

SEQ ID NO: 753426 - DNA, 18 bp, Homo sapiens
gcgttctggactctgccc

SEQ ID NO: 753427 - DNA, 14 bp, Homo sapiens
gcgttcttgtaatt

SEQ ID NO: 753428 - DNA, 15 bp, Homo sapiens
gcgttggagccactc

SEQ ID NO: 753429 - DNA, 14 bp, Homo sapiens
gcgttgggagccta

SEQ ID NO: 753430 - DNA, 17 bp, Homo sapiens
gcgttgggagcctagct

SEQ ID NO: 753431 - DNA, 20 bp, Homo sapiens
gcgttgtaaaatatagctgt

SEQ ID NO: 753432 - DNA, 16 bp, Homo sapiens
gcgttgttacaggaag

SEQ ID NO: 753433 - DNA, 15 bp, Homo sapiens
gcgtttaagttgtat

SEQ ID NO: 753434 - DNA, 21 bp, Homo sapiens
gcgtttagtttctagaggcct

SEQ ID NO: 753435 - DNA, 22 bp, Homo sapiens
gcgtttagtttctagaggcctc

SEQ ID NO: 753436 - DNA, 17 bp, Homo sapiens
gcgtttctatgacacat

SEQ ID NO: 753437 - DNA, 22 bp, Homo sapiens
gcgtttgaccttttatgtagta

SEQ ID NO: 753438 - DNA, 14 bp, Homo sapiens
gcgtttgcctcctg

SEQ ID NO: 753439 - DNA, 14 bp, Homo sapiens
gcgtttttacagtt

SEQ ID NO: 753440 - DNA, 22 bp, Homo sapiens
gcgtttttctcgtccccctccc

SEQ ID NO: 753441 - DNA, 14 bp, Homo sapiens
gcgtttttttacaa

SEQ ID NO: 753442 - DNA, 20 bp, Homo sapiens
gcgtttttttacaacattca

SEQ ID NO: 753443 - DNA, 18 bp, Homo sapiens
gctaaaaaagctgaatca

SEQ ID NO: 753444 - DNA, 18 bp, Homo sapiens
gctaaaaaataaataaaa

SEQ ID NO: 753445 - DNA, 13 bp, Homo sapiens
gctaaaaagcaac

SEQ ID NO: 753446 - DNA, 16 bp, Homo sapiens
gctaaaaatattactc

SEQ ID NO: 753447 - DNA, 15 bp, Homo sapiens
gctaaaaatgaaaat

SEQ ID NO: 753448 - DNA, 15 bp, Homo sapiens
gctaaaagaagagag

SEQ ID NO: 753449 - DNA, 14 bp, Homo sapiens
gctaaaaggaaaag

SEQ ID NO: 753450 - DNA, 15 bp, Homo sapiens
gctaaaagtgcattt

SEQ ID NO: 753451 - DNA, 15 bp, Homo sapiens
gctaaaataaaattt

SEQ ID NO: 753452 - DNA, 17 bp, Homo sapiens
gctaaaataaagaaata

SEQ ID NO: 753453 - DNA, 18 bp, Homo sapiens
gctaaacaagtaagaaaa

SEQ ID NO: 753454 - DNA, 23 bp, Homo sapiens
gctaaactccttcctggcctgag

SEQ ID NO: 753455 - DNA, 15 bp, Homo sapiens
gctaaactgaatcta

SEQ ID NO: 753456 - DNA, 18 bp, Homo sapiens
gctaaagaagtttgaaca

SEQ ID NO: 753457 - DNA, 14 bp, Homo sapiens
gctaaagatgatga

SEQ ID NO: 753458 - DNA, 21 bp, Homo sapiens
gctaaagcactttgcacttaa

SEQ ID NO: 753459 - DNA, 22 bp, Homo sapiens
gctaaagggaccatctgctgca

SEQ ID NO: 753460 - DNA, 20 bp, Homo sapiens
gctaaataaaatttgttgca

SEQ ID NO: 753461 - DNA, 12 bp, Homo sapiens
gctaaataaatg

SEQ ID NO: 753462 - DNA, 19 bp, Homo sapiens
gctaaatatttaccttgaa

SEQ ID NO: 753463 - DNA, 18 bp, Homo sapiens
gctaaatgcaatttaaaa

SEQ ID NO: 753464 - DNA, 22 bp, Homo sapiens
gctaaatgcaccaagaaagctt

SEQ ID NO: 753465 - DNA, 19 bp, Homo sapiens
gctaaatggtcgcccagga

SEQ ID NO: 753466 - DNA, 13 bp, Homo sapiens
gctaaatgtgaat

SEQ ID NO: 753467 - DNA, 16 bp, Homo sapiens
gctaaatgtgaatgat

SEQ ID NO: 753468 - DNA, 23 bp, Homo sapiens
gctaaattctatgttaaatactg

SEQ ID NO: 753469 - DNA, 18 bp, Homo sapiens
gctaaattttgttactga

SEQ ID NO: 753470 - DNA, 16 bp, Homo sapiens
gctaacaatgtctggt

SEQ ID NO: 753471 - DNA, 16 bp, Homo sapiens
gctaacaccagacaga

SEQ ID NO: 753472 - DNA, 16 bp, Homo sapiens
gctaacactggcccct

SEQ ID NO: 753473 - DNA, 19 bp, Homo sapiens
gctaacccccagcccacag

SEQ ID NO: 753474 - DNA, 21 bp, Homo sapiens
gctaacccccagcccacagag

SEQ ID NO: 753475 - DNA, 22 bp, Homo sapiens
gctaacccccttctactgagcc

SEQ ID NO: 753476 - DNA, 19 bp, Homo sapiens
gctaaccttttcacctcca

SEQ ID NO: 753477 - DNA, 13 bp, Homo sapiens
gctaactggaagc

SEQ ID NO: 753478 - DNA, 20 bp, Homo sapiens
gctaagagctagcgctgccg

SEQ ID NO: 753479 - DNA, 21 bp, Homo sapiens
gctaagatgagatttgccagc

SEQ ID NO: 753480 - DNA, 11 bp, Homo sapiens
gctaaggaaag

SEQ ID NO: 753481 - DNA, 22 bp, Homo sapiens
gctaaggaggggaaaaaaatgt

SEQ ID NO: 753482 - DNA, 12 bp, Homo sapiens
gctaaggctgct

SEQ ID NO: 753483 - DNA, 13 bp, Homo sapiens
gctaaggctgctg

SEQ ID NO: 753484 - DNA, 15 bp, Homo sapiens
gctaaggctgctggc

SEQ ID NO: 753485 - DNA, 19 bp, Homo sapiens
gctaagggtgggtgctcag

SEQ ID NO: 753486 - DNA, 21 bp, Homo sapiens
gctaagtaatttagaagatat

SEQ ID NO: 753487 - DNA, 17 bp, Homo sapiens
gctaagtatttcccagc

SEQ ID NO: 753488 - DNA, 21 bp, Homo sapiens
gctaagtcacccagagcacag

SEQ ID NO: 753489 - DNA, 21 bp, Homo sapiens
ctcacgggaccgtcagcatgg

SEQ ID NO: 753490 - DNA, 23 bp, Homo sapiens
ctcacgggaccgtcagcatgggc

SEQ ID NO: 753491 - DNA, 21 bp, Homo sapiens
ctcacgggcatgggcactccc

SEQ ID NO: 753492 - DNA, 15 bp, Homo sapiens
ctcacgggccctgcc

SEQ ID NO: 753493 - DNA, 22 bp, Homo sapiens
ctcacgggccctgccccagccc

SEQ ID NO: 753494 - DNA, 14 bp, Homo sapiens
ctcacggggcctcc

SEQ ID NO: 753495 - DNA, 19 bp, Homo sapiens
ctcacgtatttcacagagc

SEQ ID NO: 753496 - DNA, 20 bp, Homo sapiens
ctcacgtatttcacagagca

SEQ ID NO: 753497 - DNA, 23 bp, Homo sapiens
ctcagagctttaaaagtatcttt

SEQ ID NO: 753498 - DNA, 14 bp, Homo sapiens
ctcagagctttgtc

SEQ ID NO: 753499 - DNA, 21 bp, Homo sapiens
ctcagaggcccccagtgggga

SEQ ID NO: 753500 - DNA, 13 bp, Homo sapiens
ctcagaggcctgc

SEQ ID NO: 753501 - DNA, 14 bp, Homo sapiens
ctcagaggcctgct

SEQ ID NO: 753502 - DNA, 17 bp, Homo sapiens
ctcagaggcgcactgtg

SEQ ID NO: 753503 - DNA, 16 bp, Homo sapiens
ctcagaggctgttctt

SEQ ID NO: 753504 - DNA, 18 bp, Homo sapiens
ctcagagggggactgctg

SEQ ID NO: 753505 - DNA, 21 bp, Homo sapiens
ctcagagggtagccttgattt

SEQ ID NO: 753506 - DNA, 23 bp, Homo sapiens
ctcagaggtttacctagagaaca

SEQ ID NO: 753507 - DNA, 21 bp, Homo sapiens
ctcagagtccactgtggcact

SEQ ID NO: 753508 - DNA, 18 bp, Homo sapiens
ctcagagtccaggcccca

SEQ ID NO: 753509 - DNA, 18 bp, Homo sapiens
ctcagagtgaccctcagc

SEQ ID NO: 753510 - DNA, 22 bp, Homo sapiens
ctcagagtgaccctcagctgtc

SEQ ID NO: 753511 - DNA, 12 bp, Homo sapiens
ctcagagtggag

SEQ ID NO: 753512 - DNA, 14 bp, Homo sapiens
ctcagatacccagt

SEQ ID NO: 753513 - DNA, 15 bp, Homo sapiens
ctcagatataagaga

SEQ ID NO: 753514 - DNA, 16 bp, Homo sapiens
ctcagatataagagaa

SEQ ID NO: 753515 - DNA, 21 bp, Homo sapiens
ctcagatatagatcctgagct

SEQ ID NO: 753516 - DNA, 12 bp, Homo sapiens
ctcagatctgaa

SEQ ID NO: 753517 - DNA, 12 bp, Homo sapiens
ctcagatctgat

SEQ ID NO: 753518 - DNA, 16 bp, Homo sapiens
ctcagatgaggacaga

SEQ ID NO: 753519 - DNA, 13 bp, Homo sapiens
ctcagatgatctc

SEQ ID NO: 753520 - DNA, 14 bp, Homo sapiens
ctcagatggtgtgt

SEQ ID NO: 753521 - DNA, 17 bp, Homo sapiens
ctcagatgttaaaataa

SEQ ID NO: 753522 - DNA, 14 bp, Homo sapiens
ctcagattgctgaa

SEQ ID NO: 753523 - DNA, 16 bp, Homo sapiens
ctcagatttctgagga

SEQ ID NO: 753524 - DNA, 17 bp, Homo sapiens
ctcagattttatatttt

SEQ ID NO: 753525 - DNA, 20 bp, Homo sapiens
ctcagattttctaagaacca

SEQ ID NO: 753526 - DNA, 19 bp, Homo sapiens
ctcagcaaaagatgcttct

SEQ ID NO: 753527 - DNA, 20 bp, Homo sapiens
ctcagcaaaagatgcttctc

SEQ ID NO: 753528 - DNA, 16 bp, Homo sapiens
ctcagcaaagctacag

SEQ ID NO: 753529 - DNA, 20 bp, Homo sapiens
ctcagcaaagctacaggact

SEQ ID NO: 753530 - DNA, 20 bp, Homo sapiens
ctcagcacaaggccatctgg

SEQ ID NO: 753531 - DNA, 22 bp, Homo sapiens
ctcagcaccacattgcctcatt

SEQ ID NO: 753532 - DNA, 12 bp, Homo sapiens
ctcagcacccct

SEQ ID NO: 753533 - DNA, 21 bp, Homo sapiens
ctcagcacccctagcatgaac

SEQ ID NO: 753534 - DNA, 11 bp, Homo sapiens
ctcagcactgt

SEQ ID NO: 753535 - DNA, 17 bp, Homo sapiens
ctcagcagaggcagtgg

SEQ ID NO: 753536 - DNA, 19 bp, Homo sapiens
ctcagcagcagagagccct

SEQ ID NO: 753537 - DNA, 20 bp, Homo sapiens
ctcagcagcagagagccctg

SEQ ID NO: 753538 - DNA, 13 bp, Homo sapiens
ctcagcagccagt

SEQ ID NO: 753539 - DNA, 15 bp, Homo sapiens
ctcagcagccagtct

SEQ ID NO: 753540 - DNA, 15 bp, Homo sapiens
ctcagcagccctcct

SEQ ID NO: 753541 - DNA, 22 bp, Homo sapiens
ctcagcagccgccttaagctga

SEQ ID NO: 753542 - DNA, 14 bp, Homo sapiens
ctcagcagtccaca

SEQ ID NO: 753543 - DNA, 16 bp, Homo sapiens
ctcagcatatttgtat

SEQ ID NO: 753544 - DNA, 19 bp, Homo sapiens
ctcagcatatttgtatagt

SEQ ID NO: 753545 - DNA, 16 bp, Homo sapiens
ctcagcatgcatcctt

SEQ ID NO: 753546 - DNA, 15 bp, Homo sapiens
ctcagcatttctttt

SEQ ID NO: 753547 - DNA, 22 bp, Homo sapiens
ctcagcatttgattaacatttg

SEQ ID NO: 753548 - DNA, 15 bp, Homo sapiens
ctcagccaccctgag

SEQ ID NO: 753549 - DNA, 14 bp, Homo sapiens
ctcagccagagaag

SEQ ID NO: 753550 - DNA, 15 bp, Homo sapiens
ctcagccagctgttt

SEQ ID NO: 753551 - DNA, 11 bp, Homo sapiens
ctcagccaggc

SEQ ID NO: 753552 - DNA, 19 bp, Homo sapiens
ctcagccagtggcacagga

SEQ ID NO: 753553 - DNA, 23 bp, Homo sapiens
ctcagccagtggcacaggagact

SEQ ID NO: 753554 - DNA, 20 bp, Homo sapiens
ctcagccatccgcagactgc

SEQ ID NO: 753555 - DNA, 15 bp, Homo sapiens
ctcagccatgaggag

SEQ ID NO: 753556 - DNA, 22 bp, Homo sapiens
ctcagccatgggaacctcatat

SEQ ID NO: 753557 - DNA, 16 bp, Homo sapiens
ctcagccatttccccc

SEQ ID NO: 753558 - DNA, 21 bp, Homo sapiens
ctcagccatttccccctcctc

SEQ ID NO: 753559 - DNA, 22 bp, Homo sapiens
ctcagccatttccccctcctca

SEQ ID NO: 753560 - DNA, 11 bp, Homo sapiens
ctcagcccaac

SEQ ID NO: 753561 - DNA, 19 bp, Homo sapiens
ctcagcccacatagtgatg

SEQ ID NO: 753562 - DNA, 14 bp, Homo sapiens
ctcagccccaaaca

SEQ ID NO: 753563 - DNA, 22 bp, Homo sapiens
ctcagccccaaacacccaccca

SEQ ID NO: 753564 - DNA, 18 bp, Homo sapiens
ctcagccccatcgcccca

SEQ ID NO: 753565 - DNA, 18 bp, Homo sapiens
ctcagcccccaggccagg

SEQ ID NO: 753566 - DNA, 16 bp, Homo sapiens
ctcagccccgagctgt

SEQ ID NO: 753567 - DNA, 19 bp, Homo sapiens
ctcagccccgagctgtccc

SEQ ID NO: 753568 - DNA, 11 bp, Homo sapiens
ctcagccccta

SEQ ID NO: 753569 - DNA, 20 bp, Homo sapiens
ctcagcccctacccctgccc

SEQ ID NO: 753570 - DNA, 12 bp, Homo sapiens
ctcagcccctag

SEQ ID NO: 753571 - DNA, 14 bp, Homo sapiens
ctcagcccctagga

SEQ ID NO: 753572 - DNA, 18 bp, Homo sapiens
ctcagcccctcttgcccc

SEQ ID NO: 753573 - DNA, 12 bp, Homo sapiens
ctcagccctcag

SEQ ID NO: 753574 - DNA, 14 bp, Homo sapiens
ctcagccctccctg

SEQ ID NO: 753575 - DNA, 19 bp, Homo sapiens
ctcagccctccctgcccct

SEQ ID NO: 753576 - DNA, 15 bp, Homo sapiens
ctcagccctgaccct

SEQ ID NO: 753577 - DNA, 17 bp, Homo sapiens
ctcagccctggcctggc

SEQ ID NO: 753578 - DNA, 19 bp, Homo sapiens
ctcagccctggcctggctg

SEQ ID NO: 753579 - DNA, 21 bp, Homo sapiens
ctcagccctggcctggctggg

SEQ ID NO: 753580 - DNA, 15 bp, Homo sapiens
ctcagccctgggccc

SEQ ID NO: 753581 - DNA, 13 bp, Homo sapiens
ctcagcccttgcc

SEQ ID NO: 753582 - DNA, 23 bp, Homo sapiens
ctcagcccttgcccccatccctc

SEQ ID NO: 753583 - DNA, 16 bp, Homo sapiens
ctcagccgtcagccat

SEQ ID NO: 753584 - DNA, 20 bp, Homo sapiens
ctcagcctcattcagcatgg

SEQ ID NO: 753585 - DNA, 14 bp, Homo sapiens
ctcagcctccaaag

SEQ ID NO: 753586 - DNA, 11 bp, Homo sapiens
ctcagcctccc

SEQ ID NO: 753587 - DNA, 15 bp, Homo sapiens
ctcagcctcccaaag

SEQ ID NO: 753588 - DNA, 20 bp, Homo sapiens
ctcagcctcccaaagtgctg

SEQ ID NO: 753589 - DNA, 23 bp, Homo sapiens
ctcagcctcccaaagtgctggga

SEQ ID NO: 753590 - DNA, 18 bp, Homo sapiens
ctcagcctcccaagtaac

SEQ ID NO: 753591 - DNA, 13 bp, Homo sapiens
ctcagcctcccag

SEQ ID NO: 753592 - DNA, 20 bp, Homo sapiens
ctcagcctcccagagtgctg

SEQ ID NO: 753593 - DNA, 14 bp, Homo sapiens
ctcagcctcccagg

SEQ ID NO: 753594 - DNA, 16 bp, Homo sapiens
ctcagcctccccttct

SEQ ID NO: 753595 - DNA, 21 bp, Homo sapiens
ctcagcctcccgagtagctgg

SEQ ID NO: 753596 - DNA, 15 bp, Homo sapiens
ctcagcctccctagt

SEQ ID NO: 753597 - DNA, 17 bp, Homo sapiens
ctcagcctcctgagcct

SEQ ID NO: 753598 - DNA, 14 bp, Homo sapiens
ctcagcctcctggg

SEQ ID NO: 753599 - DNA, 16 bp, Homo sapiens
ctcagcctcctgggta

SEQ ID NO: 753600 - DNA, 13 bp, Homo sapiens
ctcagcctctgca

SEQ ID NO: 753601 - DNA, 20 bp, Homo sapiens
ctcagcctctgccagcgcca

SEQ ID NO: 753602 - DNA, 14 bp, Homo sapiens
ctcagcctgctgcc

SEQ ID NO: 753603 - DNA, 19 bp, Homo sapiens
ctcagcctgctgcccaggc

SEQ ID NO: 753604 - DNA, 18 bp, Homo sapiens
ctcagcctggagaggcct

SEQ ID NO: 753605 - DNA, 20 bp, Homo sapiens
ctcagcctggagaggcctgg

SEQ ID NO: 753606 - DNA, 11 bp, Homo sapiens
ctcagcctggg

SEQ ID NO: 753607 - DNA, 20 bp, Homo sapiens
ctcagcctggggctctctga

SEQ ID NO: 753608 - DNA, 12 bp, Homo sapiens
ctcagcctggtg

SEQ ID NO: 753609 - DNA, 16 bp, Homo sapiens
ctcagcctggtgggcc

SEQ ID NO: 753610 - DNA, 18 bp, Homo sapiens
ctcagcctggtgggcctc

SEQ ID NO: 753611 - DNA, 19 bp, Homo sapiens
ctcagcctggtgggcctcc

SEQ ID NO: 753612 - DNA, 13 bp, Homo sapiens
ctcagcctgtgct

SEQ ID NO: 753613 - DNA, 14 bp, Homo sapiens
ctcagcctgtgctg

SEQ ID NO: 753614 - DNA, 18 bp, Homo sapiens
ctcagcctgtgctgcccg

SEQ ID NO: 753615 - DNA, 22 bp, Homo sapiens
ctcagccttccaactagctggg

SEQ ID NO: 753616 - DNA, 23 bp, Homo sapiens
ctcagccttccccttgcccaggg

SEQ ID NO: 753617 - DNA, 14 bp, Homo sapiens
ctcagccttctgag

SEQ ID NO: 753618 - DNA, 13 bp, Homo sapiens
ctcagccttgcac

SEQ ID NO: 753619 - DNA, 19 bp, Homo sapiens
ctcagccttgcacacccac

SEQ ID NO: 753620 - DNA, 22 bp, Homo sapiens
gctcaactcacagcttctccaa

SEQ ID NO: 753621 - DNA, 22 bp, Homo sapiens
gctcaactcgggggcgcctgga

SEQ ID NO: 753622 - DNA, 23 bp, Homo sapiens
gctcaactcgggggcgcctggag

SEQ ID NO: 753623 - DNA, 15 bp, Homo sapiens
ctcagccttggataa

SEQ ID NO: 753624 - DNA, 17 bp, Homo sapiens
ctcagcgcaggctgcag

SEQ ID NO: 753625 - DNA, 20 bp, Homo sapiens
ctcagcgcaggctgcagagc

SEQ ID NO: 753626 - DNA, 15 bp, Homo sapiens
ctcagctaagctcac

SEQ ID NO: 753627 - DNA, 18 bp, Homo sapiens
ctcagctattaagaaaat

SEQ ID NO: 753628 - DNA, 13 bp, Homo sapiens
ctcagctcagcgc

SEQ ID NO: 753629 - DNA, 15 bp, Homo sapiens
ctcagctcagcgcca

SEQ ID NO: 753630 - DNA, 17 bp, Homo sapiens
ctcagctcagcgccagc

SEQ ID NO: 753631 - DNA, 22 bp, Homo sapiens
ctcagctccagaataccttctt

SEQ ID NO: 753632 - DNA, 21 bp, Homo sapiens
ctcagctccccggcactgcag

SEQ ID NO: 753633 - DNA, 13 bp, Homo sapiens
ctcagctctctgg

SEQ ID NO: 753634 - DNA, 13 bp, Homo sapiens
ctcagctctggga

SEQ ID NO: 753635 - DNA, 14 bp, Homo sapiens
ctcagctctgggag

SEQ ID NO: 753636 - DNA, 15 bp, Homo sapiens
ctcagctctgggaga

SEQ ID NO: 753637 - DNA, 22 bp, Homo sapiens
ctcagctctgggagaggatttt

SEQ ID NO: 753638 - DNA, 13 bp, Homo sapiens
ctcagctctggtc

SEQ ID NO: 753639 - DNA, 22 bp, Homo sapiens
ctcagctctggtccaggccctg

SEQ ID NO: 753640 - DNA, 13 bp, Homo sapiens
ctcagctcttcca

SEQ ID NO: 753641 - DNA, 14 bp, Homo sapiens
ctcagctcttccat

SEQ ID NO: 753642 - DNA, 18 bp, Homo sapiens
ctcagctcttggctccac

SEQ ID NO: 753643 - DNA, 18 bp, Homo sapiens
ctcagctgaaattatata

SEQ ID NO: 753644 - DNA, 14 bp, Homo sapiens
ctcagctgcacatt

SEQ ID NO: 753645 - DNA, 23 bp, Homo sapiens
ctcagctgcacattcctggcccc

SEQ ID NO: 753646 - DNA, 11 bp, Homo sapiens
ctcagctgcat

SEQ ID NO: 753647 - DNA, 14 bp, Homo sapiens
ctcagctgcatgga

SEQ ID NO: 753648 - DNA, 14 bp, Homo sapiens
ctcagctgccaagc

SEQ ID NO: 753649 - DNA, 17 bp, Homo sapiens
ctcagctgccaagcact

SEQ ID NO: 753650 - DNA, 18 bp, Homo sapiens
ctcagctgcctcacttcc

SEQ ID NO: 753651 - DNA, 15 bp, Homo sapiens
ctcagctggcagtgc

SEQ ID NO: 753652 - DNA, 19 bp, Homo sapiens
ctcagctgtcaaggctcag

SEQ ID NO: 753653 - DNA, 12 bp, Homo sapiens
ctcagctgtcac

SEQ ID NO: 753654 - DNA, 13 bp, Homo sapiens
ctcagctgtcacc

SEQ ID NO: 753655 - DNA, 17 bp, Homo sapiens
ctcagctgtcacctgct

SEQ ID NO: 753656 - DNA, 23 bp, Homo sapiens
ctcagctgtcacctgctcacagg

SEQ ID NO: 753657 - DNA, 13 bp, Homo sapiens
ctcagctttgaga

SEQ ID NO: 753658 - DNA, 12 bp, Homo sapiens
ctcaggaaaacg

SEQ ID NO: 753659 - DNA, 22 bp, Homo sapiens
ctcaggaaacgagactttccat

SEQ ID NO: 753660 - DNA, 17 bp, Homo sapiens
ctcaggaagaagagatg

SEQ ID NO: 753661 - DNA, 21 bp, Homo sapiens
ctcaggaagagctatggccca

SEQ ID NO: 753662 - DNA, 16 bp, Homo sapiens
ctcaggaaggacatgg

SEQ ID NO: 753663 - DNA, 22 bp, Homo sapiens
ctcaggacagcatcccttccca

SEQ ID NO: 753664 - DNA, 23 bp, Homo sapiens
ctcaggacagcatcccttcccac

SEQ ID NO: 753665 - DNA, 16 bp, Homo sapiens
ctcaggacccaggccc

SEQ ID NO: 753666 - DNA, 23 bp, Homo sapiens
ctcaggacctctgtaggcagcag

SEQ ID NO: 753667 - DNA, 22 bp, Homo sapiens
ctcaggagatggagggcttggc

SEQ ID NO: 753668 - DNA, 15 bp, Homo sapiens
ctcaggagcacaggc

SEQ ID NO: 753669 - DNA, 17 bp, Homo sapiens
ctcaggagcacaggcag

SEQ ID NO: 753670 - DNA, 22 bp, Homo sapiens
ctcaggagcacaggcagctgga

SEQ ID NO: 753671 - DNA, 13 bp, Homo sapiens
ctcaggagcaggg

SEQ ID NO: 753672 - DNA, 15 bp, Homo sapiens
ctcaggaggcagagg

SEQ ID NO: 753673 - DNA, 20 bp, Homo sapiens
ctcaggaggccgaggcagga

SEQ ID NO: 753674 - DNA, 14 bp, Homo sapiens
ctcaggaggctgag

SEQ ID NO: 753675 - DNA, 17 bp, Homo sapiens
ctcaggaggctgaggca

SEQ ID NO: 753676 - DNA, 20 bp, Homo sapiens
ctcaggaggctgaggcagaa

SEQ ID NO: 753677 - DNA, 20 bp, Homo sapiens
ctcaggaggctgaggcagga

SEQ ID NO: 753678 - DNA, 22 bp, Homo sapiens
ctcaggaggctgaggcaggagg

SEQ ID NO: 753679 - DNA, 23 bp, Homo sapiens
ctcaggaggctgaggcaggagga

SEQ ID NO: 753680 - DNA, 13 bp, Homo sapiens
ctcaggagggcag

SEQ ID NO: 753681 - DNA, 16 bp, Homo sapiens
ctcaggagggcaggct

SEQ ID NO: 753682 - DNA, 19 bp, Homo sapiens
ctcaggagggtgacgccca

SEQ ID NO: 753683 - DNA, 20 bp, Homo sapiens
ctcaggagggtgacgcccag

SEQ ID NO: 753684 - DNA, 23 bp, Homo sapiens
ctcaggagggtgacgcccagctc

SEQ ID NO: 753685 - DNA, 13 bp, Homo sapiens
ctcaggagtctgc

SEQ ID NO: 753686 - DNA, 17 bp, Homo sapiens
ctcaggagtctgccact

SEQ ID NO: 753687 - DNA, 23 bp, Homo sapiens
ctcaggagtttgagaccaacctg

SEQ ID NO: 753688 - DNA, 12 bp, Homo sapiens
ctcaggatccag

SEQ ID NO: 753689 - DNA, 17 bp, Homo sapiens
ctcaggatgggccaaac

SEQ ID NO: 753690 - DNA, 19 bp, Homo sapiens
ctcaggattgctaggagct

SEQ ID NO: 753691 - DNA, 20 bp, Homo sapiens
ctcaggatttaaaaactgga

SEQ ID NO: 753692 - DNA, 23 bp, Homo sapiens
ctcaggcaagcccctcagccctt

SEQ ID NO: 753693 - DNA, 17 bp, Homo sapiens
ctcaggcagacaagagc

SEQ ID NO: 753694 - DNA, 18 bp, Homo sapiens
ctcaggcagacaagagct

SEQ ID NO: 753695 - DNA, 21 bp, Homo sapiens
ctcaggcagacaagagctgct

SEQ ID NO: 753696 - DNA, 15 bp, Homo sapiens
ctcaggcaggtggga

SEQ ID NO: 753697 - DNA, 16 bp, Homo sapiens
ctcaggcataggcctg

SEQ ID NO: 753698 - DNA, 17 bp, Homo sapiens
ctcaggcataggcctgg

SEQ ID NO: 753699 - DNA, 23 bp, Homo sapiens
ctcaggcataggcctgggtgctg

SEQ ID NO: 753700 - DNA, 15 bp, Homo sapiens
ctcaggcatgcctgt

SEQ ID NO: 753701 - DNA, 17 bp, Homo sapiens
ctcaggccaagcccaat

SEQ ID NO: 753702 - DNA, 19 bp, Homo sapiens
ctcaggccacagtggggct

SEQ ID NO: 753703 - DNA, 14 bp, Homo sapiens
ctcaggccaccctc

SEQ ID NO: 753704 - DNA, 18 bp, Homo sapiens
ctcaggccacctgccccc

SEQ ID NO: 753705 - DNA, 23 bp, Homo sapiens
ctcaggccacctgcccccttctc

SEQ ID NO: 753706 - DNA, 13 bp, Homo sapiens
ctcaggccattcc

SEQ ID NO: 753707 - DNA, 14 bp, Homo sapiens
ctcaggcctcccta

SEQ ID NO: 753708 - DNA, 17 bp, Homo sapiens
ctcaggcctccctagca

SEQ ID NO: 753709 - DNA, 15 bp, Homo sapiens
ctcaggcgcttctcc

SEQ ID NO: 753710 - DNA, 19 bp, Homo sapiens
ctcaggctgcagctggaca

SEQ ID NO: 753711 - DNA, 20 bp, Homo sapiens
ctcaggctgcagctggacag

SEQ ID NO: 753712 - DNA, 21 bp, Homo sapiens
ctcaggctgcagctggacaga

SEQ ID NO: 753713 - DNA, 22 bp, Homo sapiens
ctcaggctgcagctggacagag

SEQ ID NO: 753714 - DNA, 13 bp, Homo sapiens
ctcaggctggagt

SEQ ID NO: 753715 - DNA, 22 bp, Homo sapiens
ctcaggctttcactatttcctt

SEQ ID NO: 753716 - DNA, 17 bp, Homo sapiens
ctcagggaaaagcagct

SEQ ID NO: 753717 - DNA, 22 bp, Homo sapiens
ctcagggaaaagcagctctccc

SEQ ID NO: 753718 - DNA, 17 bp, Homo sapiens
ctcagggaaaggccagt

SEQ ID NO: 753719 - DNA, 21 bp, Homo sapiens
ctcagggacagagacacctgc

SEQ ID NO: 753720 - DNA, 22 bp, Homo sapiens
ctcagggacagagacacctgca

SEQ ID NO: 753721 - DNA, 22 bp, Homo sapiens
ctcagggaccggtgctgcagga

SEQ ID NO: 753722 - DNA, 18 bp, Homo sapiens
ctcagggagcagggaagg

SEQ ID NO: 753723 - DNA, 22 bp, Homo sapiens
ctcagggagcagggaaggcctg

SEQ ID NO: 753724 - DNA, 17 bp, Homo sapiens
ctcagggagcctcccca

SEQ ID NO: 753725 - DNA, 13 bp, Homo sapiens
ctcagggagcgat

SEQ ID NO: 753726 - DNA, 18 bp, Homo sapiens
ctcagggagcgatccagg

SEQ ID NO: 753727 - DNA, 13 bp, Homo sapiens
ctcagggagggaa

SEQ ID NO: 753728 - DNA, 15 bp, Homo sapiens
ctcagggagggaagg

SEQ ID NO: 753729 - DNA, 10 bp, Homo sapiens
ctcagggcac

SEQ ID NO: 753730 - DNA, 13 bp, Homo sapiens
ctcagggcagctg

SEQ ID NO: 753731 - DNA, 14 bp, Homo sapiens
ctcagggcagctgc

SEQ ID NO: 753732 - DNA, 22 bp, Homo sapiens
ctcagggcagtggcttctttcc

SEQ ID NO: 753733 - DNA, 18 bp, Homo sapiens
ctcagggccccagcacta

SEQ ID NO: 753734 - DNA, 16 bp, Homo sapiens
ctcagggctcctccca

SEQ ID NO: 753735 - DNA, 17 bp, Homo sapiens
ctcagggctcctcccag

SEQ ID NO: 753736 - DNA, 21 bp, Homo sapiens
ctcagggctcctcccagcttg

SEQ ID NO: 753737 - DNA, 15 bp, Homo sapiens
ctcagggctggagcc

SEQ ID NO: 753738 - DNA, 23 bp, Homo sapiens
ctcagggctggagcctggggtgt

SEQ ID NO: 753739 - DNA, 21 bp, Homo sapiens
ctcagggctgtcccagccccg

SEQ ID NO: 753740 - DNA, 17 bp, Homo sapiens
ctcaggggacactggcc

SEQ ID NO: 753741 - DNA, 18 bp, Homo sapiens
ctcagttttccttctgtt

SEQ ID NO: 753742 - DNA, 14 bp, Homo sapiens
ctcataaaaagcaa

SEQ ID NO: 753743 - DNA, 16 bp, Homo sapiens
ctcataaagatgttaa

SEQ ID NO: 753744 - DNA, 17 bp, Homo sapiens
ctcataaagatgttaaa

SEQ ID NO: 753745 - DNA, 22 bp, Homo sapiens
ctcataaagatgttaaatggaa

SEQ ID NO: 753746 - DNA, 20 bp, Homo sapiens
ctcataacttgagacctaat

SEQ ID NO: 753747 - DNA, 14 bp, Homo sapiens
ctcataattggaat

SEQ ID NO: 753748 - DNA, 13 bp, Homo sapiens
ctcatactgtctg

SEQ ID NO: 753749 - DNA, 17 bp, Homo sapiens
ctcatagaggtgagaaa

SEQ ID NO: 753750 - DNA, 18 bp, Homo sapiens
ctcatagcatagccagca

SEQ ID NO: 753751 - DNA, 19 bp, Homo sapiens
ctcatagcatagccagcat

SEQ ID NO: 753752 - DNA, 14 bp, Homo sapiens
ctcatagcattaac

SEQ ID NO: 753753 - DNA, 12 bp, Homo sapiens
gctcagggctgg

SEQ ID NO: 753754 - DNA, 13 bp, Homo sapiens
gctcagggctgga

SEQ ID NO: 753755 - DNA, 23 bp, Homo sapiens
gctcagggctggagtgcgctctt

SEQ ID NO: 753756 - DNA, 15 bp, Homo sapiens
gctcaggggagcaag

SEQ ID NO: 753757 - DNA, 19 bp, Homo sapiens
gctcagggtcaaagacaga

SEQ ID NO: 753758 - DNA, 23 bp, Homo sapiens
gctcagggtcactgaaccactgc

SEQ ID NO: 753759 - DNA, 12 bp, Homo sapiens
gctcaggtgcct

SEQ ID NO: 753760 - DNA, 19 bp, Homo sapiens
gctcaggtgccttacatct

SEQ ID NO: 753761 - DNA, 22 bp, Homo sapiens
gctcaggtgctatgtcccaaga

SEQ ID NO: 753762 - DNA, 21 bp, Homo sapiens
gctcaggtttgtcctggtcat

SEQ ID NO: 753763 - DNA, 22 bp, Homo sapiens
gctcagtaaacgggaacatgcc

SEQ ID NO: 753764 - DNA, 16 bp, Homo sapiens
gctcagtaacataact

SEQ ID NO: 753765 - DNA, 17 bp, Homo sapiens
gctcagtaacataactg

SEQ ID NO: 753766 - DNA, 18 bp, Homo sapiens
gctcagtaatataatttg

SEQ ID NO: 753767 - DNA, 18 bp, Homo sapiens
gctcagtattactttctg

SEQ ID NO: 753768 - DNA, 17 bp, Homo sapiens
gctcagtctcaggagca

SEQ ID NO: 753769 - DNA, 20 bp, Homo sapiens
gctcagtctcaggagcatgg

SEQ ID NO: 753770 - DNA, 21 bp, Homo sapiens
gctcagtctcaggagcatggg

SEQ ID NO: 753771 - DNA, 19 bp, Homo sapiens
gctcagtctgttcactgca

SEQ ID NO: 753772 - DNA, 15 bp, Homo sapiens
gctcagtgccaccta

SEQ ID NO: 753773 - DNA, 16 bp, Homo sapiens
gctcagtgccacctat

SEQ ID NO: 753774 - DNA, 23 bp, Homo sapiens
gctcagtgccacctatgcctgtg

SEQ ID NO: 753775 - DNA, 13 bp, Homo sapiens
gctcagtgcctcc

SEQ ID NO: 753776 - DNA, 15 bp, Homo sapiens
gctcagtgcctcctg

SEQ ID NO: 753777 - DNA, 13 bp, Homo sapiens
gctcagtgccttc

SEQ ID NO: 753778 - DNA, 15 bp, Homo sapiens
gctcagtgccttcct

SEQ ID NO: 753779 - DNA, 22 bp, Homo sapiens
gctcagtgtccagcttccaaag

SEQ ID NO: 753780 - DNA, 16 bp, Homo sapiens
gctcagttctagtctc

SEQ ID NO: 753781 - DNA, 20 bp, Homo sapiens
gctcataatggaaaaaaaga

SEQ ID NO: 753782 - DNA, 16 bp, Homo sapiens
gctcatcattctctgt

SEQ ID NO: 753783 - DNA, 17 bp, Homo sapiens
gctcatcccccctgctg

SEQ ID NO: 753784 - DNA, 21 bp, Homo sapiens
gctcatcccccctgctgccca

SEQ ID NO: 753785 - DNA, 22 bp, Homo sapiens
gctcatcccccctgctgcccag

SEQ ID NO: 753786 - DNA, 13 bp, Homo sapiens
gctcatctctgga

SEQ ID NO: 753787 - DNA, 21 bp, Homo sapiens
gctcatctctggaaggggcag

SEQ ID NO: 753788 - DNA, 22 bp, Homo sapiens
gctcatctctggaaggggcagc

SEQ ID NO: 753789 - DNA, 23 bp, Homo sapiens
gctcatctctggaaggggcagcc

SEQ ID NO: 753790 - DNA, 15 bp, Homo sapiens
gctcatctgctggtc

SEQ ID NO: 753791 - DNA, 17 bp, Homo sapiens
gctcatgccccttgggg

SEQ ID NO: 753792 - DNA, 15 bp, Homo sapiens
gctcatgccctgcca

SEQ ID NO: 753793 - DNA, 18 bp, Homo sapiens
gctcatgtaatgtggtca

SEQ ID NO: 753794 - DNA, 15 bp, Homo sapiens
gctcatgtatattta

SEQ ID NO: 753795 - DNA, 23 bp, Homo sapiens
gctcatgtccctgtccccaggcc

SEQ ID NO: 753796 - DNA, 17 bp, Homo sapiens
gctcatgtgtgcaacag

SEQ ID NO: 753797 - DNA, 15 bp, Homo sapiens
gctcatgttgagcca

SEQ ID NO: 753798 - DNA, 13 bp, Homo sapiens
gctcattatgaaa

SEQ ID NO: 753799 - DNA, 20 bp, Homo sapiens
gctcattgtagcacaatcct

SEQ ID NO: 753800 - DNA, 22 bp, Homo sapiens
gctcattttctacgtcatgtat

SEQ ID NO: 753801 - DNA, 15 bp, Homo sapiens
gctcattttctggtt

SEQ ID NO: 753802 - DNA, 16 bp, Homo sapiens
gctcattttgcaattt

SEQ ID NO: 753803 - DNA, 16 bp, Homo sapiens
gctccaaaccccaggg

SEQ ID NO: 753804 - DNA, 21 bp, Homo sapiens
gctccaacccccgccacctca

SEQ ID NO: 753805 - DNA, 14 bp, Homo sapiens
gctccaagggacag

SEQ ID NO: 753806 - DNA, 15 bp, Homo sapiens
gctccaagggacagg

SEQ ID NO: 753807 - DNA, 19 bp, Homo sapiens
gctccaagggacaggtggg

SEQ ID NO: 753808 - DNA, 23 bp, Homo sapiens
gctccaagggacaggtgggcctg

SEQ ID NO: 753809 - DNA, 21 bp, Homo sapiens
gctccaatctctggtgcctaa

SEQ ID NO: 753810 - DNA, 14 bp, Homo sapiens
gctccaatttcccc

SEQ ID NO: 753811 - DNA, 17 bp, Homo sapiens
gctccacacattccagc

SEQ ID NO: 753812 - DNA, 19 bp, Homo sapiens
gctccacacattccagcca

SEQ ID NO: 753813 - DNA, 23 bp, Homo sapiens
gctccacacattccagccaggcc

SEQ ID NO: 753814 - DNA, 15 bp, Homo sapiens
gctccaccagcagca

SEQ ID NO: 753815 - DNA, 16 bp, Homo sapiens
gctccaccctggccga

SEQ ID NO: 753816 - DNA, 19 bp, Homo sapiens
gctccaccctggccgagtc

SEQ ID NO: 753817 - DNA, 13 bp, Homo sapiens
gctccacccttgg

SEQ ID NO: 753818 - DNA, 14 bp, Homo sapiens
gctccacccttggc

SEQ ID NO: 753819 - DNA, 22 bp, Homo sapiens
gctccacccttggcctgtctca

SEQ ID NO: 753820 - DNA, 17 bp, Homo sapiens
gctccacgggcaggggt

SEQ ID NO: 753821 - DNA, 12 bp, Homo sapiens
gctccactgtca

SEQ ID NO: 753822 - DNA, 19 bp, Homo sapiens
gctccagaagatgccagct

SEQ ID NO: 753823 - DNA, 20 bp, Homo sapiens
gctccagaagatgccagctt

SEQ ID NO: 753824 - DNA, 24 bp, Homo sapiens
gctccagaagatgccagcttctct

SEQ ID NO: 753825 - DNA, 14 bp, Homo sapiens
gctccagaccccca

SEQ ID NO: 753826 - DNA, 18 bp, Homo sapiens
gctccagataactctctt

SEQ ID NO: 753827 - DNA, 19 bp, Homo sapiens
gctccagataactctcttt

SEQ ID NO: 753828 - DNA, 19 bp, Homo sapiens
gctccagatgcagggcagt

SEQ ID NO: 753829 - DNA, 16 bp, Homo sapiens
gctccagattctgatg

SEQ ID NO: 753830 - DNA, 18 bp, Homo sapiens
gctccagattctgatgca

SEQ ID NO: 753831 - DNA, 19 bp, Homo sapiens
gctccagcaggaaggaccc

SEQ ID NO: 753832 - DNA, 16 bp, Homo sapiens
gctccagcatccagcc

SEQ ID NO: 753833 - DNA, 17 bp, Homo sapiens
gctccagcatccagcct

SEQ ID NO: 753834 - DNA, 19 bp, Homo sapiens
gctccagcatccagcctgt

SEQ ID NO: 753835 - DNA, 20 bp, Homo sapiens
gctccagcatccagcctgtg

SEQ ID NO: 753836 - DNA, 14 bp, Homo sapiens
gctccagccaaccc

SEQ ID NO: 753837 - DNA, 17 bp, Homo sapiens
gctccagccaacccctg

SEQ ID NO: 753838 - DNA, 22 bp, Homo sapiens
gctccagccaacccctgtggag

SEQ ID NO: 753839 - DNA, 23 bp, Homo sapiens
gctccagccaacccctgtggagc

SEQ ID NO: 753840 - DNA, 13 bp, Homo sapiens
gctccagccatct

SEQ ID NO: 753841 - DNA, 16 bp, Homo sapiens
gctccagcccctcttg

SEQ ID NO: 753842 - DNA, 18 bp, Homo sapiens
gctccagcccctttgcct

SEQ ID NO: 753843 - DNA, 17 bp, Homo sapiens
gctccagctggccggga

SEQ ID NO: 753844 - DNA, 23 bp, Homo sapiens
gctccagctggccgggagcctga

SEQ ID NO: 753845 - DNA, 21 bp, Homo sapiens
gctccagctgtcgtctgactc

SEQ ID NO: 753846 - DNA, 15 bp, Homo sapiens
gctccagctttaagg

SEQ ID NO: 753847 - DNA, 15 bp, Homo sapiens
gctccaggcctgcag

SEQ ID NO: 753848 - DNA, 16 bp, Homo sapiens
gctccaggcctgcagc

SEQ ID NO: 753849 - DNA, 22 bp, Homo sapiens
gctccaggcctgcagcaggagt

SEQ ID NO: 753850 - DNA, 14 bp, Homo sapiens
gctccaggcctgta

SEQ ID NO: 753851 - DNA, 12 bp, Homo sapiens
gctccagggccg

SEQ ID NO: 753852 - DNA, 19 bp, Homo sapiens
gctccaggggcccttggga

SEQ ID NO: 753853 - DNA, 23 bp, Homo sapiens
gctccaggggcccttgggacagc

SEQ ID NO: 753854 - DNA, 18 bp, Homo sapiens
gctccagggtcttgggct

SEQ ID NO: 753855 - DNA, 19 bp, Homo sapiens
gctccagggtcttgggcta

SEQ ID NO: 753856 - DNA, 18 bp, Homo sapiens
gctccaggtggctctgag

SEQ ID NO: 753857 - DNA, 14 bp, Homo sapiens
gctccagtgccgct

SEQ ID NO: 753858 - DNA, 18 bp, Homo sapiens
gctccagtgccgctcctg

SEQ ID NO: 753859 - DNA, 15 bp, Homo sapiens
gctccagtgggcagg

SEQ ID NO: 753860 - DNA, 19 bp, Homo sapiens
gctccatatttgatttcta

SEQ ID NO: 753861 - DNA, 22 bp, Homo sapiens
gctccatcccaaccaggcacct

SEQ ID NO: 753862 - DNA, 11 bp, Homo sapiens
gctcctccagc

SEQ ID NO: 753863 - DNA, 16 bp, Homo sapiens
gctcctccagccctgc

SEQ ID NO: 753864 - DNA, 16 bp, Homo sapiens
gctcctccagcccttc

SEQ ID NO: 753865 - DNA, 23 bp, Homo sapiens
gctcctccagcccttcagacgag

SEQ ID NO: 753866 - DNA, 11 bp, Homo sapiens
gctcctcccag

SEQ ID NO: 753867 - DNA, 12 bp, Homo sapiens
gctcctcccagc

SEQ ID NO: 753868 - DNA, 20 bp, Homo sapiens
gctcctccccgatccccgac

SEQ ID NO: 753869 - DNA, 15 bp, Homo sapiens
gctcctcccctcttg

SEQ ID NO: 753870 - DNA, 14 bp, Homo sapiens
gctcctcccggtgc

SEQ ID NO: 753871 - DNA, 13 bp, Homo sapiens
gctcctccctgcc

SEQ ID NO: 753872 - DNA, 15 bp, Homo sapiens
gctcctccctgcccc

SEQ ID NO: 753873 - DNA, 18 bp, Homo sapiens
gctcctccctgcccccca

SEQ ID NO: 753874 - DNA, 13 bp, Homo sapiens
gctcctccctgct

SEQ ID NO: 753875 - DNA, 16 bp, Homo sapiens
gctcctccctgctcct

SEQ ID NO: 753876 - DNA, 21 bp, Homo sapiens
gctcctccctgctcctcatgg

SEQ ID NO: 753877 - DNA, 13 bp, Homo sapiens
gctcctccctggc

SEQ ID NO: 753878 - DNA, 17 bp, Homo sapiens
gctcctccctggctgcc

SEQ ID NO: 753879 - DNA, 17 bp, Homo sapiens
gctcctccgtctgaccc

SEQ ID NO: 753880 - DNA, 20 bp, Homo sapiens
gctcctccgtctgaccctct

SEQ ID NO: 753881 - DNA, 23 bp, Homo sapiens
gctcctcctcacccacctctggg

SEQ ID NO: 753882 - DNA, 14 bp, Homo sapiens
gctcctcctccctg

SEQ ID NO: 753883 - DNA, 18 bp, Homo sapiens
ctaggaggctggccaagg

SEQ ID NO: 753884 - DNA, 22 bp, Homo sapiens
ctaggagttgagtacagtgagg

SEQ ID NO: 753885 - DNA, 21 bp, Homo sapiens
ctaggataaaaagccagggct

SEQ ID NO: 753886 - DNA, 17 bp, Homo sapiens
ctaggatgctgcagcag

SEQ ID NO: 753887 - DNA, 21 bp, Homo sapiens
ctaggatgctgcagcagagtg

SEQ ID NO: 753888 - DNA, 20 bp, Homo sapiens
ctaggatgttgctcagaagt

SEQ ID NO: 753889 - DNA, 17 bp, Homo sapiens
ctaggattccccctgcc

SEQ ID NO: 753890 - DNA, 15 bp, Homo sapiens
ctaggcacaaggttg

SEQ ID NO: 753891 - DNA, 14 bp, Homo sapiens
ctaggcatcccagg

SEQ ID NO: 753892 - DNA, 19 bp, Homo sapiens
ctaggcatcccaggggacc

SEQ ID NO: 753893 - DNA, 15 bp, Homo sapiens
ctaggcattgcagga

SEQ ID NO: 753894 - DNA, 16 bp, Homo sapiens
ctaggcattgcaggac

SEQ ID NO: 753895 - DNA, 18 bp, Homo sapiens
ctaggcattgcaggacct

SEQ ID NO: 753896 - DNA, 19 bp, Homo sapiens
ctaggccaaatgcacaagc

SEQ ID NO: 753897 - DNA, 20 bp, Homo sapiens
ctaggccaaatgcacaagct

SEQ ID NO: 753898 - DNA, 18 bp, Homo sapiens
ctaggcccattgtcctcc

SEQ ID NO: 753899 - DNA, 22 bp, Homo sapiens
ctaggcccccacttgcctcttc

SEQ ID NO: 753900 - DNA, 15 bp, Homo sapiens
ctaggcctcagccag

SEQ ID NO: 753901 - DNA, 17 bp, Homo sapiens
ctaggcctcagccagag

SEQ ID NO: 753902 - DNA, 18 bp, Homo sapiens
ctaggcctcagccagaga

SEQ ID NO: 753903 - DNA, 16 bp, Homo sapiens
ctaggcctctccagtt

SEQ ID NO: 753904 - DNA, 18 bp, Homo sapiens
ctaggcgagtgccaggac

SEQ ID NO: 753905 - DNA, 16 bp, Homo sapiens
ctaggctaaactcaag

SEQ ID NO: 753906 - DNA, 18 bp, Homo sapiens
ctaggctcgccttccctc

SEQ ID NO: 753907 - DNA, 20 bp, Homo sapiens
ctaggctcgccttccctcct

SEQ ID NO: 753908 - DNA, 16 bp, Homo sapiens
ctagggaaacttcccg

SEQ ID NO: 753909 - DNA, 14 bp, Homo sapiens
ctagggaagataat

SEQ ID NO: 753910 - DNA, 15 bp, Homo sapiens
ctagggaatctggat

SEQ ID NO: 753911 - DNA, 22 bp, Homo sapiens
ctagggacatgaaatttacaaa

SEQ ID NO: 753912 - DNA, 22 bp, Homo sapiens
ctagggagagggaagagggaga

SEQ ID NO: 753913 - DNA, 18 bp, Homo sapiens
ctagggagccatttgaga

SEQ ID NO: 753914 - DNA, 23 bp, Homo sapiens
ctagggaggaccttatctgtgcg

SEQ ID NO: 753915 - DNA, 16 bp, Homo sapiens
ctagggattcaggctg

SEQ ID NO: 753916 - DNA, 20 bp, Homo sapiens
ctagggattcaggctgcttg

SEQ ID NO: 753917 - DNA, 13 bp, Homo sapiens
ctagggcagacaa

SEQ ID NO: 753918 - DNA, 13 bp, Homo sapiens
ctagggcagggtg

SEQ ID NO: 753919 - DNA, 19 bp, Homo sapiens
ctagggcagggtgggagcc

SEQ ID NO: 753920 - DNA, 18 bp, Homo sapiens
ctagggccaagcccagca

SEQ ID NO: 753921 - DNA, 19 bp, Homo sapiens
ctagggctgaggggcctgc

SEQ ID NO: 753922 - DNA, 17 bp, Homo sapiens
ctagggctgctgcttct

SEQ ID NO: 753923 - DNA, 19 bp, Homo sapiens
ctaggggacacttccctct

SEQ ID NO: 753924 - DNA, 17 bp, Homo sapiens
ctaggggagaagagccc

SEQ ID NO: 753925 - DNA, 23 bp, Homo sapiens
ctaggggagaagagccctggaca

SEQ ID NO: 753926 - DNA, 23 bp, Homo sapiens
ctaggggcagcctccgtcatcca

SEQ ID NO: 753927 - DNA, 22 bp, Homo sapiens
ctaggggcgggggcggaggagg

SEQ ID NO: 753928 - DNA, 14 bp, Homo sapiens
ctagggggaagtga

SEQ ID NO: 753929 - DNA, 16 bp, Homo sapiens
ctagggggacggggct

SEQ ID NO: 753930 - DNA, 16 bp, Homo sapiens
ctagggggtgtcagaa

SEQ ID NO: 753931 - DNA, 18 bp, Homo sapiens
ctaggggtcaggctccat

SEQ ID NO: 753932 - DNA, 20 bp, Homo sapiens
ctagggtctgataggaacag

SEQ ID NO: 753933 - DNA, 14 bp, Homo sapiens
ctaggtacttcagg

SEQ ID NO: 753934 - DNA, 20 bp, Homo sapiens
ctaggtatcattcaactctc

SEQ ID NO: 753935 - DNA, 14 bp, Homo sapiens
ctaggtccaagccc

SEQ ID NO: 753936 - DNA, 23 bp, Homo sapiens
ctaggtcccttcccgacccagcc

SEQ ID NO: 753937 - DNA, 13 bp, Homo sapiens
ctaggtctccagt

SEQ ID NO: 753938 - DNA, 20 bp, Homo sapiens
ctaggtctcctcagggtggg

SEQ ID NO: 753939 - DNA, 12 bp, Homo sapiens
ctaggtctgata

SEQ ID NO: 753940 - DNA, 20 bp, Homo sapiens
ctaggtgacatgtctacttt

SEQ ID NO: 753941 - DNA, 19 bp, Homo sapiens
ctaggtgcagctcctcagc

SEQ ID NO: 753942 - DNA, 15 bp, Homo sapiens
ctaggtggaggcaag

SEQ ID NO: 753943 - DNA, 20 bp, Homo sapiens
ctaggtggaggttgtgcatg

SEQ ID NO: 753944 - DNA, 21 bp, Homo sapiens
ctaggtggaggttgtgcatgt

SEQ ID NO: 753945 - DNA, 22 bp, Homo sapiens
ctaggtggaggttgtgcatgtt

SEQ ID NO: 753946 - DNA, 13 bp, Homo sapiens
ctaggtgggccag

SEQ ID NO: 753947 - DNA, 12 bp, Homo sapiens
gcctctggctag

SEQ ID NO: 753948 - DNA, 18 bp, Homo sapiens
gcctctggctagaggcca

SEQ ID NO: 753949 - DNA, 19 bp, Homo sapiens
gcctctggctagaggccag

SEQ ID NO: 753950 - DNA, 13 bp, Homo sapiens
gcctctggcttcc

SEQ ID NO: 753951 - DNA, 19 bp, Homo sapiens
gcctctggcttccctaaac

SEQ ID NO: 753952 - DNA, 12 bp, Homo sapiens
gcctctgggact

SEQ ID NO: 753953 - DNA, 16 bp, Homo sapiens
gcctctgggcagcctg

SEQ ID NO: 753954 - DNA, 20 bp, Homo sapiens
gcctctgggcagcctgcttt

SEQ ID NO: 753955 - DNA, 12 bp, Homo sapiens
gcctctggttgc

SEQ ID NO: 753956 - DNA, 22 bp, Homo sapiens
gcctctggttgcctcccccgcc

SEQ ID NO: 753957 - DNA, 21 bp, Homo sapiens
gcctctgtccaaacatttcat

SEQ ID NO: 753958 - DNA, 14 bp, Homo sapiens
gcctctgtgcacag

SEQ ID NO: 753959 - DNA, 21 bp, Homo sapiens
gcctctgtgcacagtggcttc

SEQ ID NO: 753960 - DNA, 12 bp, Homo sapiens
gcctctgtgcct

SEQ ID NO: 753961 - DNA, 12 bp, Homo sapiens
gcctctgtgctg

SEQ ID NO: 753962 - DNA, 12 bp, Homo sapiens
gcctctgtggaa

SEQ ID NO: 753963 - DNA, 13 bp, Homo sapiens
gcctctgtggaag

SEQ ID NO: 753964 - DNA, 19 bp, Homo sapiens
gcctctgtgtagccgccct

SEQ ID NO: 753965 - DNA, 19 bp, Homo sapiens
gcctcttaaagctgcctgt

SEQ ID NO: 753966 - DNA, 20 bp, Homo sapiens
gcctcttaaagctgcctgta

SEQ ID NO: 753967 - DNA, 16 bp, Homo sapiens
gcctcttagtgattgt

SEQ ID NO: 753968 - DNA, 15 bp, Homo sapiens
gcctcttcctctggg

SEQ ID NO: 753969 - DNA, 17 bp, Homo sapiens
gcctcttctacttgtaa

SEQ ID NO: 753970 - DNA, 12 bp, Homo sapiens
gcctcttctctg

SEQ ID NO: 753971 - DNA, 19 bp, Homo sapiens
gcctcttctgccccggagc

SEQ ID NO: 753972 - DNA, 14 bp, Homo sapiens
gcctcttctgggct

SEQ ID NO: 753973 - DNA, 16 bp, Homo sapiens
gcctcttctgtccctg

SEQ ID NO: 753974 - DNA, 16 bp, Homo sapiens
gcctcttcttcttcag

SEQ ID NO: 753975 - DNA, 13 bp, Homo sapiens
gcctcttgaccag

SEQ ID NO: 753976 - DNA, 14 bp, Homo sapiens
gcctcttgaccagg

SEQ ID NO: 753977 - DNA, 16 bp, Homo sapiens
gcctcttgaccaggct

SEQ ID NO: 753978 - DNA, 18 bp, Homo sapiens
gcctcttgagcagtggct

SEQ ID NO: 753979 - DNA, 21 bp, Homo sapiens
gcctcttgagttcctctgcag

SEQ ID NO: 753980 - DNA, 12 bp, Homo sapiens
gcctcttgcccg

SEQ ID NO: 753981 - DNA, 18 bp, Homo sapiens
gcctcttgctgaaagcca

SEQ ID NO: 753982 - DNA, 14 bp, Homo sapiens
gcctcttggaaatc

SEQ ID NO: 753983 - DNA, 15 bp, Homo sapiens
gcctcttggaaatca

SEQ ID NO: 753984 - DNA, 19 bp, Homo sapiens
gcctcttggcttctcagcc

SEQ ID NO: 753985 - DNA, 20 bp, Homo sapiens
gcctcttggcttctcagccc

SEQ ID NO: 753986 - DNA, 22 bp, Homo sapiens
gcctcttggcttctcagcccct

SEQ ID NO: 753987 - DNA, 17 bp, Homo sapiens
gcctcttgtcccttggc

SEQ ID NO: 753988 - DNA, 16 bp, Homo sapiens
gcctcttgtttctgtg

SEQ ID NO: 753989 - DNA, 16 bp, Homo sapiens
gcctctttccctagga

SEQ ID NO: 753990 - DNA, 20 bp, Homo sapiens
gcctctttcctaacttcctt

SEQ ID NO: 753991 - DNA, 21 bp, Homo sapiens
gcctctttcctaacttccttt

SEQ ID NO: 753992 - DNA, 12 bp, Homo sapiens
gcctcttttctc

SEQ ID NO: 753993 - DNA, 18 bp, Homo sapiens
gcctcttttctctgtgct

SEQ ID NO: 753994 - DNA, 17 bp, Homo sapiens
gcctctttttccttctt

SEQ ID NO: 753995 - DNA, 17 bp, Homo sapiens
gcctctttttgcccttt

SEQ ID NO: 753996 - DNA, 23 bp, Homo sapiens
gcctgaaagaggctgaggcctgg

SEQ ID NO: 753997 - DNA, 15 bp, Homo sapiens
gcctgaacagaagct

SEQ ID NO: 753998 - DNA, 14 bp, Homo sapiens
gcctgaactccaga

SEQ ID NO: 753999 - DNA, 20 bp, Homo sapiens
gcctgaactgaggccttgtg

SEQ ID NO: 754000 - DNA, 13 bp, Homo sapiens
gcctgaagcctgg

SEQ ID NO: 754001 - DNA, 14 bp, Homo sapiens
gcctgaagcctgga

SEQ ID NO: 754002 - DNA, 20 bp, Homo sapiens
gcctgaagcttcggccgcgc

SEQ ID NO: 754003 - DNA, 22 bp, Homo sapiens
gcctgaaggggcgtctgttccc

SEQ ID NO: 754004 - DNA, 11 bp, Homo sapiens
gcctgaataaa

SEQ ID NO: 754005 - DNA, 12 bp, Homo sapiens
gcctgaataaag

SEQ ID NO: 754006 - DNA, 19 bp, Homo sapiens
gcctgaatcatgagcctgc

SEQ ID NO: 754007 - DNA, 15 bp, Homo sapiens
gcctgacacactaac

SEQ ID NO: 754008 - DNA, 15 bp, Homo sapiens
gcctgacaccccctc

SEQ ID NO: 754009 - DNA, 16 bp, Homo sapiens
gcctgacaccccctcc

SEQ ID NO: 754010 - DNA, 13 bp, Homo sapiens
gcctgacagaaac

SEQ ID NO: 754011 - DNA, 17 bp, Homo sapiens
ctagtgccttgcccaca

SEQ ID NO: 754012 - DNA, 17 bp, Homo sapiens
ctagtgctattctgtgt

SEQ ID NO: 754013 - DNA, 12 bp, Homo sapiens
ctagtgctgctg

SEQ ID NO: 754014 - DNA, 19 bp, Homo sapiens
ctagtgctgtaatattgta

SEQ ID NO: 754015 - DNA, 23 bp, Homo sapiens
ctagtgctgtaatattgtaaata

SEQ ID NO: 754016 - DNA, 17 bp, Homo sapiens
ctagtgctgtgaaaaaa

SEQ ID NO: 754017 - DNA, 22 bp, Homo sapiens
ctagtggcaagacagtggttct

SEQ ID NO: 754018 - DNA, 23 bp, Homo sapiens
ctagtggctgttcatgctccaag

SEQ ID NO: 754019 - DNA, 22 bp, Homo sapiens
ctagtggggtctccctctcctg

SEQ ID NO: 754020 - DNA, 23 bp, Homo sapiens
ctagtggggtctccctctcctgc

SEQ ID NO: 754021 - DNA, 19 bp, Homo sapiens
ctagtggggtgaacagctg

SEQ ID NO: 754022 - DNA, 19 bp, Homo sapiens
ctagtgtacctcctctcag

SEQ ID NO: 754023 - DNA, 21 bp, Homo sapiens
ctagtgtacctcctctcagtg

SEQ ID NO: 754024 - DNA, 16 bp, Homo sapiens
ctagtgtagctgccac

SEQ ID NO: 754025 - DNA, 20 bp, Homo sapiens
ctagtgtccataaataaagt

SEQ ID NO: 754026 - DNA, 16 bp, Homo sapiens
ctagtgtgagtggcag

SEQ ID NO: 754027 - DNA, 18 bp, Homo sapiens
ctagtgtgagtggcagcc

SEQ ID NO: 754028 - DNA, 22 bp, Homo sapiens
ctagtgtgagtggcagccatgc

SEQ ID NO: 754029 - DNA, 23 bp, Homo sapiens
ctagtgtgagtggcagccatgcc

SEQ ID NO: 754030 - DNA, 22 bp, Homo sapiens
ctagtgttttcaattttaaaca

SEQ ID NO: 754031 - DNA, 18 bp, Homo sapiens
ctagttactgtggtatgg

SEQ ID NO: 754032 - DNA, 22 bp, Homo sapiens
ctagttatttacaggaacttca

SEQ ID NO: 754033 - DNA, 20 bp, Homo sapiens
ctagttcagacactttggaa

SEQ ID NO: 754034 - DNA, 21 bp, Homo sapiens
ctagttcatccaatcctcact

SEQ ID NO: 754035 - DNA, 20 bp, Homo sapiens
ctagttctcaatcactgctc

SEQ ID NO: 754036 - DNA, 11 bp, Homo sapiens
ctagttctgct

SEQ ID NO: 754037 - DNA, 15 bp, Homo sapiens
ctagttgttatcaat

SEQ ID NO: 754038 - DNA, 18 bp, Homo sapiens
ctagtttcagtaaataat

SEQ ID NO: 754039 - DNA, 22 bp, Homo sapiens
ctagtttcagtaaataatgaaa

SEQ ID NO: 754040 - DNA, 13 bp, Homo sapiens
ctagtttctagtg

SEQ ID NO: 754041 - DNA, 15 bp, Homo sapiens
ctagtttgattaaat

SEQ ID NO: 754042 - DNA, 19 bp, Homo sapiens
ctagtttgattaaattctt

SEQ ID NO: 754043 - DNA, 21 bp, Homo sapiens
ctagtttgattaaattcttgc

SEQ ID NO: 754044 - DNA, 15 bp, Homo sapiens
ctagtttgctttttg

SEQ ID NO: 754045 - DNA, 14 bp, Homo sapiens
ctagttttacagat

SEQ ID NO: 754046 - DNA, 18 bp, Homo sapiens
ctagttttattttacaga

SEQ ID NO: 754047 - DNA, 18 bp, Homo sapiens
ctagttttctcctcccag

SEQ ID NO: 754048 - DNA, 15 bp, Homo sapiens
ctagttttttttgta

SEQ ID NO: 754049 - DNA, 19 bp, Homo sapiens
ctagttttttttgtaaact

SEQ ID NO: 754050 - DNA, 15 bp, Homo sapiens
ctataaaagaaacac

SEQ ID NO: 754051 - DNA, 15 bp, Homo sapiens
ctataaaagctttct

SEQ ID NO: 754052 - DNA, 19 bp, Homo sapiens
ctataaaagctttctgcca

SEQ ID NO: 754053 - DNA, 15 bp, Homo sapiens
ctataaaataaactt

SEQ ID NO: 754054 - DNA, 18 bp, Homo sapiens
ctataaaataaacttctt

SEQ ID NO: 754055 - DNA, 16 bp, Homo sapiens
ctataaaatgcccatt

SEQ ID NO: 754056 - DNA, 17 bp, Homo sapiens
ctataaaattaaatgcc

SEQ ID NO: 754057 - DNA, 18 bp, Homo sapiens
ctataaaattaaatgcct

SEQ ID NO: 754058 - DNA, 22 bp, Homo sapiens
ctataaaattaaatgccttgta

SEQ ID NO: 754059 - DNA, 13 bp, Homo sapiens
ctataaagcattt

SEQ ID NO: 754060 - DNA, 18 bp, Homo sapiens
ctataaagctagatgctt

SEQ ID NO: 754061 - DNA, 21 bp, Homo sapiens
ctataaataaaaacttatttt

SEQ ID NO: 754062 - DNA, 17 bp, Homo sapiens
ctataaatcagtatttt

SEQ ID NO: 754063 - DNA, 22 bp, Homo sapiens
ctataaattcctctttgctttg

SEQ ID NO: 754064 - DNA, 20 bp, Homo sapiens
ctataaatttaagaaaacaa

SEQ ID NO: 754065 - DNA, 16 bp, Homo sapiens
ctataaccagacacat

SEQ ID NO: 754066 - DNA, 18 bp, Homo sapiens
ctataaccccagctccct

SEQ ID NO: 754067 - DNA, 13 bp, Homo sapiens
ctataagaataag

SEQ ID NO: 754068 - DNA, 20 bp, Homo sapiens
ctataagaataaggcttttt

SEQ ID NO: 754069 - DNA, 15 bp, Homo sapiens
gcctgcagcgcctcc

SEQ ID NO: 754070 - DNA, 17 bp, Homo sapiens
gcctgcagcgcctccct

SEQ ID NO: 754071 - DNA, 18 bp, Homo sapiens
gcctgcaggagagagcag

SEQ ID NO: 754072 - DNA, 15 bp, Homo sapiens
gcctgcaggctggag

SEQ ID NO: 754073 - DNA, 18 bp, Homo sapiens
gcctgcaggtcagttgta

SEQ ID NO: 754074 - DNA, 13 bp, Homo sapiens
gcctgcagtggtg

SEQ ID NO: 754075 - DNA, 20 bp, Homo sapiens
gcctgccaaagtagtcctgg

SEQ ID NO: 754076 - DNA, 21 bp, Homo sapiens
gcctgccaaagtagtcctggc

SEQ ID NO: 754077 - DNA, 22 bp, Homo sapiens
gcctgccaaagtagtcctggca

SEQ ID NO: 754078 - DNA, 18 bp, Homo sapiens
gcctgccaaagtgcctgg

SEQ ID NO: 754079 - DNA, 19 bp, Homo sapiens
gcctgccaaagtgcctggg

SEQ ID NO: 754080 - DNA, 21 bp, Homo sapiens
gcctgccaaagtgcctgggaa

SEQ ID NO: 754081 - DNA, 22 bp, Homo sapiens
gcctgccaaagtgcctgggaag

SEQ ID NO: 754082 - DNA, 16 bp, Homo sapiens
gcctgccaccggaggt

SEQ ID NO: 754083 - DNA, 20 bp, Homo sapiens
gcctgccactctctgggact

SEQ ID NO: 754084 - DNA, 15 bp, Homo sapiens
gcctgccatcttctc

SEQ ID NO: 754085 - DNA, 20 bp, Homo sapiens
gcctgccatcttctccccga

SEQ ID NO: 754086 - DNA, 10 bp, Homo sapiens
gcctgccatg

SEQ ID NO: 754087 - DNA, 15 bp, Homo sapiens
gcctgccatgtacct

SEQ ID NO: 754088 - DNA, 13 bp, Homo sapiens
gcctgcccacccg

SEQ ID NO: 754089 - DNA, 14 bp, Homo sapiens
gcctgcccacctct

SEQ ID NO: 754090 - DNA, 19 bp, Homo sapiens
gcctgcccacctctccctg

SEQ ID NO: 754091 - DNA, 13 bp, Homo sapiens
gcctgcccagact

SEQ ID NO: 754092 - DNA, 15 bp, Homo sapiens
gcctgcccagactga

SEQ ID NO: 754093 - DNA, 14 bp, Homo sapiens
gcctgcccagcctc

SEQ ID NO: 754094 - DNA, 15 bp, Homo sapiens
gcctgcccagcctca

SEQ ID NO: 754095 - DNA, 16 bp, Homo sapiens
gcctgcccagcctcaa

SEQ ID NO: 754096 - DNA, 15 bp, Homo sapiens
gcctgccccacccac

SEQ ID NO: 754097 - DNA, 18 bp, Homo sapiens
gcctgccccacccacccc

SEQ ID NO: 754098 - DNA, 23 bp, Homo sapiens
gcctgccccacccaccccacaga

SEQ ID NO: 754099 - DNA, 16 bp, Homo sapiens
gcctgccccccagtct

SEQ ID NO: 754100 - DNA, 23 bp, Homo sapiens
gcctgccccccagtctccccact

SEQ ID NO: 754101 - DNA, 16 bp, Homo sapiens
gcctgcccccctcatc

SEQ ID NO: 754102 - DNA, 22 bp, Homo sapiens
gcctgcccctaccctggacttg

SEQ ID NO: 754103 - DNA, 16 bp, Homo sapiens
gcctgcccctgctgct

SEQ ID NO: 754104 - DNA, 12 bp, Homo sapiens
gcctgcccctgt

SEQ ID NO: 754105 - DNA, 22 bp, Homo sapiens
gcctgccctcatggcccctctg

SEQ ID NO: 754106 - DNA, 15 bp, Homo sapiens
gcctgccctcccatg

SEQ ID NO: 754107 - DNA, 18 bp, Homo sapiens
gcctgccctctgtctgtc

SEQ ID NO: 754108 - DNA, 12 bp, Homo sapiens
gcctgccctgcc

SEQ ID NO: 754109 - DNA, 13 bp, Homo sapiens
gcctgccctgcct

SEQ ID NO: 754110 - DNA, 14 bp, Homo sapiens
gcctgccctgcctc

SEQ ID NO: 754111 - DNA, 15 bp, Homo sapiens
gcctgccctgcctca

SEQ ID NO: 754112 - DNA, 17 bp, Homo sapiens
gcctgccctgcctcagc

SEQ ID NO: 754113 - DNA, 22 bp, Homo sapiens
gcctgccctgcctcagccaggc

SEQ ID NO: 754114 - DNA, 14 bp, Homo sapiens
gcctgccctgcctt

SEQ ID NO: 754115 - DNA, 15 bp, Homo sapiens
gcctgccctgccttg

SEQ ID NO: 754116 - DNA, 16 bp, Homo sapiens
gcctgccctgccttgc

SEQ ID NO: 754117 - DNA, 17 bp, Homo sapiens
gcctgccctgccttgcc

SEQ ID NO: 754118 - DNA, 23 bp, Homo sapiens
gcctgccctgccttgccgctccc

SEQ ID NO: 754119 - DNA, 20 bp, Homo sapiens
gcctgccgccgtctctgtcc

SEQ ID NO: 754120 - DNA, 21 bp, Homo sapiens
gcctgccgccgtctctgtccc

SEQ ID NO: 754121 - DNA, 17 bp, Homo sapiens
gcctgccggacacagca

SEQ ID NO: 754122 - DNA, 16 bp, Homo sapiens
gcctgccgtgcatggc

SEQ ID NO: 754123 - DNA, 21 bp, Homo sapiens
gcctgccgtgcatggctcctg

SEQ ID NO: 754124 - DNA, 20 bp, Homo sapiens
gcctgcctatgaaatttcaa

SEQ ID NO: 754125 - DNA, 14 bp, Homo sapiens
gcctgcctcaccca

SEQ ID NO: 754126 - DNA, 14 bp, Homo sapiens
gcctgcctccaccc

SEQ ID NO: 754127 - DNA, 15 bp, Homo sapiens
gcctgcctccacccg

SEQ ID NO: 754128 - DNA, 13 bp, Homo sapiens
gcctgcctcccaa

SEQ ID NO: 754129 - DNA, 18 bp, Homo sapiens
gcctgcctcctccctccc

SEQ ID NO: 754130 - DNA, 19 bp, Homo sapiens
gcctgcctcctccctccca

SEQ ID NO: 754131 - DNA, 23 bp, Homo sapiens
gcctgcctcctccctcccagctg

SEQ ID NO: 754132 - DNA, 19 bp, Homo sapiens
gcctgcctcttggcctcac

SEQ ID NO: 754133 - DNA, 17 bp, Homo sapiens
gcctgcctgatccctga

SEQ ID NO: 754134 - DNA, 12 bp, Homo sapiens
gcctgcctgcct

SEQ ID NO: 754135 - DNA, 17 bp, Homo sapiens
gcctgcctgcctccacc

SEQ ID NO: 754136 - DNA, 14 bp, Homo sapiens
gcctgcctggcccc

SEQ ID NO: 754137 - DNA, 10 bp, Homo sapiens
ctatatataa

SEQ ID NO: 754138 - DNA, 14 bp, Homo sapiens
ctatatataatttg

SEQ ID NO: 754139 - DNA, 17 bp, Homo sapiens
ctatatatacatatgta

SEQ ID NO: 754140 - DNA, 16 bp, Homo sapiens
ctatatatttctatta

SEQ ID NO: 754141 - DNA, 13 bp, Homo sapiens
ctatatcagtagt

SEQ ID NO: 754142 - DNA, 22 bp, Homo sapiens
ctatatcataactatacttgat

SEQ ID NO: 754143 - DNA, 23 bp, Homo sapiens
ctatatccagaaggggagctttt

SEQ ID NO: 754144 - DNA, 17 bp, Homo sapiens
ctatatccagttcctgc

SEQ ID NO: 754145 - DNA, 20 bp, Homo sapiens
ctatatccagttcctgctct

SEQ ID NO: 754146 - DNA, 15 bp, Homo sapiens
ctatatccatgtact

SEQ ID NO: 754147 - DNA, 15 bp, Homo sapiens
ctatatcctgtgact

SEQ ID NO: 754148 - DNA, 13 bp, Homo sapiens
ctatatgatttat

SEQ ID NO: 754149 - DNA, 17 bp, Homo sapiens
ctatatgatttatagtt

SEQ ID NO: 754150 - DNA, 19 bp, Homo sapiens
ctatatgatttatagtttg

SEQ ID NO: 754151 - DNA, 13 bp, Homo sapiens
ctatattaaatga

SEQ ID NO: 754152 - DNA, 17 bp, Homo sapiens
ctatattagatcaaata

SEQ ID NO: 754153 - DNA, 17 bp, Homo sapiens
ctatattatgtcttctt

SEQ ID NO: 754154 - DNA, 20 bp, Homo sapiens
ctatattatgtcttcttttg

SEQ ID NO: 754155 - DNA, 18 bp, Homo sapiens
ctatattattatatatat

SEQ ID NO: 754156 - DNA, 22 bp, Homo sapiens
ctatattccaggtttaagtaga

SEQ ID NO: 754157 - DNA, 13 bp, Homo sapiens
ctatattgattta

SEQ ID NO: 754158 - DNA, 20 bp, Homo sapiens
ctatattgatttaaaagtgt

SEQ ID NO: 754159 - DNA, 22 bp, Homo sapiens
ctatattgttttcagtgtacat

SEQ ID NO: 754160 - DNA, 13 bp, Homo sapiens
ctatatttagatt

SEQ ID NO: 754161 - DNA, 13 bp, Homo sapiens
ctatatttcagtg

SEQ ID NO: 754162 - DNA, 12 bp, Homo sapiens
ctatatttgcta

SEQ ID NO: 754163 - DNA, 13 bp, Homo sapiens
ctatatttgtata

SEQ ID NO: 754164 - DNA, 16 bp, Homo sapiens
ctatatttgtatatat

SEQ ID NO: 754165 - DNA, 13 bp, Homo sapiens
ctatatttgtctt

SEQ ID NO: 754166 - DNA, 14 bp, Homo sapiens
ctatatttgtcttc

SEQ ID NO: 754167 - DNA, 16 bp, Homo sapiens
ctatattttaatagaa

SEQ ID NO: 754168 - DNA, 17 bp, Homo sapiens
ctatatttttgtactga

SEQ ID NO: 754169 - DNA, 21 bp, Homo sapiens
ctatcaaactgaagccagaaa

SEQ ID NO: 754170 - DNA, 17 bp, Homo sapiens
ctatcaaccccagacac

SEQ ID NO: 754171 - DNA, 23 bp, Homo sapiens
ctatcaagtgtgctttagcttga

SEQ ID NO: 754172 - DNA, 19 bp, Homo sapiens
ctatcacacactttctctt

SEQ ID NO: 754173 - DNA, 14 bp, Homo sapiens
ctatcacacagtgg

SEQ ID NO: 754174 - DNA, 22 bp, Homo sapiens
ctatcacatgtgaaaagcttaa

SEQ ID NO: 754175 - DNA, 14 bp, Homo sapiens
ctatcacctcccct

SEQ ID NO: 754176 - DNA, 19 bp, Homo sapiens
ctatcacctcccctccttg

SEQ ID NO: 754177 - DNA, 13 bp, Homo sapiens
ctatcagaagacc

SEQ ID NO: 754178 - DNA, 16 bp, Homo sapiens
ctatcagaagttgtat

SEQ ID NO: 754179 - DNA, 19 bp, Homo sapiens
ctatcagacgtgctccctc

SEQ ID NO: 754180 - DNA, 19 bp, Homo sapiens
ctatcagagttgctgcaaa

SEQ ID NO: 754181 - DNA, 22 bp, Homo sapiens
ctatcagcaatactcatcagag

SEQ ID NO: 754182 - DNA, 17 bp, Homo sapiens
ctatcagcattgtttca

SEQ ID NO: 754183 - DNA, 13 bp, Homo sapiens
ctatcaggtaata

SEQ ID NO: 754184 - DNA, 23 bp, Homo sapiens
ctatcatagtcaccattttctca

SEQ ID NO: 754185 - DNA, 13 bp, Homo sapiens
ctatcatggcata

SEQ ID NO: 754186 - DNA, 16 bp, Homo sapiens
ctatcatttttacact

SEQ ID NO: 754187 - DNA, 23 bp, Homo sapiens
ctatccaaagaacttgatttgca

SEQ ID NO: 754188 - DNA, 12 bp, Homo sapiens
ctatccaagtgt

SEQ ID NO: 754189 - DNA, 21 bp, Homo sapiens
ctatcccaataggcagactgg

SEQ ID NO: 754190 - DNA, 16 bp, Homo sapiens
ctatcccaatcaaaga

SEQ ID NO: 754191 - DNA, 14 bp, Homo sapiens
ctatccccaagctg

SEQ ID NO: 754192 - DNA, 13 bp, Homo sapiens
ctatgggaacaat

SEQ ID NO: 754193 - DNA, 13 bp, Homo sapiens
ctatgggcctgcc

SEQ ID NO: 754194 - DNA, 17 bp, Homo sapiens
ctatgggcttggaccac

SEQ ID NO: 754195 - DNA, 15 bp, Homo sapiens
ctatggggatggtcc

SEQ ID NO: 754196 - DNA, 17 bp, Homo sapiens
ctatggtatgctggcca

SEQ ID NO: 754197 - DNA, 21 bp, Homo sapiens
ctatggtatgctggccagcac

SEQ ID NO: 754198 - DNA, 17 bp, Homo sapiens
ctatggtcgggagacag

SEQ ID NO: 754199 - DNA, 19 bp, Homo sapiens
ctatggtgagatgcagctg

SEQ ID NO: 754200 - DNA, 17 bp, Homo sapiens
ctatggttgccacccca

SEQ ID NO: 754201 - DNA, 20 bp, Homo sapiens
ctatggttgccaccccaacc

SEQ ID NO: 754202 - DNA, 22 bp, Homo sapiens
ctatgtaaacaaaccacagcag

SEQ ID NO: 754203 - DNA, 16 bp, Homo sapiens
ctatgtaaattattgt

SEQ ID NO: 754204 - DNA, 20 bp, Homo sapiens
ctatgtaaattattgtaaac

SEQ ID NO: 754205 - DNA, 21 bp, Homo sapiens
ctatgtaaattattgtaaact

SEQ ID NO: 754206 - DNA, 15 bp, Homo sapiens
ctatgtaactgcatt

SEQ ID NO: 754207 - DNA, 21 bp, Homo sapiens
ctatgtaactgcattgagaac

SEQ ID NO: 754208 - DNA, 19 bp, Homo sapiens
ctatgtacagagctttctt

SEQ ID NO: 754209 - DNA, 20 bp, Homo sapiens
ctatgtagtccgtgctgaca

SEQ ID NO: 754210 - DNA, 16 bp, Homo sapiens
ctatgtatcaatgagt

SEQ ID NO: 754211 - DNA, 18 bp, Homo sapiens
ctatgtatcgctcctatt

SEQ ID NO: 754212 - DNA, 22 bp, Homo sapiens
ctatgtatggaatacagtgtta

SEQ ID NO: 754213 - DNA, 20 bp, Homo sapiens
ctatgtcaatttgtatatca

SEQ ID NO: 754214 - DNA, 19 bp, Homo sapiens
ctatgtcatttttaatgta

SEQ ID NO: 754215 - DNA, 13 bp, Homo sapiens
ctatgtcccttgc

SEQ ID NO: 754216 - DNA, 15 bp, Homo sapiens
ctatgtcctaaggac

SEQ ID NO: 754217 - DNA, 22 bp, Homo sapiens
ctatgtcctaaggacacactaa

SEQ ID NO: 754218 - DNA, 17 bp, Homo sapiens
ctatgtcgagagctggc

SEQ ID NO: 754219 - DNA, 21 bp, Homo sapiens
ctatgtcgtgttttcaaggaa

SEQ ID NO: 754220 - DNA, 15 bp, Homo sapiens
ctatgtctgaacata

SEQ ID NO: 754221 - DNA, 13 bp, Homo sapiens
ctatgtgtaaggt

SEQ ID NO: 754222 - DNA, 16 bp, Homo sapiens
ctatgtgtttctgtaa

SEQ ID NO: 754223 - DNA, 21 bp, Homo sapiens
ctatgtgtttctgtaacaaat

SEQ ID NO: 754224 - DNA, 14 bp, Homo sapiens
ctatgtgtttttct

SEQ ID NO: 754225 - DNA, 16 bp, Homo sapiens
ctatgttaaatactgt

SEQ ID NO: 754226 - DNA, 17 bp, Homo sapiens
ctatgttaaatactgtg

SEQ ID NO: 754227 - DNA, 19 bp, Homo sapiens
ctatgttaaatactgtgca

SEQ ID NO: 754228 - DNA, 21 bp, Homo sapiens
ctatgttaaatactgtgcaga

SEQ ID NO: 754229 - DNA, 22 bp, Homo sapiens
ctatgttaaatactgtgcagaa

SEQ ID NO: 754230 - DNA, 18 bp, Homo sapiens
ctatgttactattttcta

SEQ ID NO: 754231 - DNA, 13 bp, Homo sapiens
ctatgttcaaaga

SEQ ID NO: 754232 - DNA, 19 bp, Homo sapiens
ctatgttctgtcttcccaa

SEQ ID NO: 754233 - DNA, 13 bp, Homo sapiens
ctatgttggtttc

SEQ ID NO: 754234 - DNA, 17 bp, Homo sapiens
ctatgttggtttcagtg

SEQ ID NO: 754235 - DNA, 15 bp, Homo sapiens
ctatgtttattctag

SEQ ID NO: 754236 - DNA, 13 bp, Homo sapiens
ctatgtttgtgtg

SEQ ID NO: 754237 - DNA, 16 bp, Homo sapiens
ctatgtttttaatgta

SEQ ID NO: 754238 - DNA, 20 bp, Homo sapiens
ctattaaaaatagacagtaa

SEQ ID NO: 754239 - DNA, 14 bp, Homo sapiens
ctattaaagtgact

SEQ ID NO: 754240 - DNA, 20 bp, Homo sapiens
ctattaacaattaattgtct

SEQ ID NO: 754241 - DNA, 19 bp, Homo sapiens
ctattaaccttttttgtct

SEQ ID NO: 754242 - DNA, 23 bp, Homo sapiens
ctattaagatttccaagtgccaa

SEQ ID NO: 754243 - DNA, 16 bp, Homo sapiens
ctattaagcagtaaaa

SEQ ID NO: 754244 - DNA, 21 bp, Homo sapiens
ctattaaggtgatatatttaa

SEQ ID NO: 754245 - DNA, 12 bp, Homo sapiens
ctattaatatat

SEQ ID NO: 754246 - DNA, 15 bp, Homo sapiens
ctattaatatatgta

SEQ ID NO: 754247 - DNA, 17 bp, Homo sapiens
ctattaatatatgtatt

SEQ ID NO: 754248 - DNA, 21 bp, Homo sapiens
ctattaatatatgtattattt

SEQ ID NO: 754249 - DNA, 23 bp, Homo sapiens
ctattaatatcaactctgaagct

SEQ ID NO: 754250 - DNA, 11 bp, Homo sapiens
ctattaatatt

SEQ ID NO: 754251 - DNA, 12 bp, Homo sapiens
ctattaatattt

SEQ ID NO: 754252 - DNA, 20 bp, Homo sapiens
ctattaatcaagagaaactt

SEQ ID NO: 754253 - DNA, 19 bp, Homo sapiens
ctattaatgaggtctttaa

SEQ ID NO: 754254 - DNA, 20 bp, Homo sapiens
ctattagactttagaaataa

SEQ ID NO: 754255 - DNA, 21 bp, Homo sapiens
ctattagactttagaaataaa

SEQ ID NO: 754256 - DNA, 16 bp, Homo sapiens
ctattagcggctcctc

SEQ ID NO: 754257 - DNA, 13 bp, Homo sapiens
ctattagctgggt

SEQ ID NO: 754258 - DNA, 16 bp, Homo sapiens
ctattataatttaatg

SEQ ID NO: 754259 - DNA, 21 bp, Homo sapiens
ctattataatttaatgcatgt

SEQ ID NO: 754260 - DNA, 17 bp, Homo sapiens
ctattatagcaacttta

SEQ ID NO: 754261 - DNA, 14 bp, Homo sapiens
ctattatattaaaa

SEQ ID NO: 754262 - DNA, 12 bp, Homo sapiens
ctattatcacat

SEQ ID NO: 754263 - DNA, 17 bp, Homo sapiens
ctattatggaaaactgt

SEQ ID NO: 754264 - DNA, 13 bp, Homo sapiens
ctattatgtaaca

SEQ ID NO: 754265 - DNA, 20 bp, Homo sapiens
ctattatgtaacatccagaa

SEQ ID NO: 754266 - DNA, 21 bp, Homo sapiens
ctattatgtaacatccagaag

SEQ ID NO: 754267 - DNA, 19 bp, Homo sapiens
gcctggccatgctgtccct

SEQ ID NO: 754268 - DNA, 20 bp, Homo sapiens
gcctggccatgtcacctggc

SEQ ID NO: 754269 - DNA, 15 bp, Homo sapiens
gcctggccccagcct

SEQ ID NO: 754270 - DNA, 19 bp, Homo sapiens
gcctggccccagcctgggc

SEQ ID NO: 754271 - DNA, 20 bp, Homo sapiens
gcctggccccagcctgggcc

SEQ ID NO: 754272 - DNA, 14 bp, Homo sapiens
gcctggccccaggc

SEQ ID NO: 754273 - DNA, 20 bp, Homo sapiens
gcctggccccaggccccaga

SEQ ID NO: 754274 - DNA, 23 bp, Homo sapiens
gcctggccccaggccccagacag

SEQ ID NO: 754275 - DNA, 20 bp, Homo sapiens
gcctggcccccaacctcagg

SEQ ID NO: 754276 - DNA, 22 bp, Homo sapiens
gcctggcccccaacctcagggc

SEQ ID NO: 754277 - DNA, 11 bp, Homo sapiens
gcctggccctc

SEQ ID NO: 754278 - DNA, 13 bp, Homo sapiens
gcctggccctccc

SEQ ID NO: 754279 - DNA, 17 bp, Homo sapiens
gcctggccctccctccc

SEQ ID NO: 754280 - DNA, 14 bp, Homo sapiens
gcctggccctcctg

SEQ ID NO: 754281 - DNA, 15 bp, Homo sapiens
gcctggccctcctgg

SEQ ID NO: 754282 - DNA, 17 bp, Homo sapiens
gcctggccctcctggct

SEQ ID NO: 754283 - DNA, 15 bp, Homo sapiens
gcctggccgcagggc

SEQ ID NO: 754284 - DNA, 18 bp, Homo sapiens
gcctggccgcagggcggg

SEQ ID NO: 754285 - DNA, 15 bp, Homo sapiens
gcctggccggcaacc

SEQ ID NO: 754286 - DNA, 12 bp, Homo sapiens
gcctggcctgag

SEQ ID NO: 754287 - DNA, 16 bp, Homo sapiens
gcctggcggcctgtgg

SEQ ID NO: 754288 - DNA, 17 bp, Homo sapiens
gcctggcggcctgtggg

SEQ ID NO: 754289 - DNA, 21 bp, Homo sapiens
gcctggcggggttggcccttg

SEQ ID NO: 754290 - DNA, 18 bp, Homo sapiens
gcctggcgtcggccagag

SEQ ID NO: 754291 - DNA, 15 bp, Homo sapiens
gcctggctccccgag

SEQ ID NO: 754292 - DNA, 19 bp, Homo sapiens
gcctggctccccgagggct

SEQ ID NO: 754293 - DNA, 22 bp, Homo sapiens
gcctggctccccgagggctcag

SEQ ID NO: 754294 - DNA, 23 bp, Homo sapiens
gcctggctctgccccctccccca

SEQ ID NO: 754295 - DNA, 17 bp, Homo sapiens
gcctggctctgccccgc

SEQ ID NO: 754296 - DNA, 19 bp, Homo sapiens
gcctggctggagagctgct

SEQ ID NO: 754297 - DNA, 14 bp, Homo sapiens
gcctggctgtggag

SEQ ID NO: 754298 - DNA, 16 bp, Homo sapiens
gcctggcttctggagc

SEQ ID NO: 754299 - DNA, 18 bp, Homo sapiens
gcctggcttctggagccc

SEQ ID NO: 754300 - DNA, 23 bp, Homo sapiens
gcctggcttctggagcccttggg

SEQ ID NO: 754301 - DNA, 13 bp, Homo sapiens
gcctggcttctta

SEQ ID NO: 754302 - DNA, 17 bp, Homo sapiens
gcctggcttgctccagg

SEQ ID NO: 754303 - DNA, 18 bp, Homo sapiens
gcctggcttgctccaggg

SEQ ID NO: 754304 - DNA, 23 bp, Homo sapiens
gcctgggaatgtattattctgca

SEQ ID NO: 754305 - DNA, 13 bp, Homo sapiens
gcctgggacacac

SEQ ID NO: 754306 - DNA, 17 bp, Homo sapiens
gcctgggactcccagtg

SEQ ID NO: 754307 - DNA, 18 bp, Homo sapiens
gcctgggactcccagtga

SEQ ID NO: 754308 - DNA, 21 bp, Homo sapiens
gcctgggacttccatgcctta

SEQ ID NO: 754309 - DNA, 15 bp, Homo sapiens
gcctgggatgcagtg

SEQ ID NO: 754310 - DNA, 21 bp, Homo sapiens
gcctgggcaacagagcaagac

SEQ ID NO: 754311 - DNA, 17 bp, Homo sapiens
gcctgggcagccaggct

SEQ ID NO: 754312 - DNA, 16 bp, Homo sapiens
gcctgggcagcttctg

SEQ ID NO: 754313 - DNA, 15 bp, Homo sapiens
gcctgggcaggaccc

SEQ ID NO: 754314 - DNA, 9 bp, Homo sapiens
ctatttaag

SEQ ID NO: 754315 - DNA, 21 bp, Homo sapiens
ctatttaagttatcaacttta

SEQ ID NO: 754316 - DNA, 15 bp, Homo sapiens
ctatttaatatttat

SEQ ID NO: 754317 - DNA, 13 bp, Homo sapiens
ctatttaattgaa

SEQ ID NO: 754318 - DNA, 15 bp, Homo sapiens
ctatttaattgaaac

SEQ ID NO: 754319 - DNA, 19 bp, Homo sapiens
ctatttacaagatggactt

SEQ ID NO: 754320 - DNA, 13 bp, Homo sapiens
ctatttagcatga

SEQ ID NO: 754321 - DNA, 20 bp, Homo sapiens
ctatttagtttttgtaattt

SEQ ID NO: 754322 - DNA, 22 bp, Homo sapiens
ctatttagtttttgtaatttat

SEQ ID NO: 754323 - DNA, 13 bp, Homo sapiens
ctatttatccctt

SEQ ID NO: 754324 - DNA, 16 bp, Homo sapiens
ctatttatccctttcc

SEQ ID NO: 754325 - DNA, 21 bp, Homo sapiens
ctatttatccctttcctggtt

SEQ ID NO: 754326 - DNA, 16 bp, Homo sapiens
ctatttatctgtgttt

SEQ ID NO: 754327 - DNA, 15 bp, Homo sapiens
ctatttattaatatt

SEQ ID NO: 754328 - DNA, 20 bp, Homo sapiens
ctatttattaatatttaaca

SEQ ID NO: 754329 - DNA, 21 bp, Homo sapiens
ctatttattaatatttaacat

SEQ ID NO: 754330 - DNA, 16 bp, Homo sapiens
ctatttattgactttg

SEQ ID NO: 754331 - DNA, 15 bp, Homo sapiens
ctatttattgtgctg

SEQ ID NO: 754332 - DNA, 14 bp, Homo sapiens
ctatttatttacaa

SEQ ID NO: 754333 - DNA, 14 bp, Homo sapiens
ctatttatttttac

SEQ ID NO: 754334 - DNA, 13 bp, Homo sapiens
ctatttcagcctc

SEQ ID NO: 754335 - DNA, 21 bp, Homo sapiens
ctatttcagtgttacctgtgt

SEQ ID NO: 754336 - DNA, 19 bp, Homo sapiens
ctatttccaaaagcacatg

SEQ ID NO: 754337 - DNA, 21 bp, Homo sapiens
ctatttccccaggggaaaatg

SEQ ID NO: 754338 - DNA, 17 bp, Homo sapiens
ctatttcccctcttctg

SEQ ID NO: 754339 - DNA, 12 bp, Homo sapiens
ctatttctatgt

SEQ ID NO: 754340 - DNA, 13 bp, Homo sapiens
ctatttctatgtc

SEQ ID NO: 754341 - DNA, 15 bp, Homo sapiens
ctatttctcctccat

SEQ ID NO: 754342 - DNA, 12 bp, Homo sapiens
ctatttctctat

SEQ ID NO: 754343 - DNA, 14 bp, Homo sapiens
ctatttctctgtgt

SEQ ID NO: 754344 - DNA, 15 bp, Homo sapiens
ctatttctctgtgta

SEQ ID NO: 754345 - DNA, 17 bp, Homo sapiens
ctatttctgatgatgtc

SEQ ID NO: 754346 - DNA, 14 bp, Homo sapiens
ctatttgaacaagt

SEQ ID NO: 754347 - DNA, 10 bp, Homo sapiens
ctatttgaag

SEQ ID NO: 754348 - DNA, 20 bp, Homo sapiens
ctatttgaagaaaaaaatgt

SEQ ID NO: 754349 - DNA, 19 bp, Homo sapiens
ctatttgtaaatctgccac

SEQ ID NO: 754350 - DNA, 16 bp, Homo sapiens
ctatttgtgtgtatgc

SEQ ID NO: 754351 - DNA, 18 bp, Homo sapiens
ctatttgtttacatgcag

SEQ ID NO: 754352 - DNA, 23 bp, Homo sapiens
ctatttgttttcttctgtatgtt

SEQ ID NO: 754353 - DNA, 20 bp, Homo sapiens
ctattttaaaataaattagt

SEQ ID NO: 754354 - DNA, 16 bp, Homo sapiens
ctattttaaagtaaaa

SEQ ID NO: 754355 - DNA, 11 bp, Homo sapiens
ctattttaaga

SEQ ID NO: 754356 - DNA, 23 bp, Homo sapiens
ctattttaagactgattttaata

SEQ ID NO: 754357 - DNA, 14 bp, Homo sapiens
ctattttactttgt

SEQ ID NO: 754358 - DNA, 16 bp, Homo sapiens
ctattttactttgtac

SEQ ID NO: 754359 - DNA, 17 bp, Homo sapiens
ctattttatttgtattc

SEQ ID NO: 754360 - DNA, 20 bp, Homo sapiens
ctattttcactagggctgag

SEQ ID NO: 754361 - DNA, 16 bp, Homo sapiens
ctattttcatttgtac

SEQ ID NO: 754362 - DNA, 15 bp, Homo sapiens
ctattttcctctggc

SEQ ID NO: 754363 - DNA, 17 bp, Homo sapiens
ctattttgttttaatct

SEQ ID NO: 754364 - DNA, 15 bp, Homo sapiens
ctatttttatcatga

SEQ ID NO: 754365 - DNA, 14 bp, Homo sapiens
ctatttttctatga

SEQ ID NO: 754366 - DNA, 14 bp, Homo sapiens
ctatttttgactgt

SEQ ID NO: 754367 - DNA, 22 bp, Homo sapiens
ctatttttgactgtagccacag

SEQ ID NO: 754368 - DNA, 22 bp, Homo sapiens
ctatttttgtcttatatatatt

SEQ ID NO: 754369 - DNA, 17 bp, Homo sapiens
ctattttttaaagactg

SEQ ID NO: 754370 - DNA, 22 bp, Homo sapiens
ctatttttttaactgaaaatgt

SEQ ID NO: 754371 - DNA, 18 bp, Homo sapiens
ctatttttttttttttgt

SEQ ID NO: 754372 - DNA, 21 bp, Homo sapiens
ctcaaaaaaaaaaaaatgcac

SEQ ID NO: 754373 - DNA, 22 bp, Homo sapiens
ctcaaaaaaaagaaaatgtctt

SEQ ID NO: 754374 - DNA, 17 bp, Homo sapiens
ctcaaaaaaagaaaaag

SEQ ID NO: 754375 - DNA, 18 bp, Homo sapiens
ctcaaaaaaagaaaaaga

SEQ ID NO: 754376 - DNA, 14 bp, Homo sapiens
ctcaaaacaaaggc

SEQ ID NO: 754377 - DNA, 17 bp, Homo sapiens
ctcaaaacgggtcagta

SEQ ID NO: 754378 - DNA, 19 bp, Homo sapiens
ctcaaaactcttgaaatta

SEQ ID NO: 754379 - DNA, 16 bp, Homo sapiens
ctcaaaagtctatttt

SEQ ID NO: 754380 - DNA, 20 bp, Homo sapiens
ctcaaaataaaaagcctcag

SEQ ID NO: 754381 - DNA, 21 bp, Homo sapiens
ctcaaaataaaaagcctcagt

SEQ ID NO: 754382 - DNA, 18 bp, Homo sapiens
ctcaaaataaagaagtat

SEQ ID NO: 754383 - DNA, 13 bp, Homo sapiens
ctcaaaatatttg

SEQ ID NO: 754384 - DNA, 13 bp, Homo sapiens
ctcaaacctcctc

SEQ ID NO: 754385 - DNA, 16 bp, Homo sapiens
ctcaaacctggagctg

SEQ ID NO: 754386 - DNA, 18 bp, Homo sapiens
ctcaaacctggagctgag

SEQ ID NO: 754387 - DNA, 16 bp, Homo sapiens
ctcaaactcctgacct

SEQ ID NO: 754388 - DNA, 21 bp, Homo sapiens
ctcaaactcctgacctcaggt

SEQ ID NO: 754389 - DNA, 13 bp, Homo sapiens
ctcaaactcctgg

SEQ ID NO: 754390 - DNA, 14 bp, Homo sapiens
ctcaaactcctggg

SEQ ID NO: 754391 - DNA, 19 bp, Homo sapiens
ctcaaactgaggaatttca

SEQ ID NO: 754392 - DNA, 22 bp, Homo sapiens
ctcaaactgaggaatttcacct

SEQ ID NO: 754393 - DNA, 14 bp, Homo sapiens
ctcaaactgcacat

SEQ ID NO: 754394 - DNA, 18 bp, Homo sapiens
ctcaaagagggggctctg

SEQ ID NO: 754395 - DNA, 20 bp, Homo sapiens
ctcaaagagggggctctgcc

SEQ ID NO: 754396 - DNA, 21 bp, Homo sapiens
ctcaaagagggggctctgccc

SEQ ID NO: 754397 - DNA, 18 bp, Homo sapiens
ctcaaagatgcattttta

SEQ ID NO: 754398 - DNA, 19 bp, Homo sapiens
gccttcccaagttgtgctt

SEQ ID NO: 754399 - DNA, 20 bp, Homo sapiens
gccttcccaagttgtgcttg

SEQ ID NO: 754400 - DNA, 13 bp, Homo sapiens
gccttccccagct

SEQ ID NO: 754401 - DNA, 15 bp, Homo sapiens
gccttccccagctcc

SEQ ID NO: 754402 - DNA, 13 bp, Homo sapiens
gccttcccctccc

SEQ ID NO: 754403 - DNA, 16 bp, Homo sapiens
gccttccccttgccca

SEQ ID NO: 754404 - DNA, 21 bp, Homo sapiens
gccttccccttttgcctggct

SEQ ID NO: 754405 - DNA, 23 bp, Homo sapiens
gccttccccttttgcctggctgt

SEQ ID NO: 754406 - DNA, 23 bp, Homo sapiens
gccttccctagctttagaccctg

SEQ ID NO: 754407 - DNA, 13 bp, Homo sapiens
gccttccctcact

SEQ ID NO: 754408 - DNA, 22 bp, Homo sapiens
gccttccgggtctcgcagcctg

SEQ ID NO: 754409 - DNA, 23 bp, Homo sapiens
gccttccgggtctcgcagcctga

SEQ ID NO: 754410 - DNA, 17 bp, Homo sapiens
gccttcctcatcccctc

SEQ ID NO: 754411 - DNA, 15 bp, Homo sapiens
gccttcctccccgcc

SEQ ID NO: 754412 - DNA, 20 bp, Homo sapiens
gccttcctcgtgcagagctg

SEQ ID NO: 754413 - DNA, 22 bp, Homo sapiens
gccttcctcgtgcagagctggg

SEQ ID NO: 754414 - DNA, 13 bp, Homo sapiens
gccttcctctctc

SEQ ID NO: 754415 - DNA, 19 bp, Homo sapiens
gccttcctgccctacagag

SEQ ID NO: 754416 - DNA, 19 bp, Homo sapiens
gccttccttctgctcccac

SEQ ID NO: 754417 - DNA, 19 bp, Homo sapiens
gccttcctttctccaggac

SEQ ID NO: 754418 - DNA, 21 bp, Homo sapiens
gccttcctttctccaggacca

SEQ ID NO: 754419 - DNA, 18 bp, Homo sapiens
gccttcgctccatgtttt

SEQ ID NO: 754420 - DNA, 17 bp, Homo sapiens
gccttcgcttcttgcct

SEQ ID NO: 754421 - DNA, 19 bp, Homo sapiens
gccttcgtctttcccatgg

SEQ ID NO: 754422 - DNA, 16 bp, Homo sapiens
gccttcgtgtgctgct

SEQ ID NO: 754423 - DNA, 18 bp, Homo sapiens
gccttcgtgtgctgctgc

SEQ ID NO: 754424 - DNA, 17 bp, Homo sapiens
gccttcgtgtggctcct

SEQ ID NO: 754425 - DNA, 19 bp, Homo sapiens
gccttcgtgtggctcctgg

SEQ ID NO: 754426 - DNA, 20 bp, Homo sapiens
gccttcgtgtggctcctggt

SEQ ID NO: 754427 - DNA, 15 bp, Homo sapiens
gccttctaaaggtgt

SEQ ID NO: 754428 - DNA, 17 bp, Homo sapiens
gccttctagattcactg

SEQ ID NO: 754429 - DNA, 21 bp, Homo sapiens
gccttctagattcactgtctt

SEQ ID NO: 754430 - DNA, 17 bp, Homo sapiens
gccttctcatgatccaa

SEQ ID NO: 754431 - DNA, 20 bp, Homo sapiens
gccttctcccacatgaggcc

SEQ ID NO: 754432 - DNA, 13 bp, Homo sapiens
gccttctcccctc

SEQ ID NO: 754433 - DNA, 15 bp, Homo sapiens
gccttctcccctctc

SEQ ID NO: 754434 - DNA, 23 bp, Homo sapiens
gccttctcccctctcccagggat

SEQ ID NO: 754435 - DNA, 16 bp, Homo sapiens
gccttctcctctctgg

SEQ ID NO: 754436 - DNA, 14 bp, Homo sapiens
gcctttctcctccc

SEQ ID NO: 754437 - DNA, 22 bp, Homo sapiens
gcctttctctggcttccttggc

SEQ ID NO: 754438 - DNA, 13 bp, Homo sapiens
gcctttctgcctt

SEQ ID NO: 754439 - DNA, 15 bp, Homo sapiens
gcctttcttctgccc

SEQ ID NO: 754440 - DNA, 13 bp, Homo sapiens
gcctttcttctgt

SEQ ID NO: 754441 - DNA, 22 bp, Homo sapiens
gcctttcttgtagccatggctg

SEQ ID NO: 754442 - DNA, 17 bp, Homo sapiens
gcctttgatgttacaga

SEQ ID NO: 754443 - DNA, 14 bp, Homo sapiens
gcctttgcaagatg

SEQ ID NO: 754444 - DNA, 21 bp, Homo sapiens
gcctttgcagttggactctca

SEQ ID NO: 754445 - DNA, 23 bp, Homo sapiens
gcctttgcagttggactctcagg

SEQ ID NO: 754446 - DNA, 12 bp, Homo sapiens
gcctttgccttt

SEQ ID NO: 754447 - DNA, 21 bp, Homo sapiens
gcctttgctgtttagcttcct

SEQ ID NO: 754448 - DNA, 19 bp, Homo sapiens
gcctttggacccagggcct

SEQ ID NO: 754449 - DNA, 23 bp, Homo sapiens
gcctttggacccagggcctgact

SEQ ID NO: 754450 - DNA, 14 bp, Homo sapiens
gcctttggagggga

SEQ ID NO: 754451 - DNA, 20 bp, Homo sapiens
gcctttggatgaccagaaca

SEQ ID NO: 754452 - DNA, 18 bp, Homo sapiens
gcctttggggggccaccc

SEQ ID NO: 754453 - DNA, 15 bp, Homo sapiens
gcctttgtattataa

SEQ ID NO: 754454 - DNA, 19 bp, Homo sapiens
gcctttgtattataaaagc

SEQ ID NO: 754455 - DNA, 13 bp, Homo sapiens
gcctttgtcccca

SEQ ID NO: 754456 - DNA, 14 bp, Homo sapiens
gcctttgtccccac

SEQ ID NO: 754457 - DNA, 20 bp, Homo sapiens
gcctttgtcttgtacttctg

SEQ ID NO: 754458 - DNA, 22 bp, Homo sapiens
gcctttgtgctgcgcctgcagg

SEQ ID NO: 754459 - DNA, 13 bp, Homo sapiens
gcctttgttaacc

SEQ ID NO: 754460 - DNA, 14 bp, Homo sapiens
gccttttaagtttg

SEQ ID NO: 754461 - DNA, 23 bp, Homo sapiens
gccttttaattttgtatgaggtc

SEQ ID NO: 754462 - DNA, 14 bp, Homo sapiens
gccttttaattttt

SEQ ID NO: 754463 - DNA, 20 bp, Homo sapiens
gccttttacccctgcacagt

SEQ ID NO: 754464 - DNA, 14 bp, Homo sapiens
gccttttatagcta

SEQ ID NO: 754465 - DNA, 22 bp, Homo sapiens
gccttttcacgggaactctcca

SEQ ID NO: 754466 - DNA, 12 bp, Homo sapiens
gccttttcagcc

SEQ ID NO: 754467 - DNA, 13 bp, Homo sapiens
gccttttccctct

SEQ ID NO: 754468 - DNA, 14 bp, Homo sapiens
gccttttctggagt

SEQ ID NO: 754469 - DNA, 19 bp, Homo sapiens
gccttttctggtccctctt

SEQ ID NO: 754470 - DNA, 21 bp, Homo sapiens
gccttttctggtccctcttct

SEQ ID NO: 754471 - DNA, 13 bp, Homo sapiens
gccttttctgtga

SEQ ID NO: 754472 - DNA, 15 bp, Homo sapiens
gccttttctgtgatt

SEQ ID NO: 754473 - DNA, 17 bp, Homo sapiens
gccttttctttaacttt

SEQ ID NO: 754474 - DNA, 13 bp, Homo sapiens
gccttttgacagc

SEQ ID NO: 754475 - DNA, 15 bp, Homo sapiens
gccttttgcacccct

SEQ ID NO: 754476 - DNA, 18 bp, Homo sapiens
gccttttgcacccctccc

SEQ ID NO: 754477 - DNA, 17 bp, Homo sapiens
gccttttgctacgtgcc

SEQ ID NO: 754478 - DNA, 14 bp, Homo sapiens
gccttttggatatg

SEQ ID NO: 754479 - DNA, 21 bp, Homo sapiens
gccttttgtgtaataagaaag

SEQ ID NO: 754480 - DNA, 14 bp, Homo sapiens
gccttttgtttaaa

SEQ ID NO: 754481 - DNA, 14 bp, Homo sapiens
gcctttttcattta

SEQ ID NO: 754482 - DNA, 12 bp, Homo sapiens
gcctttttcctt

SEQ ID NO: 754483 - DNA, 17 bp, Homo sapiens
gcctttttgtttcaatg

SEQ ID NO: 754484 - DNA, 16 bp, Homo sapiens
gccttttttcacagcc

SEQ ID NO: 754485 - DNA, 19 bp, Homo sapiens
gccttttttcacggaagtt

SEQ ID NO: 754486 - DNA, 17 bp, Homo sapiens
gccttttttgccagact

SEQ ID NO: 754487 - DNA, 22 bp, Homo sapiens
gcgaaaaaatcaggtggctttt

SEQ ID NO: 754488 - DNA, 23 bp, Homo sapiens
gcgaaaggatgtaaacagtgcct

SEQ ID NO: 754489 - DNA, 21 bp, Homo sapiens
gcgaaatgttctcatgaacta

SEQ ID NO: 754490 - DNA, 19 bp, Homo sapiens
gcgaacgtatttctccaga

SEQ ID NO: 754491 - DNA, 24 bp, Homo sapiens
gcgaacgtatttctccagacccag

SEQ ID NO: 754492 - DNA, 20 bp, Homo sapiens
gcgaagtctttgccttctct

SEQ ID NO: 754493 - DNA, 15 bp, Homo sapiens
gcgaagtggctctca

SEQ ID NO: 754494 - DNA, 17 bp, Homo sapiens
gcgaagtggctctcagg

SEQ ID NO: 754495 - DNA, 15 bp, Homo sapiens
gcgaatccaagctcc

SEQ ID NO: 754496 - DNA, 21 bp, Homo sapiens
gcgaatccaagctccctgccc

SEQ ID NO: 754497 - DNA, 22 bp, Homo sapiens
gcgaatccaagctccctgcccc

SEQ ID NO: 754498 - DNA, 19 bp, Homo sapiens
gcgaattcatcccctcccc

SEQ ID NO: 754499 - DNA, 13 bp, Homo sapiens
gcgacaagtagtt

SEQ ID NO: 754500 - DNA, 20 bp, Homo sapiens
gcgacactcagggcagctgc

SEQ ID NO: 754501 - DNA, 22 bp, Homo sapiens
gcgacactcagggcagctgcct

SEQ ID NO: 754502 - DNA, 24 bp, Homo sapiens
gcgacactcagggcagctgcctgg

SEQ ID NO: 754503 - DNA, 11 bp, Homo sapiens
gcgaccccaga

SEQ ID NO: 754504 - DNA, 14 bp, Homo sapiens
gcgaccccagactg

SEQ ID NO: 754505 - DNA, 23 bp, Homo sapiens
gcgacccttggtgtttcccttcc

SEQ ID NO: 754506 - DNA, 17 bp, Homo sapiens
gcgacctctctgcctct

SEQ ID NO: 754507 - DNA, 20 bp, Homo sapiens
gcgacctctctgcctctctt

SEQ ID NO: 754508 - DNA, 22 bp, Homo sapiens
gcgaccttcctcatccacccca

SEQ ID NO: 754509 - DNA, 19 bp, Homo sapiens
gcgacggctcctccccgat

SEQ ID NO: 754510 - DNA, 20 bp, Homo sapiens
gcgacggctcctccccgatc

SEQ ID NO: 754511 - DNA, 17 bp, Homo sapiens
gcgacgtcttcagagtc

SEQ ID NO: 754512 - DNA, 13 bp, Homo sapiens
gcgactaatttca

SEQ ID NO: 754513 - DNA, 19 bp, Homo sapiens
gcgactccgttggccactc

SEQ ID NO: 754514 - DNA, 20 bp, Homo sapiens
gcgactccgttggccactcc

SEQ ID NO: 754515 - DNA, 21 bp, Homo sapiens
gcgactctatagactctagga

SEQ ID NO: 754516 - DNA, 12 bp, Homo sapiens
gcgactctcctg

SEQ ID NO: 754517 - DNA, 17 bp, Homo sapiens
gcgactggatgctcgcc

SEQ ID NO: 754518 - DNA, 12 bp, Homo sapiens
gcgactttctgc

SEQ ID NO: 754519 - DNA, 21 bp, Homo sapiens
gcgagacccaaggctcactgc

SEQ ID NO: 754520 - DNA, 23 bp, Homo sapiens
gcgagacccaaggctcactgcag

SEQ ID NO: 754521 - DNA, 16 bp, Homo sapiens
gcgagaggcagagaaa

SEQ ID NO: 754522 - DNA, 23 bp, Homo sapiens
gcgagatagggggaagacagata

SEQ ID NO: 754523 - DNA, 16 bp, Homo sapiens
gcgagcatcctggcca

SEQ ID NO: 754524 - DNA, 14 bp, Homo sapiens
gcgagcctgactct

SEQ ID NO: 754525 - DNA, 14 bp, Homo sapiens
gcgagctgagaagc

SEQ ID NO: 754526 - DNA, 14 bp, Homo sapiens
gcgagctgctctgc

SEQ ID NO: 754527 - DNA, 17 bp, Homo sapiens
ctcacaacctgaaccta

SEQ ID NO: 754528 - DNA, 15 bp, Homo sapiens
ctcacaagaagacca

SEQ ID NO: 754529 - DNA, 15 bp, Homo sapiens
ctcacaatttaaaat

SEQ ID NO: 754530 - DNA, 20 bp, Homo sapiens
ctcacaatttaaaatatttc

SEQ ID NO: 754531 - DNA, 15 bp, Homo sapiens
ctcacacacacagct

SEQ ID NO: 754532 - DNA, 21 bp, Homo sapiens
ctcacacacacagctgggcaa

SEQ ID NO: 754533 - DNA, 15 bp, Homo sapiens
ctcacacaccctgag

SEQ ID NO: 754534 - DNA, 19 bp, Homo sapiens
ctcacacatccccagccag

SEQ ID NO: 754535 - DNA, 15 bp, Homo sapiens
ctcacacccaccgtc

SEQ ID NO: 754536 - DNA, 16 bp, Homo sapiens
ctcacacccctgtccc

SEQ ID NO: 754537 - DNA, 23 bp, Homo sapiens
ctcacacggacactcaaaagctg

SEQ ID NO: 754538 - DNA, 19 bp, Homo sapiens
ctcacactaagagggcaga

SEQ ID NO: 754539 - DNA, 12 bp, Homo sapiens
ctcacactcctg

SEQ ID NO: 754540 - DNA, 22 bp, Homo sapiens
ctcacactctctgcagcccagc

SEQ ID NO: 754541 - DNA, 23 bp, Homo sapiens
ctcacactctctgcagcccagcc

SEQ ID NO: 754542 - DNA, 19 bp, Homo sapiens
ctcacactgatgggctggg

SEQ ID NO: 754543 - DNA, 19 bp, Homo sapiens
ctcacactgctgtcctctc

SEQ ID NO: 754544 - DNA, 18 bp, Homo sapiens
ctcacactggtctgctgt

SEQ ID NO: 754545 - DNA, 21 bp, Homo sapiens
ctcacactggttctcaatgaa

SEQ ID NO: 754546 - DNA, 17 bp, Homo sapiens
ctcacagaacccttgga

SEQ ID NO: 754547 - DNA, 17 bp, Homo sapiens
ctcacagacctctgctt

SEQ ID NO: 754548 - DNA, 14 bp, Homo sapiens
ctcacagacctgga

SEQ ID NO: 754549 - DNA, 20 bp, Homo sapiens
ctcacagacctggagcccct

SEQ ID NO: 754550 - DNA, 13 bp, Homo sapiens
ctcacagagcttt

SEQ ID NO: 754551 - DNA, 21 bp, Homo sapiens
ctcacagattgaggtaataat

SEQ ID NO: 754552 - DNA, 18 bp, Homo sapiens
ctcacagcagtgagactg

SEQ ID NO: 754553 - DNA, 18 bp, Homo sapiens
ctcacaggccctggagaa

SEQ ID NO: 754554 - DNA, 16 bp, Homo sapiens
ctcacagggatgctgg

SEQ ID NO: 754555 - DNA, 16 bp, Homo sapiens
ctcacagggcaggcct

SEQ ID NO: 754556 - DNA, 20 bp, Homo sapiens
ctcacaggtgtttgaggcca

SEQ ID NO: 754557 - DNA, 13 bp, Homo sapiens
ctcacagtacagc

SEQ ID NO: 754558 - DNA, 19 bp, Homo sapiens
ctcacagtctctttaatct

SEQ ID NO: 754559 - DNA, 22 bp, Homo sapiens
ctcacagtgaacactcagtggc

SEQ ID NO: 754560 - DNA, 17 bp, Homo sapiens
ctcacagtgttgcccag

SEQ ID NO: 754561 - DNA, 22 bp, Homo sapiens
ctcacagttcctcgccctgggt

SEQ ID NO: 754562 - DNA, 23 bp, Homo sapiens
ctcacagttcctcgccctgggtc

SEQ ID NO: 754563 - DNA, 22 bp, Homo sapiens
ctcacatacccacacattccag

SEQ ID NO: 754564 - DNA, 13 bp, Homo sapiens
ctcacatcctctc

SEQ ID NO: 754565 - DNA, 14 bp, Homo sapiens
ctcacatcctctcc

SEQ ID NO: 754566 - DNA, 13 bp, Homo sapiens
ctcacatgggact

SEQ ID NO: 754567 - DNA, 14 bp, Homo sapiens
ctcacatgggactg

SEQ ID NO: 754568 - DNA, 20 bp, Homo sapiens
ctcacatgtggcaaaatatg

SEQ ID NO: 754569 - DNA, 12 bp, Homo sapiens
ctcacattttgt

SEQ ID NO: 754570 - DNA, 18 bp, Homo sapiens
ctcaccaacttgccacat

SEQ ID NO: 754571 - DNA, 14 bp, Homo sapiens
ctcaccaccacact

SEQ ID NO: 754572 - DNA, 21 bp, Homo sapiens
ctcaccactgccccctgctgc

SEQ ID NO: 754573 - DNA, 22 bp, Homo sapiens
ctcaccagccccactgccagca

SEQ ID NO: 754574 - DNA, 15 bp, Homo sapiens
ctcaccagccctgca

SEQ ID NO: 754575 - DNA, 13 bp, Homo sapiens
ctcaccaggaagg

SEQ ID NO: 754576 - DNA, 20 bp, Homo sapiens
ctcaccaggcccacgaggag

SEQ ID NO: 754577 - DNA, 21 bp, Homo sapiens
ctcaccagggtccgcaccagc

SEQ ID NO: 754578 - DNA, 16 bp, Homo sapiens
ctcaccagtggccttt

SEQ ID NO: 754579 - DNA, 23 bp, Homo sapiens
ctcaccagtgtcccctccactgt

SEQ ID NO: 754580 - DNA, 12 bp, Homo sapiens
ctcaccattcca

SEQ ID NO: 754581 - DNA, 20 bp, Homo sapiens
ctcaccattccaagtctcca

SEQ ID NO: 754582 - DNA, 22 bp, Homo sapiens
ctcaccattccaagtctccacc

SEQ ID NO: 754583 - DNA, 13 bp, Homo sapiens
ctcacccaaaaga

SEQ ID NO: 754584 - DNA, 18 bp, Homo sapiens
ctcacccaccagctccac

SEQ ID NO: 754585 - DNA, 14 bp, Homo sapiens
ctcacccaccatgg

SEQ ID NO: 754586 - DNA, 20 bp, Homo sapiens
ctcacccaccatggaccagc

SEQ ID NO: 754587 - DNA, 14 bp, Homo sapiens
ctcacccacctctg

SEQ ID NO: 754588 - DNA, 15 bp, Homo sapiens
ctcacccacctctgg

SEQ ID NO: 754589 - DNA, 19 bp, Homo sapiens
ctcacccagatcaggaacc

SEQ ID NO: 754590 - DNA, 14 bp, Homo sapiens
ctcacccagcctgg

SEQ ID NO: 754591 - DNA, 17 bp, Homo sapiens
ctcacccaggcaatctt

SEQ ID NO: 754592 - DNA, 15 bp, Homo sapiens
ctcaccccaaggggt

SEQ ID NO: 754593 - DNA, 17 bp, Homo sapiens
ctcaccccaatccctgc

SEQ ID NO: 754594 - DNA, 22 bp, Homo sapiens
ctcaccccaatccctgccactg

SEQ ID NO: 754595 - DNA, 22 bp, Homo sapiens
ctcaccccacttcccatctcca

SEQ ID NO: 754596 - DNA, 14 bp, Homo sapiens
ctcaccccagctcc

SEQ ID NO: 754597 - DNA, 19 bp, Homo sapiens
ctcaccccatcccacaccc

SEQ ID NO: 754598 - DNA, 21 bp, Homo sapiens
ctcaccccatcccacaccctg

SEQ ID NO: 754599 - DNA, 17 bp, Homo sapiens
ctcacccccagctttgc

SEQ ID NO: 754600 - DNA, 18 bp, Homo sapiens
ctcacccccagctttgct

SEQ ID NO: 754601 - DNA, 20 bp, Homo sapiens
ctcacccccaggtgttgcca

SEQ ID NO: 754602 - DNA, 14 bp, Homo sapiens
ctcaccccctccca

SEQ ID NO: 754603 - DNA, 22 bp, Homo sapiens
ctcaccccctcccacccccagc

SEQ ID NO: 754604 - DNA, 18 bp, Homo sapiens
ctcaccccctcctggcaa

SEQ ID NO: 754605 - DNA, 19 bp, Homo sapiens
ctcaccccctcctggcaat

SEQ ID NO: 754606 - DNA, 15 bp, Homo sapiens
ctcaccccctttgct

SEQ ID NO: 754607 - DNA, 13 bp, Homo sapiens
ctcacccctgggc

SEQ ID NO: 754608 - DNA, 12 bp, Homo sapiens
ctcaccctctgt

SEQ ID NO: 754609 - DNA, 13 bp, Homo sapiens
ctcaccctctgtc

SEQ ID NO: 754610 - DNA, 14 bp, Homo sapiens
ctcaccctctgtcc

SEQ ID NO: 754611 - DNA, 20 bp, Homo sapiens
ctcaccctctgtccccacga

SEQ ID NO: 754612 - DNA, 14 bp, Homo sapiens
ctcaccctgagccc

SEQ ID NO: 754613 - DNA, 13 bp, Homo sapiens
ctcaccctgcctt

SEQ ID NO: 754614 - DNA, 23 bp, Homo sapiens
ctcaccctgggagccagtcctcc

SEQ ID NO: 754615 - DNA, 14 bp, Homo sapiens
ctcaccctgtggga

SEQ ID NO: 754616 - DNA, 16 bp, Homo sapiens
ctcaccctgtgggacc

SEQ ID NO: 754617 - DNA, 21 bp, Homo sapiens
ctcaccctgtgggaccgcctg

SEQ ID NO: 754618 - DNA, 22 bp, Homo sapiens
ctcaccctgtgggaccgcctgg

SEQ ID NO: 754619 - DNA, 14 bp, Homo sapiens
ctcacccttcctgg

SEQ ID NO: 754620 - DNA, 21 bp, Homo sapiens
ctcaccggctctcacctggcc

SEQ ID NO: 754621 - DNA, 20 bp, Homo sapiens
ctcacctagagccagaccaa

SEQ ID NO: 754622 - DNA, 15 bp, Homo sapiens
ctcacctcatgccca

SEQ ID NO: 754623 - DNA, 19 bp, Homo sapiens
ctcacctcccgaagccacc

SEQ ID NO: 754624 - DNA, 15 bp, Homo sapiens
ctcacctctacccaa

SEQ ID NO: 754625 - DNA, 11 bp, Homo sapiens
ctcacctctga

SEQ ID NO: 754626 - DNA, 12 bp, Homo sapiens
ctcacctctgat

SEQ ID NO: 754627 - DNA, 12 bp, Homo sapiens
ctcacctgacct

SEQ ID NO: 754628 - DNA, 17 bp, Homo sapiens
ctcacctgcactaacag

SEQ ID NO: 754629 - DNA, 17 bp, Homo sapiens
ctcacctgcagagaaac

SEQ ID NO: 754630 - DNA, 18 bp, Homo sapiens
ctcacctgcccctctgtt

SEQ ID NO: 754631 - DNA, 19 bp, Homo sapiens
ctcacctgctggcccctca

SEQ ID NO: 754632 - DNA, 12 bp, Homo sapiens
ctcacctggact

SEQ ID NO: 754633 - DNA, 13 bp, Homo sapiens
ctcacctggactt

SEQ ID NO: 754634 - DNA, 21 bp, Homo sapiens
ctcacctggaggcaagaggga

SEQ ID NO: 754635 - DNA, 17 bp, Homo sapiens
ctcacctggccctgctt

SEQ ID NO: 754636 - DNA, 22 bp, Homo sapiens
ctcacctgggcctttcctgtgc

SEQ ID NO: 754637 - DNA, 16 bp, Homo sapiens
ctcacctggttgaccc

SEQ ID NO: 754638 - DNA, 13 bp, Homo sapiens
ctcaccttcctgt

SEQ ID NO: 754639 - DNA, 18 bp, Homo sapiens
ctcaccttgcaacacaca

SEQ ID NO: 754640 - DNA, 21 bp, Homo sapiens
ctcacctttagaacaggagac

SEQ ID NO: 754641 - DNA, 17 bp, Homo sapiens
ctcacctttcccatctt

SEQ ID NO: 754642 - DNA, 22 bp, Homo sapiens
ctcacctttgttttttgttgga

SEQ ID NO: 754643 - DNA, 17 bp, Homo sapiens
ctcacgactcttcctgc

SEQ ID NO: 754644 - DNA, 19 bp, Homo sapiens
ctcacgactcttcctgcaa

SEQ ID NO: 754645 - DNA, 18 bp, Homo sapiens
ctcacgccccctgtgact

SEQ ID NO: 754646 - DNA, 15 bp, Homo sapiens
ctcacgccccgctgt

SEQ ID NO: 754647 - DNA, 16 bp, Homo sapiens
ctcacgccccgctgtg

SEQ ID NO: 754648 - DNA, 19 bp, Homo sapiens
ctcacgccccgctgtgtcc

SEQ ID NO: 754649 - DNA, 13 bp, Homo sapiens
ctcacgcctgtaa

SEQ ID NO: 754650 - DNA, 21 bp, Homo sapiens
ctcacgctcccccgcagtccc

SEQ ID NO: 754651 - DNA, 21 bp, Homo sapiens
ctcacggaccactcgaggcct

SEQ ID NO: 754652 - DNA, 17 bp, Homo sapiens
gcgagcttggccttggg

SEQ ID NO: 754653 - DNA, 21 bp, Homo sapiens
gcgagcttggccttgggccgg

SEQ ID NO: 754654 - DNA, 20 bp, Homo sapiens
gcgaggagatgctccttggg

SEQ ID NO: 754655 - DNA, 17 bp, Homo sapiens
gcgaggaggctccagag

SEQ ID NO: 754656 - DNA, 15 bp, Homo sapiens
gcgagggcagctgct

SEQ ID NO: 754657 - DNA, 12 bp, Homo sapiens
gcgaggggccag

SEQ ID NO: 754658 - DNA, 21 bp, Homo sapiens
gcgagggggccggggggaggg

SEQ ID NO: 754659 - DNA, 19 bp, Homo sapiens
gcgaggtcaacagagaagg

SEQ ID NO: 754660 - DNA, 22 bp, Homo sapiens
gcgaggtcaacagagaaggcag

SEQ ID NO: 754661 - DNA, 16 bp, Homo sapiens
gcgaggtcagaggagg

SEQ ID NO: 754662 - DNA, 14 bp, Homo sapiens
gcgagtctggggac

SEQ ID NO: 754663 - DNA, 17 bp, Homo sapiens
gcgagtctggggacctg

SEQ ID NO: 754664 - DNA, 20 bp, Homo sapiens
gcgataaaactaaatatatg

SEQ ID NO: 754665 - DNA, 17 bp, Homo sapiens
gcgatccacctgtctca

SEQ ID NO: 754666 - DNA, 15 bp, Homo sapiens
gcgatcccacacagg

SEQ ID NO: 754667 - DNA, 20 bp, Homo sapiens
gcgatctcggctcagcctcc

SEQ ID NO: 754668 - DNA, 14 bp, Homo sapiens
gcgatggcaggcct

SEQ ID NO: 754669 - DNA, 15 bp, Homo sapiens
gcgatggtctcagaa

SEQ ID NO: 754670 - DNA, 17 bp, Homo sapiens
gcgattctcctgcctca

SEQ ID NO: 754671 - DNA, 15 bp, Homo sapiens
gcgatttttgtatgt

SEQ ID NO: 754672 - DNA, 17 bp, Homo sapiens
gcgcaaaggtgcctcat

SEQ ID NO: 754673 - DNA, 22 bp, Homo sapiens
gcgcaagcctgtaatcccagct

SEQ ID NO: 754674 - DNA, 18 bp, Homo sapiens
gcgcacaaggctgaccaa

SEQ ID NO: 754675 - DNA, 22 bp, Homo sapiens
gcgcacacgcacgcacacacac

SEQ ID NO: 754676 - DNA, 19 bp, Homo sapiens
gcgcacagagggaagccat

SEQ ID NO: 754677 - DNA, 16 bp, Homo sapiens
gcgcacccagagaaaa

SEQ ID NO: 754678 - DNA, 21 bp, Homo sapiens
gcgcacgcgcgagtgtgctgt

SEQ ID NO: 754679 - DNA, 16 bp, Homo sapiens
gcgcagatctgtgcct

SEQ ID NO: 754680 - DNA, 23 bp, Homo sapiens
gcgggaggcaccagctctgtggc

SEQ ID NO: 754681 - DNA, 13 bp, Homo sapiens
gcgggaggctggg

SEQ ID NO: 754682 - DNA, 16 bp, Homo sapiens
gcgggaggctggggcc

SEQ ID NO: 754683 - DNA, 18 bp, Homo sapiens
gcgggatcctccacagag

SEQ ID NO: 754684 - DNA, 19 bp, Homo sapiens
gcgggatcctccacagaga

SEQ ID NO: 754685 - DNA, 21 bp, Homo sapiens
gcgggatcctccacagagagg

SEQ ID NO: 754686 - DNA, 15 bp, Homo sapiens
gcgggcacaataaat

SEQ ID NO: 754687 - DNA, 12 bp, Homo sapiens
gcgggcacagcc

SEQ ID NO: 754688 - DNA, 15 bp, Homo sapiens
gcgggcagagggctg

SEQ ID NO: 754689 - DNA, 13 bp, Homo sapiens
gcgggcagccagg

SEQ ID NO: 754690 - DNA, 22 bp, Homo sapiens
gcgggcagggccgctcgatgcc

SEQ ID NO: 754691 - DNA, 16 bp, Homo sapiens
gcgggccagccaggcg

SEQ ID NO: 754692 - DNA, 11 bp, Homo sapiens
gcgggccaggc

SEQ ID NO: 754693 - DNA, 15 bp, Homo sapiens
gcgggccagggtcct

SEQ ID NO: 754694 - DNA, 13 bp, Homo sapiens
gcgggccagggtg

SEQ ID NO: 754695 - DNA, 17 bp, Homo sapiens
gcgggccggggcaggga

SEQ ID NO: 754696 - DNA, 18 bp, Homo sapiens
gcgggcctggacaaggtc

SEQ ID NO: 754697 - DNA, 19 bp, Homo sapiens
gcgggcctggacaaggtct

SEQ ID NO: 754698 - DNA, 15 bp, Homo sapiens
gcgggcgcgtgagtg

SEQ ID NO: 754699 - DNA, 14 bp, Homo sapiens
gcgggcgctgctgg

SEQ ID NO: 754700 - DNA, 12 bp, Homo sapiens
gcgggctcagag

SEQ ID NO: 754701 - DNA, 14 bp, Homo sapiens
gcgggctcagagct

SEQ ID NO: 754702 - DNA, 13 bp, Homo sapiens
gcgggctccctcc

SEQ ID NO: 754703 - DNA, 17 bp, Homo sapiens
gcgggctgactgggcca

SEQ ID NO: 754704 - DNA, 19 bp, Homo sapiens
gcgggctgggggtagcctg

SEQ ID NO: 754705 - DNA, 21 bp, Homo sapiens
gcgggctgggggtagcctgga

SEQ ID NO: 754706 - DNA, 22 bp, Homo sapiens
gcggggaggaggaacgggcagc

SEQ ID NO: 754707 - DNA, 16 bp, Homo sapiens
gcggggcagtatgtga

SEQ ID NO: 754708 - DNA, 15 bp, Homo sapiens
gcgggggcgtggctg

SEQ ID NO: 754709 - DNA, 20 bp, Homo sapiens
gcgggggtgtgtctgtaggt

SEQ ID NO: 754710 - DNA, 24 bp, Homo sapiens
gcgggtagatgatttctagcaggc

SEQ ID NO: 754711 - DNA, 17 bp, Homo sapiens
gcgggtcctcagctgct

SEQ ID NO: 754712 - DNA, 20 bp, Homo sapiens
gcgggtcctcagctgctccc

SEQ ID NO: 754713 - DNA, 22 bp, Homo sapiens
gcgggtcctcagctgctcccac

SEQ ID NO: 754714 - DNA, 14 bp, Homo sapiens
gcgggtctgaagga

SEQ ID NO: 754715 - DNA, 21 bp, Homo sapiens
gcgggtgaacaaagcagccac

SEQ ID NO: 754716 - DNA, 20 bp, Homo sapiens
gcgggtgatggccagcccct

SEQ ID NO: 754717 - DNA, 14 bp, Homo sapiens
gcgggtgcaccatg

SEQ ID NO: 754718 - DNA, 19 bp, Homo sapiens
gcgggtggatcacaaggtc

SEQ ID NO: 754719 - DNA, 13 bp, Homo sapiens
gcgggttctagac

SEQ ID NO: 754720 - DNA, 11 bp, Homo sapiens
gcggtacccca

SEQ ID NO: 754721 - DNA, 14 bp, Homo sapiens
gcggtcacagcatg

SEQ ID NO: 754722 - DNA, 15 bp, Homo sapiens
gcggtcatgtgtgca

SEQ ID NO: 754723 - DNA, 22 bp, Homo sapiens
gcggtcatgtgtgcatgtgagc

SEQ ID NO: 754724 - DNA, 18 bp, Homo sapiens
gcggtcccagctccctgg

SEQ ID NO: 754725 - DNA, 22 bp, Homo sapiens
gcggtcccagctccctggctcc

SEQ ID NO: 754726 - DNA, 14 bp, Homo sapiens
gcggtgaccagcct

SEQ ID NO: 754727 - DNA, 14 bp, Homo sapiens
gcggtgcctaagaa

SEQ ID NO: 754728 - DNA, 18 bp, Homo sapiens
gcggtgctgtcctcaggt

SEQ ID NO: 754729 - DNA, 18 bp, Homo sapiens
gcggtggctcacgcctgt

SEQ ID NO: 754730 - DNA, 23 bp, Homo sapiens
gcggtgtcaggtcccagcgagcc

SEQ ID NO: 754731 - DNA, 24 bp, Homo sapiens
gcggtgtcaggtcccagcgagcca

SEQ ID NO: 754732 - DNA, 21 bp, Homo sapiens
gcggtgtgtcctctgtgccca

SEQ ID NO: 754733 - DNA, 22 bp, Homo sapiens
gcggtgtgtcctctgtgcccac

SEQ ID NO: 754734 - DNA, 19 bp, Homo sapiens
gcggttataaaaaatggtt

SEQ ID NO: 754735 - DNA, 22 bp, Homo sapiens
gcggttataaaaaatggttcag

SEQ ID NO: 754736 - DNA, 12 bp, Homo sapiens
gcggttcaggaa

SEQ ID NO: 754737 - DNA, 20 bp, Homo sapiens
gcggttcctgtgcagatgct

SEQ ID NO: 754738 - DNA, 20 bp, Homo sapiens
gcggtttactcactgctgca

SEQ ID NO: 754739 - DNA, 17 bp, Homo sapiens
gcgtaatgggcctgccc

SEQ ID NO: 754740 - DNA, 12 bp, Homo sapiens
gcgtacacagag

SEQ ID NO: 754741 - DNA, 13 bp, Homo sapiens
gcgtacacagaga

SEQ ID NO: 754742 - DNA, 14 bp, Homo sapiens
gcgtagagagccgg

SEQ ID NO: 754743 - DNA, 20 bp, Homo sapiens
gcgtatatgtgcgtctctct

SEQ ID NO: 754744 - DNA, 14 bp, Homo sapiens
gcgtattctgtggc

SEQ ID NO: 754745 - DNA, 22 bp, Homo sapiens
gcgtcactgcccaccaaaggtc

SEQ ID NO: 754746 - DNA, 16 bp, Homo sapiens
gcgtcaggcagaggca

SEQ ID NO: 754747 - DNA, 19 bp, Homo sapiens
gcgtcaggggtgcacagtc

SEQ ID NO: 754748 - DNA, 20 bp, Homo sapiens
gcgtcagtttcactccctct

SEQ ID NO: 754749 - DNA, 17 bp, Homo sapiens
gcgtccagctcagccct

SEQ ID NO: 754750 - DNA, 20 bp, Homo sapiens
gcgtccagctcagccctggc

SEQ ID NO: 754751 - DNA, 24 bp, Homo sapiens
gcgtccagctcagccctggcctgg

SEQ ID NO: 754752 - DNA, 14 bp, Homo sapiens
gcgtccccctgccg

SEQ ID NO: 754753 - DNA, 11 bp, Homo sapiens
gcgtccctggc

SEQ ID NO: 754754 - DNA, 18 bp, Homo sapiens
gcgtccctggcgcaggtg

SEQ ID NO: 754755 - DNA, 19 bp, Homo sapiens
gcgtccgcgcgccagcaca

SEQ ID NO: 754756 - DNA, 20 bp, Homo sapiens
gcgtcctcctcacctcatgc

SEQ ID NO: 754757 - DNA, 14 bp, Homo sapiens
gcgtcctcctctgt

SEQ ID NO: 754758 - DNA, 17 bp, Homo sapiens
gcgtcctgacgccctgc

SEQ ID NO: 754759 - DNA, 13 bp, Homo sapiens
gcgtcctgaggaa

SEQ ID NO: 754760 - DNA, 20 bp, Homo sapiens
gcgtcctgcagaggaccaca

SEQ ID NO: 754761 - DNA, 21 bp, Homo sapiens
gcgtcctgccctgccccctcg

SEQ ID NO: 754762 - DNA, 21 bp, Homo sapiens
gcgtcctgtccacacccagct

SEQ ID NO: 754763 - DNA, 23 bp, Homo sapiens
gcgtcgccccagtggcactgaag

SEQ ID NO: 754764 - DNA, 23 bp, Homo sapiens
gcgtcgggcgtgggtctctgggg

SEQ ID NO: 754765 - DNA, 13 bp, Homo sapiens
gcgtctcccatcc

SEQ ID NO: 754766 - DNA, 14 bp, Homo sapiens
gcgtctcccatcct

SEQ ID NO: 754767 - DNA, 12 bp, Homo sapiens
gcgtctccccca

SEQ ID NO: 754768 - DNA, 15 bp, Homo sapiens
gcgtctcccccagag

SEQ ID NO: 754769 - DNA, 17 bp, Homo sapiens
gcgtctcccccagagtg

SEQ ID NO: 754770 - DNA, 21 bp, Homo sapiens
gcgtctcccccagagtgctgt

SEQ ID NO: 754771 - DNA, 21 bp, Homo sapiens
gcgtctctctttctccctcac

SEQ ID NO: 754772 - DNA, 22 bp, Homo sapiens
gcgtctgactccctccccaccc

SEQ ID NO: 754773 - DNA, 12 bp, Homo sapiens
gcgtctgcaggg

SEQ ID NO: 754774 - DNA, 16 bp, Homo sapiens
gcgtctgcagggtgac

SEQ ID NO: 754775 - DNA, 15 bp, Homo sapiens
gcgtctgccccaccc

SEQ ID NO: 754776 - DNA, 13 bp, Homo sapiens
gcgtctgcctggg

SEQ ID NO: 754777 - DNA, 16 bp, Homo sapiens
gcgtctgcgcggatgt

SEQ ID NO: 754778 - DNA, 21 bp, Homo sapiens
gcgtctggaagtccaatgtgg

SEQ ID NO: 754779 - DNA, 16 bp, Homo sapiens
gcgtcttcatctccct

SEQ ID NO: 754780 - DNA, 23 bp, Homo sapiens
gcgtcttcatctccctgccatcc

SEQ ID NO: 754781 - DNA, 18 bp, Homo sapiens
gcgtcttccgcccctgcc

SEQ ID NO: 754782 - DNA, 20 bp, Homo sapiens
gcgtcttccgcccctgcctg

SEQ ID NO: 754783 - DNA, 22 bp, Homo sapiens
gcgtcttccgcccctgcctgcc

SEQ ID NO: 754784 - DNA, 12 bp, Homo sapiens
gcgtcttcctga

SEQ ID NO: 754785 - DNA, 21 bp, Homo sapiens
gcgtcttcctgagtggtgcca

SEQ ID NO: 754786 - DNA, 18 bp, Homo sapiens
gcgtcttgcccagcagct

SEQ ID NO: 754787 - DNA, 18 bp, Homo sapiens
gcccattcgtctgtccca

SEQ ID NO: 754788 - DNA, 20 bp, Homo sapiens
gcccattcgtctgtcccaga

SEQ ID NO: 754789 - DNA, 21 bp, Homo sapiens
gcccattcgtctgtcccagag

SEQ ID NO: 754790 - DNA, 13 bp, Homo sapiens
gcccattcttctg

SEQ ID NO: 754791 - DNA, 18 bp, Homo sapiens
gcccattggagcacctgg

SEQ ID NO: 754792 - DNA, 20 bp, Homo sapiens
gcccattggccgagctcctg

SEQ ID NO: 754793 - DNA, 13 bp, Homo sapiens
gcccattgtcctc

SEQ ID NO: 754794 - DNA, 21 bp, Homo sapiens
gcccattgtcctccttttcac

SEQ ID NO: 754795 - DNA, 20 bp, Homo sapiens
gcccatttcaattctcaaaa

SEQ ID NO: 754796 - DNA, 19 bp, Homo sapiens
gcccatttcgaagatatac

SEQ ID NO: 754797 - DNA, 20 bp, Homo sapiens
gcccattttcaactgctttg

SEQ ID NO: 754798 - DNA, 14 bp, Homo sapiens
gcccatttttgcta

SEQ ID NO: 754799 - DNA, 21 bp, Homo sapiens
gccccaaaaccacagccctgt

SEQ ID NO: 754800 - DNA, 20 bp, Homo sapiens
gccccaaacgggctgccctg

SEQ ID NO: 754801 - DNA, 20 bp, Homo sapiens
gccccaaataacttcagtcc

SEQ ID NO: 754802 - DNA, 19 bp, Homo sapiens
gccccaactccaggggcac

SEQ ID NO: 754803 - DNA, 18 bp, Homo sapiens
gccccaactcctggaagc

SEQ ID NO: 754804 - DNA, 21 bp, Homo sapiens
gccccaactctcccctgacct

SEQ ID NO: 754805 - DNA, 22 bp, Homo sapiens
gccccaagaggggcgggctcag

SEQ ID NO: 754806 - DNA, 17 bp, Homo sapiens
gccccaagcagccagcc

SEQ ID NO: 754807 - DNA, 21 bp, Homo sapiens
gccccaagcagccagccagtc

SEQ ID NO: 754808 - DNA, 13 bp, Homo sapiens
gccccaagctggg

SEQ ID NO: 754809 - DNA, 14 bp, Homo sapiens
gccccaagtcctca

SEQ ID NO: 754810 - DNA, 18 bp, Homo sapiens
gccccaatccctttatta

SEQ ID NO: 754811 - DNA, 15 bp, Homo sapiens
gccccaatcttgccc

SEQ ID NO: 754812 - DNA, 11 bp, Homo sapiens
gccccacagct

SEQ ID NO: 754813 - DNA, 23 bp, Homo sapiens
gccccacaggagttgtgagccct

SEQ ID NO: 754814 - DNA, 21 bp, Homo sapiens
gccccacatgtggccatggcc

SEQ ID NO: 754815 - DNA, 12 bp, Homo sapiens
gccccacccagg

SEQ ID NO: 754816 - DNA, 20 bp, Homo sapiens
gccccaccccatccagccag

SEQ ID NO: 754817 - DNA, 17 bp, Homo sapiens
gccccacccccagccag

SEQ ID NO: 754818 - DNA, 19 bp, Homo sapiens
gccccaccccctgggcaga

SEQ ID NO: 754819 - DNA, 16 bp, Homo sapiens
gccccaccctgggccc

SEQ ID NO: 754820 - DNA, 19 bp, Homo sapiens
gccccaccctgggccctgg

SEQ ID NO: 754821 - DNA, 20 bp, Homo sapiens
gccccaccctgggccctggg

SEQ ID NO: 754822 - DNA, 15 bp, Homo sapiens
gccccacctcccatt

SEQ ID NO: 754823 - DNA, 19 bp, Homo sapiens
gccccacctcccatttctg

SEQ ID NO: 754824 - DNA, 16 bp, Homo sapiens
gccccacctcccgccc

SEQ ID NO: 754825 - DNA, 14 bp, Homo sapiens
gccccacctgagcc

SEQ ID NO: 754826 - DNA, 15 bp, Homo sapiens
gccccacctgccgca

SEQ ID NO: 754827 - DNA, 18 bp, Homo sapiens
gccccaccttgccagggc

SEQ ID NO: 754828 - DNA, 20 bp, Homo sapiens
gccccacctttattaaaatc

SEQ ID NO: 754829 - DNA, 19 bp, Homo sapiens
gccccactcctctccacca

SEQ ID NO: 754830 - DNA, 16 bp, Homo sapiens
gccccactgccagcag

SEQ ID NO: 754831 - DNA, 17 bp, Homo sapiens
gccccactgccagcagc

SEQ ID NO: 754832 - DNA, 23 bp, Homo sapiens
gccccactgccagcagcagcagg

SEQ ID NO: 754833 - DNA, 13 bp, Homo sapiens
cctgctggggatc

SEQ ID NO: 754834 - DNA, 23 bp, Homo sapiens
cctgctggggatccccgcctggc

SEQ ID NO: 754835 - DNA, 23 bp, Homo sapiens
cctgctggggctgaacatgcctg

SEQ ID NO: 754836 - DNA, 16 bp, Homo sapiens
cctgctgtctctctgg

SEQ ID NO: 754837 - DNA, 23 bp, Homo sapiens
cctgctgtgattccactacacct

SEQ ID NO: 754838 - DNA, 20 bp, Homo sapiens
cctgctgtgccatgctgggc

SEQ ID NO: 754839 - DNA, 22 bp, Homo sapiens
cctgctgtgccatgctgggcca

SEQ ID NO: 754840 - DNA, 17 bp, Homo sapiens
cctgctgtgctgctcaa

SEQ ID NO: 754841 - DNA, 13 bp, Homo sapiens
cctgctgtgggag

SEQ ID NO: 754842 - DNA, 13 bp, Homo sapiens
cctgctgtgtcct

SEQ ID NO: 754843 - DNA, 17 bp, Homo sapiens
cctgctgtgtccttcct

SEQ ID NO: 754844 - DNA, 20 bp, Homo sapiens
cctgctgtgttaagaggact

SEQ ID NO: 754845 - DNA, 22 bp, Homo sapiens
cctgctgttggtcctctctctg

SEQ ID NO: 754846 - DNA, 23 bp, Homo sapiens
cctgctgttggtcctctctctgt

SEQ ID NO: 754847 - DNA, 14 bp, Homo sapiens
cctgcttcatgctc

SEQ ID NO: 754848 - DNA, 16 bp, Homo sapiens
cctgcttcatgctcag

SEQ ID NO: 754849 - DNA, 14 bp, Homo sapiens
cctgcttccaggaa

SEQ ID NO: 754850 - DNA, 22 bp, Homo sapiens
cctgcttccaggaaactccaca

SEQ ID NO: 754851 - DNA, 14 bp, Homo sapiens
cctgcttcccctcc

SEQ ID NO: 754852 - DNA, 15 bp, Homo sapiens
cctgcttcccctccc

SEQ ID NO: 754853 - DNA, 21 bp, Homo sapiens
cctgcttcccctccctaccct

SEQ ID NO: 754854 - DNA, 15 bp, Homo sapiens
cctgcttcctggctc

SEQ ID NO: 754855 - DNA, 16 bp, Homo sapiens
cctgcttcctggctca

SEQ ID NO: 754856 - DNA, 16 bp, Homo sapiens
cctgcttcctgttacc

SEQ ID NO: 754857 - DNA, 17 bp, Homo sapiens
cctgcttctcccgggga

SEQ ID NO: 754858 - DNA, 21 bp, Homo sapiens
cctgcttctctcagccagctg

SEQ ID NO: 754859 - DNA, 23 bp, Homo sapiens
cctgcttctctcagccagctgtt

SEQ ID NO: 754860 - DNA, 23 bp, Homo sapiens
cctgcttcttcccctctgcggct

SEQ ID NO: 754861 - DNA, 14 bp, Homo sapiens
cctgcttgcacact

SEQ ID NO: 754862 - DNA, 23 bp, Homo sapiens
cctgcttgcacacttccccatct

SEQ ID NO: 754863 - DNA, 21 bp, Homo sapiens
cctgcttgccaaggcagaggc

SEQ ID NO: 754864 - DNA, 20 bp, Homo sapiens
cctgcttgcccgctcccaca

SEQ ID NO: 754865 - DNA, 20 bp, Homo sapiens
cctgctttggcctttccttg

SEQ ID NO: 754866 - DNA, 22 bp, Homo sapiens
cctgctttggcctttccttgta

SEQ ID NO: 754867 - DNA, 19 bp, Homo sapiens
cctgctttgggctgccctg

SEQ ID NO: 754868 - DNA, 20 bp, Homo sapiens
cctgctttgggctgccctgg

SEQ ID NO: 754869 - DNA, 22 bp, Homo sapiens
cctgctttgggctgccctggtg

SEQ ID NO: 754870 - DNA, 12 bp, Homo sapiens
cctgcttttctg

SEQ ID NO: 754871 - DNA, 14 bp, Homo sapiens
cctgcttttctgtc

SEQ ID NO: 754872 - DNA, 15 bp, Homo sapiens
cctgcttttctgtcc

SEQ ID NO: 754873 - DNA, 20 bp, Homo sapiens
cctgcttttctgtcctgggc

SEQ ID NO: 754874 - DNA, 19 bp, Homo sapiens
cctgctttttttcttaaaa

SEQ ID NO: 754875 - DNA, 17 bp, Homo sapiens
cctggaaaaattccaga

SEQ ID NO: 754876 - DNA, 17 bp, Homo sapiens
cctggaaacagcatgaa

SEQ ID NO: 754877 - DNA, 22 bp, Homo sapiens
cctggaaacagcatgaataaaa

SEQ ID NO: 754878 - DNA, 22 bp, Homo sapiens
cctggaaaggctcagtctcagg

SEQ ID NO: 754879 - DNA, 14 bp, Homo sapiens
cctggaaaggggag

SEQ ID NO: 754880 - DNA, 22 bp, Homo sapiens
cctggaaatatcagttactcag

SEQ ID NO: 754881 - DNA, 22 bp, Homo sapiens
cctggaacaaatcgtttctcag

SEQ ID NO: 754882 - DNA, 20 bp, Homo sapiens
cctggaacaatattttatgg

SEQ ID NO: 754883 - DNA, 13 bp, Homo sapiens
cctggaaccaatc

SEQ ID NO: 754884 - DNA, 16 bp, Homo sapiens
cctggaaccagcaagt

SEQ ID NO: 754885 - DNA, 21 bp, Homo sapiens
cctggaaccagcaagtcccag

SEQ ID NO: 754886 - DNA, 14 bp, Homo sapiens
cctggaaccaggga

SEQ ID NO: 754887 - DNA, 22 bp, Homo sapiens
cctggaagacaacccaggcagt

SEQ ID NO: 754888 - DNA, 15 bp, Homo sapiens
cctggaagagcccag

SEQ ID NO: 754889 - DNA, 11 bp, Homo sapiens
cctggaagcag

SEQ ID NO: 754890 - DNA, 23 bp, Homo sapiens
cctggaagcatttgtttctactt

SEQ ID NO: 754891 - DNA, 15 bp, Homo sapiens
cctggaagccagctt

SEQ ID NO: 754892 - DNA, 13 bp, Homo sapiens
cctggaagctgtg

SEQ ID NO: 754893 - DNA, 23 bp, Homo sapiens
cctggaagctgtgtccttgcacc

SEQ ID NO: 754894 - DNA, 11 bp, Homo sapiens
cctggaagctt

SEQ ID NO: 754895 - DNA, 14 bp, Homo sapiens
cctggaaggacaca

SEQ ID NO: 754896 - DNA, 18 bp, Homo sapiens
cctggaaggacacagtga

SEQ ID NO: 754897 - DNA, 23 bp, Homo sapiens
cctggaataaaatataaaactga

SEQ ID NO: 754898 - DNA, 21 bp, Homo sapiens
cctggaattcagcaccctggg

SEQ ID NO: 754899 - DNA, 22 bp, Homo sapiens
cctggacaaggctaacatccca

SEQ ID NO: 754900 - DNA, 9 bp, Homo sapiens
cctggacac

SEQ ID NO: 754901 - DNA, 17 bp, Homo sapiens
cctggacacacactcac

SEQ ID NO: 754902 - DNA, 12 bp, Homo sapiens
cctggacacact

SEQ ID NO: 754903 - DNA, 17 bp, Homo sapiens
cctggacacccctgctc

SEQ ID NO: 754904 - DNA, 18 bp, Homo sapiens
cctggacacccctgctct

SEQ ID NO: 754905 - DNA, 16 bp, Homo sapiens
cctggacacctcccag

SEQ ID NO: 754906 - DNA, 23 bp, Homo sapiens
cctggacacctcccaggggactg

SEQ ID NO: 754907 - DNA, 16 bp, Homo sapiens
cctggacactcagacc

SEQ ID NO: 754908 - DNA, 13 bp, Homo sapiens
cctggacagatgg

SEQ ID NO: 754909 - DNA, 19 bp, Homo sapiens
cctggacagatggcccaag

SEQ ID NO: 754910 - DNA, 19 bp, Homo sapiens
cctggacagtatcccacat

SEQ ID NO: 754911 - DNA, 20 bp, Homo sapiens
cctggacatcctcttctgct

SEQ ID NO: 754912 - DNA, 21 bp, Homo sapiens
cctggacatgaagattctttc

SEQ ID NO: 754913 - DNA, 19 bp, Homo sapiens
cctggacattttttcagtc

SEQ ID NO: 754914 - DNA, 12 bp, Homo sapiens
cctggaccaaag

SEQ ID NO: 754915 - DNA, 19 bp, Homo sapiens
cctggaccaaagggaagtg

SEQ ID NO: 754916 - DNA, 20 bp, Homo sapiens
cctggaccaaagggaagtga

SEQ ID NO: 754917 - DNA, 19 bp, Homo sapiens
cctggaccattcctgtccc

SEQ ID NO: 754918 - DNA, 15 bp, Homo sapiens
cctggacccctggac

SEQ ID NO: 754919 - DNA, 22 bp, Homo sapiens
cctggacccctggggtggccag

SEQ ID NO: 754920 - DNA, 20 bp, Homo sapiens
cctggacctgagtcggcccc

SEQ ID NO: 754921 - DNA, 14 bp, Homo sapiens
cctggacctgcctc

SEQ ID NO: 754922 - DNA, 20 bp, Homo sapiens
cctggacctgcctcctgcct

SEQ ID NO: 754923 - DNA, 23 bp, Homo sapiens
cctggacctgcctcctgcctgcc

SEQ ID NO: 754924 - DNA, 14 bp, Homo sapiens
cctggacctggaac

SEQ ID NO: 754925 - DNA, 15 bp, Homo sapiens
cctggaccttgacag

SEQ ID NO: 754926 - DNA, 21 bp, Homo sapiens
cctggaccttgacagagcagc

SEQ ID NO: 754927 - DNA, 14 bp, Homo sapiens
cctggaccttgggc

SEQ ID NO: 754928 - DNA, 20 bp, Homo sapiens
cctggaccttttgttttctg

SEQ ID NO: 754929 - DNA, 18 bp, Homo sapiens
cctggactccggaggact

SEQ ID NO: 754930 - DNA, 20 bp, Homo sapiens
cctggactccggaggactga

SEQ ID NO: 754931 - DNA, 22 bp, Homo sapiens
cctggactccggaggactgagc

SEQ ID NO: 754932 - DNA, 23 bp, Homo sapiens
cctggactccggaggactgagcc

SEQ ID NO: 754933 - DNA, 23 bp, Homo sapiens
cctggactgagccaaggaggcct

SEQ ID NO: 754934 - DNA, 13 bp, Homo sapiens
cctggactttcct

SEQ ID NO: 754935 - DNA, 12 bp, Homo sapiens
cctggagaacta

SEQ ID NO: 754936 - DNA, 19 bp, Homo sapiens
cctggagaagaatggcttt

SEQ ID NO: 754937 - DNA, 22 bp, Homo sapiens
cctggagacgtggaacctctgt

SEQ ID NO: 754938 - DNA, 21 bp, Homo sapiens
cctggagaggacggccctgcc

SEQ ID NO: 754939 - DNA, 24 bp, Homo sapiens
cctggagaggacggccctgcctgc

SEQ ID NO: 754940 - DNA, 17 bp, Homo sapiens
cctggagatagctgggg

SEQ ID NO: 754941 - DNA, 18 bp, Homo sapiens
cctggagatcctcctgca

SEQ ID NO: 754942 - DNA, 14 bp, Homo sapiens
cctggagcagaaag

SEQ ID NO: 754943 - DNA, 18 bp, Homo sapiens
cctggagcagaccacccc

SEQ ID NO: 754944 - DNA, 15 bp, Homo sapiens
cctggagcaggagcc

SEQ ID NO: 754945 - DNA, 17 bp, Homo sapiens
cctggagcaggagcccc

SEQ ID NO: 754946 - DNA, 18 bp, Homo sapiens
cctggagcaggagccccg

SEQ ID NO: 754947 - DNA, 16 bp, Homo sapiens
cctggagcatcccagg

SEQ ID NO: 754948 - DNA, 17 bp, Homo sapiens
cctggagacgtggaacc

SEQ ID NO: 754949 - DNA, 18 bp, Homo sapiens
cctggagactgcccagct

SEQ ID NO: 754950 - DNA, 14 bp, Homo sapiens
cctggagatagctg

SEQ ID NO: 754951 - DNA, 13 bp, Homo sapiens
cctggagatcctc

SEQ ID NO: 754952 - DNA, 16 bp, Homo sapiens
cctggagatcctcctg

SEQ ID NO: 754953 - DNA, 17 bp, Homo sapiens
cctggagatcctcctgc

SEQ ID NO: 754954 - DNA, 15 bp, Homo sapiens
cctggagatgcagct

SEQ ID NO: 754955 - DNA, 22 bp, Homo sapiens
cctggagatgcagctactggaa

SEQ ID NO: 754956 - DNA, 19 bp, Homo sapiens
cctggagcagaaagtgcct

SEQ ID NO: 754957 - DNA, 23 bp, Homo sapiens
cctggagcaggagccccgccaca

SEQ ID NO: 754958 - DNA, 12 bp, Homo sapiens
cctggagccaga

SEQ ID NO: 754959 - DNA, 14 bp, Homo sapiens
cctggagccagggc

SEQ ID NO: 754960 - DNA, 17 bp, Homo sapiens
cctggagccagggcaga

SEQ ID NO: 754961 - DNA, 14 bp, Homo sapiens
cctggagccatccc

SEQ ID NO: 754962 - DNA, 17 bp, Homo sapiens
cctggagcccacaacct

SEQ ID NO: 754963 - DNA, 21 bp, Homo sapiens
cctggagcccacaaccttcgg

SEQ ID NO: 754964 - DNA, 12 bp, Homo sapiens
cctggagcccct

SEQ ID NO: 754965 - DNA, 16 bp, Homo sapiens
cctggagcccctgggt

SEQ ID NO: 754966 - DNA, 22 bp, Homo sapiens
cctggagcccctgggtgggtgg

SEQ ID NO: 754967 - DNA, 21 bp, Homo sapiens
cctggagcccgcttcaagctc

SEQ ID NO: 754968 - DNA, 13 bp, Homo sapiens
cctggagccctgt

SEQ ID NO: 754969 - DNA, 21 bp, Homo sapiens
cctggagcgtttgctgtgcca

SEQ ID NO: 754970 - DNA, 22 bp, Homo sapiens
cctggagcgtttgctgtgccag

SEQ ID NO: 754971 - DNA, 15 bp, Homo sapiens
cctggagctctgtgg

SEQ ID NO: 754972 - DNA, 16 bp, Homo sapiens
cctggaggatttcatc

SEQ ID NO: 754973 - DNA, 17 bp, Homo sapiens
cctggaggcaagaggga

SEQ ID NO: 754974 - DNA, 22 bp, Homo sapiens
cctggaggcaagagggagggga

SEQ ID NO: 754975 - DNA, 18 bp, Homo sapiens
cctggaggcaggggctgc

SEQ ID NO: 754976 - DNA, 15 bp, Homo sapiens
cctggaggctgacac

SEQ ID NO: 754977 - DNA, 16 bp, Homo sapiens
cctggaggctgacaca

SEQ ID NO: 754978 - DNA, 22 bp, Homo sapiens
cctggaggctgacacagaggct

SEQ ID NO: 754979 - DNA, 16 bp, Homo sapiens
cctggaggctggggat

SEQ ID NO: 754980 - DNA, 22 bp, Homo sapiens
cctggagggaagagtggaggtg

SEQ ID NO: 754981 - DNA, 23 bp, Homo sapiens
cctggagggatgcccccaggcag

SEQ ID NO: 754982 - DNA, 17 bp, Homo sapiens
cctggagggcacttcct

SEQ ID NO: 754983 - DNA, 18 bp, Homo sapiens
cctggagggcacttcctc

SEQ ID NO: 754984 - DNA, 14 bp, Homo sapiens
cctggaggtggctg

SEQ ID NO: 754985 - DNA, 14 bp, Homo sapiens
cctggaggtgggca

SEQ ID NO: 754986 - DNA, 20 bp, Homo sapiens
cctggaggtggggttgggat

SEQ ID NO: 754987 - DNA, 12 bp, Homo sapiens
cctggagtgccc

SEQ ID NO: 754988 - DNA, 16 bp, Homo sapiens
cctggagtgccctgca

SEQ ID NO: 754989 - DNA, 18 bp, Homo sapiens
cctggagtgccctgcagg

SEQ ID NO: 754990 - DNA, 23 bp, Homo sapiens
cctggagtgccctgcaggcacag

SEQ ID NO: 754991 - DNA, 22 bp, Homo sapiens
cctggagtgtcggatcctgtga

SEQ ID NO: 754992 - DNA, 23 bp, Homo sapiens
cctggagtgtcggatcctgtgag

SEQ ID NO: 754993 - DNA, 20 bp, Homo sapiens
cctggagtgtgtcagagccc

SEQ ID NO: 754994 - DNA, 22 bp, Homo sapiens
cctggagtgtgtcagagcccag

SEQ ID NO: 754995 - DNA, 23 bp, Homo sapiens
cctggagtgtgtcagagcccagg

SEQ ID NO: 754996 - DNA, 18 bp, Homo sapiens
cctggatattattcttgt

SEQ ID NO: 754997 - DNA, 21 bp, Homo sapiens
cctggatcacgacgctgcaga

SEQ ID NO: 754998 - DNA, 22 bp, Homo sapiens
cctggatcacgacgctgcagag

SEQ ID NO: 754999 - DNA, 17 bp, Homo sapiens
cctggatccagcactgg

SEQ ID NO: 755000 - DNA, 22 bp, Homo sapiens
cctggatctaccagcataaata

SEQ ID NO: 755001 - DNA, 19 bp, Homo sapiens
cctggatctacctggaggg

SEQ ID NO: 755002 - DNA, 20 bp, Homo sapiens
cctggatctatccctgcggc

SEQ ID NO: 755003 - DNA, 14 bp, Homo sapiens
cctggatgatacta

SEQ ID NO: 755004 - DNA, 22 bp, Homo sapiens
cctggatgatttcatcttctgg

SEQ ID NO: 755005 - DNA, 13 bp, Homo sapiens
cctggatggcccc

SEQ ID NO: 755006 - DNA, 16 bp, Homo sapiens
cctggatgggcattgg

SEQ ID NO: 755007 - DNA, 20 bp, Homo sapiens
cctggatgggcattgggctg

SEQ ID NO: 755008 - DNA, 21 bp, Homo sapiens
cctggatgtgaagctcacact

SEQ ID NO: 755009 - DNA, 20 bp, Homo sapiens
cctggatgtgtggggcatgg

SEQ ID NO: 755010 - DNA, 21 bp, Homo sapiens
cctggatgtgtggggcatggt

SEQ ID NO: 755011 - DNA, 14 bp, Homo sapiens
cctggatgttgctg

SEQ ID NO: 755012 - DNA, 23 bp, Homo sapiens
cctggattcatttcctgcccttc

SEQ ID NO: 755013 - DNA, 21 bp, Homo sapiens
gcagctctccagtcaggaggc

SEQ ID NO: 755014 - DNA, 12 bp, Homo sapiens
gcagctctcccc

SEQ ID NO: 755015 - DNA, 13 bp, Homo sapiens
gcagctcttctgg

SEQ ID NO: 755016 - DNA, 22 bp, Homo sapiens
gcagctcttctggagtttctct

SEQ ID NO: 755017 - DNA, 22 bp, Homo sapiens
gcagctcttctgggcagagcct

SEQ ID NO: 755018 - DNA, 14 bp, Homo sapiens
gcagctcttgccct

SEQ ID NO: 755019 - DNA, 18 bp, Homo sapiens
gcagctcttgcccttccc

SEQ ID NO: 755020 - DNA, 20 bp, Homo sapiens
gcagctcttgcccttccctg

SEQ ID NO: 755021 - DNA, 17 bp, Homo sapiens
gcagctgaagaaaaaat

SEQ ID NO: 755022 - DNA, 14 bp, Homo sapiens
gcagctgacctctg

SEQ ID NO: 755023 - DNA, 23 bp, Homo sapiens
gcagctgacttggttctgaagcc

SEQ ID NO: 755024 - DNA, 14 bp, Homo sapiens
gcagctgagaccag

SEQ ID NO: 755025 - DNA, 16 bp, Homo sapiens
gcagctgatccatagg

SEQ ID NO: 755026 - DNA, 14 bp, Homo sapiens
gcagctgattttaa

SEQ ID NO: 755027 - DNA, 17 bp, Homo sapiens
gcagctgattttaacaa

SEQ ID NO: 755028 - DNA, 14 bp, Homo sapiens
gcagctgccagaga

SEQ ID NO: 755029 - DNA, 12 bp, Homo sapiens
gcagctgcccct

SEQ ID NO: 755030 - DNA, 17 bp, Homo sapiens
gcagctgcccctcctgg

SEQ ID NO: 755031 - DNA, 24 bp, Homo sapiens
gcagctgcccctcctggagcagaa

SEQ ID NO: 755032 - DNA, 11 bp, Homo sapiens
gcagctgcctc

SEQ ID NO: 755033 - DNA, 17 bp, Homo sapiens
gcagctgcctctgctcc

SEQ ID NO: 755034 - DNA, 15 bp, Homo sapiens
gcagctgcctggcca

SEQ ID NO: 755035 - DNA, 17 bp, Homo sapiens
gcagctgcctggggccc

SEQ ID NO: 755036 - DNA, 11 bp, Homo sapiens
gcagctgctct

SEQ ID NO: 755037 - DNA, 13 bp, Homo sapiens
gcagctgctctta

SEQ ID NO: 755038 - DNA, 18 bp, Homo sapiens
gcagctgctcttagtgcc

SEQ ID NO: 755039 - DNA, 22 bp, Homo sapiens
gcagctgctgaagttctgagcc

SEQ ID NO: 755040 - DNA, 13 bp, Homo sapiens
gcagctgctgtgg

SEQ ID NO: 755041 - DNA, 23 bp, Homo sapiens
gcagctggacagaggggactctg

SEQ ID NO: 755042 - DNA, 15 bp, Homo sapiens
gcagctggactaccc

SEQ ID NO: 755043 - DNA, 16 bp, Homo sapiens
gcagctggactctgca

SEQ ID NO: 755044 - DNA, 18 bp, Homo sapiens
gcagctggcccccagccc

SEQ ID NO: 755045 - DNA, 12 bp, Homo sapiens
gcagctggccta

SEQ ID NO: 755046 - DNA, 16 bp, Homo sapiens
gcagctgggacccctc

SEQ ID NO: 755047 - DNA, 13 bp, Homo sapiens
gcagctgggcccc

SEQ ID NO: 755048 - DNA, 14 bp, Homo sapiens
gcagctgggcccca

SEQ ID NO: 755049 - DNA, 17 bp, Homo sapiens
gcagctgggccccacct

SEQ ID NO: 755050 - DNA, 16 bp, Homo sapiens
gcagctgggccccatg

SEQ ID NO: 755051 - DNA, 18 bp, Homo sapiens
gcagctgggccccatgct

SEQ ID NO: 755052 - DNA, 21 bp, Homo sapiens
gcagctgggcttggcctggag

SEQ ID NO: 755053 - DNA, 17 bp, Homo sapiens
gcagctggtcttttctc

SEQ ID NO: 755054 - DNA, 21 bp, Homo sapiens
gcagctgtcccctctccctgg

SEQ ID NO: 755055 - DNA, 23 bp, Homo sapiens
gcagctgtgagtgcgtgtgtgtg

SEQ ID NO: 755056 - DNA, 15 bp, Homo sapiens
gcagctgttgagaaa

SEQ ID NO: 755057 - DNA, 15 bp, Homo sapiens
gcagctgtttctcat

SEQ ID NO: 755058 - DNA, 18 bp, Homo sapiens
gcagctgttttcaaagcc

SEQ ID NO: 755059 - DNA, 18 bp, Homo sapiens
gcagcttcggtgtgcaga

SEQ ID NO: 755060 - DNA, 15 bp, Homo sapiens
gcagcttctagacag

SEQ ID NO: 755061 - DNA, 16 bp, Homo sapiens
gcagcttcttgggctg

SEQ ID NO: 755062 - DNA, 17 bp, Homo sapiens
gcagcttcttgggctga

SEQ ID NO: 755063 - DNA, 12 bp, Homo sapiens
gcagcttgcccc

SEQ ID NO: 755064 - DNA, 13 bp, Homo sapiens
gcagcttgccccg

SEQ ID NO: 755065 - DNA, 22 bp, Homo sapiens
gcagctttaaactcagggacag

SEQ ID NO: 755066 - DNA, 16 bp, Homo sapiens
gcagctttttctgtgg

SEQ ID NO: 755067 - DNA, 20 bp, Homo sapiens
gcaggaaacatttctgacac

SEQ ID NO: 755068 - DNA, 21 bp, Homo sapiens
gcaggaaatgaaaatgtcttg

SEQ ID NO: 755069 - DNA, 23 bp, Homo sapiens
gcaggaaatgaaaatgtcttgtg

SEQ ID NO: 755070 - DNA, 21 bp, Homo sapiens
gcccacccccaccatgcagcc

SEQ ID NO: 755071 - DNA, 20 bp, Homo sapiens
gcccacccccagtctccagg

SEQ ID NO: 755072 - DNA, 15 bp, Homo sapiens
gcccacccccctcat

SEQ ID NO: 755073 - DNA, 22 bp, Homo sapiens
gcccacccccgggatcctgccc

SEQ ID NO: 755074 - DNA, 22 bp, Homo sapiens
gcccaccccctcaagccaatcc

SEQ ID NO: 755075 - DNA, 16 bp, Homo sapiens
gcccaccccctgccct

SEQ ID NO: 755076 - DNA, 18 bp, Homo sapiens
gcccaccccctgccctgc

SEQ ID NO: 755077 - DNA, 22 bp, Homo sapiens
gcccaccccctgccctgcacgt

SEQ ID NO: 755078 - DNA, 18 bp, Homo sapiens
gcccacccctcactcccc

SEQ ID NO: 755079 - DNA, 19 bp, Homo sapiens
gcccacccctcactcccca

SEQ ID NO: 755080 - DNA, 19 bp, Homo sapiens
gcccacccgagtacctcca

SEQ ID NO: 755081 - DNA, 23 bp, Homo sapiens
gcccacccgagtacctccagtca

SEQ ID NO: 755082 - DNA, 19 bp, Homo sapiens
gcccacccgtggagatggg

SEQ ID NO: 755083 - DNA, 19 bp, Homo sapiens
gcccaccctaccagctcct

SEQ ID NO: 755084 - DNA, 23 bp, Homo sapiens
gcccaccctaccagctcctccag

SEQ ID NO: 755085 - DNA, 19 bp, Homo sapiens
gcccaccctgctcctcctg

SEQ ID NO: 755086 - DNA, 23 bp, Homo sapiens
gcccaccctgctcctcctgccct

SEQ ID NO: 755087 - DNA, 18 bp, Homo sapiens
gcccaccgccctcctcca

SEQ ID NO: 755088 - DNA, 16 bp, Homo sapiens
gcccacctcgctcccc

SEQ ID NO: 755089 - DNA, 22 bp, Homo sapiens
gcccacctcgctcccctctgga

SEQ ID NO: 755090 - DNA, 23 bp, Homo sapiens
gcccacctcgctcccctctggaa

SEQ ID NO: 755091 - DNA, 18 bp, Homo sapiens
gcccacctctccctgcat

SEQ ID NO: 755092 - DNA, 22 bp, Homo sapiens
gcccacctctccctgcatcctg

SEQ ID NO: 755093 - DNA, 14 bp, Homo sapiens
gcccacctctcttt

SEQ ID NO: 755094 - DNA, 17 bp, Homo sapiens
gcccacctgaaagcctg

SEQ ID NO: 755095 - DNA, 13 bp, Homo sapiens
gcccacctgccca

SEQ ID NO: 755096 - DNA, 14 bp, Homo sapiens
gcccacctggccac

SEQ ID NO: 755097 - DNA, 17 bp, Homo sapiens
gcccacctggccacctg

SEQ ID NO: 755098 - DNA, 18 bp, Homo sapiens
gcccacctggccacctga

SEQ ID NO: 755099 - DNA, 19 bp, Homo sapiens
gcccacctggccacctgag

SEQ ID NO: 755100 - DNA, 20 bp, Homo sapiens
gcccacctggccacctgagg

SEQ ID NO: 755101 - DNA, 16 bp, Homo sapiens
gcccacctgggctggg

SEQ ID NO: 755102 - DNA, 20 bp, Homo sapiens
gcccacctggggtctctctc

SEQ ID NO: 755103 - DNA, 18 bp, Homo sapiens
gcccacgaggagcagcag

SEQ ID NO: 755104 - DNA, 23 bp, Homo sapiens
gcccacgagggtctcccctcctg

SEQ ID NO: 755105 - DNA, 16 bp, Homo sapiens
gcccacgatcccctcc

SEQ ID NO: 755106 - DNA, 21 bp, Homo sapiens
gcccacgcccgactagcaggc

SEQ ID NO: 755107 - DNA, 17 bp, Homo sapiens
gcccacgccggcctctg

SEQ ID NO: 755108 - DNA, 18 bp, Homo sapiens
gcccacggggatcacagc

SEQ ID NO: 755109 - DNA, 17 bp, Homo sapiens
gcccactagacccactg

SEQ ID NO: 755110 - DNA, 15 bp, Homo sapiens
gcccactagagggcc

SEQ ID NO: 755111 - DNA, 17 bp, Homo sapiens
gcccactagagggccca

SEQ ID NO: 755112 - DNA, 20 bp, Homo sapiens
gcccactccccagccccagc

SEQ ID NO: 755113 - DNA, 19 bp, Homo sapiens
gcccactgcccaccccctc

SEQ ID NO: 755114 - DNA, 23 bp, Homo sapiens
gcccactgcccaccccctcaagc

SEQ ID NO: 755115 - DNA, 15 bp, Homo sapiens
gcccactgcctcctg

SEQ ID NO: 755116 - DNA, 15 bp, Homo sapiens
gcccactgtcctggg

SEQ ID NO: 755117 - DNA, 17 bp, Homo sapiens
gcccactgtcctgggcg

SEQ ID NO: 755118 - DNA, 21 bp, Homo sapiens
gcccactgtcctgggcgccct

SEQ ID NO: 755119 - DNA, 20 bp, Homo sapiens
gcccactgtgcctcagagac

SEQ ID NO: 755120 - DNA, 22 bp, Homo sapiens
gcccactgtgcctcagagacca

SEQ ID NO: 755121 - DNA, 16 bp, Homo sapiens
gcccacttggggcctt

SEQ ID NO: 755122 - DNA, 18 bp, Homo sapiens
gcccagaaagcctctctc

SEQ ID NO: 755123 - DNA, 19 bp, Homo sapiens
gcccagaaagcctctctct

SEQ ID NO: 755124 - DNA, 19 bp, Homo sapiens
gcccagaaccacagatgtg

SEQ ID NO: 755125 - DNA, 15 bp, Homo sapiens
gcccagaactgcccc

SEQ ID NO: 755126 - DNA, 16 bp, Homo sapiens
gcccagaacttccctg

SEQ ID NO: 755127 - DNA, 20 bp, Homo sapiens
gcccagaataagttattgca

SEQ ID NO: 755128 - DNA, 18 bp, Homo sapiens
gcccagacccactctgcg

SEQ ID NO: 755129 - DNA, 17 bp, Homo sapiens
gcccagacccccagtgt

SEQ ID NO: 755130 - DNA, 16 bp, Homo sapiens
gcccagacccctctgg

SEQ ID NO: 755131 - DNA, 19 bp, Homo sapiens
gcccagacccctctggcca

SEQ ID NO: 755132 - DNA, 20 bp, Homo sapiens
gcccagacccctctggccag

SEQ ID NO: 755133 - DNA, 21 bp, Homo sapiens
gcccagacccctctggccagg

SEQ ID NO: 755134 - DNA, 17 bp, Homo sapiens
gcccagaccggcttctc

SEQ ID NO: 755135 - DNA, 11 bp, Homo sapiens
gcccagactct

SEQ ID NO: 755136 - DNA, 22 bp, Homo sapiens
gcccagagaagctggaagcctg

SEQ ID NO: 755137 - DNA, 16 bp, Homo sapiens
gcccagagaccccttc

SEQ ID NO: 755138 - DNA, 23 bp, Homo sapiens
gcccagagaccccttcctttcct

SEQ ID NO: 755139 - DNA, 16 bp, Homo sapiens
gcccagagatgcctcc

SEQ ID NO: 755140 - DNA, 19 bp, Homo sapiens
gcccagagatgcctccacc

SEQ ID NO: 755141 - DNA, 20 bp, Homo sapiens
gcccagagatgcctccaccg

SEQ ID NO: 755142 - DNA, 15 bp, Homo sapiens
gcccagagcaggaag

SEQ ID NO: 755143 - DNA, 12 bp, Homo sapiens
gcccagagccac

SEQ ID NO: 755144 - DNA, 17 bp, Homo sapiens
gcccagagccacctgga

SEQ ID NO: 755145 - DNA, 19 bp, Homo sapiens
gcccagagcctctgctgga

SEQ ID NO: 755146 - DNA, 13 bp, Homo sapiens
gcccagagcctgg

SEQ ID NO: 755147 - DNA, 15 bp, Homo sapiens
gcccagagctggcct

SEQ ID NO: 755148 - DNA, 17 bp, Homo sapiens
gcccagagctggcctcc

SEQ ID NO: 755149 - DNA, 20 bp, Homo sapiens
gcccagaggactcccaaccc

SEQ ID NO: 755150 - DNA, 16 bp, Homo sapiens
gcccagagggcccagg

SEQ ID NO: 755151 - DNA, 20 bp, Homo sapiens
gcccagatacgggggctgtg

SEQ ID NO: 755152 - DNA, 17 bp, Homo sapiens
gcccagatgaactgact

SEQ ID NO: 755153 - DNA, 18 bp, Homo sapiens
gcccagatgaactgactg

SEQ ID NO: 755154 - DNA, 21 bp, Homo sapiens
gcccagatgtgtcccccccag

SEQ ID NO: 755155 - DNA, 20 bp, Homo sapiens
gcccagattcccctgtgtca

SEQ ID NO: 755156 - DNA, 20 bp, Homo sapiens
gcccagcactgcttgaggaa

SEQ ID NO: 755157 - DNA, 16 bp, Homo sapiens
gcccagcactgtctgc

SEQ ID NO: 755158 - DNA, 14 bp, Homo sapiens
gcccagcagctcaa

SEQ ID NO: 755159 - DNA, 10 bp, Homo sapiens
gcccagcagg

SEQ ID NO: 755160 - DNA, 13 bp, Homo sapiens
gcccagcaggcag

SEQ ID NO: 755161 - DNA, 20 bp, Homo sapiens
gcccagcaggcccagcatgc

SEQ ID NO: 755162 - DNA, 13 bp, Homo sapiens
gcccagcatgcag

SEQ ID NO: 755163 - DNA, 14 bp, Homo sapiens
gcccagcattgctg

SEQ ID NO: 755164 - DNA, 12 bp, Homo sapiens
gcccagccaccc

SEQ ID NO: 755165 - DNA, 17 bp, Homo sapiens
gcccagccacccctcag

SEQ ID NO: 755166 - DNA, 14 bp, Homo sapiens
gcccagccactcca

SEQ ID NO: 755167 - DNA, 16 bp, Homo sapiens
gcccagccactccaag

SEQ ID NO: 755168 - DNA, 21 bp, Homo sapiens
gcccagccactccaagccccc

SEQ ID NO: 755169 - DNA, 19 bp, Homo sapiens
gcccagccactccaggagg

SEQ ID NO: 755170 - DNA, 14 bp, Homo sapiens
gcccagccagccac

SEQ ID NO: 755171 - DNA, 21 bp, Homo sapiens
gcccagccagccacccctgcc

SEQ ID NO: 755172 - DNA, 13 bp, Homo sapiens
gcccagccaggag

SEQ ID NO: 755173 - DNA, 14 bp, Homo sapiens
gcccagccaggccc

SEQ ID NO: 755174 - DNA, 15 bp, Homo sapiens
gcccagccaggcccc

SEQ ID NO: 755175 - DNA, 13 bp, Homo sapiens
gcccagcccagag

SEQ ID NO: 755176 - DNA, 15 bp, Homo sapiens
gcccagcccagctca

SEQ ID NO: 755177 - DNA, 18 bp, Homo sapiens
gcccagccccgctcaggc

SEQ ID NO: 755178 - DNA, 16 bp, Homo sapiens
gcccagcccctccacg

SEQ ID NO: 755179 - DNA, 19 bp, Homo sapiens
gcccagcccctgtttactg

SEQ ID NO: 755180 - DNA, 14 bp, Homo sapiens
gcccagcccctttt

SEQ ID NO: 755181 - DNA, 22 bp, Homo sapiens
gcccagccccttttctctgctc

SEQ ID NO: 755182 - DNA, 18 bp, Homo sapiens
gcccagcccggaccttgg

SEQ ID NO: 755183 - DNA, 15 bp, Homo sapiens
gcccagccggcctct

SEQ ID NO: 755184 - DNA, 22 bp, Homo sapiens
gcccagccggcctctctggcct

SEQ ID NO: 755185 - DNA, 23 bp, Homo sapiens
gcccagccggcctctctggcctc

SEQ ID NO: 755186 - DNA, 24 bp, Homo sapiens
gcccagccggcctctctggcctcc

SEQ ID NO: 755187 - DNA, 23 bp, Homo sapiens
gcccagcctagtcagggcacagc

SEQ ID NO: 755188 - DNA, 13 bp, Homo sapiens
gcccagcctctcc

SEQ ID NO: 755189 - DNA, 12 bp, Homo sapiens
gcccagcctgcc

SEQ ID NO: 755190 - DNA, 14 bp, Homo sapiens
gcccagcctgggag

SEQ ID NO: 755191 - DNA, 21 bp, Homo sapiens
gcccagcctgggagcccagag

SEQ ID NO: 755192 - DNA, 22 bp, Homo sapiens
gcccagcctgggagcccagagg

SEQ ID NO: 755193 - DNA, 11 bp, Homo sapiens
gcccagcctgt

SEQ ID NO: 755194 - DNA, 12 bp, Homo sapiens
gcccagcctgtc

SEQ ID NO: 755195 - DNA, 20 bp, Homo sapiens
gcccagcctgtcctggtaca

SEQ ID NO: 755196 - DNA, 14 bp, Homo sapiens
gcccagcgacacag

SEQ ID NO: 755197 - DNA, 15 bp, Homo sapiens
gcccagcgccaagta

SEQ ID NO: 755198 - DNA, 16 bp, Homo sapiens
gcccagcgctcgccac

SEQ ID NO: 755199 - DNA, 21 bp, Homo sapiens
gcccagcgctcgccacgctca

SEQ ID NO: 755200 - DNA, 20 bp, Homo sapiens
gcccagcggcccctcccaca

SEQ ID NO: 755201 - DNA, 15 bp, Homo sapiens
gcccagctacattcc

SEQ ID NO: 755202 - DNA, 16 bp, Homo sapiens
gcccagctacattcct

SEQ ID NO: 755203 - DNA, 11 bp, Homo sapiens
gcccagctccc

SEQ ID NO: 755204 - DNA, 21 bp, Homo sapiens
gcccagctccgcctgctggga

SEQ ID NO: 755205 - DNA, 15 bp, Homo sapiens
gcccagctcctcaca

SEQ ID NO: 755206 - DNA, 11 bp, Homo sapiens
gcccagctctc

SEQ ID NO: 755207 - DNA, 11 bp, Homo sapiens
gcccagctctt

SEQ ID NO: 755208 - DNA, 14 bp, Homo sapiens
gcccagctgctccc

SEQ ID NO: 755209 - DNA, 21 bp, Homo sapiens
gcccagctgctcccctgccac

SEQ ID NO: 755210 - DNA, 15 bp, Homo sapiens
gcccagctgggtcag

SEQ ID NO: 755211 - DNA, 18 bp, Homo sapiens
gcccagctgggtcaggca

SEQ ID NO: 755212 - DNA, 19 bp, Homo sapiens
gcccagctgggtcaggcag

SEQ ID NO: 755213 - DNA, 20 bp, Homo sapiens
gcccagctgtagccatggct

SEQ ID NO: 755214 - DNA, 22 bp, Homo sapiens
gcccagctgtagccatggctca

SEQ ID NO: 755215 - DNA, 13 bp, Homo sapiens
gcccagcttcctg

SEQ ID NO: 755216 - DNA, 13 bp, Homo sapiens
gcccagcttgggc

SEQ ID NO: 755217 - DNA, 16 bp, Homo sapiens
gcccagcttgggccca

SEQ ID NO: 755218 - DNA, 13 bp, Homo sapiens
gcccaggacagct

SEQ ID NO: 755219 - DNA, 13 bp, Homo sapiens
gcccaggaccagc

SEQ ID NO: 755220 - DNA, 14 bp, Homo sapiens
gcccaggaccagct

SEQ ID NO: 755221 - DNA, 11 bp, Homo sapiens
gcccaggagac

SEQ ID NO: 755222 - DNA, 15 bp, Homo sapiens
gcccaggagcaacag

SEQ ID NO: 755223 - DNA, 21 bp, Homo sapiens
gcccaggagctgagtcacctc

SEQ ID NO: 755224 - DNA, 15 bp, Homo sapiens
gcccaggatactggc

SEQ ID NO: 755225 - DNA, 17 bp, Homo sapiens
gcccaggatactggcac

SEQ ID NO: 755226 - DNA, 23 bp, Homo sapiens
gcccaggatactggcacagaggt

SEQ ID NO: 755227 - DNA, 16 bp, Homo sapiens
gcccaggcaccaccag

SEQ ID NO: 755228 - DNA, 22 bp, Homo sapiens
gcccaggcaccaccaggagcag

SEQ ID NO: 755229 - DNA, 11 bp, Homo sapiens
gcccaggcagc

SEQ ID NO: 755230 - DNA, 23 bp, Homo sapiens
gcccaggcagctatttcagcctc

SEQ ID NO: 755231 - DNA, 14 bp, Homo sapiens
gcccaggcaggcca

SEQ ID NO: 755232 - DNA, 22 bp, Homo sapiens
gcccaggcaggtctgcaagggc

SEQ ID NO: 755233 - DNA, 18 bp, Homo sapiens
gcccaggcatctccttgg

SEQ ID NO: 755234 - DNA, 22 bp, Homo sapiens
gcccaggccagcccccccaccc

SEQ ID NO: 755235 - DNA, 15 bp, Homo sapiens
gcccaggccatgtgg

SEQ ID NO: 755236 - DNA, 15 bp, Homo sapiens
gcccaggcccccggc

SEQ ID NO: 755237 - DNA, 17 bp, Homo sapiens
gcccaggcccccggctt

SEQ ID NO: 755238 - DNA, 23 bp, Homo sapiens
gcccaggcccccggctttcctcc

SEQ ID NO: 755239 - DNA, 21 bp, Homo sapiens
gcccaggccgggaagagccac

SEQ ID NO: 755240 - DNA, 23 bp, Homo sapiens
gcccaggccgggaagagccacct

SEQ ID NO: 755241 - DNA, 22 bp, Homo sapiens
gcccaggccgttccccttggct

SEQ ID NO: 755242 - DNA, 14 bp, Homo sapiens
gcccaggcctgctg

SEQ ID NO: 755243 - DNA, 16 bp, Homo sapiens
gcccaggcctgctggc

SEQ ID NO: 755244 - DNA, 17 bp, Homo sapiens
gcccaggcctgctggca

SEQ ID NO: 755245 - DNA, 20 bp, Homo sapiens
gcccaggcctgctggcatca

SEQ ID NO: 755246 - DNA, 16 bp, Homo sapiens
gcccaggcctggagcg

SEQ ID NO: 755247 - DNA, 18 bp, Homo sapiens
gccagtcctgcctggcca

SEQ ID NO: 755248 - DNA, 12 bp, Homo sapiens
gccagtcctggt

SEQ ID NO: 755249 - DNA, 19 bp, Homo sapiens
gccagtcgggagagccagg

SEQ ID NO: 755250 - DNA, 16 bp, Homo sapiens
gccagtctcagagacc

SEQ ID NO: 755251 - DNA, 17 bp, Homo sapiens
gccagtctcagagacca

SEQ ID NO: 755252 - DNA, 14 bp, Homo sapiens
gccagtctcccagg

SEQ ID NO: 755253 - DNA, 12 bp, Homo sapiens
gccagtctgccc

SEQ ID NO: 755254 - DNA, 23 bp, Homo sapiens
gccagtctgggtctgggtttgga

SEQ ID NO: 755255 - DNA, 20 bp, Homo sapiens
gccagtcttgcctaggccaa

SEQ ID NO: 755256 - DNA, 19 bp, Homo sapiens
gccagtgaagggttttgtg

SEQ ID NO: 755257 - DNA, 13 bp, Homo sapiens
gccagtgacagac

SEQ ID NO: 755258 - DNA, 15 bp, Homo sapiens
gccagtgagaagctg

SEQ ID NO: 755259 - DNA, 15 bp, Homo sapiens
gccagtgagggctgg

SEQ ID NO: 755260 - DNA, 21 bp, Homo sapiens
gccagtgagggctgggcccac

SEQ ID NO: 755261 - DNA, 19 bp, Homo sapiens
gccagtgatgatgttttga

SEQ ID NO: 755262 - DNA, 13 bp, Homo sapiens
gccagtgccaggg

SEQ ID NO: 755263 - DNA, 15 bp, Homo sapiens
gccagtgccagggtg

SEQ ID NO: 755264 - DNA, 23 bp, Homo sapiens
gccagtgccattccactccactc

SEQ ID NO: 755265 - DNA, 11 bp, Homo sapiens
gccagtgcctt

SEQ ID NO: 755266 - DNA, 17 bp, Homo sapiens
gccagtgccttacctcc

SEQ ID NO: 755267 - DNA, 19 bp, Homo sapiens
gccagtgccttacctcctg

SEQ ID NO: 755268 - DNA, 18 bp, Homo sapiens
gccagtgctgcttcttgc

SEQ ID NO: 755269 - DNA, 15 bp, Homo sapiens
gccagtgctggtcac

SEQ ID NO: 755270 - DNA, 17 bp, Homo sapiens
gccagtggaagaaacac

SEQ ID NO: 755271 - DNA, 17 bp, Homo sapiens
gccagtggcccccgggc

SEQ ID NO: 755272 - DNA, 14 bp, Homo sapiens
gccagtgggcctgg

SEQ ID NO: 755273 - DNA, 19 bp, Homo sapiens
gccagtggggcctgtggaa

SEQ ID NO: 755274 - DNA, 22 bp, Homo sapiens
gccagtgtccttcgaggaaccc

SEQ ID NO: 755275 - DNA, 19 bp, Homo sapiens
gccagtgtgcccaaaagcc

SEQ ID NO: 755276 - DNA, 23 bp, Homo sapiens
gccagtgtgcccaaaagccatgt

SEQ ID NO: 755277 - DNA, 21 bp, Homo sapiens
gccagtgttgtgggcttcctg

SEQ ID NO: 755278 - DNA, 17 bp, Homo sapiens
gccagttgatctgctct

SEQ ID NO: 755279 - DNA, 18 bp, Homo sapiens
gccagttttaccagcgca

SEQ ID NO: 755280 - DNA, 15 bp, Homo sapiens
gccagttttctggta

SEQ ID NO: 755281 - DNA, 13 bp, Homo sapiens
gccataaaacatt

SEQ ID NO: 755282 - DNA, 14 bp, Homo sapiens
gccataaaacatta

SEQ ID NO: 755283 - DNA, 20 bp, Homo sapiens
gccataaaacattaagaaaa

SEQ ID NO: 755284 - DNA, 15 bp, Homo sapiens
gccataacgtgcccc

SEQ ID NO: 755285 - DNA, 15 bp, Homo sapiens
gccataacttgaaaa

SEQ ID NO: 755286 - DNA, 19 bp, Homo sapiens
gccataattatgaaaactc

SEQ ID NO: 755287 - DNA, 16 bp, Homo sapiens
gccatactttgtctga

SEQ ID NO: 755288 - DNA, 19 bp, Homo sapiens
gccatagaccctgaggccc

SEQ ID NO: 755289 - DNA, 14 bp, Homo sapiens
gccatagaggccca

SEQ ID NO: 755290 - DNA, 22 bp, Homo sapiens
cgccacccccatcttccacctg

SEQ ID NO: 755291 - DNA, 20 bp, Homo sapiens
cgccacccccgcccccaccg

SEQ ID NO: 755292 - DNA, 22 bp, Homo sapiens
cgccacccccgccgtggggctc

SEQ ID NO: 755293 - DNA, 13 bp, Homo sapiens
cgccaccctgccc

SEQ ID NO: 755294 - DNA, 15 bp, Homo sapiens
cgccaccctgcccct

SEQ ID NO: 755295 - DNA, 23 bp, Homo sapiens
cgccacctcagggcacgcaggac

SEQ ID NO: 755296 - DNA, 13 bp, Homo sapiens
cgccacgctcagt

SEQ ID NO: 755297 - DNA, 17 bp, Homo sapiens
cgccacgtcccagcatc

SEQ ID NO: 755298 - DNA, 19 bp, Homo sapiens
cgccactcagccatttccc

SEQ ID NO: 755299 - DNA, 16 bp, Homo sapiens
cgccactcatttcatc

SEQ ID NO: 755300 - DNA, 14 bp, Homo sapiens
cgccactccctggg

SEQ ID NO: 755301 - DNA, 20 bp, Homo sapiens
cgccactccctgggacacag

SEQ ID NO: 755302 - DNA, 15 bp, Homo sapiens
cgccactcctgaacc

SEQ ID NO: 755303 - DNA, 17 bp, Homo sapiens
cgccactgcactccagc

SEQ ID NO: 755304 - DNA, 22 bp, Homo sapiens
cgccactgcactccagcctggg

SEQ ID NO: 755305 - DNA, 14 bp, Homo sapiens
cgccagaccccgtg

SEQ ID NO: 755306 - DNA, 16 bp, Homo sapiens
cgccagaccccgtggc

SEQ ID NO: 755307 - DNA, 19 bp, Homo sapiens
cgccagaccccgtggctct

SEQ ID NO: 755308 - DNA, 22 bp, Homo sapiens
cgccagaccccgtggctctggg

SEQ ID NO: 755309 - DNA, 23 bp, Homo sapiens
cgccagaccccgtggctctggga

SEQ ID NO: 755310 - DNA, 18 bp, Homo sapiens
cgccagccccgctcccac

SEQ ID NO: 755311 - DNA, 13 bp, Homo sapiens
cgccagcctcctc

SEQ ID NO: 755312 - DNA, 17 bp, Homo sapiens
cgccagcctcctctgga

SEQ ID NO: 755313 - DNA, 18 bp, Homo sapiens
cgccagcctcctctggac

SEQ ID NO: 755314 - DNA, 19 bp, Homo sapiens
cgccagcgacctctctgcc

SEQ ID NO: 755315 - DNA, 16 bp, Homo sapiens
cgccagcgtgtggagc

SEQ ID NO: 755316 - DNA, 20 bp, Homo sapiens
cgccagcgtgtggagcagag

SEQ ID NO: 755317 - DNA, 23 bp, Homo sapiens
cgccagctcctctctgaagcgac

SEQ ID NO: 755318 - DNA, 19 bp, Homo sapiens
cgccagctgggagcactgg

SEQ ID NO: 755319 - DNA, 16 bp, Homo sapiens
cgccaggaagccagag

SEQ ID NO: 755320 - DNA, 17 bp, Homo sapiens
cgccaggaagccagagc

SEQ ID NO: 755321 - DNA, 18 bp, Homo sapiens
cgccaggaagccagagcc

SEQ ID NO: 755322 - DNA, 16 bp, Homo sapiens
cgccaggacagcagca

SEQ ID NO: 755323 - DNA, 17 bp, Homo sapiens
cgccaggacagcagcac

SEQ ID NO: 755324 - DNA, 23 bp, Homo sapiens
cgccaggcagagctgagggccct

SEQ ID NO: 755325 - DNA, 18 bp, Homo sapiens
cgccaggcgcatgtctgc

SEQ ID NO: 755326 - DNA, 20 bp, Homo sapiens
cgccaggcgcatgtctgcac

SEQ ID NO: 755327 - DNA, 16 bp, Homo sapiens
cgccagggcccaggcc

SEQ ID NO: 755328 - DNA, 21 bp, Homo sapiens
cgccagggctggggacagagg

SEQ ID NO: 755329 - DNA, 14 bp, Homo sapiens
cgccataggccaag

SEQ ID NO: 755330 - DNA, 23 bp, Homo sapiens
cgccatggggtcggctcctgatg

SEQ ID NO: 755331 - DNA, 20 bp, Homo sapiens
cgccattgcactcccgcctg

SEQ ID NO: 755332 - DNA, 13 bp, Homo sapiens
cgccatttcctca

SEQ ID NO: 755333 - DNA, 17 bp, Homo sapiens
cgccatttcctcacgtg

SEQ ID NO: 755334 - DNA, 17 bp, Homo sapiens
cgcccaaagccagacag

SEQ ID NO: 755335 - DNA, 18 bp, Homo sapiens
cgcccacaggaagcctgc

SEQ ID NO: 755336 - DNA, 21 bp, Homo sapiens
cgcccacaggaagcctgcagt

SEQ ID NO: 755337 - DNA, 19 bp, Homo sapiens
cgcccaccgtgggcagtgc

SEQ ID NO: 755338 - DNA, 16 bp, Homo sapiens
cgcccacctcgctccc

SEQ ID NO: 755339 - DNA, 14 bp, Homo sapiens
cgcccactgtcctg

SEQ ID NO: 755340 - DNA, 16 bp, Homo sapiens
cgcccagacaccatgt

SEQ ID NO: 755341 - DNA, 22 bp, Homo sapiens
cgcccagagacccaagctgcct

SEQ ID NO: 755342 - DNA, 13 bp, Homo sapiens
cgcccagagctgg

SEQ ID NO: 755343 - DNA, 12 bp, Homo sapiens
cgcccagctccg

SEQ ID NO: 755344 - DNA, 18 bp, Homo sapiens
cgcccagctccgcctgct

SEQ ID NO: 755345 - DNA, 19 bp, Homo sapiens
cgcccagctccgcctgctg

SEQ ID NO: 755346 - DNA, 18 bp, Homo sapiens
cgcccagctgcacctgcc

SEQ ID NO: 755347 - DNA, 14 bp, Homo sapiens
cgcccaggcctgct

SEQ ID NO: 755348 - DNA, 16 bp, Homo sapiens
cgcccaggcctgctgg

SEQ ID NO: 755349 - DNA, 16 bp, Homo sapiens
cgcccagggaggagtc

SEQ ID NO: 755350 - DNA, 10 bp, Homo sapiens
cgcccagggt

SEQ ID NO: 755351 - DNA, 16 bp, Homo sapiens
cgcccagtccttccac

SEQ ID NO: 755352 - DNA, 22 bp, Homo sapiens
cgcccattcgtctgtcccagag

SEQ ID NO: 755353 - DNA, 14 bp, Homo sapiens
cgccccacccaggg

SEQ ID NO: 755354 - DNA, 15 bp, Homo sapiens
cgccccacctcccat

SEQ ID NO: 755355 - DNA, 16 bp, Homo sapiens
cgccccagagtggccc

SEQ ID NO: 755356 - DNA, 19 bp, Homo sapiens
cgccccagataccagcccc

SEQ ID NO: 755357 - DNA, 20 bp, Homo sapiens
cgccccagataccagcccct

SEQ ID NO: 755358 - DNA, 13 bp, Homo sapiens
cgccccagccctc

SEQ ID NO: 755359 - DNA, 15 bp, Homo sapiens
cgccccagccctcag

SEQ ID NO: 755360 - DNA, 21 bp, Homo sapiens
cgcccccaccgggctgcaggt

SEQ ID NO: 755361 - DNA, 11 bp, Homo sapiens
cgcccccagcc

SEQ ID NO: 755362 - DNA, 21 bp, Homo sapiens
cgccccccacacttccctggc

SEQ ID NO: 755363 - DNA, 12 bp, Homo sapiens
cgccccccacct

SEQ ID NO: 755364 - DNA, 15 bp, Homo sapiens
cgccccccagagcca

SEQ ID NO: 755365 - DNA, 14 bp, Homo sapiens
cgcccccgagccct

SEQ ID NO: 755366 - DNA, 11 bp, Homo sapiens
cgccccctccc

SEQ ID NO: 755367 - DNA, 14 bp, Homo sapiens
cgccccctccctat

SEQ ID NO: 755368 - DNA, 19 bp, Homo sapiens
cgccccctgccctcccctc

SEQ ID NO: 755369 - DNA, 16 bp, Homo sapiens
cgcgatcccacacagg

SEQ ID NO: 755370 - DNA, 16 bp, Homo sapiens
cgcgccagcgacctct

SEQ ID NO: 755371 - DNA, 22 bp, Homo sapiens
cgcgccagcgacctctctgcct

SEQ ID NO: 755372 - DNA, 19 bp, Homo sapiens
cgcgcccagcgctcgccac

SEQ ID NO: 755373 - DNA, 18 bp, Homo sapiens
cgcgccctcccccatggg

SEQ ID NO: 755374 - DNA, 18 bp, Homo sapiens
cgcgccgatgccaccggc

SEQ ID NO: 755375 - DNA, 21 bp, Homo sapiens
cgcgcgccggtccggcgcccc

SEQ ID NO: 755376 - DNA, 19 bp, Homo sapiens
cgcgcgtccccctgccggc

SEQ ID NO: 755377 - DNA, 14 bp, Homo sapiens
cgcgctcgcccagc

SEQ ID NO: 755378 - DNA, 20 bp, Homo sapiens
cgcggacgtgctggccttgg

SEQ ID NO: 755379 - DNA, 14 bp, Homo sapiens
cgcggactcgcccc

SEQ ID NO: 755380 - DNA, 20 bp, Homo sapiens
cgcggaggaggagggaggcc

SEQ ID NO: 755381 - DNA, 21 bp, Homo sapiens
cgcggaggaggagggaggcca

SEQ ID NO: 755382 - DNA, 14 bp, Homo sapiens
cgcggccctcagta

SEQ ID NO: 755383 - DNA, 21 bp, Homo sapiens
cgcggccctcagtagtccctg

SEQ ID NO: 755384 - DNA, 17 bp, Homo sapiens
cgcggccctggggcggg

SEQ ID NO: 755385 - DNA, 21 bp, Homo sapiens
cgcggcctgcaccgacccgag

SEQ ID NO: 755386 - DNA, 15 bp, Homo sapiens
cgcggctgggagcct

SEQ ID NO: 755387 - DNA, 15 bp, Homo sapiens
cgcgggaggcaccag

SEQ ID NO: 755388 - DNA, 16 bp, Homo sapiens
cgcgggaggcaccagc

SEQ ID NO: 755389 - DNA, 21 bp, Homo sapiens
cgcgggaggcaccagctctgt

SEQ ID NO: 755390 - DNA, 15 bp, Homo sapiens
cgcgggcagccaccc

SEQ ID NO: 755391 - DNA, 23 bp, Homo sapiens
cgcgggcgcccgcggcgcgaccc

SEQ ID NO: 755392 - DNA, 18 bp, Homo sapiens
cgcgggctgactgggcca

SEQ ID NO: 755393 - DNA, 17 bp, Homo sapiens
cgcgggctttgttgctg

SEQ ID NO: 755394 - DNA, 18 bp, Homo sapiens
cgcgggctttgttgctgg

SEQ ID NO: 755395 - DNA, 18 bp, Homo sapiens
cgcggggaagctggcttt

SEQ ID NO: 755396 - DNA, 19 bp, Homo sapiens
cgcggggaccctgccgagg

SEQ ID NO: 755397 - DNA, 13 bp, Homo sapiens
cgcggtgctctgg

SEQ ID NO: 755398 - DNA, 16 bp, Homo sapiens
cgcggtgctctggcgg

SEQ ID NO: 755399 - DNA, 19 bp, Homo sapiens
cgcggtggctcacgcctgt

SEQ ID NO: 755400 - DNA, 13 bp, Homo sapiens
cgcgtagagagcc

SEQ ID NO: 755401 - DNA, 15 bp, Homo sapiens
cgcgtccaaccccgg

SEQ ID NO: 755402 - DNA, 14 bp, Homo sapiens
cgcgtctcccatcc

SEQ ID NO: 755403 - DNA, 14 bp, Homo sapiens
cgcgtctgcctggg

SEQ ID NO: 755404 - DNA, 18 bp, Homo sapiens
cgcgtgataaaactgggt

SEQ ID NO: 755405 - DNA, 17 bp, Homo sapiens
cgcgttgtaaaatatag

SEQ ID NO: 755406 - DNA, 15 bp, Homo sapiens
cgctaaaagaaactt

SEQ ID NO: 755407 - DNA, 19 bp, Homo sapiens
cgctaaagagcccttgcct

SEQ ID NO: 755408 - DNA, 19 bp, Homo sapiens
cgctaaagggaccatctgc

SEQ ID NO: 755409 - DNA, 14 bp, Homo sapiens
cgctacctccctcc

SEQ ID NO: 755410 - DNA, 15 bp, Homo sapiens
cgctacctctctgtc

SEQ ID NO: 755411 - DNA, 17 bp, Homo sapiens
cgctacctctctgtccc

SEQ ID NO: 755412 - DNA, 16 bp, Homo sapiens
cgctactataaagaga

SEQ ID NO: 755413 - DNA, 15 bp, Homo sapiens
cgctaggagagactg

SEQ ID NO: 755414 - DNA, 18 bp, Homo sapiens
cgctatctgggaagctat

SEQ ID NO: 755415 - DNA, 13 bp, Homo sapiens
cgctatgtgactt

SEQ ID NO: 755416 - DNA, 15 bp, Homo sapiens
cgctcaccgctggcc

SEQ ID NO: 755417 - DNA, 21 bp, Homo sapiens
cgctcaccgctggcccttaga

SEQ ID NO: 755418 - DNA, 13 bp, Homo sapiens
cgctcagacccca

SEQ ID NO: 755419 - DNA, 13 bp, Homo sapiens
cgctcagcccagc

SEQ ID NO: 755420 - DNA, 16 bp, Homo sapiens
cgctcaggacccaggc

SEQ ID NO: 755421 - DNA, 17 bp, Homo sapiens
cgctcaggacccaggcc

SEQ ID NO: 755422 - DNA, 19 bp, Homo sapiens
gccataggagaggagggtt

SEQ ID NO: 755423 - DNA, 17 bp, Homo sapiens
gccataggccaaggtgc

SEQ ID NO: 755424 - DNA, 13 bp, Homo sapiens
gccatagggggct

SEQ ID NO: 755425 - DNA, 14 bp, Homo sapiens
gccatagggggctg

SEQ ID NO: 755426 - DNA, 21 bp, Homo sapiens
gccatagggggctgcacggga

SEQ ID NO: 755427 - DNA, 23 bp, Homo sapiens
gccataggtctaaataggatcct

SEQ ID NO: 755428 - DNA, 18 bp, Homo sapiens
gccatataagtttgaagg

SEQ ID NO: 755429 - DNA, 14 bp, Homo sapiens
gccatatatgctgt

SEQ ID NO: 755430 - DNA, 22 bp, Homo sapiens
gccatatggaggactgtgacag

SEQ ID NO: 755431 - DNA, 14 bp, Homo sapiens
gccatattaaattt

SEQ ID NO: 755432 - DNA, 20 bp, Homo sapiens
gccatattaaattttttgtt

SEQ ID NO: 755433 - DNA, 16 bp, Homo sapiens
gccatattcacacctc

SEQ ID NO: 755434 - DNA, 14 bp, Homo sapiens
gccatattccagca

SEQ ID NO: 755435 - DNA, 18 bp, Homo sapiens
gccatcaaggtccagtgg

SEQ ID NO: 755436 - DNA, 12 bp, Homo sapiens
gccatcaccctc

SEQ ID NO: 755437 - DNA, 17 bp, Homo sapiens
gccatcaccctcaccca

SEQ ID NO: 755438 - DNA, 14 bp, Homo sapiens
gccatcaccgctgg

SEQ ID NO: 755439 - DNA, 16 bp, Homo sapiens
gccatcactcagcccc

SEQ ID NO: 755440 - DNA, 22 bp, Homo sapiens
gccatcactcagcccctacccc

SEQ ID NO: 755441 - DNA, 23 bp, Homo sapiens
gccatcagggccctgccccaggc

SEQ ID NO: 755442 - DNA, 15 bp, Homo sapiens
gccatcatgccttga

SEQ ID NO: 755443 - DNA, 21 bp, Homo sapiens
gccatccaaataagaaaccta

SEQ ID NO: 755444 - DNA, 12 bp, Homo sapiens
gccatccagggt

SEQ ID NO: 755445 - DNA, 13 bp, Homo sapiens
gccatccagggtc

SEQ ID NO: 755446 - DNA, 14 bp, Homo sapiens
gccatccagggtct

SEQ ID NO: 755447 - DNA, 16 bp, Homo sapiens
gccatccagggtctgg

SEQ ID NO: 755448 - DNA, 20 bp, Homo sapiens
gccatccagggtctggcaga

SEQ ID NO: 755449 - DNA, 23 bp, Homo sapiens
gccatccagggtctggcagagcc

SEQ ID NO: 755450 - DNA, 22 bp, Homo sapiens
gccatccccaccttcacctcgg

SEQ ID NO: 755451 - DNA, 20 bp, Homo sapiens
gccatccccctctcacgcca

SEQ ID NO: 755452 - DNA, 15 bp, Homo sapiens
gccatcccctccccg

SEQ ID NO: 755453 - DNA, 19 bp, Homo sapiens
gccatcccgcttagcctgc

SEQ ID NO: 755454 - DNA, 23 bp, Homo sapiens
gccatcccgcttagcctgcctca

SEQ ID NO: 755455 - DNA, 14 bp, Homo sapiens
gccatccctgggcc

SEQ ID NO: 755456 - DNA, 18 bp, Homo sapiens
gccatccctgggcccctc

SEQ ID NO: 755457 - DNA, 20 bp, Homo sapiens
gccatcccttcggagccaac

SEQ ID NO: 755458 - DNA, 15 bp, Homo sapiens
gccatcccttgggga

SEQ ID NO: 755459 - DNA, 17 bp, Homo sapiens
gccatcccttggggaag

SEQ ID NO: 755460 - DNA, 23 bp, Homo sapiens
gccatccctttttttacatttca

SEQ ID NO: 755461 - DNA, 16 bp, Homo sapiens
gccatccgcagactgc

SEQ ID NO: 755462 - DNA, 21 bp, Homo sapiens
gccatcctgatggacctgccc

SEQ ID NO: 755463 - DNA, 16 bp, Homo sapiens
gccatcctgcccttct

SEQ ID NO: 755464 - DNA, 20 bp, Homo sapiens
gccatcctgcccttctgacc

SEQ ID NO: 755465 - DNA, 14 bp, Homo sapiens
gccatcggacagga

SEQ ID NO: 755466 - DNA, 13 bp, Homo sapiens
gccatcgtcctgg

SEQ ID NO: 755467 - DNA, 19 bp, Homo sapiens
gccatctaatgcttgttta

SEQ ID NO: 755468 - DNA, 16 bp, Homo sapiens
gccatctagccagccc

SEQ ID NO: 755469 - DNA, 17 bp, Homo sapiens
gccatctcagattctgt

SEQ ID NO: 755470 - DNA, 12 bp, Homo sapiens
gccatctcaggt

SEQ ID NO: 755471 - DNA, 19 bp, Homo sapiens
gccatctcatgaggggaga

SEQ ID NO: 755472 - DNA, 14 bp, Homo sapiens
gccatctccctccc

SEQ ID NO: 755473 - DNA, 15 bp, Homo sapiens
gccatctccctcccc

SEQ ID NO: 755474 - DNA, 23 bp, Homo sapiens
gccatctccctccccagaaacag

SEQ ID NO: 755475 - DNA, 20 bp, Homo sapiens
gccatctgacagcaggccac

SEQ ID NO: 755476 - DNA, 12 bp, Homo sapiens
gccatctgccca

SEQ ID NO: 755477 - DNA, 12 bp, Homo sapiens
gccatctggggt

SEQ ID NO: 755478 - DNA, 14 bp, Homo sapiens
gccatctgttttca

SEQ ID NO: 755479 - DNA, 16 bp, Homo sapiens
gccatctgttttcaac

SEQ ID NO: 755480 - DNA, 11 bp, Homo sapiens
gccatcttcag

SEQ ID NO: 755481 - DNA, 13 bp, Homo sapiens
gccatcttctccc

SEQ ID NO: 755482 - DNA, 16 bp, Homo sapiens
gccatgaaccaaatgg

SEQ ID NO: 755483 - DNA, 16 bp, Homo sapiens
gccatgaatctctgcc

SEQ ID NO: 755484 - DNA, 15 bp, Homo sapiens
gccatgaatttctac

SEQ ID NO: 755485 - DNA, 14 bp, Homo sapiens
gccatgacagaggc

SEQ ID NO: 755486 - DNA, 18 bp, Homo sapiens
gccatgacagaggctgca

SEQ ID NO: 755487 - DNA, 21 bp, Homo sapiens
gccatgacatttcatctgggt

SEQ ID NO: 755488 - DNA, 19 bp, Homo sapiens
gccatgagctccagacccc

SEQ ID NO: 755489 - DNA, 19 bp, Homo sapiens
gccatgaggcctcagtgga

SEQ ID NO: 755490 - DNA, 20 bp, Homo sapiens
gccatgaggcctcagtggac

SEQ ID NO: 755491 - DNA, 20 bp, Homo sapiens
gccatgagttccagaaagta

SEQ ID NO: 755492 - DNA, 22 bp, Homo sapiens
gccatgatctgtatttaatggt

SEQ ID NO: 755493 - DNA, 22 bp, Homo sapiens
gccatgatggaaatatttattt

SEQ ID NO: 755494 - DNA, 16 bp, Homo sapiens
gccatgatgtccttgg

SEQ ID NO: 755495 - DNA, 16 bp, Homo sapiens
gccatgatttgtccca

SEQ ID NO: 755496 - DNA, 18 bp, Homo sapiens
gccatgatttgtcccagc

SEQ ID NO: 755497 - DNA, 22 bp, Homo sapiens
gccatgcaccaggactggctgt

SEQ ID NO: 755498 - DNA, 18 bp, Homo sapiens
gccatgcaggaagaggcc

SEQ ID NO: 755499 - DNA, 20 bp, Homo sapiens
gccatgcaggaagaggccca

SEQ ID NO: 755500 - DNA, 15 bp, Homo sapiens
gccatgccaataaag

SEQ ID NO: 755501 - DNA, 20 bp, Homo sapiens
gccatgccaataaagtgatc

SEQ ID NO: 755502 - DNA, 14 bp, Homo sapiens
gccatgccaccctg

SEQ ID NO: 755503 - DNA, 14 bp, Homo sapiens
gccatgccactgcc

SEQ ID NO: 755504 - DNA, 15 bp, Homo sapiens
gccatgccactgcca

SEQ ID NO: 755505 - DNA, 22 bp, Homo sapiens
gccatgccactgccaggcacct

SEQ ID NO: 755506 - DNA, 15 bp, Homo sapiens
gccatgccagctggc

SEQ ID NO: 755507 - DNA, 16 bp, Homo sapiens
gccatgccagctggcc

SEQ ID NO: 755508 - DNA, 16 bp, Homo sapiens
gccatgccaggaacct

SEQ ID NO: 755509 - DNA, 14 bp, Homo sapiens
gccatgcccaaggc

SEQ ID NO: 755510 - DNA, 19 bp, Homo sapiens
gccatgccctagaccctcc

SEQ ID NO: 755511 - DNA, 22 bp, Homo sapiens
gccatgccctagaccctcccca

SEQ ID NO: 755512 - DNA, 23 bp, Homo sapiens
gccatgccctagaccctccccaa

SEQ ID NO: 755513 - DNA, 13 bp, Homo sapiens
gccatgcctcagc

SEQ ID NO: 755514 - DNA, 17 bp, Homo sapiens
gccatgcctcagccctg

SEQ ID NO: 755515 - DNA, 21 bp, Homo sapiens
gccatgcctccctgggccacc

SEQ ID NO: 755516 - DNA, 21 bp, Homo sapiens
gccatgcgaggggccagcaga

SEQ ID NO: 755517 - DNA, 16 bp, Homo sapiens
gccatgctacagttag

SEQ ID NO: 755518 - DNA, 22 bp, Homo sapiens
gccatgctcaacccccctccca

SEQ ID NO: 755519 - DNA, 21 bp, Homo sapiens
gccatgctgaggcctgggccg

SEQ ID NO: 755520 - DNA, 16 bp, Homo sapiens
gccatgctgggaagac

SEQ ID NO: 755521 - DNA, 15 bp, Homo sapiens
gccatgctgggccac

SEQ ID NO: 755522 - DNA, 14 bp, Homo sapiens
gccatgctgtccct

SEQ ID NO: 755523 - DNA, 18 bp, Homo sapiens
gccatgctgtccctgcac

SEQ ID NO: 755524 - DNA, 17 bp, Homo sapiens
gccatggaaggtgccag

SEQ ID NO: 755525 - DNA, 17 bp, Homo sapiens
gccatggaataaaccat

SEQ ID NO: 755526 - DNA, 19 bp, Homo sapiens
gccatggacgaatatgaat

SEQ ID NO: 755527 - DNA, 20 bp, Homo sapiens
gccatggactctacactgtg

SEQ ID NO: 755528 - DNA, 14 bp, Homo sapiens
gccatggatctgat

SEQ ID NO: 755529 - DNA, 18 bp, Homo sapiens
gccatggccccccactcc

SEQ ID NO: 755530 - DNA, 16 bp, Homo sapiens
gccatggcgtgtccct

SEQ ID NO: 755531 - DNA, 13 bp, Homo sapiens
gccatggctcagg

SEQ ID NO: 755532 - DNA, 12 bp, Homo sapiens
gccatggctggg

SEQ ID NO: 755533 - DNA, 16 bp, Homo sapiens
gccatggctttcatcc

SEQ ID NO: 755534 - DNA, 21 bp, Homo sapiens
gccatggctttcatcctgtgt

SEQ ID NO: 755535 - DNA, 23 bp, Homo sapiens
gccatggctttcatcctgtgtcc

SEQ ID NO: 755536 - DNA, 13 bp, Homo sapiens
gccatgggcctgc

SEQ ID NO: 755537 - DNA, 18 bp, Homo sapiens
gccatggggtccatcccc

SEQ ID NO: 755538 - DNA, 19 bp, Homo sapiens
gccatggggtccatcccct

SEQ ID NO: 755539 - DNA, 19 bp, Homo sapiens
gccatggggtcggctcctg

SEQ ID NO: 755540 - DNA, 22 bp, Homo sapiens
gccatggggtcggctcctgatg

SEQ ID NO: 755541 - DNA, 16 bp, Homo sapiens
gccatgggtggaaagt

SEQ ID NO: 755542 - DNA, 23 bp, Homo sapiens
gccatggtctttgctaggcctct

SEQ ID NO: 755543 - DNA, 19 bp, Homo sapiens
gccatggtggagggcactt

SEQ ID NO: 755544 - DNA, 20 bp, Homo sapiens
gccatggtggagggcacttc

SEQ ID NO: 755545 - DNA, 22 bp, Homo sapiens
gccatgtaaatccccactggga

SEQ ID NO: 755546 - DNA, 21 bp, Homo sapiens
cgctcagggccatgctgaggc

SEQ ID NO: 755547 - DNA, 21 bp, Homo sapiens
cgctcaggtgatcaaaataaa

SEQ ID NO: 755548 - DNA, 14 bp, Homo sapiens
cgctcagtattact

SEQ ID NO: 755549 - DNA, 22 bp, Homo sapiens
cgctcatctctggaaggggcag

SEQ ID NO: 755550 - DNA, 21 bp, Homo sapiens
cgctccatgtttttggggaca

SEQ ID NO: 755551 - DNA, 13 bp, Homo sapiens
cgctcccaccgcc

SEQ ID NO: 755552 - DNA, 16 bp, Homo sapiens
cgctcccaccgccccc

SEQ ID NO: 755553 - DNA, 17 bp, Homo sapiens
cgctcccaccgccccca

SEQ ID NO: 755554 - DNA, 18 bp, Homo sapiens
cgctcccaccgcccccac

SEQ ID NO: 755555 - DNA, 16 bp, Homo sapiens
cgctcccacctagtgc

SEQ ID NO: 755556 - DNA, 18 bp, Homo sapiens
cgctcccacctagtgccc

SEQ ID NO: 755557 - DNA, 19 bp, Homo sapiens
cgctcccacctagtgcccc

SEQ ID NO: 755558 - DNA, 23 bp, Homo sapiens
cgctcccacctagtgccccagac

SEQ ID NO: 755559 - DNA, 20 bp, Homo sapiens
cgctcccaggttcccccagc

SEQ ID NO: 755560 - DNA, 18 bp, Homo sapiens
cgctcccctccatcccca

SEQ ID NO: 755561 - DNA, 12 bp, Homo sapiens
cgctccccttgg

SEQ ID NO: 755562 - DNA, 20 bp, Homo sapiens
cgctccccttggacctccag

SEQ ID NO: 755563 - DNA, 13 bp, Homo sapiens
cgctcccgcattt

SEQ ID NO: 755564 - DNA, 19 bp, Homo sapiens
cgctccctgacttctcccc

SEQ ID NO: 755565 - DNA, 20 bp, Homo sapiens
cgctccctgacttctccccc

SEQ ID NO: 755566 - DNA, 13 bp, Homo sapiens
cgctccctggata

SEQ ID NO: 755567 - DNA, 23 bp, Homo sapiens
cgctccgaaccccgggcccgggc

SEQ ID NO: 755568 - DNA, 17 bp, Homo sapiens
cgctccgtctctgtcct

SEQ ID NO: 755569 - DNA, 15 bp, Homo sapiens
cgctcctccctgctc

SEQ ID NO: 755570 - DNA, 17 bp, Homo sapiens
cgctcctccctgctcct

SEQ ID NO: 755571 - DNA, 23 bp, Homo sapiens
cgctcctccctgctcctcatggg

SEQ ID NO: 755572 - DNA, 17 bp, Homo sapiens
cgctcctccttcccagg

SEQ ID NO: 755573 - DNA, 23 bp, Homo sapiens
cgctcctccttcccagggaccag

SEQ ID NO: 755574 - DNA, 23 bp, Homo sapiens
cgctcctcgggaaacacacaagc

SEQ ID NO: 755575 - DNA, 19 bp, Homo sapiens
cgctcgccacgctcagtgc

SEQ ID NO: 755576 - DNA, 13 bp, Homo sapiens
cgctcgcccagca

SEQ ID NO: 755577 - DNA, 18 bp, Homo sapiens
cgctcgcccagcaggaga

SEQ ID NO: 755578 - DNA, 14 bp, Homo sapiens
cgctcgctgccatc

SEQ ID NO: 755579 - DNA, 22 bp, Homo sapiens
cgctcgttccggtccccacaga

SEQ ID NO: 755580 - DNA, 14 bp, Homo sapiens
cgctctcagttctc

SEQ ID NO: 755581 - DNA, 14 bp, Homo sapiens
cgctctcttccaga

SEQ ID NO: 755582 - DNA, 16 bp, Homo sapiens
cgctctcttcctgccc

SEQ ID NO: 755583 - DNA, 23 bp, Homo sapiens
cgctctcttcctgcccctctttc

SEQ ID NO: 755584 - DNA, 12 bp, Homo sapiens
cgctctgaggca

SEQ ID NO: 755585 - DNA, 23 bp, Homo sapiens
cgctctgaggcaaccccctcgga

SEQ ID NO: 755586 - DNA, 15 bp, Homo sapiens
cgctctgctggcctg

SEQ ID NO: 755587 - DNA, 16 bp, Homo sapiens
cgctctgctggcctgg

SEQ ID NO: 755588 - DNA, 21 bp, Homo sapiens
cgctctgctggcctggccggc

SEQ ID NO: 755589 - DNA, 13 bp, Homo sapiens
cgctctggacaga

SEQ ID NO: 755590 - DNA, 16 bp, Homo sapiens
cgctctggatcctgca

SEQ ID NO: 755591 - DNA, 19 bp, Homo sapiens
cgctctgttgcccaggctg

SEQ ID NO: 755592 - DNA, 21 bp, Homo sapiens
cgctcttagctttctcagggg

SEQ ID NO: 755593 - DNA, 14 bp, Homo sapiens
cgctcttggtccct

SEQ ID NO: 755594 - DNA, 23 bp, Homo sapiens
cgctgagcgcccccgagccctga

SEQ ID NO: 755595 - DNA, 15 bp, Homo sapiens
cgctgagctgagtgg

SEQ ID NO: 755596 - DNA, 16 bp, Homo sapiens
cgctgagctgagtggc

SEQ ID NO: 755597 - DNA, 18 bp, Homo sapiens
cgctgagctgagtggcca

SEQ ID NO: 755598 - DNA, 20 bp, Homo sapiens
cgctgagtggcaggggacag

SEQ ID NO: 755599 - DNA, 19 bp, Homo sapiens
cgctgcaacctgttgatag

SEQ ID NO: 755600 - DNA, 17 bp, Homo sapiens
cgctgcacacagacggc

SEQ ID NO: 755601 - DNA, 18 bp, Homo sapiens
cgctgcagcagggcagga

SEQ ID NO: 755602 - DNA, 18 bp, Homo sapiens
cgctgcagcctctgcctc

SEQ ID NO: 755603 - DNA, 15 bp, Homo sapiens
cgctgcaggaaacat

SEQ ID NO: 755604 - DNA, 18 bp, Homo sapiens
cgctgccaccacgtctgc

SEQ ID NO: 755605 - DNA, 20 bp, Homo sapiens
cgctgccaccacgtctgcca

SEQ ID NO: 755606 - DNA, 17 bp, Homo sapiens
cgctgccagcacagagc

SEQ ID NO: 755607 - DNA, 15 bp, Homo sapiens
cgctgccagctctgt

SEQ ID NO: 755608 - DNA, 22 bp, Homo sapiens
cgctgcccctccccgtccctgt

SEQ ID NO: 755609 - DNA, 18 bp, Homo sapiens
cgctgccgcaccccagag

SEQ ID NO: 755610 - DNA, 21 bp, Homo sapiens
cgctgccgcaccccagagtgt

SEQ ID NO: 755611 - DNA, 18 bp, Homo sapiens
cgctgccgctgcaccacg

SEQ ID NO: 755612 - DNA, 14 bp, Homo sapiens
cgctgcctcctgct

SEQ ID NO: 755613 - DNA, 18 bp, Homo sapiens
cgctgcctggtctgtctg

SEQ ID NO: 755614 - DNA, 21 bp, Homo sapiens
cgctgcctggtctgtctggat

SEQ ID NO: 755615 - DNA, 22 bp, Homo sapiens
cgctgcctttatcttgaagtca

SEQ ID NO: 755616 - DNA, 22 bp, Homo sapiens
cgctgcggacaccgtggcctgg

SEQ ID NO: 755617 - DNA, 23 bp, Homo sapiens
cgctgcggacaccgtggcctggg

SEQ ID NO: 755618 - DNA, 18 bp, Homo sapiens
cgctgctacatcagactc

SEQ ID NO: 755619 - DNA, 13 bp, Homo sapiens
cgctgcttccagg

SEQ ID NO: 755620 - DNA, 16 bp, Homo sapiens
cgctgcttccaggctg

SEQ ID NO: 755621 - DNA, 14 bp, Homo sapiens
cgctggagatgcaa

SEQ ID NO: 755622 - DNA, 15 bp, Homo sapiens
cgctggagcccacag

SEQ ID NO: 755623 - DNA, 17 bp, Homo sapiens
cgctggagcccacagcg

SEQ ID NO: 755624 - DNA, 21 bp, Homo sapiens
cgctggagcccacagcgagcc

SEQ ID NO: 755625 - DNA, 19 bp, Homo sapiens
cgctggaggatgtgggcag

SEQ ID NO: 755626 - DNA, 14 bp, Homo sapiens
cgctggcccagccg

SEQ ID NO: 755627 - DNA, 15 bp, Homo sapiens
cgctggcccagccgg

SEQ ID NO: 755628 - DNA, 23 bp, Homo sapiens
cgctggcccagccggcctctctg

SEQ ID NO: 755629 - DNA, 24 bp, Homo sapiens
cgctggcccagccggcctctctgg

SEQ ID NO: 755630 - DNA, 17 bp, Homo sapiens
cgctgggctgagcccct

SEQ ID NO: 755631 - DNA, 15 bp, Homo sapiens
cgctgggtgcctgca

SEQ ID NO: 755632 - DNA, 19 bp, Homo sapiens
cgctgggtggtaccctctg

SEQ ID NO: 755633 - DNA, 22 bp, Homo sapiens
cgctgtcaaggccgagggccag

SEQ ID NO: 755634 - DNA, 23 bp, Homo sapiens
cgctgtcaaggccgagggccagg

SEQ ID NO: 755635 - DNA, 10 bp, Homo sapiens
cgctgtcctg

SEQ ID NO: 755636 - DNA, 23 bp, Homo sapiens
cgctgtcctgcgttcagcccctg

SEQ ID NO: 755637 - DNA, 16 bp, Homo sapiens
cgctgtcgccccaggc

SEQ ID NO: 755638 - DNA, 23 bp, Homo sapiens
cgctgtcgccccaggccctccct

SEQ ID NO: 755639 - DNA, 14 bp, Homo sapiens
cgctgtctccagac

SEQ ID NO: 755640 - DNA, 20 bp, Homo sapiens
cgctgtctccagacccccac

SEQ ID NO: 755641 - DNA, 17 bp, Homo sapiens
cgctgtggactgtcctg

SEQ ID NO: 755642 - DNA, 18 bp, Homo sapiens
cgctgtggactgtcctga

SEQ ID NO: 755643 - DNA, 14 bp, Homo sapiens
cgctgttcacccac

SEQ ID NO: 755644 - DNA, 13 bp, Homo sapiens
cgcttagccccgc

SEQ ID NO: 755645 - DNA, 14 bp, Homo sapiens
cgcttagccccgct

SEQ ID NO: 755646 - DNA, 15 bp, Homo sapiens
cgcttagcgctctgg

SEQ ID NO: 755647 - DNA, 21 bp, Homo sapiens
cgcttatttggaaattttagt

SEQ ID NO: 755648 - DNA, 14 bp, Homo sapiens
cgcttcacccctgc

SEQ ID NO: 755649 - DNA, 14 bp, Homo sapiens
cgcttcctcagcct

SEQ ID NO: 755650 - DNA, 16 bp, Homo sapiens
cgcttctgctggagga

SEQ ID NO: 755651 - DNA, 22 bp, Homo sapiens
cgcttctggtctggtaaatatg

SEQ ID NO: 755652 - DNA, 12 bp, Homo sapiens
cgcttgagccca

SEQ ID NO: 755653 - DNA, 14 bp, Homo sapiens
cgcttgagcccagg

SEQ ID NO: 755654 - DNA, 18 bp, Homo sapiens
cgcttgcttttctgtatt

SEQ ID NO: 755655 - DNA, 12 bp, Homo sapiens
cgcttggatctg

SEQ ID NO: 755656 - DNA, 14 bp, Homo sapiens
cgcttggatctggg

SEQ ID NO: 755657 - DNA, 21 bp, Homo sapiens
cgcttgtagaactcactctgg

SEQ ID NO: 755658 - DNA, 17 bp, Homo sapiens
cgcttgtccagcgccta

SEQ ID NO: 755659 - DNA, 15 bp, Homo sapiens
cgcttgtgacagtgc

SEQ ID NO: 755660 - DNA, 19 bp, Homo sapiens
cgcttgtggggacccaggc

SEQ ID NO: 755661 - DNA, 22 bp, Homo sapiens
cgcttgtggggacccaggctcc

SEQ ID NO: 755662 - DNA, 17 bp, Homo sapiens
cgctttctacactgtat

SEQ ID NO: 755663 - DNA, 21 bp, Homo sapiens
cgctttgctgctaccgccctg

SEQ ID NO: 755664 - DNA, 16 bp, Homo sapiens
cgcttttgcagcagag

SEQ ID NO: 755665 - DNA, 23 bp, Homo sapiens
cgcttttgccattagccaaggat

SEQ ID NO: 755666 - DNA, 18 bp, Homo sapiens
cgcttttgttttcataat

SEQ ID NO: 755667 - DNA, 11 bp, Homo sapiens
cgctttttgaa

SEQ ID NO: 755668 - DNA, 16 bp, Homo sapiens
cgctttttgaaaaagc

SEQ ID NO: 755669 - DNA, 18 bp, Homo sapiens
cggaaaaaaaaaaagaaa

SEQ ID NO: 755670 - DNA, 19 bp, Homo sapiens
cggaaaaaaaaaaagaaaa

SEQ ID NO: 755671 - DNA, 21 bp, Homo sapiens
cggaaaaaaaaaaagaaaaaa

SEQ ID NO: 755672 - DNA, 11 bp, Homo sapiens
cggaaaacaat

SEQ ID NO: 755673 - DNA, 21 bp, Homo sapiens
cggaaaacggtggaggccagg

SEQ ID NO: 755674 - DNA, 15 bp, Homo sapiens
cggaaacaggtgtgt

SEQ ID NO: 755675 - DNA, 22 bp, Homo sapiens
cggaaacatacagaggatgcct

SEQ ID NO: 755676 - DNA, 18 bp, Homo sapiens
cggaaagaagagcgagag

SEQ ID NO: 755677 - DNA, 19 bp, Homo sapiens
cggaaagtgagagccagca

SEQ ID NO: 755678 - DNA, 22 bp, Homo sapiens
cggaaagtgagagccagcagca

SEQ ID NO: 755679 - DNA, 21 bp, Homo sapiens
cggaaccgctcacctagagcc

SEQ ID NO: 755680 - DNA, 13 bp, Homo sapiens
cggaactgggctg

SEQ ID NO: 755681 - DNA, 23 bp, Homo sapiens
cggaagcagtgccttccataatt

SEQ ID NO: 755682 - DNA, 18 bp, Homo sapiens
cggaagccatagggggct

SEQ ID NO: 755683 - DNA, 12 bp, Homo sapiens
cggaagcctgtc

SEQ ID NO: 755684 - DNA, 16 bp, Homo sapiens
cggaagcctgtcctca

SEQ ID NO: 755685 - DNA, 18 bp, Homo sapiens
cggaagcgccaggctgga

SEQ ID NO: 755686 - DNA, 19 bp, Homo sapiens
cggaagcgccaggctggag

SEQ ID NO: 755687 - DNA, 23 bp, Homo sapiens
cggaaggaatgtcagggccaggt

SEQ ID NO: 755688 - DNA, 12 bp, Homo sapiens
cggaaggaggcc

SEQ ID NO: 755689 - DNA, 22 bp, Homo sapiens
cggaaggaggccaaccagcccg

SEQ ID NO: 755690 - DNA, 18 bp, Homo sapiens
cggaaggctggctgggca

SEQ ID NO: 755691 - DNA, 23 bp, Homo sapiens
cggaagggctttggttccttctc

SEQ ID NO: 755692 - DNA, 21 bp, Homo sapiens
cggaatcactctgtccttgga

SEQ ID NO: 755693 - DNA, 22 bp, Homo sapiens
cggaatcctgtcgattagactg

SEQ ID NO: 755694 - DNA, 13 bp, Homo sapiens
cggaatttacctg

SEQ ID NO: 755695 - DNA, 19 bp, Homo sapiens
cggaatttacctgatttct

SEQ ID NO: 755696 - DNA, 16 bp, Homo sapiens
cggacaaaagggccag

SEQ ID NO: 755697 - DNA, 13 bp, Homo sapiens
cggacaaaatatc

SEQ ID NO: 755698 - DNA, 14 bp, Homo sapiens
cggacaccgtggcc

SEQ ID NO: 755699 - DNA, 18 bp, Homo sapiens
cggacaccgtggcctggg

SEQ ID NO: 755700 - DNA, 19 bp, Homo sapiens
cggacaccgtggcctgggc

SEQ ID NO: 755701 - DNA, 21 bp, Homo sapiens
cggacatgcttttctgccact

SEQ ID NO: 755702 - DNA, 16 bp, Homo sapiens
cggaccactcgaggcc

SEQ ID NO: 755703 - DNA, 12 bp, Homo sapiens
cggacccacccc

SEQ ID NO: 755704 - DNA, 20 bp, Homo sapiens
cggacccaccccaactctcc

SEQ ID NO: 755705 - DNA, 23 bp, Homo sapiens
cggacccaccccaactctcccca

SEQ ID NO: 755706 - DNA, 23 bp, Homo sapiens
cggacccccagagcacccccaag

SEQ ID NO: 755707 - DNA, 23 bp, Homo sapiens
cggacccccgtcagctgcttctg

SEQ ID NO: 755708 - DNA, 13 bp, Homo sapiens
cggacccttccca

SEQ ID NO: 755709 - DNA, 17 bp, Homo sapiens
cggacccttcccagccc

SEQ ID NO: 755710 - DNA, 12 bp, Homo sapiens
cggacctacctc

SEQ ID NO: 755711 - DNA, 21 bp, Homo sapiens
cggacctacctccctccctct

SEQ ID NO: 755712 - DNA, 20 bp, Homo sapiens
cggacggccaatggtgcttc

SEQ ID NO: 755713 - DNA, 22 bp, Homo sapiens
cggacggccaatggtgcttccc

SEQ ID NO: 755714 - DNA, 19 bp, Homo sapiens
cggacggggcaggcgctgc

SEQ ID NO: 755715 - DNA, 16 bp, Homo sapiens
cggacgtgctggcctt

SEQ ID NO: 755716 - DNA, 19 bp, Homo sapiens
cggactcaccaacttgcca

SEQ ID NO: 755717 - DNA, 22 bp, Homo sapiens
cggactcaccaacttgccacat

SEQ ID NO: 755718 - DNA, 23 bp, Homo sapiens
cggactcaccaacttgccacatg

SEQ ID NO: 755719 - DNA, 14 bp, Homo sapiens
cggactccatggct

SEQ ID NO: 755720 - DNA, 18 bp, Homo sapiens
cggactcccgggccacgc

SEQ ID NO: 755721 - DNA, 23 bp, Homo sapiens
cggactcccgggccacgccccag

SEQ ID NO: 755722 - DNA, 24 bp, Homo sapiens
cggactctcccaggcctgcctgca

SEQ ID NO: 755723 - DNA, 13 bp, Homo sapiens
cggactgaggtgc

SEQ ID NO: 755724 - DNA, 16 bp, Homo sapiens
cggactgaggtgcctg

SEQ ID NO: 755725 - DNA, 12 bp, Homo sapiens
cggactgccaaa

SEQ ID NO: 755726 - DNA, 22 bp, Homo sapiens
cggagaaactcatcatttttat

SEQ ID NO: 755727 - DNA, 12 bp, Homo sapiens
cggagacagggt

SEQ ID NO: 755728 - DNA, 15 bp, Homo sapiens
cggagacagtgatct

SEQ ID NO: 755729 - DNA, 14 bp, Homo sapiens
cggagacctcctga

SEQ ID NO: 755730 - DNA, 14 bp, Homo sapiens
cggagagctggtga

SEQ ID NO: 755731 - DNA, 14 bp, Homo sapiens
cggagaggccactg

SEQ ID NO: 755732 - DNA, 19 bp, Homo sapiens
cggagagggctagccctga

SEQ ID NO: 755733 - DNA, 21 bp, Homo sapiens
cggagagggctagccctgagc

SEQ ID NO: 755734 - DNA, 22 bp, Homo sapiens
cggagagggctagccctgagcc

SEQ ID NO: 755735 - DNA, 23 bp, Homo sapiens
cggagagggctagccctgagccc

SEQ ID NO: 755736 - DNA, 17 bp, Homo sapiens
cggagagtacagtgagc

SEQ ID NO: 755737 - DNA, 18 bp, Homo sapiens
cggagagtacagtgagcc

SEQ ID NO: 755738 - DNA, 19 bp, Homo sapiens
cggagattggacggcctga

SEQ ID NO: 755739 - DNA, 15 bp, Homo sapiens
cggagcacagccctg

SEQ ID NO: 755740 - DNA, 16 bp, Homo sapiens
cggagcagcaggaagg

SEQ ID NO: 755741 - DNA, 15 bp, Homo sapiens
cggagcatcccggag

SEQ ID NO: 755742 - DNA, 16 bp, Homo sapiens
cggagcatcccggagg

SEQ ID NO: 755743 - DNA, 17 bp, Homo sapiens
cggagccatcaccctca

SEQ ID NO: 755744 - DNA, 13 bp, Homo sapiens
cggagcccagcct

SEQ ID NO: 755745 - DNA, 19 bp, Homo sapiens
cggagcccagcctgggagc

SEQ ID NO: 755746 - DNA, 13 bp, Homo sapiens
cggagccctcaga

SEQ ID NO: 755747 - DNA, 20 bp, Homo sapiens
cggagcctcatccgaggcag

SEQ ID NO: 755748 - DNA, 19 bp, Homo sapiens
cggagcctcatgttctctt

SEQ ID NO: 755749 - DNA, 21 bp, Homo sapiens
cggagcctgtgttagtgtctg

SEQ ID NO: 755750 - DNA, 20 bp, Homo sapiens
cggagcgttctctgtcctac

SEQ ID NO: 755751 - DNA, 17 bp, Homo sapiens
cggagctaacactggcc

SEQ ID NO: 755752 - DNA, 13 bp, Homo sapiens
cggagctgcctgc

SEQ ID NO: 755753 - DNA, 16 bp, Homo sapiens
cggagctgcctgcagc

SEQ ID NO: 755754 - DNA, 16 bp, Homo sapiens
cggagctggccccgcc

SEQ ID NO: 755755 - DNA, 22 bp, Homo sapiens
cggagctggttcctctctccca

SEQ ID NO: 755756 - DNA, 19 bp, Homo sapiens
cggagcttcggggcctcct

SEQ ID NO: 755757 - DNA, 21 bp, Homo sapiens
cggaggaaggaggacccagga

SEQ ID NO: 755758 - DNA, 14 bp, Homo sapiens
cggaggactgagcc

SEQ ID NO: 755759 - DNA, 16 bp, Homo sapiens
cggaggactgagcccc

SEQ ID NO: 755760 - DNA, 13 bp, Homo sapiens
cggaggagcagcc

SEQ ID NO: 755761 - DNA, 14 bp, Homo sapiens
cggaggagcagcct

SEQ ID NO: 755762 - DNA, 15 bp, Homo sapiens
cggaggagcagcctc

SEQ ID NO: 755763 - DNA, 23 bp, Homo sapiens
cggaggagcagcctcgaggctgg

SEQ ID NO: 755764 - DNA, 22 bp, Homo sapiens
cggaggaggagggaggccaggc

SEQ ID NO: 755765 - DNA, 23 bp, Homo sapiens
cggaggaggagggaggccaggcg

SEQ ID NO: 755766 - DNA, 21 bp, Homo sapiens
cggaggccttggggtgggggc

SEQ ID NO: 755767 - DNA, 23 bp, Homo sapiens
cggaggccttggggtgggggcca

SEQ ID NO: 755768 - DNA, 19 bp, Homo sapiens
cggaggctcggccgtgggc

SEQ ID NO: 755769 - DNA, 14 bp, Homo sapiens
cggaggctgggccc

SEQ ID NO: 755770 - DNA, 18 bp, Homo sapiens
cggaggctgggcccctgg

SEQ ID NO: 755771 - DNA, 14 bp, Homo sapiens
cggaggctgtgctc

SEQ ID NO: 755772 - DNA, 12 bp, Homo sapiens
cggaggctgtgt

SEQ ID NO: 755773 - DNA, 18 bp, Homo sapiens
cggaggcttgtcagagct

SEQ ID NO: 755774 - DNA, 20 bp, Homo sapiens
cggaggcttgtcagagctgg

SEQ ID NO: 755775 - DNA, 15 bp, Homo sapiens
cggagggaggcacca

SEQ ID NO: 755776 - DNA, 17 bp, Homo sapiens
cggagggatggagaaag

SEQ ID NO: 755777 - DNA, 14 bp, Homo sapiens
cggaggggacccag

SEQ ID NO: 755778 - DNA, 11 bp, Homo sapiens
cggaggggagt

SEQ ID NO: 755779 - DNA, 16 bp, Homo sapiens
cggaggggcctggcag

SEQ ID NO: 755780 - DNA, 21 bp, Homo sapiens
cggagggggacggggctcagc

SEQ ID NO: 755781 - DNA, 23 bp, Homo sapiens
cggagggggtcctcctcgctcct

SEQ ID NO: 755782 - DNA, 23 bp, Homo sapiens
cggagggtgggggccacctgcct

SEQ ID NO: 755783 - DNA, 20 bp, Homo sapiens
cggaggtccccggttgctgg

SEQ ID NO: 755784 - DNA, 16 bp, Homo sapiens
cggaggtgtggagccg

SEQ ID NO: 755785 - DNA, 13 bp, Homo sapiens
cggaggttgcagg

SEQ ID NO: 755786 - DNA, 22 bp, Homo sapiens
cggaggttgcagtgagctgaga

SEQ ID NO: 755787 - DNA, 19 bp, Homo sapiens
cggagtgaagaggggcagc

SEQ ID NO: 755788 - DNA, 14 bp, Homo sapiens
cggagtgcggacca

SEQ ID NO: 755789 - DNA, 13 bp, Homo sapiens
cggagtggacacc

SEQ ID NO: 755790 - DNA, 18 bp, Homo sapiens
cggagtggacaccgctca

SEQ ID NO: 755791 - DNA, 20 bp, Homo sapiens
cggagtggacaccgctcagt

SEQ ID NO: 755792 - DNA, 19 bp, Homo sapiens
cggagtggggggacagaga

SEQ ID NO: 755793 - DNA, 18 bp, Homo sapiens
cggagtgtctggaattgt

SEQ ID NO: 755794 - DNA, 15 bp, Homo sapiens
gccatgtacctcccc

SEQ ID NO: 755795 - DNA, 16 bp, Homo sapiens
gccatgtacctcccct

SEQ ID NO: 755796 - DNA, 23 bp, Homo sapiens
gccatgtatttcagggacctcag

SEQ ID NO: 755797 - DNA, 15 bp, Homo sapiens
gccatgtcagacaca

SEQ ID NO: 755798 - DNA, 19 bp, Homo sapiens
gccatgtccaaagaggctg

SEQ ID NO: 755799 - DNA, 19 bp, Homo sapiens
gccatgtcgccaaaaatac

SEQ ID NO: 755800 - DNA, 15 bp, Homo sapiens
gccatgtgaagaggg

SEQ ID NO: 755801 - DNA, 18 bp, Homo sapiens
gccatgtgagccaccgct

SEQ ID NO: 755802 - DNA, 20 bp, Homo sapiens
gccatgtgagccaccgctgc

SEQ ID NO: 755803 - DNA, 19 bp, Homo sapiens
gccatgtggcctgcccagc

SEQ ID NO: 755804 - DNA, 15 bp, Homo sapiens
gccatgttgcccctt

SEQ ID NO: 755805 - DNA, 20 bp, Homo sapiens
gccatgtttagattccagga

SEQ ID NO: 755806 - DNA, 14 bp, Homo sapiens
gccatgtttagtga

SEQ ID NO: 755807 - DNA, 23 bp, Homo sapiens
gccatgtttagtgaatgactttt

SEQ ID NO: 755808 - DNA, 16 bp, Homo sapiens
gccatgtttttgccaa

SEQ ID NO: 755809 - DNA, 14 bp, Homo sapiens
gccattaaaataaa

SEQ ID NO: 755810 - DNA, 15 bp, Homo sapiens
gccattaaaataaaa

SEQ ID NO: 755811 - DNA, 21 bp, Homo sapiens
gccattaaaataaaacaagcc

SEQ ID NO: 755812 - DNA, 14 bp, Homo sapiens
gccattaacaaatg

SEQ ID NO: 755813 - DNA, 13 bp, Homo sapiens
gccattaccatgg

SEQ ID NO: 755814 - DNA, 16 bp, Homo sapiens
gccattaccatggaga

SEQ ID NO: 755815 - DNA, 18 bp, Homo sapiens
gccattaccatggagaca

SEQ ID NO: 755816 - DNA, 10 bp, Homo sapiens
gccattaccc

SEQ ID NO: 755817 - DNA, 17 bp, Homo sapiens
gccattactactgtaca

SEQ ID NO: 755818 - DNA, 22 bp, Homo sapiens
gccattatatttgcattatgta

SEQ ID NO: 755819 - DNA, 23 bp, Homo sapiens
gccattatatttgcattatgtat

SEQ ID NO: 755820 - DNA, 17 bp, Homo sapiens
gccattattttctgtca

SEQ ID NO: 755821 - DNA, 19 bp, Homo sapiens
gccattattttctgtcaga

SEQ ID NO: 755822 - DNA, 20 bp, Homo sapiens
gccattattttctgtcagat

SEQ ID NO: 755823 - DNA, 21 bp, Homo sapiens
gccattcacttcataatccag

SEQ ID NO: 755824 - DNA, 22 bp, Homo sapiens
gccattccaagtcaacactctt

SEQ ID NO: 755825 - DNA, 20 bp, Homo sapiens
gccattgaacagctgtgagc

SEQ ID NO: 755826 - DNA, 16 bp, Homo sapiens
gccattgcactccagc

SEQ ID NO: 755827 - DNA, 19 bp, Homo sapiens
gccattgccaccaggagaa

SEQ ID NO: 755828 - DNA, 16 bp, Homo sapiens
gccattgccaggagat

SEQ ID NO: 755829 - DNA, 23 bp, Homo sapiens
gccattgccaggagatggcccca

SEQ ID NO: 755830 - DNA, 13 bp, Homo sapiens
gccattggcctct

SEQ ID NO: 755831 - DNA, 14 bp, Homo sapiens
gccattggcctctt

SEQ ID NO: 755832 - DNA, 12 bp, Homo sapiens
gccattgggttt

SEQ ID NO: 755833 - DNA, 18 bp, Homo sapiens
gccattggtccacccttt

SEQ ID NO: 755834 - DNA, 17 bp, Homo sapiens
gccattgtactccagcc

SEQ ID NO: 755835 - DNA, 18 bp, Homo sapiens
gccattgtactccagcct

SEQ ID NO: 755836 - DNA, 20 bp, Homo sapiens
gccattgtactccagcctgg

SEQ ID NO: 755837 - DNA, 12 bp, Homo sapiens
gccattgtgaac

SEQ ID NO: 755838 - DNA, 22 bp, Homo sapiens
gccatttatacctttgaaatat

SEQ ID NO: 755839 - DNA, 11 bp, Homo sapiens
gccatttcatg

SEQ ID NO: 755840 - DNA, 18 bp, Homo sapiens
gccatttccccctcctca

SEQ ID NO: 755841 - DNA, 19 bp, Homo sapiens
gccatttctccatgggcca

SEQ ID NO: 755842 - DNA, 13 bp, Homo sapiens
gccatttctctgc

SEQ ID NO: 755843 - DNA, 20 bp, Homo sapiens
gccatttcttctctctgttc

SEQ ID NO: 755844 - DNA, 11 bp, Homo sapiens
gccatttgaga

SEQ ID NO: 755845 - DNA, 12 bp, Homo sapiens
gccatttgcaat

SEQ ID NO: 755846 - DNA, 17 bp, Homo sapiens
gccatttgcaataacag

SEQ ID NO: 755847 - DNA, 14 bp, Homo sapiens
gccattttaaaatg

SEQ ID NO: 755848 - DNA, 19 bp, Homo sapiens
gccatttttcaaagcaatt

SEQ ID NO: 755849 - DNA, 18 bp, Homo sapiens
gccatttttctataaatc

SEQ ID NO: 755850 - DNA, 18 bp, Homo sapiens
gcccaaaacccagggcaa

SEQ ID NO: 755851 - DNA, 20 bp, Homo sapiens
gcccaaaagaggtgtcatgc

SEQ ID NO: 755852 - DNA, 19 bp, Homo sapiens
gcccaaacagctgtattta

SEQ ID NO: 755853 - DNA, 21 bp, Homo sapiens
gcccaaacagctgtatttata

SEQ ID NO: 755854 - DNA, 16 bp, Homo sapiens
gcccaaacccttaact

SEQ ID NO: 755855 - DNA, 20 bp, Homo sapiens
gcccaaacccttaactgaca

SEQ ID NO: 755856 - DNA, 20 bp, Homo sapiens
gcccaaaccttgggccctgg

SEQ ID NO: 755857 - DNA, 16 bp, Homo sapiens
gcccaaactccccttc

SEQ ID NO: 755858 - DNA, 20 bp, Homo sapiens
gcccaaactccccttccctg

SEQ ID NO: 755859 - DNA, 17 bp, Homo sapiens
gcccaaagccagacagc

SEQ ID NO: 755860 - DNA, 15 bp, Homo sapiens
gcccaaaggcccagg

SEQ ID NO: 755861 - DNA, 19 bp, Homo sapiens
gcccaaaggcccagggagg

SEQ ID NO: 755862 - DNA, 19 bp, Homo sapiens
gcccaaagtggtatagaaa

SEQ ID NO: 755863 - DNA, 10 bp, Homo sapiens
gcccaaatga

SEQ ID NO: 755864 - DNA, 19 bp, Homo sapiens
gcccaaatgtcagggttct

SEQ ID NO: 755865 - DNA, 15 bp, Homo sapiens
gcccaaccaggccct

SEQ ID NO: 755866 - DNA, 15 bp, Homo sapiens
gcccaacccttcccc

SEQ ID NO: 755867 - DNA, 16 bp, Homo sapiens
gcccaacccttcccca

SEQ ID NO: 755868 - DNA, 23 bp, Homo sapiens
gcccaaccggggagcccccgccc

SEQ ID NO: 755869 - DNA, 17 bp, Homo sapiens
gcccaagaactgcagat

SEQ ID NO: 755870 - DNA, 21 bp, Homo sapiens
gcccaagaatagatgctgact

SEQ ID NO: 755871 - DNA, 20 bp, Homo sapiens
gcccaagacagatgccccag

SEQ ID NO: 755872 - DNA, 21 bp, Homo sapiens
gcccaagacagatgccccaga

SEQ ID NO: 755873 - DNA, 23 bp, Homo sapiens
gcccaagacagatgccccagagc

SEQ ID NO: 755874 - DNA, 16 bp, Homo sapiens
gcccaagactgggctg

SEQ ID NO: 755875 - DNA, 13 bp, Homo sapiens
gcccaagagcaga

SEQ ID NO: 755876 - DNA, 22 bp, Homo sapiens
gcccaagagcagagtctgggcc

SEQ ID NO: 755877 - DNA, 18 bp, Homo sapiens
gcccaagagccctgtggc

SEQ ID NO: 755878 - DNA, 21 bp, Homo sapiens
gcccaagagccctgtggccgc

SEQ ID NO: 755879 - DNA, 17 bp, Homo sapiens
gcccaagaggactgaga

SEQ ID NO: 755880 - DNA, 18 bp, Homo sapiens
gcccaagaggtctgagcc

SEQ ID NO: 755881 - DNA, 13 bp, Homo sapiens
gcccaagccctga

SEQ ID NO: 755882 - DNA, 22 bp, Homo sapiens
gcccaagcttaatagccctccc

SEQ ID NO: 755883 - DNA, 20 bp, Homo sapiens
gcccaagcttccctccatcc

SEQ ID NO: 755884 - DNA, 15 bp, Homo sapiens
gcccaagggatggca

SEQ ID NO: 755885 - DNA, 18 bp, Homo sapiens
gcccaagggatggcacca

SEQ ID NO: 755886 - DNA, 22 bp, Homo sapiens
gcccaagggcctcccaccagag

SEQ ID NO: 755887 - DNA, 21 bp, Homo sapiens
gcccaaggggcttcgttttca

SEQ ID NO: 755888 - DNA, 15 bp, Homo sapiens
gcccaaggtcccctc

SEQ ID NO: 755889 - DNA, 19 bp, Homo sapiens
gcccaagtgaccagggaag

SEQ ID NO: 755890 - DNA, 22 bp, Homo sapiens
gcccaagtgggcagtcaccacc

SEQ ID NO: 755891 - DNA, 20 bp, Homo sapiens
gcccaatgctttgggaggcc

SEQ ID NO: 755892 - DNA, 20 bp, Homo sapiens
gcccacaacttgtcacccaa

SEQ ID NO: 755893 - DNA, 22 bp, Homo sapiens
gcccacaatccctttctaagga

SEQ ID NO: 755894 - DNA, 15 bp, Homo sapiens
gcccacagagcctgg

SEQ ID NO: 755895 - DNA, 16 bp, Homo sapiens
gcccacagagcctggc

SEQ ID NO: 755896 - DNA, 18 bp, Homo sapiens
gcccacagagcctggctt

SEQ ID NO: 755897 - DNA, 15 bp, Homo sapiens
gcccacagcgagcct

SEQ ID NO: 755898 - DNA, 19 bp, Homo sapiens
gcccacagcgagcctgtgc

SEQ ID NO: 755899 - DNA, 20 bp, Homo sapiens
gcccacagcgagcctgtgcc

SEQ ID NO: 755900 - DNA, 13 bp, Homo sapiens
gcccacagctccc

SEQ ID NO: 755901 - DNA, 17 bp, Homo sapiens
gcccacagctcccaccc

SEQ ID NO: 755902 - DNA, 12 bp, Homo sapiens
gcccacagggaa

SEQ ID NO: 755903 - DNA, 17 bp, Homo sapiens
gcccacagtatatttta

SEQ ID NO: 755904 - DNA, 20 bp, Homo sapiens
gcccacatagtgatggttcc

SEQ ID NO: 755905 - DNA, 15 bp, Homo sapiens
gcccacatcccaggc

SEQ ID NO: 755906 - DNA, 19 bp, Homo sapiens
gcccacatgggacctggcc

SEQ ID NO: 755907 - DNA, 15 bp, Homo sapiens
gcccacatttgggct

SEQ ID NO: 755908 - DNA, 23 bp, Homo sapiens
gcccacatttgggctcagggttg

SEQ ID NO: 755909 - DNA, 21 bp, Homo sapiens
gcccaccagacgtcaggccct

SEQ ID NO: 755910 - DNA, 17 bp, Homo sapiens
gcccaccagccagccct

SEQ ID NO: 755911 - DNA, 19 bp, Homo sapiens
gcccaccagccagccctgg

SEQ ID NO: 755912 - DNA, 20 bp, Homo sapiens
gcccaccagccagccctggc

SEQ ID NO: 755913 - DNA, 21 bp, Homo sapiens
gcccaccagccagccctggcc

SEQ ID NO: 755914 - DNA, 13 bp, Homo sapiens
gcccacccacgca

SEQ ID NO: 755915 - DNA, 16 bp, Homo sapiens
gcccacccagggagct

SEQ ID NO: 755916 - DNA, 15 bp, Homo sapiens
gcccacccaggtccc

SEQ ID NO: 755917 - DNA, 13 bp, Homo sapiens
gcccacccccacc

SEQ ID NO: 755918 - DNA, 13 bp, Homo sapiens
gcaggcagcgcag

SEQ ID NO: 755919 - DNA, 18 bp, Homo sapiens
gcaggcaggaacaaacag

SEQ ID NO: 755920 - DNA, 22 bp, Homo sapiens
gcaggcaggaacaaacagggct

SEQ ID NO: 755921 - DNA, 16 bp, Homo sapiens
gcaggcaggcggctcc

SEQ ID NO: 755922 - DNA, 14 bp, Homo sapiens
gcaggcagggagaa

SEQ ID NO: 755923 - DNA, 17 bp, Homo sapiens
gcaggcagggagaaggg

SEQ ID NO: 755924 - DNA, 12 bp, Homo sapiens
gcaggcaggggc

SEQ ID NO: 755925 - DNA, 20 bp, Homo sapiens
gcaggcaggtgtttattaaa

SEQ ID NO: 755926 - DNA, 17 bp, Homo sapiens
gcaggcattgctttgcc

SEQ ID NO: 755927 - DNA, 24 bp, Homo sapiens
gcaggccaagagcagaggcagcga

SEQ ID NO: 755928 - DNA, 21 bp, Homo sapiens
gcaggccacccgggctgcctg

SEQ ID NO: 755929 - DNA, 15 bp, Homo sapiens
gcaggccaggccagc

SEQ ID NO: 755930 - DNA, 17 bp, Homo sapiens
gcaggccaggccagctg

SEQ ID NO: 755931 - DNA, 15 bp, Homo sapiens
gcaggcccagcatgc

SEQ ID NO: 755932 - DNA, 11 bp, Homo sapiens
gcaggccctcc

SEQ ID NO: 755933 - DNA, 15 bp, Homo sapiens
gcaggccctccctct

SEQ ID NO: 755934 - DNA, 15 bp, Homo sapiens
gcaggccctggcctc

SEQ ID NO: 755935 - DNA, 13 bp, Homo sapiens
gcaggccctgtcc

SEQ ID NO: 755936 - DNA, 17 bp, Homo sapiens
gcaggccctgtccagcc

SEQ ID NO: 755937 - DNA, 18 bp, Homo sapiens
gcaggccctgtccagccc

SEQ ID NO: 755938 - DNA, 15 bp, Homo sapiens
gcaggcctaagacat

SEQ ID NO: 755939 - DNA, 22 bp, Homo sapiens
gcaggcctccaacgcccctgtg

SEQ ID NO: 755940 - DNA, 19 bp, Homo sapiens
gcaggcctccgtcttccca

SEQ ID NO: 755941 - DNA, 14 bp, Homo sapiens
gcaggcctgaccca

SEQ ID NO: 755942 - DNA, 22 bp, Homo sapiens
gcaggcctgagaatgagtggga

SEQ ID NO: 755943 - DNA, 15 bp, Homo sapiens
gcaggccttgctggg

SEQ ID NO: 755944 - DNA, 19 bp, Homo sapiens
gcaggccttgctggggtcc

SEQ ID NO: 755945 - DNA, 21 bp, Homo sapiens
gcaggcgatccccgcttcccc

SEQ ID NO: 755946 - DNA, 22 bp, Homo sapiens
gcaggcgatggggcaagacaga

SEQ ID NO: 755947 - DNA, 12 bp, Homo sapiens
gcaggcggccag

SEQ ID NO: 755948 - DNA, 15 bp, Homo sapiens
gcaggcggccctcag

SEQ ID NO: 755949 - DNA, 22 bp, Homo sapiens
gcaggcggccctcagtgcatcc

SEQ ID NO: 755950 - DNA, 16 bp, Homo sapiens
gcaggcggctcctcct

SEQ ID NO: 755951 - DNA, 20 bp, Homo sapiens
gcaggcgggcccatgaagaa

SEQ ID NO: 755952 - DNA, 19 bp, Homo sapiens
gcaggcgggccggggcagg

SEQ ID NO: 755953 - DNA, 23 bp, Homo sapiens
gcaggcgggccggggcagggact

SEQ ID NO: 755954 - DNA, 14 bp, Homo sapiens
gcaggcggtcccca

SEQ ID NO: 755955 - DNA, 24 bp, Homo sapiens
gcaggcggtccccatccccaccag

SEQ ID NO: 755956 - DNA, 15 bp, Homo sapiens
gcaggcgtgtggcag

SEQ ID NO: 755957 - DNA, 17 bp, Homo sapiens
gcaggcgtgtggcagcc

SEQ ID NO: 755958 - DNA, 18 bp, Homo sapiens
gcaggcgtgtggcagcca

SEQ ID NO: 755959 - DNA, 19 bp, Homo sapiens
gcaggcgtgtggcagccac

SEQ ID NO: 755960 - DNA, 18 bp, Homo sapiens
gcaggctcactgccaggc

SEQ ID NO: 755961 - DNA, 23 bp, Homo sapiens
gcaggctcactgccaggccagcc

SEQ ID NO: 755962 - DNA, 18 bp, Homo sapiens
gcaggctcctggctgtgc

SEQ ID NO: 755963 - DNA, 20 bp, Homo sapiens
gcaggctcctggctgtgccc

SEQ ID NO: 755964 - DNA, 23 bp, Homo sapiens
gcaggctcctggctgtgcccagc

SEQ ID NO: 755965 - DNA, 13 bp, Homo sapiens
gcaggctctctcc

SEQ ID NO: 755966 - DNA, 20 bp, Homo sapiens
gcaggctctgggctcagggc

SEQ ID NO: 755967 - DNA, 21 bp, Homo sapiens
gcagtacatacgtctgccagg

SEQ ID NO: 755968 - DNA, 23 bp, Homo sapiens
gcagtaccctccattgggcacag

SEQ ID NO: 755969 - DNA, 17 bp, Homo sapiens
gcagtagaactccaggc

SEQ ID NO: 755970 - DNA, 18 bp, Homo sapiens
gcagtagagtcatctcca

SEQ ID NO: 755971 - DNA, 20 bp, Homo sapiens
gcagtagagtcatctccatc

SEQ ID NO: 755972 - DNA, 15 bp, Homo sapiens
gcagtagatgtgctt

SEQ ID NO: 755973 - DNA, 12 bp, Homo sapiens
gcagtagtctct

SEQ ID NO: 755974 - DNA, 17 bp, Homo sapiens
gcagtatataataactt

SEQ ID NO: 755975 - DNA, 18 bp, Homo sapiens
gcagtatataataacttt

SEQ ID NO: 755976 - DNA, 18 bp, Homo sapiens
gcagtatctcttacatca

SEQ ID NO: 755977 - DNA, 12 bp, Homo sapiens
gcagtcaccacc

SEQ ID NO: 755978 - DNA, 18 bp, Homo sapiens
gcagtcaccacccagccc

SEQ ID NO: 755979 - DNA, 23 bp, Homo sapiens
gcagtcactggaggttgaagcca

SEQ ID NO: 755980 - DNA, 19 bp, Homo sapiens
gcagtcagcagatgctgtt

SEQ ID NO: 755981 - DNA, 17 bp, Homo sapiens
gcagtcagggtgggaag

SEQ ID NO: 755982 - DNA, 14 bp, Homo sapiens
gcagtcatctactt

SEQ ID NO: 755983 - DNA, 16 bp, Homo sapiens
gcagtccagagctttt

SEQ ID NO: 755984 - DNA, 18 bp, Homo sapiens
gcagtccagagcttttca

SEQ ID NO: 755985 - DNA, 20 bp, Homo sapiens
gcagtccagagcttttcagc

SEQ ID NO: 755986 - DNA, 23 bp, Homo sapiens
gcagtccaggcctctctctgctc

SEQ ID NO: 755987 - DNA, 13 bp, Homo sapiens
gcagtcccacact

SEQ ID NO: 755988 - DNA, 18 bp, Homo sapiens
gcagtcccacactgtgca

SEQ ID NO: 755989 - DNA, 21 bp, Homo sapiens
gcagtcccagtattctcagag

SEQ ID NO: 755990 - DNA, 23 bp, Homo sapiens
gcagtcccattcatattaagaca

SEQ ID NO: 755991 - DNA, 13 bp, Homo sapiens
gcagtccccagcc

SEQ ID NO: 755992 - DNA, 18 bp, Homo sapiens
gcagtcccgggagaaaag

SEQ ID NO: 755993 - DNA, 15 bp, Homo sapiens
gcagtcctccggggt

SEQ ID NO: 755994 - DNA, 18 bp, Homo sapiens
gcagtcctggaagccagc

SEQ ID NO: 755995 - DNA, 20 bp, Homo sapiens
gcagtcctggaagccagctt

SEQ ID NO: 755996 - DNA, 14 bp, Homo sapiens
gcagtcctgtgtga

SEQ ID NO: 755997 - DNA, 13 bp, Homo sapiens
gcagtcctgttca

SEQ ID NO: 755998 - DNA, 15 bp, Homo sapiens
gcagtcctgttcaaa

SEQ ID NO: 755999 - DNA, 14 bp, Homo sapiens
gcagtccttactcc

SEQ ID NO: 756000 - DNA, 15 bp, Homo sapiens
gcagtcctttgtaaa

SEQ ID NO: 756001 - DNA, 22 bp, Homo sapiens
gcagtcctttgtaaacagtgtt

SEQ ID NO: 756002 - DNA, 12 bp, Homo sapiens
gcagtcgcagga

SEQ ID NO: 756003 - DNA, 17 bp, Homo sapiens
gcagtcgggggctggcc

SEQ ID NO: 756004 - DNA, 23 bp, Homo sapiens
gcagtcgggggctggcctaggag

SEQ ID NO: 756005 - DNA, 16 bp, Homo sapiens
gcagtcgtgcctgtgt

SEQ ID NO: 756006 - DNA, 17 bp, Homo sapiens
gcagtcgtgcctgtgtc

SEQ ID NO: 756007 - DNA, 15 bp, Homo sapiens
gcagtctaccctgtc

SEQ ID NO: 756008 - DNA, 14 bp, Homo sapiens
gcagtctgctctgc

SEQ ID NO: 756009 - DNA, 18 bp, Homo sapiens
gcagtgacgtgcacctgt

SEQ ID NO: 756010 - DNA, 13 bp, Homo sapiens
gcagtgactttgt

SEQ ID NO: 756011 - DNA, 18 bp, Homo sapiens
gcagtgagcagggtgggg

SEQ ID NO: 756012 - DNA, 23 bp, Homo sapiens
gcagtgagccgagattgcaccac

SEQ ID NO: 756013 - DNA, 14 bp, Homo sapiens
gcagtgagctgaga

SEQ ID NO: 756014 - DNA, 21 bp, Homo sapiens
gcagtgaggggccctccatgc

SEQ ID NO: 756015 - DNA, 23 bp, Homo sapiens
gcagtgaggggccctccatgcgc

SEQ ID NO: 756016 - DNA, 18 bp, Homo sapiens
gcagtgagtctcttcaga

SEQ ID NO: 756017 - DNA, 20 bp, Homo sapiens
gcagtgagttacagcgagag

SEQ ID NO: 756018 - DNA, 17 bp, Homo sapiens
gcagtgagttgggattg

SEQ ID NO: 756019 - DNA, 14 bp, Homo sapiens
gcagtgatctcagg

SEQ ID NO: 756020 - DNA, 19 bp, Homo sapiens
gcagtgatctcagggcaga

SEQ ID NO: 756021 - DNA, 13 bp, Homo sapiens
gcagtgcacattt

SEQ ID NO: 756022 - DNA, 17 bp, Homo sapiens
gcagtgcatgcatgttg

SEQ ID NO: 756023 - DNA, 20 bp, Homo sapiens
gcagtgcatgtgaagcatgc

SEQ ID NO: 756024 - DNA, 19 bp, Homo sapiens
gcagtgccacagcctgctg

SEQ ID NO: 756025 - DNA, 20 bp, Homo sapiens
gcagtgccacagcctgctgg

SEQ ID NO: 756026 - DNA, 22 bp, Homo sapiens
gcagtgccacagcctgctggca

SEQ ID NO: 756027 - DNA, 23 bp, Homo sapiens
gcagtgccacagcctgctggcag

SEQ ID NO: 756028 - DNA, 12 bp, Homo sapiens
gcagtgccagcc

SEQ ID NO: 756029 - DNA, 15 bp, Homo sapiens
gcagtgccagccaat

SEQ ID NO: 756030 - DNA, 18 bp, Homo sapiens
gcagtgcccatgtgtaca

SEQ ID NO: 756031 - DNA, 19 bp, Homo sapiens
gcagtgcccatgtgtacat

SEQ ID NO: 756032 - DNA, 16 bp, Homo sapiens
gcagtgccccagggag

SEQ ID NO: 756033 - DNA, 13 bp, Homo sapiens
gcagtgccctttg

SEQ ID NO: 756034 - DNA, 20 bp, Homo sapiens
gcagtgcctcgaggcaccgg

SEQ ID NO: 756035 - DNA, 14 bp, Homo sapiens
gcagtgcctggagt

SEQ ID NO: 756036 - DNA, 15 bp, Homo sapiens
gcagtgccttccata

SEQ ID NO: 756037 - DNA, 16 bp, Homo sapiens
gcagtgccttccataa

SEQ ID NO: 756038 - DNA, 15 bp, Homo sapiens
gcagtgccttgggga

SEQ ID NO: 756039 - DNA, 21 bp, Homo sapiens
gcagtgctgatccggctgctc

SEQ ID NO: 756040 - DNA, 15 bp, Homo sapiens
gcagtggacaccagg

SEQ ID NO: 756041 - DNA, 14 bp, Homo sapiens
gcagtggaggtggg

SEQ ID NO: 756042 - DNA, 23 bp, Homo sapiens
gcagtggaggtggggtgtttggg

SEQ ID NO: 756043 - DNA, 16 bp, Homo sapiens
gcagtggccaagcctg

SEQ ID NO: 756044 - DNA, 18 bp, Homo sapiens
gcagtggccaagcctgct

SEQ ID NO: 756045 - DNA, 12 bp, Homo sapiens
gcagtggccacg

SEQ ID NO: 756046 - DNA, 23 bp, Homo sapiens
gcagtggctctcagagcagcaga

SEQ ID NO: 756047 - DNA, 14 bp, Homo sapiens
gcagtggcttttca

SEQ ID NO: 756048 - DNA, 23 bp, Homo sapiens
cctggctccccacgagtcacctg

SEQ ID NO: 756049 - DNA, 16 bp, Homo sapiens
cctggctccccgaggg

SEQ ID NO: 756050 - DNA, 21 bp, Homo sapiens
cctggctccccgagggctcag

SEQ ID NO: 756051 - DNA, 18 bp, Homo sapiens
cctggctccctcccgtag

SEQ ID NO: 756052 - DNA, 22 bp, Homo sapiens
cctggctccctcctccaggcct

SEQ ID NO: 756053 - DNA, 17 bp, Homo sapiens
cctggctcctccgtctg

SEQ ID NO: 756054 - DNA, 23 bp, Homo sapiens
cctggctcctgaggggcatctgc

SEQ ID NO: 756055 - DNA, 19 bp, Homo sapiens
cctggctccttgcagcagg

SEQ ID NO: 756056 - DNA, 19 bp, Homo sapiens
cctggctctgccccctccc

SEQ ID NO: 756057 - DNA, 13 bp, Homo sapiens
cctggctctgggg

SEQ ID NO: 756058 - DNA, 20 bp, Homo sapiens
cctggctctgggggacccag

SEQ ID NO: 756059 - DNA, 22 bp, Homo sapiens
cctggctctgggggacccaggt

SEQ ID NO: 756060 - DNA, 23 bp, Homo sapiens
cctggctgaccccaaagagcctg

SEQ ID NO: 756061 - DNA, 16 bp, Homo sapiens
cctggctgaggttcct

SEQ ID NO: 756062 - DNA, 19 bp, Homo sapiens
cctggctgaggttcctctg

SEQ ID NO: 756063 - DNA, 13 bp, Homo sapiens
cctggctgcactc

SEQ ID NO: 756064 - DNA, 16 bp, Homo sapiens
cctggctgccaggcgt

SEQ ID NO: 756065 - DNA, 12 bp, Homo sapiens
cctggctgccca

SEQ ID NO: 756066 - DNA, 15 bp, Homo sapiens
cctggctgcccatca

SEQ ID NO: 756067 - DNA, 17 bp, Homo sapiens
cctggctgccctggccc

SEQ ID NO: 756068 - DNA, 14 bp, Homo sapiens
cctggctgctgctt

SEQ ID NO: 756069 - DNA, 13 bp, Homo sapiens
cctggctggagga

SEQ ID NO: 756070 - DNA, 20 bp, Homo sapiens
cctggctgggacgtggctca

SEQ ID NO: 756071 - DNA, 21 bp, Homo sapiens
cctggctgggacgtggctcag

SEQ ID NO: 756072 - DNA, 19 bp, Homo sapiens
cctggctgggttcaggtcc

SEQ ID NO: 756073 - DNA, 13 bp, Homo sapiens
cctggctgtactg

SEQ ID NO: 756074 - DNA, 19 bp, Homo sapiens
cctggctgtactgctcagg

SEQ ID NO: 756075 - DNA, 13 bp, Homo sapiens
cctggctgtccaa

SEQ ID NO: 756076 - DNA, 12 bp, Homo sapiens
cctggctgtgcc

SEQ ID NO: 756077 - DNA, 16 bp, Homo sapiens
cctggctgtgcccagc

SEQ ID NO: 756078 - DNA, 22 bp, Homo sapiens
cctggctgtgcccagcaggccc

SEQ ID NO: 756079 - DNA, 24 bp, Homo sapiens
cctggctgtgcccagcaggcccag

SEQ ID NO: 756080 - DNA, 12 bp, Homo sapiens
cctggctgtgga

SEQ ID NO: 756081 - DNA, 19 bp, Homo sapiens
cctggctgtggaggcctga

SEQ ID NO: 756082 - DNA, 23 bp, Homo sapiens
cctggcttcactctccctgacgg

SEQ ID NO: 756083 - DNA, 14 bp, Homo sapiens
cctggcttctggag

SEQ ID NO: 756084 - DNA, 15 bp, Homo sapiens
cctggcttctggagc

SEQ ID NO: 756085 - DNA, 16 bp, Homo sapiens
cctggcttctggagcc

SEQ ID NO: 756086 - DNA, 22 bp, Homo sapiens
cctggcttctggagcccttggg

SEQ ID NO: 756087 - DNA, 17 bp, Homo sapiens
cctggcttgctccaggg

SEQ ID NO: 756088 - DNA, 16 bp, Homo sapiens
cctggcttgcttgccg

SEQ ID NO: 756089 - DNA, 18 bp, Homo sapiens
gcagtttatatttaactc

SEQ ID NO: 756090 - DNA, 15 bp, Homo sapiens
gcagtttcctggaaa

SEQ ID NO: 756091 - DNA, 17 bp, Homo sapiens
gcagtttcttgtgtaga

SEQ ID NO: 756092 - DNA, 18 bp, Homo sapiens
gcagtttcttgtgtagat

SEQ ID NO: 756093 - DNA, 12 bp, Homo sapiens
gcagtttgcaaa

SEQ ID NO: 756094 - DNA, 13 bp, Homo sapiens
gcagtttgcaaaa

SEQ ID NO: 756095 - DNA, 14 bp, Homo sapiens
gcagtttggccctg

SEQ ID NO: 756096 - DNA, 19 bp, Homo sapiens
gcagtttggccctggagcc

SEQ ID NO: 756097 - DNA, 18 bp, Homo sapiens
gcagtttgggagacatgg

SEQ ID NO: 756098 - DNA, 14 bp, Homo sapiens
gcagtttgtgaatg

SEQ ID NO: 756099 - DNA, 19 bp, Homo sapiens
gcagtttttataatagatt

SEQ ID NO: 756100 - DNA, 14 bp, Homo sapiens
gcagtttttcagga

SEQ ID NO: 756101 - DNA, 23 bp, Homo sapiens
gcagtttttcaggagcgcaagat

SEQ ID NO: 756102 - DNA, 12 bp, Homo sapiens
gcagttttttga

SEQ ID NO: 756103 - DNA, 18 bp, Homo sapiens
gcagttttttgaaaatgg

SEQ ID NO: 756104 - DNA, 23 bp, Homo sapiens
gcagttttttttttcttgtctat

SEQ ID NO: 756105 - DNA, 16 bp, Homo sapiens
gcataaaaaaatgatg

SEQ ID NO: 756106 - DNA, 17 bp, Homo sapiens
gcataaaacctaaaggt

SEQ ID NO: 756107 - DNA, 16 bp, Homo sapiens
gcataaagtaaataca

SEQ ID NO: 756108 - DNA, 19 bp, Homo sapiens
gcataacctgtctcacctg

SEQ ID NO: 756109 - DNA, 13 bp, Homo sapiens
gcataagattaaa

SEQ ID NO: 756110 - DNA, 19 bp, Homo sapiens
gcataagattaaaggaagg

SEQ ID NO: 756111 - DNA, 14 bp, Homo sapiens
gcataataagctaa

SEQ ID NO: 756112 - DNA, 19 bp, Homo sapiens
gcataatatgaagcctttg

SEQ ID NO: 756113 - DNA, 20 bp, Homo sapiens
gcataatgataaaataaata

SEQ ID NO: 756114 - DNA, 21 bp, Homo sapiens
gcataatttgtttaaaattct

SEQ ID NO: 756115 - DNA, 12 bp, Homo sapiens
gcatacaaaata

SEQ ID NO: 756116 - DNA, 13 bp, Homo sapiens
gcatacaataaaa

SEQ ID NO: 756117 - DNA, 20 bp, Homo sapiens
gcatacaataaaagagcttt

SEQ ID NO: 756118 - DNA, 21 bp, Homo sapiens
gcatacacacatgccctcctg

SEQ ID NO: 756119 - DNA, 23 bp, Homo sapiens
gcatacacacatgccctcctgga

SEQ ID NO: 756120 - DNA, 15 bp, Homo sapiens
gcatacactgtagtt

SEQ ID NO: 756121 - DNA, 16 bp, Homo sapiens
gcataccacttttgtt

SEQ ID NO: 756122 - DNA, 20 bp, Homo sapiens
gcataccacttttgttcttg

SEQ ID NO: 756123 - DNA, 18 bp, Homo sapiens
gcatacccaaaccaggtg

SEQ ID NO: 756124 - DNA, 18 bp, Homo sapiens
gcatacctcctatgggtt

SEQ ID NO: 756125 - DNA, 14 bp, Homo sapiens
gcataccttgtgca

SEQ ID NO: 756126 - DNA, 18 bp, Homo sapiens
gcatacgtacacatttta

SEQ ID NO: 756127 - DNA, 16 bp, Homo sapiens
gcatactgttgataca

SEQ ID NO: 756128 - DNA, 19 bp, Homo sapiens
gcatacttacctagtgaaa

SEQ ID NO: 756129 - DNA, 21 bp, Homo sapiens
gcatacttacctagtgaaact

SEQ ID NO: 756130 - DNA, 21 bp, Homo sapiens
gcatacttcaaaactgtttgt

SEQ ID NO: 756131 - DNA, 18 bp, Homo sapiens
gcatactttgacaaggaa

SEQ ID NO: 756132 - DNA, 15 bp, Homo sapiens
gcatactttttaaaa

SEQ ID NO: 756133 - DNA, 17 bp, Homo sapiens
gcatactttttaaaaaa

SEQ ID NO: 756134 - DNA, 14 bp, Homo sapiens
gcatagactgaggt

SEQ ID NO: 756135 - DNA, 20 bp, Homo sapiens
gcatagactgaggtataaag

SEQ ID NO: 756136 - DNA, 23 bp, Homo sapiens
gcatagactgaggtataaagaca

SEQ ID NO: 756137 - DNA, 16 bp, Homo sapiens
gcatagaggcttctcc

SEQ ID NO: 756138 - DNA, 15 bp, Homo sapiens
gcatagcctgcctga

SEQ ID NO: 756139 - DNA, 18 bp, Homo sapiens
gcatagcgtcctgccctg

SEQ ID NO: 756140 - DNA, 17 bp, Homo sapiens
gcatagctacaatttgt

SEQ ID NO: 756141 - DNA, 14 bp, Homo sapiens
gcatagctctgggg

SEQ ID NO: 756142 - DNA, 23 bp, Homo sapiens
gcatagctgttttagctgaggga

SEQ ID NO: 756143 - DNA, 17 bp, Homo sapiens
gcataggcccagccagg

SEQ ID NO: 756144 - DNA, 18 bp, Homo sapiens
gcataggcccagccaggg

SEQ ID NO: 756145 - DNA, 16 bp, Homo sapiens
gcataggcctgggtgc

SEQ ID NO: 756146 - DNA, 22 bp, Homo sapiens
gcataggcctgggtgctggctg

SEQ ID NO: 756147 - DNA, 24 bp, Homo sapiens
gcataggctcttaagcagcatgga

SEQ ID NO: 756148 - DNA, 17 bp, Homo sapiens
gcataggggggagggtc

SEQ ID NO: 756149 - DNA, 18 bp, Homo sapiens
gcataggggggagggtct

SEQ ID NO: 756150 - DNA, 17 bp, Homo sapiens
gcataggtctctttgct

SEQ ID NO: 756151 - DNA, 23 bp, Homo sapiens
gcatagtattccattgtgtgagt

SEQ ID NO: 756152 - DNA, 12 bp, Homo sapiens
gcatagtgctgg

SEQ ID NO: 756153 - DNA, 18 bp, Homo sapiens
gcatagttgtagacaaag

SEQ ID NO: 756154 - DNA, 21 bp, Homo sapiens
gcatataaaggttatgaaaca

SEQ ID NO: 756155 - DNA, 22 bp, Homo sapiens
gcatataaaggttatgaaacat

SEQ ID NO: 756156 - DNA, 15 bp, Homo sapiens
gcatataacttatat

SEQ ID NO: 756157 - DNA, 19 bp, Homo sapiens
gcatataatgaataaatca

SEQ ID NO: 756158 - DNA, 21 bp, Homo sapiens
gcatatactgaagtcttttct

SEQ ID NO: 756159 - DNA, 12 bp, Homo sapiens
gcatatactggt

SEQ ID NO: 756160 - DNA, 14 bp, Homo sapiens
gcatatagaaaaca

SEQ ID NO: 756161 - DNA, 15 bp, Homo sapiens
gcatatagaaaacaa

SEQ ID NO: 756162 - DNA, 17 bp, Homo sapiens
gcatataggtgatgttt

SEQ ID NO: 756163 - DNA, 19 bp, Homo sapiens
gcatataggtgatgtttgc

SEQ ID NO: 756164 - DNA, 17 bp, Homo sapiens
gcatatcattaaacaaa

SEQ ID NO: 756165 - DNA, 15 bp, Homo sapiens
gcatatcctgagcca

SEQ ID NO: 756166 - DNA, 16 bp, Homo sapiens
gcatatctgcctcccc

SEQ ID NO: 756167 - DNA, 17 bp, Homo sapiens
gcatatctgcctcccct

SEQ ID NO: 756168 - DNA, 17 bp, Homo sapiens
gcatatctggtatatgt

SEQ ID NO: 756169 - DNA, 20 bp, Homo sapiens
gcatatctggtatatgtcat

SEQ ID NO: 756170 - DNA, 21 bp, Homo sapiens
gcatatctggtcagaactgca

SEQ ID NO: 756171 - DNA, 23 bp, Homo sapiens
gcatatgagcctgccctcactcc

SEQ ID NO: 756172 - DNA, 17 bp, Homo sapiens
gcatatgcatgccaggc

SEQ ID NO: 756173 - DNA, 12 bp, Homo sapiens
gcatatgttgaa

SEQ ID NO: 756174 - DNA, 23 bp, Homo sapiens
gcatattataaaggataaagaag

SEQ ID NO: 756175 - DNA, 13 bp, Homo sapiens
cctgggctaagca

SEQ ID NO: 756176 - DNA, 16 bp, Homo sapiens
cctgggctcactgtgc

SEQ ID NO: 756177 - DNA, 17 bp, Homo sapiens
cctgggctccctcttgt

SEQ ID NO: 756178 - DNA, 15 bp, Homo sapiens
cctgggctctgaaca

SEQ ID NO: 756179 - DNA, 21 bp, Homo sapiens
cctgggctctgaacacacacg

SEQ ID NO: 756180 - DNA, 13 bp, Homo sapiens
cctgggctctgga

SEQ ID NO: 756181 - DNA, 14 bp, Homo sapiens
cctgggctgccacc

SEQ ID NO: 756182 - DNA, 17 bp, Homo sapiens
cctgggctgccaccagc

SEQ ID NO: 756183 - DNA, 18 bp, Homo sapiens
cctgggctgccaccagcc

SEQ ID NO: 756184 - DNA, 14 bp, Homo sapiens
cctgggctgggaaa

SEQ ID NO: 756185 - DNA, 13 bp, Homo sapiens
cctgggctgggca

SEQ ID NO: 756186 - DNA, 18 bp, Homo sapiens
cctgggctgggcagcctt

SEQ ID NO: 756187 - DNA, 13 bp, Homo sapiens
cctgggctgggga

SEQ ID NO: 756188 - DNA, 19 bp, Homo sapiens
cctgggctggggaggagga

SEQ ID NO: 756189 - DNA, 22 bp, Homo sapiens
cctgggctggggaggaggagag

SEQ ID NO: 756190 - DNA, 13 bp, Homo sapiens
cctgggctggggc

SEQ ID NO: 756191 - DNA, 19 bp, Homo sapiens
cctgggctggggcctcaga

SEQ ID NO: 756192 - DNA, 17 bp, Homo sapiens
cctgggctgggtgctgg

SEQ ID NO: 756193 - DNA, 21 bp, Homo sapiens
cctgggctgggtggcccctgt

SEQ ID NO: 756194 - DNA, 16 bp, Homo sapiens
cctgggctgtccagcc

SEQ ID NO: 756195 - DNA, 18 bp, Homo sapiens
cctgggctgttggcactc

SEQ ID NO: 756196 - DNA, 21 bp, Homo sapiens
cctgggctgttggcactcaca

SEQ ID NO: 756197 - DNA, 23 bp, Homo sapiens
cctgggctgttggcactcacaga

SEQ ID NO: 756198 - DNA, 18 bp, Homo sapiens
cctgggcttctgtaccac

SEQ ID NO: 756199 - DNA, 18 bp, Homo sapiens
cctgggcttggcccgcgg

SEQ ID NO: 756200 - DNA, 16 bp, Homo sapiens
cctgggcttggcctgc

SEQ ID NO: 756201 - DNA, 18 bp, Homo sapiens
cctgggcttggcctgctg

SEQ ID NO: 756202 - DNA, 21 bp, Homo sapiens
cctgggcttggcctgctgtga

SEQ ID NO: 756203 - DNA, 17 bp, Homo sapiens
cctgggcttggctcttg

SEQ ID NO: 756204 - DNA, 17 bp, Homo sapiens
cctggggaaggagccag

SEQ ID NO: 756205 - DNA, 13 bp, Homo sapiens
cctggggacagag

SEQ ID NO: 756206 - DNA, 17 bp, Homo sapiens
cctggggacagagccac

SEQ ID NO: 756207 - DNA, 10 bp, Homo sapiens
cctggggagc

SEQ ID NO: 756208 - DNA, 16 bp, Homo sapiens
cctggggagccctcag

SEQ ID NO: 756209 - DNA, 16 bp, Homo sapiens
cctggggagctcctgg

SEQ ID NO: 756210 - DNA, 22 bp, Homo sapiens
cctggggagctcctgggaccct

SEQ ID NO: 756211 - DNA, 14 bp, Homo sapiens
gcatccattcctca

SEQ ID NO: 756212 - DNA, 18 bp, Homo sapiens
gcatccattcctcaggga

SEQ ID NO: 756213 - DNA, 13 bp, Homo sapiens
gcatcccagcttg

SEQ ID NO: 756214 - DNA, 19 bp, Homo sapiens
gcatcccaggggaccacac

SEQ ID NO: 756215 - DNA, 21 bp, Homo sapiens
gcatcccaggggaccacacct

SEQ ID NO: 756216 - DNA, 14 bp, Homo sapiens
gcatcccagtggcc

SEQ ID NO: 756217 - DNA, 16 bp, Homo sapiens
gcatcccagtggcctc

SEQ ID NO: 756218 - DNA, 20 bp, Homo sapiens
gcatcccagtggcctcaacc

SEQ ID NO: 756219 - DNA, 14 bp, Homo sapiens
gcatcccatctctc

SEQ ID NO: 756220 - DNA, 17 bp, Homo sapiens
gcatcccatctctccca

SEQ ID NO: 756221 - DNA, 18 bp, Homo sapiens
gcatcccatctctcccac

SEQ ID NO: 756222 - DNA, 21 bp, Homo sapiens
gcatcccatctctcccacttc

SEQ ID NO: 756223 - DNA, 16 bp, Homo sapiens
gcatcccccaaagttc

SEQ ID NO: 756224 - DNA, 20 bp, Homo sapiens
gcatcccccaaagttcacaa

SEQ ID NO: 756225 - DNA, 15 bp, Homo sapiens
gcatcccccctgctc

SEQ ID NO: 756226 - DNA, 17 bp, Homo sapiens
gcatcccccctgctcag

SEQ ID NO: 756227 - DNA, 18 bp, Homo sapiens
gcatcccccctgctcagc

SEQ ID NO: 756228 - DNA, 22 bp, Homo sapiens
gcatcccggaggaaatctgcag

SEQ ID NO: 756229 - DNA, 21 bp, Homo sapiens
gcatccctggagcaggagccc

SEQ ID NO: 756230 - DNA, 14 bp, Homo sapiens
gcatccgtgtattt

SEQ ID NO: 756231 - DNA, 23 bp, Homo sapiens
gcatccgtgtatttggctgggct

SEQ ID NO: 756232 - DNA, 19 bp, Homo sapiens
gcatcctaaagataaagcc

SEQ ID NO: 756233 - DNA, 15 bp, Homo sapiens
gcatcctatgcttaa

SEQ ID NO: 756234 - DNA, 14 bp, Homo sapiens
gcatcctatttggt

SEQ ID NO: 756235 - DNA, 18 bp, Homo sapiens
gcatcctcctcagccccc

SEQ ID NO: 756236 - DNA, 20 bp, Homo sapiens
gcatcctcctcagcccccag

SEQ ID NO: 756237 - DNA, 21 bp, Homo sapiens
gcatcctcctcagcccccagg

SEQ ID NO: 756238 - DNA, 22 bp, Homo sapiens
gcatcctgagccccgccctctt

SEQ ID NO: 756239 - DNA, 13 bp, Homo sapiens
gcatcctgaggcc

SEQ ID NO: 756240 - DNA, 15 bp, Homo sapiens
gcatcctgaggccag

SEQ ID NO: 756241 - DNA, 18 bp, Homo sapiens
gcatcctgcaaggtgaaa

SEQ ID NO: 756242 - DNA, 13 bp, Homo sapiens
gcatcctgctggg

SEQ ID NO: 756243 - DNA, 17 bp, Homo sapiens
gcatccttgtcttttga

SEQ ID NO: 756244 - DNA, 23 bp, Homo sapiens
gcatcctttagggttctgcctct

SEQ ID NO: 756245 - DNA, 20 bp, Homo sapiens
gcatccttttctgcagaggg

SEQ ID NO: 756246 - DNA, 22 bp, Homo sapiens
gcatcggcagctgaaccctgct

SEQ ID NO: 756247 - DNA, 16 bp, Homo sapiens
gcatcgggggcctgca

SEQ ID NO: 756248 - DNA, 19 bp, Homo sapiens
gcatcgggggcctgcaaat

SEQ ID NO: 756249 - DNA, 18 bp, Homo sapiens
gcatcgtgacccttcagg

SEQ ID NO: 756250 - DNA, 16 bp, Homo sapiens
gcatctactctaaaga

SEQ ID NO: 756251 - DNA, 23 bp, Homo sapiens
gcatctatacgtaatttaaacaa

SEQ ID NO: 756252 - DNA, 14 bp, Homo sapiens
gcatctatctcatc

SEQ ID NO: 756253 - DNA, 13 bp, Homo sapiens
gcatctcagccca

SEQ ID NO: 756254 - DNA, 12 bp, Homo sapiens
gcatctcccaga

SEQ ID NO: 756255 - DNA, 20 bp, Homo sapiens
gcatctctgtcccattccct

SEQ ID NO: 756256 - DNA, 23 bp, Homo sapiens
gcatctctgtcccattccctggg

SEQ ID NO: 756257 - DNA, 21 bp, Homo sapiens
gcatctcttcttccctgtcag

SEQ ID NO: 756258 - DNA, 23 bp, Homo sapiens
gcatctcttcttccctgtcagcc

SEQ ID NO: 756259 - DNA, 16 bp, Homo sapiens
gcatctgacacaaaaa

SEQ ID NO: 756260 - DNA, 17 bp, Homo sapiens
gcatctgaccagcagcg

SEQ ID NO: 756261 - DNA, 17 bp, Homo sapiens
gcatctgactcacaaga

SEQ ID NO: 756262 - DNA, 17 bp, Homo sapiens
gcatctgagtccagctc

SEQ ID NO: 756263 - DNA, 16 bp, Homo sapiens
gcatctgcaacaaaaa

SEQ ID NO: 756264 - DNA, 12 bp, Homo sapiens
gcatctgcaccc

SEQ ID NO: 756265 - DNA, 21 bp, Homo sapiens
gcatctgcaggcaccgggctg

SEQ ID NO: 756266 - DNA, 17 bp, Homo sapiens
gcatctgcccctccccc

SEQ ID NO: 756267 - DNA, 12 bp, Homo sapiens
gcatctggctgt

SEQ ID NO: 756268 - DNA, 20 bp, Homo sapiens
gcatctggctgtctagaatg

SEQ ID NO: 756269 - DNA, 22 bp, Homo sapiens
gcatctggctgtctagaatgtg

SEQ ID NO: 756270 - DNA, 12 bp, Homo sapiens
gcatctggtctt

SEQ ID NO: 756271 - DNA, 13 bp, Homo sapiens
gcatctggtcttg

SEQ ID NO: 756272 - DNA, 22 bp, Homo sapiens
gcatctgtataagtaagaaaat

SEQ ID NO: 756273 - DNA, 20 bp, Homo sapiens
gcatctgtctgtctgtgggc

SEQ ID NO: 756274 - DNA, 15 bp, Homo sapiens
gcatctgtgatggga

SEQ ID NO: 756275 - DNA, 18 bp, Homo sapiens
gcatctgtgatgggagcg

SEQ ID NO: 756276 - DNA, 12 bp, Homo sapiens
gcatctgtgcgt

SEQ ID NO: 756277 - DNA, 16 bp, Homo sapiens
gcatctgttagcagag

SEQ ID NO: 756278 - DNA, 18 bp, Homo sapiens
gcatctgttagcagagtc

SEQ ID NO: 756279 - DNA, 19 bp, Homo sapiens
gcatctgtttacctggcag

SEQ ID NO: 756280 - DNA, 14 bp, Homo sapiens
gcatcttcttgcat

SEQ ID NO: 756281 - DNA, 21 bp, Homo sapiens
gcatcttcttgcatctaatga

SEQ ID NO: 756282 - DNA, 23 bp, Homo sapiens
gcatcttttctagagacacattg

SEQ ID NO: 756283 - DNA, 18 bp, Homo sapiens
gcatctttttttcatttt

SEQ ID NO: 756284 - DNA, 23 bp, Homo sapiens
gcatgaaaaatcatgggccagag

SEQ ID NO: 756285 - DNA, 13 bp, Homo sapiens
gcatgaaaaggat

SEQ ID NO: 756286 - DNA, 14 bp, Homo sapiens
gcatgaaataaaat

SEQ ID NO: 756287 - DNA, 17 bp, Homo sapiens
gcatgaacaagttttaa

SEQ ID NO: 756288 - DNA, 18 bp, Homo sapiens
gcatgaaccctcttgcca

SEQ ID NO: 756289 - DNA, 21 bp, Homo sapiens
gcatgaaccctcttgccatcc

SEQ ID NO: 756290 - DNA, 18 bp, Homo sapiens
gcatgaagtaatatgcac

SEQ ID NO: 756291 - DNA, 20 bp, Homo sapiens
gcatgaagtaatatgcacac

SEQ ID NO: 756292 - DNA, 22 bp, Homo sapiens
gcatgaagtaatatgcacacat

SEQ ID NO: 756293 - DNA, 15 bp, Homo sapiens
gcatgaataaaacac

SEQ ID NO: 756294 - DNA, 17 bp, Homo sapiens
gcatgacaaaaataaca

SEQ ID NO: 756295 - DNA, 18 bp, Homo sapiens
gcatgacaaaaataacac

SEQ ID NO: 756296 - DNA, 21 bp, Homo sapiens
gcatgacaaaaataacactgt

SEQ ID NO: 756297 - DNA, 19 bp, Homo sapiens
gcatgacaactactttaag

SEQ ID NO: 756298 - DNA, 19 bp, Homo sapiens
gcatgacaagccccaggca

SEQ ID NO: 756299 - DNA, 14 bp, Homo sapiens
gcatgacactctag

SEQ ID NO: 756300 - DNA, 18 bp, Homo sapiens
gcatgacagcctgcagca

SEQ ID NO: 756301 - DNA, 15 bp, Homo sapiens
gcatgaccacataga

SEQ ID NO: 756302 - DNA, 16 bp, Homo sapiens
cctggtactcaagccc

SEQ ID NO: 756303 - DNA, 19 bp, Homo sapiens
cctggtactcaagcccgcg

SEQ ID NO: 756304 - DNA, 22 bp, Homo sapiens
cctggtactctggcaaatgatg

SEQ ID NO: 756305 - DNA, 21 bp, Homo sapiens
cctggtagactaggtttattt

SEQ ID NO: 756306 - DNA, 13 bp, Homo sapiens
cctggtattttca

SEQ ID NO: 756307 - DNA, 23 bp, Homo sapiens
cctggtcacaggactctgcctcc

SEQ ID NO: 756308 - DNA, 18 bp, Homo sapiens
cctggtcaccctggggct

SEQ ID NO: 756309 - DNA, 21 bp, Homo sapiens
cctggtcaccctggggctgct

SEQ ID NO: 756310 - DNA, 22 bp, Homo sapiens
cctggtccagggaagctggccg

SEQ ID NO: 756311 - DNA, 19 bp, Homo sapiens
cctggtccatgcagggggc

SEQ ID NO: 756312 - DNA, 18 bp, Homo sapiens
cctggtccccactgctga

SEQ ID NO: 756313 - DNA, 13 bp, Homo sapiens
cctggtcccctcc

SEQ ID NO: 756314 - DNA, 19 bp, Homo sapiens
cctggtccctcgtccacag

SEQ ID NO: 756315 - DNA, 14 bp, Homo sapiens
cctggtcctgaggg

SEQ ID NO: 756316 - DNA, 19 bp, Homo sapiens
cctggtcctggacacctcc

SEQ ID NO: 756317 - DNA, 15 bp, Homo sapiens
cctggtcctggcctc

SEQ ID NO: 756318 - DNA, 17 bp, Homo sapiens
cctggtcctggcctcct

SEQ ID NO: 756319 - DNA, 19 bp, Homo sapiens
cctggtccttccaggcccc

SEQ ID NO: 756320 - DNA, 13 bp, Homo sapiens
cctggtccttccc

SEQ ID NO: 756321 - DNA, 22 bp, Homo sapiens
cctggtccttccctgatggcct

SEQ ID NO: 756322 - DNA, 22 bp, Homo sapiens
cctggtcgtctatcccagtgtg

SEQ ID NO: 756323 - DNA, 16 bp, Homo sapiens
cctggtctgaggatgt

SEQ ID NO: 756324 - DNA, 17 bp, Homo sapiens
cctggtctgaggatgta

SEQ ID NO: 756325 - DNA, 22 bp, Homo sapiens
cctggtctggttgggcagccag

SEQ ID NO: 756326 - DNA, 16 bp, Homo sapiens
cctggtcttctctaca

SEQ ID NO: 756327 - DNA, 17 bp, Homo sapiens
cctggtcttctctacag

SEQ ID NO: 756328 - DNA, 16 bp, Homo sapiens
cctggtctttcctctg

SEQ ID NO: 756329 - DNA, 16 bp, Homo sapiens
cctggtgacctcctgt

SEQ ID NO: 756330 - DNA, 18 bp, Homo sapiens
cctggtgacctcctgtca

SEQ ID NO: 756331 - DNA, 18 bp, Homo sapiens
cctggtgaggcccagcct

SEQ ID NO: 756332 - DNA, 15 bp, Homo sapiens
cctgtcccccaaggt

SEQ ID NO: 756333 - DNA, 14 bp, Homo sapiens
cctgtcccccactc

SEQ ID NO: 756334 - DNA, 13 bp, Homo sapiens
cctgtcccgcctt

SEQ ID NO: 756335 - DNA, 22 bp, Homo sapiens
cctgtcccgccttcctcctcca

SEQ ID NO: 756336 - DNA, 13 bp, Homo sapiens
cctgtccctctag

SEQ ID NO: 756337 - DNA, 14 bp, Homo sapiens
cctgtccctctagt

SEQ ID NO: 756338 - DNA, 16 bp, Homo sapiens
cctgtccctctcaggc

SEQ ID NO: 756339 - DNA, 12 bp, Homo sapiens
cctgtccctgag

SEQ ID NO: 756340 - DNA, 11 bp, Homo sapiens
cctgtccctgc

SEQ ID NO: 756341 - DNA, 14 bp, Homo sapiens
cctgtccctgcccc

SEQ ID NO: 756342 - DNA, 15 bp, Homo sapiens
cctgtcccttgacct

SEQ ID NO: 756343 - DNA, 14 bp, Homo sapiens
cctgtccggaccgc

SEQ ID NO: 756344 - DNA, 13 bp, Homo sapiens
cctgtcctcaccg

SEQ ID NO: 756345 - DNA, 13 bp, Homo sapiens
cctgtcctccaac

SEQ ID NO: 756346 - DNA, 23 bp, Homo sapiens
cctgtcctcccatcccctggact

SEQ ID NO: 756347 - DNA, 23 bp, Homo sapiens
cctgtcctcctcggatcaccgag

SEQ ID NO: 756348 - DNA, 15 bp, Homo sapiens
cctgtcctcctggaa

SEQ ID NO: 756349 - DNA, 14 bp, Homo sapiens
cctgtcctctttgt

SEQ ID NO: 756350 - DNA, 12 bp, Homo sapiens
cctgtcctgcct

SEQ ID NO: 756351 - DNA, 14 bp, Homo sapiens
cctgtcctgcctcc

SEQ ID NO: 756352 - DNA, 15 bp, Homo sapiens
cctgtcctgcctcct

SEQ ID NO: 756353 - DNA, 17 bp, Homo sapiens
cctgtcctgcctcctca

SEQ ID NO: 756354 - DNA, 18 bp, Homo sapiens
cctgtcctgcctcctcat

SEQ ID NO: 756355 - DNA, 16 bp, Homo sapiens
cctgtcctggtacagc

SEQ ID NO: 756356 - DNA, 14 bp, Homo sapiens
cctgtccttctaca

SEQ ID NO: 756357 - DNA, 18 bp, Homo sapiens
cctgtcgagacacttgcc

SEQ ID NO: 756358 - DNA, 22 bp, Homo sapiens
cctgtcgattagactggacagc

SEQ ID NO: 756359 - DNA, 19 bp, Homo sapiens
cctgtcgcccacccagctg

SEQ ID NO: 756360 - DNA, 16 bp, Homo sapiens
cctgtcggtctccagt

SEQ ID NO: 756361 - DNA, 17 bp, Homo sapiens
cctgtcgtgccagtcct

SEQ ID NO: 756362 - DNA, 18 bp, Homo sapiens
cctgtcgtgccagtcctg

SEQ ID NO: 756363 - DNA, 20 bp, Homo sapiens
cctgtctaaagccttaacta

SEQ ID NO: 756364 - DNA, 17 bp, Homo sapiens
cctgtctagagagggag

SEQ ID NO: 756365 - DNA, 17 bp, Homo sapiens
cctgtctaggtctcctc

SEQ ID NO: 756366 - DNA, 21 bp, Homo sapiens
cctgtctaggtctcctcaggg

SEQ ID NO: 756367 - DNA, 17 bp, Homo sapiens
cctgtctcatccccagg

SEQ ID NO: 756368 - DNA, 15 bp, Homo sapiens
cctgtctccactgtg

SEQ ID NO: 756369 - DNA, 14 bp, Homo sapiens
cctgtctccagctg

SEQ ID NO: 756370 - DNA, 15 bp, Homo sapiens
cctgtctccagctgc

SEQ ID NO: 756371 - DNA, 17 bp, Homo sapiens
cctgtctccagctgcct

SEQ ID NO: 756372 - DNA, 23 bp, Homo sapiens
cctgtctccagctgcctgggccc

SEQ ID NO: 756373 - DNA, 15 bp, Homo sapiens
cctgtctcgggctga

SEQ ID NO: 756374 - DNA, 16 bp, Homo sapiens
cctgtctctaaggagc

SEQ ID NO: 756375 - DNA, 18 bp, Homo sapiens
cctgtctctattagctgg

SEQ ID NO: 756376 - DNA, 13 bp, Homo sapiens
cctgtctctgcct

SEQ ID NO: 756377 - DNA, 20 bp, Homo sapiens
cctgtctgaaggacacttcc

SEQ ID NO: 756378 - DNA, 20 bp, Homo sapiens
cctgtctgagactcacagga

SEQ ID NO: 756379 - DNA, 23 bp, Homo sapiens
cctgtctgagactcacaggaagg

SEQ ID NO: 756380 - DNA, 16 bp, Homo sapiens
cctgtctgccagccag

SEQ ID NO: 756381 - DNA, 19 bp, Homo sapiens
cctgtctgccagccagcag

SEQ ID NO: 756382 - DNA, 19 bp, Homo sapiens
cctgtctgccctctgggtc

SEQ ID NO: 756383 - DNA, 18 bp, Homo sapiens
cctgtctgctaggcgctg

SEQ ID NO: 756384 - DNA, 22 bp, Homo sapiens
cctgtctgctaggcgctgggga

SEQ ID NO: 756385 - DNA, 13 bp, Homo sapiens
cctgtctggaaga

SEQ ID NO: 756386 - DNA, 22 bp, Homo sapiens
cctgtctggaagacgtggctct

SEQ ID NO: 756387 - DNA, 18 bp, Homo sapiens
cctgtctggctcggaccc

SEQ ID NO: 756388 - DNA, 22 bp, Homo sapiens
cctgtctggctcggacccaccc

SEQ ID NO: 756389 - DNA, 23 bp, Homo sapiens
cctgtctggctcggacccacccc

SEQ ID NO: 756390 - DNA, 16 bp, Homo sapiens
cctgtctgtccctttt

SEQ ID NO: 756391 - DNA, 17 bp, Homo sapiens
cctgtctgtccttctga

SEQ ID NO: 756392 - DNA, 13 bp, Homo sapiens
cctgtctgtgtgc

SEQ ID NO: 756393 - DNA, 15 bp, Homo sapiens
cctgtctgtttatat

SEQ ID NO: 756394 - DNA, 22 bp, Homo sapiens
cctgtcttatcctccaccgtct

SEQ ID NO: 756395 - DNA, 19 bp, Homo sapiens
cctgtcttcagagaaccca

SEQ ID NO: 756396 - DNA, 13 bp, Homo sapiens
cctgtcttgctcc

SEQ ID NO: 756397 - DNA, 17 bp, Homo sapiens
cctgtcttgctcctggg

SEQ ID NO: 756398 - DNA, 17 bp, Homo sapiens
cctgtgaatcaatcctg

SEQ ID NO: 756399 - DNA, 17 bp, Homo sapiens
cctgtgacaaaggatga

SEQ ID NO: 756400 - DNA, 17 bp, Homo sapiens
cctgtgacatggtgcct

SEQ ID NO: 756401 - DNA, 18 bp, Homo sapiens
cctgtgacatggtgcctg

SEQ ID NO: 756402 - DNA, 21 bp, Homo sapiens
cctgtgacatggtgcctgaga

SEQ ID NO: 756403 - DNA, 23 bp, Homo sapiens
cctgtgaccttgggaccaaaggg

SEQ ID NO: 756404 - DNA, 23 bp, Homo sapiens
cctgtgagatgtgtatcagtgtt

SEQ ID NO: 756405 - DNA, 20 bp, Homo sapiens
cctgtgagcccagctgggtc

SEQ ID NO: 756406 - DNA, 18 bp, Homo sapiens
cctgtgagggagtgcaga

SEQ ID NO: 756407 - DNA, 20 bp, Homo sapiens
cctgtgagggagtgcagaac

SEQ ID NO: 756408 - DNA, 20 bp, Homo sapiens
cctgtgaggtaactgggatc

SEQ ID NO: 756409 - DNA, 17 bp, Homo sapiens
cctgtgatacatttctg

SEQ ID NO: 756410 - DNA, 16 bp, Homo sapiens
cctgtgatgctgggca

SEQ ID NO: 756411 - DNA, 22 bp, Homo sapiens
cctgtgcacaccccactcccac

SEQ ID NO: 756412 - DNA, 13 bp, Homo sapiens
cctgtgcactggg

SEQ ID NO: 756413 - DNA, 16 bp, Homo sapiens
cctgtgcactgggcag

SEQ ID NO: 756414 - DNA, 16 bp, Homo sapiens
cctgtgcagaccttac

SEQ ID NO: 756415 - DNA, 19 bp, Homo sapiens
cctgtgcagaccttactca

SEQ ID NO: 756416 - DNA, 23 bp, Homo sapiens
cctgtgcagcagcccagcttcct

SEQ ID NO: 756417 - DNA, 21 bp, Homo sapiens
cctgtgccacccaccagggcg

SEQ ID NO: 756418 - DNA, 14 bp, Homo sapiens
cctgtgccagcacc

SEQ ID NO: 756419 - DNA, 17 bp, Homo sapiens
cctgtgccaggctgaat

SEQ ID NO: 756420 - DNA, 15 bp, Homo sapiens
cctgtgccatgccca

SEQ ID NO: 756421 - DNA, 17 bp, Homo sapiens
cctgtgccccagctgcc

SEQ ID NO: 756422 - DNA, 15 bp, Homo sapiens
cctgtgcccccagcc

SEQ ID NO: 756423 - DNA, 17 bp, Homo sapiens
cctgtgcccccagcctc

SEQ ID NO: 756424 - DNA, 20 bp, Homo sapiens
cctgtgccctcaccccaatc

SEQ ID NO: 756425 - DNA, 21 bp, Homo sapiens
cctgtgccctcaccccaatcc

SEQ ID NO: 756426 - DNA, 17 bp, Homo sapiens
cctgtgccgcactctgg

SEQ ID NO: 756427 - DNA, 17 bp, Homo sapiens
cctgtgcctctgggact

SEQ ID NO: 756428 - DNA, 20 bp, Homo sapiens
cctgtgcctctgggactgga

SEQ ID NO: 756429 - DNA, 20 bp, Homo sapiens
cctgtgcctggccccagcct

SEQ ID NO: 756430 - DNA, 17 bp, Homo sapiens
cctgtgcctgggccctg

SEQ ID NO: 756431 - DNA, 12 bp, Homo sapiens
gcatgtgtattt

SEQ ID NO: 756432 - DNA, 20 bp, Homo sapiens
gcatgtgtatttccagtgca

SEQ ID NO: 756433 - DNA, 21 bp, Homo sapiens
gcatgtgtatttccagtgcaa

SEQ ID NO: 756434 - DNA, 13 bp, Homo sapiens
gcatgtgtcagag

SEQ ID NO: 756435 - DNA, 14 bp, Homo sapiens
gcatgtgtcagagt

SEQ ID NO: 756436 - DNA, 15 bp, Homo sapiens
gcatgtgtcagagtg

SEQ ID NO: 756437 - DNA, 18 bp, Homo sapiens
gcatgtgtcagagtgttg

SEQ ID NO: 756438 - DNA, 15 bp, Homo sapiens
gcatgtgtgcctgtg

SEQ ID NO: 756439 - DNA, 16 bp, Homo sapiens
gcatgtgtgcctgtgg

SEQ ID NO: 756440 - DNA, 11 bp, Homo sapiens
gcatgtgtgtg

SEQ ID NO: 756441 - DNA, 14 bp, Homo sapiens
gcatgtgtgtgtgt

SEQ ID NO: 756442 - DNA, 20 bp, Homo sapiens
gcatgtgtttggttctgggg

SEQ ID NO: 756443 - DNA, 13 bp, Homo sapiens
gcatgttatgttt

SEQ ID NO: 756444 - DNA, 19 bp, Homo sapiens
gcatgttatgtttaataag

SEQ ID NO: 756445 - DNA, 13 bp, Homo sapiens
gcatgttcctcct

SEQ ID NO: 756446 - DNA, 17 bp, Homo sapiens
gcatgtttgtgattgac

SEQ ID NO: 756447 - DNA, 14 bp, Homo sapiens
gcattaaaagaaaa

SEQ ID NO: 756448 - DNA, 12 bp, Homo sapiens
gcattaaacctg

SEQ ID NO: 756449 - DNA, 14 bp, Homo sapiens
gcattaaacctgtc

SEQ ID NO: 756450 - DNA, 22 bp, Homo sapiens
gcattaaacctgtctccactgt

SEQ ID NO: 756451 - DNA, 19 bp, Homo sapiens
gcattaaatataatatgca

SEQ ID NO: 756452 - DNA, 14 bp, Homo sapiens
gcattaacttctct

SEQ ID NO: 756453 - DNA, 14 bp, Homo sapiens
gcattaagcacaca

SEQ ID NO: 756454 - DNA, 14 bp, Homo sapiens
gcattaagcccaat

SEQ ID NO: 756455 - DNA, 16 bp, Homo sapiens
gcatttggctgctgta

SEQ ID NO: 756456 - DNA, 12 bp, Homo sapiens
gcatttggtctc

SEQ ID NO: 756457 - DNA, 22 bp, Homo sapiens
gcatttggtgagagtcaaagct

SEQ ID NO: 756458 - DNA, 12 bp, Homo sapiens
gcatttgtaaaa

SEQ ID NO: 756459 - DNA, 18 bp, Homo sapiens
gcatttgtcaatgacagt

SEQ ID NO: 756460 - DNA, 19 bp, Homo sapiens
gcatttgtccttttgtgaa

SEQ ID NO: 756461 - DNA, 18 bp, Homo sapiens
gcatttgtttatgtaatt

SEQ ID NO: 756462 - DNA, 19 bp, Homo sapiens
gcatttgtttatgtaattt

SEQ ID NO: 756463 - DNA, 18 bp, Homo sapiens
gcatttgtttgaactgat

SEQ ID NO: 756464 - DNA, 21 bp, Homo sapiens
gcattttagaaactacaaata

SEQ ID NO: 756465 - DNA, 12 bp, Homo sapiens
gcattttattct

SEQ ID NO: 756466 - DNA, 17 bp, Homo sapiens
gcattttcctcctctgc

SEQ ID NO: 756467 - DNA, 23 bp, Homo sapiens
gcattttcctcttgtcctggccc

SEQ ID NO: 756468 - DNA, 12 bp, Homo sapiens
gcattttcttca

SEQ ID NO: 756469 - DNA, 17 bp, Homo sapiens
gcattttgctattgtaa

SEQ ID NO: 756470 - DNA, 12 bp, Homo sapiens
gcattttgtaat

SEQ ID NO: 756471 - DNA, 23 bp, Homo sapiens
gcattttgtatttgtctaactgg

SEQ ID NO: 756472 - DNA, 19 bp, Homo sapiens
gcattttgtttctgtatat

SEQ ID NO: 756473 - DNA, 14 bp, Homo sapiens
gcatttttaaactt

SEQ ID NO: 756474 - DNA, 16 bp, Homo sapiens
gcatttttaagggagt

SEQ ID NO: 756475 - DNA, 22 bp, Homo sapiens
gcatttttatactcagaactgt

SEQ ID NO: 756476 - DNA, 16 bp, Homo sapiens
gcatttttatgcagac

SEQ ID NO: 756477 - DNA, 21 bp, Homo sapiens
gcatttttcaatatattgaac

SEQ ID NO: 756478 - DNA, 21 bp, Homo sapiens
gcatttttgatttatgcatgg

SEQ ID NO: 756479 - DNA, 13 bp, Homo sapiens
gccaaaaaggacc

SEQ ID NO: 756480 - DNA, 19 bp, Homo sapiens
gccaaaaaggatacataat

SEQ ID NO: 756481 - DNA, 21 bp, Homo sapiens
gccaaaaatacaacacagacg

SEQ ID NO: 756482 - DNA, 13 bp, Homo sapiens
gccaaaaatacag

SEQ ID NO: 756483 - DNA, 18 bp, Homo sapiens
gccaaaaccacatgggct

SEQ ID NO: 756484 - DNA, 19 bp, Homo sapiens
gccaaaaccacatgggctg

SEQ ID NO: 756485 - DNA, 15 bp, Homo sapiens
gccaaaagctgctca

SEQ ID NO: 756486 - DNA, 18 bp, Homo sapiens
gccaaaagtccctccctg

SEQ ID NO: 756487 - DNA, 14 bp, Homo sapiens
gccaaaatgacttt

SEQ ID NO: 756488 - DNA, 23 bp, Homo sapiens
gccaaaatggttaatttttcctg

SEQ ID NO: 756489 - DNA, 21 bp, Homo sapiens
gccaaaatgtacttaaatgag

SEQ ID NO: 756490 - DNA, 18 bp, Homo sapiens
gccaaaatgttggctgcg

SEQ ID NO: 756491 - DNA, 17 bp, Homo sapiens
gccaaaccaagcaaatt

SEQ ID NO: 756492 - DNA, 17 bp, Homo sapiens
gccaaacccttgctttc

SEQ ID NO: 756493 - DNA, 19 bp, Homo sapiens
gccaaacccttgctttcct

SEQ ID NO: 756494 - DNA, 20 bp, Homo sapiens
gccaaacccttgctttcctg

SEQ ID NO: 756495 - DNA, 19 bp, Homo sapiens
gccaaagaaacaagctgtg

SEQ ID NO: 756496 - DNA, 23 bp, Homo sapiens
gccaaagaaacaagctgtgcagg

SEQ ID NO: 756497 - DNA, 17 bp, Homo sapiens
gccaaagaaatgggcct

SEQ ID NO: 756498 - DNA, 18 bp, Homo sapiens
gccaaagaaatgggcctg

SEQ ID NO: 756499 - DNA, 23 bp, Homo sapiens
gccaaagaaatgggcctgcctgc

SEQ ID NO: 756500 - DNA, 15 bp, Homo sapiens
gccaaagagcctttc

SEQ ID NO: 756501 - DNA, 16 bp, Homo sapiens
gccaaagagcctttcc

SEQ ID NO: 756502 - DNA, 19 bp, Homo sapiens
gccaaagagcctttccaaa

SEQ ID NO: 756503 - DNA, 14 bp, Homo sapiens
gccaaagccccatg

SEQ ID NO: 756504 - DNA, 16 bp, Homo sapiens
gccaaagcctcctcca

SEQ ID NO: 756505 - DNA, 23 bp, Homo sapiens
gccaaaggaccgttttgtattgc

SEQ ID NO: 756506 - DNA, 20 bp, Homo sapiens
gccaaaggctggtggcaagt

SEQ ID NO: 756507 - DNA, 16 bp, Homo sapiens
gccaaaggggagccag

SEQ ID NO: 756508 - DNA, 18 bp, Homo sapiens
gccaaagtgcagcccttc

SEQ ID NO: 756509 - DNA, 13 bp, Homo sapiens
gccaaagtgcctg

SEQ ID NO: 756510 - DNA, 14 bp, Homo sapiens
gccaaagtgcctgg

SEQ ID NO: 756511 - DNA, 15 bp, Homo sapiens
gccaaatagcaaaga

SEQ ID NO: 756512 - DNA, 15 bp, Homo sapiens
gccaaataggaggga

SEQ ID NO: 756513 - DNA, 20 bp, Homo sapiens
gccaaatatgcactttccct

SEQ ID NO: 756514 - DNA, 23 bp, Homo sapiens
gccaaatccgctctcttcctgcc

SEQ ID NO: 756515 - DNA, 19 bp, Homo sapiens
gccaaattatttgtgtaat

SEQ ID NO: 756516 - DNA, 23 bp, Homo sapiens
gccaaattatttgtgtaatagaa

SEQ ID NO: 756517 - DNA, 22 bp, Homo sapiens
gccaacaaaccctctgtagcta

SEQ ID NO: 756518 - DNA, 16 bp, Homo sapiens
gccaacaactctgcct

SEQ ID NO: 756519 - DNA, 16 bp, Homo sapiens
gccaacaggtggcagg

SEQ ID NO: 756520 - DNA, 23 bp, Homo sapiens
gccaacaggtggcaggaccagga

SEQ ID NO: 756521 - DNA, 20 bp, Homo sapiens
gccaacagtcaaaacagaga

SEQ ID NO: 756522 - DNA, 23 bp, Homo sapiens
gccaacagttgtatgtttgctga

SEQ ID NO: 756523 - DNA, 22 bp, Homo sapiens
gccaaccagcccgacagtgcca

SEQ ID NO: 756524 - DNA, 12 bp, Homo sapiens
gccaaccagcct

SEQ ID NO: 756525 - DNA, 14 bp, Homo sapiens
gccaaccagccttt

SEQ ID NO: 756526 - DNA, 14 bp, Homo sapiens
gccaaccaggaccc

SEQ ID NO: 756527 - DNA, 15 bp, Homo sapiens
gccaaccaggaccca

SEQ ID NO: 756528 - DNA, 16 bp, Homo sapiens
gccaaccaggacccag

SEQ ID NO: 756529 - DNA, 19 bp, Homo sapiens
gccaaccccacccagctcc

SEQ ID NO: 756530 - DNA, 15 bp, Homo sapiens
gccaacccctgtgga

SEQ ID NO: 756531 - DNA, 13 bp, Homo sapiens
gccaacccttctc

SEQ ID NO: 756532 - DNA, 14 bp, Homo sapiens
gccaacctgatgcc

SEQ ID NO: 756533 - DNA, 23 bp, Homo sapiens
gccaacgacaaagccaaactctg

SEQ ID NO: 756534 - DNA, 15 bp, Homo sapiens
gccaacgagacacat

SEQ ID NO: 756535 - DNA, 21 bp, Homo sapiens
gccaacgagacacattgcctt

SEQ ID NO: 756536 - DNA, 22 bp, Homo sapiens
gccaacgagacacattgccttc

SEQ ID NO: 756537 - DNA, 16 bp, Homo sapiens
gccaactaagccctcg

SEQ ID NO: 756538 - DNA, 23 bp, Homo sapiens
gccaactaagccctcgaaccaag

SEQ ID NO: 756539 - DNA, 17 bp, Homo sapiens
gccaactagcccctggg

SEQ ID NO: 756540 - DNA, 18 bp, Homo sapiens
gccaactatgattattaa

SEQ ID NO: 756541 - DNA, 20 bp, Homo sapiens
gccaactgattttgtatgta

SEQ ID NO: 756542 - DNA, 22 bp, Homo sapiens
gccaactgcaaaaaaagcctcc

SEQ ID NO: 756543 - DNA, 22 bp, Homo sapiens
gccaacttgagggcccagagca

SEQ ID NO: 756544 - DNA, 17 bp, Homo sapiens
gccaacttgtaaataca

SEQ ID NO: 756545 - DNA, 18 bp, Homo sapiens
gccaacttgtaaatacac

SEQ ID NO: 756546 - DNA, 18 bp, Homo sapiens
gccaagaaaatgaaggga

SEQ ID NO: 756547 - DNA, 19 bp, Homo sapiens
gccaagaaagatgtatata

SEQ ID NO: 756548 - DNA, 22 bp, Homo sapiens
gccaagaagcctgcaggagaaa

SEQ ID NO: 756549 - DNA, 19 bp, Homo sapiens
gccaagaatattgcaaaat

SEQ ID NO: 756550 - DNA, 13 bp, Homo sapiens
gccaagacaaatc

SEQ ID NO: 756551 - DNA, 19 bp, Homo sapiens
gccaagacaaatcaacaga

SEQ ID NO: 756552 - DNA, 20 bp, Homo sapiens
gccaagataggaccttgggc

SEQ ID NO: 756553 - DNA, 22 bp, Homo sapiens
gccaagataggaccttgggcca

SEQ ID NO: 756554 - DNA, 23 bp, Homo sapiens
gccaagatggaagtcacctttct

SEQ ID NO: 756555 - DNA, 16 bp, Homo sapiens
gccaagattgtccttt

SEQ ID NO: 756556 - DNA, 15 bp, Homo sapiens
gccaagattttcctc

SEQ ID NO: 756557 - DNA, 22 bp, Homo sapiens
gccaagcacctagcctcgctct

SEQ ID NO: 756558 - DNA, 19 bp, Homo sapiens
gccaagcctgctgtgtcct

SEQ ID NO: 756559 - DNA, 12 bp, Homo sapiens
gccaagccttct

SEQ ID NO: 756560 - DNA, 23 bp, Homo sapiens
gccaagcgggggcgtggctggcc

SEQ ID NO: 756561 - DNA, 16 bp, Homo sapiens
cctgttgggctgaacc

SEQ ID NO: 756562 - DNA, 13 bp, Homo sapiens
cctgtttactgat

SEQ ID NO: 756563 - DNA, 19 bp, Homo sapiens
cctgtttataatctgaaga

SEQ ID NO: 756564 - DNA, 14 bp, Homo sapiens
cctgtttctgcagc

SEQ ID NO: 756565 - DNA, 21 bp, Homo sapiens
cctgtttctggaagactgctc

SEQ ID NO: 756566 - DNA, 14 bp, Homo sapiens
cctgtttctgtaga

SEQ ID NO: 756567 - DNA, 15 bp, Homo sapiens
cctgtttgaaatatc

SEQ ID NO: 756568 - DNA, 11 bp, Homo sapiens
cctgtttgatg

SEQ ID NO: 756569 - DNA, 21 bp, Homo sapiens
cctgtttggcctctctatcct

SEQ ID NO: 756570 - DNA, 16 bp, Homo sapiens
cctgtttggtggggtg

SEQ ID NO: 756571 - DNA, 17 bp, Homo sapiens
cctgtttgttgagtgca

SEQ ID NO: 756572 - DNA, 15 bp, Homo sapiens
cctgttttctccctc

SEQ ID NO: 756573 - DNA, 18 bp, Homo sapiens
cctgttttctccctctca

SEQ ID NO: 756574 - DNA, 16 bp, Homo sapiens
cctgttttctgagccc

SEQ ID NO: 756575 - DNA, 23 bp, Homo sapiens
cctgttttcttaggcactgaggg

SEQ ID NO: 756576 - DNA, 19 bp, Homo sapiens
gccaccaccctcaggtgcc

SEQ ID NO: 756577 - DNA, 22 bp, Homo sapiens
gccaccaccctcaggtgcctcc

SEQ ID NO: 756578 - DNA, 19 bp, Homo sapiens
gccaccacctttggctggt

SEQ ID NO: 756579 - DNA, 16 bp, Homo sapiens
gccaccacgtccagct

SEQ ID NO: 756580 - DNA, 17 bp, Homo sapiens
gccaccacgtctgccag

SEQ ID NO: 756581 - DNA, 17 bp, Homo sapiens
gccaccacttccagagc

SEQ ID NO: 756582 - DNA, 21 bp, Homo sapiens
gccaccagacttggcctccag

SEQ ID NO: 756583 - DNA, 20 bp, Homo sapiens
gccaccagccatcctccctc

SEQ ID NO: 756584 - DNA, 15 bp, Homo sapiens
gccaccagctctgcc

SEQ ID NO: 756585 - DNA, 12 bp, Homo sapiens
gccaccaggatg

SEQ ID NO: 756586 - DNA, 17 bp, Homo sapiens
gccaccaggctggcgca

SEQ ID NO: 756587 - DNA, 12 bp, Homo sapiens
gccaccagggag

SEQ ID NO: 756588 - DNA, 18 bp, Homo sapiens
gccaccagggagcttcct

SEQ ID NO: 756589 - DNA, 22 bp, Homo sapiens
gccaccagggagcttcctggct

SEQ ID NO: 756590 - DNA, 19 bp, Homo sapiens
gccaccagtggacctagcc

SEQ ID NO: 756591 - DNA, 22 bp, Homo sapiens
gccaccatattcagtgctgtgg

SEQ ID NO: 756592 - DNA, 23 bp, Homo sapiens
gccaccatattcagtgctgtggc

SEQ ID NO: 756593 - DNA, 21 bp, Homo sapiens
gccaccatgcttgcctgaagc

SEQ ID NO: 756594 - DNA, 17 bp, Homo sapiens
gccaccatggccagcca

SEQ ID NO: 756595 - DNA, 19 bp, Homo sapiens
gccacccaagcctgctggc

SEQ ID NO: 756596 - DNA, 20 bp, Homo sapiens
gccacccaagcctgctggct

SEQ ID NO: 756597 - DNA, 16 bp, Homo sapiens
gccacccacctccctg

SEQ ID NO: 756598 - DNA, 18 bp, Homo sapiens
gccacccacctccctgcc

SEQ ID NO: 756599 - DNA, 12 bp, Homo sapiens
gccacccactca

SEQ ID NO: 756600 - DNA, 13 bp, Homo sapiens
gccacccactcag

SEQ ID NO: 756601 - DNA, 18 bp, Homo sapiens
gccacccactcaggattg

SEQ ID NO: 756602 - DNA, 20 bp, Homo sapiens
gccacccatcgtccacccca

SEQ ID NO: 756603 - DNA, 16 bp, Homo sapiens
gccacccattcttccc

SEQ ID NO: 756604 - DNA, 14 bp, Homo sapiens
gccaccccaaccca

SEQ ID NO: 756605 - DNA, 22 bp, Homo sapiens
gccaccccagagtgggagaggc

SEQ ID NO: 756606 - DNA, 14 bp, Homo sapiens
gccaccccatgagc

SEQ ID NO: 756607 - DNA, 13 bp, Homo sapiens
gccacccccaggc

SEQ ID NO: 756608 - DNA, 16 bp, Homo sapiens
gccacccccaggtctt

SEQ ID NO: 756609 - DNA, 17 bp, Homo sapiens
gccacccccaggtcttc

SEQ ID NO: 756610 - DNA, 16 bp, Homo sapiens
gccacccccagttcct

SEQ ID NO: 756611 - DNA, 14 bp, Homo sapiens
gccacccccatgga

SEQ ID NO: 756612 - DNA, 15 bp, Homo sapiens
gccacccccgccccc

SEQ ID NO: 756613 - DNA, 19 bp, Homo sapiens
gccacccccgctggaggat

SEQ ID NO: 756614 - DNA, 23 bp, Homo sapiens
gccaccccgagggctgagcctgg

SEQ ID NO: 756615 - DNA, 21 bp, Homo sapiens
gccaccccgggctctctgctg

SEQ ID NO: 756616 - DNA, 14 bp, Homo sapiens
gccacccctcagat

SEQ ID NO: 756617 - DNA, 17 bp, Homo sapiens
gccacccctgccactca

SEQ ID NO: 756618 - DNA, 13 bp, Homo sapiens
gccaccccttcct

SEQ ID NO: 756619 - DNA, 15 bp, Homo sapiens
gccacccgggcaagg

SEQ ID NO: 756620 - DNA, 22 bp, Homo sapiens
gccaccctagccaatgtctcct

SEQ ID NO: 756621 - DNA, 21 bp, Homo sapiens
gccaccctcacacacacagct

SEQ ID NO: 756622 - DNA, 22 bp, Homo sapiens
gccaccctccacgaggtgtgac

SEQ ID NO: 756623 - DNA, 18 bp, Homo sapiens
gccaccctccttcccgcc

SEQ ID NO: 756624 - DNA, 13 bp, Homo sapiens
gccaccctctggg

SEQ ID NO: 756625 - DNA, 14 bp, Homo sapiens
gccaccctgcccct

SEQ ID NO: 756626 - DNA, 23 bp, Homo sapiens
gccaccctgcccctaagttatta

SEQ ID NO: 756627 - DNA, 15 bp, Homo sapiens
gccaccctgctgcac

SEQ ID NO: 756628 - DNA, 18 bp, Homo sapiens
gccaccctgctgcactag

SEQ ID NO: 756629 - DNA, 14 bp, Homo sapiens
gccaccctggcccg

SEQ ID NO: 756630 - DNA, 23 bp, Homo sapiens
gccaccctggcccgcccctcgct

SEQ ID NO: 756631 - DNA, 15 bp, Homo sapiens
gccaccgactgccca

SEQ ID NO: 756632 - DNA, 16 bp, Homo sapiens
gccaccgactgcccag

SEQ ID NO: 756633 - DNA, 16 bp, Homo sapiens
gccaccgcccagctca

SEQ ID NO: 756634 - DNA, 17 bp, Homo sapiens
gccaccgcgcccagcct

SEQ ID NO: 756635 - DNA, 17 bp, Homo sapiens
gccaccgcgcctggccg

SEQ ID NO: 756636 - DNA, 23 bp, Homo sapiens
gccaccggggcaagagggaaggt

SEQ ID NO: 756637 - DNA, 14 bp, Homo sapiens
gccaccgggggtgg

SEQ ID NO: 756638 - DNA, 20 bp, Homo sapiens
gccaccgggggtggctctgt

SEQ ID NO: 756639 - DNA, 15 bp, Homo sapiens
gccaccgtgcctggc

SEQ ID NO: 756640 - DNA, 16 bp, Homo sapiens
gccaccgtgcctggcc

SEQ ID NO: 756641 - DNA, 16 bp, Homo sapiens
gccaccgtgcctggct

SEQ ID NO: 756642 - DNA, 13 bp, Homo sapiens
gccaccgtggggg

SEQ ID NO: 756643 - DNA, 14 bp, Homo sapiens
gccaccgtttcttc

SEQ ID NO: 756644 - DNA, 15 bp, Homo sapiens
gccaccgtttcttcc

SEQ ID NO: 756645 - DNA, 19 bp, Homo sapiens
gccacctatctcgtgggag

SEQ ID NO: 756646 - DNA, 20 bp, Homo sapiens
gccacctatctcgtgggaga

SEQ ID NO: 756647 - DNA, 14 bp, Homo sapiens
gccacctcagggca

SEQ ID NO: 756648 - DNA, 15 bp, Homo sapiens
gccacctccagaaac

SEQ ID NO: 756649 - DNA, 11 bp, Homo sapiens
gccacctcccc

SEQ ID NO: 756650 - DNA, 12 bp, Homo sapiens
gccacctcccct

SEQ ID NO: 756651 - DNA, 15 bp, Homo sapiens
gccacctcccctatc

SEQ ID NO: 756652 - DNA, 21 bp, Homo sapiens
gccacctcccctatccaccca

SEQ ID NO: 756653 - DNA, 14 bp, Homo sapiens
gccacctccgccag

SEQ ID NO: 756654 - DNA, 18 bp, Homo sapiens
gccacctcctaccccttc

SEQ ID NO: 756655 - DNA, 12 bp, Homo sapiens
gccacctcctcc

SEQ ID NO: 756656 - DNA, 15 bp, Homo sapiens
gccacctcctccccc

SEQ ID NO: 756657 - DNA, 22 bp, Homo sapiens
gccacctcctccccctgttctg

SEQ ID NO: 756658 - DNA, 12 bp, Homo sapiens
gccacctctcca

SEQ ID NO: 756659 - DNA, 23 bp, Homo sapiens
gccacctctccaagggcttctgc

SEQ ID NO: 756660 - DNA, 22 bp, Homo sapiens
gccacctgaggtgggcccagga

SEQ ID NO: 756661 - DNA, 18 bp, Homo sapiens
gccacctgcaagatggac

SEQ ID NO: 756662 - DNA, 10 bp, Homo sapiens
gccacctgcc

SEQ ID NO: 756663 - DNA, 19 bp, Homo sapiens
gccacctgccacccccagg

SEQ ID NO: 756664 - DNA, 16 bp, Homo sapiens
gccacctgcccccttc

SEQ ID NO: 756665 - DNA, 17 bp, Homo sapiens
gccacctgcccccttct

SEQ ID NO: 756666 - DNA, 18 bp, Homo sapiens
gccacctgcccccttctc

SEQ ID NO: 756667 - DNA, 22 bp, Homo sapiens
gccacctggcagggctcacact

SEQ ID NO: 756668 - DNA, 22 bp, Homo sapiens
gccaccttgttacaaatttttt

SEQ ID NO: 756669 - DNA, 13 bp, Homo sapiens
gccacgactgcca

SEQ ID NO: 756670 - DNA, 15 bp, Homo sapiens
gccacgattggagaa

SEQ ID NO: 756671 - DNA, 23 bp, Homo sapiens
gccacgcaggggctctgagcccg

SEQ ID NO: 756672 - DNA, 18 bp, Homo sapiens
gccacgcagtgcctggag

SEQ ID NO: 756673 - DNA, 12 bp, Homo sapiens
gccacgccccag

SEQ ID NO: 756674 - DNA, 14 bp, Homo sapiens
gccacgccccagcc

SEQ ID NO: 756675 - DNA, 17 bp, Homo sapiens
gccacgccccagcccga

SEQ ID NO: 756676 - DNA, 17 bp, Homo sapiens
gccacgctcagtgcccg

SEQ ID NO: 756677 - DNA, 13 bp, Homo sapiens
gccacgctccagc

SEQ ID NO: 756678 - DNA, 14 bp, Homo sapiens
gccacgctccagct

SEQ ID NO: 756679 - DNA, 16 bp, Homo sapiens
gccacgctccagctgc

SEQ ID NO: 756680 - DNA, 18 bp, Homo sapiens
gccacgctgtcctctcga

SEQ ID NO: 756681 - DNA, 14 bp, Homo sapiens
gccacgctttgctg

SEQ ID NO: 756682 - DNA, 19 bp, Homo sapiens
gccacggataccgccacgg

SEQ ID NO: 756683 - DNA, 14 bp, Homo sapiens
gccacggccaccct

SEQ ID NO: 756684 - DNA, 15 bp, Homo sapiens
gccacggccaccctc

SEQ ID NO: 756685 - DNA, 19 bp, Homo sapiens
gccacggtttatcctcttg

SEQ ID NO: 756686 - DNA, 15 bp, Homo sapiens
gccacgtatagtcct

SEQ ID NO: 756687 - DNA, 15 bp, Homo sapiens
gccacgtcatgtctc

SEQ ID NO: 756688 - DNA, 21 bp, Homo sapiens
gccacgtcccaccccacctct

SEQ ID NO: 756689 - DNA, 21 bp, Homo sapiens
gccacgtcccagcatccctgg

SEQ ID NO: 756690 - DNA, 17 bp, Homo sapiens
gccacgtcccgctgcct

SEQ ID NO: 756691 - DNA, 14 bp, Homo sapiens
gccacgtgaatggc

SEQ ID NO: 756692 - DNA, 17 bp, Homo sapiens
gccacgtgccaggcccg

SEQ ID NO: 756693 - DNA, 18 bp, Homo sapiens
gccacgtgccaggcccgg

SEQ ID NO: 756694 - DNA, 21 bp, Homo sapiens
gccacgtgggcaaacaggcag

SEQ ID NO: 756695 - DNA, 20 bp, Homo sapiens
ccttcccgacccagccagct

SEQ ID NO: 756696 - DNA, 12 bp, Homo sapiens
ccttccctagct

SEQ ID NO: 756697 - DNA, 19 bp, Homo sapiens
ccttccctcactcttcctc

SEQ ID NO: 756698 - DNA, 11 bp, Homo sapiens
ccttgcctggt

SEQ ID NO: 756699 - DNA, 15 bp, Homo sapiens
ccttgcctggtacag

SEQ ID NO: 756700 - DNA, 20 bp, Homo sapiens
ccttgcctttcgaggcctga

SEQ ID NO: 756701 - DNA, 13 bp, Homo sapiens
ccttgcgcctcag

SEQ ID NO: 756702 - DNA, 15 bp, Homo sapiens
ccttgcgcctcagcc

SEQ ID NO: 756703 - DNA, 20 bp, Homo sapiens
ccttgcgctgtcccaggcat

SEQ ID NO: 756704 - DNA, 14 bp, Homo sapiens
ccttgcggaagcca

SEQ ID NO: 756705 - DNA, 19 bp, Homo sapiens
ccttgcggaagccataggg

SEQ ID NO: 756706 - DNA, 20 bp, Homo sapiens
ccttgcggaagccatagggg

SEQ ID NO: 756707 - DNA, 11 bp, Homo sapiens
ccttgctacct

SEQ ID NO: 756708 - DNA, 12 bp, Homo sapiens
ccttgctacctc

SEQ ID NO: 756709 - DNA, 17 bp, Homo sapiens
ccttgctagctagccag

SEQ ID NO: 756710 - DNA, 18 bp, Homo sapiens
ccttgctcgctgtaaaat

SEQ ID NO: 756711 - DNA, 22 bp, Homo sapiens
ccttgctctcccctgccctgct

SEQ ID NO: 756712 - DNA, 18 bp, Homo sapiens
ccttgctctgagcacagg

SEQ ID NO: 756713 - DNA, 17 bp, Homo sapiens
ccttgctgaccccaggt

SEQ ID NO: 756714 - DNA, 18 bp, Homo sapiens
ccttgctgaccccaggtc

SEQ ID NO: 756715 - DNA, 18 bp, Homo sapiens
ccttgctgactctctgag

SEQ ID NO: 756716 - DNA, 20 bp, Homo sapiens
ccttgctgactctctgagct

SEQ ID NO: 756717 - DNA, 11 bp, Homo sapiens
ccttgctgccc

SEQ ID NO: 756718 - DNA, 23 bp, Homo sapiens
ccttgctgcccgcgggagacagc

SEQ ID NO: 756719 - DNA, 17 bp, Homo sapiens
ccttgctggccccagcc

SEQ ID NO: 756720 - DNA, 20 bp, Homo sapiens
ccttgctggccccagccctg

SEQ ID NO: 756721 - DNA, 21 bp, Homo sapiens
ccttgctggccccagccctgc

SEQ ID NO: 756722 - DNA, 12 bp, Homo sapiens
ccttgctgggcc

SEQ ID NO: 756723 - DNA, 19 bp, Homo sapiens
ccttgctggggtccagggc

SEQ ID NO: 756724 - DNA, 21 bp, Homo sapiens
ccttgctgtatgctgatcatc

SEQ ID NO: 756725 - DNA, 14 bp, Homo sapiens
ccttgctgtcctga

SEQ ID NO: 756726 - DNA, 16 bp, Homo sapiens
ccttgctgtcctgatc

SEQ ID NO: 756727 - DNA, 12 bp, Homo sapiens
ccttgctgtgaa

SEQ ID NO: 756728 - DNA, 21 bp, Homo sapiens
ccttgctgtttgtcctgagat

SEQ ID NO: 756729 - DNA, 16 bp, Homo sapiens
ccttgcttacctctca

SEQ ID NO: 756730 - DNA, 21 bp, Homo sapiens
ccttgcttctcccatttcctg

SEQ ID NO: 756731 - DNA, 23 bp, Homo sapiens
ccttgcttctcccatttcctgat

SEQ ID NO: 756732 - DNA, 15 bp, Homo sapiens
ccttgctttcctggg

SEQ ID NO: 756733 - DNA, 18 bp, Homo sapiens
ccttgctttcctgggcct

SEQ ID NO: 756734 - DNA, 19 bp, Homo sapiens
ccttgctttcctgggcctt

SEQ ID NO: 756735 - DNA, 15 bp, Homo sapiens
ccttgctttgggctt

SEQ ID NO: 756736 - DNA, 23 bp, Homo sapiens
ccttgctttggggggtgtgctga

SEQ ID NO: 756737 - DNA, 15 bp, Homo sapiens
ccttgctttgtctgg

SEQ ID NO: 756738 - DNA, 18 bp, Homo sapiens
ccttgcttttccctcttt

SEQ ID NO: 756739 - DNA, 20 bp, Homo sapiens
ccttgcttttccctcttttc

SEQ ID NO: 756740 - DNA, 20 bp, Homo sapiens
ccttggaaaccgtgtgtcca

SEQ ID NO: 756741 - DNA, 19 bp, Homo sapiens
ccttggaaacctgccctgc

SEQ ID NO: 756742 - DNA, 22 bp, Homo sapiens
ccttggaaatagaaagaagcca

SEQ ID NO: 756743 - DNA, 19 bp, Homo sapiens
ccttggaaatgtctgctgg

SEQ ID NO: 756744 - DNA, 20 bp, Homo sapiens
ccttggaaatgtctgctggt

SEQ ID NO: 756745 - DNA, 16 bp, Homo sapiens
ccttggaaccagcccc

SEQ ID NO: 756746 - DNA, 15 bp, Homo sapiens
ccttggaagtttcat

SEQ ID NO: 756747 - DNA, 23 bp, Homo sapiens
ccttggaccactcctgtccctgt

SEQ ID NO: 756748 - DNA, 14 bp, Homo sapiens
ccttggacctccag

SEQ ID NO: 756749 - DNA, 16 bp, Homo sapiens
ccttggacctccaggg

SEQ ID NO: 756750 - DNA, 16 bp, Homo sapiens
ccttggactccatcgc

SEQ ID NO: 756751 - DNA, 16 bp, Homo sapiens
ccttggagaggagagt

SEQ ID NO: 756752 - DNA, 13 bp, Homo sapiens
ccttggagcaggc

SEQ ID NO: 756753 - DNA, 13 bp, Homo sapiens
ccttggagccccg

SEQ ID NO: 756754 - DNA, 16 bp, Homo sapiens
ccttggaggaatgaca

SEQ ID NO: 756755 - DNA, 22 bp, Homo sapiens
ccttggataatgctgttgcctc

SEQ ID NO: 756756 - DNA, 22 bp, Homo sapiens
ccttggatcctgaatctgtgca

SEQ ID NO: 756757 - DNA, 17 bp, Homo sapiens
ccttggcaccaccaggg

SEQ ID NO: 756758 - DNA, 18 bp, Homo sapiens
ccttggcacccccatgct

SEQ ID NO: 756759 - DNA, 21 bp, Homo sapiens
ccttggcacccccatgctgcc

SEQ ID NO: 756760 - DNA, 19 bp, Homo sapiens
ccttggcatcacagggcag

SEQ ID NO: 756761 - DNA, 23 bp, Homo sapiens
ccttggcatgggcgcaggcccag

SEQ ID NO: 756762 - DNA, 21 bp, Homo sapiens
ccttggccccctttcccgggc

SEQ ID NO: 756763 - DNA, 12 bp, Homo sapiens
ccttggcccctc

SEQ ID NO: 756764 - DNA, 22 bp, Homo sapiens
ccttggcccctccctcccggct

SEQ ID NO: 756765 - DNA, 21 bp, Homo sapiens
ccttggccgcataggcccagc

SEQ ID NO: 756766 - DNA, 16 bp, Homo sapiens
ccttggccggctgtgc

SEQ ID NO: 756767 - DNA, 20 bp, Homo sapiens
ccttggccggctgtgctcag

SEQ ID NO: 756768 - DNA, 24 bp, Homo sapiens
ccttggcctcccaaagtgctggga

SEQ ID NO: 756769 - DNA, 14 bp, Homo sapiens
ccttggcctgtcca

SEQ ID NO: 756770 - DNA, 17 bp, Homo sapiens
ccttggcgctctcagct

SEQ ID NO: 756771 - DNA, 21 bp, Homo sapiens
ccttggctatgaaaatgagcc

SEQ ID NO: 756772 - DNA, 22 bp, Homo sapiens
ccttggctatgaaaatgagccc

SEQ ID NO: 756773 - DNA, 12 bp, Homo sapiens
ccttggctcaga

SEQ ID NO: 756774 - DNA, 16 bp, Homo sapiens
ccttggctcccggggg

SEQ ID NO: 756775 - DNA, 21 bp, Homo sapiens
ccttggctcccgggggcccca

SEQ ID NO: 756776 - DNA, 16 bp, Homo sapiens
ccttggctgaattaaa

SEQ ID NO: 756777 - DNA, 21 bp, Homo sapiens
ccttggctgaattaaaatggt

SEQ ID NO: 756778 - DNA, 20 bp, Homo sapiens
ccttggctgacatgaagctg

SEQ ID NO: 756779 - DNA, 12 bp, Homo sapiens
ccttggctgcag

SEQ ID NO: 756780 - DNA, 22 bp, Homo sapiens
ccttggctgcagccatcccgct

SEQ ID NO: 756781 - DNA, 21 bp, Homo sapiens
ccttggctgtgaggcccctgg

SEQ ID NO: 756782 - DNA, 14 bp, Homo sapiens
ccttggcttctgct

SEQ ID NO: 756783 - DNA, 17 bp, Homo sapiens
ccttggcttctgtgatg

SEQ ID NO: 756784 - DNA, 16 bp, Homo sapiens
ccttggcttgcctggt

SEQ ID NO: 756785 - DNA, 13 bp, Homo sapiens
ccttggcttgtta

SEQ ID NO: 756786 - DNA, 17 bp, Homo sapiens
ccttggctttcagagcc

SEQ ID NO: 756787 - DNA, 20 bp, Homo sapiens
ccttggctttcagagccagc

SEQ ID NO: 756788 - DNA, 14 bp, Homo sapiens
ccttgggaaggaca

SEQ ID NO: 756789 - DNA, 18 bp, Homo sapiens
ccttgggaccaaaggggg

SEQ ID NO: 756790 - DNA, 23 bp, Homo sapiens
ccttgggaggttttattctgact

SEQ ID NO: 756791 - DNA, 19 bp, Homo sapiens
ccttgggcatccacccagt

SEQ ID NO: 756792 - DNA, 22 bp, Homo sapiens
ccttgggcatccacccagtgct

SEQ ID NO: 756793 - DNA, 23 bp, Homo sapiens
ccttgggcatccacccagtgctg

SEQ ID NO: 756794 - DNA, 16 bp, Homo sapiens
ccttgggccataatta

SEQ ID NO: 756795 - DNA, 18 bp, Homo sapiens
ccttgggcggctgagagc

SEQ ID NO: 756796 - DNA, 20 bp, Homo sapiens
ccttgggcgtctcccccaga

SEQ ID NO: 756797 - DNA, 12 bp, Homo sapiens
ccttgggctccc

SEQ ID NO: 756798 - DNA, 13 bp, Homo sapiens
ccttgggctccct

SEQ ID NO: 756799 - DNA, 13 bp, Homo sapiens
ccttgggctcctg

SEQ ID NO: 756800 - DNA, 17 bp, Homo sapiens
ccttgggctcctggctg

SEQ ID NO: 756801 - DNA, 23 bp, Homo sapiens
ccttgggctcctggctgccaggc

SEQ ID NO: 756802 - DNA, 17 bp, Homo sapiens
ccttgggctgctcctca

SEQ ID NO: 756803 - DNA, 18 bp, Homo sapiens
ccttgggctgctcctcat

SEQ ID NO: 756804 - DNA, 22 bp, Homo sapiens
ccttggggcctggcttgctcca

SEQ ID NO: 756805 - DNA, 22 bp, Homo sapiens
ccttggggctcagccacagcct

SEQ ID NO: 756806 - DNA, 13 bp, Homo sapiens
ccttggggctggg

SEQ ID NO: 756807 - DNA, 13 bp, Homo sapiens
ccttggggggcca

SEQ ID NO: 756808 - DNA, 17 bp, Homo sapiens
ccttgggggggctgcct

SEQ ID NO: 756809 - DNA, 18 bp, Homo sapiens
ccttgggggggctgcctt

SEQ ID NO: 756810 - DNA, 20 bp, Homo sapiens
ccttgggggggctgcctttg

SEQ ID NO: 756811 - DNA, 19 bp, Homo sapiens
ccttggggtccctccaccc

SEQ ID NO: 756812 - DNA, 21 bp, Homo sapiens
ccttggggtccctccacccca

SEQ ID NO: 756813 - DNA, 16 bp, Homo sapiens
ccttggggtgggggcc

SEQ ID NO: 756814 - DNA, 21 bp, Homo sapiens
ccttgggttccaaccaggcag

SEQ ID NO: 756815 - DNA, 18 bp, Homo sapiens
ccttggtatgtgccaggc

SEQ ID NO: 756816 - DNA, 18 bp, Homo sapiens
ccttggtcccaagcctga

SEQ ID NO: 756817 - DNA, 18 bp, Homo sapiens
ccttggtccctctcagat

SEQ ID NO: 756818 - DNA, 15 bp, Homo sapiens
ccttggtgtccacct

SEQ ID NO: 756819 - DNA, 23 bp, Homo sapiens
cctttcctccccatacacacaca

SEQ ID NO: 756820 - DNA, 17 bp, Homo sapiens
cctttcctctccctcag

SEQ ID NO: 756821 - DNA, 22 bp, Homo sapiens
cctttcctggacactcagacct

SEQ ID NO: 756822 - DNA, 12 bp, Homo sapiens
cctttcctggtt

SEQ ID NO: 756823 - DNA, 11 bp, Homo sapiens
cctttcctgtc

SEQ ID NO: 756824 - DNA, 14 bp, Homo sapiens
cctttcctgtccca

SEQ ID NO: 756825 - DNA, 15 bp, Homo sapiens
cctttcctgtcccac

SEQ ID NO: 756826 - DNA, 17 bp, Homo sapiens
cctttcctgtgccaacc

SEQ ID NO: 756827 - DNA, 12 bp, Homo sapiens
cctttccttccc

SEQ ID NO: 756828 - DNA, 13 bp, Homo sapiens
cctttccttccct

SEQ ID NO: 756829 - DNA, 17 bp, Homo sapiens
cctttccttccctctct

SEQ ID NO: 756830 - DNA, 14 bp, Homo sapiens
gaatctcccctcct

SEQ ID NO: 756831 - DNA, 14 bp, Homo sapiens
gaatctctgcctct

SEQ ID NO: 756832 - DNA, 15 bp, Homo sapiens
gaatctcttcactac

SEQ ID NO: 756833 - DNA, 13 bp, Homo sapiens
gaatctctttccc

SEQ ID NO: 756834 - DNA, 20 bp, Homo sapiens
gaatctgaaagtatattttc

SEQ ID NO: 756835 - DNA, 21 bp, Homo sapiens
gaatctgatctttttatacac

SEQ ID NO: 756836 - DNA, 14 bp, Homo sapiens
gaatctgatgcctt

SEQ ID NO: 756837 - DNA, 12 bp, Homo sapiens
gaatctgccttc

SEQ ID NO: 756838 - DNA, 16 bp, Homo sapiens
gaatctgccttccagc

SEQ ID NO: 756839 - DNA, 17 bp, Homo sapiens
gaatctgccttccagcc

SEQ ID NO: 756840 - DNA, 15 bp, Homo sapiens
gaatctgctgttgcc

SEQ ID NO: 756841 - DNA, 21 bp, Homo sapiens
gaatctgctgttgccatagcc

SEQ ID NO: 756842 - DNA, 21 bp, Homo sapiens
gaatctggcattctacacctg

SEQ ID NO: 756843 - DNA, 14 bp, Homo sapiens
gaatctgggaggga

SEQ ID NO: 756844 - DNA, 17 bp, Homo sapiens
gaatctgggagggaagt

SEQ ID NO: 756845 - DNA, 20 bp, Homo sapiens
gaatctgtgggtctgggagt

SEQ ID NO: 756846 - DNA, 20 bp, Homo sapiens
gaatcttaatgcttgtaatt

SEQ ID NO: 756847 - DNA, 16 bp, Homo sapiens
gaatcttcacctcaga

SEQ ID NO: 756848 - DNA, 17 bp, Homo sapiens
gaatcttcacctcagag

SEQ ID NO: 756849 - DNA, 14 bp, Homo sapiens
gaatcttccccaag

SEQ ID NO: 756850 - DNA, 21 bp, Homo sapiens
gaatcttctcatcttttatct

SEQ ID NO: 756851 - DNA, 20 bp, Homo sapiens
gaatcttgctgcaggccctc

SEQ ID NO: 756852 - DNA, 15 bp, Homo sapiens
gaatctttctcctgg

SEQ ID NO: 756853 - DNA, 16 bp, Homo sapiens
gaatcttttataatga

SEQ ID NO: 756854 - DNA, 15 bp, Homo sapiens
gaatgaaaaaacagt

SEQ ID NO: 756855 - DNA, 15 bp, Homo sapiens
gaatgaaaaatttaa

SEQ ID NO: 756856 - DNA, 20 bp, Homo sapiens
gaatgaaaaatttaagcatt

SEQ ID NO: 756857 - DNA, 23 bp, Homo sapiens
gaatgaaaaatttaagcattgtt

SEQ ID NO: 756858 - DNA, 15 bp, Homo sapiens
gaatgaaaactcatt

SEQ ID NO: 756859 - DNA, 18 bp, Homo sapiens
gaatgaaaagctgctggt

SEQ ID NO: 756860 - DNA, 13 bp, Homo sapiens
gaatgaaaataac

SEQ ID NO: 756861 - DNA, 20 bp, Homo sapiens
gaatgaaaataactgaattt

SEQ ID NO: 756862 - DNA, 21 bp, Homo sapiens
gaatgaaaatacatctttttg

SEQ ID NO: 756863 - DNA, 14 bp, Homo sapiens
gaatgaaaggcctt

SEQ ID NO: 756864 - DNA, 20 bp, Homo sapiens
gaatgaaattcctccttccc

SEQ ID NO: 756865 - DNA, 20 bp, Homo sapiens
gaatgaacactcttttgctt

SEQ ID NO: 756866 - DNA, 17 bp, Homo sapiens
gaatgaaccttctggcc

SEQ ID NO: 756867 - DNA, 16 bp, Homo sapiens
gaatgaagcagtattt

SEQ ID NO: 756868 - DNA, 16 bp, Homo sapiens
gaatgaagctgccatc

SEQ ID NO: 756869 - DNA, 16 bp, Homo sapiens
gaatgaattaaataaa

SEQ ID NO: 756870 - DNA, 12 bp, Homo sapiens
gaatgacactgt

SEQ ID NO: 756871 - DNA, 18 bp, Homo sapiens
gaatgagagcgacacaga

SEQ ID NO: 756872 - DNA, 20 bp, Homo sapiens
gaatgagcccagagaacagc

SEQ ID NO: 756873 - DNA, 20 bp, Homo sapiens
gaatgagcctacgctgaaga

SEQ ID NO: 756874 - DNA, 11 bp, Homo sapiens
gaatgagcctc

SEQ ID NO: 756875 - DNA, 15 bp, Homo sapiens
gaatgaggtgggagg

SEQ ID NO: 756876 - DNA, 21 bp, Homo sapiens
gaatgagtcaatcagccttta

SEQ ID NO: 756877 - DNA, 14 bp, Homo sapiens
gaatgagtgggaat

SEQ ID NO: 756878 - DNA, 14 bp, Homo sapiens
gaatgagtgtgcat

SEQ ID NO: 756879 - DNA, 21 bp, Homo sapiens
gaatgatagaactttgccagt

SEQ ID NO: 756880 - DNA, 22 bp, Homo sapiens
gaatgatagcccagaacaaaaa

SEQ ID NO: 756881 - DNA, 23 bp, Homo sapiens
gaatgatgctcaaaatctttcca

SEQ ID NO: 756882 - DNA, 14 bp, Homo sapiens
gaatgattaatcaa

SEQ ID NO: 756883 - DNA, 21 bp, Homo sapiens
gaatgattcaattttttaatg

SEQ ID NO: 756884 - DNA, 19 bp, Homo sapiens
gaatgattggttaaaatgt

SEQ ID NO: 756885 - DNA, 14 bp, Homo sapiens
gaatgatttcatgc

SEQ ID NO: 756886 - DNA, 18 bp, Homo sapiens
gaatgatttttcattggc

SEQ ID NO: 756887 - DNA, 14 bp, Homo sapiens
gaatgatttttctt

SEQ ID NO: 756888 - DNA, 16 bp, Homo sapiens
gaatgcacagtgggtg

SEQ ID NO: 756889 - DNA, 13 bp, Homo sapiens
gaatgcacctccc

SEQ ID NO: 756890 - DNA, 16 bp, Homo sapiens
gaatgcacctccccaa

SEQ ID NO: 756891 - DNA, 17 bp, Homo sapiens
gaatgcacctccccaaa

SEQ ID NO: 756892 - DNA, 18 bp, Homo sapiens
gaatgcacctccccaaag

SEQ ID NO: 756893 - DNA, 16 bp, Homo sapiens
gaatgcagattcctgg

SEQ ID NO: 756894 - DNA, 13 bp, Homo sapiens
gaatgcagcagga

SEQ ID NO: 756895 - DNA, 20 bp, Homo sapiens
gaatgcagcccaccaggagc

SEQ ID NO: 756896 - DNA, 21 bp, Homo sapiens
gaatgcagggaagagggcagt

SEQ ID NO: 756897 - DNA, 22 bp, Homo sapiens
gaatgcagtcctcatctccagc

SEQ ID NO: 756898 - DNA, 15 bp, Homo sapiens
gaatgcataatgttt

SEQ ID NO: 756899 - DNA, 14 bp, Homo sapiens
gaatgcatgtaagg

SEQ ID NO: 756900 - DNA, 15 bp, Homo sapiens
gaatgcattaaaaaa

SEQ ID NO: 756901 - DNA, 16 bp, Homo sapiens
gaatgcattaaaaaaa

SEQ ID NO: 756902 - DNA, 24 bp, Homo sapiens
gaatgccactttggctgaactaca

SEQ ID NO: 756903 - DNA, 13 bp, Homo sapiens
gaatgccatttct

SEQ ID NO: 756904 - DNA, 17 bp, Homo sapiens
gaatgcccccagctggc

SEQ ID NO: 756905 - DNA, 14 bp, Homo sapiens
gaatgccgtggatt

SEQ ID NO: 756906 - DNA, 20 bp, Homo sapiens
gaatgcctcaatgtgaccag

SEQ ID NO: 756907 - DNA, 21 bp, Homo sapiens
gaatgcctcaatgtgaccagg

SEQ ID NO: 756908 - DNA, 13 bp, Homo sapiens
gaatgcctcctcc

SEQ ID NO: 756909 - DNA, 12 bp, Homo sapiens
gaatgcctggag

SEQ ID NO: 756910 - DNA, 12 bp, Homo sapiens
gaatgcctgtgc

SEQ ID NO: 756911 - DNA, 21 bp, Homo sapiens
gaatgcggccgcattccctga

SEQ ID NO: 756912 - DNA, 23 bp, Homo sapiens
gaatgctcagggtcactgaacca

SEQ ID NO: 756913 - DNA, 13 bp, Homo sapiens
gaatgctcccagc

SEQ ID NO: 756914 - DNA, 14 bp, Homo sapiens
gaatgctcccagct

SEQ ID NO: 756915 - DNA, 20 bp, Homo sapiens
gaatgctcccccatcctccc

SEQ ID NO: 756916 - DNA, 15 bp, Homo sapiens
gaatgctctgtgcca

SEQ ID NO: 756917 - DNA, 10 bp, Homo sapiens
gaatgctgcc

SEQ ID NO: 756918 - DNA, 14 bp, Homo sapiens
gaatgctgccttta

SEQ ID NO: 756919 - DNA, 16 bp, Homo sapiens
gaatgctgggactcag

SEQ ID NO: 756920 - DNA, 18 bp, Homo sapiens
gaatgctgggactcagcc

SEQ ID NO: 756921 - DNA, 12 bp, Homo sapiens
gaatgctgggcc

SEQ ID NO: 756922 - DNA, 21 bp, Homo sapiens
gaatgctgggcccccagcctg

SEQ ID NO: 756923 - DNA, 18 bp, Homo sapiens
gaatgctggttttcctaa

SEQ ID NO: 756924 - DNA, 17 bp, Homo sapiens
gaatgctgtacatctat

SEQ ID NO: 756925 - DNA, 18 bp, Homo sapiens
gaatgctttttgaatgtt

SEQ ID NO: 756926 - DNA, 13 bp, Homo sapiens
gaatggaaaaatc

SEQ ID NO: 756927 - DNA, 19 bp, Homo sapiens
gaatggaaaaatccttgaa

SEQ ID NO: 756928 - DNA, 19 bp, Homo sapiens
gaatggaactactgtactt

SEQ ID NO: 756929 - DNA, 22 bp, Homo sapiens
gaatggaagggttctggctgcc

SEQ ID NO: 756930 - DNA, 14 bp, Homo sapiens
gaatggagaaagta

SEQ ID NO: 756931 - DNA, 15 bp, Homo sapiens
gaatggaggggcaga

SEQ ID NO: 756932 - DNA, 20 bp, Homo sapiens
gaatggaggggcagagccag

SEQ ID NO: 756933 - DNA, 22 bp, Homo sapiens
gaatggaggggcagagccagga

SEQ ID NO: 756934 - DNA, 14 bp, Homo sapiens
gaatggatcacaag

SEQ ID NO: 756935 - DNA, 14 bp, Homo sapiens
gaatggatggggag

SEQ ID NO: 756936 - DNA, 15 bp, Homo sapiens
gaatggatggggaga

SEQ ID NO: 756937 - DNA, 21 bp, Homo sapiens
gaatggcaatagggtagaatg

SEQ ID NO: 756938 - DNA, 13 bp, Homo sapiens
gaatggcagctgc

SEQ ID NO: 756939 - DNA, 16 bp, Homo sapiens
gaatggcagctgccac

SEQ ID NO: 756940 - DNA, 18 bp, Homo sapiens
gaatggcatttgcaataa

SEQ ID NO: 756941 - DNA, 21 bp, Homo sapiens
gaatggcctgccttgaagcca

SEQ ID NO: 756942 - DNA, 14 bp, Homo sapiens
gaatgggagccaga

SEQ ID NO: 756943 - DNA, 22 bp, Homo sapiens
gaatgggagccagaattcacta

SEQ ID NO: 756944 - DNA, 14 bp, Homo sapiens
gaatgggatgtgtg

SEQ ID NO: 756945 - DNA, 13 bp, Homo sapiens
gaatgggggagag

SEQ ID NO: 756946 - DNA, 21 bp, Homo sapiens
gaatggggggcgggccagggt

SEQ ID NO: 756947 - DNA, 18 bp, Homo sapiens
gaatggggttcctgctgt

SEQ ID NO: 756948 - DNA, 17 bp, Homo sapiens
gaatgggttttctattt

SEQ ID NO: 756949 - DNA, 20 bp, Homo sapiens
cccagctacattcctcagct

SEQ ID NO: 756950 - DNA, 22 bp, Homo sapiens
cccagctaccctttttctccag

SEQ ID NO: 756951 - DNA, 23 bp, Homo sapiens
cccagctactcagaagcctgagg

SEQ ID NO: 756952 - DNA, 13 bp, Homo sapiens
ctgccctgcctga

SEQ ID NO: 756953 - DNA, 14 bp, Homo sapiens
ctgccctgcctgag

SEQ ID NO: 756954 - DNA, 15 bp, Homo sapiens
ctgccctgcctgagg

SEQ ID NO: 756955 - DNA, 17 bp, Homo sapiens
ctgccctgcctgaggag

SEQ ID NO: 756956 - DNA, 14 bp, Homo sapiens
ctgccctgcctgcc

SEQ ID NO: 756957 - DNA, 17 bp, Homo sapiens
ctgccctgcctgcccac

SEQ ID NO: 756958 - DNA, 18 bp, Homo sapiens
ctgccctgcctgcccact

SEQ ID NO: 756959 - DNA, 13 bp, Homo sapiens
ctgccctgccttg

SEQ ID NO: 756960 - DNA, 22 bp, Homo sapiens
ctgccctgccttgccgctcccc

SEQ ID NO: 756961 - DNA, 11 bp, Homo sapiens
ctgccctgctg

SEQ ID NO: 756962 - DNA, 13 bp, Homo sapiens
ctgccctgctgcc

SEQ ID NO: 756963 - DNA, 14 bp, Homo sapiens
ctgccctgctgcca

SEQ ID NO: 756964 - DNA, 12 bp, Homo sapiens
ctgccctggagg

SEQ ID NO: 756965 - DNA, 17 bp, Homo sapiens
ctgccctggagggaggc

SEQ ID NO: 756966 - DNA, 13 bp, Homo sapiens
ctgccctggcagc

SEQ ID NO: 756967 - DNA, 16 bp, Homo sapiens
ctgccctggcagcagc

SEQ ID NO: 756968 - DNA, 15 bp, Homo sapiens
ctgccctggccctga

SEQ ID NO: 756969 - DNA, 22 bp, Homo sapiens
ctgccctggccctgaggtgtgg

SEQ ID NO: 756970 - DNA, 20 bp, Homo sapiens
ctgccctggctgctgccccc

SEQ ID NO: 756971 - DNA, 14 bp, Homo sapiens
ctgccctggtccag

SEQ ID NO: 756972 - DNA, 21 bp, Homo sapiens
ctgccctggtccagggaagct

SEQ ID NO: 756973 - DNA, 12 bp, Homo sapiens
ctgccctggtgc

SEQ ID NO: 756974 - DNA, 18 bp, Homo sapiens
ctgccctggtgctgccac

SEQ ID NO: 756975 - DNA, 12 bp, Homo sapiens
ctgccctgtgcc

SEQ ID NO: 756976 - DNA, 13 bp, Homo sapiens
ctgccctgtgccg

SEQ ID NO: 756977 - DNA, 22 bp, Homo sapiens
ctgccctgtgtacttcccgggc

SEQ ID NO: 756978 - DNA, 16 bp, Homo sapiens
ctgcccttcccctccc

SEQ ID NO: 756979 - DNA, 16 bp, Homo sapiens
ctgcccttccctctgg

SEQ ID NO: 756980 - DNA, 17 bp, Homo sapiens
ctgcccttccctctggg

SEQ ID NO: 756981 - DNA, 18 bp, Homo sapiens
ctgcccttccgcagtgtg

SEQ ID NO: 756982 - DNA, 22 bp, Homo sapiens
ctgcccttcctcagtttaatcc

SEQ ID NO: 756983 - DNA, 15 bp, Homo sapiens
ctgcccttcctcctg

SEQ ID NO: 756984 - DNA, 19 bp, Homo sapiens
ctgcccttcctcctgatgg

SEQ ID NO: 756985 - DNA, 17 bp, Homo sapiens
ctgcccttctcaagact

SEQ ID NO: 756986 - DNA, 21 bp, Homo sapiens
ctgcccttgaaccccctccct

SEQ ID NO: 756987 - DNA, 17 bp, Homo sapiens
ctgcccttgatcagccc

SEQ ID NO: 756988 - DNA, 15 bp, Homo sapiens
ctgcccttgctgccc

SEQ ID NO: 756989 - DNA, 16 bp, Homo sapiens
ctgcccttgctgcccg

SEQ ID NO: 756990 - DNA, 13 bp, Homo sapiens
ctgcccttggcac

SEQ ID NO: 756991 - DNA, 19 bp, Homo sapiens
ctgcccttggcaccaccag

SEQ ID NO: 756992 - DNA, 22 bp, Homo sapiens
ctgcccttggcaccaccagggt

SEQ ID NO: 756993 - DNA, 22 bp, Homo sapiens
ctgccctttgcagtgtgcaggg

SEQ ID NO: 756994 - DNA, 19 bp, Homo sapiens
ctgccgaagaattgtcttg

SEQ ID NO: 756995 - DNA, 14 bp, Homo sapiens
ctgccgacatccct

SEQ ID NO: 756996 - DNA, 23 bp, Homo sapiens
ctgccgacatccctcccccagca

SEQ ID NO: 756997 - DNA, 16 bp, Homo sapiens
ctgccgaccgaggctg

SEQ ID NO: 756998 - DNA, 21 bp, Homo sapiens
ctgccgaccgaggctggagct

SEQ ID NO: 756999 - DNA, 23 bp, Homo sapiens
ctgccgaccgaggctggagctgg

SEQ ID NO: 757000 - DNA, 17 bp, Homo sapiens
ctgccgacctcgtcctc

SEQ ID NO: 757001 - DNA, 19 bp, Homo sapiens
ctgccgacctcgtcctccc

SEQ ID NO: 757002 - DNA, 20 bp, Homo sapiens
ctgccgactcccccaaccaa

SEQ ID NO: 757003 - DNA, 17 bp, Homo sapiens
ctgccgacttggagact

SEQ ID NO: 757004 - DNA, 22 bp, Homo sapiens
ctgccgacttggagactcctgg

SEQ ID NO: 757005 - DNA, 19 bp, Homo sapiens
ctgccgagacagaccctct

SEQ ID NO: 757006 - DNA, 13 bp, Homo sapiens
ctgccgagccacc

SEQ ID NO: 757007 - DNA, 15 bp, Homo sapiens
ctgccgagggggctg

SEQ ID NO: 757008 - DNA, 22 bp, Homo sapiens
ctgccgagggggctgtcatgcg

SEQ ID NO: 757009 - DNA, 17 bp, Homo sapiens
ctgccgcatgctccctc

SEQ ID NO: 757010 - DNA, 13 bp, Homo sapiens
ctgccgcccacct

SEQ ID NO: 757011 - DNA, 13 bp, Homo sapiens
ctgccgctgcacc

SEQ ID NO: 757012 - DNA, 14 bp, Homo sapiens
ctgccgctgcacca

SEQ ID NO: 757013 - DNA, 19 bp, Homo sapiens
ctgccgctgcttccaggct

SEQ ID NO: 757014 - DNA, 22 bp, Homo sapiens
ctgccggacacagcaccgtgcc

SEQ ID NO: 757015 - DNA, 18 bp, Homo sapiens
ctgccggatctgggctgt

SEQ ID NO: 757016 - DNA, 14 bp, Homo sapiens
ctgccggctctttc

SEQ ID NO: 757017 - DNA, 19 bp, Homo sapiens
ctgccgggctgagggcctg

SEQ ID NO: 757018 - DNA, 23 bp, Homo sapiens
ctgccgggctgagggcctgctgg

SEQ ID NO: 757019 - DNA, 14 bp, Homo sapiens
ctgccgggttctag

SEQ ID NO: 757020 - DNA, 20 bp, Homo sapiens
ctgccggtcgggcagccagc

SEQ ID NO: 757021 - DNA, 22 bp, Homo sapiens
ctgccggtcgggcagccagcag

SEQ ID NO: 757022 - DNA, 21 bp, Homo sapiens
ctgccggtgggaccctgtccg

SEQ ID NO: 757023 - DNA, 14 bp, Homo sapiens
ctgccggtttgaaa

SEQ ID NO: 757024 - DNA, 18 bp, Homo sapiens
ctgccgtcaccaccaccc

SEQ ID NO: 757025 - DNA, 22 bp, Homo sapiens
ctgccgtcaccaccacccctac

SEQ ID NO: 757026 - DNA, 21 bp, Homo sapiens
ctgccgtctctcctgctctca

SEQ ID NO: 757027 - DNA, 23 bp, Homo sapiens
ctgccgtctctcctgctctcata

SEQ ID NO: 757028 - DNA, 14 bp, Homo sapiens
ctgccgtgcctgtg

SEQ ID NO: 757029 - DNA, 22 bp, Homo sapiens
ctgccgtgggcctgtcgtgcca

SEQ ID NO: 757030 - DNA, 20 bp, Homo sapiens
ctgcctaaatccactctgca

SEQ ID NO: 757031 - DNA, 14 bp, Homo sapiens
ctgcctaagtggct

SEQ ID NO: 757032 - DNA, 17 bp, Homo sapiens
ctgcctacacacacagc

SEQ ID NO: 757033 - DNA, 20 bp, Homo sapiens
ctgcctacagaacttcagaa

SEQ ID NO: 757034 - DNA, 13 bp, Homo sapiens
ctgcctactcacg

SEQ ID NO: 757035 - DNA, 14 bp, Homo sapiens
ctgcctactcacga

SEQ ID NO: 757036 - DNA, 18 bp, Homo sapiens
ctgcctagaaaatgcaaa

SEQ ID NO: 757037 - DNA, 15 bp, Homo sapiens
ctgcctagagtgtag

SEQ ID NO: 757038 - DNA, 18 bp, Homo sapiens
ctgcctagagtgtagcct

SEQ ID NO: 757039 - DNA, 20 bp, Homo sapiens
ctgcctagagtgtagcctaa

SEQ ID NO: 757040 - DNA, 23 bp, Homo sapiens
ctgcctagagtgtagcctaaagg

SEQ ID NO: 757041 - DNA, 14 bp, Homo sapiens
ctgcctagcatggg

SEQ ID NO: 757042 - DNA, 15 bp, Homo sapiens
ctgcctagccctccc

SEQ ID NO: 757043 - DNA, 21 bp, Homo sapiens
ctgcctagccctccccccagc

SEQ ID NO: 757044 - DNA, 19 bp, Homo sapiens
ctgcctaggaggctggcca

SEQ ID NO: 757045 - DNA, 21 bp, Homo sapiens
ctgcctagtcgggacttgtaa

SEQ ID NO: 757046 - DNA, 20 bp, Homo sapiens
ctgcctataatcttatacaa

SEQ ID NO: 757047 - DNA, 15 bp, Homo sapiens
ctgcctcacccacac

SEQ ID NO: 757048 - DNA, 17 bp, Homo sapiens
ctgcctcacccacaccc

SEQ ID NO: 757049 - DNA, 14 bp, Homo sapiens
ctgcctcacttcct

SEQ ID NO: 757050 - DNA, 23 bp, Homo sapiens
ctgcctcacttcctacaagagca

SEQ ID NO: 757051 - DNA, 17 bp, Homo sapiens
ctgcctcagccagtggc

SEQ ID NO: 757052 - DNA, 15 bp, Homo sapiens
ctgcctcagctacct

SEQ ID NO: 757053 - DNA, 14 bp, Homo sapiens
ctgcctcaggactg

SEQ ID NO: 757054 - DNA, 22 bp, Homo sapiens
ctgcctcaggaggcaggacctt

SEQ ID NO: 757055 - DNA, 15 bp, Homo sapiens
ctgcctcaggcactc

SEQ ID NO: 757056 - DNA, 14 bp, Homo sapiens
ctgcctccagaatg

SEQ ID NO: 757057 - DNA, 21 bp, Homo sapiens
ctgcctcccaaggtcctctca

SEQ ID NO: 757058 - DNA, 12 bp, Homo sapiens
ctgcctcccact

SEQ ID NO: 757059 - DNA, 13 bp, Homo sapiens
ctgcctcccatgc

SEQ ID NO: 757060 - DNA, 17 bp, Homo sapiens
ctgcctcccattctgca

SEQ ID NO: 757061 - DNA, 13 bp, Homo sapiens
ctgcctcccccga

SEQ ID NO: 757062 - DNA, 18 bp, Homo sapiens
ctgcctccctcaccctga

SEQ ID NO: 757063 - DNA, 19 bp, Homo sapiens
ctgcctccctcaccctgag

SEQ ID NO: 757064 - DNA, 23 bp, Homo sapiens
ctgcctccctctccatatctcct

SEQ ID NO: 757065 - DNA, 18 bp, Homo sapiens
ctgcctccctctcttccg

SEQ ID NO: 757066 - DNA, 22 bp, Homo sapiens
ctgcctccctctcttccgggag

SEQ ID NO: 757067 - DNA, 12 bp, Homo sapiens
ctgcctcctagg

SEQ ID NO: 757068 - DNA, 19 bp, Homo sapiens
ctgcctcctaggctggaag

SEQ ID NO: 757069 - DNA, 23 bp, Homo sapiens
ctgcctcctccctcccagctgca

SEQ ID NO: 757070 - DNA, 13 bp, Homo sapiens
ctgcctcctcttc

SEQ ID NO: 757071 - DNA, 14 bp, Homo sapiens
ctgcctcctcttca

SEQ ID NO: 757072 - DNA, 15 bp, Homo sapiens
ctgcctcctgccacc

SEQ ID NO: 757073 - DNA, 21 bp, Homo sapiens
ctgcctcctgccaccccttcc

SEQ ID NO: 757074 - DNA, 13 bp, Homo sapiens
ctgcctcctgcct

SEQ ID NO: 757075 - DNA, 16 bp, Homo sapiens
ctgcctcctgcctgcc

SEQ ID NO: 757076 - DNA, 16 bp, Homo sapiens
ctgcctcctgcctggg

SEQ ID NO: 757077 - DNA, 18 bp, Homo sapiens
caggcccaggccagcccc

SEQ ID NO: 757078 - DNA, 18 bp, Homo sapiens
caggcccagtgacaaaga

SEQ ID NO: 757079 - DNA, 19 bp, Homo sapiens
caggcccatctcaggtgcc

SEQ ID NO: 757080 - DNA, 23 bp, Homo sapiens
caggcccatgctatgagttttct

SEQ ID NO: 757081 - DNA, 17 bp, Homo sapiens
caggccccaaaaccaca

SEQ ID NO: 757082 - DNA, 22 bp, Homo sapiens
caggccccaccaagagggtgga

SEQ ID NO: 757083 - DNA, 17 bp, Homo sapiens
caggccccacgccctct

SEQ ID NO: 757084 - DNA, 20 bp, Homo sapiens
caggccccactccttcctga

SEQ ID NO: 757085 - DNA, 11 bp, Homo sapiens
caggcccccgg

SEQ ID NO: 757086 - DNA, 22 bp, Homo sapiens
caggccccgcttgtccagcgcc

SEQ ID NO: 757087 - DNA, 17 bp, Homo sapiens
caggcccctgaggactg

SEQ ID NO: 757088 - DNA, 18 bp, Homo sapiens
caggcccctgaggactgg

SEQ ID NO: 757089 - DNA, 21 bp, Homo sapiens
caggcccctgttatgcttagg

SEQ ID NO: 757090 - DNA, 23 bp, Homo sapiens
caggcccgccctctgcctcctca

SEQ ID NO: 757091 - DNA, 18 bp, Homo sapiens
caggcccgtcggagctgc

SEQ ID NO: 757092 - DNA, 21 bp, Homo sapiens
caggcccgtgggcgcaaaggt

SEQ ID NO: 757093 - DNA, 14 bp, Homo sapiens
caggccctccagtg

SEQ ID NO: 757094 - DNA, 20 bp, Homo sapiens
caggccctccagtgggctga

SEQ ID NO: 757095 - DNA, 14 bp, Homo sapiens
caggccctccatgg

SEQ ID NO: 757096 - DNA, 17 bp, Homo sapiens
caggccctccatgggct

SEQ ID NO: 757097 - DNA, 20 bp, Homo sapiens
caggccctccatgggctagt

SEQ ID NO: 757098 - DNA, 19 bp, Homo sapiens
caggccctccctgactccc

SEQ ID NO: 757099 - DNA, 23 bp, Homo sapiens
caggccctccctgtctccagggc

SEQ ID NO: 757100 - DNA, 17 bp, Homo sapiens
caggccctctgcctgca

SEQ ID NO: 757101 - DNA, 13 bp, Homo sapiens
caggccctctgtg

SEQ ID NO: 757102 - DNA, 15 bp, Homo sapiens
caggccctctgtggc

SEQ ID NO: 757103 - DNA, 15 bp, Homo sapiens
caggccctgactcct

SEQ ID NO: 757104 - DNA, 18 bp, Homo sapiens
caggccctgactcctctg

SEQ ID NO: 757105 - DNA, 15 bp, Homo sapiens
caggccctgctcctg

SEQ ID NO: 757106 - DNA, 15 bp, Homo sapiens
caggccctggcctcc

SEQ ID NO: 757107 - DNA, 17 bp, Homo sapiens
caggccctggcctcccc

SEQ ID NO: 757108 - DNA, 18 bp, Homo sapiens
caggccctggcctcccct

SEQ ID NO: 757109 - DNA, 14 bp, Homo sapiens
caggccctgtccag

SEQ ID NO: 757110 - DNA, 21 bp, Homo sapiens
caggcccttcctctccactgc

SEQ ID NO: 757111 - DNA, 14 bp, Homo sapiens
caggcccttggctg

SEQ ID NO: 757112 - DNA, 15 bp, Homo sapiens
caggcccttggctgc

SEQ ID NO: 757113 - DNA, 18 bp, Homo sapiens
caggcccttggctgcagg

SEQ ID NO: 757114 - DNA, 21 bp, Homo sapiens
caggccctttgaagcctcagc

SEQ ID NO: 757115 - DNA, 19 bp, Homo sapiens
caggccgacagtcggtgac

SEQ ID NO: 757116 - DNA, 18 bp, Homo sapiens
caggccgcagctcttgcc

SEQ ID NO: 757117 - DNA, 15 bp, Homo sapiens
caggccggagcccag

SEQ ID NO: 757118 - DNA, 20 bp, Homo sapiens
caggccgggaagagccacct

SEQ ID NO: 757119 - DNA, 21 bp, Homo sapiens
caggccgggaagagccacctg

SEQ ID NO: 757120 - DNA, 20 bp, Homo sapiens
caggccggggtggagcatgg

SEQ ID NO: 757121 - DNA, 18 bp, Homo sapiens
caggccgttccccttggc

SEQ ID NO: 757122 - DNA, 23 bp, Homo sapiens
caggccgttccccttggcttcct

SEQ ID NO: 757123 - DNA, 18 bp, Homo sapiens
caggcctacagaaattga

SEQ ID NO: 757124 - DNA, 13 bp, Homo sapiens
caggcctatttca

SEQ ID NO: 757125 - DNA, 20 bp, Homo sapiens
caggcctcactggctcatgc

SEQ ID NO: 757126 - DNA, 21 bp, Homo sapiens
caggcctcactggctcatgcc

SEQ ID NO: 757127 - DNA, 23 bp, Homo sapiens
caggcctccaacgcccctgtggc

SEQ ID NO: 757128 - DNA, 15 bp, Homo sapiens
caggcctccagcctc

SEQ ID NO: 757129 - DNA, 13 bp, Homo sapiens
caggcctccctct

SEQ ID NO: 757130 - DNA, 15 bp, Homo sapiens
caggcctccctctct

SEQ ID NO: 757131 - DNA, 20 bp, Homo sapiens
caggcctccctgaaacactg

SEQ ID NO: 757132 - DNA, 11 bp, Homo sapiens
caggcctccta

SEQ ID NO: 757133 - DNA, 13 bp, Homo sapiens
caggcctcctagg

SEQ ID NO: 757134 - DNA, 15 bp, Homo sapiens
caggcctcctagggg

SEQ ID NO: 757135 - DNA, 21 bp, Homo sapiens
caggcctcctaggggaagggg

SEQ ID NO: 757136 - DNA, 13 bp, Homo sapiens
caggcctctgtgt

SEQ ID NO: 757137 - DNA, 20 bp, Homo sapiens
caggcctgaaagaggctgag

SEQ ID NO: 757138 - DNA, 22 bp, Homo sapiens
caggcctgaaagaggctgaggc

SEQ ID NO: 757139 - DNA, 23 bp, Homo sapiens
caggcctgaaagaggctgaggcc

SEQ ID NO: 757140 - DNA, 21 bp, Homo sapiens
caggcctgaacccgtccattc

SEQ ID NO: 757141 - DNA, 21 bp, Homo sapiens
caggcctgacccacggggcag

SEQ ID NO: 757142 - DNA, 15 bp, Homo sapiens
caggcctgagaatga

SEQ ID NO: 757143 - DNA, 16 bp, Homo sapiens
caggcctgagaatgag

SEQ ID NO: 757144 - DNA, 12 bp, Homo sapiens
caggcctgcagc

SEQ ID NO: 757145 - DNA, 20 bp, Homo sapiens
caggcctgcctgttcccatt

SEQ ID NO: 757146 - DNA, 13 bp, Homo sapiens
caggcctgctggc

SEQ ID NO: 757147 - DNA, 15 bp, Homo sapiens
caggcctgctggcat

SEQ ID NO: 757148 - DNA, 12 bp, Homo sapiens
caggcctggacg

SEQ ID NO: 757149 - DNA, 20 bp, Homo sapiens
caggcctggcaagtgggtga

SEQ ID NO: 757150 - DNA, 13 bp, Homo sapiens
caggcctggcctc

SEQ ID NO: 757151 - DNA, 16 bp, Homo sapiens
caggcctggcctcgcc

SEQ ID NO: 757152 - DNA, 20 bp, Homo sapiens
caggcctggcctcgcctgcc

SEQ ID NO: 757153 - DNA, 21 bp, Homo sapiens
caggcctggcctcgcctgcct

SEQ ID NO: 757154 - DNA, 14 bp, Homo sapiens
caggcctggctccc

SEQ ID NO: 757155 - DNA, 16 bp, Homo sapiens
caggcctggctccccg

SEQ ID NO: 757156 - DNA, 11 bp, Homo sapiens
caggcctggga

SEQ ID NO: 757157 - DNA, 16 bp, Homo sapiens
caggcctgggacccag

SEQ ID NO: 757158 - DNA, 24 bp, Homo sapiens
caggcctgggacccagctactctg

SEQ ID NO: 757159 - DNA, 21 bp, Homo sapiens
caggcctgggatgcagtgatg

SEQ ID NO: 757160 - DNA, 14 bp, Homo sapiens
caggcctgggcagg

SEQ ID NO: 757161 - DNA, 13 bp, Homo sapiens
caggcctgggttt

SEQ ID NO: 757162 - DNA, 12 bp, Homo sapiens
caggcctgtgtg

SEQ ID NO: 757163 - DNA, 20 bp, Homo sapiens
caggcctgtgtgactccatt

SEQ ID NO: 757164 - DNA, 13 bp, Homo sapiens
caggcctgttgct

SEQ ID NO: 757165 - DNA, 16 bp, Homo sapiens
caggccttatctccaa

SEQ ID NO: 757166 - DNA, 13 bp, Homo sapiens
caggccttctgtg

SEQ ID NO: 757167 - DNA, 20 bp, Homo sapiens
caggccttctgtggggctgg

SEQ ID NO: 757168 - DNA, 22 bp, Homo sapiens
caggccttctgtggggctgggc

SEQ ID NO: 757169 - DNA, 20 bp, Homo sapiens
ctgtttgtttaagctgagcc

SEQ ID NO: 757170 - DNA, 14 bp, Homo sapiens
ctgtttgtttcata

SEQ ID NO: 757171 - DNA, 13 bp, Homo sapiens
ctgttttaattgt

SEQ ID NO: 757172 - DNA, 15 bp, Homo sapiens
ctgttttactgtttt

SEQ ID NO: 757173 - DNA, 17 bp, Homo sapiens
ctgttttagctgaggga

SEQ ID NO: 757174 - DNA, 14 bp, Homo sapiens
ctgttttatgttga

SEQ ID NO: 757175 - DNA, 17 bp, Homo sapiens
ctgttttatgttgatct

SEQ ID NO: 757176 - DNA, 21 bp, Homo sapiens
ctgttttatgttgatctgcat

SEQ ID NO: 757177 - DNA, 15 bp, Homo sapiens
ctgttttcaagtgta

SEQ ID NO: 757178 - DNA, 17 bp, Homo sapiens
ctgttttcaataacaaa

SEQ ID NO: 757179 - DNA, 16 bp, Homo sapiens
ctgttttcccacgagg

SEQ ID NO: 757180 - DNA, 23 bp, Homo sapiens
ctgttttcctcccttctgctact

SEQ ID NO: 757181 - DNA, 11 bp, Homo sapiens
ctgttttctcc

SEQ ID NO: 757182 - DNA, 13 bp, Homo sapiens
ctgttttctcttg

SEQ ID NO: 757183 - DNA, 14 bp, Homo sapiens
ctgttttctcttga

SEQ ID NO: 757184 - DNA, 17 bp, Homo sapiens
ctgttttctcttgagag

SEQ ID NO: 757185 - DNA, 13 bp, Homo sapiens
ctgttttctgagc

SEQ ID NO: 757186 - DNA, 17 bp, Homo sapiens
ctgttttctgagcccgg

SEQ ID NO: 757187 - DNA, 19 bp, Homo sapiens
ctgttttctgtttgtaaat

SEQ ID NO: 757188 - DNA, 20 bp, Homo sapiens
ctgttttgaataaattttca

SEQ ID NO: 757189 - DNA, 16 bp, Homo sapiens
ctgttttgcacagtta

SEQ ID NO: 757190 - DNA, 22 bp, Homo sapiens
ctgttttgcctgaagttggagt

SEQ ID NO: 757191 - DNA, 16 bp, Homo sapiens
ctgttttgggcctcca

SEQ ID NO: 757192 - DNA, 17 bp, Homo sapiens
ctgttttgggcctccat

SEQ ID NO: 757193 - DNA, 18 bp, Homo sapiens
ctgttttggtcccctccc

SEQ ID NO: 757194 - DNA, 19 bp, Homo sapiens
ctgttttggtcccctccct

SEQ ID NO: 757195 - DNA, 20 bp, Homo sapiens
ctgttttggtcccctccctc

SEQ ID NO: 757196 - DNA, 21 bp, Homo sapiens
ctgttttggtcccctccctcg

SEQ ID NO: 757197 - DNA, 19 bp, Homo sapiens
ctgttttgtatatgatcta

SEQ ID NO: 757198 - DNA, 20 bp, Homo sapiens
ctgttttgtggtcagctgta

SEQ ID NO: 757199 - DNA, 18 bp, Homo sapiens
ctgttttgtggtttggaa

SEQ ID NO: 757200 - DNA, 20 bp, Homo sapiens
ctgttttgtggtttggaata

SEQ ID NO: 757201 - DNA, 16 bp, Homo sapiens
ctgttttgttaatata

SEQ ID NO: 757202 - DNA, 14 bp, Homo sapiens
ctgttttgttctgt

SEQ ID NO: 757203 - DNA, 20 bp, Homo sapiens
ctgttttgttgacattctga

SEQ ID NO: 757204 - DNA, 21 bp, Homo sapiens
ctgttttgttgacattctgaa

SEQ ID NO: 757205 - DNA, 22 bp, Homo sapiens
ctgttttgttgacattctgaat

SEQ ID NO: 757206 - DNA, 22 bp, Homo sapiens
ctgttttgtttggcaaggaaag

SEQ ID NO: 757207 - DNA, 17 bp, Homo sapiens
ctgtttttaagctgttt

SEQ ID NO: 757208 - DNA, 22 bp, Homo sapiens
ctgtttttagagcttccaaatg

SEQ ID NO: 757209 - DNA, 16 bp, Homo sapiens
ctgtttttagtgctga

SEQ ID NO: 757210 - DNA, 15 bp, Homo sapiens
ctgtttttcacattt

SEQ ID NO: 757211 - DNA, 14 bp, Homo sapiens
ctgtttttcttgtc

SEQ ID NO: 757212 - DNA, 12 bp, Homo sapiens
ctgtttttgtat

SEQ ID NO: 757213 - DNA, 14 bp, Homo sapiens
ctgtttttgtatct

SEQ ID NO: 757214 - DNA, 22 bp, Homo sapiens
ctgtttttttcaggctcctaaa

SEQ ID NO: 757215 - DNA, 14 bp, Homo sapiens
ctgtttttttgtta

SEQ ID NO: 757216 - DNA, 15 bp, Homo sapiens
cttaaaaaaatgaca

SEQ ID NO: 757217 - DNA, 17 bp, Homo sapiens
cttaaaaaaatgacaga

SEQ ID NO: 757218 - DNA, 18 bp, Homo sapiens
cttaaaaaacttgtaaat

SEQ ID NO: 757219 - DNA, 16 bp, Homo sapiens
cttaaaaaatgtgaaa

SEQ ID NO: 757220 - DNA, 11 bp, Homo sapiens
cttaaaaactg

SEQ ID NO: 757221 - DNA, 15 bp, Homo sapiens
cttaaaaactgtgta

SEQ ID NO: 757222 - DNA, 14 bp, Homo sapiens
cttaaaaagacact

SEQ ID NO: 757223 - DNA, 20 bp, Homo sapiens
cttaaaaatcattgattgtc

SEQ ID NO: 757224 - DNA, 16 bp, Homo sapiens
cttaaaaatgtaaata

SEQ ID NO: 757225 - DNA, 14 bp, Homo sapiens
cttaaaaccaaaga

SEQ ID NO: 757226 - DNA, 15 bp, Homo sapiens
cttaaaaccaaagag

SEQ ID NO: 757227 - DNA, 21 bp, Homo sapiens
cttaaaaccaaagagggcttc

SEQ ID NO: 757228 - DNA, 21 bp, Homo sapiens
cttaaaagaaatcttgcttca

SEQ ID NO: 757229 - DNA, 21 bp, Homo sapiens
cttaaaagctatcttcatgta

SEQ ID NO: 757230 - DNA, 22 bp, Homo sapiens
cttaaaagctatcttcatgtaa

SEQ ID NO: 757231 - DNA, 21 bp, Homo sapiens
cttaaaaggagagaagaaagt

SEQ ID NO: 757232 - DNA, 22 bp, Homo sapiens
cttaaaaggagagaagaaagtg

SEQ ID NO: 757233 - DNA, 14 bp, Homo sapiens
cttaaaaggggccc

SEQ ID NO: 757234 - DNA, 15 bp, Homo sapiens
cttaaaaggggccca

SEQ ID NO: 757235 - DNA, 17 bp, Homo sapiens
cttaaaagtactttaaa

SEQ ID NO: 757236 - DNA, 12 bp, Homo sapiens
cttaaaagtatt

SEQ ID NO: 757237 - DNA, 14 bp, Homo sapiens
cttaaaataagcag

SEQ ID NO: 757238 - DNA, 12 bp, Homo sapiens
cttaaaatacaa

SEQ ID NO: 757239 - DNA, 19 bp, Homo sapiens
cttaaaatacaagactgcc

SEQ ID NO: 757240 - DNA, 22 bp, Homo sapiens
cttaaaatagcaacactctata

SEQ ID NO: 757241 - DNA, 22 bp, Homo sapiens
cttaaaataggggatatttaag

SEQ ID NO: 757242 - DNA, 11 bp, Homo sapiens
cttaaaatatc

SEQ ID NO: 757243 - DNA, 19 bp, Homo sapiens
cttaaaatatctctaaaat

SEQ ID NO: 757244 - DNA, 15 bp, Homo sapiens
cttaaaatctctaat

SEQ ID NO: 757245 - DNA, 20 bp, Homo sapiens
cttaaaatgacaaagccatt

SEQ ID NO: 757246 - DNA, 13 bp, Homo sapiens
cttaaacaaaaat

SEQ ID NO: 757247 - DNA, 13 bp, Homo sapiens
cttaaacaaagtg

SEQ ID NO: 757248 - DNA, 17 bp, Homo sapiens
cttaaacccatacaatg

SEQ ID NO: 757249 - DNA, 23 bp, Homo sapiens
cttaaaccttcagttatgatttt

SEQ ID NO: 757250 - DNA, 14 bp, Homo sapiens
cttaaactaaataa

SEQ ID NO: 757251 - DNA, 20 bp, Homo sapiens
cttaaactaaataatgaata

SEQ ID NO: 757252 - DNA, 14 bp, Homo sapiens
cttaaactaaatgt

SEQ ID NO: 757253 - DNA, 14 bp, Homo sapiens
cttaaacttgaccc

SEQ ID NO: 757254 - DNA, 19 bp, Homo sapiens
cttaaagaaaattgcatga

SEQ ID NO: 757255 - DNA, 13 bp, Homo sapiens
cttaaagaaacag

SEQ ID NO: 757256 - DNA, 12 bp, Homo sapiens
cttaaagcaaaa

SEQ ID NO: 757257 - DNA, 23 bp, Homo sapiens
cttaaagctgcctgtagttagga

SEQ ID NO: 757258 - DNA, 20 bp, Homo sapiens
cttaaaggcaccatctaata

SEQ ID NO: 757259 - DNA, 14 bp, Homo sapiens
cttaaaggcctgga

SEQ ID NO: 757260 - DNA, 19 bp, Homo sapiens
cttaaagtgaaggaaataa

SEQ ID NO: 757261 - DNA, 16 bp, Homo sapiens
cttaaagtgccagtat

SEQ ID NO: 757262 - DNA, 22 bp, Homo sapiens
cttaaagttgattttgaacttt

SEQ ID NO: 757263 - DNA, 20 bp, Homo sapiens
cttaaagttggtattaataa

SEQ ID NO: 757264 - DNA, 22 bp, Homo sapiens
cttaaagttggtattaataaaa

SEQ ID NO: 757265 - DNA, 15 bp, Homo sapiens
cttaaagttgtcact

SEQ ID NO: 757266 - DNA, 19 bp, Homo sapiens
cttaaataaaactatttaa

SEQ ID NO: 757267 - DNA, 19 bp, Homo sapiens
cttaaataatgcttcagat

SEQ ID NO: 757268 - DNA, 16 bp, Homo sapiens
cttaaataatgtgaaa

SEQ ID NO: 757269 - DNA, 20 bp, Homo sapiens
cttaaatacactgaattgaa

SEQ ID NO: 757270 - DNA, 21 bp, Homo sapiens
cttaaatacactgaattgaat

SEQ ID NO: 757271 - DNA, 16 bp, Homo sapiens
cttaaatacagataat

SEQ ID NO: 757272 - DNA, 19 bp, Homo sapiens
cttaaatacagataattca

SEQ ID NO: 757273 - DNA, 14 bp, Homo sapiens
cttaaataggaaag

SEQ ID NO: 757274 - DNA, 16 bp, Homo sapiens
cttaaatgacagtgaa

SEQ ID NO: 757275 - DNA, 16 bp, Homo sapiens
cttaaatgctcataaa

SEQ ID NO: 757276 - DNA, 19 bp, Homo sapiens
cttaaatgctcataaagat

SEQ ID NO: 757277 - DNA, 21 bp, Homo sapiens
cttaaatggaattattttgaa

SEQ ID NO: 757278 - DNA, 16 bp, Homo sapiens
cttaaatgttattatc

SEQ ID NO: 757279 - DNA, 12 bp, Homo sapiens
cttaaatgttta

SEQ ID NO: 757280 - DNA, 22 bp, Homo sapiens
cttaaatgtttatactgtattt

SEQ ID NO: 757281 - DNA, 19 bp, Homo sapiens
cttaaattaaacaatttat

SEQ ID NO: 757282 - DNA, 14 bp, Homo sapiens
catttcccacatct

SEQ ID NO: 757283 - DNA, 16 bp, Homo sapiens
catttcccacatcttt

SEQ ID NO: 757284 - DNA, 14 bp, Homo sapiens
catttccccctcct

SEQ ID NO: 757285 - DNA, 15 bp, Homo sapiens
catttcccctccttc

SEQ ID NO: 757286 - DNA, 18 bp, Homo sapiens
catttccgtcccccccca

SEQ ID NO: 757287 - DNA, 22 bp, Homo sapiens
catttccgtccccccccaggcc

SEQ ID NO: 757288 - DNA, 20 bp, Homo sapiens
catttcctcagcttatctct

SEQ ID NO: 757289 - DNA, 18 bp, Homo sapiens
catttcctcgcagcctct

SEQ ID NO: 757290 - DNA, 12 bp, Homo sapiens
catttcctgccc

SEQ ID NO: 757291 - DNA, 21 bp, Homo sapiens
cttaaatttttagccatttct

SEQ ID NO: 757292 - DNA, 16 bp, Homo sapiens
cttaaatttttgtcat

SEQ ID NO: 757293 - DNA, 19 bp, Homo sapiens
cttaacaaaccaacatctt

SEQ ID NO: 757294 - DNA, 15 bp, Homo sapiens
cttaacaggctgatt

SEQ ID NO: 757295 - DNA, 13 bp, Homo sapiens
cttaacatattta

SEQ ID NO: 757296 - DNA, 15 bp, Homo sapiens
cttaacatatttact

SEQ ID NO: 757297 - DNA, 18 bp, Homo sapiens
cttaacatccctcctgct

SEQ ID NO: 757298 - DNA, 20 bp, Homo sapiens
cttaacattagatgtcatga

SEQ ID NO: 757299 - DNA, 20 bp, Homo sapiens
cttaaccaccgcatatgcat

SEQ ID NO: 757300 - DNA, 22 bp, Homo sapiens
cttaaccaccgcatatgcatgc

SEQ ID NO: 757301 - DNA, 14 bp, Homo sapiens
cttaacccaaggag

SEQ ID NO: 757302 - DNA, 16 bp, Homo sapiens
cttaacccaaggagca

SEQ ID NO: 757303 - DNA, 19 bp, Homo sapiens
cttaacccctaagactgcc

SEQ ID NO: 757304 - DNA, 18 bp, Homo sapiens
cttaacctttccgctgtc

SEQ ID NO: 757305 - DNA, 11 bp, Homo sapiens
cttaacctttg

SEQ ID NO: 757306 - DNA, 16 bp, Homo sapiens
cttaacggaccaaagc

SEQ ID NO: 757307 - DNA, 20 bp, Homo sapiens
cttaactaagactcccgccc

SEQ ID NO: 757308 - DNA, 18 bp, Homo sapiens
cttaactataaggtgcct

SEQ ID NO: 757309 - DNA, 19 bp, Homo sapiens
cttaactataaggtgcctc

SEQ ID NO: 757310 - DNA, 12 bp, Homo sapiens
cttaactccaag

SEQ ID NO: 757311 - DNA, 17 bp, Homo sapiens
cttaactctaaccctgt

SEQ ID NO: 757312 - DNA, 18 bp, Homo sapiens
cttaactctaaccctgtg

SEQ ID NO: 757313 - DNA, 16 bp, Homo sapiens
cttaactctcaagcta

SEQ ID NO: 757314 - DNA, 12 bp, Homo sapiens
cttaactgaaat

SEQ ID NO: 757315 - DNA, 21 bp, Homo sapiens
cttaactgtatttcagtattt

SEQ ID NO: 757316 - DNA, 14 bp, Homo sapiens
cttaacttcacata

SEQ ID NO: 757317 - DNA, 14 bp, Homo sapiens
cttaacttcttgct

SEQ ID NO: 757318 - DNA, 22 bp, Homo sapiens
cttaacttcttgcttctttcta

SEQ ID NO: 757319 - DNA, 13 bp, Homo sapiens
cttaactttaact

SEQ ID NO: 757320 - DNA, 11 bp, Homo sapiens
cttaactttat

SEQ ID NO: 757321 - DNA, 13 bp, Homo sapiens
cttaactttataa

SEQ ID NO: 757322 - DNA, 13 bp, Homo sapiens
cttaagaaaattt

SEQ ID NO: 757323 - DNA, 16 bp, Homo sapiens
cttaagaactgtgtct

SEQ ID NO: 757324 - DNA, 15 bp, Homo sapiens
cttaagacactgtga

SEQ ID NO: 757325 - DNA, 14 bp, Homo sapiens
cttaagagaatatt

SEQ ID NO: 757326 - DNA, 23 bp, Homo sapiens
cttaagagaatattttaagtatt

SEQ ID NO: 757327 - DNA, 18 bp, Homo sapiens
cttaagagctatttgtgg

SEQ ID NO: 757328 - DNA, 18 bp, Homo sapiens
cttaagatctgactgcca

SEQ ID NO: 757329 - DNA, 14 bp, Homo sapiens
cttaagatgggcct

SEQ ID NO: 757330 - DNA, 18 bp, Homo sapiens
cttaagcaaaagaaaaag

SEQ ID NO: 757331 - DNA, 12 bp, Homo sapiens
cttaagcaaatt

SEQ ID NO: 757332 - DNA, 13 bp, Homo sapiens
cttaagcactttg

SEQ ID NO: 757333 - DNA, 19 bp, Homo sapiens
cttaagcactttgaaaata

SEQ ID NO: 757334 - DNA, 18 bp, Homo sapiens
cttaagcagaacaaatgt

SEQ ID NO: 757335 - DNA, 18 bp, Homo sapiens
cttaagcagaagcattaa

SEQ ID NO: 757336 - DNA, 15 bp, Homo sapiens
cttaagcagcatgga

SEQ ID NO: 757337 - DNA, 16 bp, Homo sapiens
cttaagcagcatggaa

SEQ ID NO: 757338 - DNA, 18 bp, Homo sapiens
cttaagcagcatggaaaa

SEQ ID NO: 757339 - DNA, 19 bp, Homo sapiens
cttaagcagcatggaaaaa

SEQ ID NO: 757340 - DNA, 18 bp, Homo sapiens
cttaagcatctggctcta

SEQ ID NO: 757341 - DNA, 22 bp, Homo sapiens
cttaagccactgcctctccctc

SEQ ID NO: 757342 - DNA, 18 bp, Homo sapiens
cttaagccataggcccag

SEQ ID NO: 757343 - DNA, 19 bp, Homo sapiens
cttaagcccagtgcactga

SEQ ID NO: 757344 - DNA, 16 bp, Homo sapiens
cttaagcctggaaggt

SEQ ID NO: 757345 - DNA, 20 bp, Homo sapiens
cttaagccttttgctcacaa

SEQ ID NO: 757346 - DNA, 20 bp, Homo sapiens
cttaaggacaaaaatgaact

SEQ ID NO: 757347 - DNA, 22 bp, Homo sapiens
cttaaggcctaaggaagccagt

SEQ ID NO: 757348 - DNA, 17 bp, Homo sapiens
cttaagggttgaaggca

SEQ ID NO: 757349 - DNA, 18 bp, Homo sapiens
cttaagggttgaaggcag

SEQ ID NO: 757350 - DNA, 19 bp, Homo sapiens
cttaagggttgaaggcagt

SEQ ID NO: 757351 - DNA, 23 bp, Homo sapiens
cttaagggttgaaggcagtctga

SEQ ID NO: 757352 - DNA, 16 bp, Homo sapiens
cttaagtcttccttaa

SEQ ID NO: 757353 - DNA, 22 bp, Homo sapiens
cttaagtgagcagaacaggtag

SEQ ID NO: 757354 - DNA, 17 bp, Homo sapiens
cttaagtgtaaatgaag

SEQ ID NO: 757355 - DNA, 20 bp, Homo sapiens
cttaagttagcctccaccac

SEQ ID NO: 757356 - DNA, 20 bp, Homo sapiens
cttaagttctttgatttgta

SEQ ID NO: 757357 - DNA, 21 bp, Homo sapiens
cttaagttctttgatttgtac

SEQ ID NO: 757358 - DNA, 23 bp, Homo sapiens
cttaagttctttgatttgtacca

SEQ ID NO: 757359 - DNA, 16 bp, Homo sapiens
cttaataaaagaacat

SEQ ID NO: 757360 - DNA, 17 bp, Homo sapiens
cttaataaattcagata

SEQ ID NO: 757361 - DNA, 18 bp, Homo sapiens
cttaataaattcagatat

SEQ ID NO: 757362 - DNA, 20 bp, Homo sapiens
cttaataaattgtgtttcct

SEQ ID NO: 757363 - DNA, 19 bp, Homo sapiens
cttaataactgtgtactgt

SEQ ID NO: 757364 - DNA, 20 bp, Homo sapiens
cttaataactgtgtactgtt

SEQ ID NO: 757365 - DNA, 22 bp, Homo sapiens
cttaatactcaaatgagtaaca

SEQ ID NO: 757366 - DNA, 18 bp, Homo sapiens
cttaatagacttctctta

SEQ ID NO: 757367 - DNA, 14 bp, Homo sapiens
cttaatagcaacag

SEQ ID NO: 757368 - DNA, 15 bp, Homo sapiens
cttaatagctgtagt

SEQ ID NO: 757369 - DNA, 21 bp, Homo sapiens
cttaatatgctgcaacaaaat

SEQ ID NO: 757370 - DNA, 14 bp, Homo sapiens
cttaatattgagaa

SEQ ID NO: 757371 - DNA, 19 bp, Homo sapiens
cttaatattgaggctgcag

SEQ ID NO: 757372 - DNA, 15 bp, Homo sapiens
cttaatcactactgt

SEQ ID NO: 757373 - DNA, 20 bp, Homo sapiens
cttaatcaggtcctcagaga

SEQ ID NO: 757374 - DNA, 22 bp, Homo sapiens
cttaatccaatattttgccttt

SEQ ID NO: 757375 - DNA, 20 bp, Homo sapiens
cttaatcctttaactctgcg

SEQ ID NO: 757376 - DNA, 17 bp, Homo sapiens
cttaatcgatgaatgta

SEQ ID NO: 757377 - DNA, 16 bp, Homo sapiens
cttaatctaagaaaca

SEQ ID NO: 757378 - DNA, 18 bp, Homo sapiens
cttaatctggacacactg

SEQ ID NO: 757379 - DNA, 20 bp, Homo sapiens
cttaatctgtgtgtatattg

SEQ ID NO: 757380 - DNA, 16 bp, Homo sapiens
cttaatcttgctttct

SEQ ID NO: 757381 - DNA, 12 bp, Homo sapiens
cttaatgaaaaa

SEQ ID NO: 757382 - DNA, 16 bp, Homo sapiens
cttaatgacaacactt

SEQ ID NO: 757383 - DNA, 23 bp, Homo sapiens
cttaatgacattcccctcccacc

SEQ ID NO: 757384 - DNA, 14 bp, Homo sapiens
cttaatgagatagt

SEQ ID NO: 757385 - DNA, 17 bp, Homo sapiens
cttaatgcttgtaattt

SEQ ID NO: 757386 - DNA, 22 bp, Homo sapiens
cttaatggctgataattttaaa

SEQ ID NO: 757387 - DNA, 16 bp, Homo sapiens
cttaatgtaattcagg

SEQ ID NO: 757388 - DNA, 19 bp, Homo sapiens
cttaatgtaattcaggact

SEQ ID NO: 757389 - DNA, 20 bp, Homo sapiens
cttaatgtaattcaggactc

SEQ ID NO: 757390 - DNA, 17 bp, Homo sapiens
cttaatgtatgttacca

SEQ ID NO: 757391 - DNA, 20 bp, Homo sapiens
cttaatgttctgaataattt

SEQ ID NO: 757392 - DNA, 22 bp, Homo sapiens
cttaatgttctgaataatttct

SEQ ID NO: 757393 - DNA, 13 bp, Homo sapiens
cttaatgttgaat

SEQ ID NO: 757394 - DNA, 15 bp, Homo sapiens
cttaatgttgaatgt

SEQ ID NO: 757395 - DNA, 16 bp, Homo sapiens
cttaatgttgaatgta

SEQ ID NO: 757396 - DNA, 12 bp, Homo sapiens
cttaatgtttat

SEQ ID NO: 757397 - DNA, 14 bp, Homo sapiens
cttaatgtttattc

SEQ ID NO: 757398 - DNA, 18 bp, Homo sapiens
cttaattattatttgtgt

SEQ ID NO: 757399 - DNA, 19 bp, Homo sapiens
cttaattattatttgtgtt

SEQ ID NO: 757400 - DNA, 23 bp, Homo sapiens
cttaattcagtatgatttatcct

SEQ ID NO: 757401 - DNA, 17 bp, Homo sapiens
cttaattcctttctcat

SEQ ID NO: 757402 - DNA, 19 bp, Homo sapiens
cttaattcctttctcatcc

SEQ ID NO: 757403 - DNA, 14 bp, Homo sapiens
cttaattctccttc

SEQ ID NO: 757404 - DNA, 16 bp, Homo sapiens
cttaattctccttccc

SEQ ID NO: 757405 - DNA, 14 bp, Homo sapiens
cttaattctctgca

SEQ ID NO: 757406 - DNA, 23 bp, Homo sapiens
cttaattgttcattttgagctga

SEQ ID NO: 757407 - DNA, 17 bp, Homo sapiens
cttaatttaatgtatta

SEQ ID NO: 757408 - DNA, 21 bp, Homo sapiens
cttaatttaattgctttgaag

SEQ ID NO: 757409 - DNA, 14 bp, Homo sapiens
gacacccccccaac

SEQ ID NO: 757410 - DNA, 13 bp, Homo sapiens
gacaccccctccc

SEQ ID NO: 757411 - DNA, 18 bp, Homo sapiens
gacacccctgctctaccc

SEQ ID NO: 757412 - DNA, 19 bp, Homo sapiens
gacacccctgctctaccca

SEQ ID NO: 757413 - DNA, 18 bp, Homo sapiens
gacaccccttatccagga

SEQ ID NO: 757414 - DNA, 19 bp, Homo sapiens
gacaccccttatccaggac

SEQ ID NO: 757415 - DNA, 13 bp, Homo sapiens
gacaccctcaacc

SEQ ID NO: 757416 - DNA, 13 bp, Homo sapiens
gacaccgctcagt

SEQ ID NO: 757417 - DNA, 20 bp, Homo sapiens
gacaccggggtggtgggaac

SEQ ID NO: 757418 - DNA, 15 bp, Homo sapiens
gacaccgtccctcag

SEQ ID NO: 757419 - DNA, 17 bp, Homo sapiens
gacaccgtcgaccagga

SEQ ID NO: 757420 - DNA, 21 bp, Homo sapiens
gacaccgtcgaccaggaaagc

SEQ ID NO: 757421 - DNA, 14 bp, Homo sapiens
gacaccgtggcctg

SEQ ID NO: 757422 - DNA, 13 bp, Homo sapiens
gacacctaccatg

SEQ ID NO: 757423 - DNA, 16 bp, Homo sapiens
gacacctaccatgctg

SEQ ID NO: 757424 - DNA, 18 bp, Homo sapiens
gacacctaccatgctgct

SEQ ID NO: 757425 - DNA, 19 bp, Homo sapiens
gacacctaccatgctgctt

SEQ ID NO: 757426 - DNA, 22 bp, Homo sapiens
gacacctccccctttcacactg

SEQ ID NO: 757427 - DNA, 16 bp, Homo sapiens
gacacctgcacctccc

SEQ ID NO: 757428 - DNA, 17 bp, Homo sapiens
gacacctgcacctcccc

SEQ ID NO: 757429 - DNA, 22 bp, Homo sapiens
gacacctgcacctccccccact

SEQ ID NO: 757430 - DNA, 14 bp, Homo sapiens
gacacctgccctgc

SEQ ID NO: 757431 - DNA, 15 bp, Homo sapiens
gacacctgccctgcc

SEQ ID NO: 757432 - DNA, 17 bp, Homo sapiens
gacacctgggccgggct

SEQ ID NO: 757433 - DNA, 22 bp, Homo sapiens
gacacgattgagaactgacaaa

SEQ ID NO: 757434 - DNA, 18 bp, Homo sapiens
gacacgcaagtgtgtgag

SEQ ID NO: 757435 - DNA, 15 bp, Homo sapiens
gacacggagcccagc

SEQ ID NO: 757436 - DNA, 20 bp, Homo sapiens
gacacggatctgagaatctt

SEQ ID NO: 757437 - DNA, 18 bp, Homo sapiens
gacacgggtggggaaagg

SEQ ID NO: 757438 - DNA, 20 bp, Homo sapiens
gacacgtgggctcccctctt

SEQ ID NO: 757439 - DNA, 21 bp, Homo sapiens
gacacgtgtggcgggcagtgg

SEQ ID NO: 757440 - DNA, 16 bp, Homo sapiens
gacactaaaaactgat

SEQ ID NO: 757441 - DNA, 16 bp, Homo sapiens
gacactaaaacaagag

SEQ ID NO: 757442 - DNA, 23 bp, Homo sapiens
gacactaaaacaagaggacacaa

SEQ ID NO: 757443 - DNA, 15 bp, Homo sapiens
gacactaacgacttc

SEQ ID NO: 757444 - DNA, 17 bp, Homo sapiens
gacactacacccagcaa

SEQ ID NO: 757445 - DNA, 16 bp, Homo sapiens
gacactagaagatttt

SEQ ID NO: 757446 - DNA, 15 bp, Homo sapiens
gacactcagacctga

SEQ ID NO: 757447 - DNA, 18 bp, Homo sapiens
gacactcagggcagctgc

SEQ ID NO: 757448 - DNA, 12 bp, Homo sapiens
gacactccagtg

SEQ ID NO: 757449 - DNA, 21 bp, Homo sapiens
gacactccccgaagtcttttg

SEQ ID NO: 757450 - DNA, 15 bp, Homo sapiens
gacactcccttgggc

SEQ ID NO: 757451 - DNA, 19 bp, Homo sapiens
gacactcctataaggagag

SEQ ID NO: 757452 - DNA, 21 bp, Homo sapiens
gacactctagtgacttcctgg

SEQ ID NO: 757453 - DNA, 17 bp, Homo sapiens
gacactctctggaagcc

SEQ ID NO: 757454 - DNA, 15 bp, Homo sapiens
gacactctgctctgc

SEQ ID NO: 757455 - DNA, 17 bp, Homo sapiens
gacactctgctctgccc

SEQ ID NO: 757456 - DNA, 20 bp, Homo sapiens
gacactgaagaagtcactga

SEQ ID NO: 757457 - DNA, 13 bp, Homo sapiens
gacactgacaaag

SEQ ID NO: 757458 - DNA, 18 bp, Homo sapiens
gacactgagcttctgaga

SEQ ID NO: 757459 - DNA, 12 bp, Homo sapiens
gacactgcctta

SEQ ID NO: 757460 - DNA, 16 bp, Homo sapiens
gacactgccttagcct

SEQ ID NO: 757461 - DNA, 19 bp, Homo sapiens
gacactgccttagcctctt

SEQ ID NO: 757462 - DNA, 16 bp, Homo sapiens
gacactgcgccccgcc

SEQ ID NO: 757463 - DNA, 15 bp, Homo sapiens
gacactgctgcacca

SEQ ID NO: 757464 - DNA, 13 bp, Homo sapiens
gacactggacatg

SEQ ID NO: 757465 - DNA, 12 bp, Homo sapiens
gacactggcatg

SEQ ID NO: 757466 - DNA, 19 bp, Homo sapiens
gacactgggcagcaaggct

SEQ ID NO: 757467 - DNA, 20 bp, Homo sapiens
gacactgggggaggagagga

SEQ ID NO: 757468 - DNA, 19 bp, Homo sapiens
gacactggtttacacttta

SEQ ID NO: 757469 - DNA, 20 bp, Homo sapiens
gacactgtgagagttgtctc

SEQ ID NO: 757470 - DNA, 21 bp, Homo sapiens
gacactgtgagagttgtctct

SEQ ID NO: 757471 - DNA, 16 bp, Homo sapiens
gacactgtgcccagcc

SEQ ID NO: 757472 - DNA, 17 bp, Homo sapiens
gacactgttgcaaaggt

SEQ ID NO: 757473 - DNA, 19 bp, Homo sapiens
gacactgtttacaagaaaa

SEQ ID NO: 757474 - DNA, 22 bp, Homo sapiens
gacactgtttacaagaaaaaat

SEQ ID NO: 757475 - DNA, 16 bp, Homo sapiens
gacactgttttcctta

SEQ ID NO: 757476 - DNA, 23 bp, Homo sapiens
gacacttcagagagctggtagtt

SEQ ID NO: 757477 - DNA, 12 bp, Homo sapiens
gacacttcagat

SEQ ID NO: 757478 - DNA, 17 bp, Homo sapiens
gacacttccctctgttt

SEQ ID NO: 757479 - DNA, 18 bp, Homo sapiens
gacacttccctctgtttc

SEQ ID NO: 757480 - DNA, 20 bp, Homo sapiens
gacacttccctctgtttctc

SEQ ID NO: 757481 - DNA, 16 bp, Homo sapiens
gacacttccctgggcc

SEQ ID NO: 757482 - DNA, 12 bp, Homo sapiens
gacacttcctgc

SEQ ID NO: 757483 - DNA, 15 bp, Homo sapiens
gacacttgccttctt

SEQ ID NO: 757484 - DNA, 23 bp, Homo sapiens
gacacttgccttcttcacccagc

SEQ ID NO: 757485 - DNA, 22 bp, Homo sapiens
gacactttgaaatgtgtttctg

SEQ ID NO: 757486 - DNA, 21 bp, Homo sapiens
gacactttgccaaggctctcc

SEQ ID NO: 757487 - DNA, 17 bp, Homo sapiens
gacacttttaaaaaaca

SEQ ID NO: 757488 - DNA, 19 bp, Homo sapiens
gacacttttcaaaagaaga

SEQ ID NO: 757489 - DNA, 15 bp, Homo sapiens
gacagaaaagtgcct

SEQ ID NO: 757490 - DNA, 14 bp, Homo sapiens
gacagaaactggat

SEQ ID NO: 757491 - DNA, 13 bp, Homo sapiens
gacagaacattta

SEQ ID NO: 757492 - DNA, 20 bp, Homo sapiens
gacagaacccctacatgaaa

SEQ ID NO: 757493 - DNA, 21 bp, Homo sapiens
gacagaaccgagaagggggtg

SEQ ID NO: 757494 - DNA, 18 bp, Homo sapiens
gacagaacttgaatgtgt

SEQ ID NO: 757495 - DNA, 15 bp, Homo sapiens
gacagaagtctcctc

SEQ ID NO: 757496 - DNA, 18 bp, Homo sapiens
gacagacatctctgcacc

SEQ ID NO: 757497 - DNA, 16 bp, Homo sapiens
gacagaccacttgcca

SEQ ID NO: 757498 - DNA, 23 bp, Homo sapiens
gacagacccagtgagtgaatcag

SEQ ID NO: 757499 - DNA, 14 bp, Homo sapiens
gacagaccctctgc

SEQ ID NO: 757500 - DNA, 17 bp, Homo sapiens
gacagaccctctgccgc

SEQ ID NO: 757501 - DNA, 20 bp, Homo sapiens
gacagaccggggttcaagcc

SEQ ID NO: 757502 - DNA, 19 bp, Homo sapiens
gacagacggaaatgaaatt

SEQ ID NO: 757503 - DNA, 18 bp, Homo sapiens
gacagacttgagaacttg

SEQ ID NO: 757504 - DNA, 20 bp, Homo sapiens
gacagactttggacagtggc

SEQ ID NO: 757505 - DNA, 23 bp, Homo sapiens
gacagactttggacagtggcctc

SEQ ID NO: 757506 - DNA, 13 bp, Homo sapiens
gacagagaatctt

SEQ ID NO: 757507 - DNA, 17 bp, Homo sapiens
gacagagacacctgcac

SEQ ID NO: 757508 - DNA, 18 bp, Homo sapiens
gacagagacacctgcacc

SEQ ID NO: 757509 - DNA, 21 bp, Homo sapiens
gacagagacacctgcacctcc

SEQ ID NO: 757510 - DNA, 22 bp, Homo sapiens
gacagagacacctgcacctccc

SEQ ID NO: 757511 - DNA, 16 bp, Homo sapiens
gacagagactcagatg

SEQ ID NO: 757512 - DNA, 22 bp, Homo sapiens
gacagagactttaatcactgct

SEQ ID NO: 757513 - DNA, 15 bp, Homo sapiens
gacagagaggactgt

SEQ ID NO: 757514 - DNA, 21 bp, Homo sapiens
cccatctcatgcccctggctg

SEQ ID NO: 757515 - DNA, 15 bp, Homo sapiens
cccatctccagggaa

SEQ ID NO: 757516 - DNA, 20 bp, Homo sapiens
cccatctccctgcctggccc

SEQ ID NO: 757517 - DNA, 14 bp, Homo sapiens
cccatctccctgct

SEQ ID NO: 757518 - DNA, 20 bp, Homo sapiens
cccatctccttacctctgga

SEQ ID NO: 757519 - DNA, 13 bp, Homo sapiens
cccatctctacaa

SEQ ID NO: 757520 - DNA, 20 bp, Homo sapiens
cccatctctcccacttcctc

SEQ ID NO: 757521 - DNA, 23 bp, Homo sapiens
cccatctctccctcccctgccat

SEQ ID NO: 757522 - DNA, 16 bp, Homo sapiens
cccatctctgagtgga

SEQ ID NO: 757523 - DNA, 18 bp, Homo sapiens
cccatctctgagtggagg

SEQ ID NO: 757524 - DNA, 18 bp, Homo sapiens
cccatctctgtctggggc

SEQ ID NO: 757525 - DNA, 18 bp, Homo sapiens
cccatctcttcctaccca

SEQ ID NO: 757526 - DNA, 14 bp, Homo sapiens
cccatctcttctgg

SEQ ID NO: 757527 - DNA, 13 bp, Homo sapiens
cccatctgccctc

SEQ ID NO: 757528 - DNA, 14 bp, Homo sapiens
cccatctgccctcc

SEQ ID NO: 757529 - DNA, 17 bp, Homo sapiens
cccatctgtctgccaac

SEQ ID NO: 757530 - DNA, 13 bp, Homo sapiens
cccatctgtcttc

SEQ ID NO: 757531 - DNA, 16 bp, Homo sapiens
cccatctgtgaataag

SEQ ID NO: 757532 - DNA, 17 bp, Homo sapiens
cccatcttccacctgtg

SEQ ID NO: 757533 - DNA, 16 bp, Homo sapiens
cccatcttcctgctgc

SEQ ID NO: 757534 - DNA, 19 bp, Homo sapiens
cccatcttcctgctgctgt

SEQ ID NO: 757535 - DNA, 20 bp, Homo sapiens
cccatcttcctgctgctgta

SEQ ID NO: 757536 - DNA, 21 bp, Homo sapiens
cccatcttgatctttgagccc

SEQ ID NO: 757537 - DNA, 22 bp, Homo sapiens
gacagatacctccaaccctgcc

SEQ ID NO: 757538 - DNA, 23 bp, Homo sapiens
gacagatacctccaaccctgccg

SEQ ID NO: 757539 - DNA, 15 bp, Homo sapiens
gacagatattttatc

SEQ ID NO: 757540 - DNA, 17 bp, Homo sapiens
gacagatcaagctgtga

SEQ ID NO: 757541 - DNA, 19 bp, Homo sapiens
gacagatcaagctgtgaga

SEQ ID NO: 757542 - DNA, 20 bp, Homo sapiens
gacagatgaatgccgtggat

SEQ ID NO: 757543 - DNA, 16 bp, Homo sapiens
gacagatgcaagttat

SEQ ID NO: 757544 - DNA, 14 bp, Homo sapiens
gacagatggacgca

SEQ ID NO: 757545 - DNA, 22 bp, Homo sapiens
gacagatggacgcaggccctgt

SEQ ID NO: 757546 - DNA, 15 bp, Homo sapiens
gacagatggcccaag

SEQ ID NO: 757547 - DNA, 21 bp, Homo sapiens
gacagatggcccaagggatgg

SEQ ID NO: 757548 - DNA, 17 bp, Homo sapiens
gacagatgtcagccgag

SEQ ID NO: 757549 - DNA, 15 bp, Homo sapiens
gacagattcgcagca

SEQ ID NO: 757550 - DNA, 12 bp, Homo sapiens
gacagatttcag

SEQ ID NO: 757551 - DNA, 22 bp, Homo sapiens
gacagcaacggggaggccaagt

SEQ ID NO: 757552 - DNA, 14 bp, Homo sapiens
gacagcaagtgagc

SEQ ID NO: 757553 - DNA, 17 bp, Homo sapiens
gacagcaagtgagcaga

SEQ ID NO: 757554 - DNA, 21 bp, Homo sapiens
gacagcaccactgctgaggag

SEQ ID NO: 757555 - DNA, 17 bp, Homo sapiens
gacagcagaagcctcca

SEQ ID NO: 757556 - DNA, 20 bp, Homo sapiens
gacagcagaagcctccaagc

SEQ ID NO: 757557 - DNA, 12 bp, Homo sapiens
gacagcagcact

SEQ ID NO: 757558 - DNA, 15 bp, Homo sapiens
gacagcagcctgtat

SEQ ID NO: 757559 - DNA, 21 bp, Homo sapiens
gacagcagcctgtatgtggtg

SEQ ID NO: 757560 - DNA, 18 bp, Homo sapiens
gacagcagctcaggcaca

SEQ ID NO: 757561 - DNA, 12 bp, Homo sapiens
gacagcaggcag

SEQ ID NO: 757562 - DNA, 21 bp, Homo sapiens
gacagcatcccttcccacatg

SEQ ID NO: 757563 - DNA, 12 bp, Homo sapiens
gacagcatgact

SEQ ID NO: 757564 - DNA, 19 bp, Homo sapiens
gacagcatgtgccctcctg

SEQ ID NO: 757565 - DNA, 18 bp, Homo sapiens
gacagccaagcacctcca

SEQ ID NO: 757566 - DNA, 14 bp, Homo sapiens
gacagccagagctg

SEQ ID NO: 757567 - DNA, 22 bp, Homo sapiens
gacagcccaacttccagaggac

SEQ ID NO: 757568 - DNA, 17 bp, Homo sapiens
gacagcccactgagaag

SEQ ID NO: 757569 - DNA, 15 bp, Homo sapiens
gacagcccagagcct

SEQ ID NO: 757570 - DNA, 21 bp, Homo sapiens
gacagcccaggatactggcac

SEQ ID NO: 757571 - DNA, 11 bp, Homo sapiens
gacagcctccc

SEQ ID NO: 757572 - DNA, 16 bp, Homo sapiens
gacagcctcccacccc

SEQ ID NO: 757573 - DNA, 12 bp, Homo sapiens
gacagcctggca

SEQ ID NO: 757574 - DNA, 19 bp, Homo sapiens
gacagcctggcacagggca

SEQ ID NO: 757575 - DNA, 19 bp, Homo sapiens
gacagcgatggcaggcctg

SEQ ID NO: 757576 - DNA, 13 bp, Homo sapiens
gacagcggccttg

SEQ ID NO: 757577 - DNA, 14 bp, Homo sapiens
gacagctctggggt

SEQ ID NO: 757578 - DNA, 14 bp, Homo sapiens
gacagcttcctcac

SEQ ID NO: 757579 - DNA, 16 bp, Homo sapiens
gacagcttcctcacac

SEQ ID NO: 757580 - DNA, 22 bp, Homo sapiens
gacagcttgagccgggcccctg

SEQ ID NO: 757581 - DNA, 20 bp, Homo sapiens
gacagctttactttaaaatt

SEQ ID NO: 757582 - DNA, 23 bp, Homo sapiens
gacagctttctgggatgtcacag

SEQ ID NO: 757583 - DNA, 23 bp, Homo sapiens
gacagctttgctccgctcccacc

SEQ ID NO: 757584 - DNA, 19 bp, Homo sapiens
gacaggaaaaaccaacagg

SEQ ID NO: 757585 - DNA, 19 bp, Homo sapiens
gacaggaaaatcctctggc

SEQ ID NO: 757586 - DNA, 20 bp, Homo sapiens
gacaggaaagccctccccct

SEQ ID NO: 757587 - DNA, 19 bp, Homo sapiens
gacaggaccccagctctgc

SEQ ID NO: 757588 - DNA, 20 bp, Homo sapiens
gacaggaccccagctctgcg

SEQ ID NO: 757589 - DNA, 13 bp, Homo sapiens
gacaggacctgac

SEQ ID NO: 757590 - DNA, 15 bp, Homo sapiens
gacaggacctgacta

SEQ ID NO: 757591 - DNA, 11 bp, Homo sapiens
gacaggagaaa

SEQ ID NO: 757592 - DNA, 24 bp, Homo sapiens
gacaggagaaatgcatccattcct

SEQ ID NO: 757593 - DNA, 18 bp, Homo sapiens
gacaggagacctggcact

SEQ ID NO: 757594 - DNA, 21 bp, Homo sapiens
gacaggagacctggcactgga

SEQ ID NO: 757595 - DNA, 11 bp, Homo sapiens
gacaggagcct

SEQ ID NO: 757596 - DNA, 19 bp, Homo sapiens
gacaggagcctagcggagc

SEQ ID NO: 757597 - DNA, 12 bp, Homo sapiens
gacaggagcctg

SEQ ID NO: 757598 - DNA, 23 bp, Homo sapiens
gacaggaggaggagatggccata

SEQ ID NO: 757599 - DNA, 13 bp, Homo sapiens
gacaggatccagg

SEQ ID NO: 757600 - DNA, 18 bp, Homo sapiens
gacaggatccaggccggc

SEQ ID NO: 757601 - DNA, 16 bp, Homo sapiens
gacaggcaaataaaag

SEQ ID NO: 757602 - DNA, 17 bp, Homo sapiens
gacaggcagcctccttt

SEQ ID NO: 757603 - DNA, 14 bp, Homo sapiens
gacaggcaggccag

SEQ ID NO: 757604 - DNA, 22 bp, Homo sapiens
gacaggcaggccagatggcccc

SEQ ID NO: 757605 - DNA, 20 bp, Homo sapiens
gacaggccatgtgagccacc

SEQ ID NO: 757606 - DNA, 16 bp, Homo sapiens
gacaggcccaagagat

SEQ ID NO: 757607 - DNA, 21 bp, Homo sapiens
gacaggcccaagagatgaaga

SEQ ID NO: 757608 - DNA, 13 bp, Homo sapiens
gacaggccctccc

SEQ ID NO: 757609 - DNA, 15 bp, Homo sapiens
gacaggcctcacctc

SEQ ID NO: 757610 - DNA, 20 bp, Homo sapiens
gacaggcctcacctctaccc

SEQ ID NO: 757611 - DNA, 18 bp, Homo sapiens
gacaggctcgtcagccac

SEQ ID NO: 757612 - DNA, 22 bp, Homo sapiens
gacaggctcgtcagccacctgg

SEQ ID NO: 757613 - DNA, 19 bp, Homo sapiens
gacaggctcttagcagctt

SEQ ID NO: 757614 - DNA, 20 bp, Homo sapiens
gacaggctggaatgagggag

SEQ ID NO: 757615 - DNA, 22 bp, Homo sapiens
gacaggctggaatgagggaggc

SEQ ID NO: 757616 - DNA, 18 bp, Homo sapiens
gacaggctggcattctag

SEQ ID NO: 757617 - DNA, 15 bp, Homo sapiens
gacagggaagagcag

SEQ ID NO: 757618 - DNA, 16 bp, Homo sapiens
gacagggaagagcaga

SEQ ID NO: 757619 - DNA, 19 bp, Homo sapiens
gacagggaatgctgaggcc

SEQ ID NO: 757620 - DNA, 22 bp, Homo sapiens
gacagggaatgctgaggcctcg

SEQ ID NO: 757621 - DNA, 13 bp, Homo sapiens
gacagggacccac

SEQ ID NO: 757622 - DNA, 15 bp, Homo sapiens
gacagggagggccgg

SEQ ID NO: 757623 - DNA, 15 bp, Homo sapiens
gacagggagggggac

SEQ ID NO: 757624 - DNA, 18 bp, Homo sapiens
gacagggagggggacctg

SEQ ID NO: 757625 - DNA, 15 bp, Homo sapiens
gacagggcagagcag

SEQ ID NO: 757626 - DNA, 15 bp, Homo sapiens
gacagggcatggcca

SEQ ID NO: 757627 - DNA, 14 bp, Homo sapiens
gacagggccagggt

SEQ ID NO: 757628 - DNA, 13 bp, Homo sapiens
gacagggccagtg

SEQ ID NO: 757629 - DNA, 18 bp, Homo sapiens
gacagggccagtgcagtt

SEQ ID NO: 757630 - DNA, 14 bp, Homo sapiens
gacagggccagtgg

SEQ ID NO: 757631 - DNA, 19 bp, Homo sapiens
gacagggccagtggggcct

SEQ ID NO: 757632 - DNA, 22 bp, Homo sapiens
gacagggccagtggggcctgtg

SEQ ID NO: 757633 - DNA, 20 bp, Homo sapiens
gacagggctgagcgtggaag

SEQ ID NO: 757634 - DNA, 20 bp, Homo sapiens
gacagggggtgggaagggga

SEQ ID NO: 757635 - DNA, 17 bp, Homo sapiens
gacagggtaggaaaggg

SEQ ID NO: 757636 - DNA, 16 bp, Homo sapiens
cccatttctatttatt

SEQ ID NO: 757637 - DNA, 19 bp, Homo sapiens
cccatttctatttatttac

SEQ ID NO: 757638 - DNA, 15 bp, Homo sapiens
cccatttctcactga

SEQ ID NO: 757639 - DNA, 14 bp, Homo sapiens
cccatttgtcccag

SEQ ID NO: 757640 - DNA, 18 bp, Homo sapiens
cccatttgtgccagagga

SEQ ID NO: 757641 - DNA, 14 bp, Homo sapiens
cccattttcatcct

SEQ ID NO: 757642 - DNA, 16 bp, Homo sapiens
cccattttcatcctga

SEQ ID NO: 757643 - DNA, 17 bp, Homo sapiens
cccattttccccttcct

SEQ ID NO: 757644 - DNA, 20 bp, Homo sapiens
cccattttccccttcctcat

SEQ ID NO: 757645 - DNA, 22 bp, Homo sapiens
cccattttgcaaaatttccagt

SEQ ID NO: 757646 - DNA, 13 bp, Homo sapiens
cccatttttctct

SEQ ID NO: 757647 - DNA, 19 bp, Homo sapiens
ccccaaaaccacagccctg

SEQ ID NO: 757648 - DNA, 20 bp, Homo sapiens
ccccaaaagaaaccatgaca

SEQ ID NO: 757649 - DNA, 15 bp, Homo sapiens
ccccaaaatccaaaa

SEQ ID NO: 757650 - DNA, 21 bp, Homo sapiens
ccccaaaatccaaaacttctc

SEQ ID NO: 757651 - DNA, 18 bp, Homo sapiens
ccccaaacaccttccagc

SEQ ID NO: 757652 - DNA, 15 bp, Homo sapiens
ccccaaacagactcg

SEQ ID NO: 757653 - DNA, 14 bp, Homo sapiens
ccccaaaccccagc

SEQ ID NO: 757654 - DNA, 20 bp, Homo sapiens
ccccaaaccccagccccaac

SEQ ID NO: 757655 - DNA, 19 bp, Homo sapiens
ccccaaacgggctgccctg

SEQ ID NO: 757656 - DNA, 22 bp, Homo sapiens
ccccaaagagcctggagaagct

SEQ ID NO: 757657 - DNA, 19 bp, Homo sapiens
ccccaaagctttcctgccc

SEQ ID NO: 757658 - DNA, 21 bp, Homo sapiens
ccccaaagctttcctgcccca

SEQ ID NO: 757659 - DNA, 15 bp, Homo sapiens
ccccaaaggacgcct

SEQ ID NO: 757660 - DNA, 14 bp, Homo sapiens
ccccaaaggcatcc

SEQ ID NO: 757661 - DNA, 15 bp, Homo sapiens
ccccaaagtgctggg

SEQ ID NO: 757662 - DNA, 15 bp, Homo sapiens
ccccaaatcaataca

SEQ ID NO: 757663 - DNA, 17 bp, Homo sapiens
ccccaacacctgctgcg

SEQ ID NO: 757664 - DNA, 19 bp, Homo sapiens
ccccaacacctgctgcgct

SEQ ID NO: 757665 - DNA, 18 bp, Homo sapiens
gacagtgccccgggaacc

SEQ ID NO: 757666 - DNA, 22 bp, Homo sapiens
gacagtgcctcttccagtgaac

SEQ ID NO: 757667 - DNA, 17 bp, Homo sapiens
gacagtgcctgggaatg

SEQ ID NO: 757668 - DNA, 13 bp, Homo sapiens
gacagtgccttct

SEQ ID NO: 757669 - DNA, 20 bp, Homo sapiens
gacagtgcgtgatttctcag

SEQ ID NO: 757670 - DNA, 21 bp, Homo sapiens
gacagtgctgagattggaaaa

SEQ ID NO: 757671 - DNA, 14 bp, Homo sapiens
gacagtgctgccct

SEQ ID NO: 757672 - DNA, 17 bp, Homo sapiens
gacagtgctgccctgcg

SEQ ID NO: 757673 - DNA, 17 bp, Homo sapiens
gacagtgcttcagcctg

SEQ ID NO: 757674 - DNA, 13 bp, Homo sapiens
gacagtgcttgca

SEQ ID NO: 757675 - DNA, 14 bp, Homo sapiens
gacagtgcttgcat

SEQ ID NO: 757676 - DNA, 23 bp, Homo sapiens
gacagtgcttgcatcctatttgg

SEQ ID NO: 757677 - DNA, 15 bp, Homo sapiens
gacagtggatatgac

SEQ ID NO: 757678 - DNA, 12 bp, Homo sapiens
gacagtgtacaa

SEQ ID NO: 757679 - DNA, 23 bp, Homo sapiens
gacagtgttgaaaatgttcagaa

SEQ ID NO: 757680 - DNA, 21 bp, Homo sapiens
gacagttatactgtcggtttt

SEQ ID NO: 757681 - DNA, 15 bp, Homo sapiens
gacagttctgaagaa

SEQ ID NO: 757682 - DNA, 15 bp, Homo sapiens
gacagttggcagaga

SEQ ID NO: 757683 - DNA, 24 bp, Homo sapiens
gacagttggcagagaaggcctctt

SEQ ID NO: 757684 - DNA, 23 bp, Homo sapiens
gacagtttaccagttgcctttta

SEQ ID NO: 757685 - DNA, 15 bp, Homo sapiens
gacagtttataatag

SEQ ID NO: 757686 - DNA, 18 bp, Homo sapiens
gacagtttatcctgtctg

SEQ ID NO: 757687 - DNA, 16 bp, Homo sapiens
gacagtttatttgttg

SEQ ID NO: 757688 - DNA, 22 bp, Homo sapiens
gacagttttccttctcatctgt

SEQ ID NO: 757689 - DNA, 12 bp, Homo sapiens
gacataaaactt

SEQ ID NO: 757690 - DNA, 15 bp, Homo sapiens
gacataaaactttaa

SEQ ID NO: 757691 - DNA, 22 bp, Homo sapiens
gacataaaactttaaaaggcaa

SEQ ID NO: 757692 - DNA, 15 bp, Homo sapiens
gacataaaattccac

SEQ ID NO: 757693 - DNA, 14 bp, Homo sapiens
gacataagtaactt

SEQ ID NO: 757694 - DNA, 21 bp, Homo sapiens
gacatacatagacatttcaaa

SEQ ID NO: 757695 - DNA, 15 bp, Homo sapiens
gacatactaaccagc

SEQ ID NO: 757696 - DNA, 16 bp, Homo sapiens
gacatactaaccagca

SEQ ID NO: 757697 - DNA, 11 bp, Homo sapiens
gacatatatag

SEQ ID NO: 757698 - DNA, 20 bp, Homo sapiens
gacatatattttttaaaata

SEQ ID NO: 757699 - DNA, 15 bp, Homo sapiens
gacatatttaactgg

SEQ ID NO: 757700 - DNA, 17 bp, Homo sapiens
gacatatttaatgtttt

SEQ ID NO: 757701 - DNA, 18 bp, Homo sapiens
gacatatttaatgtttta

SEQ ID NO: 757702 - DNA, 22 bp, Homo sapiens
gacatatttaatgttttaaatg

SEQ ID NO: 757703 - DNA, 14 bp, Homo sapiens
gacatcaaaacttg

SEQ ID NO: 757704 - DNA, 18 bp, Homo sapiens
gacatcagattgttaagg

SEQ ID NO: 757705 - DNA, 16 bp, Homo sapiens
gacatcaggagactgg

SEQ ID NO: 757706 - DNA, 20 bp, Homo sapiens
gacatcagtggcatggctcc

SEQ ID NO: 757707 - DNA, 21 bp, Homo sapiens
gacatcagttcctttgtgtgt

SEQ ID NO: 757708 - DNA, 22 bp, Homo sapiens
gacatcattcatgacaacatga

SEQ ID NO: 757709 - DNA, 14 bp, Homo sapiens
gacatccaaatcta

SEQ ID NO: 757710 - DNA, 23 bp, Homo sapiens
gacatccatgttccgagaagaac

SEQ ID NO: 757711 - DNA, 20 bp, Homo sapiens
gacatccctcccccagcaga

SEQ ID NO: 757712 - DNA, 13 bp, Homo sapiens
gacatcccttcct

SEQ ID NO: 757713 - DNA, 14 bp, Homo sapiens
gacatcccttcctg

SEQ ID NO: 757714 - DNA, 19 bp, Homo sapiens
gacatcccttcctggaaac

SEQ ID NO: 757715 - DNA, 21 bp, Homo sapiens
gacatccgtcattgctgctgc

SEQ ID NO: 757716 - DNA, 14 bp, Homo sapiens
gacatcctgtataa

SEQ ID NO: 757717 - DNA, 13 bp, Homo sapiens
gacatctcagggg

SEQ ID NO: 757718 - DNA, 18 bp, Homo sapiens
gacatctcaggggccaga

SEQ ID NO: 757719 - DNA, 13 bp, Homo sapiens
gacatctctctgg

SEQ ID NO: 757720 - DNA, 14 bp, Homo sapiens
gacatctctctggc

SEQ ID NO: 757721 - DNA, 16 bp, Homo sapiens
gacatctctctggctt

SEQ ID NO: 757722 - DNA, 17 bp, Homo sapiens
gacatctctctggcttc

SEQ ID NO: 757723 - DNA, 23 bp, Homo sapiens
gacatctctctggcttctgaaga

SEQ ID NO: 757724 - DNA, 12 bp, Homo sapiens
gacatctctgga

SEQ ID NO: 757725 - DNA, 21 bp, Homo sapiens
gacatctctggagccagagag

SEQ ID NO: 757726 - DNA, 13 bp, Homo sapiens
gacatctgcctgt

SEQ ID NO: 757727 - DNA, 17 bp, Homo sapiens
gacatctgcctgtaatt

SEQ ID NO: 757728 - DNA, 21 bp, Homo sapiens
gacatctgtttctaaatgttt

SEQ ID NO: 757729 - DNA, 22 bp, Homo sapiens
gacatcttgcctacttttcttt

SEQ ID NO: 757730 - DNA, 20 bp, Homo sapiens
gacatgaagattctttccca

SEQ ID NO: 757731 - DNA, 20 bp, Homo sapiens
gacatgaccctctgtcccca

SEQ ID NO: 757732 - DNA, 22 bp, Homo sapiens
gacatgagattttattttttgt

SEQ ID NO: 757733 - DNA, 23 bp, Homo sapiens
gacatgatactgatgccatgttt

SEQ ID NO: 757734 - DNA, 21 bp, Homo sapiens
gacatgatggagcgcacctgc

SEQ ID NO: 757735 - DNA, 23 bp, Homo sapiens
gacatgatttagggaagcaggga

SEQ ID NO: 757736 - DNA, 14 bp, Homo sapiens
gacatgatttcctt

SEQ ID NO: 757737 - DNA, 16 bp, Homo sapiens
gacatgatttccttga

SEQ ID NO: 757738 - DNA, 17 bp, Homo sapiens
gacatgccctgtgtggc

SEQ ID NO: 757739 - DNA, 17 bp, Homo sapiens
gacatgcggtagccagc

SEQ ID NO: 757740 - DNA, 22 bp, Homo sapiens
gacatgcggtagccagcacaca

SEQ ID NO: 757741 - DNA, 23 bp, Homo sapiens
gacatgcggtagccagcacacag

SEQ ID NO: 757742 - DNA, 17 bp, Homo sapiens
gacatgcgtgtgtcagg

SEQ ID NO: 757743 - DNA, 15 bp, Homo sapiens
gacatgctcacctct

SEQ ID NO: 757744 - DNA, 16 bp, Homo sapiens
gacatgctcacctcta

SEQ ID NO: 757745 - DNA, 21 bp, Homo sapiens
gacatgcttttctgccactcc

SEQ ID NO: 757746 - DNA, 18 bp, Homo sapiens
gacatggaagagagagcc

SEQ ID NO: 757747 - DNA, 14 bp, Homo sapiens
gacatggaccagca

SEQ ID NO: 757748 - DNA, 17 bp, Homo sapiens
gacatggaccagcatct

SEQ ID NO: 757749 - DNA, 17 bp, Homo sapiens
gacatggagtgttactg

SEQ ID NO: 757750 - DNA, 21 bp, Homo sapiens
gacatggcccattggagcacc

SEQ ID NO: 757751 - DNA, 16 bp, Homo sapiens
gacatggggcaagcca

SEQ ID NO: 757752 - DNA, 18 bp, Homo sapiens
gacatggggcaagccagg

SEQ ID NO: 757753 - DNA, 21 bp, Homo sapiens
gacatggggcaagccagggcc

SEQ ID NO: 757754 - DNA, 24 bp, Homo sapiens
gacatggggcaagccagggcccag

SEQ ID NO: 757755 - DNA, 17 bp, Homo sapiens
gacatgggtattttata

SEQ ID NO: 757756 - DNA, 14 bp, Homo sapiens
gacatggtgcctga

SEQ ID NO: 757757 - DNA, 24 bp, Homo sapiens
ccccaccggaactgggctggcgct

SEQ ID NO: 757758 - DNA, 18 bp, Homo sapiens
ccccaccggtccagctgg

SEQ ID NO: 757759 - DNA, 12 bp, Homo sapiens
ccccacctccca

SEQ ID NO: 757760 - DNA, 13 bp, Homo sapiens
ccccacctctcca

SEQ ID NO: 757761 - DNA, 17 bp, Homo sapiens
ccccacctctccctgac

SEQ ID NO: 757762 - DNA, 13 bp, Homo sapiens
ccccacctcttgt

SEQ ID NO: 757763 - DNA, 23 bp, Homo sapiens
ccccacctcttgtttctgggtcc

SEQ ID NO: 757764 - DNA, 12 bp, Homo sapiens
ccccacctgcgg

SEQ ID NO: 757765 - DNA, 13 bp, Homo sapiens
ccccacctggaca

SEQ ID NO: 757766 - DNA, 11 bp, Homo sapiens
ccccacctggg

SEQ ID NO: 757767 - DNA, 16 bp, Homo sapiens
ccccaccttccccaga

SEQ ID NO: 757768 - DNA, 15 bp, Homo sapiens
ccccaccttgccagg

SEQ ID NO: 757769 - DNA, 19 bp, Homo sapiens
ccccaccttgccagggcag

SEQ ID NO: 757770 - DNA, 23 bp, Homo sapiens
ccccaccttggtccctctcagat

SEQ ID NO: 757771 - DNA, 21 bp, Homo sapiens
ccccacgagtcacctgcaagc

SEQ ID NO: 757772 - DNA, 17 bp, Homo sapiens
ccccacgccctctcctc

SEQ ID NO: 757773 - DNA, 13 bp, Homo sapiens
ccccactcacccc

SEQ ID NO: 757774 - DNA, 15 bp, Homo sapiens
ccccactcaggggac

SEQ ID NO: 757775 - DNA, 17 bp, Homo sapiens
ccccactcccccttccc

SEQ ID NO: 757776 - DNA, 15 bp, Homo sapiens
ccccactcccctcac

SEQ ID NO: 757777 - DNA, 23 bp, Homo sapiens
ccccactcccgaaagcctttcct

SEQ ID NO: 757778 - DNA, 12 bp, Homo sapiens
ccccactcctct

SEQ ID NO: 757779 - DNA, 13 bp, Homo sapiens
ccccactcctctc

SEQ ID NO: 757780 - DNA, 20 bp, Homo sapiens
ccccactctcattccccagg

SEQ ID NO: 757781 - DNA, 12 bp, Homo sapiens
ccccactctccc

SEQ ID NO: 757782 - DNA, 15 bp, Homo sapiens
ccccactctccccac

SEQ ID NO: 757783 - DNA, 18 bp, Homo sapiens
ccccactctccccacact

SEQ ID NO: 757784 - DNA, 13 bp, Homo sapiens
ccccactctctca

SEQ ID NO: 757785 - DNA, 16 bp, Homo sapiens
ccccactctctcaccc

SEQ ID NO: 757786 - DNA, 18 bp, Homo sapiens
ccccactctctcacccac

SEQ ID NO: 757787 - DNA, 15 bp, Homo sapiens
ccccactgacagcct

SEQ ID NO: 757788 - DNA, 15 bp, Homo sapiens
ccccactgccagcag

SEQ ID NO: 757789 - DNA, 18 bp, Homo sapiens
ccccactgctaaggctgc

SEQ ID NO: 757790 - DNA, 14 bp, Homo sapiens
ccccactgctgagc

SEQ ID NO: 757791 - DNA, 15 bp, Homo sapiens
ccccactgctgagct

SEQ ID NO: 757792 - DNA, 17 bp, Homo sapiens
ccccactggacaacact

SEQ ID NO: 757793 - DNA, 13 bp, Homo sapiens
gacatttaaatgt

SEQ ID NO: 757794 - DNA, 15 bp, Homo sapiens
gacatttaaatgtaa

SEQ ID NO: 757795 - DNA, 19 bp, Homo sapiens
gacatttacaggagggccc

SEQ ID NO: 757796 - DNA, 19 bp, Homo sapiens
gacatttctaacatatgta

SEQ ID NO: 757797 - DNA, 13 bp, Homo sapiens
gacatttctctaa

SEQ ID NO: 757798 - DNA, 14 bp, Homo sapiens
gacatttcttcata

SEQ ID NO: 757799 - DNA, 17 bp, Homo sapiens
gacatttgctgaactca

SEQ ID NO: 757800 - DNA, 22 bp, Homo sapiens
gacatttgctgaactcagcaca

SEQ ID NO: 757801 - DNA, 22 bp, Homo sapiens
gacatttgggagacatgtgaca

SEQ ID NO: 757802 - DNA, 17 bp, Homo sapiens
gacatttgtttgctgta

SEQ ID NO: 757803 - DNA, 14 bp, Homo sapiens
gacattttacatta

SEQ ID NO: 757804 - DNA, 23 bp, Homo sapiens
gacatttttccgtttgcttttgt

SEQ ID NO: 757805 - DNA, 23 bp, Homo sapiens
gaccaaaaaaggacgtaaaattt

SEQ ID NO: 757806 - DNA, 23 bp, Homo sapiens
gaccaaaatcaggaaccacagat

SEQ ID NO: 757807 - DNA, 17 bp, Homo sapiens
gaccaaaatgacaatga

SEQ ID NO: 757808 - DNA, 15 bp, Homo sapiens
gaccaaactacttca

SEQ ID NO: 757809 - DNA, 20 bp, Homo sapiens
gaccaaagcaaagaaaataa

SEQ ID NO: 757810 - DNA, 23 bp, Homo sapiens
gaccaaagggaagtgaggcccaa

SEQ ID NO: 757811 - DNA, 12 bp, Homo sapiens
gaccaaaggggg

SEQ ID NO: 757812 - DNA, 13 bp, Homo sapiens
gaccaaaggtcag

SEQ ID NO: 757813 - DNA, 17 bp, Homo sapiens
gaccaaagtcccttcct

SEQ ID NO: 757814 - DNA, 18 bp, Homo sapiens
gaccaaatcgagtgatag

SEQ ID NO: 757815 - DNA, 21 bp, Homo sapiens
gaccaaatgtgccatactaat

SEQ ID NO: 757816 - DNA, 16 bp, Homo sapiens
gaccaaattgcttcta

SEQ ID NO: 757817 - DNA, 21 bp, Homo sapiens
gaccaacaaagtcacagtcgt

SEQ ID NO: 757818 - DNA, 22 bp, Homo sapiens
gaccaacatggagaaaccctgt

SEQ ID NO: 757819 - DNA, 15 bp, Homo sapiens
gaccaaccctgggac

SEQ ID NO: 757820 - DNA, 16 bp, Homo sapiens
gaccaaccctgtttcc

SEQ ID NO: 757821 - DNA, 16 bp, Homo sapiens
gaccaacctgctctgt

SEQ ID NO: 757822 - DNA, 14 bp, Homo sapiens
gaccaactgcccta

SEQ ID NO: 757823 - DNA, 17 bp, Homo sapiens
gaccaactggcttctgt

SEQ ID NO: 757824 - DNA, 22 bp, Homo sapiens
gaccaactggcttctgtgcact

SEQ ID NO: 757825 - DNA, 19 bp, Homo sapiens
gaccaactgtgttgtatta

SEQ ID NO: 757826 - DNA, 21 bp, Homo sapiens
gaccaactgtgttgtattaac

SEQ ID NO: 757827 - DNA, 22 bp, Homo sapiens
gaccaactgtgttgtattaaca

SEQ ID NO: 757828 - DNA, 12 bp, Homo sapiens
gaccaagaactg

SEQ ID NO: 757829 - DNA, 13 bp, Homo sapiens
gaccaagaactgc

SEQ ID NO: 757830 - DNA, 18 bp, Homo sapiens
gaccaagagagaaagaag

SEQ ID NO: 757831 - DNA, 23 bp, Homo sapiens
gaccaaggcaaggcaggtgcctc

SEQ ID NO: 757832 - DNA, 21 bp, Homo sapiens
gaccaaggcctcggcagaact

SEQ ID NO: 757833 - DNA, 20 bp, Homo sapiens
gaccaataaaatttctaaga

SEQ ID NO: 757834 - DNA, 21 bp, Homo sapiens
gaccaataaaatttctaagag

SEQ ID NO: 757835 - DNA, 16 bp, Homo sapiens
gaccaatccccagcct

SEQ ID NO: 757836 - DNA, 20 bp, Homo sapiens
gaccaattagtcactgctgc

SEQ ID NO: 757837 - DNA, 21 bp, Homo sapiens
gaccaattctggacagacaga

SEQ ID NO: 757838 - DNA, 18 bp, Homo sapiens
gaccaattgtgctgccat

SEQ ID NO: 757839 - DNA, 18 bp, Homo sapiens
gaccacacattttatgag

SEQ ID NO: 757840 - DNA, 22 bp, Homo sapiens
gaccacacccgaagtcctgtca

SEQ ID NO: 757841 - DNA, 17 bp, Homo sapiens
gaccacacttcctgtcc

SEQ ID NO: 757842 - DNA, 22 bp, Homo sapiens
gaccacacttcctgtccagaga

SEQ ID NO: 757843 - DNA, 23 bp, Homo sapiens
gaccacagcaagccatcatcctc

SEQ ID NO: 757844 - DNA, 12 bp, Homo sapiens
gaccacagcaca

SEQ ID NO: 757845 - DNA, 14 bp, Homo sapiens
gaccacagcacagc

SEQ ID NO: 757846 - DNA, 15 bp, Homo sapiens
gaccacagcacagcc

SEQ ID NO: 757847 - DNA, 21 bp, Homo sapiens
gaccacagtgggtggcacctc

SEQ ID NO: 757848 - DNA, 22 bp, Homo sapiens
gaccacagtgggtggcacctcc

SEQ ID NO: 757849 - DNA, 18 bp, Homo sapiens
gaccacatctgtcctcac

SEQ ID NO: 757850 - DNA, 17 bp, Homo sapiens
gaccacatctttatctg

SEQ ID NO: 757851 - DNA, 23 bp, Homo sapiens
gaccacatctttatctgttcttg

SEQ ID NO: 757852 - DNA, 22 bp, Homo sapiens
gaccaccaccccaacaaaccat

SEQ ID NO: 757853 - DNA, 14 bp, Homo sapiens
gaccaccagcccca

SEQ ID NO: 757854 - DNA, 20 bp, Homo sapiens
gaccaccagccccagcaaga

SEQ ID NO: 757855 - DNA, 20 bp, Homo sapiens
gaccaccagccgccccagcc

SEQ ID NO: 757856 - DNA, 16 bp, Homo sapiens
gaccacccatatcatg

SEQ ID NO: 757857 - DNA, 19 bp, Homo sapiens
gaccacccccaaacacaaa

SEQ ID NO: 757858 - DNA, 22 bp, Homo sapiens
gaccacccccaaacacaaaaca

SEQ ID NO: 757859 - DNA, 18 bp, Homo sapiens
gaccaccccctgttccct

SEQ ID NO: 757860 - DNA, 23 bp, Homo sapiens
gaccaccccctgttccctgttct

SEQ ID NO: 757861 - DNA, 14 bp, Homo sapiens
gaccaccctcccct

SEQ ID NO: 757862 - DNA, 16 bp, Homo sapiens
gaccaccctcccctct

SEQ ID NO: 757863 - DNA, 19 bp, Homo sapiens
gaccaccctcccctctctt

SEQ ID NO: 757864 - DNA, 14 bp, Homo sapiens
gaccaccctgagcc

SEQ ID NO: 757865 - DNA, 11 bp, Homo sapiens
gaccacctcca

SEQ ID NO: 757866 - DNA, 13 bp, Homo sapiens
gaccacctgccca

SEQ ID NO: 757867 - DNA, 22 bp, Homo sapiens
gaccaccttctgtccccagccc

SEQ ID NO: 757868 - DNA, 21 bp, Homo sapiens
gaccacgcccgtcctgcctgt

SEQ ID NO: 757869 - DNA, 16 bp, Homo sapiens
gaccacgccgccctcc

SEQ ID NO: 757870 - DNA, 17 bp, Homo sapiens
gaccacgccgccctcca

SEQ ID NO: 757871 - DNA, 14 bp, Homo sapiens
gaccacgctttcta

SEQ ID NO: 757872 - DNA, 21 bp, Homo sapiens
gaccacgctttctagctgttg

SEQ ID NO: 757873 - DNA, 20 bp, Homo sapiens
gaccacgtgaaatttgcctc

SEQ ID NO: 757874 - DNA, 14 bp, Homo sapiens
gaccacgtttctaa

SEQ ID NO: 757875 - DNA, 14 bp, Homo sapiens
gaccactcagcccc

SEQ ID NO: 757876 - DNA, 17 bp, Homo sapiens
gaccactcagcccctag

SEQ ID NO: 757877 - DNA, 21 bp, Homo sapiens
gaccactcttctttaagccat

SEQ ID NO: 757878 - DNA, 20 bp, Homo sapiens
gaccagaaaatgtaaggcaa

SEQ ID NO: 757879 - DNA, 16 bp, Homo sapiens
ccccagcctctggcat

SEQ ID NO: 757880 - DNA, 17 bp, Homo sapiens
ccccagcctgacctgag

SEQ ID NO: 757881 - DNA, 19 bp, Homo sapiens
ccccagcctgacctgagac

SEQ ID NO: 757882 - DNA, 11 bp, Homo sapiens
ccccagcctgg

SEQ ID NO: 757883 - DNA, 14 bp, Homo sapiens
ccccagcctggcca

SEQ ID NO: 757884 - DNA, 19 bp, Homo sapiens
ccccagcgagagtccctgc

SEQ ID NO: 757885 - DNA, 16 bp, Homo sapiens
ccccagcgtcaggcct

SEQ ID NO: 757886 - DNA, 20 bp, Homo sapiens
ccccagcgtcaggcctacct

SEQ ID NO: 757887 - DNA, 15 bp, Homo sapiens
ccccagcgtctgcag

SEQ ID NO: 757888 - DNA, 16 bp, Homo sapiens
ccccagctccctgcac

SEQ ID NO: 757889 - DNA, 19 bp, Homo sapiens
ccccagctccctgcaccgc

SEQ ID NO: 757890 - DNA, 21 bp, Homo sapiens
ccccagctctaagcagccagg

SEQ ID NO: 757891 - DNA, 16 bp, Homo sapiens
ccccagctgacatgga

SEQ ID NO: 757892 - DNA, 15 bp, Homo sapiens
ccccagctgactgtg

SEQ ID NO: 757893 - DNA, 15 bp, Homo sapiens
ccccagctgccaggc

SEQ ID NO: 757894 - DNA, 19 bp, Homo sapiens
ccccagctgccaggcggcc

SEQ ID NO: 757895 - DNA, 21 bp, Homo sapiens
ccccagctgccaggcggccct

SEQ ID NO: 757896 - DNA, 15 bp, Homo sapiens
ccccagctgggaggc

SEQ ID NO: 757897 - DNA, 23 bp, Homo sapiens
ccccagcttctctctccctgtca

SEQ ID NO: 757898 - DNA, 17 bp, Homo sapiens
ccccaggacctggctgc

SEQ ID NO: 757899 - DNA, 21 bp, Homo sapiens
ccccaggacctggctgccata

SEQ ID NO: 757900 - DNA, 12 bp, Homo sapiens
ccccaggacgcc

SEQ ID NO: 757901 - DNA, 18 bp, Homo sapiens
ccccaggactctggcact

SEQ ID NO: 757902 - DNA, 18 bp, Homo sapiens
ccccaggagggaggcagg

SEQ ID NO: 757903 - DNA, 16 bp, Homo sapiens
ccccaggatctgggtt

SEQ ID NO: 757904 - DNA, 15 bp, Homo sapiens
ccccaggattccccc

SEQ ID NO: 757905 - DNA, 16 bp, Homo sapiens
ccccaggattccccca

SEQ ID NO: 757906 - DNA, 11 bp, Homo sapiens
ccccaggcagg

SEQ ID NO: 757907 - DNA, 18 bp, Homo sapiens
ccccaggcaggctgtgcg

SEQ ID NO: 757908 - DNA, 13 bp, Homo sapiens
ccccaggccaggc

SEQ ID NO: 757909 - DNA, 22 bp, Homo sapiens
ccccaggccaggccaccaggat

SEQ ID NO: 757910 - DNA, 14 bp, Homo sapiens
ccccaggccaggtg

SEQ ID NO: 757911 - DNA, 14 bp, Homo sapiens
ccccaggcccagcc

SEQ ID NO: 757912 - DNA, 15 bp, Homo sapiens
ccccaggcccagccc

SEQ ID NO: 757913 - DNA, 18 bp, Homo sapiens
ccccaggccccagacagg

SEQ ID NO: 757914 - DNA, 14 bp, Homo sapiens
ccccaggccctccc

SEQ ID NO: 757915 - DNA, 15 bp, Homo sapiens
ccccaggccctccca

SEQ ID NO: 757916 - DNA, 15 bp, Homo sapiens
ccccaggccggagcc

SEQ ID NO: 757917 - DNA, 16 bp, Homo sapiens
ccccaggccggagccc

SEQ ID NO: 757918 - DNA, 15 bp, Homo sapiens
ccccaggcctccagc

SEQ ID NO: 757919 - DNA, 23 bp, Homo sapiens
ccccaggcctcctaggggaaggg

SEQ ID NO: 757920 - DNA, 22 bp, Homo sapiens
gaccagggtcttacctctctgg

SEQ ID NO: 757921 - DNA, 16 bp, Homo sapiens
gaccagggtggagctg

SEQ ID NO: 757922 - DNA, 18 bp, Homo sapiens
gaccagtgggatgggctc

SEQ ID NO: 757923 - DNA, 15 bp, Homo sapiens
gaccagtttgcagag

SEQ ID NO: 757924 - DNA, 18 bp, Homo sapiens
gaccataattttttttaa

SEQ ID NO: 757925 - DNA, 23 bp, Homo sapiens
gaccatattctaagttagactct

SEQ ID NO: 757926 - DNA, 13 bp, Homo sapiens
gaccatcactgag

SEQ ID NO: 757927 - DNA, 22 bp, Homo sapiens
gaccatcactgagagtcaggag

SEQ ID NO: 757928 - DNA, 20 bp, Homo sapiens
gaccatcctggccaacatga

SEQ ID NO: 757929 - DNA, 18 bp, Homo sapiens
gaccatcctggcccctcc

SEQ ID NO: 757930 - DNA, 19 bp, Homo sapiens
gaccatcctggcccctcca

SEQ ID NO: 757931 - DNA, 13 bp, Homo sapiens
gaccatcctggct

SEQ ID NO: 757932 - DNA, 16 bp, Homo sapiens
gaccatctgattaaaa

SEQ ID NO: 757933 - DNA, 13 bp, Homo sapiens
gaccatctgctgc

SEQ ID NO: 757934 - DNA, 16 bp, Homo sapiens
gaccatctgctgcagt

SEQ ID NO: 757935 - DNA, 15 bp, Homo sapiens
gaccatctgctttta

SEQ ID NO: 757936 - DNA, 17 bp, Homo sapiens
gaccatctgcttttatt

SEQ ID NO: 757937 - DNA, 12 bp, Homo sapiens
gaccatgccaga

SEQ ID NO: 757938 - DNA, 17 bp, Homo sapiens
gaccatgccagacccac

SEQ ID NO: 757939 - DNA, 21 bp, Homo sapiens
gaccatgccagattctgcctc

SEQ ID NO: 757940 - DNA, 22 bp, Homo sapiens
gaccatgccagattctgcctct

SEQ ID NO: 757941 - DNA, 23 bp, Homo sapiens
gaccatggccgaagccccttgga

SEQ ID NO: 757942 - DNA, 17 bp, Homo sapiens
gaccatggttttggctc

SEQ ID NO: 757943 - DNA, 12 bp, Homo sapiens
gaccatgtgtca

SEQ ID NO: 757944 - DNA, 13 bp, Homo sapiens
gaccatgtgtcac

SEQ ID NO: 757945 - DNA, 13 bp, Homo sapiens
gaccatgttcatt

SEQ ID NO: 757946 - DNA, 15 bp, Homo sapiens
gaccattcaattagt

SEQ ID NO: 757947 - DNA, 16 bp, Homo sapiens
gaccattcctgtccct

SEQ ID NO: 757948 - DNA, 14 bp, Homo sapiens
gaccattctgcctc

SEQ ID NO: 757949 - DNA, 17 bp, Homo sapiens
gaccattgacctcagct

SEQ ID NO: 757950 - DNA, 18 bp, Homo sapiens
gaccattgagtccctgct

SEQ ID NO: 757951 - DNA, 13 bp, Homo sapiens
gaccatttataat

SEQ ID NO: 757952 - DNA, 13 bp, Homo sapiens
gacccaaagacca

SEQ ID NO: 757953 - DNA, 17 bp, Homo sapiens
gacccaaagcaaaacat

SEQ ID NO: 757954 - DNA, 21 bp, Homo sapiens
gacccaaagcaaaacatcaca

SEQ ID NO: 757955 - DNA, 17 bp, Homo sapiens
gacccaaagcaggatga

SEQ ID NO: 757956 - DNA, 19 bp, Homo sapiens
gacccaactgggggcaaag

SEQ ID NO: 757957 - DNA, 23 bp, Homo sapiens
gacccaagtctgaacgtggaatt

SEQ ID NO: 757958 - DNA, 19 bp, Homo sapiens
gacccaatgtaggagctgc

SEQ ID NO: 757959 - DNA, 12 bp, Homo sapiens
gacccacagctc

SEQ ID NO: 757960 - DNA, 14 bp, Homo sapiens
gacccacagctctg

SEQ ID NO: 757961 - DNA, 12 bp, Homo sapiens
gacccacatgct

SEQ ID NO: 757962 - DNA, 19 bp, Homo sapiens
gacccaccaaactgcacac

SEQ ID NO: 757963 - DNA, 12 bp, Homo sapiens
gacccacccagc

SEQ ID NO: 757964 - DNA, 15 bp, Homo sapiens
gacccacccagcccc

SEQ ID NO: 757965 - DNA, 17 bp, Homo sapiens
gacccacccagcccctc

SEQ ID NO: 757966 - DNA, 23 bp, Homo sapiens
gacccacccatcttcctgctgct

SEQ ID NO: 757967 - DNA, 17 bp, Homo sapiens
gacccacccctgtgctc

SEQ ID NO: 757968 - DNA, 14 bp, Homo sapiens
gacccacctgcgct

SEQ ID NO: 757969 - DNA, 16 bp, Homo sapiens
gacccacctggagccc

SEQ ID NO: 757970 - DNA, 17 bp, Homo sapiens
gacccagaatggagcct

SEQ ID NO: 757971 - DNA, 17 bp, Homo sapiens
gacccagagccctctga

SEQ ID NO: 757972 - DNA, 18 bp, Homo sapiens
gacccagaggccctgaag

SEQ ID NO: 757973 - DNA, 13 bp, Homo sapiens
gacccagagtgga

SEQ ID NO: 757974 - DNA, 20 bp, Homo sapiens
gacccagatcctcacaacca

SEQ ID NO: 757975 - DNA, 15 bp, Homo sapiens
gacccagatgtgacg

SEQ ID NO: 757976 - DNA, 12 bp, Homo sapiens
gacccagcatct

SEQ ID NO: 757977 - DNA, 19 bp, Homo sapiens
gacccagcatctcccagca

SEQ ID NO: 757978 - DNA, 18 bp, Homo sapiens
gacccagccagctgcagg

SEQ ID NO: 757979 - DNA, 20 bp, Homo sapiens
gacccagccagctgcagggc

SEQ ID NO: 757980 - DNA, 22 bp, Homo sapiens
gacccagccccttgagaaacct

SEQ ID NO: 757981 - DNA, 18 bp, Homo sapiens
gacccagcccgcggcctg

SEQ ID NO: 757982 - DNA, 19 bp, Homo sapiens
gacccagcccgcggcctgg

SEQ ID NO: 757983 - DNA, 21 bp, Homo sapiens
gacccagcccgcggcctggac

SEQ ID NO: 757984 - DNA, 12 bp, Homo sapiens
gacccagcctga

SEQ ID NO: 757985 - DNA, 12 bp, Homo sapiens
gacccagctact

SEQ ID NO: 757986 - DNA, 15 bp, Homo sapiens
gacccagctactctg

SEQ ID NO: 757987 - DNA, 20 bp, Homo sapiens
gacccagctactgaaccagc

SEQ ID NO: 757988 - DNA, 12 bp, Homo sapiens
gacccagctcct

SEQ ID NO: 757989 - DNA, 13 bp, Homo sapiens
gacccagctcctc

SEQ ID NO: 757990 - DNA, 19 bp, Homo sapiens
gacccagctgcagaccatg

SEQ ID NO: 757991 - DNA, 21 bp, Homo sapiens
gacccagcttagagttcttct

SEQ ID NO: 757992 - DNA, 15 bp, Homo sapiens
gacccaggaaaggca

SEQ ID NO: 757993 - DNA, 12 bp, Homo sapiens
gacccaggacag

SEQ ID NO: 757994 - DNA, 12 bp, Homo sapiens
gacccaggctcc

SEQ ID NO: 757995 - DNA, 16 bp, Homo sapiens
gacccaggctccgccc

SEQ ID NO: 757996 - DNA, 17 bp, Homo sapiens
gacccaggctccgccct

SEQ ID NO: 757997 - DNA, 23 bp, Homo sapiens
gacccaggctccgcccttagtcc

SEQ ID NO: 757998 - DNA, 11 bp, Homo sapiens
gacccagggtc

SEQ ID NO: 757999 - DNA, 13 bp, Homo sapiens
gacccaggtggct

SEQ ID NO: 758000 - DNA, 15 bp, Homo sapiens
gacccaggtgggact

SEQ ID NO: 758001 - DNA, 16 bp, Homo sapiens
gacccaggtgggactt

SEQ ID NO: 758002 - DNA, 22 bp, Homo sapiens
ccccatcttgatctttgagccc

SEQ ID NO: 758003 - DNA, 14 bp, Homo sapiens
ccccatgagctcgg

SEQ ID NO: 758004 - DNA, 20 bp, Homo sapiens
ccccatgcctgtccagcctg

SEQ ID NO: 758005 - DNA, 21 bp, Homo sapiens
ccccatgcctgtccagcctgg

SEQ ID NO: 758006 - DNA, 23 bp, Homo sapiens
ccccatgcctgtccagcctgggc

SEQ ID NO: 758007 - DNA, 24 bp, Homo sapiens
ccccatgcctgtccagcctgggca

SEQ ID NO: 758008 - DNA, 15 bp, Homo sapiens
ccccatgctctgccc

SEQ ID NO: 758009 - DNA, 18 bp, Homo sapiens
ccccatgctgccttcagg

SEQ ID NO: 758010 - DNA, 19 bp, Homo sapiens
ccccatgctgccttcaggg

SEQ ID NO: 758011 - DNA, 23 bp, Homo sapiens
ccccatgcttaacatacccgcct

SEQ ID NO: 758012 - DNA, 12 bp, Homo sapiens
ccccatgggctg

SEQ ID NO: 758013 - DNA, 17 bp, Homo sapiens
ccccatgggcttggact

SEQ ID NO: 758014 - DNA, 19 bp, Homo sapiens
ccccatggtcagccctagg

SEQ ID NO: 758015 - DNA, 15 bp, Homo sapiens
ccccatgtctctcag

SEQ ID NO: 758016 - DNA, 18 bp, Homo sapiens
ccccatgtgccttgtcca

SEQ ID NO: 758017 - DNA, 22 bp, Homo sapiens
ccccatgtgccttgtccaggaa

SEQ ID NO: 758018 - DNA, 17 bp, Homo sapiens
ccccatgtggcagccca

SEQ ID NO: 758019 - DNA, 23 bp, Homo sapiens
ccccatgtgtcctggttcccgtt

SEQ ID NO: 758020 - DNA, 22 bp, Homo sapiens
ccccatgttgtaatgctgcact

SEQ ID NO: 758021 - DNA, 17 bp, Homo sapiens
ccccattagagtcagcc

SEQ ID NO: 758022 - DNA, 20 bp, Homo sapiens
ccccattccttgcgcctcag

SEQ ID NO: 758023 - DNA, 22 bp, Homo sapiens
ccccattccttgcgcctcagcc

SEQ ID NO: 758024 - DNA, 16 bp, Homo sapiens
ccccattctcatctgc

SEQ ID NO: 758025 - DNA, 12 bp, Homo sapiens
ccccattctccc

SEQ ID NO: 758026 - DNA, 21 bp, Homo sapiens
ccccattcttcctagttttct

SEQ ID NO: 758027 - DNA, 15 bp, Homo sapiens
ccccattcttttgta

SEQ ID NO: 758028 - DNA, 16 bp, Homo sapiens
ccccatttcccatctg

SEQ ID NO: 758029 - DNA, 18 bp, Homo sapiens
ccccatttcccatctgca

SEQ ID NO: 758030 - DNA, 13 bp, Homo sapiens
ccccatttctatt

SEQ ID NO: 758031 - DNA, 14 bp, Homo sapiens
ccccatttctgcct

SEQ ID NO: 758032 - DNA, 13 bp, Homo sapiens
cccccaacacagg

SEQ ID NO: 758033 - DNA, 18 bp, Homo sapiens
cccccaacacctgctgcg

SEQ ID NO: 758034 - DNA, 20 bp, Homo sapiens
cccccaacactgtgccctgg

SEQ ID NO: 758035 - DNA, 22 bp, Homo sapiens
cccccaacactgtgccctggtg

SEQ ID NO: 758036 - DNA, 16 bp, Homo sapiens
cccccaaccaaggaag

SEQ ID NO: 758037 - DNA, 14 bp, Homo sapiens
cccccaacccccag

SEQ ID NO: 758038 - DNA, 15 bp, Homo sapiens
cccccaacccccaga

SEQ ID NO: 758039 - DNA, 15 bp, Homo sapiens
cccccaacctttccc

SEQ ID NO: 758040 - DNA, 16 bp, Homo sapiens
cccccaactccaggaa

SEQ ID NO: 758041 - DNA, 18 bp, Homo sapiens
cccccaactcttcctccc

SEQ ID NO: 758042 - DNA, 21 bp, Homo sapiens
cccccaacttcaccaccccct

SEQ ID NO: 758043 - DNA, 14 bp, Homo sapiens
cccccaagcctggg

SEQ ID NO: 758044 - DNA, 22 bp, Homo sapiens
cccccaagcctgggcttgagct

SEQ ID NO: 758045 - DNA, 19 bp, Homo sapiens
cccccaaggttctggttcc

SEQ ID NO: 758046 - DNA, 14 bp, Homo sapiens
cccccaataaaggc

SEQ ID NO: 758047 - DNA, 17 bp, Homo sapiens
cccccaataaaggcagc

SEQ ID NO: 758048 - DNA, 16 bp, Homo sapiens
gacccctaccccctca

SEQ ID NO: 758049 - DNA, 17 bp, Homo sapiens
gacccctaccccctcat

SEQ ID NO: 758050 - DNA, 12 bp, Homo sapiens
gacccctcacca

SEQ ID NO: 758051 - DNA, 17 bp, Homo sapiens
gacccctcccctcgtgt

SEQ ID NO: 758052 - DNA, 14 bp, Homo sapiens
gacccctccctgca

SEQ ID NO: 758053 - DNA, 20 bp, Homo sapiens
gacccctccctgcaggggct

SEQ ID NO: 758054 - DNA, 23 bp, Homo sapiens
gacccctcccttgctcagtgcct

SEQ ID NO: 758055 - DNA, 14 bp, Homo sapiens
gacccctctcctca

SEQ ID NO: 758056 - DNA, 16 bp, Homo sapiens
gacccctgagcttgca

SEQ ID NO: 758057 - DNA, 13 bp, Homo sapiens
gacccctgccttc

SEQ ID NO: 758058 - DNA, 16 bp, Homo sapiens
gacccctgccttcctc

SEQ ID NO: 758059 - DNA, 23 bp, Homo sapiens
gacccctgctcccagcctgctga

SEQ ID NO: 758060 - DNA, 22 bp, Homo sapiens
gacccctggcttttcactgctg

SEQ ID NO: 758061 - DNA, 18 bp, Homo sapiens
gacccctggggtggccag

SEQ ID NO: 758062 - DNA, 19 bp, Homo sapiens
gacccctggggtggccagg

SEQ ID NO: 758063 - DNA, 15 bp, Homo sapiens
gacccctgtccagga

SEQ ID NO: 758064 - DNA, 13 bp, Homo sapiens
gacccctgtctcc

SEQ ID NO: 758065 - DNA, 12 bp, Homo sapiens
gacccctgtctt

SEQ ID NO: 758066 - DNA, 16 bp, Homo sapiens
gacccctgttcatgcc

SEQ ID NO: 758067 - DNA, 22 bp, Homo sapiens
gaccccttcctttcctctgcag

SEQ ID NO: 758068 - DNA, 16 bp, Homo sapiens
gaccccttctctctcc

SEQ ID NO: 758069 - DNA, 19 bp, Homo sapiens
gaccccttctctctccaga

SEQ ID NO: 758070 - DNA, 21 bp, Homo sapiens
gaccccttgttgcactgcccc

SEQ ID NO: 758071 - DNA, 22 bp, Homo sapiens
gaccccttgttgcactgccccc

SEQ ID NO: 758072 - DNA, 15 bp, Homo sapiens
gacccgacctggccg

SEQ ID NO: 758073 - DNA, 16 bp, Homo sapiens
gacccgaggcccagat

SEQ ID NO: 758074 - DNA, 13 bp, Homo sapiens
gacccgcctgctc

SEQ ID NO: 758075 - DNA, 14 bp, Homo sapiens
gacccgcctgctcc

SEQ ID NO: 758076 - DNA, 13 bp, Homo sapiens
gacccgctctgga

SEQ ID NO: 758077 - DNA, 22 bp, Homo sapiens
gacccggagctaacactggccc

SEQ ID NO: 758078 - DNA, 19 bp, Homo sapiens
gacccggaggggcctggca

SEQ ID NO: 758079 - DNA, 21 bp, Homo sapiens
gacccggccgccgccaggact

SEQ ID NO: 758080 - DNA, 20 bp, Homo sapiens
gacccggggtctcctggacc

SEQ ID NO: 758081 - DNA, 21 bp, Homo sapiens
gacccggggtctcctggacct

SEQ ID NO: 758082 - DNA, 18 bp, Homo sapiens
gacccggttattcgccca

SEQ ID NO: 758083 - DNA, 15 bp, Homo sapiens
gaccctacaggagag

SEQ ID NO: 758084 - DNA, 19 bp, Homo sapiens
gaccctactgaagtggctg

SEQ ID NO: 758085 - DNA, 10 bp, Homo sapiens
gaccctcact

SEQ ID NO: 758086 - DNA, 18 bp, Homo sapiens
gaccctcagccctggcct

SEQ ID NO: 758087 - DNA, 17 bp, Homo sapiens
gaccctcagctgtcacc

SEQ ID NO: 758088 - DNA, 22 bp, Homo sapiens
gaccctcaggtgtagctgagct

SEQ ID NO: 758089 - DNA, 11 bp, Homo sapiens
gaccctccaaa

SEQ ID NO: 758090 - DNA, 22 bp, Homo sapiens
gaccctcccagtctcatctcct

SEQ ID NO: 758091 - DNA, 23 bp, Homo sapiens
gaccctccccaaggatgaccaca

SEQ ID NO: 758092 - DNA, 15 bp, Homo sapiens
gaccctccccgcacc

SEQ ID NO: 758093 - DNA, 13 bp, Homo sapiens
gaccctccccggc

SEQ ID NO: 758094 - DNA, 18 bp, Homo sapiens
gaccctcccggcctggct

SEQ ID NO: 758095 - DNA, 23 bp, Homo sapiens
gaccctcctccactccacctcca

SEQ ID NO: 758096 - DNA, 19 bp, Homo sapiens
gaccctcctcctcccccag

SEQ ID NO: 758097 - DNA, 14 bp, Homo sapiens
gaccctcctggcct

SEQ ID NO: 758098 - DNA, 21 bp, Homo sapiens
gaccctcctggccttcctcgt

SEQ ID NO: 758099 - DNA, 10 bp, Homo sapiens
gaccctcctt

SEQ ID NO: 758100 - DNA, 16 bp, Homo sapiens
gaccctcgcagaccta

SEQ ID NO: 758101 - DNA, 14 bp, Homo sapiens
gaccctctgcggcc

SEQ ID NO: 758102 - DNA, 13 bp, Homo sapiens
gaccctctgggaa

SEQ ID NO: 758103 - DNA, 20 bp, Homo sapiens
gaccctctgggaacctccca

SEQ ID NO: 758104 - DNA, 14 bp, Homo sapiens
gaccctctgtcccc

SEQ ID NO: 758105 - DNA, 17 bp, Homo sapiens
gaccctctgtccccagg

SEQ ID NO: 758106 - DNA, 17 bp, Homo sapiens
gaccctcttgcccatcc

SEQ ID NO: 758107 - DNA, 17 bp, Homo sapiens
gaccctgacctccgccc

SEQ ID NO: 758108 - DNA, 11 bp, Homo sapiens
gaccctgagac

SEQ ID NO: 758109 - DNA, 16 bp, Homo sapiens
gaccctgagactccag

SEQ ID NO: 758110 - DNA, 14 bp, Homo sapiens
gaccctgaggccct

SEQ ID NO: 758111 - DNA, 20 bp, Homo sapiens
gaccctgcaaacagaacagg

SEQ ID NO: 758112 - DNA, 21 bp, Homo sapiens
gaccctgccacagccagagga

SEQ ID NO: 758113 - DNA, 22 bp, Homo sapiens
gaccctgccacagccagaggag

SEQ ID NO: 758114 - DNA, 16 bp, Homo sapiens
gaccctgccgaggggg

SEQ ID NO: 758115 - DNA, 16 bp, Homo sapiens
gaccctgcctgagccc

SEQ ID NO: 758116 - DNA, 21 bp, Homo sapiens
gaccctgcgaaggggccctgg

SEQ ID NO: 758117 - DNA, 14 bp, Homo sapiens
gaccctgcggcctc

SEQ ID NO: 758118 - DNA, 13 bp, Homo sapiens
gaccctgctcaca

SEQ ID NO: 758119 - DNA, 11 bp, Homo sapiens
gaccctggaat

SEQ ID NO: 758120 - DNA, 19 bp, Homo sapiens
gaccctggaattcagcacc

SEQ ID NO: 758121 - DNA, 20 bp, Homo sapiens
gaccctggaattcagcaccc

SEQ ID NO: 758122 - DNA, 16 bp, Homo sapiens
gaccctggaggcccca

SEQ ID NO: 758123 - DNA, 15 bp, Homo sapiens
gaccctggcctcaag

SEQ ID NO: 758124 - DNA, 21 bp, Homo sapiens
ccccccaagatgagctgcagc

SEQ ID NO: 758125 - DNA, 12 bp, Homo sapiens
ccccccactgca

SEQ ID NO: 758126 - DNA, 16 bp, Homo sapiens
ccccccagagccaggg

SEQ ID NO: 758127 - DNA, 13 bp, Homo sapiens
ccccccagcctcc

SEQ ID NO: 758128 - DNA, 12 bp, Homo sapiens
ccccccaggccc

SEQ ID NO: 758129 - DNA, 12 bp, Homo sapiens
ccccccagggct

SEQ ID NO: 758130 - DNA, 12 bp, Homo sapiens
ccccccagtctc

SEQ ID NO: 758131 - DNA, 17 bp, Homo sapiens
ccccccatcccagggtc

SEQ ID NO: 758132 - DNA, 12 bp, Homo sapiens
cccccccaggcc

SEQ ID NO: 758133 - DNA, 13 bp, Homo sapiens
cccccccaggccc

SEQ ID NO: 758134 - DNA, 13 bp, Homo sapiens
ccccccgcccacc

SEQ ID NO: 758135 - DNA, 22 bp, Homo sapiens
cccccctcaaggggcagggagg

SEQ ID NO: 758136 - DNA, 13 bp, Homo sapiens
cccccctcctcca

SEQ ID NO: 758137 - DNA, 22 bp, Homo sapiens
cccccctctcctcccagctgct

SEQ ID NO: 758138 - DNA, 13 bp, Homo sapiens
cccccctgtacac

SEQ ID NO: 758139 - DNA, 11 bp, Homo sapiens
ccccccttcca

SEQ ID NO: 758140 - DNA, 12 bp, Homo sapiens
ccccccttccac

SEQ ID NO: 758141 - DNA, 17 bp, Homo sapiens
cccccgacactgctgca

SEQ ID NO: 758142 - DNA, 14 bp, Homo sapiens
cccccgacggcctc

SEQ ID NO: 758143 - DNA, 17 bp, Homo sapiens
cccccgacggcctccag

SEQ ID NO: 758144 - DNA, 18 bp, Homo sapiens
cccccgactgcctgtctc

SEQ ID NO: 758145 - DNA, 14 bp, Homo sapiens
cccccgagccctga

SEQ ID NO: 758146 - DNA, 16 bp, Homo sapiens
cccccgagccctgact

SEQ ID NO: 758147 - DNA, 20 bp, Homo sapiens
cccccgagccctgactcctg

SEQ ID NO: 758148 - DNA, 13 bp, Homo sapiens
cccccgagctggg

SEQ ID NO: 758149 - DNA, 21 bp, Homo sapiens
cccccgagctgggggccatga

SEQ ID NO: 758150 - DNA, 15 bp, Homo sapiens
cccccgaggctgcta

SEQ ID NO: 758151 - DNA, 21 bp, Homo sapiens
cccccgcacagccacccgtgg

SEQ ID NO: 758152 - DNA, 13 bp, Homo sapiens
cccccgccaggcg

SEQ ID NO: 758153 - DNA, 12 bp, Homo sapiens
cccccgccatgc

SEQ ID NO: 758154 - DNA, 13 bp, Homo sapiens
cccccgccccagg

SEQ ID NO: 758155 - DNA, 11 bp, Homo sapiens
cccccgccccg

SEQ ID NO: 758156 - DNA, 14 bp, Homo sapiens
cccccgccctcatg

SEQ ID NO: 758157 - DNA, 13 bp, Homo sapiens
cccccgcctgcca

SEQ ID NO: 758158 - DNA, 15 bp, Homo sapiens
cccccgcctgccacc

SEQ ID NO: 758159 - DNA, 22 bp, Homo sapiens
cccccgcgccctccctccgcct

SEQ ID NO: 758160 - DNA, 18 bp, Homo sapiens
cccccgcttagccccgct

SEQ ID NO: 758161 - DNA, 16 bp, Homo sapiens
cccccggctttcctcc

SEQ ID NO: 758162 - DNA, 16 bp, Homo sapiens
cccccgggatcctgcc

SEQ ID NO: 758163 - DNA, 14 bp, Homo sapiens
cccccgggcctgca

SEQ ID NO: 758164 - DNA, 17 bp, Homo sapiens
cccccgggcctgcacag

SEQ ID NO: 758165 - DNA, 19 bp, Homo sapiens
cccccgtcagctgcttctg

SEQ ID NO: 758166 - DNA, 16 bp, Homo sapiens
ccccctcaaacctcct

SEQ ID NO: 758167 - DNA, 12 bp, Homo sapiens
ccccctcagcct

SEQ ID NO: 758168 - DNA, 15 bp, Homo sapiens
ccccctccccccaga

SEQ ID NO: 758169 - DNA, 18 bp, Homo sapiens
ccccctcccctcccagtc

SEQ ID NO: 758170 - DNA, 14 bp, Homo sapiens
ccccctccctggcc

SEQ ID NO: 758171 - DNA, 10 bp, Homo sapiens
ccccctcctc

SEQ ID NO: 758172 - DNA, 15 bp, Homo sapiens
ccccctcctccagta

SEQ ID NO: 758173 - DNA, 12 bp, Homo sapiens
ccccctcctctc

SEQ ID NO: 758174 - DNA, 14 bp, Homo sapiens
ccccctcctctccc

SEQ ID NO: 758175 - DNA, 11 bp, Homo sapiens
ccccctcctga

SEQ ID NO: 758176 - DNA, 14 bp, Homo sapiens
ccccctcctggcaa

SEQ ID NO: 758177 - DNA, 13 bp, Homo sapiens
ccccctcgccagc

SEQ ID NO: 758178 - DNA, 14 bp, Homo sapiens
ccccctcgccagct

SEQ ID NO: 758179 - DNA, 15 bp, Homo sapiens
gacctacctccctcc

SEQ ID NO: 758180 - DNA, 19 bp, Homo sapiens
gacctacctccctccctct

SEQ ID NO: 758181 - DNA, 22 bp, Homo sapiens
gacctacctccctccctctccg

SEQ ID NO: 758182 - DNA, 22 bp, Homo sapiens
gacctagaagcttaacactatt

SEQ ID NO: 758183 - DNA, 20 bp, Homo sapiens
gacctagaccagtttgcatg

SEQ ID NO: 758184 - DNA, 13 bp, Homo sapiens
gacctagcaggct

SEQ ID NO: 758185 - DNA, 15 bp, Homo sapiens
gacctagcaggctgt

SEQ ID NO: 758186 - DNA, 16 bp, Homo sapiens
gacctagcaggctgtt

SEQ ID NO: 758187 - DNA, 13 bp, Homo sapiens
gacctagcctgga

SEQ ID NO: 758188 - DNA, 14 bp, Homo sapiens
gacctagcctggat

SEQ ID NO: 758189 - DNA, 19 bp, Homo sapiens
gacctagcctggatggccc

SEQ ID NO: 758190 - DNA, 23 bp, Homo sapiens
gacctagcctggatggcccctcc

SEQ ID NO: 758191 - DNA, 17 bp, Homo sapiens
gacctagctctttgggc

SEQ ID NO: 758192 - DNA, 12 bp, Homo sapiens
gacctaggggga

SEQ ID NO: 758193 - DNA, 19 bp, Homo sapiens
gacctagggggacggggct

SEQ ID NO: 758194 - DNA, 19 bp, Homo sapiens
gacctagtcccctttcctc

SEQ ID NO: 758195 - DNA, 23 bp, Homo sapiens
gacctataaatcattaagacaac

SEQ ID NO: 758196 - DNA, 22 bp, Homo sapiens
gacctatgtacttaatccttta

SEQ ID NO: 758197 - DNA, 23 bp, Homo sapiens
gacctatgtcctaaggacacact

SEQ ID NO: 758198 - DNA, 15 bp, Homo sapiens
gacctcaagcaacca

SEQ ID NO: 758199 - DNA, 18 bp, Homo sapiens
gacctcagagtccaggcc

SEQ ID NO: 758200 - DNA, 11 bp, Homo sapiens
gacctcagcca

SEQ ID NO: 758201 - DNA, 14 bp, Homo sapiens
gacctcagcctgtg

SEQ ID NO: 758202 - DNA, 20 bp, Homo sapiens
gacctcagccttccccttgc

SEQ ID NO: 758203 - DNA, 16 bp, Homo sapiens
gacctcagctgcacat

SEQ ID NO: 758204 - DNA, 20 bp, Homo sapiens
gacctcagctgcacattcct

SEQ ID NO: 758205 - DNA, 17 bp, Homo sapiens
gacctcaggagggcagg

SEQ ID NO: 758206 - DNA, 11 bp, Homo sapiens
gacctcagggg

SEQ ID NO: 758207 - DNA, 18 bp, Homo sapiens
gacctcaggtgagaagca

SEQ ID NO: 758208 - DNA, 21 bp, Homo sapiens
gacctcaggtgagaagcagag

SEQ ID NO: 758209 - DNA, 18 bp, Homo sapiens
gacctcagtgactcagaa

SEQ ID NO: 758210 - DNA, 23 bp, Homo sapiens
gacctcatcaggatgaacccagg

SEQ ID NO: 758211 - DNA, 16 bp, Homo sapiens
gacctcatgcccagct

SEQ ID NO: 758212 - DNA, 17 bp, Homo sapiens
gacctcatgcccagctc

SEQ ID NO: 758213 - DNA, 23 bp, Homo sapiens
gacctcatgcccagctctctgac

SEQ ID NO: 758214 - DNA, 19 bp, Homo sapiens
gacctccaggggctcctgg

SEQ ID NO: 758215 - DNA, 20 bp, Homo sapiens
gacctccaggggctcctggg

SEQ ID NO: 758216 - DNA, 12 bp, Homo sapiens
gacctccatccc

SEQ ID NO: 758217 - DNA, 18 bp, Homo sapiens
gacctccatccctgctct

SEQ ID NO: 758218 - DNA, 21 bp, Homo sapiens
gacctcccagccctatggatg

SEQ ID NO: 758219 - DNA, 16 bp, Homo sapiens
gacctccccctcactt

SEQ ID NO: 758220 - DNA, 13 bp, Homo sapiens
gacctcccctccc

SEQ ID NO: 758221 - DNA, 19 bp, Homo sapiens
gacctcccttccgaccctc

SEQ ID NO: 758222 - DNA, 22 bp, Homo sapiens
gacctcccttccgaccctctgg

SEQ ID NO: 758223 - DNA, 21 bp, Homo sapiens
gacctccgcccctgcccccgc

SEQ ID NO: 758224 - DNA, 22 bp, Homo sapiens
gacctcctccctcattcatctt

SEQ ID NO: 758225 - DNA, 22 bp, Homo sapiens
gacctcctgacaacgtctcttc

SEQ ID NO: 758226 - DNA, 19 bp, Homo sapiens
gacctccttagccctgtct

SEQ ID NO: 758227 - DNA, 21 bp, Homo sapiens
gacctcgagcagatgatgcca

SEQ ID NO: 758228 - DNA, 20 bp, Homo sapiens
gacctctacggacctcacat

SEQ ID NO: 758229 - DNA, 14 bp, Homo sapiens
gacctctcccaggg

SEQ ID NO: 758230 - DNA, 16 bp, Homo sapiens
gacctctctcagcccc

SEQ ID NO: 758231 - DNA, 16 bp, Homo sapiens
gacctctctcggcccc

SEQ ID NO: 758232 - DNA, 16 bp, Homo sapiens
gacctctctgcctctc

SEQ ID NO: 758233 - DNA, 18 bp, Homo sapiens
gacctctgcaagacaaag

SEQ ID NO: 758234 - DNA, 14 bp, Homo sapiens
gacctctgcagcaa

SEQ ID NO: 758235 - DNA, 14 bp, Homo sapiens
gacctctgctgagt

SEQ ID NO: 758236 - DNA, 16 bp, Homo sapiens
gacctcttgctgccag

SEQ ID NO: 758237 - DNA, 16 bp, Homo sapiens
gacctcttgctgtctc

SEQ ID NO: 758238 - DNA, 17 bp, Homo sapiens
gacctcttgctgtctct

SEQ ID NO: 758239 - DNA, 18 bp, Homo sapiens
gacctgaaataatatatt

SEQ ID NO: 758240 - DNA, 20 bp, Homo sapiens
gacctgaaggtattggcctg

SEQ ID NO: 758241 - DNA, 21 bp, Homo sapiens
gacctgaaggtattggcctgt

SEQ ID NO: 758242 - DNA, 22 bp, Homo sapiens
gacctgaaggtattggcctgtt

SEQ ID NO: 758243 - DNA, 21 bp, Homo sapiens
gacctgagactcacactctct

SEQ ID NO: 758244 - DNA, 14 bp, Homo sapiens
gacctgaggagaca

SEQ ID NO: 758245 - DNA, 17 bp, Homo sapiens
gacctgagggacccttc

SEQ ID NO: 758246 - DNA, 12 bp, Homo sapiens
gacctgagtatt

SEQ ID NO: 758247 - DNA, 14 bp, Homo sapiens
gacctgagtatttt

SEQ ID NO: 758248 - DNA, 19 bp, Homo sapiens
gacgcttaacctttccgct

SEQ ID NO: 758249 - DNA, 21 bp, Homo sapiens
gacgcttttgagtgggccctg

SEQ ID NO: 758250 - DNA, 14 bp, Homo sapiens
gacggaaatgaaat

SEQ ID NO: 758251 - DNA, 21 bp, Homo sapiens
gacggaggggagtagagaagt

SEQ ID NO: 758252 - DNA, 21 bp, Homo sapiens
gacggagtggggggacagaga

SEQ ID NO: 758253 - DNA, 17 bp, Homo sapiens
gacggccaatggtgctt

SEQ ID NO: 758254 - DNA, 13 bp, Homo sapiens
gacggccctgctg

SEQ ID NO: 758255 - DNA, 20 bp, Homo sapiens
gacggcctaggggtggcgct

SEQ ID NO: 758256 - DNA, 17 bp, Homo sapiens
gacggcctccaggaggg

SEQ ID NO: 758257 - DNA, 22 bp, Homo sapiens
gacggcctccaggaggggcctg

SEQ ID NO: 758258 - DNA, 22 bp, Homo sapiens
gacggcctgatgctccctcccc

SEQ ID NO: 758259 - DNA, 13 bp, Homo sapiens
gacggcgctgcct

SEQ ID NO: 758260 - DNA, 17 bp, Homo sapiens
gacggcgctgcctcagg

SEQ ID NO: 758261 - DNA, 17 bp, Homo sapiens
gacggcgtttcaccatg

SEQ ID NO: 758262 - DNA, 20 bp, Homo sapiens
gacggctgccattggtccac

SEQ ID NO: 758263 - DNA, 18 bp, Homo sapiens
gacggctggggacccacc

SEQ ID NO: 758264 - DNA, 21 bp, Homo sapiens
gacggctggggacccacccag

SEQ ID NO: 758265 - DNA, 19 bp, Homo sapiens
gacggctgtgacgcagccg

SEQ ID NO: 758266 - DNA, 20 bp, Homo sapiens
gacggctgtgacgcagccgg

SEQ ID NO: 758267 - DNA, 13 bp, Homo sapiens
gacgggccctcct

SEQ ID NO: 758268 - DNA, 19 bp, Homo sapiens
gacgggccgcaggagggag

SEQ ID NO: 758269 - DNA, 21 bp, Homo sapiens
gacggtattaaaatggagcga

SEQ ID NO: 758270 - DNA, 21 bp, Homo sapiens
gacggtgacaaagatggctca

SEQ ID NO: 758271 - DNA, 23 bp, Homo sapiens
gacggtgcccaagccagaggctg

SEQ ID NO: 758272 - DNA, 20 bp, Homo sapiens
gacgtactccaacagaagaa

SEQ ID NO: 758273 - DNA, 22 bp, Homo sapiens
gacgtccttccatatccctgcc

SEQ ID NO: 758274 - DNA, 23 bp, Homo sapiens
gacgtccttccatatccctgccc

SEQ ID NO: 758275 - DNA, 20 bp, Homo sapiens
gacgtctggggtgtggggat

SEQ ID NO: 758276 - DNA, 11 bp, Homo sapiens
gacgtgcactg

SEQ ID NO: 758277 - DNA, 17 bp, Homo sapiens
gacgtgcactgacagcc

SEQ ID NO: 758278 - DNA, 14 bp, Homo sapiens
gacgtgcactgtga

SEQ ID NO: 758279 - DNA, 22 bp, Homo sapiens
gacgtgccttttgcacccctcc

SEQ ID NO: 758280 - DNA, 17 bp, Homo sapiens
gacgtgctggccttggt

SEQ ID NO: 758281 - DNA, 14 bp, Homo sapiens
gacgtggctcagcc

SEQ ID NO: 758282 - DNA, 15 bp, Homo sapiens
gacgtggctcagcca

SEQ ID NO: 758283 - DNA, 18 bp, Homo sapiens
gacgtgggcatcatttta

SEQ ID NO: 758284 - DNA, 14 bp, Homo sapiens
gacgtgggccctgc

SEQ ID NO: 758285 - DNA, 15 bp, Homo sapiens
gacgtgtacagcaca

SEQ ID NO: 758286 - DNA, 19 bp, Homo sapiens
gacgtgtacagcacagaat

SEQ ID NO: 758287 - DNA, 22 bp, Homo sapiens
gacgtgtgttcttttgagtcct

SEQ ID NO: 758288 - DNA, 22 bp, Homo sapiens
gacgtgttacccactgccatgc

SEQ ID NO: 758289 - DNA, 14 bp, Homo sapiens
gacgtgtttgtgtt

SEQ ID NO: 758290 - DNA, 13 bp, Homo sapiens
gacgttgcctgag

SEQ ID NO: 758291 - DNA, 21 bp, Homo sapiens
gacgttgttgtcattgtccag

SEQ ID NO: 758292 - DNA, 15 bp, Homo sapiens
gacgttttctccgca

SEQ ID NO: 758293 - DNA, 23 bp, Homo sapiens
gacgttttctccgcattggaaga

SEQ ID NO: 758294 - DNA, 18 bp, Homo sapiens
gactaaaaatattataac

SEQ ID NO: 758295 - DNA, 23 bp, Homo sapiens
gactaaaagggcttcggccacag

SEQ ID NO: 758296 - DNA, 19 bp, Homo sapiens
gactaaactttttttctgt

SEQ ID NO: 758297 - DNA, 22 bp, Homo sapiens
gactaaactttttttctgtacc

SEQ ID NO: 758298 - DNA, 13 bp, Homo sapiens
gactaaagagaga

SEQ ID NO: 758299 - DNA, 18 bp, Homo sapiens
gactaaagagagaatgta

SEQ ID NO: 758300 - DNA, 22 bp, Homo sapiens
gactaaaggcatccttgtcttt

SEQ ID NO: 758301 - DNA, 18 bp, Homo sapiens
gactaacataaaatctgt

SEQ ID NO: 758302 - DNA, 21 bp, Homo sapiens
gactaacataaaatctgtgaa

SEQ ID NO: 758303 - DNA, 22 bp, Homo sapiens
gactaacataaaatctgtgaat

SEQ ID NO: 758304 - DNA, 16 bp, Homo sapiens
gactaagaattttgtt

SEQ ID NO: 758305 - DNA, 22 bp, Homo sapiens
gactaatataacttgaaaattt

SEQ ID NO: 758306 - DNA, 23 bp, Homo sapiens
gactaatgctttttagaaagcat

SEQ ID NO: 758307 - DNA, 13 bp, Homo sapiens
gactaatttcaaa

SEQ ID NO: 758308 - DNA, 19 bp, Homo sapiens
cccctagacctccccctca

SEQ ID NO: 758309 - DNA, 21 bp, Homo sapiens
cccctaggatgctgcagcaga

SEQ ID NO: 758310 - DNA, 21 bp, Homo sapiens
cccctatccacccagcccatt

SEQ ID NO: 758311 - DNA, 13 bp, Homo sapiens
cccctatcctccc

SEQ ID NO: 758312 - DNA, 14 bp, Homo sapiens
cccctatcctcccc

SEQ ID NO: 758313 - DNA, 15 bp, Homo sapiens
cccctatcctcccct

SEQ ID NO: 758314 - DNA, 14 bp, Homo sapiens
cccctatttattga

SEQ ID NO: 758315 - DNA, 21 bp, Homo sapiens
cccctcaaacctcctcttctg

SEQ ID NO: 758316 - DNA, 19 bp, Homo sapiens
cccctcaaactgcacatct

SEQ ID NO: 758317 - DNA, 18 bp, Homo sapiens
cccctcaaatcgtccagc

SEQ ID NO: 758318 - DNA, 15 bp, Homo sapiens
cccctcaacacctct

SEQ ID NO: 758319 - DNA, 16 bp, Homo sapiens
cccctcaacacctctg

SEQ ID NO: 758320 - DNA, 18 bp, Homo sapiens
cccctcaccacccccact

SEQ ID NO: 758321 - DNA, 18 bp, Homo sapiens
cccctcaccccagctccg

SEQ ID NO: 758322 - DNA, 15 bp, Homo sapiens
cccctcaccctctgt

SEQ ID NO: 758323 - DNA, 13 bp, Homo sapiens
cccctcacctcct

SEQ ID NO: 758324 - DNA, 15 bp, Homo sapiens
cccctcacctgggcc

SEQ ID NO: 758325 - DNA, 20 bp, Homo sapiens
cccctcacctgggcctttcc

SEQ ID NO: 758326 - DNA, 14 bp, Homo sapiens
cccctcaccttgca

SEQ ID NO: 758327 - DNA, 16 bp, Homo sapiens
cccctcactccccagg

SEQ ID NO: 758328 - DNA, 18 bp, Homo sapiens
cccctcactccccaggga

SEQ ID NO: 758329 - DNA, 13 bp, Homo sapiens
cccctcagagccc

SEQ ID NO: 758330 - DNA, 20 bp, Homo sapiens
cccctcagagccctgccctg

SEQ ID NO: 758331 - DNA, 13 bp, Homo sapiens
cccctcagagctc

SEQ ID NO: 758332 - DNA, 23 bp, Homo sapiens
cccctcagatgatctctccacgg

SEQ ID NO: 758333 - DNA, 14 bp, Homo sapiens
cccctcagcccttg

SEQ ID NO: 758334 - DNA, 15 bp, Homo sapiens
cccctcagcccttgc

SEQ ID NO: 758335 - DNA, 12 bp, Homo sapiens
cccctcagcctc

SEQ ID NO: 758336 - DNA, 13 bp, Homo sapiens
cccctcagcctct

SEQ ID NO: 758337 - DNA, 13 bp, Homo sapiens
cccctcagcctgc

SEQ ID NO: 758338 - DNA, 15 bp, Homo sapiens
cccctcagcctgccc

SEQ ID NO: 758339 - DNA, 16 bp, Homo sapiens
cccctcagccttggga

SEQ ID NO: 758340 - DNA, 15 bp, Homo sapiens
cccctcagcgcaggc

SEQ ID NO: 758341 - DNA, 20 bp, Homo sapiens
cccctcagcgcaggctgcag

SEQ ID NO: 758342 - DNA, 22 bp, Homo sapiens
cccctcagcgcaggctgcagag

SEQ ID NO: 758343 - DNA, 17 bp, Homo sapiens
cccctcagggggccagc

SEQ ID NO: 758344 - DNA, 20 bp, Homo sapiens
cccctcagggggccagctgg

SEQ ID NO: 758345 - DNA, 22 bp, Homo sapiens
cccctcatcatagcaataacat

SEQ ID NO: 758346 - DNA, 22 bp, Homo sapiens
cccctcattcagagactgccct

SEQ ID NO: 758347 - DNA, 12 bp, Homo sapiens
cccctccacagc

SEQ ID NO: 758348 - DNA, 14 bp, Homo sapiens
cccctccacatccc

SEQ ID NO: 758349 - DNA, 20 bp, Homo sapiens
cccctccacatcccagcagc

SEQ ID NO: 758350 - DNA, 18 bp, Homo sapiens
cccctccacgtgtccgtc

SEQ ID NO: 758351 - DNA, 19 bp, Homo sapiens
cccctccagaccctgcctg

SEQ ID NO: 758352 - DNA, 11 bp, Homo sapiens
cccctccagga

SEQ ID NO: 758353 - DNA, 12 bp, Homo sapiens
cccctccagtgt

SEQ ID NO: 758354 - DNA, 15 bp, Homo sapiens
cccctccagtgttgc

SEQ ID NO: 758355 - DNA, 16 bp, Homo sapiens
cccctcccaccacagc

SEQ ID NO: 758356 - DNA, 17 bp, Homo sapiens
cccctcccacccccagc

SEQ ID NO: 758357 - DNA, 12 bp, Homo sapiens
cccctcccagac

SEQ ID NO: 758358 - DNA, 16 bp, Homo sapiens
cccctcccagacaggc

SEQ ID NO: 758359 - DNA, 20 bp, Homo sapiens
cccctcccagacaggccctc

SEQ ID NO: 758360 - DNA, 22 bp, Homo sapiens
cccctcccagacaggccctccc

SEQ ID NO: 758361 - DNA, 14 bp, Homo sapiens
cccctcccatctgg

SEQ ID NO: 758362 - DNA, 13 bp, Homo sapiens
cccctcccattag

SEQ ID NO: 758363 - DNA, 14 bp, Homo sapiens
cccctccccagcca

SEQ ID NO: 758364 - DNA, 15 bp, Homo sapiens
cccctccccagctcc

SEQ ID NO: 758365 - DNA, 21 bp, Homo sapiens
cccctccccatgcaggtggtg

SEQ ID NO: 758366 - DNA, 15 bp, Homo sapiens
cccctcccccaaccc

SEQ ID NO: 758367 - DNA, 16 bp, Homo sapiens
cccctcccccaacccc

SEQ ID NO: 758368 - DNA, 18 bp, Homo sapiens
cccctcccccaaccccca

SEQ ID NO: 758369 - DNA, 18 bp, Homo sapiens
cccctcccctcagcctgc

SEQ ID NO: 758370 - DNA, 15 bp, Homo sapiens
gactcagagcaattt

SEQ ID NO: 758371 - DNA, 12 bp, Homo sapiens
gactcagcacca

SEQ ID NO: 758372 - DNA, 10 bp, Homo sapiens
gactcagcca

SEQ ID NO: 758373 - DNA, 23 bp, Homo sapiens
gactcagggaccggtgctgcagg

SEQ ID NO: 758374 - DNA, 23 bp, Homo sapiens
gactcagggcagcgccaggctga

SEQ ID NO: 758375 - DNA, 19 bp, Homo sapiens
gactcagggccatgcctgc

SEQ ID NO: 758376 - DNA, 20 bp, Homo sapiens
gactcagggccccagcacta

SEQ ID NO: 758377 - DNA, 12 bp, Homo sapiens
gactcagggctc

SEQ ID NO: 758378 - DNA, 22 bp, Homo sapiens
gactcaggtctgtaactgccca

SEQ ID NO: 758379 - DNA, 23 bp, Homo sapiens
gactcaggtctgtaactgcccag

SEQ ID NO: 758380 - DNA, 20 bp, Homo sapiens
gactcaggtgggccctctga

SEQ ID NO: 758381 - DNA, 20 bp, Homo sapiens
gactcaggttccagaacagc

SEQ ID NO: 758382 - DNA, 23 bp, Homo sapiens
gactcaggttgtagtaaagaaat

SEQ ID NO: 758383 - DNA, 15 bp, Homo sapiens
gactcaggttgtctg

SEQ ID NO: 758384 - DNA, 15 bp, Homo sapiens
gactcagtgagctgg

SEQ ID NO: 758385 - DNA, 16 bp, Homo sapiens
gactcagtgagctggg

SEQ ID NO: 758386 - DNA, 21 bp, Homo sapiens
gactcagtgtctgcctttaaa

SEQ ID NO: 758387 - DNA, 12 bp, Homo sapiens
gactcatatatt

SEQ ID NO: 758388 - DNA, 21 bp, Homo sapiens
gactcatatcccctatttaac

SEQ ID NO: 758389 - DNA, 22 bp, Homo sapiens
gactcatcaatcaaataagtat

SEQ ID NO: 758390 - DNA, 18 bp, Homo sapiens
gactcatggtgtgttaca

SEQ ID NO: 758391 - DNA, 16 bp, Homo sapiens
gactcattctgaagga

SEQ ID NO: 758392 - DNA, 17 bp, Homo sapiens
gactcattctgaaggag

SEQ ID NO: 758393 - DNA, 18 bp, Homo sapiens
gactcatttcacagcctt

SEQ ID NO: 758394 - DNA, 13 bp, Homo sapiens
gactccacctcaa

SEQ ID NO: 758395 - DNA, 18 bp, Homo sapiens
gactccagaatctgctgt

SEQ ID NO: 758396 - DNA, 13 bp, Homo sapiens
gactccagccagc

SEQ ID NO: 758397 - DNA, 14 bp, Homo sapiens
gactccagccagcg

SEQ ID NO: 758398 - DNA, 17 bp, Homo sapiens
gactccagcccctggac

SEQ ID NO: 758399 - DNA, 18 bp, Homo sapiens
gactccagcccctggacc

SEQ ID NO: 758400 - DNA, 15 bp, Homo sapiens
gactccaggcagcag

SEQ ID NO: 758401 - DNA, 16 bp, Homo sapiens
gactccaggcagcaga

SEQ ID NO: 758402 - DNA, 20 bp, Homo sapiens
gactccaggcagcagacaca

SEQ ID NO: 758403 - DNA, 12 bp, Homo sapiens
gactccatctct

SEQ ID NO: 758404 - DNA, 15 bp, Homo sapiens
gactccatttctttc

SEQ ID NO: 758405 - DNA, 19 bp, Homo sapiens
gactccatttctttcttcc

SEQ ID NO: 758406 - DNA, 17 bp, Homo sapiens
gactcccaagtttccat

SEQ ID NO: 758407 - DNA, 21 bp, Homo sapiens
gactcccaagtttccatagca

SEQ ID NO: 758408 - DNA, 14 bp, Homo sapiens
gactcccagcagag

SEQ ID NO: 758409 - DNA, 15 bp, Homo sapiens
gactcccagcagagc

SEQ ID NO: 758410 - DNA, 21 bp, Homo sapiens
gactcccccaaccaaggaagg

SEQ ID NO: 758411 - DNA, 18 bp, Homo sapiens
gactcccgccccgggctg

SEQ ID NO: 758412 - DNA, 20 bp, Homo sapiens
gactcccgccccgggctggc

SEQ ID NO: 758413 - DNA, 23 bp, Homo sapiens
gactcccgggccacgccccagcc

SEQ ID NO: 758414 - DNA, 13 bp, Homo sapiens
gactccctcccca

SEQ ID NO: 758415 - DNA, 21 bp, Homo sapiens
gactccctccccacccaagag

SEQ ID NO: 758416 - DNA, 23 bp, Homo sapiens
gactccctcctcacctctggact

SEQ ID NO: 758417 - DNA, 22 bp, Homo sapiens
gactccctgagtctggacctcc

SEQ ID NO: 758418 - DNA, 23 bp, Homo sapiens
gactccctgagtctggacctcca

SEQ ID NO: 758419 - DNA, 12 bp, Homo sapiens
gactccctgtgg

SEQ ID NO: 758420 - DNA, 22 bp, Homo sapiens
gactcccttaaaatagaaataa

SEQ ID NO: 758421 - DNA, 14 bp, Homo sapiens
gactccggaggact

SEQ ID NO: 758422 - DNA, 16 bp, Homo sapiens
gactccggaggactga

SEQ ID NO: 758423 - DNA, 14 bp, Homo sapiens
gactccggccctcc

SEQ ID NO: 758424 - DNA, 15 bp, Homo sapiens
gactccggccctcct

SEQ ID NO: 758425 - DNA, 13 bp, Homo sapiens
gactccggcctgt

SEQ ID NO: 758426 - DNA, 14 bp, Homo sapiens
gactccggcctgta

SEQ ID NO: 758427 - DNA, 18 bp, Homo sapiens
gactccggcctgtaatca

SEQ ID NO: 758428 - DNA, 19 bp, Homo sapiens
gactccgggaccattgacc

SEQ ID NO: 758429 - DNA, 22 bp, Homo sapiens
gactccggggccccactggctg

SEQ ID NO: 758430 - DNA, 16 bp, Homo sapiens
gactccgttggccact

SEQ ID NO: 758431 - DNA, 19 bp, Homo sapiens
gactcctcaaaccacttgc

SEQ ID NO: 758432 - DNA, 22 bp, Homo sapiens
gactcctcaaaccacttgcctg

SEQ ID NO: 758433 - DNA, 11 bp, Homo sapiens
gactcctccca

SEQ ID NO: 758434 - DNA, 13 bp, Homo sapiens
gactcctcccaca

SEQ ID NO: 758435 - DNA, 22 bp, Homo sapiens
gactcctcctgggggctggctc

SEQ ID NO: 758436 - DNA, 13 bp, Homo sapiens
cccctctgcttct

SEQ ID NO: 758437 - DNA, 12 bp, Homo sapiens
cccctctggtcg

SEQ ID NO: 758438 - DNA, 19 bp, Homo sapiens
cccctctggtcgctcctgc

SEQ ID NO: 758439 - DNA, 12 bp, Homo sapiens
cccctctggtgt

SEQ ID NO: 758440 - DNA, 14 bp, Homo sapiens
cccctctgtccagg

SEQ ID NO: 758441 - DNA, 22 bp, Homo sapiens
cccctctgtccaggcactgaga

SEQ ID NO: 758442 - DNA, 11 bp, Homo sapiens
cccctctgtct

SEQ ID NO: 758443 - DNA, 22 bp, Homo sapiens
cccctcttagcttacaggaagc

SEQ ID NO: 758444 - DNA, 18 bp, Homo sapiens
cccctcttcaaagcagag

SEQ ID NO: 758445 - DNA, 21 bp, Homo sapiens
cccctcttcaaagcagagtgg

SEQ ID NO: 758446 - DNA, 11 bp, Homo sapiens
cccctcttccc

SEQ ID NO: 758447 - DNA, 16 bp, Homo sapiens
cccctcttcctccctg

SEQ ID NO: 758448 - DNA, 15 bp, Homo sapiens
cccctcttcctcttg

SEQ ID NO: 758449 - DNA, 22 bp, Homo sapiens
cccctcttggagaagtctcagc

SEQ ID NO: 758450 - DNA, 17 bp, Homo sapiens
cccctctttctctttct

SEQ ID NO: 758451 - DNA, 21 bp, Homo sapiens
cccctctttgcacagcatgag

SEQ ID NO: 758452 - DNA, 16 bp, Homo sapiens
cccctcttttggcctt

SEQ ID NO: 758453 - DNA, 18 bp, Homo sapiens
cccctcttttggccttgt

SEQ ID NO: 758454 - DNA, 16 bp, Homo sapiens
cccctgaaagcctcac

SEQ ID NO: 758455 - DNA, 16 bp, Homo sapiens
cccctgacagggccag

SEQ ID NO: 758456 - DNA, 18 bp, Homo sapiens
cccctgacctcactgtga

SEQ ID NO: 758457 - DNA, 15 bp, Homo sapiens
cccctgacctgtcca

SEQ ID NO: 758458 - DNA, 16 bp, Homo sapiens
cccctgacctgtccag

SEQ ID NO: 758459 - DNA, 17 bp, Homo sapiens
cccctgacctgtccagg

SEQ ID NO: 758460 - DNA, 20 bp, Homo sapiens
cccctgacctgtgagcccag

SEQ ID NO: 758461 - DNA, 22 bp, Homo sapiens
cccctgagaccacccccaaaca

SEQ ID NO: 758462 - DNA, 20 bp, Homo sapiens
cccctgagagtttcctcaga

SEQ ID NO: 758463 - DNA, 17 bp, Homo sapiens
cccctgagtccgcctgc

SEQ ID NO: 758464 - DNA, 19 bp, Homo sapiens
cccctgagtccgcctgcgc

SEQ ID NO: 758465 - DNA, 22 bp, Homo sapiens
cccctgagtccgcctgcgcctc

SEQ ID NO: 758466 - DNA, 20 bp, Homo sapiens
cccctgagttgggcagccag

SEQ ID NO: 758467 - DNA, 18 bp, Homo sapiens
cccctgatctctgacctc

SEQ ID NO: 758468 - DNA, 20 bp, Homo sapiens
cccctgatctctgacctctg

SEQ ID NO: 758469 - DNA, 16 bp, Homo sapiens
cccctgatgcagcctg

SEQ ID NO: 758470 - DNA, 16 bp, Homo sapiens
cccctgcaaagcccag

SEQ ID NO: 758471 - DNA, 22 bp, Homo sapiens
cccctgcaacttccgctgaggg

SEQ ID NO: 758472 - DNA, 15 bp, Homo sapiens
cccctgcaagaagcg

SEQ ID NO: 758473 - DNA, 22 bp, Homo sapiens
cccctgcaagaagcgccgactc

SEQ ID NO: 758474 - DNA, 17 bp, Homo sapiens
cccctgcacaagccatg

SEQ ID NO: 758475 - DNA, 16 bp, Homo sapiens
cccctgcacctggcct

SEQ ID NO: 758476 - DNA, 22 bp, Homo sapiens
cccctgcactaggcaggtaata

SEQ ID NO: 758477 - DNA, 13 bp, Homo sapiens
cccctgcagcctg

SEQ ID NO: 758478 - DNA, 14 bp, Homo sapiens
cccctgcagcctgg

SEQ ID NO: 758479 - DNA, 16 bp, Homo sapiens
cccctgcagcctgggt

SEQ ID NO: 758480 - DNA, 20 bp, Homo sapiens
cccctgcagtttggccctgg

SEQ ID NO: 758481 - DNA, 12 bp, Homo sapiens
cccctgccacca

SEQ ID NO: 758482 - DNA, 15 bp, Homo sapiens
cccctgccaccgact

SEQ ID NO: 758483 - DNA, 18 bp, Homo sapiens
cccctgccaccgactgcc

SEQ ID NO: 758484 - DNA, 21 bp, Homo sapiens
cccctgccacctccctgaccc

SEQ ID NO: 758485 - DNA, 17 bp, Homo sapiens
cccctgccccccagcct

SEQ ID NO: 758486 - DNA, 23 bp, Homo sapiens
cccctgcccggtggtttgccatg

SEQ ID NO: 758487 - DNA, 19 bp, Homo sapiens
cccctgccctcgtggccag

SEQ ID NO: 758488 - DNA, 15 bp, Homo sapiens
cccctgccctgctcc

SEQ ID NO: 758489 - DNA, 14 bp, Homo sapiens
cccctgccctgctg

SEQ ID NO: 758490 - DNA, 13 bp, Homo sapiens
cccctgccctgtg

SEQ ID NO: 758491 - DNA, 19 bp, Homo sapiens
cccctgcctcccattctgc

SEQ ID NO: 758492 - DNA, 13 bp, Homo sapiens
gactctggccctg

SEQ ID NO: 758493 - DNA, 12 bp, Homo sapiens
gactctgggcag

SEQ ID NO: 758494 - DNA, 18 bp, Homo sapiens
gactctgggctatggaca

SEQ ID NO: 758495 - DNA, 19 bp, Homo sapiens
gactctgggctatggacac

SEQ ID NO: 758496 - DNA, 16 bp, Homo sapiens
gactctgtctcaaaaa

SEQ ID NO: 758497 - DNA, 13 bp, Homo sapiens
gactctgttattg

SEQ ID NO: 758498 - DNA, 14 bp, Homo sapiens
gactcttcactcca

SEQ ID NO: 758499 - DNA, 21 bp, Homo sapiens
gactcttgcctgtttcccagg

SEQ ID NO: 758500 - DNA, 12 bp, Homo sapiens
gactcttgctct

SEQ ID NO: 758501 - DNA, 21 bp, Homo sapiens
gactctttattgtctgtaaat

SEQ ID NO: 758502 - DNA, 22 bp, Homo sapiens
gactctttattgtctgtaaatc

SEQ ID NO: 758503 - DNA, 13 bp, Homo sapiens
gactctttcaaag

SEQ ID NO: 758504 - DNA, 18 bp, Homo sapiens
gactctttcctaaagcca

SEQ ID NO: 758505 - DNA, 19 bp, Homo sapiens
gactctttctgaaggaaga

SEQ ID NO: 758506 - DNA, 23 bp, Homo sapiens
gactctttctgaaggaagagaag

SEQ ID NO: 758507 - DNA, 23 bp, Homo sapiens
gactctttgggtccattcagatg

SEQ ID NO: 758508 - DNA, 20 bp, Homo sapiens
gactctttttagggccaggc

SEQ ID NO: 758509 - DNA, 16 bp, Homo sapiens
gactgaaaacctctcc

SEQ ID NO: 758510 - DNA, 17 bp, Homo sapiens
gactgaaaacctctcct

SEQ ID NO: 758511 - DNA, 14 bp, Homo sapiens
gactgaaaccattt

SEQ ID NO: 758512 - DNA, 21 bp, Homo sapiens
gactgaaagaagaaaacagta

SEQ ID NO: 758513 - DNA, 17 bp, Homo sapiens
gactgaaagaagaacag

SEQ ID NO: 758514 - DNA, 20 bp, Homo sapiens
gactgaaagaagaacagctg

SEQ ID NO: 758515 - DNA, 12 bp, Homo sapiens
gactgaaagcag

SEQ ID NO: 758516 - DNA, 16 bp, Homo sapiens
gactgaaagcagcagc

SEQ ID NO: 758517 - DNA, 18 bp, Homo sapiens
gactgaaagcagcagcta

SEQ ID NO: 758518 - DNA, 21 bp, Homo sapiens
gactgaaagcagcagctagga

SEQ ID NO: 758519 - DNA, 14 bp, Homo sapiens
gactgaacatgttt

SEQ ID NO: 758520 - DNA, 12 bp, Homo sapiens
gactgaactcca

SEQ ID NO: 758521 - DNA, 16 bp, Homo sapiens
gactgaatgttttatt

SEQ ID NO: 758522 - DNA, 17 bp, Homo sapiens
gactgaatgttttattt

SEQ ID NO: 758523 - DNA, 21 bp, Homo sapiens
gactgaatgttttatttatca

SEQ ID NO: 758524 - DNA, 14 bp, Homo sapiens
gactgacagcatgt

SEQ ID NO: 758525 - DNA, 21 bp, Homo sapiens
gactgacagtttacagacgct

SEQ ID NO: 758526 - DNA, 21 bp, Homo sapiens
gactgaccctgaggaggccgc

SEQ ID NO: 758527 - DNA, 21 bp, Homo sapiens
gactgagagcccactgcagtt

SEQ ID NO: 758528 - DNA, 13 bp, Homo sapiens
gactgagcagccg

SEQ ID NO: 758529 - DNA, 15 bp, Homo sapiens
gactgagcagccgcc

SEQ ID NO: 758530 - DNA, 20 bp, Homo sapiens
gactgagccaaggaggcctg

SEQ ID NO: 758531 - DNA, 11 bp, Homo sapiens
gactgagcccc

SEQ ID NO: 758532 - DNA, 14 bp, Homo sapiens
gactgagcccccac

SEQ ID NO: 758533 - DNA, 13 bp, Homo sapiens
gactgagccctct

SEQ ID NO: 758534 - DNA, 23 bp, Homo sapiens
gactgagccctctcactccagcc

SEQ ID NO: 758535 - DNA, 17 bp, Homo sapiens
gactgagctctccaggc

SEQ ID NO: 758536 - DNA, 21 bp, Homo sapiens
gactgagctctccaggccagg

SEQ ID NO: 758537 - DNA, 21 bp, Homo sapiens
gactgagggattttagcctct

SEQ ID NO: 758538 - DNA, 15 bp, Homo sapiens
gactgaggtataaag

SEQ ID NO: 758539 - DNA, 14 bp, Homo sapiens
gactgaggtgcctg

SEQ ID NO: 758540 - DNA, 16 bp, Homo sapiens
gactgaggtgcctgct

SEQ ID NO: 758541 - DNA, 17 bp, Homo sapiens
gactgaggtgcctgctc

SEQ ID NO: 758542 - DNA, 23 bp, Homo sapiens
gactgaggtgcctgctcaggtgc

SEQ ID NO: 758543 - DNA, 21 bp, Homo sapiens
gactgagtacgttgtgcattt

SEQ ID NO: 758544 - DNA, 15 bp, Homo sapiens
gactgagtcagatgg

SEQ ID NO: 758545 - DNA, 15 bp, Homo sapiens
gactgagtgggaagc

SEQ ID NO: 758546 - DNA, 17 bp, Homo sapiens
gactgagtgggaagccc

SEQ ID NO: 758547 - DNA, 22 bp, Homo sapiens
gactgagtgggaagcccatcct

SEQ ID NO: 758548 - DNA, 19 bp, Homo sapiens
gactgatagcttacactga

SEQ ID NO: 758549 - DNA, 23 bp, Homo sapiens
gactgatagcttacactgaggac

SEQ ID NO: 758550 - DNA, 21 bp, Homo sapiens
gactgatcatccaggcctcag

SEQ ID NO: 758551 - DNA, 20 bp, Homo sapiens
gactgatccctggccactga

SEQ ID NO: 758552 - DNA, 14 bp, Homo sapiens
gactgattggcctg

SEQ ID NO: 758553 - DNA, 14 bp, Homo sapiens
gactgatttcagag

SEQ ID NO: 758554 - DNA, 16 bp, Homo sapiens
gactgatttcagagtg

SEQ ID NO: 758555 - DNA, 13 bp, Homo sapiens
gactgattttaat

SEQ ID NO: 758556 - DNA, 15 bp, Homo sapiens
gactgcaaacttttt

SEQ ID NO: 758557 - DNA, 15 bp, Homo sapiens
gactgcacagcggcc

SEQ ID NO: 758558 - DNA, 21 bp, Homo sapiens
gactgcacagcgtcctgtcca

SEQ ID NO: 758559 - DNA, 17 bp, Homo sapiens
gactgcacccagctcca

SEQ ID NO: 758560 - DNA, 20 bp, Homo sapiens
gactgcacccagctccaggg

SEQ ID NO: 758561 - DNA, 17 bp, Homo sapiens
gactgcagacattctca

SEQ ID NO: 758562 - DNA, 18 bp, Homo sapiens
gactgcaggggccactcc

SEQ ID NO: 758563 - DNA, 18 bp, Homo sapiens
gactgcaggtgggctggg

SEQ ID NO: 758564 - DNA, 21 bp, Homo sapiens
gactgcagtcggcatgccagg

SEQ ID NO: 758565 - DNA, 12 bp, Homo sapiens
gactgcagtgtg

SEQ ID NO: 758566 - DNA, 17 bp, Homo sapiens
gactgcatggggaggca

SEQ ID NO: 758567 - DNA, 19 bp, Homo sapiens
gactgcatggggaggcagc

SEQ ID NO: 758568 - DNA, 21 bp, Homo sapiens
gactgcatggggaggcagcag

SEQ ID NO: 758569 - DNA, 23 bp, Homo sapiens
gactgcatgtaccatttgcatgg

SEQ ID NO: 758570 - DNA, 20 bp, Homo sapiens
gactgcatttaaatttgatt

SEQ ID NO: 758571 - DNA, 11 bp, Homo sapiens
gactgccaaat

SEQ ID NO: 758572 - DNA, 20 bp, Homo sapiens
gactgccaggaccccaggtc

SEQ ID NO: 758573 - DNA, 16 bp, Homo sapiens
gactgccaggctgttt

SEQ ID NO: 758574 - DNA, 11 bp, Homo sapiens
gactgccaggt

SEQ ID NO: 758575 - DNA, 20 bp, Homo sapiens
gactgccagtccccctgccc

SEQ ID NO: 758576 - DNA, 17 bp, Homo sapiens
gactgccatattaaatt

SEQ ID NO: 758577 - DNA, 11 bp, Homo sapiens
gactgcccagc

SEQ ID NO: 758578 - DNA, 12 bp, Homo sapiens
gactgcccagcc

SEQ ID NO: 758579 - DNA, 13 bp, Homo sapiens
gactgcccagcca

SEQ ID NO: 758580 - DNA, 15 bp, Homo sapiens
gactgcccagccact

SEQ ID NO: 758581 - DNA, 23 bp, Homo sapiens
gactgcccctgctgtgctgctca

SEQ ID NO: 758582 - DNA, 16 bp, Homo sapiens
gactgccgaccgaggc

SEQ ID NO: 758583 - DNA, 10 bp, Homo sapiens
gactgcctcc

SEQ ID NO: 758584 - DNA, 12 bp, Homo sapiens
gactgcctccct

SEQ ID NO: 758585 - DNA, 14 bp, Homo sapiens
gactgcctccctct

SEQ ID NO: 758586 - DNA, 10 bp, Homo sapiens
gactgcctgt

SEQ ID NO: 758587 - DNA, 18 bp, Homo sapiens
gactgcctgtctccatga

SEQ ID NO: 758588 - DNA, 20 bp, Homo sapiens
gactgcgatcttcagagcag

SEQ ID NO: 758589 - DNA, 14 bp, Homo sapiens
gactgcgctggacg

SEQ ID NO: 758590 - DNA, 23 bp, Homo sapiens
gactgcggaggaaggaggaccca

SEQ ID NO: 758591 - DNA, 15 bp, Homo sapiens
gactgctagggagtg

SEQ ID NO: 758592 - DNA, 19 bp, Homo sapiens
gactgctcagaacttgctg

SEQ ID NO: 758593 - DNA, 23 bp, Homo sapiens
gactgctcagaacttgctgctgt

SEQ ID NO: 758594 - DNA, 21 bp, Homo sapiens
gactgctcccggcccgcctgc

SEQ ID NO: 758595 - DNA, 19 bp, Homo sapiens
gactgctgctgcctggcca

SEQ ID NO: 758596 - DNA, 12 bp, Homo sapiens
gactgctgggac

SEQ ID NO: 758597 - DNA, 14 bp, Homo sapiens
gactgctgggactg

SEQ ID NO: 758598 - DNA, 20 bp, Homo sapiens
gactgctgtgaaatggagaa

SEQ ID NO: 758599 - DNA, 16 bp, Homo sapiens
gactgcttcccatcct

SEQ ID NO: 758600 - DNA, 15 bp, Homo sapiens
gactggaaccaggga

SEQ ID NO: 758601 - DNA, 14 bp, Homo sapiens
gactggaagacact

SEQ ID NO: 758602 - DNA, 21 bp, Homo sapiens
gactggaagctaatttgcatt

SEQ ID NO: 758603 - DNA, 22 bp, Homo sapiens
gactggaagttgtggatatcag

SEQ ID NO: 758604 - DNA, 21 bp, Homo sapiens
gactggacagcttgtggcaag

SEQ ID NO: 758605 - DNA, 20 bp, Homo sapiens
gactggagaccgcttcaccc

SEQ ID NO: 758606 - DNA, 21 bp, Homo sapiens
gactggagaccgcttcacccc

SEQ ID NO: 758607 - DNA, 23 bp, Homo sapiens
gactggagaccgcttcacccctg

SEQ ID NO: 758608 - DNA, 23 bp, Homo sapiens
gactggaggcccctggagccaga

SEQ ID NO: 758609 - DNA, 17 bp, Homo sapiens
gactggaggtgggcatg

SEQ ID NO: 758610 - DNA, 15 bp, Homo sapiens
gactggagtccctgt

SEQ ID NO: 758611 - DNA, 20 bp, Homo sapiens
gactggagtgaggcttccag

SEQ ID NO: 758612 - DNA, 15 bp, Homo sapiens
gactggatactgccc

SEQ ID NO: 758613 - DNA, 17 bp, Homo sapiens
gactggatcttctatca

SEQ ID NO: 758614 - DNA, 19 bp, Homo sapiens
gacttcctgactctcacct

SEQ ID NO: 758615 - DNA, 13 bp, Homo sapiens
gacttcctggggc

SEQ ID NO: 758616 - DNA, 15 bp, Homo sapiens
gacttcctggggccc

SEQ ID NO: 758617 - DNA, 22 bp, Homo sapiens
gacttcctggggccccgctggg

SEQ ID NO: 758618 - DNA, 14 bp, Homo sapiens
gacttccttgctct

SEQ ID NO: 758619 - DNA, 17 bp, Homo sapiens
gacttccttgctctccc

SEQ ID NO: 758620 - DNA, 15 bp, Homo sapiens
gacttcgactcagga

SEQ ID NO: 758621 - DNA, 17 bp, Homo sapiens
gacttctaatttatatt

SEQ ID NO: 758622 - DNA, 15 bp, Homo sapiens
gacttctacctgccc

SEQ ID NO: 758623 - DNA, 21 bp, Homo sapiens
gacttctattttttaaagact

SEQ ID NO: 758624 - DNA, 14 bp, Homo sapiens
gacttctccaggtc

SEQ ID NO: 758625 - DNA, 13 bp, Homo sapiens
gacttctcccccg

SEQ ID NO: 758626 - DNA, 22 bp, Homo sapiens
gacttctcccctgcccttcctc

SEQ ID NO: 758627 - DNA, 13 bp, Homo sapiens
gacttctgcctgg

SEQ ID NO: 758628 - DNA, 16 bp, Homo sapiens
gacttctgcctggaga

SEQ ID NO: 758629 - DNA, 19 bp, Homo sapiens
gacttctggaaggctggct

SEQ ID NO: 758630 - DNA, 21 bp, Homo sapiens
gacttctggaaggctggctga

SEQ ID NO: 758631 - DNA, 20 bp, Homo sapiens
gacttctggttgtatttcta

SEQ ID NO: 758632 - DNA, 17 bp, Homo sapiens
gacttcttacccaaagc

SEQ ID NO: 758633 - DNA, 18 bp, Homo sapiens
gacttcttacccaaagca

SEQ ID NO: 758634 - DNA, 15 bp, Homo sapiens
gacttcttgcttcag

SEQ ID NO: 758635 - DNA, 20 bp, Homo sapiens
gacttcttggtttggggaga

SEQ ID NO: 758636 - DNA, 22 bp, Homo sapiens
gacttcttggtttggggagaaa

SEQ ID NO: 758637 - DNA, 22 bp, Homo sapiens
gacttctttactaacactggct

SEQ ID NO: 758638 - DNA, 14 bp, Homo sapiens
gacttgaaagcatc

SEQ ID NO: 758639 - DNA, 17 bp, Homo sapiens
gacttgaaagcatccat

SEQ ID NO: 758640 - DNA, 19 bp, Homo sapiens
gacttgaaagcatccatgt

SEQ ID NO: 758641 - DNA, 11 bp, Homo sapiens
gacttgaagtt

SEQ ID NO: 758642 - DNA, 13 bp, Homo sapiens
gacttgaagttgt

SEQ ID NO: 758643 - DNA, 15 bp, Homo sapiens
gacttgaagttgtta

SEQ ID NO: 758644 - DNA, 16 bp, Homo sapiens
gacttgacagtggaac

SEQ ID NO: 758645 - DNA, 15 bp, Homo sapiens
gacttgaccctttcc

SEQ ID NO: 758646 - DNA, 16 bp, Homo sapiens
gacttgaccctttcct

SEQ ID NO: 758647 - DNA, 22 bp, Homo sapiens
gacttgaccctttcctccccca

SEQ ID NO: 758648 - DNA, 19 bp, Homo sapiens
gacttgactttagtctgca

SEQ ID NO: 758649 - DNA, 12 bp, Homo sapiens
gacttgagccac

SEQ ID NO: 758650 - DNA, 13 bp, Homo sapiens
gacttgagccact

SEQ ID NO: 758651 - DNA, 23 bp, Homo sapiens
gacttgagtgttcctttttaaat

SEQ ID NO: 758652 - DNA, 14 bp, Homo sapiens
gacttgattgtact

SEQ ID NO: 758653 - DNA, 19 bp, Homo sapiens
gacttgcatacctgctttt

SEQ ID NO: 758654 - DNA, 18 bp, Homo sapiens
gacttgcatgaagagaag

SEQ ID NO: 758655 - DNA, 17 bp, Homo sapiens
gacttggatcccagggg

SEQ ID NO: 758656 - DNA, 12 bp, Homo sapiens
gacttggcactt

SEQ ID NO: 758657 - DNA, 19 bp, Homo sapiens
gacttggctgtccttcccc

SEQ ID NO: 758658 - DNA, 22 bp, Homo sapiens
gacttggggccagcgcttctgg

SEQ ID NO: 758659 - DNA, 21 bp, Homo sapiens
gacttggtggcttttccttga

SEQ ID NO: 758660 - DNA, 17 bp, Homo sapiens
gacttggttggtagggt

SEQ ID NO: 758661 - DNA, 17 bp, Homo sapiens
gacttgtaggaatctgc

SEQ ID NO: 758662 - DNA, 19 bp, Homo sapiens
gacttgtaggaatctgcct

SEQ ID NO: 758663 - DNA, 23 bp, Homo sapiens
gacttgtatagcatgaaataaaa

SEQ ID NO: 758664 - DNA, 18 bp, Homo sapiens
gacttgtgtcccatgatc

SEQ ID NO: 758665 - DNA, 13 bp, Homo sapiens
gacttgtgtctct

SEQ ID NO: 758666 - DNA, 12 bp, Homo sapiens
gacttgtgtctg

SEQ ID NO: 758667 - DNA, 15 bp, Homo sapiens
gacttgttctgagta

SEQ ID NO: 758668 - DNA, 14 bp, Homo sapiens
gacttgttcttggt

SEQ ID NO: 758669 - DNA, 18 bp, Homo sapiens
gacttgtttgtcttccat

SEQ ID NO: 758670 - DNA, 14 bp, Homo sapiens
gactttaaaaaaac

SEQ ID NO: 758671 - DNA, 19 bp, Homo sapiens
gactttacttgtggtgtga

SEQ ID NO: 758672 - DNA, 18 bp, Homo sapiens
gactttagaaataaatgt

SEQ ID NO: 758673 - DNA, 17 bp, Homo sapiens
gactttagtctgcaaaa

SEQ ID NO: 758674 - DNA, 11 bp, Homo sapiens
gactttataaa

SEQ ID NO: 758675 - DNA, 19 bp, Homo sapiens
gactttataattccttctg

SEQ ID NO: 758676 - DNA, 16 bp, Homo sapiens
gactttatttatttct

SEQ ID NO: 758677 - DNA, 17 bp, Homo sapiens
gactttatttatttcta

SEQ ID NO: 758678 - DNA, 21 bp, Homo sapiens
gactttatttatttctagttc

SEQ ID NO: 758679 - DNA, 16 bp, Homo sapiens
gactttcaaaatatat

SEQ ID NO: 758680 - DNA, 13 bp, Homo sapiens
gactttccacccc

SEQ ID NO: 758681 - DNA, 18 bp, Homo sapiens
gactttccaccccctccc

SEQ ID NO: 758682 - DNA, 15 bp, Homo sapiens
gactttcccaaatgt

SEQ ID NO: 758683 - DNA, 18 bp, Homo sapiens
gactttctctaataataa

SEQ ID NO: 758684 - DNA, 12 bp, Homo sapiens
gactttctgcct

SEQ ID NO: 758685 - DNA, 14 bp, Homo sapiens
gactttctgcctgg

SEQ ID NO: 758686 - DNA, 16 bp, Homo sapiens
gactttctgcctggag

SEQ ID NO: 758687 - DNA, 22 bp, Homo sapiens
gactttctgtgacgcagacaga

SEQ ID NO: 758688 - DNA, 11 bp, Homo sapiens
gactttctgtt

SEQ ID NO: 758689 - DNA, 11 bp, Homo sapiens
gactttcttct

SEQ ID NO: 758690 - DNA, 18 bp, Homo sapiens
gactttgacaattactca

SEQ ID NO: 758691 - DNA, 23 bp, Homo sapiens
gactttgacaattactcaggttt

SEQ ID NO: 758692 - DNA, 22 bp, Homo sapiens
gactttgagcctgcatcttctt

SEQ ID NO: 758693 - DNA, 14 bp, Homo sapiens
gactttgatccttg

SEQ ID NO: 758694 - DNA, 22 bp, Homo sapiens
gactttgcccagggtcctgtgc

SEQ ID NO: 758695 - DNA, 15 bp, Homo sapiens
gagaaaatgcctcaa

SEQ ID NO: 758696 - DNA, 16 bp, Homo sapiens
gagaaacaaaatcctc

SEQ ID NO: 758697 - DNA, 19 bp, Homo sapiens
gagaaacactgaaaagaag

SEQ ID NO: 758698 - DNA, 13 bp, Homo sapiens
gagaaacagagac

SEQ ID NO: 758699 - DNA, 14 bp, Homo sapiens
gagaaacagagaca

SEQ ID NO: 758700 - DNA, 22 bp, Homo sapiens
gagaaacagttggtaacttttg

SEQ ID NO: 758701 - DNA, 18 bp, Homo sapiens
gagaaagaaaaggcaaaa

SEQ ID NO: 758702 - DNA, 19 bp, Homo sapiens
gagaaagaatttgagacgc

SEQ ID NO: 758703 - DNA, 21 bp, Homo sapiens
gagaaagatgttccagtgagg

SEQ ID NO: 758704 - DNA, 20 bp, Homo sapiens
gagaaagcatattgactttt

SEQ ID NO: 758705 - DNA, 21 bp, Homo sapiens
gagaaagcccacctgggctgg

SEQ ID NO: 758706 - DNA, 15 bp, Homo sapiens
gagaaagcttttatt

SEQ ID NO: 758707 - DNA, 12 bp, Homo sapiens
gagaaaggagaa

SEQ ID NO: 758708 - DNA, 16 bp, Homo sapiens
gagaaataatgcattt

SEQ ID NO: 758709 - DNA, 20 bp, Homo sapiens
gagaaatatggacacttaat

SEQ ID NO: 758710 - DNA, 16 bp, Homo sapiens
gagaaatcacaggggc

SEQ ID NO: 758711 - DNA, 17 bp, Homo sapiens
gagaaatcacaggggcg

SEQ ID NO: 758712 - DNA, 20 bp, Homo sapiens
gagaaatgaataagctttct

SEQ ID NO: 758713 - DNA, 11 bp, Homo sapiens
gagaaatgcca

SEQ ID NO: 758714 - DNA, 17 bp, Homo sapiens
gagaaattcgtgtgttt

SEQ ID NO: 758715 - DNA, 14 bp, Homo sapiens
gagaaattctgtgg

SEQ ID NO: 758716 - DNA, 13 bp, Homo sapiens
gagaaatttttat

SEQ ID NO: 758717 - DNA, 15 bp, Homo sapiens
gagaacaaagctgtt

SEQ ID NO: 758718 - DNA, 20 bp, Homo sapiens
gagaacaacaggcaggggcc

SEQ ID NO: 758719 - DNA, 20 bp, Homo sapiens
gagaacaagtcacagctgca

SEQ ID NO: 758720 - DNA, 20 bp, Homo sapiens
gagaacacgttgccaggggc

SEQ ID NO: 758721 - DNA, 18 bp, Homo sapiens
gagaacaggtggttttta

SEQ ID NO: 758722 - DNA, 13 bp, Homo sapiens
gagaacagtagga

SEQ ID NO: 758723 - DNA, 22 bp, Homo sapiens
gagaacagttgagagagaatct

SEQ ID NO: 758724 - DNA, 12 bp, Homo sapiens
gagaacatccat

SEQ ID NO: 758725 - DNA, 22 bp, Homo sapiens
gagaaccagtctcctcactctg

SEQ ID NO: 758726 - DNA, 14 bp, Homo sapiens
gagaaccagtgcag

SEQ ID NO: 758727 - DNA, 16 bp, Homo sapiens
gagaaccattgttctg

SEQ ID NO: 758728 - DNA, 21 bp, Homo sapiens
gagaacccaaagagacagctc

SEQ ID NO: 758729 - DNA, 22 bp, Homo sapiens
gagaaccgagcaaagatcaaaa

SEQ ID NO: 758730 - DNA, 17 bp, Homo sapiens
gagaacctttagaatat

SEQ ID NO: 758731 - DNA, 22 bp, Homo sapiens
gagaactaaactagtttttcct

SEQ ID NO: 758732 - DNA, 17 bp, Homo sapiens
gagaactcagaagagaa

SEQ ID NO: 758733 - DNA, 18 bp, Homo sapiens
gagaactcagaagagaaa

SEQ ID NO: 758734 - DNA, 22 bp, Homo sapiens
gagaactcgcgctcagtaaacg

SEQ ID NO: 758735 - DNA, 13 bp, Homo sapiens
gagaactgcagac

SEQ ID NO: 758736 - DNA, 18 bp, Homo sapiens
gagaactgcatatgtttc

SEQ ID NO: 758737 - DNA, 15 bp, Homo sapiens
gagaactgtggccgt

SEQ ID NO: 758738 - DNA, 20 bp, Homo sapiens
gagaagaaaggtgagtttga

SEQ ID NO: 758739 - DNA, 22 bp, Homo sapiens
gagaagaatgaaaatgcagtcc

SEQ ID NO: 758740 - DNA, 15 bp, Homo sapiens
gagaagagcttgcac

SEQ ID NO: 758741 - DNA, 14 bp, Homo sapiens
gagaagaggaggag

SEQ ID NO: 758742 - DNA, 13 bp, Homo sapiens
gagaagaggctgg

SEQ ID NO: 758743 - DNA, 18 bp, Homo sapiens
gagaagagggcccagccc

SEQ ID NO: 758744 - DNA, 20 bp, Homo sapiens
gagaagagggcccagcccag

SEQ ID NO: 758745 - DNA, 16 bp, Homo sapiens
gagaagagggcctgtg

SEQ ID NO: 758746 - DNA, 19 bp, Homo sapiens
gagaagagggcctgtggga

SEQ ID NO: 758747 - DNA, 15 bp, Homo sapiens
gagaagaggtccttg

SEQ ID NO: 758748 - DNA, 14 bp, Homo sapiens
gagaagagtatttt

SEQ ID NO: 758749 - DNA, 20 bp, Homo sapiens
gagaagatgcctgttaattt

SEQ ID NO: 758750 - DNA, 21 bp, Homo sapiens
gagaagatttcagagctgagg

SEQ ID NO: 758751 - DNA, 20 bp, Homo sapiens
gagaagcaaaccgccctgca

SEQ ID NO: 758752 - DNA, 20 bp, Homo sapiens
gagaagcacagctcctgcca

SEQ ID NO: 758753 - DNA, 14 bp, Homo sapiens
gagaagcagtgagc

SEQ ID NO: 758754 - DNA, 21 bp, Homo sapiens
gagaagcatcggagggaattg

SEQ ID NO: 758755 - DNA, 14 bp, Homo sapiens
gagaagccaccttc

SEQ ID NO: 758756 - DNA, 13 bp, Homo sapiens
gagaagccccgca

SEQ ID NO: 758757 - DNA, 13 bp, Homo sapiens
gagaagccttcag

SEQ ID NO: 758758 - DNA, 13 bp, Homo sapiens
gagaagcggctgg

SEQ ID NO: 758759 - DNA, 13 bp, Homo sapiens
gagaagctctgaa

SEQ ID NO: 758760 - DNA, 13 bp, Homo sapiens
gagaagctgcagg

SEQ ID NO: 758761 - DNA, 19 bp, Homo sapiens
gagaagctgctccaggcct

SEQ ID NO: 758762 - DNA, 21 bp, Homo sapiens
gagaagcttctaattagatca

SEQ ID NO: 758763 - DNA, 16 bp, Homo sapiens
gagaaggaaaaagaaa

SEQ ID NO: 758764 - DNA, 18 bp, Homo sapiens
gagaaggaaaattttagc

SEQ ID NO: 758765 - DNA, 11 bp, Homo sapiens
gagaaggaaat

SEQ ID NO: 758766 - DNA, 14 bp, Homo sapiens
gagaaggaaataaa

SEQ ID NO: 758767 - DNA, 14 bp, Homo sapiens
gagaaggaagggca

SEQ ID NO: 758768 - DNA, 17 bp, Homo sapiens
gagaaggaagggcagag

SEQ ID NO: 758769 - DNA, 20 bp, Homo sapiens
gagaaggacccggaggggcc

SEQ ID NO: 758770 - DNA, 22 bp, Homo sapiens
gagaaggacccggaggggcctg

SEQ ID NO: 758771 - DNA, 23 bp, Homo sapiens
gagaaggacccggaggggcctgg

SEQ ID NO: 758772 - DNA, 21 bp, Homo sapiens
gagaaggcagtagttttcaaa

SEQ ID NO: 758773 - DNA, 18 bp, Homo sapiens
gagaaggcatgagaaaga

SEQ ID NO: 758774 - DNA, 17 bp, Homo sapiens
gagaaggggaagcactc

SEQ ID NO: 758775 - DNA, 19 bp, Homo sapiens
gagaagggttctgccctgc

SEQ ID NO: 758776 - DNA, 14 bp, Homo sapiens
gagaagtacttggt

SEQ ID NO: 758777 - DNA, 22 bp, Homo sapiens
gagaagtagctagtagcaatgt

SEQ ID NO: 758778 - DNA, 21 bp, Homo sapiens
gagaagtctcagctaagctca

SEQ ID NO: 758779 - DNA, 19 bp, Homo sapiens
gagaagtgaataactgcaa

SEQ ID NO: 758780 - DNA, 16 bp, Homo sapiens
gagaagtgcccctgct

SEQ ID NO: 758781 - DNA, 22 bp, Homo sapiens
gagaagtgcccctgctgcctcc

SEQ ID NO: 758782 - DNA, 14 bp, Homo sapiens
ccccttattgctgc

SEQ ID NO: 758783 - DNA, 16 bp, Homo sapiens
ccccttattgctgcca

SEQ ID NO: 758784 - DNA, 21 bp, Homo sapiens
ccccttattgctgccaaaacc

SEQ ID NO: 758785 - DNA, 22 bp, Homo sapiens
ccccttcacttctgaccacact

SEQ ID NO: 758786 - DNA, 23 bp, Homo sapiens
ccccttcacttctgaccacactt

SEQ ID NO: 758787 - DNA, 16 bp, Homo sapiens
ccccttcagctcctga

SEQ ID NO: 758788 - DNA, 18 bp, Homo sapiens
ccccttcagctcctgagt

SEQ ID NO: 758789 - DNA, 16 bp, Homo sapiens
ccccttcatcctctga

SEQ ID NO: 758790 - DNA, 18 bp, Homo sapiens
ccccttccaaatgtccct

SEQ ID NO: 758791 - DNA, 14 bp, Homo sapiens
ccccttccactgag

SEQ ID NO: 758792 - DNA, 19 bp, Homo sapiens
ccccttccccactgcctgc

SEQ ID NO: 758793 - DNA, 16 bp, Homo sapiens
ccccttccccaggccc

SEQ ID NO: 758794 - DNA, 22 bp, Homo sapiens
ccccttccccgtcccctgcagc

SEQ ID NO: 758795 - DNA, 23 bp, Homo sapiens
ccccttccccgtcccctgcagcc

SEQ ID NO: 758796 - DNA, 11 bp, Homo sapiens
ccccttcccct

SEQ ID NO: 758797 - DNA, 16 bp, Homo sapiens
ccccttccccttctgt

SEQ ID NO: 758798 - DNA, 16 bp, Homo sapiens
ccccttcccgccttcc

SEQ ID NO: 758799 - DNA, 14 bp, Homo sapiens
ccccttccctgcaa

SEQ ID NO: 758800 - DNA, 16 bp, Homo sapiens
ccccttccctggggag

SEQ ID NO: 758801 - DNA, 19 bp, Homo sapiens
ccccttcctaaatatccaa

SEQ ID NO: 758802 - DNA, 12 bp, Homo sapiens
ccccttcctaag

SEQ ID NO: 758803 - DNA, 15 bp, Homo sapiens
ccccttcctggacac

SEQ ID NO: 758804 - DNA, 11 bp, Homo sapiens
ccccttcctgt

SEQ ID NO: 758805 - DNA, 12 bp, Homo sapiens
ccccttcctgtc

SEQ ID NO: 758806 - DNA, 13 bp, Homo sapiens
ccccttcctgttc

SEQ ID NO: 758807 - DNA, 19 bp, Homo sapiens
ccccttcgtgtgtccatgt

SEQ ID NO: 758808 - DNA, 21 bp, Homo sapiens
ccccttctacatttcttagac

SEQ ID NO: 758809 - DNA, 14 bp, Homo sapiens
ccccttctcagaat

SEQ ID NO: 758810 - DNA, 16 bp, Homo sapiens
ccccttctcccagcac

SEQ ID NO: 758811 - DNA, 22 bp, Homo sapiens
ccccttctccccttcctggaca

SEQ ID NO: 758812 - DNA, 14 bp, Homo sapiens
ccccttctctcctc

SEQ ID NO: 758813 - DNA, 17 bp, Homo sapiens
ccccttctctctccaga

SEQ ID NO: 758814 - DNA, 17 bp, Homo sapiens
ccccttctgtgtcacag

SEQ ID NO: 758815 - DNA, 14 bp, Homo sapiens
ccccttcttcccgc

SEQ ID NO: 758816 - DNA, 15 bp, Homo sapiens
ccccttcttgggccc

SEQ ID NO: 758817 - DNA, 17 bp, Homo sapiens
gagaatggctgggtcag

SEQ ID NO: 758818 - DNA, 19 bp, Homo sapiens
gagaatggggttcctgctg

SEQ ID NO: 758819 - DNA, 17 bp, Homo sapiens
gagaatggtgctgttta

SEQ ID NO: 758820 - DNA, 23 bp, Homo sapiens
gagaatggtgtgaacccgggagc

SEQ ID NO: 758821 - DNA, 18 bp, Homo sapiens
gagaatgtatcagccagc

SEQ ID NO: 758822 - DNA, 22 bp, Homo sapiens
gagaatgtatcagccagccttc

SEQ ID NO: 758823 - DNA, 12 bp, Homo sapiens
gagaatgtgacc

SEQ ID NO: 758824 - DNA, 14 bp, Homo sapiens
gagaatgtgtgtag

SEQ ID NO: 758825 - DNA, 22 bp, Homo sapiens
gagaatgtgtgtgtgtggcagg

SEQ ID NO: 758826 - DNA, 23 bp, Homo sapiens
gagaattaagttttaaataaacc

SEQ ID NO: 758827 - DNA, 16 bp, Homo sapiens
gagaattcagtatttt

SEQ ID NO: 758828 - DNA, 14 bp, Homo sapiens
gagaattgggggct

SEQ ID NO: 758829 - DNA, 21 bp, Homo sapiens
gagaattgtatcatttgaaca

SEQ ID NO: 758830 - DNA, 13 bp, Homo sapiens
gagaatttctaaa

SEQ ID NO: 758831 - DNA, 17 bp, Homo sapiens
gagaatttctaaagtaa

SEQ ID NO: 758832 - DNA, 15 bp, Homo sapiens
gagacaaagtgggtg

SEQ ID NO: 758833 - DNA, 13 bp, Homo sapiens
gagacaaatcttt

SEQ ID NO: 758834 - DNA, 21 bp, Homo sapiens
gagacaactatcaattcttga

SEQ ID NO: 758835 - DNA, 17 bp, Homo sapiens
gagacaagccctggcaa

SEQ ID NO: 758836 - DNA, 18 bp, Homo sapiens
gagacaattagcagaatg

SEQ ID NO: 758837 - DNA, 20 bp, Homo sapiens
gagacaattagcagaatgga

SEQ ID NO: 758838 - DNA, 13 bp, Homo sapiens
gagacacattgcc

SEQ ID NO: 758839 - DNA, 15 bp, Homo sapiens
gagacacctgcacct

SEQ ID NO: 758840 - DNA, 19 bp, Homo sapiens
gagacacctgcacctcccc

SEQ ID NO: 758841 - DNA, 21 bp, Homo sapiens
gagacagaagcctggactctg

SEQ ID NO: 758842 - DNA, 14 bp, Homo sapiens
gagacagaatgtat

SEQ ID NO: 758843 - DNA, 22 bp, Homo sapiens
gagacagaccacttgccacgct

SEQ ID NO: 758844 - DNA, 9 bp, Homo sapiens
gagacagag

SEQ ID NO: 758845 - DNA, 18 bp, Homo sapiens
gagacagagtgctgaggg

SEQ ID NO: 758846 - DNA, 20 bp, Homo sapiens
gagacagatacctccaaccc

SEQ ID NO: 758847 - DNA, 18 bp, Homo sapiens
gagacagatcactcctgg

SEQ ID NO: 758848 - DNA, 19 bp, Homo sapiens
gagacagcaccactgctga

SEQ ID NO: 758849 - DNA, 22 bp, Homo sapiens
gagacagcaccactgctgagga

SEQ ID NO: 758850 - DNA, 17 bp, Homo sapiens
gagacagcagcctgtat

SEQ ID NO: 758851 - DNA, 17 bp, Homo sapiens
gagacagcttctctgca

SEQ ID NO: 758852 - DNA, 21 bp, Homo sapiens
gagacagcttctctgcagtaa

SEQ ID NO: 758853 - DNA, 15 bp, Homo sapiens
gagacagggctgctc

SEQ ID NO: 758854 - DNA, 17 bp, Homo sapiens
gagacagggctgctccc

SEQ ID NO: 758855 - DNA, 14 bp, Homo sapiens
gagacagggtctca

SEQ ID NO: 758856 - DNA, 20 bp, Homo sapiens
gagacagggtctcactctgt

SEQ ID NO: 758857 - DNA, 12 bp, Homo sapiens
gagacagggttt

SEQ ID NO: 758858 - DNA, 16 bp, Homo sapiens
gagacagtgaatttgg

SEQ ID NO: 758859 - DNA, 14 bp, Homo sapiens
gagacagtgggaaa

SEQ ID NO: 758860 - DNA, 13 bp, Homo sapiens
gagacatcttgcc

SEQ ID NO: 758861 - DNA, 13 bp, Homo sapiens
gagacatgtgaca

SEQ ID NO: 758862 - DNA, 13 bp, Homo sapiens
gagacattgctct

SEQ ID NO: 758863 - DNA, 15 bp, Homo sapiens
gagaccaacctgacc

SEQ ID NO: 758864 - DNA, 23 bp, Homo sapiens
gagaccaagactctgaaatctca

SEQ ID NO: 758865 - DNA, 22 bp, Homo sapiens
gagaccacagtttacctcaggt

SEQ ID NO: 758866 - DNA, 11 bp, Homo sapiens
gagaccagcac

SEQ ID NO: 758867 - DNA, 22 bp, Homo sapiens
gagaccagtggtctggaaacag

SEQ ID NO: 758868 - DNA, 22 bp, Homo sapiens
gagaccagttgggagcactgga

SEQ ID NO: 758869 - DNA, 23 bp, Homo sapiens
gagaccagttgggagcactggag

SEQ ID NO: 758870 - DNA, 15 bp, Homo sapiens
gagaccatcctggcc

SEQ ID NO: 758871 - DNA, 16 bp, Homo sapiens
gagaccatcctggcca

SEQ ID NO: 758872 - DNA, 17 bp, Homo sapiens
gagaccatcctggcccc

SEQ ID NO: 758873 - DNA, 18 bp, Homo sapiens
gagaccatcctggcccct

SEQ ID NO: 758874 - DNA, 15 bp, Homo sapiens
gagaccatcctggct

SEQ ID NO: 758875 - DNA, 15 bp, Homo sapiens
gagacccaaaccccc

SEQ ID NO: 758876 - DNA, 21 bp, Homo sapiens
gagacccaaattataagggcc

SEQ ID NO: 758877 - DNA, 22 bp, Homo sapiens
gagacccaaggctcactgcagc

SEQ ID NO: 758878 - DNA, 15 bp, Homo sapiens
gagacccaagggcag

SEQ ID NO: 758879 - DNA, 18 bp, Homo sapiens
gagacccagccctcatcc

SEQ ID NO: 758880 - DNA, 15 bp, Homo sapiens
gagacccagctgcag

SEQ ID NO: 758881 - DNA, 12 bp, Homo sapiens
gagacccccaca

SEQ ID NO: 758882 - DNA, 15 bp, Homo sapiens
gagacccccacacct

SEQ ID NO: 758883 - DNA, 14 bp, Homo sapiens
gagacccccaggcc

SEQ ID NO: 758884 - DNA, 22 bp, Homo sapiens
gagaccccgcactgcagacggg

SEQ ID NO: 758885 - DNA, 12 bp, Homo sapiens
gagaccccttcc

SEQ ID NO: 758886 - DNA, 17 bp, Homo sapiens
gagaccctacaggagag

SEQ ID NO: 758887 - DNA, 14 bp, Homo sapiens
gagaccctgcaaga

SEQ ID NO: 758888 - DNA, 20 bp, Homo sapiens
gagaccctgccacagccaga

SEQ ID NO: 758889 - DNA, 13 bp, Homo sapiens
gagaccctggcct

SEQ ID NO: 758890 - DNA, 14 bp, Homo sapiens
gagaccctgggaga

SEQ ID NO: 758891 - DNA, 21 bp, Homo sapiens
gagaccctgtctcaaaaaaag

SEQ ID NO: 758892 - DNA, 18 bp, Homo sapiens
gagacccttttctcagga

SEQ ID NO: 758893 - DNA, 20 bp, Homo sapiens
gagaccgggccctgggttcc

SEQ ID NO: 758894 - DNA, 20 bp, Homo sapiens
gagacctcatcaggatgaac

SEQ ID NO: 758895 - DNA, 21 bp, Homo sapiens
gagacctcatcctgctctttt

SEQ ID NO: 758896 - DNA, 13 bp, Homo sapiens
gagacctgaggca

SEQ ID NO: 758897 - DNA, 12 bp, Homo sapiens
gagacctgtgct

SEQ ID NO: 758898 - DNA, 16 bp, Homo sapiens
gagacgccactccctg

SEQ ID NO: 758899 - DNA, 21 bp, Homo sapiens
gagacgccctatttctatgtc

SEQ ID NO: 758900 - DNA, 17 bp, Homo sapiens
gagacggggtctccctg

SEQ ID NO: 758901 - DNA, 20 bp, Homo sapiens
gagacgtggaacctctgtct

SEQ ID NO: 758902 - DNA, 22 bp, Homo sapiens
gagactaagccctgtcgagaca

SEQ ID NO: 758903 - DNA, 19 bp, Homo sapiens
gagactaatgttggacaga

SEQ ID NO: 758904 - DNA, 20 bp, Homo sapiens
gagactcacactctctgcag

SEQ ID NO: 758905 - DNA, 22 bp, Homo sapiens
gagactcacactctctgcagcc

SEQ ID NO: 758906 - DNA, 15 bp, Homo sapiens
gagactcacaggaag

SEQ ID NO: 758907 - DNA, 20 bp, Homo sapiens
gagactcacctctgcctcaa

SEQ ID NO: 758908 - DNA, 23 bp, Homo sapiens
gagactcacctctgcctcaatgt

SEQ ID NO: 758909 - DNA, 21 bp, Homo sapiens
gagactccagaatctgctgtt

SEQ ID NO: 758910 - DNA, 17 bp, Homo sapiens
cccgcactctgccccca

SEQ ID NO: 758911 - DNA, 16 bp, Homo sapiens
cccgcagacaccttgg

SEQ ID NO: 758912 - DNA, 16 bp, Homo sapiens
cccgcagcccgcctgc

SEQ ID NO: 758913 - DNA, 17 bp, Homo sapiens
cccgcaggatcaggtga

SEQ ID NO: 758914 - DNA, 21 bp, Homo sapiens
cccgcagggccatgcagacct

SEQ ID NO: 758915 - DNA, 18 bp, Homo sapiens
cccgcagtccccagccct

SEQ ID NO: 758916 - DNA, 17 bp, Homo sapiens
cccgcatgtgtgcctgg

SEQ ID NO: 758917 - DNA, 20 bp, Homo sapiens
cccgcatgtgtgcctggccg

SEQ ID NO: 758918 - DNA, 23 bp, Homo sapiens
cccgccacctatctcgtgggaga

SEQ ID NO: 758919 - DNA, 17 bp, Homo sapiens
cccgccacggccaccct

SEQ ID NO: 758920 - DNA, 18 bp, Homo sapiens
cccgccacggccaccctc

SEQ ID NO: 758921 - DNA, 13 bp, Homo sapiens
cccgccagccccg

SEQ ID NO: 758922 - DNA, 14 bp, Homo sapiens
cccgccagcctcag

SEQ ID NO: 758923 - DNA, 15 bp, Homo sapiens
cccgccagcctcagt

SEQ ID NO: 758924 - DNA, 11 bp, Homo sapiens
cccgccagggc

SEQ ID NO: 758925 - DNA, 15 bp, Homo sapiens
cccgccagggctggg

SEQ ID NO: 758926 - DNA, 15 bp, Homo sapiens
cccgcccacccacgc

SEQ ID NO: 758927 - DNA, 16 bp, Homo sapiens
cccgcccacccacgca

SEQ ID NO: 758928 - DNA, 16 bp, Homo sapiens
cccgcccactgtcctg

SEQ ID NO: 758929 - DNA, 17 bp, Homo sapiens
cccgcccactgtcctgg

SEQ ID NO: 758930 - DNA, 19 bp, Homo sapiens
cccgcccactgtcctgggc

SEQ ID NO: 758931 - DNA, 18 bp, Homo sapiens
cccgccccagccctcagt

SEQ ID NO: 758932 - DNA, 11 bp, Homo sapiens
cccgccccagg

SEQ ID NO: 758933 - DNA, 13 bp, Homo sapiens
cccgccccaggct

SEQ ID NO: 758934 - DNA, 12 bp, Homo sapiens
cccgcccccacc

SEQ ID NO: 758935 - DNA, 14 bp, Homo sapiens
cccgccccccacac

SEQ ID NO: 758936 - DNA, 16 bp, Homo sapiens
cccgccccccagagcc

SEQ ID NO: 758937 - DNA, 19 bp, Homo sapiens
cccgccccccagagccagg

SEQ ID NO: 758938 - DNA, 20 bp, Homo sapiens
cccgccccccagagccaggg

SEQ ID NO: 758939 - DNA, 16 bp, Homo sapiens
gagactgggctctggc

SEQ ID NO: 758940 - DNA, 14 bp, Homo sapiens
gagactgggctgag

SEQ ID NO: 758941 - DNA, 15 bp, Homo sapiens
gagactgggctgagg

SEQ ID NO: 758942 - DNA, 15 bp, Homo sapiens
gagactgggtaggaa

SEQ ID NO: 758943 - DNA, 23 bp, Homo sapiens
gagactggtcctgtgtgcagtga

SEQ ID NO: 758944 - DNA, 17 bp, Homo sapiens
gagactggttagtgatg

SEQ ID NO: 758945 - DNA, 21 bp, Homo sapiens
gagactggttagtgatgcagt

SEQ ID NO: 758946 - DNA, 23 bp, Homo sapiens
gagactggttagtgatgcagtta

SEQ ID NO: 758947 - DNA, 19 bp, Homo sapiens
gagactgtcggagaggctg

SEQ ID NO: 758948 - DNA, 15 bp, Homo sapiens
gagactgtggtaggg

SEQ ID NO: 758949 - DNA, 23 bp, Homo sapiens
gagacttactgggtgaggaaatc

SEQ ID NO: 758950 - DNA, 23 bp, Homo sapiens
gagacttcccagaccccggaggc

SEQ ID NO: 758951 - DNA, 14 bp, Homo sapiens
gagacttcctctgg

SEQ ID NO: 758952 - DNA, 13 bp, Homo sapiens
gagacttgtatga

SEQ ID NO: 758953 - DNA, 16 bp, Homo sapiens
gagactttaaaagcat

SEQ ID NO: 758954 - DNA, 17 bp, Homo sapiens
gagactttaaaagcatt

SEQ ID NO: 758955 - DNA, 14 bp, Homo sapiens
gagactttctgctg

SEQ ID NO: 758956 - DNA, 17 bp, Homo sapiens
gagactttgctgttact

SEQ ID NO: 758957 - DNA, 11 bp, Homo sapiens
gagagaaaaaa

SEQ ID NO: 758958 - DNA, 13 bp, Homo sapiens
gagagaaaatata

SEQ ID NO: 758959 - DNA, 21 bp, Homo sapiens
gagagaaaatatatgtatttt

SEQ ID NO: 758960 - DNA, 11 bp, Homo sapiens
gagagaaagaa

SEQ ID NO: 758961 - DNA, 22 bp, Homo sapiens
gagagaaagtgtgagcaaacta

SEQ ID NO: 758962 - DNA, 22 bp, Homo sapiens
gagagaacaacaggcaggggcc

SEQ ID NO: 758963 - DNA, 15 bp, Homo sapiens
gagagaagaaagtgt

SEQ ID NO: 758964 - DNA, 20 bp, Homo sapiens
gagagaagccacgctgtcct

SEQ ID NO: 758965 - DNA, 22 bp, Homo sapiens
gagagaatagagctgccactgg

SEQ ID NO: 758966 - DNA, 13 bp, Homo sapiens
gagagacaagaag

SEQ ID NO: 758967 - DNA, 21 bp, Homo sapiens
gagagacaggcagcccagcag

SEQ ID NO: 758968 - DNA, 13 bp, Homo sapiens
gagagaccctcac

SEQ ID NO: 758969 - DNA, 13 bp, Homo sapiens
gagagaccctggc

SEQ ID NO: 758970 - DNA, 15 bp, Homo sapiens
gagagaccctggcct

SEQ ID NO: 758971 - DNA, 17 bp, Homo sapiens
gagagaccctggcctca

SEQ ID NO: 758972 - DNA, 20 bp, Homo sapiens
gagagactccacgcaggcga

SEQ ID NO: 758973 - DNA, 16 bp, Homo sapiens
gagagactgaaagcag

SEQ ID NO: 758974 - DNA, 17 bp, Homo sapiens
gagagactgagcagccg

SEQ ID NO: 758975 - DNA, 23 bp, Homo sapiens
gagagagaagtgcccctgctgcc

SEQ ID NO: 758976 - DNA, 14 bp, Homo sapiens
gagagagagagaga

SEQ ID NO: 758977 - DNA, 13 bp, Homo sapiens
gagagagaggaca

SEQ ID NO: 758978 - DNA, 14 bp, Homo sapiens
gagagagaggctgc

SEQ ID NO: 758979 - DNA, 15 bp, Homo sapiens
gagagagaggctgcc

SEQ ID NO: 758980 - DNA, 13 bp, Homo sapiens
gagagagagggga

SEQ ID NO: 758981 - DNA, 15 bp, Homo sapiens
gagagagaggtattt

SEQ ID NO: 758982 - DNA, 16 bp, Homo sapiens
gagagagctgtattaa

SEQ ID NO: 758983 - DNA, 13 bp, Homo sapiens
gagagaggacagc

SEQ ID NO: 758984 - DNA, 15 bp, Homo sapiens
gagagaggaggcctg

SEQ ID NO: 758985 - DNA, 14 bp, Homo sapiens
gagagagttagcat

SEQ ID NO: 758986 - DNA, 21 bp, Homo sapiens
gagagagttgttttaataact

SEQ ID NO: 758987 - DNA, 14 bp, Homo sapiens
gagagatgagaaag

SEQ ID NO: 758988 - DNA, 22 bp, Homo sapiens
gagagatgagaaagcttttatt

SEQ ID NO: 758989 - DNA, 15 bp, Homo sapiens
gagagcaaaggccca

SEQ ID NO: 758990 - DNA, 18 bp, Homo sapiens
gagagcaaaggcccatgc

SEQ ID NO: 758991 - DNA, 17 bp, Homo sapiens
gagagcaactctgagat

SEQ ID NO: 758992 - DNA, 11 bp, Homo sapiens
gagagcactgc

SEQ ID NO: 758993 - DNA, 12 bp, Homo sapiens
gagagcactgcc

SEQ ID NO: 758994 - DNA, 13 bp, Homo sapiens
gagagcactgcct

SEQ ID NO: 758995 - DNA, 22 bp, Homo sapiens
gagagcactgcctctatgccct

SEQ ID NO: 758996 - DNA, 12 bp, Homo sapiens
gagagcagcagc

SEQ ID NO: 758997 - DNA, 13 bp, Homo sapiens
gagagcagcagca

SEQ ID NO: 758998 - DNA, 14 bp, Homo sapiens
gagagcagcagcac

SEQ ID NO: 758999 - DNA, 17 bp, Homo sapiens
gagagcagcagcaccaa

SEQ ID NO: 759000 - DNA, 17 bp, Homo sapiens
gagagcagcgcccaggc

SEQ ID NO: 759001 - DNA, 23 bp, Homo sapiens
gagagcagcgcccaggcctgctg

SEQ ID NO: 759002 - DNA, 10 bp, Homo sapiens
gagagcagct

SEQ ID NO: 759003 - DNA, 14 bp, Homo sapiens
gagagcagctccct

SEQ ID NO: 759004 - DNA, 14 bp, Homo sapiens
gagagcagctggct

SEQ ID NO: 759005 - DNA, 21 bp, Homo sapiens
gagagcagctttaaactcagg

SEQ ID NO: 759006 - DNA, 12 bp, Homo sapiens
gagagcaggcag

SEQ ID NO: 759007 - DNA, 14 bp, Homo sapiens
gagagcaggctggc

SEQ ID NO: 759008 - DNA, 13 bp, Homo sapiens
gagagcaggggag

SEQ ID NO: 759009 - DNA, 14 bp, Homo sapiens
gagagcaggggagc

SEQ ID NO: 759010 - DNA, 20 bp, Homo sapiens
gagagcaggggagcttggga

SEQ ID NO: 759011 - DNA, 15 bp, Homo sapiens
gagagcagtgggcag

SEQ ID NO: 759012 - DNA, 16 bp, Homo sapiens
gagagcagtgggcagg

SEQ ID NO: 759013 - DNA, 19 bp, Homo sapiens
gagagcatctgcaacaaaa

SEQ ID NO: 759014 - DNA, 21 bp, Homo sapiens
gagagccaacctcggcttgtg

SEQ ID NO: 759015 - DNA, 17 bp, Homo sapiens
gagagccagctctctct

SEQ ID NO: 759016 - DNA, 12 bp, Homo sapiens
gagagccagctt

SEQ ID NO: 759017 - DNA, 14 bp, Homo sapiens
gagagccaggatgc

SEQ ID NO: 759018 - DNA, 19 bp, Homo sapiens
gagagccaggatgcccaga

SEQ ID NO: 759019 - DNA, 17 bp, Homo sapiens
gagagccagtggcgggt

SEQ ID NO: 759020 - DNA, 16 bp, Homo sapiens
gagagccatacataaa

SEQ ID NO: 759021 - DNA, 14 bp, Homo sapiens
gagagcccattccc

SEQ ID NO: 759022 - DNA, 14 bp, Homo sapiens
gagagcccccacca

SEQ ID NO: 759023 - DNA, 16 bp, Homo sapiens
gagagcccccaccagc

SEQ ID NO: 759024 - DNA, 12 bp, Homo sapiens
gagagccctgct

SEQ ID NO: 759025 - DNA, 19 bp, Homo sapiens
gagagccgtggtccctgag

SEQ ID NO: 759026 - DNA, 21 bp, Homo sapiens
gagagccgtggtccctgagga

SEQ ID NO: 759027 - DNA, 21 bp, Homo sapiens
gagagcctagaacatccctgg

SEQ ID NO: 759028 - DNA, 14 bp, Homo sapiens
gagagcctgctgca

SEQ ID NO: 759029 - DNA, 19 bp, Homo sapiens
gagagcctggtgctgctgc

SEQ ID NO: 759030 - DNA, 18 bp, Homo sapiens
gagagcgcctcttcctct

SEQ ID NO: 759031 - DNA, 18 bp, Homo sapiens
gagagctgttcccaaatt

SEQ ID NO: 759032 - DNA, 15 bp, Homo sapiens
gagaggacagcttga

SEQ ID NO: 759033 - DNA, 18 bp, Homo sapiens
gagaggacggccctgcct

SEQ ID NO: 759034 - DNA, 23 bp, Homo sapiens
gagaggacggccctgcctgcctc

SEQ ID NO: 759035 - DNA, 12 bp, Homo sapiens
gagaggagactt

SEQ ID NO: 759036 - DNA, 17 bp, Homo sapiens
gagaggaggcagccccc

SEQ ID NO: 759037 - DNA, 18 bp, Homo sapiens
gagaggagggttcctctt

SEQ ID NO: 759038 - DNA, 20 bp, Homo sapiens
gagaggatacatttaataaa

SEQ ID NO: 759039 - DNA, 23 bp, Homo sapiens
cccggcgcctgccctgcccaagt

SEQ ID NO: 759040 - DNA, 14 bp, Homo sapiens
cccggcgcggtggc

SEQ ID NO: 759041 - DNA, 19 bp, Homo sapiens
cccggcgcggtggctcacg

SEQ ID NO: 759042 - DNA, 22 bp, Homo sapiens
cccggctgagggtgggaggcaa

SEQ ID NO: 759043 - DNA, 16 bp, Homo sapiens
cccggctgcagaggcc

SEQ ID NO: 759044 - DNA, 21 bp, Homo sapiens
cccggctgcagaggccagagg

SEQ ID NO: 759045 - DNA, 13 bp, Homo sapiens
cccggctgctgct

SEQ ID NO: 759046 - DNA, 12 bp, Homo sapiens
cccggctgggcc

SEQ ID NO: 759047 - DNA, 13 bp, Homo sapiens
cccgggagcctag

SEQ ID NO: 759048 - DNA, 23 bp, Homo sapiens
cccgggaggcagaggttgcagtg

SEQ ID NO: 759049 - DNA, 14 bp, Homo sapiens
cccgggcaggccag

SEQ ID NO: 759050 - DNA, 22 bp, Homo sapiens
cccgggcccgttgaggatgagg

SEQ ID NO: 759051 - DNA, 17 bp, Homo sapiens
cccgggccctcccttgg

SEQ ID NO: 759052 - DNA, 17 bp, Homo sapiens
cccgggctctctgctgt

SEQ ID NO: 759053 - DNA, 17 bp, Homo sapiens
cccgggctctggccacc

SEQ ID NO: 759054 - DNA, 13 bp, Homo sapiens
cccgggctggccc

SEQ ID NO: 759055 - DNA, 17 bp, Homo sapiens
cccgggctggccctgtg

SEQ ID NO: 759056 - DNA, 21 bp, Homo sapiens
cccggggagctgcagagcagc

SEQ ID NO: 759057 - DNA, 12 bp, Homo sapiens
cccggggcagca

SEQ ID NO: 759058 - DNA, 20 bp, Homo sapiens
cccggggcagctgccagaga

SEQ ID NO: 759059 - DNA, 21 bp, Homo sapiens
cccggggcatggacagggcca

SEQ ID NO: 759060 - DNA, 16 bp, Homo sapiens
cccggggccagcactt

SEQ ID NO: 759061 - DNA, 18 bp, Homo sapiens
cccgggggagcccagtga

SEQ ID NO: 759062 - DNA, 16 bp, Homo sapiens
gagagggacacatgcc

SEQ ID NO: 759063 - DNA, 19 bp, Homo sapiens
gagagggagagcagagaaa

SEQ ID NO: 759064 - DNA, 18 bp, Homo sapiens
gagagggaggcaagccct

SEQ ID NO: 759065 - DNA, 23 bp, Homo sapiens
gagagggaggtcactggaaaggg

SEQ ID NO: 759066 - DNA, 21 bp, Homo sapiens
gagagggcaatctttgccttt

SEQ ID NO: 759067 - DNA, 18 bp, Homo sapiens
gagagggcagtgtttcct

SEQ ID NO: 759068 - DNA, 15 bp, Homo sapiens
gagagggcccagctg

SEQ ID NO: 759069 - DNA, 22 bp, Homo sapiens
gagagggcggtgggtatgcgag

SEQ ID NO: 759070 - DNA, 15 bp, Homo sapiens
gagagggctggtcct

SEQ ID NO: 759071 - DNA, 23 bp, Homo sapiens
gagagggctgttggacagctgct

SEQ ID NO: 759072 - DNA, 10 bp, Homo sapiens
gagaggggaa

SEQ ID NO: 759073 - DNA, 14 bp, Homo sapiens
gagaggggaagaat

SEQ ID NO: 759074 - DNA, 17 bp, Homo sapiens
gagaggggaagaattta

SEQ ID NO: 759075 - DNA, 13 bp, Homo sapiens
gagaggggaggga

SEQ ID NO: 759076 - DNA, 16 bp, Homo sapiens
gagagggggctctcca

SEQ ID NO: 759077 - DNA, 13 bp, Homo sapiens
gagagggtctgga

SEQ ID NO: 759078 - DNA, 16 bp, Homo sapiens
gagaggtagcgagctg

SEQ ID NO: 759079 - DNA, 18 bp, Homo sapiens
gagaggtagcgagctgct

SEQ ID NO: 759080 - DNA, 11 bp, Homo sapiens
gagaggtattt

SEQ ID NO: 759081 - DNA, 21 bp, Homo sapiens
gagaggtcaccagctgctgtg

SEQ ID NO: 759082 - DNA, 21 bp, Homo sapiens
gagaggtgattctcagggctg

SEQ ID NO: 759083 - DNA, 14 bp, Homo sapiens
gagaggtgccagca

SEQ ID NO: 759084 - DNA, 19 bp, Homo sapiens
gagaggttataggtcactc

SEQ ID NO: 759085 - DNA, 17 bp, Homo sapiens
gagaggtttctggggcc

SEQ ID NO: 759086 - DNA, 16 bp, Homo sapiens
gagagtaccatgctgg

SEQ ID NO: 759087 - DNA, 15 bp, Homo sapiens
gagagtatattatgt

SEQ ID NO: 759088 - DNA, 20 bp, Homo sapiens
gagagtcagctctctgccct

SEQ ID NO: 759089 - DNA, 15 bp, Homo sapiens
gagagtcctctggat

SEQ ID NO: 759090 - DNA, 23 bp, Homo sapiens
gagagtgcggcgtgggggcactg

SEQ ID NO: 759091 - DNA, 17 bp, Homo sapiens
gagagtggtgagtggaa

SEQ ID NO: 759092 - DNA, 18 bp, Homo sapiens
gagagtggtgagtggaag

SEQ ID NO: 759093 - DNA, 20 bp, Homo sapiens
gagagtgtgcaactggccag

SEQ ID NO: 759094 - DNA, 22 bp, Homo sapiens
gagagttagcatgtatgaatgt

SEQ ID NO: 759095 - DNA, 14 bp, Homo sapiens
gagagttgtctctg

SEQ ID NO: 759096 - DNA, 13 bp, Homo sapiens
gagagtttcctca

SEQ ID NO: 759097 - DNA, 23 bp, Homo sapiens
gagataaacaccaacccaggaat

SEQ ID NO: 759098 - DNA, 20 bp, Homo sapiens
gagataaaccaataaatcca

SEQ ID NO: 759099 - DNA, 14 bp, Homo sapiens
gagataataagatt

SEQ ID NO: 759100 - DNA, 21 bp, Homo sapiens
gagataatgttagaggtttta

SEQ ID NO: 759101 - DNA, 23 bp, Homo sapiens
gagataccacaaaccctgctgaa

SEQ ID NO: 759102 - DNA, 16 bp, Homo sapiens
gagatactaaatctgg

SEQ ID NO: 759103 - DNA, 21 bp, Homo sapiens
gagatacttgatgccaaaatg

SEQ ID NO: 759104 - DNA, 20 bp, Homo sapiens
gagatagcattgtgaactga

SEQ ID NO: 759105 - DNA, 13 bp, Homo sapiens
gagatagctgggg

SEQ ID NO: 759106 - DNA, 16 bp, Homo sapiens
gagatagttttcatcc

SEQ ID NO: 759107 - DNA, 17 bp, Homo sapiens
gagatagttttcatcca

SEQ ID NO: 759108 - DNA, 17 bp, Homo sapiens
gagatatacaaatatat

SEQ ID NO: 759109 - DNA, 21 bp, Homo sapiens
gagatatctgagggaggaggc

SEQ ID NO: 759110 - DNA, 22 bp, Homo sapiens
gagatatctgagggaggaggcc

SEQ ID NO: 759111 - DNA, 17 bp, Homo sapiens
gagatatggcattgcac

SEQ ID NO: 759112 - DNA, 17 bp, Homo sapiens
gagatattttaaaatga

SEQ ID NO: 759113 - DNA, 14 bp, Homo sapiens
gagatattttgtaa

SEQ ID NO: 759114 - DNA, 17 bp, Homo sapiens
gagatattttgtaaaat

SEQ ID NO: 759115 - DNA, 15 bp, Homo sapiens
gagatcaaagatgaa

SEQ ID NO: 759116 - DNA, 11 bp, Homo sapiens
gagatccccag

SEQ ID NO: 759117 - DNA, 17 bp, Homo sapiens
gagatcccgcctcttct

SEQ ID NO: 759118 - DNA, 17 bp, Homo sapiens
gagatcccttaagaagt

SEQ ID NO: 759119 - DNA, 18 bp, Homo sapiens
gagatcccttaagaagtt

SEQ ID NO: 759120 - DNA, 17 bp, Homo sapiens
gagatcctcctgcagac

SEQ ID NO: 759121 - DNA, 22 bp, Homo sapiens
gagatcgacaccatcctggcta

SEQ ID NO: 759122 - DNA, 14 bp, Homo sapiens
gagatcgagaccat

SEQ ID NO: 759123 - DNA, 17 bp, Homo sapiens
gagatcgagaccatcct

SEQ ID NO: 759124 - DNA, 19 bp, Homo sapiens
gagatcgagaccatcctgg

SEQ ID NO: 759125 - DNA, 18 bp, Homo sapiens
gagatctgaacccagctg

SEQ ID NO: 759126 - DNA, 15 bp, Homo sapiens
gagatcttccttccg

SEQ ID NO: 759127 - DNA, 17 bp, Homo sapiens
gagatctttctttccaa

SEQ ID NO: 759128 - DNA, 17 bp, Homo sapiens
gagatgaccagggatgc

SEQ ID NO: 759129 - DNA, 21 bp, Homo sapiens
gagatgaccagggatgctggg

SEQ ID NO: 759130 - DNA, 13 bp, Homo sapiens
gagatgactgagt

SEQ ID NO: 759131 - DNA, 12 bp, Homo sapiens
gagatgagaaag

SEQ ID NO: 759132 - DNA, 23 bp, Homo sapiens
gagatgagaaagcttttattcct

SEQ ID NO: 759133 - DNA, 14 bp, Homo sapiens
gagatgagaaatga

SEQ ID NO: 759134 - DNA, 18 bp, Homo sapiens
gagatgagaaatgatgaa

SEQ ID NO: 759135 - DNA, 13 bp, Homo sapiens
gagatgaggccag

SEQ ID NO: 759136 - DNA, 14 bp, Homo sapiens
gagatgaggccaga

SEQ ID NO: 759137 - DNA, 22 bp, Homo sapiens
gagatgatacatccaaagcaga

SEQ ID NO: 759138 - DNA, 18 bp, Homo sapiens
gagatgcaccaccaagcc

SEQ ID NO: 759139 - DNA, 12 bp, Homo sapiens
gagatgcagagg

SEQ ID NO: 759140 - DNA, 13 bp, Homo sapiens
gagatgcagctgg

SEQ ID NO: 759141 - DNA, 12 bp, Homo sapiens
gagatgcatgat

SEQ ID NO: 759142 - DNA, 17 bp, Homo sapiens
gagatgcatgcgcaggc

SEQ ID NO: 759143 - DNA, 14 bp, Homo sapiens
gagatgcggccaag

SEQ ID NO: 759144 - DNA, 14 bp, Homo sapiens
gagatgctaattta

SEQ ID NO: 759145 - DNA, 17 bp, Homo sapiens
gagatgctaatttattt

SEQ ID NO: 759146 - DNA, 13 bp, Homo sapiens
gagatgcttctct

SEQ ID NO: 759147 - DNA, 23 bp, Homo sapiens
gagatggactcaggatccagtga

SEQ ID NO: 759148 - DNA, 17 bp, Homo sapiens
gagatggagggcttggc

SEQ ID NO: 759149 - DNA, 23 bp, Homo sapiens
gagatggaggtttccttttggaa

SEQ ID NO: 759150 - DNA, 16 bp, Homo sapiens
gagatggagtttctct

SEQ ID NO: 759151 - DNA, 19 bp, Homo sapiens
gagatggcagattcccact

SEQ ID NO: 759152 - DNA, 16 bp, Homo sapiens
gagatggccatgctca

SEQ ID NO: 759153 - DNA, 21 bp, Homo sapiens
gagatgggaatgaggtgggag

SEQ ID NO: 759154 - DNA, 18 bp, Homo sapiens
gagatgggcttgttttct

SEQ ID NO: 759155 - DNA, 17 bp, Homo sapiens
gagatggggcgggggtg

SEQ ID NO: 759156 - DNA, 22 bp, Homo sapiens
gagatggttaaaaaggccaaag

SEQ ID NO: 759157 - DNA, 14 bp, Homo sapiens
gagatgtaattgtt

SEQ ID NO: 759158 - DNA, 15 bp, Homo sapiens
gagatgtagaaagtt

SEQ ID NO: 759159 - DNA, 17 bp, Homo sapiens
gagatgtgcctgtggga

SEQ ID NO: 759160 - DNA, 18 bp, Homo sapiens
gagatgtgcctgtgggag

SEQ ID NO: 759161 - DNA, 16 bp, Homo sapiens
gagatgtgtatcagtg

SEQ ID NO: 759162 - DNA, 21 bp, Homo sapiens
gagatgtgtgagcatcctgca

SEQ ID NO: 759163 - DNA, 17 bp, Homo sapiens
gagatgttattactgtt

SEQ ID NO: 759164 - DNA, 19 bp, Homo sapiens
gagatgttgaggggaggag

SEQ ID NO: 759165 - DNA, 21 bp, Homo sapiens
gagatgtttttaaaagtttca

SEQ ID NO: 759166 - DNA, 15 bp, Homo sapiens
ccctagaaaggagag

SEQ ID NO: 759167 - DNA, 14 bp, Homo sapiens
ccctagaagaaaac

SEQ ID NO: 759168 - DNA, 21 bp, Homo sapiens
ccctagaataatctcatcccc

SEQ ID NO: 759169 - DNA, 22 bp, Homo sapiens
ccctagaataatctcatccccc

SEQ ID NO: 759170 - DNA, 16 bp, Homo sapiens
ccctagacctccccct

SEQ ID NO: 759171 - DNA, 13 bp, Homo sapiens
ccctagccattcc

SEQ ID NO: 759172 - DNA, 15 bp, Homo sapiens
ccctagccattcctg

SEQ ID NO: 759173 - DNA, 15 bp, Homo sapiens
ccctagcccagactc

SEQ ID NO: 759174 - DNA, 19 bp, Homo sapiens
ccctagcccagactctgag

SEQ ID NO: 759175 - DNA, 12 bp, Homo sapiens
ccctagcccttc

SEQ ID NO: 759176 - DNA, 13 bp, Homo sapiens
ccctagcccttcc

SEQ ID NO: 759177 - DNA, 14 bp, Homo sapiens
ccctagcccttcca

SEQ ID NO: 759178 - DNA, 17 bp, Homo sapiens
ccctagcccttccagcc

SEQ ID NO: 759179 - DNA, 18 bp, Homo sapiens
ccctagcccttccagcct

SEQ ID NO: 759180 - DNA, 21 bp, Homo sapiens
ccctagcccttccagcctggg

SEQ ID NO: 759181 - DNA, 23 bp, Homo sapiens
ccctagcccttccagcctgggac

SEQ ID NO: 759182 - DNA, 23 bp, Homo sapiens
ccctagcctgacccggaggaaag

SEQ ID NO: 759183 - DNA, 13 bp, Homo sapiens
ccctagctgaccc

SEQ ID NO: 759184 - DNA, 19 bp, Homo sapiens
gagcaaaataaggaagagg

SEQ ID NO: 759185 - DNA, 13 bp, Homo sapiens
gagcaaaatcaac

SEQ ID NO: 759186 - DNA, 13 bp, Homo sapiens
gagcaaacccaga

SEQ ID NO: 759187 - DNA, 13 bp, Homo sapiens
gagcaaagatcaa

SEQ ID NO: 759188 - DNA, 18 bp, Homo sapiens
gagcaaagatcaaaataa

SEQ ID NO: 759189 - DNA, 22 bp, Homo sapiens
gagcaaagcgcccacccaggtc

SEQ ID NO: 759190 - DNA, 13 bp, Homo sapiens
gagcaaaggccca

SEQ ID NO: 759191 - DNA, 15 bp, Homo sapiens
gagcaaaggcccatg

SEQ ID NO: 759192 - DNA, 20 bp, Homo sapiens
gagcaacagagtgagaccct

SEQ ID NO: 759193 - DNA, 16 bp, Homo sapiens
gagcaacccctgtacc

SEQ ID NO: 759194 - DNA, 20 bp, Homo sapiens
gagcaacccctgtacccagc

SEQ ID NO: 759195 - DNA, 15 bp, Homo sapiens
gagcaacctctcact

SEQ ID NO: 759196 - DNA, 19 bp, Homo sapiens
gagcaacctctcactcccc

SEQ ID NO: 759197 - DNA, 21 bp, Homo sapiens
gagcaacctctcactccccat

SEQ ID NO: 759198 - DNA, 21 bp, Homo sapiens
gagcaacggcccatagccttg

SEQ ID NO: 759199 - DNA, 15 bp, Homo sapiens
gagcaactctccact

SEQ ID NO: 759200 - DNA, 19 bp, Homo sapiens
gagcaactctccactccat

SEQ ID NO: 759201 - DNA, 15 bp, Homo sapiens
gagcaagacagagac

SEQ ID NO: 759202 - DNA, 18 bp, Homo sapiens
gagcaagaccctgtctct

SEQ ID NO: 759203 - DNA, 22 bp, Homo sapiens
gagcaagaggggcatactattg

SEQ ID NO: 759204 - DNA, 20 bp, Homo sapiens
gagcaagccggcaagcgagc

SEQ ID NO: 759205 - DNA, 15 bp, Homo sapiens
gagcaaggcatttgg

SEQ ID NO: 759206 - DNA, 14 bp, Homo sapiens
gagcaataacttct

SEQ ID NO: 759207 - DNA, 15 bp, Homo sapiens
gagcaataacttcta

SEQ ID NO: 759208 - DNA, 14 bp, Homo sapiens
gagcaatcacagga

SEQ ID NO: 759209 - DNA, 16 bp, Homo sapiens
gagcaatgtctgtgct

SEQ ID NO: 759210 - DNA, 20 bp, Homo sapiens
gagcaatttacctggtacta

SEQ ID NO: 759211 - DNA, 22 bp, Homo sapiens
gagcacaaaattcaaagcatgg

SEQ ID NO: 759212 - DNA, 14 bp, Homo sapiens
gagcacagacacag

SEQ ID NO: 759213 - DNA, 14 bp, Homo sapiens
gagcacagagccct

SEQ ID NO: 759214 - DNA, 17 bp, Homo sapiens
gagcacagatctgtttc

SEQ ID NO: 759215 - DNA, 13 bp, Homo sapiens
gagcacagcccac

SEQ ID NO: 759216 - DNA, 14 bp, Homo sapiens
gagcacagcccacg

SEQ ID NO: 759217 - DNA, 13 bp, Homo sapiens
gagcacagccctg

SEQ ID NO: 759218 - DNA, 19 bp, Homo sapiens
gagcacagccctgggaggg

SEQ ID NO: 759219 - DNA, 16 bp, Homo sapiens
gagcacaggtcccacc

SEQ ID NO: 759220 - DNA, 18 bp, Homo sapiens
gagcacaggtcccacctc

SEQ ID NO: 759221 - DNA, 22 bp, Homo sapiens
gagcacaggtcccacctccagc

SEQ ID NO: 759222 - DNA, 23 bp, Homo sapiens
gagcacaggtcccacctccagcc

SEQ ID NO: 759223 - DNA, 22 bp, Homo sapiens
gagcacaggtgtctgcctagat

SEQ ID NO: 759224 - DNA, 21 bp, Homo sapiens
gagcacatagtgtcctgccca

SEQ ID NO: 759225 - DNA, 17 bp, Homo sapiens
gagcacatctctctgcc

SEQ ID NO: 759226 - DNA, 22 bp, Homo sapiens
gagcacatgttactgcttcatt

SEQ ID NO: 759227 - DNA, 13 bp, Homo sapiens
gagcacccagagc

SEQ ID NO: 759228 - DNA, 11 bp, Homo sapiens
gagcaccccca

SEQ ID NO: 759229 - DNA, 19 bp, Homo sapiens
gagcacccccaagcctggg

SEQ ID NO: 759230 - DNA, 12 bp, Homo sapiens
gagcaccccctc

SEQ ID NO: 759231 - DNA, 21 bp, Homo sapiens
gagcacccctctctgcatctg

SEQ ID NO: 759232 - DNA, 22 bp, Homo sapiens
gagcaccgcctgtgaaatacca

SEQ ID NO: 759233 - DNA, 21 bp, Homo sapiens
gagcaccgtgtcaagctgctc

SEQ ID NO: 759234 - DNA, 12 bp, Homo sapiens
gagcacctcacc

SEQ ID NO: 759235 - DNA, 12 bp, Homo sapiens
gagcacctgctt

SEQ ID NO: 759236 - DNA, 20 bp, Homo sapiens
gagcacctggaccccctgcc

SEQ ID NO: 759237 - DNA, 16 bp, Homo sapiens
gagcaccttcctcact

SEQ ID NO: 759238 - DNA, 23 bp, Homo sapiens
gagcacgcctgccatcttctccc

SEQ ID NO: 759239 - DNA, 14 bp, Homo sapiens
gagcactgatggaa

SEQ ID NO: 759240 - DNA, 13 bp, Homo sapiens
gagcactgcctct

SEQ ID NO: 759241 - DNA, 21 bp, Homo sapiens
gagcactgcctctatgccctg

SEQ ID NO: 759242 - DNA, 22 bp, Homo sapiens
gagcactgcctctatgccctgc

SEQ ID NO: 759243 - DNA, 23 bp, Homo sapiens
gagcactgcctctatgccctgca

SEQ ID NO: 759244 - DNA, 20 bp, Homo sapiens
gagcactggagtgcagggag

SEQ ID NO: 759245 - DNA, 16 bp, Homo sapiens
gagcactggccagaga

SEQ ID NO: 759246 - DNA, 24 bp, Homo sapiens
gagcactggccagagagggcccag

SEQ ID NO: 759247 - DNA, 23 bp, Homo sapiens
gagcactggtgtgaactcaccct

SEQ ID NO: 759248 - DNA, 16 bp, Homo sapiens
gagcacttgcgtcctg

SEQ ID NO: 759249 - DNA, 19 bp, Homo sapiens
gagcacttgcgtcctgcag

SEQ ID NO: 759250 - DNA, 22 bp, Homo sapiens
gagcagaaatttatctttcaaa

SEQ ID NO: 759251 - DNA, 18 bp, Homo sapiens
gagcagaatactggtctc

SEQ ID NO: 759252 - DNA, 18 bp, Homo sapiens
gagcagaatgttgtactt

SEQ ID NO: 759253 - DNA, 22 bp, Homo sapiens
gagcagaccaccccgcctgccc

SEQ ID NO: 759254 - DNA, 15 bp, Homo sapiens
gagcagaccagcttt

SEQ ID NO: 759255 - DNA, 12 bp, Homo sapiens
gagcagagacac

SEQ ID NO: 759256 - DNA, 15 bp, Homo sapiens
gagcagagcctacag

SEQ ID NO: 759257 - DNA, 18 bp, Homo sapiens
gagcagagcgatggagca

SEQ ID NO: 759258 - DNA, 22 bp, Homo sapiens
gagcagagctctcccctcctgc

SEQ ID NO: 759259 - DNA, 16 bp, Homo sapiens
gagcagaggggctgaa

SEQ ID NO: 759260 - DNA, 16 bp, Homo sapiens
gagcagagtctgggcc

SEQ ID NO: 759261 - DNA, 19 bp, Homo sapiens
gagcagagtctgggcctct

SEQ ID NO: 759262 - DNA, 22 bp, Homo sapiens
gagcagcagcaccaaccacagc

SEQ ID NO: 759263 - DNA, 14 bp, Homo sapiens
gagcagcagccagc

SEQ ID NO: 759264 - DNA, 15 bp, Homo sapiens
gagcagcagccagca

SEQ ID NO: 759265 - DNA, 12 bp, Homo sapiens
gagcagccagag

SEQ ID NO: 759266 - DNA, 13 bp, Homo sapiens
gagcagccagagc

SEQ ID NO: 759267 - DNA, 14 bp, Homo sapiens
gagcagccaggacc

SEQ ID NO: 759268 - DNA, 10 bp, Homo sapiens
gagcagcctc

SEQ ID NO: 759269 - DNA, 15 bp, Homo sapiens
gagcagcctcgaggc

SEQ ID NO: 759270 - DNA, 14 bp, Homo sapiens
gagcagcctgatgg

SEQ ID NO: 759271 - DNA, 15 bp, Homo sapiens
gagcagcctgatggc

SEQ ID NO: 759272 - DNA, 14 bp, Homo sapiens
gagcagcctgtggc

SEQ ID NO: 759273 - DNA, 14 bp, Homo sapiens
gagcagcgcccagg

SEQ ID NO: 759274 - DNA, 18 bp, Homo sapiens
gagcagcggctctggtcc

SEQ ID NO: 759275 - DNA, 20 bp, Homo sapiens
gagcagctattttaagccat

SEQ ID NO: 759276 - DNA, 16 bp, Homo sapiens
gagcagctccctttct

SEQ ID NO: 759277 - DNA, 16 bp, Homo sapiens
gagcaggaaggacagg

SEQ ID NO: 759278 - DNA, 19 bp, Homo sapiens
gagcaggaaggacaggaag

SEQ ID NO: 759279 - DNA, 17 bp, Homo sapiens
gagcaggacagccagca

SEQ ID NO: 759280 - DNA, 12 bp, Homo sapiens
gagcaggacctc

SEQ ID NO: 759281 - DNA, 20 bp, Homo sapiens
gagcaggactccaggcccaa

SEQ ID NO: 759282 - DNA, 11 bp, Homo sapiens
gagcaggagcc

SEQ ID NO: 759283 - DNA, 18 bp, Homo sapiens
gagcaggaggccaataaa

SEQ ID NO: 759284 - DNA, 17 bp, Homo sapiens
gagcaggaggcccctgg

SEQ ID NO: 759285 - DNA, 22 bp, Homo sapiens
gagcaggcaaaaaagggacagc

SEQ ID NO: 759286 - DNA, 19 bp, Homo sapiens
gagcaggcacatggaggag

SEQ ID NO: 759287 - DNA, 11 bp, Homo sapiens
gagcaggcagg

SEQ ID NO: 759288 - DNA, 15 bp, Homo sapiens
gagcaggcaggggca

SEQ ID NO: 759289 - DNA, 18 bp, Homo sapiens
gagcaggcggtgggcacc

SEQ ID NO: 759290 - DNA, 21 bp, Homo sapiens
gagcaggctggcagctctcca

SEQ ID NO: 759291 - DNA, 16 bp, Homo sapiens
gagcaggctgtggggt

SEQ ID NO: 759292 - DNA, 18 bp, Homo sapiens
gagcagggaaggcctgac

SEQ ID NO: 759293 - DNA, 14 bp, Homo sapiens
gagcagggctgact

SEQ ID NO: 759294 - DNA, 18 bp, Homo sapiens
ccctcagggggccagctg

SEQ ID NO: 759295 - DNA, 23 bp, Homo sapiens
ccctcagggggccagctggggag

SEQ ID NO: 759296 - DNA, 19 bp, Homo sapiens
ccctcagtagtccctgcac

SEQ ID NO: 759297 - DNA, 13 bp, Homo sapiens
ccctcagtgatac

SEQ ID NO: 759298 - DNA, 14 bp, Homo sapiens
ccctcatcccccag

SEQ ID NO: 759299 - DNA, 13 bp, Homo sapiens
ccctcatcctttt

SEQ ID NO: 759300 - DNA, 18 bp, Homo sapiens
ccctcattactgggcctt

SEQ ID NO: 759301 - DNA, 15 bp, Homo sapiens
ccctcattcatcttg

SEQ ID NO: 759302 - DNA, 17 bp, Homo sapiens
ccctcattcatcttgca

SEQ ID NO: 759303 - DNA, 13 bp, Homo sapiens
ccctcattcccct

SEQ ID NO: 759304 - DNA, 14 bp, Homo sapiens
ccctcattcccctc

SEQ ID NO: 759305 - DNA, 15 bp, Homo sapiens
ccctcattcccctcg

SEQ ID NO: 759306 - DNA, 20 bp, Homo sapiens
ccctcattgctgtcttgccc

SEQ ID NO: 759307 - DNA, 16 bp, Homo sapiens
gagcataaaacctaaa

SEQ ID NO: 759308 - DNA, 12 bp, Homo sapiens
gagcataattta

SEQ ID NO: 759309 - DNA, 17 bp, Homo sapiens
gagcataatttaaaaat

SEQ ID NO: 759310 - DNA, 24 bp, Homo sapiens
gagcatatctggtatatgtcatta

SEQ ID NO: 759311 - DNA, 14 bp, Homo sapiens
gagcatcaagaatt

SEQ ID NO: 759312 - DNA, 16 bp, Homo sapiens
gagcatcaatcttgtt

SEQ ID NO: 759313 - DNA, 13 bp, Homo sapiens
gagcatccccctc

SEQ ID NO: 759314 - DNA, 20 bp, Homo sapiens
gagcatcccggaggaaatct

SEQ ID NO: 759315 - DNA, 22 bp, Homo sapiens
gagcatcctgagccccgccctc

SEQ ID NO: 759316 - DNA, 15 bp, Homo sapiens
gagcatcgtgaccct

SEQ ID NO: 759317 - DNA, 21 bp, Homo sapiens
gagcatcgtgacccttcaggg

SEQ ID NO: 759318 - DNA, 18 bp, Homo sapiens
gagcatctcttgaggcca

SEQ ID NO: 759319 - DNA, 19 bp, Homo sapiens
gagcatctcttgaggccag

SEQ ID NO: 759320 - DNA, 16 bp, Homo sapiens
gagcatcttgccagcc

SEQ ID NO: 759321 - DNA, 15 bp, Homo sapiens
gagcatgcacagctg

SEQ ID NO: 759322 - DNA, 17 bp, Homo sapiens
gagcatgcacagctgct

SEQ ID NO: 759323 - DNA, 19 bp, Homo sapiens
gagcatgcacagctgcttg

SEQ ID NO: 759324 - DNA, 16 bp, Homo sapiens
gagcatgcacatgctg

SEQ ID NO: 759325 - DNA, 17 bp, Homo sapiens
gagcatgcggagccagc

SEQ ID NO: 759326 - DNA, 20 bp, Homo sapiens
gagcatgcttaccttctgct

SEQ ID NO: 759327 - DNA, 19 bp, Homo sapiens
gagcatggaacacttcgag

SEQ ID NO: 759328 - DNA, 15 bp, Homo sapiens
gagcatgggcctggc

SEQ ID NO: 759329 - DNA, 21 bp, Homo sapiens
gagcatggggataaaggagaa

SEQ ID NO: 759330 - DNA, 22 bp, Homo sapiens
gagcatggggataaaggagaag

SEQ ID NO: 759331 - DNA, 22 bp, Homo sapiens
gagcatgtactgagccttgtaa

SEQ ID NO: 759332 - DNA, 20 bp, Homo sapiens
gagcattacgtgagccaggt

SEQ ID NO: 759333 - DNA, 13 bp, Homo sapiens
gagcattggcccc

SEQ ID NO: 759334 - DNA, 22 bp, Homo sapiens
gagcatttaatggcagctagtg

SEQ ID NO: 759335 - DNA, 20 bp, Homo sapiens
gagcatttctcatcagtagt

SEQ ID NO: 759336 - DNA, 22 bp, Homo sapiens
gagccaaaatggttaatttttc

SEQ ID NO: 759337 - DNA, 23 bp, Homo sapiens
gagccaacctcggcttgtgggct

SEQ ID NO: 759338 - DNA, 17 bp, Homo sapiens
gagccaactgattttgt

SEQ ID NO: 759339 - DNA, 13 bp, Homo sapiens
gagccaagctgca

SEQ ID NO: 759340 - DNA, 22 bp, Homo sapiens
gagccaagctgcacaatttaat

SEQ ID NO: 759341 - DNA, 17 bp, Homo sapiens
gagccaaggaggcctgg

SEQ ID NO: 759342 - DNA, 14 bp, Homo sapiens
gagccaaggccacc

SEQ ID NO: 759343 - DNA, 13 bp, Homo sapiens
gagccaagggagg

SEQ ID NO: 759344 - DNA, 16 bp, Homo sapiens
gagccaagggagggaa

SEQ ID NO: 759345 - DNA, 18 bp, Homo sapiens
gagccaagggagggaagg

SEQ ID NO: 759346 - DNA, 13 bp, Homo sapiens
gagccacaagctg

SEQ ID NO: 759347 - DNA, 16 bp, Homo sapiens
gagccacaagctgcac

SEQ ID NO: 759348 - DNA, 23 bp, Homo sapiens
gagccacaagctgcactgtgaac

SEQ ID NO: 759349 - DNA, 20 bp, Homo sapiens
gagccacaggcaggggtgag

SEQ ID NO: 759350 - DNA, 17 bp, Homo sapiens
gagccaccaaagtcaca

SEQ ID NO: 759351 - DNA, 23 bp, Homo sapiens
gagccaccatgcttgcctgaagc

SEQ ID NO: 759352 - DNA, 13 bp, Homo sapiens
gagccaccccatg

SEQ ID NO: 759353 - DNA, 15 bp, Homo sapiens
gagccaccgctgcca

SEQ ID NO: 759354 - DNA, 16 bp, Homo sapiens
gagccaccgtgcctgg

SEQ ID NO: 759355 - DNA, 23 bp, Homo sapiens
gagccaccgtgcctggccagatt

SEQ ID NO: 759356 - DNA, 13 bp, Homo sapiens
gagccacctgcaa

SEQ ID NO: 759357 - DNA, 15 bp, Homo sapiens
gagccacctggatct

SEQ ID NO: 759358 - DNA, 23 bp, Homo sapiens
gagccacctggatctatccctgc

SEQ ID NO: 759359 - DNA, 12 bp, Homo sapiens
gagccacctggc

SEQ ID NO: 759360 - DNA, 16 bp, Homo sapiens
gagccacctggcaggg

SEQ ID NO: 759361 - DNA, 17 bp, Homo sapiens
gagccacctggcagggc

SEQ ID NO: 759362 - DNA, 24 bp, Homo sapiens
gagccacctggcagggctcacact

SEQ ID NO: 759363 - DNA, 12 bp, Homo sapiens
gagccactcctg

SEQ ID NO: 759364 - DNA, 17 bp, Homo sapiens
gagccactcctgtcccg

SEQ ID NO: 759365 - DNA, 12 bp, Homo sapiens
gagccactgggc

SEQ ID NO: 759366 - DNA, 14 bp, Homo sapiens
gagccactgggccc

SEQ ID NO: 759367 - DNA, 15 bp, Homo sapiens
gagccacttctcccc

SEQ ID NO: 759368 - DNA, 13 bp, Homo sapiens
gagccagcagctg

SEQ ID NO: 759369 - DNA, 14 bp, Homo sapiens
gagccagccaggcc

SEQ ID NO: 759370 - DNA, 15 bp, Homo sapiens
gagccagccctccct

SEQ ID NO: 759371 - DNA, 16 bp, Homo sapiens
gagccagcctggctct

SEQ ID NO: 759372 - DNA, 22 bp, Homo sapiens
gagccagcctggctctgccccc

SEQ ID NO: 759373 - DNA, 14 bp, Homo sapiens
gagccagcctggga

SEQ ID NO: 759374 - DNA, 11 bp, Homo sapiens
gagccagctgc

SEQ ID NO: 759375 - DNA, 12 bp, Homo sapiens
gagccagctgct

SEQ ID NO: 759376 - DNA, 17 bp, Homo sapiens
gagccaggatgcccaga

SEQ ID NO: 759377 - DNA, 22 bp, Homo sapiens
gagccaggcctgggtctgtgtc

SEQ ID NO: 759378 - DNA, 15 bp, Homo sapiens
gagccagggcagagg

SEQ ID NO: 759379 - DNA, 19 bp, Homo sapiens
gagccagggcagaggaatg

SEQ ID NO: 759380 - DNA, 12 bp, Homo sapiens
gagccagggcct

SEQ ID NO: 759381 - DNA, 11 bp, Homo sapiens
gagccagggct

SEQ ID NO: 759382 - DNA, 16 bp, Homo sapiens
gagccagggctgtcct

SEQ ID NO: 759383 - DNA, 18 bp, Homo sapiens
gagccagggctgtcctta

SEQ ID NO: 759384 - DNA, 18 bp, Homo sapiens
gagccaggtaatgaggga

SEQ ID NO: 759385 - DNA, 22 bp, Homo sapiens
gagccaggtaatgagggactgg

SEQ ID NO: 759386 - DNA, 12 bp, Homo sapiens
gagccagtaact

SEQ ID NO: 759387 - DNA, 22 bp, Homo sapiens
gagccagtgtgcccaaaagcca

SEQ ID NO: 759388 - DNA, 18 bp, Homo sapiens
gagccagttgtcctatgg

SEQ ID NO: 759389 - DNA, 23 bp, Homo sapiens
gagccagttgtcctatggacaac

SEQ ID NO: 759390 - DNA, 14 bp, Homo sapiens
gagccatcaccctc

SEQ ID NO: 759391 - DNA, 22 bp, Homo sapiens
gagccatcaccctcacccactc

SEQ ID NO: 759392 - DNA, 23 bp, Homo sapiens
gagccatcccttcggagccaaca

SEQ ID NO: 759393 - DNA, 22 bp, Homo sapiens
gagccatcggtgaaactaacag

SEQ ID NO: 759394 - DNA, 15 bp, Homo sapiens
gagccatgaagcatt

SEQ ID NO: 759395 - DNA, 19 bp, Homo sapiens
gagccatgattttctaaaa

SEQ ID NO: 759396 - DNA, 16 bp, Homo sapiens
gagccatgccaggctg

SEQ ID NO: 759397 - DNA, 23 bp, Homo sapiens
gagccatgcctccctgggccacc

SEQ ID NO: 759398 - DNA, 14 bp, Homo sapiens
gagccatgctggga

SEQ ID NO: 759399 - DNA, 18 bp, Homo sapiens
gagccatggaaggtgcca

SEQ ID NO: 759400 - DNA, 19 bp, Homo sapiens
gagccatggaaggtgccag

SEQ ID NO: 759401 - DNA, 20 bp, Homo sapiens
gagccatggaaggtgccaga

SEQ ID NO: 759402 - DNA, 17 bp, Homo sapiens
gagccatgggcctgggc

SEQ ID NO: 759403 - DNA, 17 bp, Homo sapiens
gagcccaaccaggccct

SEQ ID NO: 759404 - DNA, 16 bp, Homo sapiens
gagcccacaaagcctt

SEQ ID NO: 759405 - DNA, 20 bp, Homo sapiens
gagcccacagcgagcctgtg

SEQ ID NO: 759406 - DNA, 23 bp, Homo sapiens
gagcccacagcgagcctgtgcct

SEQ ID NO: 759407 - DNA, 16 bp, Homo sapiens
gagcccaccagccagc

SEQ ID NO: 759408 - DNA, 21 bp, Homo sapiens
gagcccaccagccagccctgg

SEQ ID NO: 759409 - DNA, 19 bp, Homo sapiens
gagcccactgcccaccccc

SEQ ID NO: 759410 - DNA, 23 bp, Homo sapiens
gagcccactgcccaccccctcaa

SEQ ID NO: 759411 - DNA, 22 bp, Homo sapiens
gagcccagccattaccatggag

SEQ ID NO: 759412 - DNA, 13 bp, Homo sapiens
gagcccagcctgg

SEQ ID NO: 759413 - DNA, 17 bp, Homo sapiens
gagcccagcctgggagc

SEQ ID NO: 759414 - DNA, 21 bp, Homo sapiens
gagcccagcctgggagcccag

SEQ ID NO: 759415 - DNA, 14 bp, Homo sapiens
gagcccagctctga

SEQ ID NO: 759416 - DNA, 21 bp, Homo sapiens
gagcccagctctgaaaccagt

SEQ ID NO: 759417 - DNA, 14 bp, Homo sapiens
gagcccagctcttg

SEQ ID NO: 759418 - DNA, 19 bp, Homo sapiens
gagcccagctcttgctctc

SEQ ID NO: 759419 - DNA, 12 bp, Homo sapiens
gagcccaggagt

SEQ ID NO: 759420 - DNA, 23 bp, Homo sapiens
gagcccaggagttcgaggctgca

SEQ ID NO: 759421 - DNA, 23 bp, Homo sapiens
ccctccgggcaggggagccaggg

SEQ ID NO: 759422 - DNA, 19 bp, Homo sapiens
ccctcctaaatgtcagctg

SEQ ID NO: 759423 - DNA, 18 bp, Homo sapiens
ccctcctaccctgcgccc

SEQ ID NO: 759424 - DNA, 19 bp, Homo sapiens
ccctcctacgcagatgctg

SEQ ID NO: 759425 - DNA, 17 bp, Homo sapiens
ccctcctactgcgcgtt

SEQ ID NO: 759426 - DNA, 14 bp, Homo sapiens
ccctcctagggggt

SEQ ID NO: 759427 - DNA, 18 bp, Homo sapiens
ccctcctagggggtgtca

SEQ ID NO: 759428 - DNA, 16 bp, Homo sapiens
ccctctgctctgcctg

SEQ ID NO: 759429 - DNA, 17 bp, Homo sapiens
ccctctgctctgcctgg

SEQ ID NO: 759430 - DNA, 20 bp, Homo sapiens
ccctctgctctgcctggagt

SEQ ID NO: 759431 - DNA, 21 bp, Homo sapiens
ccctctggaggggtgtggctc

SEQ ID NO: 759432 - DNA, 18 bp, Homo sapiens
ccctctggagtggccact

SEQ ID NO: 759433 - DNA, 12 bp, Homo sapiens
ccctctggccag

SEQ ID NO: 759434 - DNA, 22 bp, Homo sapiens
ccctctggccaggatggagggg

SEQ ID NO: 759435 - DNA, 16 bp, Homo sapiens
ccctctggccctgcct

SEQ ID NO: 759436 - DNA, 15 bp, Homo sapiens
ccctctggcttccca

SEQ ID NO: 759437 - DNA, 15 bp, Homo sapiens
ccctctgggaacctc

SEQ ID NO: 759438 - DNA, 21 bp, Homo sapiens
ccctctgggcacgcctgctgg

SEQ ID NO: 759439 - DNA, 22 bp, Homo sapiens
ccctctggtccttctgacccca

SEQ ID NO: 759440 - DNA, 19 bp, Homo sapiens
ccctctggtcgctcctgcc

SEQ ID NO: 759441 - DNA, 24 bp, Homo sapiens
ccctctgtccaggcactgagatac

SEQ ID NO: 759442 - DNA, 19 bp, Homo sapiens
ccctctgtcttctctatcc

SEQ ID NO: 759443 - DNA, 18 bp, Homo sapiens
ccctctgtgtatttgctt

SEQ ID NO: 759444 - DNA, 19 bp, Homo sapiens
ccctctgttaggtccattt

SEQ ID NO: 759445 - DNA, 15 bp, Homo sapiens
ccctctgttctctcc

SEQ ID NO: 759446 - DNA, 20 bp, Homo sapiens
ccctctgtttctctttcctt

SEQ ID NO: 759447 - DNA, 22 bp, Homo sapiens
ccctcttaagatctgactgcca

SEQ ID NO: 759448 - DNA, 17 bp, Homo sapiens
ccctcttcaaagcagag

SEQ ID NO: 759449 - DNA, 13 bp, Homo sapiens
ccctcttccagct

SEQ ID NO: 759450 - DNA, 15 bp, Homo sapiens
ccctcttccagcttc

SEQ ID NO: 759451 - DNA, 13 bp, Homo sapiens
ccctcttcccttc

SEQ ID NO: 759452 - DNA, 17 bp, Homo sapiens
ccctcttcccttcctcc

SEQ ID NO: 759453 - DNA, 13 bp, Homo sapiens
ccctcttcctctt

SEQ ID NO: 759454 - DNA, 18 bp, Homo sapiens
ccctcttcctcttgaccc

SEQ ID NO: 759455 - DNA, 20 bp, Homo sapiens
ccctcttcctgacgaaactg

SEQ ID NO: 759456 - DNA, 15 bp, Homo sapiens
ccctcttcctgtgat

SEQ ID NO: 759457 - DNA, 15 bp, Homo sapiens
ccctcttctcaagtg

SEQ ID NO: 759458 - DNA, 16 bp, Homo sapiens
ccctcttctcaagtgc

SEQ ID NO: 759459 - DNA, 15 bp, Homo sapiens
ccctcttctctcctc

SEQ ID NO: 759460 - DNA, 19 bp, Homo sapiens
ccctcttgacccatctccc

SEQ ID NO: 759461 - DNA, 15 bp, Homo sapiens
ccctcttgccagcct

SEQ ID NO: 759462 - DNA, 13 bp, Homo sapiens
ccctcttgcccat

SEQ ID NO: 759463 - DNA, 15 bp, Homo sapiens
ccctcttgcccatcc

SEQ ID NO: 759464 - DNA, 18 bp, Homo sapiens
ccctcttgcgggcctgga

SEQ ID NO: 759465 - DNA, 18 bp, Homo sapiens
ccctcttggattaaggaa

SEQ ID NO: 759466 - DNA, 22 bp, Homo sapiens
ccctcttggattaaggaagact

SEQ ID NO: 759467 - DNA, 21 bp, Homo sapiens
ccctcttgtaagtcatctact

SEQ ID NO: 759468 - DNA, 17 bp, Homo sapiens
ccctcttgtctcccctg

SEQ ID NO: 759469 - DNA, 18 bp, Homo sapiens
ccctcttgtctcccctgt

SEQ ID NO: 759470 - DNA, 20 bp, Homo sapiens
ccctctttcatctcctgagt

SEQ ID NO: 759471 - DNA, 11 bp, Homo sapiens
ccctctttccc

SEQ ID NO: 759472 - DNA, 22 bp, Homo sapiens
ccctctttcccaccctccacct

SEQ ID NO: 759473 - DNA, 18 bp, Homo sapiens
ccctctttccctgcgaga

SEQ ID NO: 759474 - DNA, 19 bp, Homo sapiens
ccctctttctctttcttcc

SEQ ID NO: 759475 - DNA, 21 bp, Homo sapiens
ccctctttctctttcttcctt

SEQ ID NO: 759476 - DNA, 20 bp, Homo sapiens
ccctctttgcacagcatgag

SEQ ID NO: 759477 - DNA, 21 bp, Homo sapiens
ccctctttggctcccctgtac

SEQ ID NO: 759478 - DNA, 12 bp, Homo sapiens
ccctcttttctt

SEQ ID NO: 759479 - DNA, 15 bp, Homo sapiens
ccctcttttggcctt

SEQ ID NO: 759480 - DNA, 18 bp, Homo sapiens
ccctgaaaacccagagag

SEQ ID NO: 759481 - DNA, 24 bp, Homo sapiens
ccctgaaaatgtttttctgccagg

SEQ ID NO: 759482 - DNA, 12 bp, Homo sapiens
ccctgaaacacg

SEQ ID NO: 759483 - DNA, 19 bp, Homo sapiens
ccctgaaacacgaaacttg

SEQ ID NO: 759484 - DNA, 21 bp, Homo sapiens
ccctgaaacacgaaacttgtt

SEQ ID NO: 759485 - DNA, 18 bp, Homo sapiens
ccctgaaacactgcttct

SEQ ID NO: 759486 - DNA, 23 bp, Homo sapiens
ccctgaaagagaagatggccatg

SEQ ID NO: 759487 - DNA, 14 bp, Homo sapiens
ccctgaaagcctca

SEQ ID NO: 759488 - DNA, 19 bp, Homo sapiens
ccctgaaccacgaggctgc

SEQ ID NO: 759489 - DNA, 20 bp, Homo sapiens
ccctgaaccacgaggctgcc

SEQ ID NO: 759490 - DNA, 21 bp, Homo sapiens
ccctgaaccacgaggctgccc

SEQ ID NO: 759491 - DNA, 16 bp, Homo sapiens
ccctgaacccctggcc

SEQ ID NO: 759492 - DNA, 19 bp, Homo sapiens
ccctgaacccctggccagc

SEQ ID NO: 759493 - DNA, 19 bp, Homo sapiens
ccctgaaccgcaccccatc

SEQ ID NO: 759494 - DNA, 22 bp, Homo sapiens
ccctgaagacgagcatccccct

SEQ ID NO: 759495 - DNA, 19 bp, Homo sapiens
ccctgaagagacaggcacc

SEQ ID NO: 759496 - DNA, 16 bp, Homo sapiens
ccctgaagcctccgtg

SEQ ID NO: 759497 - DNA, 17 bp, Homo sapiens
ccctgaagcctccgtgg

SEQ ID NO: 759498 - DNA, 19 bp, Homo sapiens
ccctgaagcctccgtggaa

SEQ ID NO: 759499 - DNA, 22 bp, Homo sapiens
ccctgaagcctccgtggaacat

SEQ ID NO: 759500 - DNA, 20 bp, Homo sapiens
ccctgaagtgagcacagcct

SEQ ID NO: 759501 - DNA, 13 bp, Homo sapiens
ccctgacagggcc

SEQ ID NO: 759502 - DNA, 20 bp, Homo sapiens
ccctgaccatggttttggct

SEQ ID NO: 759503 - DNA, 21 bp, Homo sapiens
ccctgaccgtgtacatagccc

SEQ ID NO: 759504 - DNA, 14 bp, Homo sapiens
ccctgacctcccag

SEQ ID NO: 759505 - DNA, 15 bp, Homo sapiens
ccctgacctgtccag

SEQ ID NO: 759506 - DNA, 20 bp, Homo sapiens
ccctgacctgtgagcccagc

SEQ ID NO: 759507 - DNA, 15 bp, Homo sapiens
ccctgacggctgcca

SEQ ID NO: 759508 - DNA, 21 bp, Homo sapiens
ccctgactcattctgaaggag

SEQ ID NO: 759509 - DNA, 14 bp, Homo sapiens
ccctgactcctctg

SEQ ID NO: 759510 - DNA, 17 bp, Homo sapiens
ccctgactcctctggct

SEQ ID NO: 759511 - DNA, 17 bp, Homo sapiens
ccctgactcctggactc

SEQ ID NO: 759512 - DNA, 13 bp, Homo sapiens
ccctgactctctg

SEQ ID NO: 759513 - DNA, 13 bp, Homo sapiens
ccctgactgggag

SEQ ID NO: 759514 - DNA, 14 bp, Homo sapiens
ccctgactggtgct

SEQ ID NO: 759515 - DNA, 21 bp, Homo sapiens
ccctgactgtcagggagggcc

SEQ ID NO: 759516 - DNA, 14 bp, Homo sapiens
ccctgacttctccc

SEQ ID NO: 759517 - DNA, 13 bp, Homo sapiens
ccctgacttctgg

SEQ ID NO: 759518 - DNA, 17 bp, Homo sapiens
ccctgagaccaccccca

SEQ ID NO: 759519 - DNA, 21 bp, Homo sapiens
ccctgagaccacccccaaaca

SEQ ID NO: 759520 - DNA, 10 bp, Homo sapiens
ccctgagact

SEQ ID NO: 759521 - DNA, 13 bp, Homo sapiens
ccctgagactcca

SEQ ID NO: 759522 - DNA, 14 bp, Homo sapiens
ccctgagactccag

SEQ ID NO: 759523 - DNA, 20 bp, Homo sapiens
ccctgagagtggtgccctgg

SEQ ID NO: 759524 - DNA, 17 bp, Homo sapiens
ccctgagagtttcctca

SEQ ID NO: 759525 - DNA, 23 bp, Homo sapiens
ccctgagagtttcctcagaaccc

SEQ ID NO: 759526 - DNA, 14 bp, Homo sapiens
ccctgagatcccct

SEQ ID NO: 759527 - DNA, 13 bp, Homo sapiens
ccctgagcccggc

SEQ ID NO: 759528 - DNA, 22 bp, Homo sapiens
ccctgagcccggccctccccca

SEQ ID NO: 759529 - DNA, 13 bp, Homo sapiens
ccctgagcctgca

SEQ ID NO: 759530 - DNA, 22 bp, Homo sapiens
ccctgagctcggtggacccagg

SEQ ID NO: 759531 - DNA, 13 bp, Homo sapiens
ccctgagctgagg

SEQ ID NO: 759532 - DNA, 14 bp, Homo sapiens
ccctgagctgaggc

SEQ ID NO: 759533 - DNA, 13 bp, Homo sapiens
ccctgaggaatga

SEQ ID NO: 759534 - DNA, 18 bp, Homo sapiens
ccctgaggacctctcagc

SEQ ID NO: 759535 - DNA, 14 bp, Homo sapiens
ccctgaggactgga

SEQ ID NO: 759536 - DNA, 22 bp, Homo sapiens
ccctgaggatgggtcagagcta

SEQ ID NO: 759537 - DNA, 18 bp, Homo sapiens
ccctgaggccctgggctg

SEQ ID NO: 759538 - DNA, 16 bp, Homo sapiens
ccctgaggcctagact

SEQ ID NO: 759539 - DNA, 19 bp, Homo sapiens
ccctgaggcctagactctg

SEQ ID NO: 759540 - DNA, 17 bp, Homo sapiens
ccctgaggcggaggctg

SEQ ID NO: 759541 - DNA, 22 bp, Homo sapiens
ccctgaggcggaggctgtgctc

SEQ ID NO: 759542 - DNA, 16 bp, Homo sapiens
ccctgaggggctgggc

SEQ ID NO: 759543 - DNA, 20 bp, Homo sapiens
ccctgaggggctggggaggg

SEQ ID NO: 759544 - DNA, 23 bp, Homo sapiens
ccctgaggtgtgggggctgcagc

SEQ ID NO: 759545 - DNA, 22 bp, Homo sapiens
ccctgagtaatcgcttaaagat

SEQ ID NO: 759546 - DNA, 19 bp, Homo sapiens
ccctgagtcaactggagca

SEQ ID NO: 759547 - DNA, 15 bp, Homo sapiens
ccctgagtccgcctg

SEQ ID NO: 759548 - DNA, 16 bp, Homo sapiens
ccctgagtctggacct

SEQ ID NO: 759549 - DNA, 22 bp, Homo sapiens
ccctgagtctggacctccatcc

SEQ ID NO: 759550 - DNA, 14 bp, Homo sapiens
gagcttgctccaga

SEQ ID NO: 759551 - DNA, 15 bp, Homo sapiens
gagcttgctccagat

SEQ ID NO: 759552 - DNA, 13 bp, Homo sapiens
gagcttgctttga

SEQ ID NO: 759553 - DNA, 15 bp, Homo sapiens
gagcttggccagaag

SEQ ID NO: 759554 - DNA, 13 bp, Homo sapiens
gagcttgggactc

SEQ ID NO: 759555 - DNA, 19 bp, Homo sapiens
gagcttgggataaagcaag

SEQ ID NO: 759556 - DNA, 13 bp, Homo sapiens
gagcttgggcagt

SEQ ID NO: 759557 - DNA, 20 bp, Homo sapiens
gagcttgggggatgactaga

SEQ ID NO: 759558 - DNA, 13 bp, Homo sapiens
ccctgcccgggga

SEQ ID NO: 759559 - DNA, 20 bp, Homo sapiens
ccctgcccggggagctgcag

SEQ ID NO: 759560 - DNA, 22 bp, Homo sapiens
ccctgcccggggagctgcagag

SEQ ID NO: 759561 - DNA, 23 bp, Homo sapiens
ccctgcccggtggtttgccatgt

SEQ ID NO: 759562 - DNA, 20 bp, Homo sapiens
ccctgccctcagcctgttgc

SEQ ID NO: 759563 - DNA, 16 bp, Homo sapiens
ccctgccctcatggga

SEQ ID NO: 759564 - DNA, 13 bp, Homo sapiens
ccctgccctcgtg

SEQ ID NO: 759565 - DNA, 17 bp, Homo sapiens
ccctgccctcgtggcca

SEQ ID NO: 759566 - DNA, 12 bp, Homo sapiens
ccctgccctgca

SEQ ID NO: 759567 - DNA, 13 bp, Homo sapiens
ccctgccctgcac

SEQ ID NO: 759568 - DNA, 18 bp, Homo sapiens
ccctgccctgctcctaag

SEQ ID NO: 759569 - DNA, 12 bp, Homo sapiens
ccctgccctggt

SEQ ID NO: 759570 - DNA, 14 bp, Homo sapiens
ccctgccctggtcc

SEQ ID NO: 759571 - DNA, 11 bp, Homo sapiens
ccctgccctgt

SEQ ID NO: 759572 - DNA, 12 bp, Homo sapiens
ccctgccctgta

SEQ ID NO: 759573 - DNA, 13 bp, Homo sapiens
ccctgccctgtgc

SEQ ID NO: 759574 - DNA, 20 bp, Homo sapiens
ccctgccctgtgccgcactc

SEQ ID NO: 759575 - DNA, 15 bp, Homo sapiens
ccctgcccttcctca

SEQ ID NO: 759576 - DNA, 22 bp, Homo sapiens
ccctgcccttcctcctgatgga

SEQ ID NO: 759577 - DNA, 14 bp, Homo sapiens
ccctgcccttggca

SEQ ID NO: 759578 - DNA, 13 bp, Homo sapiens
ccctgccgagggg

SEQ ID NO: 759579 - DNA, 14 bp, Homo sapiens
ccctgccgcctcaa

SEQ ID NO: 759580 - DNA, 13 bp, Homo sapiens
ccctgccggccgg

SEQ ID NO: 759581 - DNA, 14 bp, Homo sapiens
ccctgcctcctgcc

SEQ ID NO: 759582 - DNA, 15 bp, Homo sapiens
ccctgcctcctgcca

SEQ ID NO: 759583 - DNA, 16 bp, Homo sapiens
ccctgcctcctgccac

SEQ ID NO: 759584 - DNA, 21 bp, Homo sapiens
ccctgcctcctggaggaccag

SEQ ID NO: 759585 - DNA, 12 bp, Homo sapiens
ccctgcctctgt

SEQ ID NO: 759586 - DNA, 20 bp, Homo sapiens
ccctgcctcttgtgtccctg

SEQ ID NO: 759587 - DNA, 12 bp, Homo sapiens
ccctgcctgaga

SEQ ID NO: 759588 - DNA, 15 bp, Homo sapiens
ccctgcctgagccca

SEQ ID NO: 759589 - DNA, 21 bp, Homo sapiens
ccctgcctgagggcccctctg

SEQ ID NO: 759590 - DNA, 22 bp, Homo sapiens
ccctgcctgagggcccctctgc

SEQ ID NO: 759591 - DNA, 18 bp, Homo sapiens
ccctgcctgcctcttggc

SEQ ID NO: 759592 - DNA, 14 bp, Homo sapiens
ccctgcctgctgca

SEQ ID NO: 759593 - DNA, 20 bp, Homo sapiens
ccctgcctgggccttggctg

SEQ ID NO: 759594 - DNA, 18 bp, Homo sapiens
ccctgcctgtcacctggg

SEQ ID NO: 759595 - DNA, 23 bp, Homo sapiens
ccctgcctgttggcaggcccact

SEQ ID NO: 759596 - DNA, 12 bp, Homo sapiens
ccctgccttcct

SEQ ID NO: 759597 - DNA, 14 bp, Homo sapiens
ccctgccttcctct

SEQ ID NO: 759598 - DNA, 16 bp, Homo sapiens
ccctgccttcctctga

SEQ ID NO: 759599 - DNA, 12 bp, Homo sapiens
ccctgccttgcc

SEQ ID NO: 759600 - DNA, 17 bp, Homo sapiens
ccctgccttgccgctcc

SEQ ID NO: 759601 - DNA, 13 bp, Homo sapiens
ccctgcgcctcca

SEQ ID NO: 759602 - DNA, 14 bp, Homo sapiens
ccctgcgcctccag

SEQ ID NO: 759603 - DNA, 18 bp, Homo sapiens
ccctgcgcctccagaggt

SEQ ID NO: 759604 - DNA, 16 bp, Homo sapiens
ccctgcgctctctttg

SEQ ID NO: 759605 - DNA, 12 bp, Homo sapiens
ccctgcgggcca

SEQ ID NO: 759606 - DNA, 18 bp, Homo sapiens
ccctgcgggccacagggc

SEQ ID NO: 759607 - DNA, 13 bp, Homo sapiens
ccctgcgggccag

SEQ ID NO: 759608 - DNA, 14 bp, Homo sapiens
ccctgcgggccagg

SEQ ID NO: 759609 - DNA, 17 bp, Homo sapiens
ccctgcggtagatggga

SEQ ID NO: 759610 - DNA, 22 bp, Homo sapiens
ccctgcgtcctgacgccctgcg

SEQ ID NO: 759611 - DNA, 17 bp, Homo sapiens
ccctgcgtgggggccag

SEQ ID NO: 759612 - DNA, 18 bp, Homo sapiens
ccctgcgttggagccact

SEQ ID NO: 759613 - DNA, 19 bp, Homo sapiens
ccctgcgttggagccactc

SEQ ID NO: 759614 - DNA, 20 bp, Homo sapiens
ccctgcgttggagccactcc

SEQ ID NO: 759615 - DNA, 13 bp, Homo sapiens
ccctgctcagtgc

SEQ ID NO: 759616 - DNA, 22 bp, Homo sapiens
ccctgctcagtgcttgggctcc

SEQ ID NO: 759617 - DNA, 18 bp, Homo sapiens
ccctgctccaccagcagc

SEQ ID NO: 759618 - DNA, 15 bp, Homo sapiens
ccctgctcccagcct

SEQ ID NO: 759619 - DNA, 16 bp, Homo sapiens
ccctgctcccagcctg

SEQ ID NO: 759620 - DNA, 18 bp, Homo sapiens
ccctgctcccagcctgct

SEQ ID NO: 759621 - DNA, 17 bp, Homo sapiens
ccctgctcccattcctc

SEQ ID NO: 759622 - DNA, 16 bp, Homo sapiens
ccctgctcctcatggg

SEQ ID NO: 759623 - DNA, 14 bp, Homo sapiens
ccctgctcctgcag

SEQ ID NO: 759624 - DNA, 18 bp, Homo sapiens
ccctgctcctgcagcatg

SEQ ID NO: 759625 - DNA, 22 bp, Homo sapiens
ccctgctctacccatgagcctg

SEQ ID NO: 759626 - DNA, 15 bp, Homo sapiens
ccctgctctggtccc

SEQ ID NO: 759627 - DNA, 22 bp, Homo sapiens
ccctgctctggtcccctctctt

SEQ ID NO: 759628 - DNA, 21 bp, Homo sapiens
ccctgctgaacacagtgtctg

SEQ ID NO: 759629 - DNA, 19 bp, Homo sapiens
ccctgctgaccttggagga

SEQ ID NO: 759630 - DNA, 23 bp, Homo sapiens
ccctgctgagtcccaggctgagc

SEQ ID NO: 759631 - DNA, 16 bp, Homo sapiens
ccctgctgcactagga

SEQ ID NO: 759632 - DNA, 13 bp, Homo sapiens
ccctgctgccaca

SEQ ID NO: 759633 - DNA, 15 bp, Homo sapiens
ccctgctgccacagc

SEQ ID NO: 759634 - DNA, 13 bp, Homo sapiens
ccctgctgccatg

SEQ ID NO: 759635 - DNA, 22 bp, Homo sapiens
ccctgctgccgcctcccagcct

SEQ ID NO: 759636 - DNA, 11 bp, Homo sapiens
ccctgctgcct

SEQ ID NO: 759637 - DNA, 12 bp, Homo sapiens
ccctgctgcctc

SEQ ID NO: 759638 - DNA, 12 bp, Homo sapiens
ccctgctggcct

SEQ ID NO: 759639 - DNA, 17 bp, Homo sapiens
ccctgctgtctctctgg

SEQ ID NO: 759640 - DNA, 22 bp, Homo sapiens
ccctgctgtctctctgggctgc

SEQ ID NO: 759641 - DNA, 13 bp, Homo sapiens
ccctgctgtgcca

SEQ ID NO: 759642 - DNA, 21 bp, Homo sapiens
ccctgctgtgccatgctgggc

SEQ ID NO: 759643 - DNA, 14 bp, Homo sapiens
ccctgctgtgctgc

SEQ ID NO: 759644 - DNA, 15 bp, Homo sapiens
ccctgcttcctgctt

SEQ ID NO: 759645 - DNA, 14 bp, Homo sapiens
ccctgcttctcccg

SEQ ID NO: 759646 - DNA, 22 bp, Homo sapiens
ccctgctttgggctgccctggt

SEQ ID NO: 759647 - DNA, 18 bp, Homo sapiens
ccctgctttttttcttaa

SEQ ID NO: 759648 - DNA, 22 bp, Homo sapiens
ccctgctttttttcttaaaagt

SEQ ID NO: 759649 - DNA, 17 bp, Homo sapiens
ccctggaaaacagacgg

SEQ ID NO: 759650 - DNA, 21 bp, Homo sapiens
ccctggaaaacagacgggtct

SEQ ID NO: 759651 - DNA, 19 bp, Homo sapiens
ccctggaaaggggagttga

SEQ ID NO: 759652 - DNA, 17 bp, Homo sapiens
ccctggaagagcccagt

SEQ ID NO: 759653 - DNA, 18 bp, Homo sapiens
ccctggaagccggcggcc

SEQ ID NO: 759654 - DNA, 9 bp, Homo sapiens
ccctggaat

SEQ ID NO: 759655 - DNA, 18 bp, Homo sapiens
ccctggaattcagcaccc

SEQ ID NO: 759656 - DNA, 22 bp, Homo sapiens
ccctggaattcagcaccctggg

SEQ ID NO: 759657 - DNA, 20 bp, Homo sapiens
ccctggacaggcagcctcct

SEQ ID NO: 759658 - DNA, 17 bp, Homo sapiens
ccctggaccaccagccc

SEQ ID NO: 759659 - DNA, 21 bp, Homo sapiens
ccctggaccaccagccccagc

SEQ ID NO: 759660 - DNA, 17 bp, Homo sapiens
ccctggacttgcctctg

SEQ ID NO: 759661 - DNA, 13 bp, Homo sapiens
ccctggagagaag

SEQ ID NO: 759662 - DNA, 21 bp, Homo sapiens
ccctggagccagactctggtc

SEQ ID NO: 759663 - DNA, 18 bp, Homo sapiens
ccctggagccagggcaga

SEQ ID NO: 759664 - DNA, 23 bp, Homo sapiens
ccctggagccagggcagaggaat

SEQ ID NO: 759665 - DNA, 12 bp, Homo sapiens
ccctggagccat

SEQ ID NO: 759666 - DNA, 16 bp, Homo sapiens
ccctggagccatccct

SEQ ID NO: 759667 - DNA, 12 bp, Homo sapiens
ccctggagccca

SEQ ID NO: 759668 - DNA, 12 bp, Homo sapiens
ccctggaggcgg

SEQ ID NO: 759669 - DNA, 23 bp, Homo sapiens
ccctggaggcggtgcggcaggga

SEQ ID NO: 759670 - DNA, 19 bp, Homo sapiens
ccctggaggctgacacaga

SEQ ID NO: 759671 - DNA, 23 bp, Homo sapiens
ccctggaggggacttccacacct

SEQ ID NO: 759672 - DNA, 19 bp, Homo sapiens
ccctggagtgtgtcagagc

SEQ ID NO: 759673 - DNA, 23 bp, Homo sapiens
ccctggtggagaaagcactgacc

SEQ ID NO: 759674 - DNA, 19 bp, Homo sapiens
ccctggttgcctctcttgc

SEQ ID NO: 759675 - DNA, 19 bp, Homo sapiens
ccctgtaaggtttcaatgc

SEQ ID NO: 759676 - DNA, 18 bp, Homo sapiens
ccctgtacacaactcact

SEQ ID NO: 759677 - DNA, 15 bp, Homo sapiens
ccctgtacagtgtta

SEQ ID NO: 759678 - DNA, 15 bp, Homo sapiens
ccctgtacccacccc

SEQ ID NO: 759679 - DNA, 16 bp, Homo sapiens
ccctgtacccacccca

SEQ ID NO: 759680 - DNA, 22 bp, Homo sapiens
ccctgtacccaccccagcacag

SEQ ID NO: 759681 - DNA, 13 bp, Homo sapiens
ccctgtacccagc

SEQ ID NO: 759682 - DNA, 17 bp, Homo sapiens
ccctgtacccagctcct

SEQ ID NO: 759683 - DNA, 18 bp, Homo sapiens
ccctgtactgttctgtgt

SEQ ID NO: 759684 - DNA, 21 bp, Homo sapiens
ccctgtagagtgggagctgag

SEQ ID NO: 759685 - DNA, 17 bp, Homo sapiens
ccctgtagctctgcctc

SEQ ID NO: 759686 - DNA, 14 bp, Homo sapiens
ccctgtaggcctca

SEQ ID NO: 759687 - DNA, 15 bp, Homo sapiens
ccctgtaggcctcag

SEQ ID NO: 759688 - DNA, 22 bp, Homo sapiens
ccctgtagttgacaattctgca

SEQ ID NO: 759689 - DNA, 21 bp, Homo sapiens
gaggagcccatactcagcctg

SEQ ID NO: 759690 - DNA, 15 bp, Homo sapiens
gaggagccccagcta

SEQ ID NO: 759691 - DNA, 12 bp, Homo sapiens
gaggagccctga

SEQ ID NO: 759692 - DNA, 13 bp, Homo sapiens
gaggagcctctgg

SEQ ID NO: 759693 - DNA, 16 bp, Homo sapiens
gaggagcctctggctt

SEQ ID NO: 759694 - DNA, 20 bp, Homo sapiens
gaggagcctctggcttccct

SEQ ID NO: 759695 - DNA, 20 bp, Homo sapiens
gaggagccttgctgggccag

SEQ ID NO: 759696 - DNA, 20 bp, Homo sapiens
gaggagcgcaggcagcgcag

SEQ ID NO: 759697 - DNA, 16 bp, Homo sapiens
gaggagctgagggagg

SEQ ID NO: 759698 - DNA, 11 bp, Homo sapiens
gaggagctgct

SEQ ID NO: 759699 - DNA, 16 bp, Homo sapiens
gaggagctgggcccct

SEQ ID NO: 759700 - DNA, 21 bp, Homo sapiens
gaggagcttgggggatgacta

SEQ ID NO: 759701 - DNA, 18 bp, Homo sapiens
gaggaggaaaaggaaaaa

SEQ ID NO: 759702 - DNA, 10 bp, Homo sapiens
gaggaggaag

SEQ ID NO: 759703 - DNA, 11 bp, Homo sapiens
gaggaggaagc

SEQ ID NO: 759704 - DNA, 14 bp, Homo sapiens
gaggaggacacagc

SEQ ID NO: 759705 - DNA, 15 bp, Homo sapiens
gaggaggacacagca

SEQ ID NO: 759706 - DNA, 14 bp, Homo sapiens
gaggaggacccctg

SEQ ID NO: 759707 - DNA, 14 bp, Homo sapiens
gaggaggaggagaa

SEQ ID NO: 759708 - DNA, 14 bp, Homo sapiens
gaggaggagggagg

SEQ ID NO: 759709 - DNA, 19 bp, Homo sapiens
gaggaggatgtccctgggc

SEQ ID NO: 759710 - DNA, 14 bp, Homo sapiens
gaggaggccacctc

SEQ ID NO: 759711 - DNA, 12 bp, Homo sapiens
gaggaggcctgg

SEQ ID NO: 759712 - DNA, 13 bp, Homo sapiens
gaggaggctgccc

SEQ ID NO: 759713 - DNA, 19 bp, Homo sapiens
gaggaggctgccctgaggg

SEQ ID NO: 759714 - DNA, 13 bp, Homo sapiens
gaggaggctggtg

SEQ ID NO: 759715 - DNA, 14 bp, Homo sapiens
gaggagggactgtc

SEQ ID NO: 759716 - DNA, 22 bp, Homo sapiens
gaggagggaggccgggcggtca

SEQ ID NO: 759717 - DNA, 19 bp, Homo sapiens
gaggagggatgctgcctga

SEQ ID NO: 759718 - DNA, 12 bp, Homo sapiens
gaggagggcaga

SEQ ID NO: 759719 - DNA, 20 bp, Homo sapiens
gaggagggcgtgactcaccc

SEQ ID NO: 759720 - DNA, 15 bp, Homo sapiens
gaggaggggaagctg

SEQ ID NO: 759721 - DNA, 20 bp, Homo sapiens
gaggaggggaagctgggccc

SEQ ID NO: 759722 - DNA, 16 bp, Homo sapiens
gaggagggtggaggaa

SEQ ID NO: 759723 - DNA, 15 bp, Homo sapiens
gaggagggtggggga

SEQ ID NO: 759724 - DNA, 18 bp, Homo sapiens
gaggaggtggcagccctg

SEQ ID NO: 759725 - DNA, 15 bp, Homo sapiens
gaggaggtgtgagga

SEQ ID NO: 759726 - DNA, 21 bp, Homo sapiens
gaggagtaaataattggaaaa

SEQ ID NO: 759727 - DNA, 20 bp, Homo sapiens
gaggagtaacaatacaaatg

SEQ ID NO: 759728 - DNA, 14 bp, Homo sapiens
gaggagtctcaaca

SEQ ID NO: 759729 - DNA, 19 bp, Homo sapiens
gaggagtctcaacatgtgt

SEQ ID NO: 759730 - DNA, 16 bp, Homo sapiens
gaggagtctgaggact

SEQ ID NO: 759731 - DNA, 17 bp, Homo sapiens
gaggagtctgaggactg

SEQ ID NO: 759732 - DNA, 16 bp, Homo sapiens
gaggagtgcagccttc

SEQ ID NO: 759733 - DNA, 13 bp, Homo sapiens
gaggagtgttatt

SEQ ID NO: 759734 - DNA, 16 bp, Homo sapiens
gaggagtttcgaggta

SEQ ID NO: 759735 - DNA, 20 bp, Homo sapiens
gaggagtttcgaggtagagt

SEQ ID NO: 759736 - DNA, 21 bp, Homo sapiens
gaggataaaaaggaaggagag

SEQ ID NO: 759737 - DNA, 22 bp, Homo sapiens
gaggataaaaaggaaggagaga

SEQ ID NO: 759738 - DNA, 17 bp, Homo sapiens
gaggataaagaaaagac

SEQ ID NO: 759739 - DNA, 13 bp, Homo sapiens
gaggatacaaatt

SEQ ID NO: 759740 - DNA, 15 bp, Homo sapiens
gaggatacaaattta

SEQ ID NO: 759741 - DNA, 17 bp, Homo sapiens
gaggatacagaggagat

SEQ ID NO: 759742 - DNA, 15 bp, Homo sapiens
gaggatacatttaat

SEQ ID NO: 759743 - DNA, 13 bp, Homo sapiens
gaggatacgacag

SEQ ID NO: 759744 - DNA, 20 bp, Homo sapiens
gaggatagtagttaaataac

SEQ ID NO: 759745 - DNA, 23 bp, Homo sapiens
gaggatataatgtgtgctttatt

SEQ ID NO: 759746 - DNA, 17 bp, Homo sapiens
gaggatatttattactt

SEQ ID NO: 759747 - DNA, 16 bp, Homo sapiens
gaggatctcttgagcc

SEQ ID NO: 759748 - DNA, 19 bp, Homo sapiens
gaggatctcttgagcctgg

SEQ ID NO: 759749 - DNA, 18 bp, Homo sapiens
gaggatgaatagatgtga

SEQ ID NO: 759750 - DNA, 22 bp, Homo sapiens
gaggatgaatagatgtgatcac

SEQ ID NO: 759751 - DNA, 21 bp, Homo sapiens
gaggatgaatgtatgtgcact

SEQ ID NO: 759752 - DNA, 14 bp, Homo sapiens
gaggatgagcagag

SEQ ID NO: 759753 - DNA, 15 bp, Homo sapiens
gaggatgagcagagg

SEQ ID NO: 759754 - DNA, 21 bp, Homo sapiens
gaggatgatttcagaaggaga

SEQ ID NO: 759755 - DNA, 17 bp, Homo sapiens
gaggatgccttttctgt

SEQ ID NO: 759756 - DNA, 13 bp, Homo sapiens
gaggatggagaga

SEQ ID NO: 759757 - DNA, 15 bp, Homo sapiens
gaggatggagagagg

SEQ ID NO: 759758 - DNA, 16 bp, Homo sapiens
gaggatgtgggcagct

SEQ ID NO: 759759 - DNA, 18 bp, Homo sapiens
gaggattgcttgagccca

SEQ ID NO: 759760 - DNA, 20 bp, Homo sapiens
gaggattgcttgagctcagg

SEQ ID NO: 759761 - DNA, 15 bp, Homo sapiens
gaggatttcctggag

SEQ ID NO: 759762 - DNA, 17 bp, Homo sapiens
gaggatttcctggagtg

SEQ ID NO: 759763 - DNA, 18 bp, Homo sapiens
gaggatttcctggagtgc

SEQ ID NO: 759764 - DNA, 22 bp, Homo sapiens
gaggattttccagttctgacac

SEQ ID NO: 759765 - DNA, 15 bp, Homo sapiens
gaggcaaaggttcta

SEQ ID NO: 759766 - DNA, 21 bp, Homo sapiens
gaggcaaaggttctatctgct

SEQ ID NO: 759767 - DNA, 16 bp, Homo sapiens
gaggcaaattaactgt

SEQ ID NO: 759768 - DNA, 14 bp, Homo sapiens
gaggcaagagggag

SEQ ID NO: 759769 - DNA, 16 bp, Homo sapiens
gaggcaagagggaggg

SEQ ID NO: 759770 - DNA, 23 bp, Homo sapiens
gaggcaagagggaggggacagag

SEQ ID NO: 759771 - DNA, 23 bp, Homo sapiens
gaggcaatgtcaggaacagaagg

SEQ ID NO: 759772 - DNA, 21 bp, Homo sapiens
gaggcaattagacactttgga

SEQ ID NO: 759773 - DNA, 23 bp, Homo sapiens
gaggcaattttaatcccctgcac

SEQ ID NO: 759774 - DNA, 14 bp, Homo sapiens
gaggcaccagctct

SEQ ID NO: 759775 - DNA, 15 bp, Homo sapiens
gaggcaccagctctg

SEQ ID NO: 759776 - DNA, 17 bp, Homo sapiens
gaggcaccaggaagccg

SEQ ID NO: 759777 - DNA, 19 bp, Homo sapiens
gaggcacctccaggcaggc

SEQ ID NO: 759778 - DNA, 14 bp, Homo sapiens
gaggcacctgctgg

SEQ ID NO: 759779 - DNA, 20 bp, Homo sapiens
gaggcactcagtgagcctcc

SEQ ID NO: 759780 - DNA, 22 bp, Homo sapiens
gaggcactcagtgagcctcctg

SEQ ID NO: 759781 - DNA, 18 bp, Homo sapiens
gaggcactgaagtgctta

SEQ ID NO: 759782 - DNA, 23 bp, Homo sapiens
gaggcagaaacctatctcaggga

SEQ ID NO: 759783 - DNA, 15 bp, Homo sapiens
gaggcagacagcagc

SEQ ID NO: 759784 - DNA, 16 bp, Homo sapiens
gaggcagacagcagct

SEQ ID NO: 759785 - DNA, 16 bp, Homo sapiens
gaggcagagaaagaag

SEQ ID NO: 759786 - DNA, 19 bp, Homo sapiens
gaggcagagaaagaagaga

SEQ ID NO: 759787 - DNA, 19 bp, Homo sapiens
gaggcagagaatctcttgg

SEQ ID NO: 759788 - DNA, 15 bp, Homo sapiens
gaggcagagaggagt

SEQ ID NO: 759789 - DNA, 12 bp, Homo sapiens
gaggcagagttt

SEQ ID NO: 759790 - DNA, 20 bp, Homo sapiens
gaggcagcagtgtgaggcca

SEQ ID NO: 759791 - DNA, 12 bp, Homo sapiens
gaggcagccaga

SEQ ID NO: 759792 - DNA, 17 bp, Homo sapiens
gaggcagccagacccag

SEQ ID NO: 759793 - DNA, 23 bp, Homo sapiens
gaggcagcgtgaaagcagatgag

SEQ ID NO: 759794 - DNA, 18 bp, Homo sapiens
gaggcagcgtgggctctg

SEQ ID NO: 759795 - DNA, 14 bp, Homo sapiens
cccttcttcccgcc

SEQ ID NO: 759796 - DNA, 14 bp, Homo sapiens
cccttcttcctccc

SEQ ID NO: 759797 - DNA, 13 bp, Homo sapiens
cccttcttgccat

SEQ ID NO: 759798 - DNA, 15 bp, Homo sapiens
cccttcttgctgccc

SEQ ID NO: 759799 - DNA, 16 bp, Homo sapiens
cccttcttgctgccct

SEQ ID NO: 759800 - DNA, 21 bp, Homo sapiens
cccttcttgggccccagaccc

SEQ ID NO: 759801 - DNA, 13 bp, Homo sapiens
cccttctttcctc

SEQ ID NO: 759802 - DNA, 11 bp, Homo sapiens
cccttcttttt

SEQ ID NO: 759803 - DNA, 21 bp, Homo sapiens
cccttgaagaggggaggggcc

SEQ ID NO: 759804 - DNA, 23 bp, Homo sapiens
cccttgaagaggggaggggccta

SEQ ID NO: 759805 - DNA, 15 bp, Homo sapiens
cccttgaagcaataa

SEQ ID NO: 759806 - DNA, 16 bp, Homo sapiens
cccttgaatctgcagg

SEQ ID NO: 759807 - DNA, 19 bp, Homo sapiens
cccttgaatctgcagggag

SEQ ID NO: 759808 - DNA, 23 bp, Homo sapiens
cccttgactgtacagagactcta

SEQ ID NO: 759809 - DNA, 15 bp, Homo sapiens
cccttgagacctcag

SEQ ID NO: 759810 - DNA, 17 bp, Homo sapiens
cccttgagacctcagcc

SEQ ID NO: 759811 - DNA, 19 bp, Homo sapiens
cccttgagatgagtttctg

SEQ ID NO: 759812 - DNA, 20 bp, Homo sapiens
cccttgaggattgtggaaaa

SEQ ID NO: 759813 - DNA, 21 bp, Homo sapiens
cccttgatcagccccaccctg

SEQ ID NO: 759814 - DNA, 19 bp, Homo sapiens
cccttgatcgacttcttgg

SEQ ID NO: 759815 - DNA, 16 bp, Homo sapiens
cccttgatgcacagag

SEQ ID NO: 759816 - DNA, 19 bp, Homo sapiens
cccttgatgggtgctgccc

SEQ ID NO: 759817 - DNA, 19 bp, Homo sapiens
cccttgatttaaacacaca

SEQ ID NO: 759818 - DNA, 20 bp, Homo sapiens
cccttgatttaaacacacag

SEQ ID NO: 759819 - DNA, 14 bp, Homo sapiens
cccttgcaagccat

SEQ ID NO: 759820 - DNA, 23 bp, Homo sapiens
cccttgcaagccataacgtgccc

SEQ ID NO: 759821 - DNA, 13 bp, Homo sapiens
cccttgcagcctg

SEQ ID NO: 759822 - DNA, 16 bp, Homo sapiens
cccttgccactttgca

SEQ ID NO: 759823 - DNA, 15 bp, Homo sapiens
cccttgcccagggct

SEQ ID NO: 759824 - DNA, 22 bp, Homo sapiens
gaggctgcagcaggtgctgggc

SEQ ID NO: 759825 - DNA, 15 bp, Homo sapiens
gaggctgcatgctct

SEQ ID NO: 759826 - DNA, 16 bp, Homo sapiens
gaggctgccccaggcc

SEQ ID NO: 759827 - DNA, 17 bp, Homo sapiens
gaggctgccccaggccg

SEQ ID NO: 759828 - DNA, 19 bp, Homo sapiens
gaggctgccccaggccgga

SEQ ID NO: 759829 - DNA, 12 bp, Homo sapiens
gaggctgccccc

SEQ ID NO: 759830 - DNA, 17 bp, Homo sapiens
gaggctgcccccatcca

SEQ ID NO: 759831 - DNA, 21 bp, Homo sapiens
gaggctgcccccatccagcca

SEQ ID NO: 759832 - DNA, 16 bp, Homo sapiens
gaggctgccctgaggg

SEQ ID NO: 759833 - DNA, 13 bp, Homo sapiens
gaggctgcctcag

SEQ ID NO: 759834 - DNA, 15 bp, Homo sapiens
gaggctgcctcagcc

SEQ ID NO: 759835 - DNA, 16 bp, Homo sapiens
gaggctgcctcagcca

SEQ ID NO: 759836 - DNA, 15 bp, Homo sapiens
gaggctggaggaagg

SEQ ID NO: 759837 - DNA, 17 bp, Homo sapiens
gaggctggaggcagggc

SEQ ID NO: 759838 - DNA, 15 bp, Homo sapiens
gaggctgggcccctg

SEQ ID NO: 759839 - DNA, 18 bp, Homo sapiens
gaggctggggccccatct

SEQ ID NO: 759840 - DNA, 17 bp, Homo sapiens
gaggctgggggagagcc

SEQ ID NO: 759841 - DNA, 22 bp, Homo sapiens
gaggctggtgctgtggccaggg

SEQ ID NO: 759842 - DNA, 24 bp, Homo sapiens
gaggctggtggttttcagagcagg

SEQ ID NO: 759843 - DNA, 13 bp, Homo sapiens
gaggctggttttg

SEQ ID NO: 759844 - DNA, 17 bp, Homo sapiens
gaggctgtcacagtcct

SEQ ID NO: 759845 - DNA, 14 bp, Homo sapiens
gaggctgtcctgta

SEQ ID NO: 759846 - DNA, 17 bp, Homo sapiens
gaggctgtctggggcct

SEQ ID NO: 759847 - DNA, 14 bp, Homo sapiens
gaggctgtgctccg

SEQ ID NO: 759848 - DNA, 13 bp, Homo sapiens
gaggctgtgtctc

SEQ ID NO: 759849 - DNA, 17 bp, Homo sapiens
gaggctgtgtggccaac

SEQ ID NO: 759850 - DNA, 18 bp, Homo sapiens
gaggctgtgtggccaacc

SEQ ID NO: 759851 - DNA, 20 bp, Homo sapiens
gaggctgtgtggccaaccag

SEQ ID NO: 759852 - DNA, 16 bp, Homo sapiens
gaggcttagagagagg

SEQ ID NO: 759853 - DNA, 13 bp, Homo sapiens
gaggcttcacgcc

SEQ ID NO: 759854 - DNA, 23 bp, Homo sapiens
gaggcttccagagagtcctctgg

SEQ ID NO: 759855 - DNA, 14 bp, Homo sapiens
gaggcttccaggct

SEQ ID NO: 759856 - DNA, 19 bp, Homo sapiens
gaggcttccaggctcttcc

SEQ ID NO: 759857 - DNA, 15 bp, Homo sapiens
gaggcttcctgcgtc

SEQ ID NO: 759858 - DNA, 15 bp, Homo sapiens
gaggcttctccgcca

SEQ ID NO: 759859 - DNA, 23 bp, Homo sapiens
gaggcttctccgccagcctcctc

SEQ ID NO: 759860 - DNA, 21 bp, Homo sapiens
gaggcttgtcagagctgggag

SEQ ID NO: 759861 - DNA, 18 bp, Homo sapiens
gaggctttaagctccagc

SEQ ID NO: 759862 - DNA, 20 bp, Homo sapiens
gaggctttaagctccagctt

SEQ ID NO: 759863 - DNA, 14 bp, Homo sapiens
gaggctttggattt

SEQ ID NO: 759864 - DNA, 16 bp, Homo sapiens
gaggctttggatttga

SEQ ID NO: 759865 - DNA, 20 bp, Homo sapiens
gaggctttggatttgacatt

SEQ ID NO: 759866 - DNA, 14 bp, Homo sapiens
gaggctttggccca

SEQ ID NO: 759867 - DNA, 23 bp, Homo sapiens
gaggctttggggtcctagcccag

SEQ ID NO: 759868 - DNA, 18 bp, Homo sapiens
gaggctttggtaccccca

SEQ ID NO: 759869 - DNA, 10 bp, Homo sapiens
gagggaaaag

SEQ ID NO: 759870 - DNA, 12 bp, Homo sapiens
gagggaaacctt

SEQ ID NO: 759871 - DNA, 21 bp, Homo sapiens
gagggaaatctgtaaagccag

SEQ ID NO: 759872 - DNA, 13 bp, Homo sapiens
gagggaacaaaac

SEQ ID NO: 759873 - DNA, 15 bp, Homo sapiens
gagggaacagacagg

SEQ ID NO: 759874 - DNA, 20 bp, Homo sapiens
gagggaacctgttagtctcc

SEQ ID NO: 759875 - DNA, 14 bp, Homo sapiens
gagggaagagggag

SEQ ID NO: 759876 - DNA, 16 bp, Homo sapiens
gagggaagagggagac

SEQ ID NO: 759877 - DNA, 23 bp, Homo sapiens
gagggaagatcttgatggtgttt

SEQ ID NO: 759878 - DNA, 17 bp, Homo sapiens
gagggaagggccaccct

SEQ ID NO: 759879 - DNA, 16 bp, Homo sapiens
gagggaaggggatgga

SEQ ID NO: 759880 - DNA, 18 bp, Homo sapiens
gagggacacatgcccctc

SEQ ID NO: 759881 - DNA, 22 bp, Homo sapiens
gagggacacatgcccctccccc

SEQ ID NO: 759882 - DNA, 16 bp, Homo sapiens
gagggacaggatctat

SEQ ID NO: 759883 - DNA, 16 bp, Homo sapiens
gagggacaggctgaag

SEQ ID NO: 759884 - DNA, 17 bp, Homo sapiens
gagggacaggctgaaga

SEQ ID NO: 759885 - DNA, 19 bp, Homo sapiens
gagggaccaactgggccca

SEQ ID NO: 759886 - DNA, 15 bp, Homo sapiens
gagggaccatgtgtc

SEQ ID NO: 759887 - DNA, 16 bp, Homo sapiens
gagggaccatgtgtca

SEQ ID NO: 759888 - DNA, 21 bp, Homo sapiens
gagggacctgcatctaagcat

SEQ ID NO: 759889 - DNA, 14 bp, Homo sapiens
gagggacgcctggg

SEQ ID NO: 759890 - DNA, 15 bp, Homo sapiens
gagggacgcctgggg

SEQ ID NO: 759891 - DNA, 23 bp, Homo sapiens
gagggacgcctgggggtgccagg

SEQ ID NO: 759892 - DNA, 14 bp, Homo sapiens
gagggacttggctg

SEQ ID NO: 759893 - DNA, 21 bp, Homo sapiens
gagggagacactggcccctca

SEQ ID NO: 759894 - DNA, 11 bp, Homo sapiens
gagggagacca

SEQ ID NO: 759895 - DNA, 20 bp, Homo sapiens
gagggagacggccctgctgg

SEQ ID NO: 759896 - DNA, 21 bp, Homo sapiens
gagggagacggccctgctggg

SEQ ID NO: 759897 - DNA, 15 bp, Homo sapiens
gagggagactcctgg

SEQ ID NO: 759898 - DNA, 14 bp, Homo sapiens
gagggagctgctgg

SEQ ID NO: 759899 - DNA, 15 bp, Homo sapiens
gagggaggacatcat

SEQ ID NO: 759900 - DNA, 15 bp, Homo sapiens
gagggaggacctggg

SEQ ID NO: 759901 - DNA, 17 bp, Homo sapiens
gagggaggaggccacct

SEQ ID NO: 759902 - DNA, 14 bp, Homo sapiens
gagggaggcaccat

SEQ ID NO: 759903 - DNA, 14 bp, Homo sapiens
gagggaggccaggc

SEQ ID NO: 759904 - DNA, 16 bp, Homo sapiens
gagggagggagccatg

SEQ ID NO: 759905 - DNA, 13 bp, Homo sapiens
gagggagggctgg

SEQ ID NO: 759906 - DNA, 18 bp, Homo sapiens
gagggagggctgggctag

SEQ ID NO: 759907 - DNA, 21 bp, Homo sapiens
gagggaggggaaaagcatttt

SEQ ID NO: 759908 - DNA, 20 bp, Homo sapiens
gagggaggggacagaggccc

SEQ ID NO: 759909 - DNA, 15 bp, Homo sapiens
gagggaggtgtttaa

SEQ ID NO: 759910 - DNA, 23 bp, Homo sapiens
gagggaggtgtttaaagagaggt

SEQ ID NO: 759911 - DNA, 15 bp, Homo sapiens
gagggagtctcagga

SEQ ID NO: 759912 - DNA, 13 bp, Homo sapiens
gagggagtggcac

SEQ ID NO: 759913 - DNA, 14 bp, Homo sapiens
gagggatcacaggg

SEQ ID NO: 759914 - DNA, 14 bp, Homo sapiens
gagggatcagcccc

SEQ ID NO: 759915 - DNA, 15 bp, Homo sapiens
gagggatcagccccg

SEQ ID NO: 759916 - DNA, 20 bp, Homo sapiens
gagggatctgagtaggtctg

SEQ ID NO: 759917 - DNA, 14 bp, Homo sapiens
gagggatgccccca

SEQ ID NO: 759918 - DNA, 19 bp, Homo sapiens
gaggtggagcttgcagtga

SEQ ID NO: 759919 - DNA, 19 bp, Homo sapiens
gaggtggaggctgcagtga

SEQ ID NO: 759920 - DNA, 18 bp, Homo sapiens
gaggtggagggagggaag

SEQ ID NO: 759921 - DNA, 19 bp, Homo sapiens
gaggtggaggtgggctgat

SEQ ID NO: 759922 - DNA, 24 bp, Homo sapiens
gaggtggattccgagtggtgacag

SEQ ID NO: 759923 - DNA, 17 bp, Homo sapiens
gaggtggccagagctgg

SEQ ID NO: 759924 - DNA, 21 bp, Homo sapiens
gaggtggccagagctgggagg

SEQ ID NO: 759925 - DNA, 23 bp, Homo sapiens
gaggtggccagagctgggaggca

SEQ ID NO: 759926 - DNA, 15 bp, Homo sapiens
gaggtggcccaggcc

SEQ ID NO: 759927 - DNA, 16 bp, Homo sapiens
gaggtggcccaggccc

SEQ ID NO: 759928 - DNA, 11 bp, Homo sapiens
gaggtggccct

SEQ ID NO: 759929 - DNA, 12 bp, Homo sapiens
gaggtggccctt

SEQ ID NO: 759930 - DNA, 19 bp, Homo sapiens
gaggtggcccttgtttaca

SEQ ID NO: 759931 - DNA, 22 bp, Homo sapiens
gaggtggctgcgcccccagctt

SEQ ID NO: 759932 - DNA, 16 bp, Homo sapiens
gaggtggcttcatgtg

SEQ ID NO: 759933 - DNA, 14 bp, Homo sapiens
gaggtgggaggcca

SEQ ID NO: 759934 - DNA, 15 bp, Homo sapiens
gaggtgggaggccag

SEQ ID NO: 759935 - DNA, 17 bp, Homo sapiens
gaggtgggaggccaggc

SEQ ID NO: 759936 - DNA, 14 bp, Homo sapiens
gaggtgggagggcc

SEQ ID NO: 759937 - DNA, 15 bp, Homo sapiens
gaggtgggcagctgg

SEQ ID NO: 759938 - DNA, 12 bp, Homo sapiens
gaggtgggcagg

SEQ ID NO: 759939 - DNA, 17 bp, Homo sapiens
gaggtgggccagtctgt

SEQ ID NO: 759940 - DNA, 12 bp, Homo sapiens
gaggtgggccca

SEQ ID NO: 759941 - DNA, 14 bp, Homo sapiens
gaggtgggctgggg

SEQ ID NO: 759942 - DNA, 17 bp, Homo sapiens
gaggtggggaaggaggg

SEQ ID NO: 759943 - DNA, 17 bp, Homo sapiens
gaggtgggggctggagg

SEQ ID NO: 759944 - DNA, 20 bp, Homo sapiens
gaggtggtctgaatgttctg

SEQ ID NO: 759945 - DNA, 15 bp, Homo sapiens
gaggtggtgaatttt

SEQ ID NO: 759946 - DNA, 17 bp, Homo sapiens
gaggtggtgccttctca

SEQ ID NO: 759947 - DNA, 15 bp, Homo sapiens
gaggtgtgggggctg

SEQ ID NO: 759948 - DNA, 19 bp, Homo sapiens
gaggtgtttaaagagaggt

SEQ ID NO: 759949 - DNA, 18 bp, Homo sapiens
gaggttaaacggtgccca

SEQ ID NO: 759950 - DNA, 19 bp, Homo sapiens
gaggttataggtcactcct

SEQ ID NO: 759951 - DNA, 16 bp, Homo sapiens
gaggttatctgcctgg

SEQ ID NO: 759952 - DNA, 17 bp, Homo sapiens
gaggttatctgcctggc

SEQ ID NO: 759953 - DNA, 22 bp, Homo sapiens
gaggttattcacaacctcacca

SEQ ID NO: 759954 - DNA, 23 bp, Homo sapiens
gaggttattcacaacctcaccaa

SEQ ID NO: 759955 - DNA, 18 bp, Homo sapiens
gaggttattttccgccag

SEQ ID NO: 759956 - DNA, 17 bp, Homo sapiens
gaggttcatttcaaata

SEQ ID NO: 759957 - DNA, 15 bp, Homo sapiens
gaggttctgggcctc

SEQ ID NO: 759958 - DNA, 22 bp, Homo sapiens
gaggttcttgtaccacttcatc

SEQ ID NO: 759959 - DNA, 15 bp, Homo sapiens
gaggttgaagccaag

SEQ ID NO: 759960 - DNA, 21 bp, Homo sapiens
gaggttgaggaaaagactgtg

SEQ ID NO: 759961 - DNA, 15 bp, Homo sapiens
ccgcaggagggaggc

SEQ ID NO: 759962 - DNA, 22 bp, Homo sapiens
ccgcaggcgcggcggctctgcc

SEQ ID NO: 759963 - DNA, 24 bp, Homo sapiens
ccgcaggcgcggcggctctgccca

SEQ ID NO: 759964 - DNA, 17 bp, Homo sapiens
ccgcagggagggctgtg

SEQ ID NO: 759965 - DNA, 11 bp, Homo sapiens
ccgcagggcca

SEQ ID NO: 759966 - DNA, 20 bp, Homo sapiens
ccgcagggccatgcagacct

SEQ ID NO: 759967 - DNA, 11 bp, Homo sapiens
ccgcagggccc

SEQ ID NO: 759968 - DNA, 12 bp, Homo sapiens
ccgcagggcggg

SEQ ID NO: 759969 - DNA, 15 bp, Homo sapiens
ccgcatatgcatgcc

SEQ ID NO: 759970 - DNA, 17 bp, Homo sapiens
ccgcatatgcatgccag

SEQ ID NO: 759971 - DNA, 15 bp, Homo sapiens
ccgcatcttctccat

SEQ ID NO: 759972 - DNA, 16 bp, Homo sapiens
ccgcatcttctccatc

SEQ ID NO: 759973 - DNA, 22 bp, Homo sapiens
ccgcatgtgtgcctggccgcag

SEQ ID NO: 759974 - DNA, 17 bp, Homo sapiens
ccgcattggtgactcac

SEQ ID NO: 759975 - DNA, 13 bp, Homo sapiens
ccgcatttctcat

SEQ ID NO: 759976 - DNA, 18 bp, Homo sapiens
ccgcatttctcatgcttc

SEQ ID NO: 759977 - DNA, 20 bp, Homo sapiens
ccgccacatggtgtggccat

SEQ ID NO: 759978 - DNA, 19 bp, Homo sapiens
ccgccaccgcgggtgtggg

SEQ ID NO: 759979 - DNA, 17 bp, Homo sapiens
ccgccacctatctcgtg

SEQ ID NO: 759980 - DNA, 15 bp, Homo sapiens
ccgccacctcagggc

SEQ ID NO: 759981 - DNA, 22 bp, Homo sapiens
ccgccacctgaggtgggctggg

SEQ ID NO: 759982 - DNA, 13 bp, Homo sapiens
ccgccacggccac

SEQ ID NO: 759983 - DNA, 15 bp, Homo sapiens
ccgccacggccaccc

SEQ ID NO: 759984 - DNA, 19 bp, Homo sapiens
ccgccacggccaccctcct

SEQ ID NO: 759985 - DNA, 18 bp, Homo sapiens
ccgccactcagccatttc

SEQ ID NO: 759986 - DNA, 16 bp, Homo sapiens
ccgccactcctgaacc

SEQ ID NO: 759987 - DNA, 22 bp, Homo sapiens
ccgccagccccgctcccaccta

SEQ ID NO: 759988 - DNA, 11 bp, Homo sapiens
ccgccagcctc

SEQ ID NO: 759989 - DNA, 12 bp, Homo sapiens
ccgccagcctca

SEQ ID NO: 759990 - DNA, 16 bp, Homo sapiens
ccgccagcctcagtgc

SEQ ID NO: 759991 - DNA, 18 bp, Homo sapiens
ccgccagcctcagtgcca

SEQ ID NO: 759992 - DNA, 13 bp, Homo sapiens
ccgccagcctcct

SEQ ID NO: 759993 - DNA, 23 bp, Homo sapiens
ccgccagcctcctctggacggca

SEQ ID NO: 759994 - DNA, 12 bp, Homo sapiens
ccgccagctggg

SEQ ID NO: 759995 - DNA, 20 bp, Homo sapiens
ccgccagcttcccttcactc

SEQ ID NO: 759996 - DNA, 16 bp, Homo sapiens
ccgccatccagggtct

SEQ ID NO: 759997 - DNA, 23 bp, Homo sapiens
ccgccatccagggtctggcagag

SEQ ID NO: 759998 - DNA, 12 bp, Homo sapiens
ccgccatctgcg

SEQ ID NO: 759999 - DNA, 20 bp, Homo sapiens
ccgccatctgcgcagggtgg

SEQ ID NO: 760000 - DNA, 16 bp, Homo sapiens
ccgccatggtgtcccg

SEQ ID NO: 760001 - DNA, 23 bp, Homo sapiens
ccgcccaaagagaaatcacaggg

SEQ ID NO: 760002 - DNA, 12 bp, Homo sapiens
ccgcccacccac

SEQ ID NO: 760003 - DNA, 22 bp, Homo sapiens
ccgcccacgccggcctctgctg

SEQ ID NO: 760004 - DNA, 15 bp, Homo sapiens
ccgcccactgtcctg

SEQ ID NO: 760005 - DNA, 22 bp, Homo sapiens
ccgcccagagacccaagctgcc

SEQ ID NO: 760006 - DNA, 13 bp, Homo sapiens
ccgcccagcctct

SEQ ID NO: 760007 - DNA, 20 bp, Homo sapiens
ccgcccagctcatgtaggtg

SEQ ID NO: 760008 - DNA, 19 bp, Homo sapiens
ccgcccagctctcccacat

SEQ ID NO: 760009 - DNA, 17 bp, Homo sapiens
ccgcccagctgcacctg

SEQ ID NO: 760010 - DNA, 12 bp, Homo sapiens
ccgcccatccct

SEQ ID NO: 760011 - DNA, 12 bp, Homo sapiens
ccgccccagccc

SEQ ID NO: 760012 - DNA, 17 bp, Homo sapiens
ccgccccagccccttct

SEQ ID NO: 760013 - DNA, 16 bp, Homo sapiens
ccgccccagccctcag

SEQ ID NO: 760014 - DNA, 19 bp, Homo sapiens
ccgccccagccctcagtca

SEQ ID NO: 760015 - DNA, 12 bp, Homo sapiens
ccgccccaggct

SEQ ID NO: 760016 - DNA, 14 bp, Homo sapiens
ccgccccaggcttc

SEQ ID NO: 760017 - DNA, 20 bp, Homo sapiens
ccgccccaggcttccgcgcc

SEQ ID NO: 760018 - DNA, 12 bp, Homo sapiens
ccgcccccaccg

SEQ ID NO: 760019 - DNA, 15 bp, Homo sapiens
ccgcccccaccgggc

SEQ ID NO: 760020 - DNA, 13 bp, Homo sapiens
ccgcccccagtcc

SEQ ID NO: 760021 - DNA, 20 bp, Homo sapiens
ccgccccccacacttccctg

SEQ ID NO: 760022 - DNA, 21 bp, Homo sapiens
ccgccccccacacttccctgg

SEQ ID NO: 760023 - DNA, 23 bp, Homo sapiens
ccgccccccacacttccctggcg

SEQ ID NO: 760024 - DNA, 16 bp, Homo sapiens
ccgccccccagagcca

SEQ ID NO: 760025 - DNA, 17 bp, Homo sapiens
ccgcccccgccccgcgc

SEQ ID NO: 760026 - DNA, 14 bp, Homo sapiens
ccgccccctcctga

SEQ ID NO: 760027 - DNA, 14 bp, Homo sapiens
ccgccccgcgcgcc

SEQ ID NO: 760028 - DNA, 15 bp, Homo sapiens
ccgcccctcgcccgc

SEQ ID NO: 760029 - DNA, 18 bp, Homo sapiens
ccgcccctcgctgctgct

SEQ ID NO: 760030 - DNA, 18 bp, Homo sapiens
ccgcccctctccaaacac

SEQ ID NO: 760031 - DNA, 13 bp, Homo sapiens
ccgcccgaccagg

SEQ ID NO: 760032 - DNA, 18 bp, Homo sapiens
ccgccctcacctgcagag

SEQ ID NO: 760033 - DNA, 13 bp, Homo sapiens
ccgccctccatcc

SEQ ID NO: 760034 - DNA, 15 bp, Homo sapiens
ccgccctgccactca

SEQ ID NO: 760035 - DNA, 19 bp, Homo sapiens
ccgccctgcgggccacagg

SEQ ID NO: 760036 - DNA, 13 bp, Homo sapiens
ccgccctgggctg

SEQ ID NO: 760037 - DNA, 22 bp, Homo sapiens
ccgccctgggctggactggagg

SEQ ID NO: 760038 - DNA, 24 bp, Homo sapiens
ccgccctgggctgtctgtcaccag

SEQ ID NO: 760039 - DNA, 20 bp, Homo sapiens
ccgccgcagaagcagcccct

SEQ ID NO: 760040 - DNA, 16 bp, Homo sapiens
ccgccgccctggacag

SEQ ID NO: 760041 - DNA, 13 bp, Homo sapiens
ccggatttctaac

SEQ ID NO: 760042 - DNA, 22 bp, Homo sapiens
ccggatttctaacagtccttgc

SEQ ID NO: 760043 - DNA, 14 bp, Homo sapiens
ccggcaagccacag

SEQ ID NO: 760044 - DNA, 16 bp, Homo sapiens
ccggcagggcgggcag

SEQ ID NO: 760045 - DNA, 18 bp, Homo sapiens
ccggcagggtcctagaaa

SEQ ID NO: 760046 - DNA, 17 bp, Homo sapiens
ccggcatccttgcctgt

SEQ ID NO: 760047 - DNA, 17 bp, Homo sapiens
ccggccaatggaaacct

SEQ ID NO: 760048 - DNA, 13 bp, Homo sapiens
ccggccacagctg

SEQ ID NO: 760049 - DNA, 15 bp, Homo sapiens
ccggccacagctgct

SEQ ID NO: 760050 - DNA, 13 bp, Homo sapiens
ccggccaggccac

SEQ ID NO: 760051 - DNA, 15 bp, Homo sapiens
ccggccatactgcct

SEQ ID NO: 760052 - DNA, 22 bp, Homo sapiens
ccggcccaccagggactgcagc

SEQ ID NO: 760053 - DNA, 16 bp, Homo sapiens
ccggcccagagacccc

SEQ ID NO: 760054 - DNA, 18 bp, Homo sapiens
ccggcccagagacccctt

SEQ ID NO: 760055 - DNA, 14 bp, Homo sapiens
ccggcccagatgtg

SEQ ID NO: 760056 - DNA, 18 bp, Homo sapiens
ccggcccagatgtgtccc

SEQ ID NO: 760057 - DNA, 18 bp, Homo sapiens
ccggcccagcctaggccc

SEQ ID NO: 760058 - DNA, 13 bp, Homo sapiens
ccggcccagtgcc

SEQ ID NO: 760059 - DNA, 16 bp, Homo sapiens
ccggcccagtgccact

SEQ ID NO: 760060 - DNA, 14 bp, Homo sapiens
ccggccccaccccc

SEQ ID NO: 760061 - DNA, 14 bp, Homo sapiens
ccggccccacctcc

SEQ ID NO: 760062 - DNA, 17 bp, Homo sapiens
ccggccccacctccctg

SEQ ID NO: 760063 - DNA, 15 bp, Homo sapiens
ccggccccagccaga

SEQ ID NO: 760064 - DNA, 16 bp, Homo sapiens
ccggccccagccagag

SEQ ID NO: 760065 - DNA, 19 bp, Homo sapiens
ccggcccccctctcgggct

SEQ ID NO: 760066 - DNA, 22 bp, Homo sapiens
ccggccccctccccccagactc

SEQ ID NO: 760067 - DNA, 17 bp, Homo sapiens
ccggcccctcaccctct

SEQ ID NO: 760068 - DNA, 17 bp, Homo sapiens
ccggcccctccccctga

SEQ ID NO: 760069 - DNA, 17 bp, Homo sapiens
ccggccctcccccagct

SEQ ID NO: 760070 - DNA, 17 bp, Homo sapiens
ccggccgagctgcctgg

SEQ ID NO: 760071 - DNA, 16 bp, Homo sapiens
ccggccgccgccagga

SEQ ID NO: 760072 - DNA, 16 bp, Homo sapiens
ccggccggacctctga

SEQ ID NO: 760073 - DNA, 23 bp, Homo sapiens
ccggcctccactcccccacctga

SEQ ID NO: 760074 - DNA, 22 bp, Homo sapiens
ccggcctcctcggagagcagca

SEQ ID NO: 760075 - DNA, 16 bp, Homo sapiens
ccggcctctctggcct

SEQ ID NO: 760076 - DNA, 21 bp, Homo sapiens
ccggcctctctggcctcccac

SEQ ID NO: 760077 - DNA, 22 bp, Homo sapiens
ccggcctctctggcctcccacc

SEQ ID NO: 760078 - DNA, 21 bp, Homo sapiens
ccggcctgatgacagagcgag

SEQ ID NO: 760079 - DNA, 23 bp, Homo sapiens
ccggcctgtaatcagctctcctg

SEQ ID NO: 760080 - DNA, 17 bp, Homo sapiens
ccggcgccccgcacccc

SEQ ID NO: 760081 - DNA, 21 bp, Homo sapiens
ccggcgccccgcacccccgcc

SEQ ID NO: 760082 - DNA, 13 bp, Homo sapiens
ccggcgcctgccc

SEQ ID NO: 760083 - DNA, 17 bp, Homo sapiens
ccggcgcctgccctgcc

SEQ ID NO: 760084 - DNA, 19 bp, Homo sapiens
ccggcgcctgccctgccca

SEQ ID NO: 760085 - DNA, 20 bp, Homo sapiens
ccggcgcctgccctgcccaa

SEQ ID NO: 760086 - DNA, 23 bp, Homo sapiens
ccggcgcctgccctgcccaagtg

SEQ ID NO: 760087 - DNA, 14 bp, Homo sapiens
ccggcgctgcaggt

SEQ ID NO: 760088 - DNA, 17 bp, Homo sapiens
ccggcggctactctgga

SEQ ID NO: 760089 - DNA, 19 bp, Homo sapiens
ccggcggctctgagcaggg

SEQ ID NO: 760090 - DNA, 20 bp, Homo sapiens
ccggcggctctgagcagggg

SEQ ID NO: 760091 - DNA, 19 bp, Homo sapiens
ccggcgggatgttgaactg

SEQ ID NO: 760092 - DNA, 15 bp, Homo sapiens
ccggcgtcttgccca

SEQ ID NO: 760093 - DNA, 20 bp, Homo sapiens
ccggcgtcttgcccagcagc

SEQ ID NO: 760094 - DNA, 17 bp, Homo sapiens
ccggctctttccttgct

SEQ ID NO: 760095 - DNA, 15 bp, Homo sapiens
ccggctgcagaggcc

SEQ ID NO: 760096 - DNA, 13 bp, Homo sapiens
ccggctgccccca

SEQ ID NO: 760097 - DNA, 15 bp, Homo sapiens
ccggctgcccccatc

SEQ ID NO: 760098 - DNA, 13 bp, Homo sapiens
ccggctgcctgcc

SEQ ID NO: 760099 - DNA, 19 bp, Homo sapiens
ccggctgctcctccagccc

SEQ ID NO: 760100 - DNA, 21 bp, Homo sapiens
ccggctgctcctccagccctt

SEQ ID NO: 760101 - DNA, 13 bp, Homo sapiens
ccggctgctgctt

SEQ ID NO: 760102 - DNA, 19 bp, Homo sapiens
ccggctggcctggaggctc

SEQ ID NO: 760103 - DNA, 21 bp, Homo sapiens
ccggctggcctggaggctcag

SEQ ID NO: 760104 - DNA, 14 bp, Homo sapiens
ccggctgtggagca

SEQ ID NO: 760105 - DNA, 19 bp, Homo sapiens
ccggctttcctccggagcc

SEQ ID NO: 760106 - DNA, 21 bp, Homo sapiens
ccgggaagtgagggctcactc

SEQ ID NO: 760107 - DNA, 19 bp, Homo sapiens
ccgggacaccgtggggaag

SEQ ID NO: 760108 - DNA, 20 bp, Homo sapiens
ccgggacaccgtggggaagg

SEQ ID NO: 760109 - DNA, 21 bp, Homo sapiens
ccgggaccaccctgagccggc

SEQ ID NO: 760110 - DNA, 22 bp, Homo sapiens
ccgggaccctgctcacaggcag

SEQ ID NO: 760111 - DNA, 18 bp, Homo sapiens
ccgggagcctaggaccac

SEQ ID NO: 760112 - DNA, 23 bp, Homo sapiens
ccgggagcctaggaccactcagc

SEQ ID NO: 760113 - DNA, 16 bp, Homo sapiens
ccgggagcctccccct

SEQ ID NO: 760114 - DNA, 18 bp, Homo sapiens
ccgggagcctccccctca

SEQ ID NO: 760115 - DNA, 22 bp, Homo sapiens
ccgggagcctccccctcagatg

SEQ ID NO: 760116 - DNA, 16 bp, Homo sapiens
ccgggagcctgatcac

SEQ ID NO: 760117 - DNA, 20 bp, Homo sapiens
ccgggagctggtgacagcct

SEQ ID NO: 760118 - DNA, 19 bp, Homo sapiens
ccgggaggaaaaggcccct

SEQ ID NO: 760119 - DNA, 22 bp, Homo sapiens
ccgggaggtggaggttgcagtg

SEQ ID NO: 760120 - DNA, 23 bp, Homo sapiens
ccgggatattatagaaaattatt

SEQ ID NO: 760121 - DNA, 15 bp, Homo sapiens
ccgggatcctgcccc

SEQ ID NO: 760122 - DNA, 16 bp, Homo sapiens
ccgggatcctgccccc

SEQ ID NO: 760123 - DNA, 20 bp, Homo sapiens
ccgggatcctgcccccaagt

SEQ ID NO: 760124 - DNA, 17 bp, Homo sapiens
ccgggcaaatgccaggg

SEQ ID NO: 760125 - DNA, 19 bp, Homo sapiens
ccgggcaaatgccagggcc

SEQ ID NO: 760126 - DNA, 21 bp, Homo sapiens
ccgggcaaatgccagggcccg

SEQ ID NO: 760127 - DNA, 11 bp, Homo sapiens
ccgggcagaaa

SEQ ID NO: 760128 - DNA, 13 bp, Homo sapiens
ccgggcaggccag

SEQ ID NO: 760129 - DNA, 17 bp, Homo sapiens
ccgggccacgcaggggc

SEQ ID NO: 760130 - DNA, 21 bp, Homo sapiens
ccgggccacgccccagcccga

SEQ ID NO: 760131 - DNA, 14 bp, Homo sapiens
ccgggccagggctg

SEQ ID NO: 760132 - DNA, 15 bp, Homo sapiens
ccgggccagggctgc

SEQ ID NO: 760133 - DNA, 21 bp, Homo sapiens
ccgggcccctgggcttggcct

SEQ ID NO: 760134 - DNA, 23 bp, Homo sapiens
ccgggcccctgggcttggcctgc

SEQ ID NO: 760135 - DNA, 17 bp, Homo sapiens
ccgggccctcccttgga

SEQ ID NO: 760136 - DNA, 23 bp, Homo sapiens
ccgggccgaatcccctccctgtc

SEQ ID NO: 760137 - DNA, 13 bp, Homo sapiens
ccgggcctgcaca

SEQ ID NO: 760138 - DNA, 14 bp, Homo sapiens
ccgggcgccaggac

SEQ ID NO: 760139 - DNA, 15 bp, Homo sapiens
ccgggcgccaggaca

SEQ ID NO: 760140 - DNA, 19 bp, Homo sapiens
ccgggcgccaggacagcag

SEQ ID NO: 760141 - DNA, 20 bp, Homo sapiens
ccgggcgccaggacagcagc

SEQ ID NO: 760142 - DNA, 14 bp, Homo sapiens
ccgggctctctgct

SEQ ID NO: 760143 - DNA, 16 bp, Homo sapiens
ccgggctgagggcctg

SEQ ID NO: 760144 - DNA, 19 bp, Homo sapiens
ccgggctgcctgcccctgc

SEQ ID NO: 760145 - DNA, 22 bp, Homo sapiens
ccgggctgcctgcccctgctgc

SEQ ID NO: 760146 - DNA, 12 bp, Homo sapiens
ccgggctggccc

SEQ ID NO: 760147 - DNA, 13 bp, Homo sapiens
ccgggctggccct

SEQ ID NO: 760148 - DNA, 17 bp, Homo sapiens
ccgggctggccctgtgc

SEQ ID NO: 760149 - DNA, 19 bp, Homo sapiens
ccgggctggccctgtgcag

SEQ ID NO: 760150 - DNA, 18 bp, Homo sapiens
ccgggctgggagctctgc

SEQ ID NO: 760151 - DNA, 17 bp, Homo sapiens
ccggggactcgcagcac

SEQ ID NO: 760152 - DNA, 15 bp, Homo sapiens
ccggggagctgcaga

SEQ ID NO: 760153 - DNA, 19 bp, Homo sapiens
ccggggcatggacagggcc

SEQ ID NO: 760154 - DNA, 20 bp, Homo sapiens
ccggggcatggacagggcca

SEQ ID NO: 760155 - DNA, 22 bp, Homo sapiens
ccggggcatggacagggccagg

SEQ ID NO: 760156 - DNA, 16 bp, Homo sapiens
ccggggccagagacat

SEQ ID NO: 760157 - DNA, 15 bp, Homo sapiens
ccggggccagcactt

SEQ ID NO: 760158 - DNA, 16 bp, Homo sapiens
ccggggctggcaagca

SEQ ID NO: 760159 - DNA, 21 bp, Homo sapiens
ccgggggacgcctgccctgcc

SEQ ID NO: 760160 - DNA, 15 bp, Homo sapiens
ccgggggagcccagt

SEQ ID NO: 760161 - DNA, 20 bp, Homo sapiens
ccgggggaggggccctcagg

SEQ ID NO: 760162 - DNA, 14 bp, Homo sapiens
ccgtcttcagccta

SEQ ID NO: 760163 - DNA, 15 bp, Homo sapiens
ccgtcttcagcctag

SEQ ID NO: 760164 - DNA, 11 bp, Homo sapiens
ccgtcttcctt

SEQ ID NO: 760165 - DNA, 16 bp, Homo sapiens
ccgtgaagcagtgcct

SEQ ID NO: 760166 - DNA, 18 bp, Homo sapiens
ccgtgacagactcctgag

SEQ ID NO: 760167 - DNA, 15 bp, Homo sapiens
ccgtgcagtacaggc

SEQ ID NO: 760168 - DNA, 14 bp, Homo sapiens
ccgtgcatcccccc

SEQ ID NO: 760169 - DNA, 14 bp, Homo sapiens
ccgtgcatggctcc

SEQ ID NO: 760170 - DNA, 19 bp, Homo sapiens
ccgtgcatggctcctgtct

SEQ ID NO: 760171 - DNA, 20 bp, Homo sapiens
ccgtgccaaccccacccagc

SEQ ID NO: 760172 - DNA, 22 bp, Homo sapiens
ccgtgccaaccccacccagctc

SEQ ID NO: 760173 - DNA, 12 bp, Homo sapiens
ccgtgcccaggg

SEQ ID NO: 760174 - DNA, 12 bp, Homo sapiens
ccgtgcccctgt

SEQ ID NO: 760175 - DNA, 16 bp, Homo sapiens
ccgtgcccctttcctt

SEQ ID NO: 760176 - DNA, 19 bp, Homo sapiens
ccgtgcccctttccttcac

SEQ ID NO: 760177 - DNA, 17 bp, Homo sapiens
ccgtgcccgcaggaact

SEQ ID NO: 760178 - DNA, 14 bp, Homo sapiens
ccgtgcctccacca

SEQ ID NO: 760179 - DNA, 17 bp, Homo sapiens
ccgtgcctccaccacca

SEQ ID NO: 760180 - DNA, 14 bp, Homo sapiens
ccgtgcctgtgtcc

SEQ ID NO: 760181 - DNA, 16 bp, Homo sapiens
ccgtgctcgccccagc

SEQ ID NO: 760182 - DNA, 17 bp, Homo sapiens
ccgtgctcgccccagca

SEQ ID NO: 760183 - DNA, 16 bp, Homo sapiens
ccgtgctgggcagccc

SEQ ID NO: 760184 - DNA, 16 bp, Homo sapiens
ccgtggacaccccaga

SEQ ID NO: 760185 - DNA, 23 bp, Homo sapiens
ccgtggacaccccagacctgcga

SEQ ID NO: 760186 - DNA, 15 bp, Homo sapiens
ccgtggaccacctag

SEQ ID NO: 760187 - DNA, 23 bp, Homo sapiens
ccgtggaccaggaggattgcctt

SEQ ID NO: 760188 - DNA, 16 bp, Homo sapiens
ccgtggaccttcctgc

SEQ ID NO: 760189 - DNA, 19 bp, Homo sapiens
ccgtggactggctcatgcc

SEQ ID NO: 760190 - DNA, 20 bp, Homo sapiens
ccgtggaggaggaaggcaag

SEQ ID NO: 760191 - DNA, 11 bp, Homo sapiens
ccgtggatgcg

SEQ ID NO: 760192 - DNA, 21 bp, Homo sapiens
ccgtggatggccgtggatgcg

SEQ ID NO: 760193 - DNA, 19 bp, Homo sapiens
ccgtggattgcacgtggcc

SEQ ID NO: 760194 - DNA, 20 bp, Homo sapiens
ccgtggattgcacgtggcct

SEQ ID NO: 760195 - DNA, 20 bp, Homo sapiens
ccgtggcacagctgggagcc

SEQ ID NO: 760196 - DNA, 15 bp, Homo sapiens
ccgtggcactgcata

SEQ ID NO: 760197 - DNA, 21 bp, Homo sapiens
ccgtggcctggcatctgtgtg

SEQ ID NO: 760198 - DNA, 14 bp, Homo sapiens
ccgtggcctgggct

SEQ ID NO: 760199 - DNA, 15 bp, Homo sapiens
ccgtggctctgggag

SEQ ID NO: 760200 - DNA, 21 bp, Homo sapiens
ccgtggcttcccgctcagccc

SEQ ID NO: 760201 - DNA, 23 bp, Homo sapiens
ccgtggcttcccgctcagccctc

SEQ ID NO: 760202 - DNA, 23 bp, Homo sapiens
ccgtggcttgggctggtcagagt

SEQ ID NO: 760203 - DNA, 23 bp, Homo sapiens
ccgtgggcgcaaaggtgcctcat

SEQ ID NO: 760204 - DNA, 17 bp, Homo sapiens
ccgtggggccgccgcct

SEQ ID NO: 760205 - DNA, 20 bp, Homo sapiens
ccgtggggccgccgcctctt

SEQ ID NO: 760206 - DNA, 23 bp, Homo sapiens
ccgtgggggaactgacgctggag

SEQ ID NO: 760207 - DNA, 18 bp, Homo sapiens
ccgtggtacccccccttt

SEQ ID NO: 760208 - DNA, 11 bp, Homo sapiens
ccgtggtccaa

SEQ ID NO: 760209 - DNA, 13 bp, Homo sapiens
ccgtggtccctga

SEQ ID NO: 760210 - DNA, 16 bp, Homo sapiens
ccgtggtccctgagga

SEQ ID NO: 760211 - DNA, 23 bp, Homo sapiens
ccgtggtttgaacacgaaagaaa

SEQ ID NO: 760212 - DNA, 11 bp, Homo sapiens
ccgtgtacaat

SEQ ID NO: 760213 - DNA, 17 bp, Homo sapiens
ccgtgtcccaaggagct

SEQ ID NO: 760214 - DNA, 17 bp, Homo sapiens
ccgtgtcccctgacagg

SEQ ID NO: 760215 - DNA, 19 bp, Homo sapiens
ccgtgtcccctgacagggc

SEQ ID NO: 760216 - DNA, 16 bp, Homo sapiens
ccgtgtctctgaggac

SEQ ID NO: 760217 - DNA, 16 bp, Homo sapiens
ccgtgtctgtctggca

SEQ ID NO: 760218 - DNA, 20 bp, Homo sapiens
ccgtgtgaatgtagcttcca

SEQ ID NO: 760219 - DNA, 23 bp, Homo sapiens
ccgtgtgaatgtagcttccacct

SEQ ID NO: 760220 - DNA, 18 bp, Homo sapiens
gagtgggacttggagagc

SEQ ID NO: 760221 - DNA, 19 bp, Homo sapiens
gagtgggacttggagagca

SEQ ID NO: 760222 - DNA, 19 bp, Homo sapiens
gagtgggagaaggcagtga

SEQ ID NO: 760223 - DNA, 19 bp, Homo sapiens
gagtgggagaggctgggag

SEQ ID NO: 760224 - DNA, 15 bp, Homo sapiens
gagtgggcacctcag

SEQ ID NO: 760225 - DNA, 15 bp, Homo sapiens
gagtgggccctgccc

SEQ ID NO: 760226 - DNA, 21 bp, Homo sapiens
gagtgggccctgcccggggag

SEQ ID NO: 760227 - DNA, 19 bp, Homo sapiens
gagtgggggagagcaggct

SEQ ID NO: 760228 - DNA, 16 bp, Homo sapiens
gagtggggggacagag

SEQ ID NO: 760229 - DNA, 13 bp, Homo sapiens
gagtgggtgaata

SEQ ID NO: 760230 - DNA, 15 bp, Homo sapiens
gagtgggttgatttc

SEQ ID NO: 760231 - DNA, 18 bp, Homo sapiens
gagtggtcactggtcagg

SEQ ID NO: 760232 - DNA, 22 bp, Homo sapiens
gagtggtcactggtcagggcag

SEQ ID NO: 760233 - DNA, 15 bp, Homo sapiens
gagtggtgcagacag

SEQ ID NO: 760234 - DNA, 15 bp, Homo sapiens
gagtggttcctgtgg

SEQ ID NO: 760235 - DNA, 17 bp, Homo sapiens
gagtgtaaaatgtatat

SEQ ID NO: 760236 - DNA, 13 bp, Homo sapiens
gagtgtaactttc

SEQ ID NO: 760237 - DNA, 17 bp, Homo sapiens
gagtgtaagtgtgagta

SEQ ID NO: 760238 - DNA, 17 bp, Homo sapiens
gagtgtagactgtggct

SEQ ID NO: 760239 - DNA, 18 bp, Homo sapiens
gagtgtagcctaaagggc

SEQ ID NO: 760240 - DNA, 19 bp, Homo sapiens
gagtgtagcctaaagggca

SEQ ID NO: 760241 - DNA, 15 bp, Homo sapiens
gagtgtagctgtgaa

SEQ ID NO: 760242 - DNA, 16 bp, Homo sapiens
gagtgtagctgtgaaa

SEQ ID NO: 760243 - DNA, 15 bp, Homo sapiens
gagtgtaggtgactt

SEQ ID NO: 760244 - DNA, 13 bp, Homo sapiens
gagtgtatatata

SEQ ID NO: 760245 - DNA, 16 bp, Homo sapiens
gagtgtcctgcccatg

SEQ ID NO: 760246 - DNA, 18 bp, Homo sapiens
gagtgtcctgcccatgcc

SEQ ID NO: 760247 - DNA, 19 bp, Homo sapiens
gagtgtccttagtgtataa

SEQ ID NO: 760248 - DNA, 22 bp, Homo sapiens
gagtgtctttccacggagccac

SEQ ID NO: 760249 - DNA, 14 bp, Homo sapiens
gagtgtgaaatctc

SEQ ID NO: 760250 - DNA, 20 bp, Homo sapiens
gagtgtgaagctttgcacac

SEQ ID NO: 760251 - DNA, 20 bp, Homo sapiens
gagtgtgaatataaatgtgt

SEQ ID NO: 760252 - DNA, 22 bp, Homo sapiens
gagtgtgaatataaatgtgtgt

SEQ ID NO: 760253 - DNA, 14 bp, Homo sapiens
gagtgtgacagggc

SEQ ID NO: 760254 - DNA, 12 bp, Homo sapiens
gagtgtgaccaa

SEQ ID NO: 760255 - DNA, 15 bp, Homo sapiens
gagtgtgagagatgg

SEQ ID NO: 760256 - DNA, 13 bp, Homo sapiens
gagtgtgagcagg

SEQ ID NO: 760257 - DNA, 21 bp, Homo sapiens
gagtgtgcaactggccagcca

SEQ ID NO: 760258 - DNA, 20 bp, Homo sapiens
gagtgtgcagacagccatgc

SEQ ID NO: 760259 - DNA, 17 bp, Homo sapiens
gagtgtgcctgaagtcc

SEQ ID NO: 760260 - DNA, 20 bp, Homo sapiens
gagtgtgcctgaagtcccag

SEQ ID NO: 760261 - DNA, 16 bp, Homo sapiens
gagtgtgtattgttcc

SEQ ID NO: 760262 - DNA, 17 bp, Homo sapiens
gagtgtgtattgttccc

SEQ ID NO: 760263 - DNA, 18 bp, Homo sapiens
gagtgtgtattgttccca

SEQ ID NO: 760264 - DNA, 17 bp, Homo sapiens
gagtgtgtcagagccca

SEQ ID NO: 760265 - DNA, 21 bp, Homo sapiens
gagtgtgtccaagtgtgtgtg

SEQ ID NO: 760266 - DNA, 12 bp, Homo sapiens
gagtgtgtctgc

SEQ ID NO: 760267 - DNA, 15 bp, Homo sapiens
gagtgtgtctgctga

SEQ ID NO: 760268 - DNA, 14 bp, Homo sapiens
gagtgtgtgggcag

SEQ ID NO: 760269 - DNA, 16 bp, Homo sapiens
gagtgtgtgggcaggg

SEQ ID NO: 760270 - DNA, 21 bp, Homo sapiens
gagtgttcattttagtgactg

SEQ ID NO: 760271 - DNA, 23 bp, Homo sapiens
gagtgttctgtgggcttggcctt

SEQ ID NO: 760272 - DNA, 17 bp, Homo sapiens
gagttaaaaagggcagg

SEQ ID NO: 760273 - DNA, 13 bp, Homo sapiens
gagttaagtctat

SEQ ID NO: 760274 - DNA, 19 bp, Homo sapiens
gagttacagcgagaggcag

SEQ ID NO: 760275 - DNA, 23 bp, Homo sapiens
gagttaccattatttaatttgta

SEQ ID NO: 760276 - DNA, 19 bp, Homo sapiens
gagttacttgtctgaggcc

SEQ ID NO: 760277 - DNA, 21 bp, Homo sapiens
gagttacttgtctgaggcctc

SEQ ID NO: 760278 - DNA, 18 bp, Homo sapiens
gagttatatgttcactgt

SEQ ID NO: 760279 - DNA, 14 bp, Homo sapiens
gagttatcaggtgc

SEQ ID NO: 760280 - DNA, 18 bp, Homo sapiens
gagttatctaaaagaaat

SEQ ID NO: 760281 - DNA, 20 bp, Homo sapiens
gagttatcttctttattatt

SEQ ID NO: 760282 - DNA, 22 bp, Homo sapiens
gagttatcttctttattattcc

SEQ ID NO: 760283 - DNA, 17 bp, Homo sapiens
gagttatgatgtaatct

SEQ ID NO: 760284 - DNA, 14 bp, Homo sapiens
cctacttgtgactg

SEQ ID NO: 760285 - DNA, 20 bp, Homo sapiens
cctagaacatccctgggcaa

SEQ ID NO: 760286 - DNA, 13 bp, Homo sapiens
cctagaagaaaac

SEQ ID NO: 760287 - DNA, 14 bp, Homo sapiens
cctagaagaaaacc

SEQ ID NO: 760288 - DNA, 16 bp, Homo sapiens
cctagaagcccctgtc

SEQ ID NO: 760289 - DNA, 22 bp, Homo sapiens
cctagaaggtggggacctgggg

SEQ ID NO: 760290 - DNA, 23 bp, Homo sapiens
cctagaaggtggggacctggggg

SEQ ID NO: 760291 - DNA, 22 bp, Homo sapiens
cctagaataatctcatcccccc

SEQ ID NO: 760292 - DNA, 18 bp, Homo sapiens
cctagaatgtcagatttc

SEQ ID NO: 760293 - DNA, 18 bp, Homo sapiens
cctagaatgtttcatttg

SEQ ID NO: 760294 - DNA, 16 bp, Homo sapiens
cctagaccctccccaa

SEQ ID NO: 760295 - DNA, 13 bp, Homo sapiens
cctagacctcccc

SEQ ID NO: 760296 - DNA, 20 bp, Homo sapiens
cctagactctgtctacctgg

SEQ ID NO: 760297 - DNA, 20 bp, Homo sapiens
cctagacttcccaacagcct

SEQ ID NO: 760298 - DNA, 16 bp, Homo sapiens
cctagagacagaagca

SEQ ID NO: 760299 - DNA, 15 bp, Homo sapiens
cctagagcactctca

SEQ ID NO: 760300 - DNA, 17 bp, Homo sapiens
cctagagcactctcacc

SEQ ID NO: 760301 - DNA, 15 bp, Homo sapiens
cctagagggaggggc

SEQ ID NO: 760302 - DNA, 16 bp, Homo sapiens
cctagagggaggggcc

SEQ ID NO: 760303 - DNA, 18 bp, Homo sapiens
cctagagggaggggccta

SEQ ID NO: 760304 - DNA, 16 bp, Homo sapiens
cctagaggtgggcagc

SEQ ID NO: 760305 - DNA, 22 bp, Homo sapiens
cctagaggtgggcagctgggcc

SEQ ID NO: 760306 - DNA, 21 bp, Homo sapiens
cctagaggttctgggttttct

SEQ ID NO: 760307 - DNA, 13 bp, Homo sapiens
cctagagtgcagg

SEQ ID NO: 760308 - DNA, 20 bp, Homo sapiens
cctagatccacgtgtggcct

SEQ ID NO: 760309 - DNA, 22 bp, Homo sapiens
cctagatgtttaacaaatctaa

SEQ ID NO: 760310 - DNA, 23 bp, Homo sapiens
cctagattaggtagactttgctt

SEQ ID NO: 760311 - DNA, 19 bp, Homo sapiens
cctagcaacatatctctgc

SEQ ID NO: 760312 - DNA, 20 bp, Homo sapiens
cctagcaacatatctctgcc

SEQ ID NO: 760313 - DNA, 15 bp, Homo sapiens
cctagcacagcagct

SEQ ID NO: 760314 - DNA, 20 bp, Homo sapiens
cctagcagcaccgttctgtg

SEQ ID NO: 760315 - DNA, 13 bp, Homo sapiens
cctagcaggctgt

SEQ ID NO: 760316 - DNA, 16 bp, Homo sapiens
cctagcaggctgttcc

SEQ ID NO: 760317 - DNA, 22 bp, Homo sapiens
cctagcatggggtcagccccaa

SEQ ID NO: 760318 - DNA, 21 bp, Homo sapiens
cctagccattcctggtaccca

SEQ ID NO: 760319 - DNA, 12 bp, Homo sapiens
cctagccctccc

SEQ ID NO: 760320 - DNA, 20 bp, Homo sapiens
cctagccctccccccagctc

SEQ ID NO: 760321 - DNA, 21 bp, Homo sapiens
cctagccctccccccagctcc

SEQ ID NO: 760322 - DNA, 20 bp, Homo sapiens
cctagccctctcacatttat

SEQ ID NO: 760323 - DNA, 13 bp, Homo sapiens
cctagccctggga

SEQ ID NO: 760324 - DNA, 15 bp, Homo sapiens
cctagccctgggaca

SEQ ID NO: 760325 - DNA, 15 bp, Homo sapiens
cctagcccttccagc

SEQ ID NO: 760326 - DNA, 21 bp, Homo sapiens
cctagcccttccagcctggga

SEQ ID NO: 760327 - DNA, 18 bp, Homo sapiens
cctagcccttccctgagt

SEQ ID NO: 760328 - DNA, 20 bp, Homo sapiens
cctagcctgtgcctctggga

SEQ ID NO: 760329 - DNA, 10 bp, Homo sapiens
cctagccttg

SEQ ID NO: 760330 - DNA, 15 bp, Homo sapiens
cctagccttgcttgt

SEQ ID NO: 760331 - DNA, 21 bp, Homo sapiens
cctagcgatctctcctggcct

SEQ ID NO: 760332 - DNA, 15 bp, Homo sapiens
cctagctaattattt

SEQ ID NO: 760333 - DNA, 13 bp, Homo sapiens
cctagctcttaca

SEQ ID NO: 760334 - DNA, 21 bp, Homo sapiens
cctagctgaccccgagaagtg

SEQ ID NO: 760335 - DNA, 13 bp, Homo sapiens
cctagctgacgcc

SEQ ID NO: 760336 - DNA, 15 bp, Homo sapiens
cctagctgctgtcac

SEQ ID NO: 760337 - DNA, 14 bp, Homo sapiens
cctagctggctctg

SEQ ID NO: 760338 - DNA, 17 bp, Homo sapiens
cctagctggctctgtga

SEQ ID NO: 760339 - DNA, 21 bp, Homo sapiens
cctagctgtgccccctctggt

SEQ ID NO: 760340 - DNA, 14 bp, Homo sapiens
cctagctgtgtcag

SEQ ID NO: 760341 - DNA, 16 bp, Homo sapiens
cctagctgtgtgaata

SEQ ID NO: 760342 - DNA, 21 bp, Homo sapiens
cctagcttgggaggcttcccc

SEQ ID NO: 760343 - DNA, 22 bp, Homo sapiens
cctagctttatatatggacatg

SEQ ID NO: 760344 - DNA, 17 bp, Homo sapiens
cctaggaaaccagctcg

SEQ ID NO: 760345 - DNA, 16 bp, Homo sapiens
cctaggaaactcacac

SEQ ID NO: 760346 - DNA, 22 bp, Homo sapiens
cctaggaaactcacactcccct

SEQ ID NO: 760347 - DNA, 20 bp, Homo sapiens
cctaggaccactcagcccct

SEQ ID NO: 760348 - DNA, 23 bp, Homo sapiens
cctaggaccactcagcccctagg

SEQ ID NO: 760349 - DNA, 20 bp, Homo sapiens
cctaggacgccaacttctcc

SEQ ID NO: 760350 - DNA, 12 bp, Homo sapiens
cctaggagacca

SEQ ID NO: 760351 - DNA, 13 bp, Homo sapiens
cctaggagagcca

SEQ ID NO: 760352 - DNA, 14 bp, Homo sapiens
cctaggagagccaa

SEQ ID NO: 760353 - DNA, 22 bp, Homo sapiens
gatactgtttcttgcactgaat

SEQ ID NO: 760354 - DNA, 20 bp, Homo sapiens
gatacttaagtgctgcaatt

SEQ ID NO: 760355 - DNA, 19 bp, Homo sapiens
gatacttagtggtatgtct

SEQ ID NO: 760356 - DNA, 17 bp, Homo sapiens
gatacttgttccagatg

SEQ ID NO: 760357 - DNA, 18 bp, Homo sapiens
gatactttgatattttca

SEQ ID NO: 760358 - DNA, 21 bp, Homo sapiens
gatagaaaacagcccccactc

SEQ ID NO: 760359 - DNA, 14 bp, Homo sapiens
gatagaagaactgc

SEQ ID NO: 760360 - DNA, 16 bp, Homo sapiens
gatagaagaactgcaa

SEQ ID NO: 760361 - DNA, 21 bp, Homo sapiens
gatagacacatatgaggggga

SEQ ID NO: 760362 - DNA, 12 bp, Homo sapiens
gatagacactgg

SEQ ID NO: 760363 - DNA, 22 bp, Homo sapiens
gatagacagtgctgccctgcga

SEQ ID NO: 760364 - DNA, 13 bp, Homo sapiens
gatagacttggga

SEQ ID NO: 760365 - DNA, 14 bp, Homo sapiens
gatagagctgggtg

SEQ ID NO: 760366 - DNA, 15 bp, Homo sapiens
gatagagctgggtgg

SEQ ID NO: 760367 - DNA, 15 bp, Homo sapiens
gatagaggaaaggga

SEQ ID NO: 760368 - DNA, 13 bp, Homo sapiens
gatagagttccat

SEQ ID NO: 760369 - DNA, 16 bp, Homo sapiens
gatagatttggaatag

SEQ ID NO: 760370 - DNA, 12 bp, Homo sapiens
gatagcactttc

SEQ ID NO: 760371 - DNA, 22 bp, Homo sapiens
gatagcattgttttcttttaca

SEQ ID NO: 760372 - DNA, 23 bp, Homo sapiens
gatagcatttttgatttatgcat

SEQ ID NO: 760373 - DNA, 20 bp, Homo sapiens
gatagcccagaacaaaaaga

SEQ ID NO: 760374 - DNA, 23 bp, Homo sapiens
gatagcccagaacaaaaagaaat

SEQ ID NO: 760375 - DNA, 15 bp, Homo sapiens
gatagcccaggagca

SEQ ID NO: 760376 - DNA, 16 bp, Homo sapiens
gatagccctgtcctgg

SEQ ID NO: 760377 - DNA, 21 bp, Homo sapiens
gatagccctgtcctggtggta

SEQ ID NO: 760378 - DNA, 19 bp, Homo sapiens
gatagctgcatgtggcttt

SEQ ID NO: 760379 - DNA, 13 bp, Homo sapiens
gatagctggggct

SEQ ID NO: 760380 - DNA, 14 bp, Homo sapiens
gatagctggggctt

SEQ ID NO: 760381 - DNA, 15 bp, Homo sapiens
gatagcttacactga

SEQ ID NO: 760382 - DNA, 17 bp, Homo sapiens
gatagcttacactgagg

SEQ ID NO: 760383 - DNA, 17 bp, Homo sapiens
gataggaccttgggcca

SEQ ID NO: 760384 - DNA, 21 bp, Homo sapiens
gataggactccatttctttct

SEQ ID NO: 760385 - DNA, 22 bp, Homo sapiens
gataggactccatttctttctt

SEQ ID NO: 760386 - DNA, 17 bp, Homo sapiens
gataggagggggcggca

SEQ ID NO: 760387 - DNA, 23 bp, Homo sapiens
gataggagttctctgatgcagaa

SEQ ID NO: 760388 - DNA, 23 bp, Homo sapiens
gataggcaggaacatacagacac

SEQ ID NO: 760389 - DNA, 15 bp, Homo sapiens
gataggcccaaggtc

SEQ ID NO: 760390 - DNA, 21 bp, Homo sapiens
gataggcccaaggtcccctcc

SEQ ID NO: 760391 - DNA, 23 bp, Homo sapiens
gataggcctgtgggccagattgc

SEQ ID NO: 760392 - DNA, 23 bp, Homo sapiens
gatagtcttggaagctgtttgga

SEQ ID NO: 760393 - DNA, 23 bp, Homo sapiens
gatagtggggagacttcttggct

SEQ ID NO: 760394 - DNA, 15 bp, Homo sapiens
gatataaaaacagat

SEQ ID NO: 760395 - DNA, 20 bp, Homo sapiens
gatataaaactctgggtctt

SEQ ID NO: 760396 - DNA, 20 bp, Homo sapiens
gatataaaaggatgttacaa

SEQ ID NO: 760397 - DNA, 21 bp, Homo sapiens
gatataaaaggatgttacaag

SEQ ID NO: 760398 - DNA, 19 bp, Homo sapiens
gatataacattcagttccc

SEQ ID NO: 760399 - DNA, 15 bp, Homo sapiens
gatataactgtcttg

SEQ ID NO: 760400 - DNA, 20 bp, Homo sapiens
gatataactgtcttgtttca

SEQ ID NO: 760401 - DNA, 15 bp, Homo sapiens
gatataagagaagtc

SEQ ID NO: 760402 - DNA, 16 bp, Homo sapiens
gatataagagaagtct

SEQ ID NO: 760403 - DNA, 14 bp, Homo sapiens
gatataagctttta

SEQ ID NO: 760404 - DNA, 18 bp, Homo sapiens
gatataatcttggcttct

SEQ ID NO: 760405 - DNA, 14 bp, Homo sapiens
gatcaccagcccgg

SEQ ID NO: 760406 - DNA, 15 bp, Homo sapiens
gatcaccatgttagc

SEQ ID NO: 760407 - DNA, 17 bp, Homo sapiens
gatcaccatgttagcct

SEQ ID NO: 760408 - DNA, 18 bp, Homo sapiens
gatcaccatgttagcctt

SEQ ID NO: 760409 - DNA, 19 bp, Homo sapiens
gatcaccatgttagcctta

SEQ ID NO: 760410 - DNA, 15 bp, Homo sapiens
gatcaccattatatt

SEQ ID NO: 760411 - DNA, 17 bp, Homo sapiens
gatcacccactcctatg

SEQ ID NO: 760412 - DNA, 23 bp, Homo sapiens
gatcaccgactgaaaatattgtt

SEQ ID NO: 760413 - DNA, 18 bp, Homo sapiens
gatcactatgcattttaa

SEQ ID NO: 760414 - DNA, 13 bp, Homo sapiens
gatcactgagcca

SEQ ID NO: 760415 - DNA, 12 bp, Homo sapiens
gatcactggagc

SEQ ID NO: 760416 - DNA, 18 bp, Homo sapiens
gatcactggagcccagga

SEQ ID NO: 760417 - DNA, 16 bp, Homo sapiens
gatcagaaagtgacat

SEQ ID NO: 760418 - DNA, 20 bp, Homo sapiens
gatcagacatacagctgcct

SEQ ID NO: 760419 - DNA, 20 bp, Homo sapiens
gatcagaccaaacagtgctg

SEQ ID NO: 760420 - DNA, 16 bp, Homo sapiens
gatcagaccataatgt

SEQ ID NO: 760421 - DNA, 23 bp, Homo sapiens
gatcagagcaggacctcccttcc

SEQ ID NO: 760422 - DNA, 16 bp, Homo sapiens
gatcagagccgtggtc

SEQ ID NO: 760423 - DNA, 15 bp, Homo sapiens
gatcagaggagtaaa

SEQ ID NO: 760424 - DNA, 16 bp, Homo sapiens
gatcagatgctgaatt

SEQ ID NO: 760425 - DNA, 20 bp, Homo sapiens
gatcagatgctgaattgaga

SEQ ID NO: 760426 - DNA, 14 bp, Homo sapiens
gatcagcatctgtg

SEQ ID NO: 760427 - DNA, 21 bp, Homo sapiens
gatcagccattaaaataaaac

SEQ ID NO: 760428 - DNA, 21 bp, Homo sapiens
gatcagccccaccctggccta

SEQ ID NO: 760429 - DNA, 17 bp, Homo sapiens
gatcagctgtttgtcat

SEQ ID NO: 760430 - DNA, 18 bp, Homo sapiens
gatcaggaaccagggcct

SEQ ID NO: 760431 - DNA, 12 bp, Homo sapiens
gatcaggagccc

SEQ ID NO: 760432 - DNA, 23 bp, Homo sapiens
gatcaggctgctggaaacacagt

SEQ ID NO: 760433 - DNA, 19 bp, Homo sapiens
gatcaggtaccaaggaaat

SEQ ID NO: 760434 - DNA, 20 bp, Homo sapiens
gatcaggttatactttaggt

SEQ ID NO: 760435 - DNA, 13 bp, Homo sapiens
gatcaggtttgcc

SEQ ID NO: 760436 - DNA, 23 bp, Homo sapiens
gatcagtaaaattatactgtgtg

SEQ ID NO: 760437 - DNA, 14 bp, Homo sapiens
gatcagtatttcac

SEQ ID NO: 760438 - DNA, 15 bp, Homo sapiens
gatcagtccaactga

SEQ ID NO: 760439 - DNA, 22 bp, Homo sapiens
gatcatagctcactgtaacctc

SEQ ID NO: 760440 - DNA, 18 bp, Homo sapiens
gatcataggaagtggctg

SEQ ID NO: 760441 - DNA, 22 bp, Homo sapiens
gatcataggaagtggctggtct

SEQ ID NO: 760442 - DNA, 23 bp, Homo sapiens
gatcataggaagtggctggtctg

SEQ ID NO: 760443 - DNA, 22 bp, Homo sapiens
gatcatatggagctcatgtcag

SEQ ID NO: 760444 - DNA, 16 bp, Homo sapiens
gatcatccaggcctca

SEQ ID NO: 760445 - DNA, 13 bp, Homo sapiens
gatcatccctttc

SEQ ID NO: 760446 - DNA, 14 bp, Homo sapiens
gatcatcgccagag

SEQ ID NO: 760447 - DNA, 21 bp, Homo sapiens
gatcatcgccagaggtgcttc

SEQ ID NO: 760448 - DNA, 23 bp, Homo sapiens
gatcatcgccagaggtgcttcac

SEQ ID NO: 760449 - DNA, 19 bp, Homo sapiens
gatcatgtactttttagta

SEQ ID NO: 760450 - DNA, 14 bp, Homo sapiens
gatcattgcatttc

SEQ ID NO: 760451 - DNA, 13 bp, Homo sapiens
gatcatttctgcc

SEQ ID NO: 760452 - DNA, 21 bp, Homo sapiens
gatcatttgcccttaaggaca

SEQ ID NO: 760453 - DNA, 19 bp, Homo sapiens
gatcattttccccccactc

SEQ ID NO: 760454 - DNA, 23 bp, Homo sapiens
gatcattttccccccactctccc

SEQ ID NO: 760455 - DNA, 19 bp, Homo sapiens
gatcatttttccaggactc

SEQ ID NO: 760456 - DNA, 19 bp, Homo sapiens
gatccaactaatgccttac

SEQ ID NO: 760457 - DNA, 23 bp, Homo sapiens
gatccaaggccgcggcccagacc

SEQ ID NO: 760458 - DNA, 14 bp, Homo sapiens
gatccacacacaga

SEQ ID NO: 760459 - DNA, 16 bp, Homo sapiens
gatccacacacagagg

SEQ ID NO: 760460 - DNA, 18 bp, Homo sapiens
gatccacacacagaggaa

SEQ ID NO: 760461 - DNA, 17 bp, Homo sapiens
gatccacccaaccctat

SEQ ID NO: 760462 - DNA, 14 bp, Homo sapiens
gatccacccacctc

SEQ ID NO: 760463 - DNA, 19 bp, Homo sapiens
gatccacccacctcggcct

SEQ ID NO: 760464 - DNA, 19 bp, Homo sapiens
gatccacgtgtggcctccg

SEQ ID NO: 760465 - DNA, 13 bp, Homo sapiens
gatccagaagagc

SEQ ID NO: 760466 - DNA, 21 bp, Homo sapiens
gatccagactgtaagatgttg

SEQ ID NO: 760467 - DNA, 14 bp, Homo sapiens
gatccagagagcag

SEQ ID NO: 760468 - DNA, 18 bp, Homo sapiens
gatccagatccagactgt

SEQ ID NO: 760469 - DNA, 17 bp, Homo sapiens
gatccagccctggttct

SEQ ID NO: 760470 - DNA, 22 bp, Homo sapiens
gatccagccctggttctggctg

SEQ ID NO: 760471 - DNA, 23 bp, Homo sapiens
gatccagccctggttctggctgt

SEQ ID NO: 760472 - DNA, 15 bp, Homo sapiens
gatccagtgacatga

SEQ ID NO: 760473 - DNA, 14 bp, Homo sapiens
gatccagtgtataa

SEQ ID NO: 760474 - DNA, 22 bp, Homo sapiens
gatccagtgtataaatccaata

SEQ ID NO: 760475 - DNA, 15 bp, Homo sapiens
gatccatccatctcc

SEQ ID NO: 760476 - DNA, 16 bp, Homo sapiens
gatccatccatctcca

SEQ ID NO: 760477 - DNA, 16 bp, Homo sapiens
gatccatgtagcagga

SEQ ID NO: 760478 - DNA, 19 bp, Homo sapiens
gatccatgtagcaggactg

SEQ ID NO: 760479 - DNA, 19 bp, Homo sapiens
gatccattaatttaaatga

SEQ ID NO: 760480 - DNA, 22 bp, Homo sapiens
gatcccaccccattttctgtgg

SEQ ID NO: 760481 - DNA, 22 bp, Homo sapiens
gatcccagcacctattgaatta

SEQ ID NO: 760482 - DNA, 17 bp, Homo sapiens
cctcaaagggcagtttt

SEQ ID NO: 760483 - DNA, 18 bp, Homo sapiens
cctcaaatcagtcttcct

SEQ ID NO: 760484 - DNA, 15 bp, Homo sapiens
cctcaaatcgtccag

SEQ ID NO: 760485 - DNA, 19 bp, Homo sapiens
cctcaaatgacccaaagac

SEQ ID NO: 760486 - DNA, 17 bp, Homo sapiens
cctcaaattttttgact

SEQ ID NO: 760487 - DNA, 16 bp, Homo sapiens
cctcaacaagggagag

SEQ ID NO: 760488 - DNA, 22 bp, Homo sapiens
cctcaacaagggagagacctca

SEQ ID NO: 760489 - DNA, 14 bp, Homo sapiens
cctcaacaccctgc

SEQ ID NO: 760490 - DNA, 15 bp, Homo sapiens
cctcaacaccctgct

SEQ ID NO: 760491 - DNA, 20 bp, Homo sapiens
cctcaacaccctgcttctcc

SEQ ID NO: 760492 - DNA, 16 bp, Homo sapiens
cctcaacacctctgca

SEQ ID NO: 760493 - DNA, 15 bp, Homo sapiens
cctcaacctcctggg

SEQ ID NO: 760494 - DNA, 19 bp, Homo sapiens
cctcaacgttgctccccat

SEQ ID NO: 760495 - DNA, 16 bp, Homo sapiens
cctcaactaaccctta

SEQ ID NO: 760496 - DNA, 16 bp, Homo sapiens
cctcaagaaataaaag

SEQ ID NO: 760497 - DNA, 18 bp, Homo sapiens
cctcaagccaatcccctc

SEQ ID NO: 760498 - DNA, 22 bp, Homo sapiens
cctcaaggacttgaaagcatcc

SEQ ID NO: 760499 - DNA, 23 bp, Homo sapiens
cctcaaggacttgaaagcatcca

SEQ ID NO: 760500 - DNA, 22 bp, Homo sapiens
cctcaaggccctcggagctggc

SEQ ID NO: 760501 - DNA, 16 bp, Homo sapiens
cctcaagttccatgct

SEQ ID NO: 760502 - DNA, 22 bp, Homo sapiens
cctcaagttcttggaccagttt

SEQ ID NO: 760503 - DNA, 13 bp, Homo sapiens
cctcaatccagct

SEQ ID NO: 760504 - DNA, 23 bp, Homo sapiens
cctcaatgctgggccctcttatc

SEQ ID NO: 760505 - DNA, 16 bp, Homo sapiens
cctcaatggaggtttg

SEQ ID NO: 760506 - DNA, 16 bp, Homo sapiens
cctcaatgtgaccagg

SEQ ID NO: 760507 - DNA, 16 bp, Homo sapiens
cctcaatttctgaaca

SEQ ID NO: 760508 - DNA, 19 bp, Homo sapiens
cctcaatttttgtctcaga

SEQ ID NO: 760509 - DNA, 15 bp, Homo sapiens
cctcacaagcctctt

SEQ ID NO: 760510 - DNA, 16 bp, Homo sapiens
cctcacacacacagct

SEQ ID NO: 760511 - DNA, 21 bp, Homo sapiens
cctcacacacacagctgggca

SEQ ID NO: 760512 - DNA, 23 bp, Homo sapiens
cctcacacaccctgaggtcaggg

SEQ ID NO: 760513 - DNA, 21 bp, Homo sapiens
cctcacacccctgtcccaccc

SEQ ID NO: 760514 - DNA, 18 bp, Homo sapiens
cctcacactgctgtcctc

SEQ ID NO: 760515 - DNA, 19 bp, Homo sapiens
cctcacagacctctgcttg

SEQ ID NO: 760516 - DNA, 17 bp, Homo sapiens
cctcacatcctctccag

SEQ ID NO: 760517 - DNA, 13 bp, Homo sapiens
cctcaccaaacta

SEQ ID NO: 760518 - DNA, 20 bp, Homo sapiens
cctcaccacacccaggtctc

SEQ ID NO: 760519 - DNA, 15 bp, Homo sapiens
cctcaccaccacact

SEQ ID NO: 760520 - DNA, 12 bp, Homo sapiens
cctcaccacccc

SEQ ID NO: 760521 - DNA, 16 bp, Homo sapiens
cctcaccattgtgaag

SEQ ID NO: 760522 - DNA, 15 bp, Homo sapiens
cctcacccaccatgg

SEQ ID NO: 760523 - DNA, 23 bp, Homo sapiens
cctcacccaccatggaccagccc

SEQ ID NO: 760524 - DNA, 15 bp, Homo sapiens
cctcacccagatcag

SEQ ID NO: 760525 - DNA, 15 bp, Homo sapiens
cctcaccccaatccc

SEQ ID NO: 760526 - DNA, 15 bp, Homo sapiens
cctcaggccattccc

SEQ ID NO: 760527 - DNA, 21 bp, Homo sapiens
cctcaggccattccccaacgg

SEQ ID NO: 760528 - DNA, 12 bp, Homo sapiens
cctcaggctccc

SEQ ID NO: 760529 - DNA, 20 bp, Homo sapiens
cctcaggctccccagaactg

SEQ ID NO: 760530 - DNA, 19 bp, Homo sapiens
cctcaggcttgagggaggg

SEQ ID NO: 760531 - DNA, 20 bp, Homo sapiens
cctcaggcttgagggagggc

SEQ ID NO: 760532 - DNA, 20 bp, Homo sapiens
cctcagggacagagacacct

SEQ ID NO: 760533 - DNA, 21 bp, Homo sapiens
cctcagggacagagacacctg

SEQ ID NO: 760534 - DNA, 22 bp, Homo sapiens
cctcagggagcagggaaggcct

SEQ ID NO: 760535 - DNA, 15 bp, Homo sapiens
cctcagggagcctcc

SEQ ID NO: 760536 - DNA, 22 bp, Homo sapiens
cctcagggagcgatccagggga

SEQ ID NO: 760537 - DNA, 21 bp, Homo sapiens
cctcagggcacgcaggaccag

SEQ ID NO: 760538 - DNA, 22 bp, Homo sapiens
cctcagggcacgcaggaccagt

SEQ ID NO: 760539 - DNA, 19 bp, Homo sapiens
cctcagggctcagtctttt

SEQ ID NO: 760540 - DNA, 14 bp, Homo sapiens
cctcagggctccca

SEQ ID NO: 760541 - DNA, 14 bp, Homo sapiens
cctcagggctgtcc

SEQ ID NO: 760542 - DNA, 22 bp, Homo sapiens
cctcagggctgtcccagccccg

SEQ ID NO: 760543 - DNA, 12 bp, Homo sapiens
cctcaggggcaa

SEQ ID NO: 760544 - DNA, 15 bp, Homo sapiens
cctcaggggcacctc

SEQ ID NO: 760545 - DNA, 22 bp, Homo sapiens
cctcaggggcaggtggtggagg

SEQ ID NO: 760546 - DNA, 20 bp, Homo sapiens
cctcaggggcctctctcctg

SEQ ID NO: 760547 - DNA, 19 bp, Homo sapiens
cctcagggggccagctggg

SEQ ID NO: 760548 - DNA, 23 bp, Homo sapiens
cctcagggggtaggagagcactg

SEQ ID NO: 760549 - DNA, 17 bp, Homo sapiens
cctcaggggtggagaag

SEQ ID NO: 760550 - DNA, 14 bp, Homo sapiens
cctcagggtcctgc

SEQ ID NO: 760551 - DNA, 23 bp, Homo sapiens
cctcagggtcctgccctccggag

SEQ ID NO: 760552 - DNA, 18 bp, Homo sapiens
cctcagggtctaaggagc

SEQ ID NO: 760553 - DNA, 19 bp, Homo sapiens
cctcagggtggggggtgac

SEQ ID NO: 760554 - DNA, 22 bp, Homo sapiens
cctcaggtacagcgggctgtgc

SEQ ID NO: 760555 - DNA, 12 bp, Homo sapiens
cctcaggtcagc

SEQ ID NO: 760556 - DNA, 13 bp, Homo sapiens
cctcaggtcagct

SEQ ID NO: 760557 - DNA, 16 bp, Homo sapiens
cctcaggtcagctggg

SEQ ID NO: 760558 - DNA, 18 bp, Homo sapiens
cctcaggtcagctgggag

SEQ ID NO: 760559 - DNA, 19 bp, Homo sapiens
cctcaggtcagctgggagc

SEQ ID NO: 760560 - DNA, 20 bp, Homo sapiens
cctcaggtcagctgggagcc

SEQ ID NO: 760561 - DNA, 17 bp, Homo sapiens
cctcaggtgagaagcag

SEQ ID NO: 760562 - DNA, 22 bp, Homo sapiens
cctcaggtgagaagcagaggaa

SEQ ID NO: 760563 - DNA, 14 bp, Homo sapiens
cctcaggtgcctcc

SEQ ID NO: 760564 - DNA, 14 bp, Homo sapiens
cctcaggtgctgtc

SEQ ID NO: 760565 - DNA, 11 bp, Homo sapiens
cctcaggtggc

SEQ ID NO: 760566 - DNA, 15 bp, Homo sapiens
cctcaggtgtagctg

SEQ ID NO: 760567 - DNA, 19 bp, Homo sapiens
cctcagtagtccctgcaca

SEQ ID NO: 760568 - DNA, 15 bp, Homo sapiens
cctcagtatatttaa

SEQ ID NO: 760569 - DNA, 14 bp, Homo sapiens
cctcagtatttatg

SEQ ID NO: 760570 - DNA, 14 bp, Homo sapiens
cctcagtcaccccc

SEQ ID NO: 760571 - DNA, 19 bp, Homo sapiens
cctcagtcacccccacttc

SEQ ID NO: 760572 - DNA, 19 bp, Homo sapiens
cctcagtcaggcactggct

SEQ ID NO: 760573 - DNA, 21 bp, Homo sapiens
cctcagtcaggcactggctga

SEQ ID NO: 760574 - DNA, 13 bp, Homo sapiens
cctcagtgccact

SEQ ID NO: 760575 - DNA, 16 bp, Homo sapiens
cctcagtgccacttga

SEQ ID NO: 760576 - DNA, 23 bp, Homo sapiens
cctcagtgccacttgacattcct

SEQ ID NO: 760577 - DNA, 16 bp, Homo sapiens
cctcagtggatcttca

SEQ ID NO: 760578 - DNA, 14 bp, Homo sapiens
cctcagtgggaaga

SEQ ID NO: 760579 - DNA, 13 bp, Homo sapiens
cctcagtgtattt

SEQ ID NO: 760580 - DNA, 12 bp, Homo sapiens
cctcagtgtcat

SEQ ID NO: 760581 - DNA, 15 bp, Homo sapiens
cctcagttcaacctg

SEQ ID NO: 760582 - DNA, 16 bp, Homo sapiens
cctcagttcaacctgg

SEQ ID NO: 760583 - DNA, 22 bp, Homo sapiens
cctcagttcaacctggtggcac

SEQ ID NO: 760584 - DNA, 18 bp, Homo sapiens
cctcagttcccttggcct

SEQ ID NO: 760585 - DNA, 18 bp, Homo sapiens
cctcagttgtcctgccct

SEQ ID NO: 760586 - DNA, 19 bp, Homo sapiens
cctcagtttctccatcagc

SEQ ID NO: 760587 - DNA, 19 bp, Homo sapiens
cctcagtttggtagtgccc

SEQ ID NO: 760588 - DNA, 19 bp, Homo sapiens
cctcagttttatcattttc

SEQ ID NO: 760589 - DNA, 15 bp, Homo sapiens
cctcagttttccttc

SEQ ID NO: 760590 - DNA, 20 bp, Homo sapiens
cctcatatgcaatttgggat

SEQ ID NO: 760591 - DNA, 13 bp, Homo sapiens
cctcatcactgga

SEQ ID NO: 760592 - DNA, 17 bp, Homo sapiens
cctcatcactggactgc

SEQ ID NO: 760593 - DNA, 13 bp, Homo sapiens
cctcatcaggatg

SEQ ID NO: 760594 - DNA, 14 bp, Homo sapiens
cctcatcaggatga

SEQ ID NO: 760595 - DNA, 21 bp, Homo sapiens
cctcatcaggatgaacccagg

SEQ ID NO: 760596 - DNA, 15 bp, Homo sapiens
cctcatcatcagagc

SEQ ID NO: 760597 - DNA, 13 bp, Homo sapiens
cctcatcatccac

SEQ ID NO: 760598 - DNA, 14 bp, Homo sapiens
cctcatcatccacc

SEQ ID NO: 760599 - DNA, 17 bp, Homo sapiens
cctcatcatccacccgc

SEQ ID NO: 760600 - DNA, 18 bp, Homo sapiens
cctcatcatccacccgct

SEQ ID NO: 760601 - DNA, 22 bp, Homo sapiens
cctcatccaccccatccctccc

SEQ ID NO: 760602 - DNA, 18 bp, Homo sapiens
cctcatccatgcacttta

SEQ ID NO: 760603 - DNA, 19 bp, Homo sapiens
cctcatcccacttcctttc

SEQ ID NO: 760604 - DNA, 21 bp, Homo sapiens
cctcatcccacttcctttcct

SEQ ID NO: 760605 - DNA, 18 bp, Homo sapiens
cctcatcccctcgtcctg

SEQ ID NO: 760606 - DNA, 14 bp, Homo sapiens
cctcatcctgcttc

SEQ ID NO: 760607 - DNA, 19 bp, Homo sapiens
cctcatcctgcttctcttt

SEQ ID NO: 760608 - DNA, 16 bp, Homo sapiens
cctcatcctttccctc

SEQ ID NO: 760609 - DNA, 21 bp, Homo sapiens
cctcatcctttccctctccca

SEQ ID NO: 760610 - DNA, 11 bp, Homo sapiens
cctcatctagg

SEQ ID NO: 760611 - DNA, 17 bp, Homo sapiens
gatctggggggtgggga

SEQ ID NO: 760612 - DNA, 15 bp, Homo sapiens
gatctggtcctaccc

SEQ ID NO: 760613 - DNA, 20 bp, Homo sapiens
gatctggtggtcagccctag

SEQ ID NO: 760614 - DNA, 15 bp, Homo sapiens
gatctgtactttgtg

SEQ ID NO: 760615 - DNA, 23 bp, Homo sapiens
gatctgtatctagaaagagatca

SEQ ID NO: 760616 - DNA, 20 bp, Homo sapiens
gatctgtatttaatggtttt

SEQ ID NO: 760617 - DNA, 17 bp, Homo sapiens
gatctgtcccttaataa

SEQ ID NO: 760618 - DNA, 14 bp, Homo sapiens
gatctgtcttggca

SEQ ID NO: 760619 - DNA, 21 bp, Homo sapiens
gatctgtgatagttcaccccc

SEQ ID NO: 760620 - DNA, 17 bp, Homo sapiens
gatctgtgatttcttct

SEQ ID NO: 760621 - DNA, 13 bp, Homo sapiens
gatctgtgcccca

SEQ ID NO: 760622 - DNA, 13 bp, Homo sapiens
gatctgtgcctgg

SEQ ID NO: 760623 - DNA, 17 bp, Homo sapiens
gatctgtgcctgggatc

SEQ ID NO: 760624 - DNA, 22 bp, Homo sapiens
gatctgttaaaaaagaaatctg

SEQ ID NO: 760625 - DNA, 18 bp, Homo sapiens
gatctgttttgaaggcaa

SEQ ID NO: 760626 - DNA, 20 bp, Homo sapiens
gatctgttttgaaggcaaaa

SEQ ID NO: 760627 - DNA, 15 bp, Homo sapiens
gatcttaatataaat

SEQ ID NO: 760628 - DNA, 17 bp, Homo sapiens
gatcttaggcatgtgct

SEQ ID NO: 760629 - DNA, 20 bp, Homo sapiens
gatcttaggcatgtgctggt

SEQ ID NO: 760630 - DNA, 16 bp, Homo sapiens
gatcttcaatggcttt

SEQ ID NO: 760631 - DNA, 18 bp, Homo sapiens
gatcttccttccgctctg

SEQ ID NO: 760632 - DNA, 19 bp, Homo sapiens
gatcttctatcattccaat

SEQ ID NO: 760633 - DNA, 12 bp, Homo sapiens
gatcttctgaaa

SEQ ID NO: 760634 - DNA, 15 bp, Homo sapiens
gatcttctgaaatga

SEQ ID NO: 760635 - DNA, 16 bp, Homo sapiens
gatcttctgaaatgaa

SEQ ID NO: 760636 - DNA, 18 bp, Homo sapiens
gatcttctgaaatgaaac

SEQ ID NO: 760637 - DNA, 22 bp, Homo sapiens
gatcttcttcatccaacttcca

SEQ ID NO: 760638 - DNA, 22 bp, Homo sapiens
gatcttgaatgtggtctcagga

SEQ ID NO: 760639 - DNA, 18 bp, Homo sapiens
gatcttgcctgtctggct

SEQ ID NO: 760640 - DNA, 19 bp, Homo sapiens
gatcttggcttactgcagc

SEQ ID NO: 760641 - DNA, 15 bp, Homo sapiens
gatcttgtgctcagc

SEQ ID NO: 760642 - DNA, 17 bp, Homo sapiens
gatcttgtgctcagcat

SEQ ID NO: 760643 - DNA, 15 bp, Homo sapiens
gatctttactcttga

SEQ ID NO: 760644 - DNA, 15 bp, Homo sapiens
gatctttcaggaaag

SEQ ID NO: 760645 - DNA, 17 bp, Homo sapiens
gatctttctcttccctg

SEQ ID NO: 760646 - DNA, 18 bp, Homo sapiens
gatctttctcttccctga

SEQ ID NO: 760647 - DNA, 19 bp, Homo sapiens
gatctttctttccaaaaca

SEQ ID NO: 760648 - DNA, 18 bp, Homo sapiens
gatgcccccaggcagcca

SEQ ID NO: 760649 - DNA, 19 bp, Homo sapiens
gatgccccctccaggagag

SEQ ID NO: 760650 - DNA, 20 bp, Homo sapiens
gatgccccctccaggagaga

SEQ ID NO: 760651 - DNA, 21 bp, Homo sapiens
gatgccccgtccccctctggc

SEQ ID NO: 760652 - DNA, 13 bp, Homo sapiens
gatgcccctgaca

SEQ ID NO: 760653 - DNA, 22 bp, Homo sapiens
gatgccccttctccccttcctg

SEQ ID NO: 760654 - DNA, 18 bp, Homo sapiens
gatgccctggaggtggct

SEQ ID NO: 760655 - DNA, 21 bp, Homo sapiens
gatgccctttggaaagccatt

SEQ ID NO: 760656 - DNA, 19 bp, Homo sapiens
gatgccgaacattaggaat

SEQ ID NO: 760657 - DNA, 22 bp, Homo sapiens
gatgccgaacattaggaattgt

SEQ ID NO: 760658 - DNA, 20 bp, Homo sapiens
gatgccgggcgccaggacag

SEQ ID NO: 760659 - DNA, 16 bp, Homo sapiens
gatgccgtcctgctgg

SEQ ID NO: 760660 - DNA, 22 bp, Homo sapiens
gatgcctcaccacacccaggtc

SEQ ID NO: 760661 - DNA, 16 bp, Homo sapiens
gatgcctcctgtcaga

SEQ ID NO: 760662 - DNA, 16 bp, Homo sapiens
gatgcctggcctgcca

SEQ ID NO: 760663 - DNA, 14 bp, Homo sapiens
gatgcctgttaatt

SEQ ID NO: 760664 - DNA, 12 bp, Homo sapiens
gatgccttcccc

SEQ ID NO: 760665 - DNA, 15 bp, Homo sapiens
gatgcctttgctgtt

SEQ ID NO: 760666 - DNA, 15 bp, Homo sapiens
gatgcgagcttggcc

SEQ ID NO: 760667 - DNA, 17 bp, Homo sapiens
gatgcgagcttggcctt

SEQ ID NO: 760668 - DNA, 13 bp, Homo sapiens
gatgcgccttgct

SEQ ID NO: 760669 - DNA, 18 bp, Homo sapiens
gatgcggctttctctgcc

SEQ ID NO: 760670 - DNA, 19 bp, Homo sapiens
gatgcggctttctctgcct

SEQ ID NO: 760671 - DNA, 20 bp, Homo sapiens
gatgcggctttctctgcctc

SEQ ID NO: 760672 - DNA, 14 bp, Homo sapiens
gatgcgtattctgt

SEQ ID NO: 760673 - DNA, 19 bp, Homo sapiens
gatgcgtattctgtggccg

SEQ ID NO: 760674 - DNA, 15 bp, Homo sapiens
gatgcgtgggaggca

SEQ ID NO: 760675 - DNA, 17 bp, Homo sapiens
gatgcgtgggaggcaga

SEQ ID NO: 760676 - DNA, 13 bp, Homo sapiens
gatgctaatttat

SEQ ID NO: 760677 - DNA, 15 bp, Homo sapiens
gatgctatgaaattg

SEQ ID NO: 760678 - DNA, 22 bp, Homo sapiens
gatgctccagccaacccctgtg

SEQ ID NO: 760679 - DNA, 19 bp, Homo sapiens
gatgctccagggcagcctc

SEQ ID NO: 760680 - DNA, 15 bp, Homo sapiens
gatgctccctcccct

SEQ ID NO: 760681 - DNA, 15 bp, Homo sapiens
gatgctcctccgggt

SEQ ID NO: 760682 - DNA, 21 bp, Homo sapiens
gatgctccttgggccctttga

SEQ ID NO: 760683 - DNA, 14 bp, Homo sapiens
gatgctctggcttg

SEQ ID NO: 760684 - DNA, 20 bp, Homo sapiens
gatgctctggcttgccccag

SEQ ID NO: 760685 - DNA, 22 bp, Homo sapiens
gatgctctggcttgccccagga

SEQ ID NO: 760686 - DNA, 23 bp, Homo sapiens
gatgctctggcttgccccaggac

SEQ ID NO: 760687 - DNA, 16 bp, Homo sapiens
gatgctgacccaggaa

SEQ ID NO: 760688 - DNA, 19 bp, Homo sapiens
gatgctgccccgttccctg

SEQ ID NO: 760689 - DNA, 14 bp, Homo sapiens
gatgctgcctgagt

SEQ ID NO: 760690 - DNA, 13 bp, Homo sapiens
gatgctgctgaag

SEQ ID NO: 760691 - DNA, 14 bp, Homo sapiens
gatgctggagaggt

SEQ ID NO: 760692 - DNA, 19 bp, Homo sapiens
gatgctgggagttctaaca

SEQ ID NO: 760693 - DNA, 21 bp, Homo sapiens
gatgctgggcacttcatctga

SEQ ID NO: 760694 - DNA, 12 bp, Homo sapiens
gatgctgggctg

SEQ ID NO: 760695 - DNA, 20 bp, Homo sapiens
gatgctgggctgggccctct

SEQ ID NO: 760696 - DNA, 20 bp, Homo sapiens
gatgctggtggctggtgaga

SEQ ID NO: 760697 - DNA, 16 bp, Homo sapiens
gatgctgtgctatgaa

SEQ ID NO: 760698 - DNA, 15 bp, Homo sapiens
gatgctgtgtgccca

SEQ ID NO: 760699 - DNA, 16 bp, Homo sapiens
gatgctgtgtgcccaa

SEQ ID NO: 760700 - DNA, 16 bp, Homo sapiens
gatgctgttgtgaagc

SEQ ID NO: 760701 - DNA, 23 bp, Homo sapiens
gatgcttctcactgccatgccag

SEQ ID NO: 760702 - DNA, 14 bp, Homo sapiens
gatgcttctctcct

SEQ ID NO: 760703 - DNA, 23 bp, Homo sapiens
gatgcttgcggcaaaaggaaagc

SEQ ID NO: 760704 - DNA, 16 bp, Homo sapiens
gatgcttgtacataat

SEQ ID NO: 760705 - DNA, 17 bp, Homo sapiens
gatgcttttctgtctct

SEQ ID NO: 760706 - DNA, 20 bp, Homo sapiens
gatgcttttctgtctctgcc

SEQ ID NO: 760707 - DNA, 13 bp, Homo sapiens
gatgcttttgctg

SEQ ID NO: 760708 - DNA, 15 bp, Homo sapiens
gatgcttttgctgct

SEQ ID NO: 760709 - DNA, 16 bp, Homo sapiens
gatgcttttgctgctg

SEQ ID NO: 760710 - DNA, 17 bp, Homo sapiens
gatgcttttgctgctgc

SEQ ID NO: 760711 - DNA, 19 bp, Homo sapiens
gatgcttttgctgctgctt

SEQ ID NO: 760712 - DNA, 17 bp, Homo sapiens
gatgcttttgtgagaaa

SEQ ID NO: 760713 - DNA, 18 bp, Homo sapiens
gatggaaaaactgaggct

SEQ ID NO: 760714 - DNA, 15 bp, Homo sapiens
gatggaaaaggaaga

SEQ ID NO: 760715 - DNA, 18 bp, Homo sapiens
gatggaaaataaacatca

SEQ ID NO: 760716 - DNA, 17 bp, Homo sapiens
gatggaaaattcatttt

SEQ ID NO: 760717 - DNA, 16 bp, Homo sapiens
gatggaaacgcactta

SEQ ID NO: 760718 - DNA, 17 bp, Homo sapiens
gatggaacacggccaca

SEQ ID NO: 760719 - DNA, 16 bp, Homo sapiens
gatggaactgtgtatt

SEQ ID NO: 760720 - DNA, 17 bp, Homo sapiens
gatggaactgtgtattt

SEQ ID NO: 760721 - DNA, 23 bp, Homo sapiens
gatggaagatggtccgtgcccag

SEQ ID NO: 760722 - DNA, 23 bp, Homo sapiens
gatggaatggaaaagcaacttca

SEQ ID NO: 760723 - DNA, 21 bp, Homo sapiens
gatggaatttttctgtacttc

SEQ ID NO: 760724 - DNA, 15 bp, Homo sapiens
gatggacacccccag

SEQ ID NO: 760725 - DNA, 17 bp, Homo sapiens
gatggacacccccagct

SEQ ID NO: 760726 - DNA, 15 bp, Homo sapiens
gatggacacgagcca

SEQ ID NO: 760727 - DNA, 23 bp, Homo sapiens
gatggacacgagccacaagctgc

SEQ ID NO: 760728 - DNA, 17 bp, Homo sapiens
gatggacactaatgcag

SEQ ID NO: 760729 - DNA, 13 bp, Homo sapiens
gatggacagacac

SEQ ID NO: 760730 - DNA, 20 bp, Homo sapiens
gatggacagacacctccccc

SEQ ID NO: 760731 - DNA, 15 bp, Homo sapiens
gatggacaggaaagg

SEQ ID NO: 760732 - DNA, 15 bp, Homo sapiens
gatggacccctccct

SEQ ID NO: 760733 - DNA, 15 bp, Homo sapiens
gatggaccgggtggg

SEQ ID NO: 760734 - DNA, 14 bp, Homo sapiens
gatggacgcaggcc

SEQ ID NO: 760735 - DNA, 21 bp, Homo sapiens
gatggactcaggatccagtga

SEQ ID NO: 760736 - DNA, 17 bp, Homo sapiens
gatggactggggagcac

SEQ ID NO: 760737 - DNA, 22 bp, Homo sapiens
gatggagactggtcctgtgtgc

SEQ ID NO: 760738 - DNA, 21 bp, Homo sapiens
gatggagaggcggcctcgtgc

SEQ ID NO: 760739 - DNA, 16 bp, Homo sapiens
gatggagcgcacctgc

SEQ ID NO: 760740 - DNA, 13 bp, Homo sapiens
gatggaggccaga

SEQ ID NO: 760741 - DNA, 16 bp, Homo sapiens
cctccagcctcccctc

SEQ ID NO: 760742 - DNA, 18 bp, Homo sapiens
cctccagcctcccctccc

SEQ ID NO: 760743 - DNA, 15 bp, Homo sapiens
cctccagcctccctg

SEQ ID NO: 760744 - DNA, 21 bp, Homo sapiens
cctccagcctccctgtctcca

SEQ ID NO: 760745 - DNA, 16 bp, Homo sapiens
cctccagcctctcccg

SEQ ID NO: 760746 - DNA, 11 bp, Homo sapiens
cctccagctca

SEQ ID NO: 760747 - DNA, 18 bp, Homo sapiens
cctccagctgcaccagag

SEQ ID NO: 760748 - DNA, 16 bp, Homo sapiens
cctccagctgttctta

SEQ ID NO: 760749 - DNA, 12 bp, Homo sapiens
cctccagcttct

SEQ ID NO: 760750 - DNA, 20 bp, Homo sapiens
cctccagcttttcctcaggg

SEQ ID NO: 760751 - DNA, 15 bp, Homo sapiens
cctccaggaaccaca

SEQ ID NO: 760752 - DNA, 12 bp, Homo sapiens
cctccaggagct

SEQ ID NO: 760753 - DNA, 19 bp, Homo sapiens
cctccaggagcttcttgtt

SEQ ID NO: 760754 - DNA, 14 bp, Homo sapiens
cctccaggaggggc

SEQ ID NO: 760755 - DNA, 15 bp, Homo sapiens
cctccaggcctgcct

SEQ ID NO: 760756 - DNA, 16 bp, Homo sapiens
cctccaggcctgcctc

SEQ ID NO: 760757 - DNA, 18 bp, Homo sapiens
cctccaggcctgcctccc

SEQ ID NO: 760758 - DNA, 19 bp, Homo sapiens
cctccaggcctgcctccca

SEQ ID NO: 760759 - DNA, 13 bp, Homo sapiens
cctccaggcctgt

SEQ ID NO: 760760 - DNA, 18 bp, Homo sapiens
cctccagggaaggtggcc

SEQ ID NO: 760761 - DNA, 22 bp, Homo sapiens
cctccagggaaggtggccacag

SEQ ID NO: 760762 - DNA, 12 bp, Homo sapiens
cctccagggcca

SEQ ID NO: 760763 - DNA, 17 bp, Homo sapiens
cctccagggccacgtgc

SEQ ID NO: 760764 - DNA, 18 bp, Homo sapiens
cctccagggccacgtgcc

SEQ ID NO: 760765 - DNA, 19 bp, Homo sapiens
cctccagggccacgtgcca

SEQ ID NO: 760766 - DNA, 14 bp, Homo sapiens
cctccaggtgtgca

SEQ ID NO: 760767 - DNA, 21 bp, Homo sapiens
cctccaggttcaagtgattct

SEQ ID NO: 760768 - DNA, 15 bp, Homo sapiens
cctccagtgggctga

SEQ ID NO: 760769 - DNA, 20 bp, Homo sapiens
cctccagtgggctgatgctg

SEQ ID NO: 760770 - DNA, 20 bp, Homo sapiens
cctccccgctccgtctctgt

SEQ ID NO: 760771 - DNA, 21 bp, Homo sapiens
cctccccgctccgtctctgtc

SEQ ID NO: 760772 - DNA, 14 bp, Homo sapiens
cctccccggcccta

SEQ ID NO: 760773 - DNA, 21 bp, Homo sapiens
cctccccgtccctgtccccca

SEQ ID NO: 760774 - DNA, 17 bp, Homo sapiens
cctccccgtctcattcc

SEQ ID NO: 760775 - DNA, 22 bp, Homo sapiens
cctccccgtttcagtggaccct

SEQ ID NO: 760776 - DNA, 13 bp, Homo sapiens
cctcccctatcca

SEQ ID NO: 760777 - DNA, 15 bp, Homo sapiens
cctcccctatccacc

SEQ ID NO: 760778 - DNA, 14 bp, Homo sapiens
cctcccctcagcct

SEQ ID NO: 760779 - DNA, 16 bp, Homo sapiens
cctcccctcagcctgc

SEQ ID NO: 760780 - DNA, 17 bp, Homo sapiens
cctcccctcagcctgcc

SEQ ID NO: 760781 - DNA, 15 bp, Homo sapiens
cctcccctccccagc

SEQ ID NO: 760782 - DNA, 14 bp, Homo sapiens
cctcccctcctctt

SEQ ID NO: 760783 - DNA, 20 bp, Homo sapiens
cctcccctccttgcctcctg

SEQ ID NO: 760784 - DNA, 18 bp, Homo sapiens
cctcccctcgtgtcagct

SEQ ID NO: 760785 - DNA, 16 bp, Homo sapiens
cctcccctctcagaac

SEQ ID NO: 760786 - DNA, 19 bp, Homo sapiens
cctcccctctcatccccct

SEQ ID NO: 760787 - DNA, 23 bp, Homo sapiens
cctcccctctcatccccctgtgg

SEQ ID NO: 760788 - DNA, 21 bp, Homo sapiens
cctcccctctcttgcacccgc

SEQ ID NO: 760789 - DNA, 23 bp, Homo sapiens
cctcccctctcttgcacccgcct

SEQ ID NO: 760790 - DNA, 13 bp, Homo sapiens
cctcccctgccac

SEQ ID NO: 760791 - DNA, 18 bp, Homo sapiens
cctcccctgccagggcag

SEQ ID NO: 760792 - DNA, 15 bp, Homo sapiens
cctcccctgccttgc

SEQ ID NO: 760793 - DNA, 14 bp, Homo sapiens
cctcccctggggac

SEQ ID NO: 760794 - DNA, 15 bp, Homo sapiens
cctccccttcttccc

SEQ ID NO: 760795 - DNA, 16 bp, Homo sapiens
cctccccttcttcccg

SEQ ID NO: 760796 - DNA, 14 bp, Homo sapiens
cctccccttgggcg

SEQ ID NO: 760797 - DNA, 16 bp, Homo sapiens
cctcccgacagcccat

SEQ ID NO: 760798 - DNA, 14 bp, Homo sapiens
cctcccgagctcct

SEQ ID NO: 760799 - DNA, 17 bp, Homo sapiens
cctcccgagtagctggg

SEQ ID NO: 760800 - DNA, 21 bp, Homo sapiens
cctcccgagtagctgggatta

SEQ ID NO: 760801 - DNA, 13 bp, Homo sapiens
cctcccggtgccc

SEQ ID NO: 760802 - DNA, 17 bp, Homo sapiens
cctccctacttccaaga

SEQ ID NO: 760803 - DNA, 13 bp, Homo sapiens
cctccctagccct

SEQ ID NO: 760804 - DNA, 19 bp, Homo sapiens
cctccctatatgcacccct

SEQ ID NO: 760805 - DNA, 20 bp, Homo sapiens
cctccctcagcccccaggat

SEQ ID NO: 760806 - DNA, 15 bp, Homo sapiens
cctccctcagcccct

SEQ ID NO: 760807 - DNA, 13 bp, Homo sapiens
cctccctcagcct

SEQ ID NO: 760808 - DNA, 20 bp, Homo sapiens
cctccctcagcctccccttc

SEQ ID NO: 760809 - DNA, 12 bp, Homo sapiens
cctccctcagcg

SEQ ID NO: 760810 - DNA, 20 bp, Homo sapiens
cctccctcagggagcgatcc

SEQ ID NO: 760811 - DNA, 12 bp, Homo sapiens
cctccctccaag

SEQ ID NO: 760812 - DNA, 21 bp, Homo sapiens
cctccctccaagcctggcacc

SEQ ID NO: 760813 - DNA, 15 bp, Homo sapiens
cctccctccacccca

SEQ ID NO: 760814 - DNA, 17 bp, Homo sapiens
cctccctccaccccagg

SEQ ID NO: 760815 - DNA, 19 bp, Homo sapiens
cctccctccaccccaggac

SEQ ID NO: 760816 - DNA, 15 bp, Homo sapiens
cctccctccacctca

SEQ ID NO: 760817 - DNA, 15 bp, Homo sapiens
cctccctcccagctg

SEQ ID NO: 760818 - DNA, 16 bp, Homo sapiens
cctccctcccagctgc

SEQ ID NO: 760819 - DNA, 18 bp, Homo sapiens
cctccctcccagctgcac

SEQ ID NO: 760820 - DNA, 16 bp, Homo sapiens
cctccctccctagccc

SEQ ID NO: 760821 - DNA, 15 bp, Homo sapiens
cctccctccgcctcc

SEQ ID NO: 760822 - DNA, 16 bp, Homo sapiens
cctccctccgcctccc

SEQ ID NO: 760823 - DNA, 13 bp, Homo sapiens
cctccctcctcag

SEQ ID NO: 760824 - DNA, 14 bp, Homo sapiens
cctccctcctcagg

SEQ ID NO: 760825 - DNA, 13 bp, Homo sapiens
cctccctcgtggg

SEQ ID NO: 760826 - DNA, 11 bp, Homo sapiens
cctccctctct

SEQ ID NO: 760827 - DNA, 22 bp, Homo sapiens
cctccctctctcttctgctcca

SEQ ID NO: 760828 - DNA, 20 bp, Homo sapiens
cctccctctcttccgggagc

SEQ ID NO: 760829 - DNA, 18 bp, Homo sapiens
cctccctctgacctgcag

SEQ ID NO: 760830 - DNA, 17 bp, Homo sapiens
cctccctctgccccaag

SEQ ID NO: 760831 - DNA, 18 bp, Homo sapiens
cctccctcttccttcccc

SEQ ID NO: 760832 - DNA, 20 bp, Homo sapiens
cctccctgaaaatgtttttc

SEQ ID NO: 760833 - DNA, 20 bp, Homo sapiens
cctccctgaaccatccctga

SEQ ID NO: 760834 - DNA, 21 bp, Homo sapiens
cctccctgactccctgtgggg

SEQ ID NO: 760835 - DNA, 15 bp, Homo sapiens
cctccctgagcctgc

SEQ ID NO: 760836 - DNA, 17 bp, Homo sapiens
cctccctgagcctgcat

SEQ ID NO: 760837 - DNA, 16 bp, Homo sapiens
cctccctgcaggggct

SEQ ID NO: 760838 - DNA, 13 bp, Homo sapiens
cctccctgcccaa

SEQ ID NO: 760839 - DNA, 14 bp, Homo sapiens
cctccctgcccaaa

SEQ ID NO: 760840 - DNA, 13 bp, Homo sapiens
cctccctgcccat

SEQ ID NO: 760841 - DNA, 14 bp, Homo sapiens
cctccctgcccatc

SEQ ID NO: 760842 - DNA, 15 bp, Homo sapiens
cctccctgcccccca

SEQ ID NO: 760843 - DNA, 22 bp, Homo sapiens
cctccctgcccctcccttcaac

SEQ ID NO: 760844 - DNA, 12 bp, Homo sapiens
cctccctgcctg

SEQ ID NO: 760845 - DNA, 17 bp, Homo sapiens
cctccctgctcagtgct

SEQ ID NO: 760846 - DNA, 19 bp, Homo sapiens
cctccctgctcagtgcttg

SEQ ID NO: 760847 - DNA, 15 bp, Homo sapiens
cctccctgctcctca

SEQ ID NO: 760848 - DNA, 21 bp, Homo sapiens
cctccctgcttgcacacttcc

SEQ ID NO: 760849 - DNA, 16 bp, Homo sapiens
cctccctggctcccat

SEQ ID NO: 760850 - DNA, 14 bp, Homo sapiens
cctccctggctcct

SEQ ID NO: 760851 - DNA, 23 bp, Homo sapiens
cctccctggctgccctggccctg

SEQ ID NO: 760852 - DNA, 10 bp, Homo sapiens
cctccctggg

SEQ ID NO: 760853 - DNA, 18 bp, Homo sapiens
cctccctgggccacctcc

SEQ ID NO: 760854 - DNA, 19 bp, Homo sapiens
cctccctgggccacctcct

SEQ ID NO: 760855 - DNA, 13 bp, Homo sapiens
cctccctgggcta

SEQ ID NO: 760856 - DNA, 13 bp, Homo sapiens
cctccctgggttc

SEQ ID NO: 760857 - DNA, 12 bp, Homo sapiens
cctccctgtcaa

SEQ ID NO: 760858 - DNA, 21 bp, Homo sapiens
cctccctgtctccagctgcct

SEQ ID NO: 760859 - DNA, 23 bp, Homo sapiens
cctccctgtctccagctgcctgg

SEQ ID NO: 760860 - DNA, 19 bp, Homo sapiens
cctccctgtgcccccagcc

SEQ ID NO: 760861 - DNA, 19 bp, Homo sapiens
cctcccttccgaccctctg

SEQ ID NO: 760862 - DNA, 23 bp, Homo sapiens
cctcccttccgaccctctgggaa

SEQ ID NO: 760863 - DNA, 15 bp, Homo sapiens
cctcccttccttttc

SEQ ID NO: 760864 - DNA, 16 bp, Homo sapiens
cctcccttccttttcc

SEQ ID NO: 760865 - DNA, 17 bp, Homo sapiens
cctcccttccttttccc

SEQ ID NO: 760866 - DNA, 14 bp, Homo sapiens
cctcccttctccct

SEQ ID NO: 760867 - DNA, 17 bp, Homo sapiens
cctcccttgccccaggc

SEQ ID NO: 760868 - DNA, 21 bp, Homo sapiens
cctcccttggaaacctgccct

SEQ ID NO: 760869 - DNA, 22 bp, Homo sapiens
cctcccttggaaacctgccctg

SEQ ID NO: 760870 - DNA, 14 bp, Homo sapiens
cctccgactccaga

SEQ ID NO: 760871 - DNA, 16 bp, Homo sapiens
cctccgagagggagag

SEQ ID NO: 760872 - DNA, 14 bp, Homo sapiens
gatgtctaatagtt

SEQ ID NO: 760873 - DNA, 16 bp, Homo sapiens
gatgtctacagaaaat

SEQ ID NO: 760874 - DNA, 17 bp, Homo sapiens
gatgtctacagaaaatg

SEQ ID NO: 760875 - DNA, 14 bp, Homo sapiens
gatgtctccagatt

SEQ ID NO: 760876 - DNA, 13 bp, Homo sapiens
gatgtctctgggg

SEQ ID NO: 760877 - DNA, 15 bp, Homo sapiens
gatgtctctggggca

SEQ ID NO: 760878 - DNA, 16 bp, Homo sapiens
gatgtctcttgtagaa

SEQ ID NO: 760879 - DNA, 12 bp, Homo sapiens
gatgtcttccct

SEQ ID NO: 760880 - DNA, 15 bp, Homo sapiens
gatgtcttctgcctg

SEQ ID NO: 760881 - DNA, 18 bp, Homo sapiens
gatgtcttctgcctgtta

SEQ ID NO: 760882 - DNA, 21 bp, Homo sapiens
gatgtcttggaacattggaat

SEQ ID NO: 760883 - DNA, 19 bp, Homo sapiens
gatgtctttttattaaaat

SEQ ID NO: 760884 - DNA, 22 bp, Homo sapiens
gatgtgaattattgacactgaa

SEQ ID NO: 760885 - DNA, 20 bp, Homo sapiens
gatgtgacggggtgtgtggc

SEQ ID NO: 760886 - DNA, 18 bp, Homo sapiens
gatgtgatatataagtgt

SEQ ID NO: 760887 - DNA, 20 bp, Homo sapiens
gatgtgatcatagctcactg

SEQ ID NO: 760888 - DNA, 16 bp, Homo sapiens
gatgtgattgtggaat

SEQ ID NO: 760889 - DNA, 18 bp, Homo sapiens
gatgtgattgtggaatgg

SEQ ID NO: 760890 - DNA, 20 bp, Homo sapiens
gatgtgcaaaaccttttact

SEQ ID NO: 760891 - DNA, 22 bp, Homo sapiens
gatgtgcatttcacctgtgaca

SEQ ID NO: 760892 - DNA, 12 bp, Homo sapiens
gatgtgcttctg

SEQ ID NO: 760893 - DNA, 19 bp, Homo sapiens
gattatgtagcaaaataca

SEQ ID NO: 760894 - DNA, 21 bp, Homo sapiens
gattatgttatacaaggcaag

SEQ ID NO: 760895 - DNA, 19 bp, Homo sapiens
gattattactaattctatt

SEQ ID NO: 760896 - DNA, 13 bp, Homo sapiens
gattattataaac

SEQ ID NO: 760897 - DNA, 14 bp, Homo sapiens
gattattataaact

SEQ ID NO: 760898 - DNA, 22 bp, Homo sapiens
gattattataaactataaactt

SEQ ID NO: 760899 - DNA, 17 bp, Homo sapiens
gattattctgattccac

SEQ ID NO: 760900 - DNA, 12 bp, Homo sapiens
gattattggaaa

SEQ ID NO: 760901 - DNA, 23 bp, Homo sapiens
gattattgtgacttcactgtata

SEQ ID NO: 760902 - DNA, 18 bp, Homo sapiens
gattatttacaagaagaa

SEQ ID NO: 760903 - DNA, 21 bp, Homo sapiens
gattatttacaagaagaactc

SEQ ID NO: 760904 - DNA, 16 bp, Homo sapiens
gattatttatgacctg

SEQ ID NO: 760905 - DNA, 14 bp, Homo sapiens
gattatttcacttt

SEQ ID NO: 760906 - DNA, 13 bp, Homo sapiens
gattcaaaatatt

SEQ ID NO: 760907 - DNA, 16 bp, Homo sapiens
gattcaaaatatttaa

SEQ ID NO: 760908 - DNA, 16 bp, Homo sapiens
gattcaaaccaaagct

SEQ ID NO: 760909 - DNA, 18 bp, Homo sapiens
gattcaaaccaaagctgc

SEQ ID NO: 760910 - DNA, 20 bp, Homo sapiens
gattcaaaccaaagctgcct

SEQ ID NO: 760911 - DNA, 14 bp, Homo sapiens
gattcaaatgtttt

SEQ ID NO: 760912 - DNA, 10 bp, Homo sapiens
gattcaaatt

SEQ ID NO: 760913 - DNA, 17 bp, Homo sapiens
gattcaaattgctgctt

SEQ ID NO: 760914 - DNA, 16 bp, Homo sapiens
gattcacatctcattt

SEQ ID NO: 760915 - DNA, 14 bp, Homo sapiens
gattcacatctgca

SEQ ID NO: 760916 - DNA, 20 bp, Homo sapiens
gattcacctcttcctctggt

SEQ ID NO: 760917 - DNA, 18 bp, Homo sapiens
gattcacctgtaaaactt

SEQ ID NO: 760918 - DNA, 23 bp, Homo sapiens
gattcagccttctttttctggac

SEQ ID NO: 760919 - DNA, 23 bp, Homo sapiens
gattcagcgaagtctcatgggaa

SEQ ID NO: 760920 - DNA, 13 bp, Homo sapiens
gattcagctctgc

SEQ ID NO: 760921 - DNA, 19 bp, Homo sapiens
gattcaggacgtccttcca

SEQ ID NO: 760922 - DNA, 18 bp, Homo sapiens
gattcaggccagcccagc

SEQ ID NO: 760923 - DNA, 19 bp, Homo sapiens
gattcaggccagcccagcc

SEQ ID NO: 760924 - DNA, 13 bp, Homo sapiens
gattcaggggctt

SEQ ID NO: 760925 - DNA, 22 bp, Homo sapiens
gattcaggggctttgggcccaa

SEQ ID NO: 760926 - DNA, 17 bp, Homo sapiens
gattcaggtatgttgcc

SEQ ID NO: 760927 - DNA, 19 bp, Homo sapiens
gattcagtttctaaaattg

SEQ ID NO: 760928 - DNA, 22 bp, Homo sapiens
gattcatctaccctgctgacct

SEQ ID NO: 760929 - DNA, 13 bp, Homo sapiens
gattcattttcct

SEQ ID NO: 760930 - DNA, 18 bp, Homo sapiens
gattccaaagagtagaat

SEQ ID NO: 760931 - DNA, 19 bp, Homo sapiens
gattccaaagagtagaatt

SEQ ID NO: 760932 - DNA, 23 bp, Homo sapiens
gattccaaataaaacttgagccc

SEQ ID NO: 760933 - DNA, 23 bp, Homo sapiens
gattccaaggctttaaagctgag

SEQ ID NO: 760934 - DNA, 21 bp, Homo sapiens
gattccactacacctggctga

SEQ ID NO: 760935 - DNA, 20 bp, Homo sapiens
gattccagagagtggctcct

SEQ ID NO: 760936 - DNA, 18 bp, Homo sapiens
gattccagcccacattgg

SEQ ID NO: 760937 - DNA, 17 bp, Homo sapiens
gattccattccatggaa

SEQ ID NO: 760938 - DNA, 16 bp, Homo sapiens
gattcccaccaaggtc

SEQ ID NO: 760939 - DNA, 19 bp, Homo sapiens
gattcccagagacaggaaa

SEQ ID NO: 760940 - DNA, 21 bp, Homo sapiens
gattcccagagacaggaaaat

SEQ ID NO: 760941 - DNA, 19 bp, Homo sapiens
gattcccagagcaaaataa

SEQ ID NO: 760942 - DNA, 11 bp, Homo sapiens
gattcccccag

SEQ ID NO: 760943 - DNA, 21 bp, Homo sapiens
gattcccctaacctcattccc

SEQ ID NO: 760944 - DNA, 13 bp, Homo sapiens
gattcccttctgg

SEQ ID NO: 760945 - DNA, 20 bp, Homo sapiens
gattcctcttgcctctctca

SEQ ID NO: 760946 - DNA, 16 bp, Homo sapiens
gattcctgacccaggc

SEQ ID NO: 760947 - DNA, 18 bp, Homo sapiens
gattcctgacccaggccg

SEQ ID NO: 760948 - DNA, 19 bp, Homo sapiens
gattcctgacccaggccgc

SEQ ID NO: 760949 - DNA, 12 bp, Homo sapiens
gattcctggctc

SEQ ID NO: 760950 - DNA, 12 bp, Homo sapiens
gattcctgggcc

SEQ ID NO: 760951 - DNA, 14 bp, Homo sapiens
gattcctgggcctg

SEQ ID NO: 760952 - DNA, 15 bp, Homo sapiens
gattcctgggcctgt

SEQ ID NO: 760953 - DNA, 10 bp, Homo sapiens
gattcctggt

SEQ ID NO: 760954 - DNA, 13 bp, Homo sapiens
gattcctggtttg

SEQ ID NO: 760955 - DNA, 16 bp, Homo sapiens
gattcctggtttgact

SEQ ID NO: 760956 - DNA, 17 bp, Homo sapiens
gattccttgtgttttgt

SEQ ID NO: 760957 - DNA, 21 bp, Homo sapiens
gattccttttgatggggagaa

SEQ ID NO: 760958 - DNA, 23 bp, Homo sapiens
gattccttttgatggggagaaag

SEQ ID NO: 760959 - DNA, 17 bp, Homo sapiens
gattcgaatgacactgt

SEQ ID NO: 760960 - DNA, 17 bp, Homo sapiens
gattcggtatcccccca

SEQ ID NO: 760961 - DNA, 14 bp, Homo sapiens
gattctaaggactc

SEQ ID NO: 760962 - DNA, 15 bp, Homo sapiens
gattctaatgtcttc

SEQ ID NO: 760963 - DNA, 23 bp, Homo sapiens
gattctaccacacagcagcagtt

SEQ ID NO: 760964 - DNA, 17 bp, Homo sapiens
gattctactcttgtcat

SEQ ID NO: 760965 - DNA, 21 bp, Homo sapiens
gattctattatatattttata

SEQ ID NO: 760966 - DNA, 18 bp, Homo sapiens
gattctatttaattgaaa

SEQ ID NO: 760967 - DNA, 18 bp, Homo sapiens
gattctcaaaggagcgag

SEQ ID NO: 760968 - DNA, 18 bp, Homo sapiens
gattctcagggctggagc

SEQ ID NO: 760969 - DNA, 13 bp, Homo sapiens
gattctccctggg

SEQ ID NO: 760970 - DNA, 13 bp, Homo sapiens
gattctctactgc

SEQ ID NO: 760971 - DNA, 23 bp, Homo sapiens
gattctctctccatttggaatta

SEQ ID NO: 760972 - DNA, 20 bp, Homo sapiens
gattctcttagctactgtat

SEQ ID NO: 760973 - DNA, 18 bp, Homo sapiens
gattctgaaacaggccct

SEQ ID NO: 760974 - DNA, 23 bp, Homo sapiens
gattctgaaatttttttcctaag

SEQ ID NO: 760975 - DNA, 21 bp, Homo sapiens
gattctgaccttaaatgcaac

SEQ ID NO: 760976 - DNA, 22 bp, Homo sapiens
gattctgatttcagtttttcat

SEQ ID NO: 760977 - DNA, 15 bp, Homo sapiens
gattctgcagtaaat

SEQ ID NO: 760978 - DNA, 15 bp, Homo sapiens
gattctgcctctctg

SEQ ID NO: 760979 - DNA, 15 bp, Homo sapiens
gattctgggaggaag

SEQ ID NO: 760980 - DNA, 22 bp, Homo sapiens
gattctgggaggaagcaggttg

SEQ ID NO: 760981 - DNA, 21 bp, Homo sapiens
gattctgggaggcaagaaaag

SEQ ID NO: 760982 - DNA, 15 bp, Homo sapiens
gattctggggctgtg

SEQ ID NO: 760983 - DNA, 19 bp, Homo sapiens
gattctgggtttgcccagt

SEQ ID NO: 760984 - DNA, 23 bp, Homo sapiens
gattctgggtttgcccagtcctg

SEQ ID NO: 760985 - DNA, 17 bp, Homo sapiens
gattctggttccagggt

SEQ ID NO: 760986 - DNA, 22 bp, Homo sapiens
gattctggttccagggtccctc

SEQ ID NO: 760987 - DNA, 15 bp, Homo sapiens
gattcttctcttgtg

SEQ ID NO: 760988 - DNA, 18 bp, Homo sapiens
gattcttgattcctggct

SEQ ID NO: 760989 - DNA, 13 bp, Homo sapiens
gattcttgtaaat

SEQ ID NO: 760990 - DNA, 15 bp, Homo sapiens
gattcttgtaaatct

SEQ ID NO: 760991 - DNA, 16 bp, Homo sapiens
gattcttgtaaatctt

SEQ ID NO: 760992 - DNA, 17 bp, Homo sapiens
gattctttccatttgca

SEQ ID NO: 760993 - DNA, 20 bp, Homo sapiens
gattctttttttctgtcagt

SEQ ID NO: 760994 - DNA, 21 bp, Homo sapiens
gattctttttttctgtcagta

SEQ ID NO: 760995 - DNA, 15 bp, Homo sapiens
gattgacctgctccg

SEQ ID NO: 760996 - DNA, 14 bp, Homo sapiens
gattgagaactgac

SEQ ID NO: 760997 - DNA, 15 bp, Homo sapiens
gattgagaactgaca

SEQ ID NO: 760998 - DNA, 20 bp, Homo sapiens
gattgagacctacaggctga

SEQ ID NO: 760999 - DNA, 17 bp, Homo sapiens
gattgagctctctgccc

SEQ ID NO: 761000 - DNA, 16 bp, Homo sapiens
gattgaggagttgcct

SEQ ID NO: 761001 - DNA, 21 bp, Homo sapiens
gattgaggataaaaaggaagg

SEQ ID NO: 761002 - DNA, 17 bp, Homo sapiens
gattgaggggccctggc

SEQ ID NO: 761003 - DNA, 17 bp, Homo sapiens
cctcctggtcctggaca

SEQ ID NO: 761004 - DNA, 18 bp, Homo sapiens
cctcctggtcctggacac

SEQ ID NO: 761005 - DNA, 16 bp, Homo sapiens
cctcctggtttccttt

SEQ ID NO: 761006 - DNA, 19 bp, Homo sapiens
cctcctggtttcctttctc

SEQ ID NO: 761007 - DNA, 12 bp, Homo sapiens
cctcctgtcact

SEQ ID NO: 761008 - DNA, 21 bp, Homo sapiens
cctcctgtcactcactgaggc

SEQ ID NO: 761009 - DNA, 11 bp, Homo sapiens
cctcctgtgcc

SEQ ID NO: 761010 - DNA, 16 bp, Homo sapiens
cctcctgtgccccagc

SEQ ID NO: 761011 - DNA, 20 bp, Homo sapiens
cctcctgtgccccagctgcc

SEQ ID NO: 761012 - DNA, 21 bp, Homo sapiens
cctcctgtgccccagctgcca

SEQ ID NO: 761013 - DNA, 12 bp, Homo sapiens
cctcctgtgcct

SEQ ID NO: 761014 - DNA, 19 bp, Homo sapiens
cctcctgtgcctggcccca

SEQ ID NO: 761015 - DNA, 11 bp, Homo sapiens
gattgcagctt

SEQ ID NO: 761016 - DNA, 18 bp, Homo sapiens
gattgcagctttatgttc

SEQ ID NO: 761017 - DNA, 16 bp, Homo sapiens
gattgcatcctgctgg

SEQ ID NO: 761018 - DNA, 16 bp, Homo sapiens
gattgccccagagccc

SEQ ID NO: 761019 - DNA, 13 bp, Homo sapiens
gattgctctggag

SEQ ID NO: 761020 - DNA, 18 bp, Homo sapiens
gattgctctggagcagcc

SEQ ID NO: 761021 - DNA, 23 bp, Homo sapiens
gattgctctggagcagccaaggc

SEQ ID NO: 761022 - DNA, 20 bp, Homo sapiens
gattgctgaatcccatcagg

SEQ ID NO: 761023 - DNA, 14 bp, Homo sapiens
gattgcttaaaata

SEQ ID NO: 761024 - DNA, 17 bp, Homo sapiens
gattgcttaaaatagca

SEQ ID NO: 761025 - DNA, 18 bp, Homo sapiens
gattgcttaaaatagcaa

SEQ ID NO: 761026 - DNA, 18 bp, Homo sapiens
gattgcttcaattaaaat

SEQ ID NO: 761027 - DNA, 14 bp, Homo sapiens
gattgcttctgtag

SEQ ID NO: 761028 - DNA, 18 bp, Homo sapiens
gattgcttgagctcagga

SEQ ID NO: 761029 - DNA, 18 bp, Homo sapiens
gattgctttgctgcacag

SEQ ID NO: 761030 - DNA, 23 bp, Homo sapiens
gattgctttgctgcacagcagga

SEQ ID NO: 761031 - DNA, 13 bp, Homo sapiens
gattggaaagaca

SEQ ID NO: 761032 - DNA, 15 bp, Homo sapiens
gattggaatgcagag

SEQ ID NO: 761033 - DNA, 19 bp, Homo sapiens
gattggaatttctggcctc

SEQ ID NO: 761034 - DNA, 15 bp, Homo sapiens
gattggaccaggcca

SEQ ID NO: 761035 - DNA, 16 bp, Homo sapiens
gattggacggcctgat

SEQ ID NO: 761036 - DNA, 15 bp, Homo sapiens
gattggagaatactt

SEQ ID NO: 761037 - DNA, 19 bp, Homo sapiens
gattggagaatactttgct

SEQ ID NO: 761038 - DNA, 23 bp, Homo sapiens
gattggagaatactttgcttcat

SEQ ID NO: 761039 - DNA, 15 bp, Homo sapiens
gattggagctgaaga

SEQ ID NO: 761040 - DNA, 20 bp, Homo sapiens
gattggattattcatttaaa

SEQ ID NO: 761041 - DNA, 18 bp, Homo sapiens
gattggatttgctgtgac

SEQ ID NO: 761042 - DNA, 13 bp, Homo sapiens
gattggcatggct

SEQ ID NO: 761043 - DNA, 16 bp, Homo sapiens
gattggcttaaagtga

SEQ ID NO: 761044 - DNA, 17 bp, Homo sapiens
gattggcttaaagtgaa

SEQ ID NO: 761045 - DNA, 18 bp, Homo sapiens
gattggcttaaagtgaag

SEQ ID NO: 761046 - DNA, 21 bp, Homo sapiens
gattggcttaaagtgaaggaa

SEQ ID NO: 761047 - DNA, 23 bp, Homo sapiens
gattggctttgtgcttggggcta

SEQ ID NO: 761048 - DNA, 22 bp, Homo sapiens
gattgggacgcacagtgcagtt

SEQ ID NO: 761049 - DNA, 20 bp, Homo sapiens
gattggggaagactgtggct

SEQ ID NO: 761050 - DNA, 22 bp, Homo sapiens
gattggtgttcgtttccatcat

SEQ ID NO: 761051 - DNA, 16 bp, Homo sapiens
gattggttaaaatgtg

SEQ ID NO: 761052 - DNA, 14 bp, Homo sapiens
gattggttctgttt

SEQ ID NO: 761053 - DNA, 23 bp, Homo sapiens
gattgtaaaatagcttgtatagt

SEQ ID NO: 761054 - DNA, 21 bp, Homo sapiens
gattgtacagaatcattgctt

SEQ ID NO: 761055 - DNA, 22 bp, Homo sapiens
gattgtacagaatcattgctta

SEQ ID NO: 761056 - DNA, 10 bp, Homo sapiens
gattgtattg

SEQ ID NO: 761057 - DNA, 20 bp, Homo sapiens
gattgtattgttgaaaaagt

SEQ ID NO: 761058 - DNA, 15 bp, Homo sapiens
gattgtatttgtgac

SEQ ID NO: 761059 - DNA, 17 bp, Homo sapiens
gattgtcagccacctcc

SEQ ID NO: 761060 - DNA, 16 bp, Homo sapiens
gattgtcttgcaactt

SEQ ID NO: 761061 - DNA, 22 bp, Homo sapiens
gattgtgaggcttctaataaag

SEQ ID NO: 761062 - DNA, 16 bp, Homo sapiens
gattgtggaaaaccag

SEQ ID NO: 761063 - DNA, 21 bp, Homo sapiens
gattgtggaatgttggataag

SEQ ID NO: 761064 - DNA, 21 bp, Homo sapiens
gattgttaagtctaaatattt

SEQ ID NO: 761065 - DNA, 20 bp, Homo sapiens
gattgttggtgaattttcaa

SEQ ID NO: 761066 - DNA, 22 bp, Homo sapiens
gattgtttaaagaagctctcca

SEQ ID NO: 761067 - DNA, 17 bp, Homo sapiens
gattgtttgctctgaga

SEQ ID NO: 761068 - DNA, 12 bp, Homo sapiens
gattgttttatc

SEQ ID NO: 761069 - DNA, 18 bp, Homo sapiens
gatttaaaagcctgctca

SEQ ID NO: 761070 - DNA, 18 bp, Homo sapiens
gatttaaaagtgtatttt

SEQ ID NO: 761071 - DNA, 17 bp, Homo sapiens
gatttaaacacacagat

SEQ ID NO: 761072 - DNA, 14 bp, Homo sapiens
gatttaaatttaag

SEQ ID NO: 761073 - DNA, 14 bp, Homo sapiens
gatttaacactttt

SEQ ID NO: 761074 - DNA, 14 bp, Homo sapiens
gatttaacagaaat

SEQ ID NO: 761075 - DNA, 19 bp, Homo sapiens
gatttaacagaaatgtaca

SEQ ID NO: 761076 - DNA, 19 bp, Homo sapiens
gatttaacagtcatttaaa

SEQ ID NO: 761077 - DNA, 19 bp, Homo sapiens
gatttaagtgaatacatta

SEQ ID NO: 761078 - DNA, 19 bp, Homo sapiens
gatttaatctgccaagggc

SEQ ID NO: 761079 - DNA, 14 bp, Homo sapiens
gatttaatttccag

SEQ ID NO: 761080 - DNA, 16 bp, Homo sapiens
gatttacactgggaga

SEQ ID NO: 761081 - DNA, 19 bp, Homo sapiens
gatttacagcctcacttga

SEQ ID NO: 761082 - DNA, 15 bp, Homo sapiens
gatttagaactgtat

SEQ ID NO: 761083 - DNA, 23 bp, Homo sapiens
gatttagaagcaaagatttcagt

SEQ ID NO: 761084 - DNA, 16 bp, Homo sapiens
gatttagatatgcaaa

SEQ ID NO: 761085 - DNA, 15 bp, Homo sapiens
gatttaggagcagaa

SEQ ID NO: 761086 - DNA, 18 bp, Homo sapiens
gatttagggaagcaggga

SEQ ID NO: 761087 - DNA, 21 bp, Homo sapiens
gatttagtgcttaacattttc

SEQ ID NO: 761088 - DNA, 21 bp, Homo sapiens
gatttagtgtttttacctctg

SEQ ID NO: 761089 - DNA, 22 bp, Homo sapiens
gatttagtgtttttacctctgt

SEQ ID NO: 761090 - DNA, 13 bp, Homo sapiens
gatttagtttcag

SEQ ID NO: 761091 - DNA, 14 bp, Homo sapiens
gatttagtttcagt

SEQ ID NO: 761092 - DNA, 14 bp, Homo sapiens
gatttataaacaga

SEQ ID NO: 761093 - DNA, 13 bp, Homo sapiens
gatttataaagca

SEQ ID NO: 761094 - DNA, 20 bp, Homo sapiens
gatttatagtttgtacatgc

SEQ ID NO: 761095 - DNA, 15 bp, Homo sapiens
gatttatgtcagcac

SEQ ID NO: 761096 - DNA, 14 bp, Homo sapiens
gatttattatataa

SEQ ID NO: 761097 - DNA, 12 bp, Homo sapiens
gatttatttaaa

SEQ ID NO: 761098 - DNA, 18 bp, Homo sapiens
gatttatttaaaatagca

SEQ ID NO: 761099 - DNA, 15 bp, Homo sapiens
gatttatttgcttct

SEQ ID NO: 761100 - DNA, 14 bp, Homo sapiens
gatttattttacat

SEQ ID NO: 761101 - DNA, 15 bp, Homo sapiens
gatttattttacatt

SEQ ID NO: 761102 - DNA, 17 bp, Homo sapiens
gatttatttttcagttc

SEQ ID NO: 761103 - DNA, 14 bp, Homo sapiens
gatttcactaggac

SEQ ID NO: 761104 - DNA, 21 bp, Homo sapiens
gatttcactaggactcagaaa

SEQ ID NO: 761105 - DNA, 16 bp, Homo sapiens
gatttcagaagagact

SEQ ID NO: 761106 - DNA, 15 bp, Homo sapiens
gatttcagaagccta

SEQ ID NO: 761107 - DNA, 20 bp, Homo sapiens
gatttcaggatactctgtca

SEQ ID NO: 761108 - DNA, 18 bp, Homo sapiens
gatttcaggcagcagggg

SEQ ID NO: 761109 - DNA, 17 bp, Homo sapiens
gatttcatagttcagaa

SEQ ID NO: 761110 - DNA, 16 bp, Homo sapiens
gatttcatcttctgga

SEQ ID NO: 761111 - DNA, 20 bp, Homo sapiens
gatttcatgctatctctgtg

SEQ ID NO: 761112 - DNA, 21 bp, Homo sapiens
gatttcatttcaactgtttgc

SEQ ID NO: 761113 - DNA, 13 bp, Homo sapiens
gatttccaggccc

SEQ ID NO: 761114 - DNA, 18 bp, Homo sapiens
gatttccaggcccctgag

SEQ ID NO: 761115 - DNA, 20 bp, Homo sapiens
gatttccattgtgtggcctg

SEQ ID NO: 761116 - DNA, 21 bp, Homo sapiens
gatttccattgtgtggcctgg

SEQ ID NO: 761117 - DNA, 21 bp, Homo sapiens
gatttcccccctccgcctcca

SEQ ID NO: 761118 - DNA, 18 bp, Homo sapiens
gatttccctgcagacctc

SEQ ID NO: 761119 - DNA, 22 bp, Homo sapiens
gatttcccttcatttaaactaa

SEQ ID NO: 761120 - DNA, 22 bp, Homo sapiens
gatttccgttaaaataccagcc

SEQ ID NO: 761121 - DNA, 14 bp, Homo sapiens
gatttcctaaacat

SEQ ID NO: 761122 - DNA, 18 bp, Homo sapiens
gatttcctacagaaatac

SEQ ID NO: 761123 - DNA, 22 bp, Homo sapiens
gatttcctacagaaatactgct

SEQ ID NO: 761124 - DNA, 22 bp, Homo sapiens
gatttctaacagtccttgcttt

SEQ ID NO: 761125 - DNA, 10 bp, Homo sapiens
gatttctaat

SEQ ID NO: 761126 - DNA, 23 bp, Homo sapiens
gatttctagaaagcctgttcccc

SEQ ID NO: 761127 - DNA, 16 bp, Homo sapiens
gatttctagcaggcag

SEQ ID NO: 761128 - DNA, 17 bp, Homo sapiens
gatttctagcaggcagg

SEQ ID NO: 761129 - DNA, 21 bp, Homo sapiens
gatttctagtgtatactctgt

SEQ ID NO: 761130 - DNA, 20 bp, Homo sapiens
gatttctcagtgatttccta

SEQ ID NO: 761131 - DNA, 20 bp, Homo sapiens
gatttctcccagctctagac

SEQ ID NO: 761132 - DNA, 14 bp, Homo sapiens
gatttctctgaaca

SEQ ID NO: 761133 - DNA, 17 bp, Homo sapiens
cctctcctgccctctgc

SEQ ID NO: 761134 - DNA, 18 bp, Homo sapiens
cctctcctgccctctgct

SEQ ID NO: 761135 - DNA, 22 bp, Homo sapiens
cctctcctgccctctgctctgc

SEQ ID NO: 761136 - DNA, 12 bp, Homo sapiens
gcaaaaaatact

SEQ ID NO: 761137 - DNA, 18 bp, Homo sapiens
gcaaaaaatactttttct

SEQ ID NO: 761138 - DNA, 11 bp, Homo sapiens
cctctgctcca

SEQ ID NO: 761139 - DNA, 16 bp, Homo sapiens
cctctgctccagcaac

SEQ ID NO: 761140 - DNA, 12 bp, Homo sapiens
cctctgctccct

SEQ ID NO: 761141 - DNA, 13 bp, Homo sapiens
cctctgctccctc

SEQ ID NO: 761142 - DNA, 18 bp, Homo sapiens
cctctgctcctggagcct

SEQ ID NO: 761143 - DNA, 22 bp, Homo sapiens
cctctgctcctggagcctttga

SEQ ID NO: 761144 - DNA, 22 bp, Homo sapiens
cctctgctctgaggcttccaga

SEQ ID NO: 761145 - DNA, 15 bp, Homo sapiens
cctctgctctgcctg

SEQ ID NO: 761146 - DNA, 20 bp, Homo sapiens
cctctgctgaatgcagggaa

SEQ ID NO: 761147 - DNA, 17 bp, Homo sapiens
cctctgctgacctgctg

SEQ ID NO: 761148 - DNA, 12 bp, Homo sapiens
cctctgctgccc

SEQ ID NO: 761149 - DNA, 13 bp, Homo sapiens
cctctgctgcccc

SEQ ID NO: 761150 - DNA, 14 bp, Homo sapiens
cctctgctgccccc

SEQ ID NO: 761151 - DNA, 23 bp, Homo sapiens
cctctgctgctgcccggggtggg

SEQ ID NO: 761152 - DNA, 19 bp, Homo sapiens
cctctgctgctgtccctcc

SEQ ID NO: 761153 - DNA, 18 bp, Homo sapiens
cctctgcttctcatccca

SEQ ID NO: 761154 - DNA, 19 bp, Homo sapiens
cctctggaaccccccaggc

SEQ ID NO: 761155 - DNA, 16 bp, Homo sapiens
cctctggaattgctca

SEQ ID NO: 761156 - DNA, 15 bp, Homo sapiens
cctctggactggcta

SEQ ID NO: 761157 - DNA, 17 bp, Homo sapiens
cctctggactggctaga

SEQ ID NO: 761158 - DNA, 18 bp, Homo sapiens
cctctggactggctagag

SEQ ID NO: 761159 - DNA, 21 bp, Homo sapiens
cctctggagtggccactaagc

SEQ ID NO: 761160 - DNA, 17 bp, Homo sapiens
cctctggattccctttt

SEQ ID NO: 761161 - DNA, 23 bp, Homo sapiens
cctctggccaaatatgcactttc

SEQ ID NO: 761162 - DNA, 14 bp, Homo sapiens
cctctggcccctca

SEQ ID NO: 761163 - DNA, 12 bp, Homo sapiens
cctctggccctg

SEQ ID NO: 761164 - DNA, 15 bp, Homo sapiens
cctctggccctgcct

SEQ ID NO: 761165 - DNA, 15 bp, Homo sapiens
cctctggcccttgga

SEQ ID NO: 761166 - DNA, 17 bp, Homo sapiens
cctctggccgcagaggt

SEQ ID NO: 761167 - DNA, 17 bp, Homo sapiens
cctctggccgccacccc

SEQ ID NO: 761168 - DNA, 13 bp, Homo sapiens
cctctggctagag

SEQ ID NO: 761169 - DNA, 22 bp, Homo sapiens
cctctggctagaggccagcccc

SEQ ID NO: 761170 - DNA, 23 bp, Homo sapiens
cctctggctagaggccagcccca

SEQ ID NO: 761171 - DNA, 24 bp, Homo sapiens
cctctggctagaggccagccccac

SEQ ID NO: 761172 - DNA, 17 bp, Homo sapiens
cctctggctccagctgg

SEQ ID NO: 761173 - DNA, 12 bp, Homo sapiens
cctctggcttcc

SEQ ID NO: 761174 - DNA, 16 bp, Homo sapiens
cctctggctttcccag

SEQ ID NO: 761175 - DNA, 20 bp, Homo sapiens
cctctggctttcccaggaga

SEQ ID NO: 761176 - DNA, 18 bp, Homo sapiens
cctctgggaacctcccag

SEQ ID NO: 761177 - DNA, 23 bp, Homo sapiens
cctctgggcacgcctgctggccg

SEQ ID NO: 761178 - DNA, 17 bp, Homo sapiens
cctctgggcagcctgct

SEQ ID NO: 761179 - DNA, 23 bp, Homo sapiens
cctctgggcagcctgctttggcc

SEQ ID NO: 761180 - DNA, 16 bp, Homo sapiens
cctctgggcaggacct

SEQ ID NO: 761181 - DNA, 12 bp, Homo sapiens
cctctgggccat

SEQ ID NO: 761182 - DNA, 16 bp, Homo sapiens
cctctggggacaggat

SEQ ID NO: 761183 - DNA, 21 bp, Homo sapiens
cctctggggccttcgggaccc

SEQ ID NO: 761184 - DNA, 12 bp, Homo sapiens
cctctgggggga

SEQ ID NO: 761185 - DNA, 21 bp, Homo sapiens
cctctgggtccttggctcccg

SEQ ID NO: 761186 - DNA, 19 bp, Homo sapiens
cctctgggttccagcagag

SEQ ID NO: 761187 - DNA, 23 bp, Homo sapiens
cctctggtaaacattcctccagc

SEQ ID NO: 761188 - DNA, 15 bp, Homo sapiens
cctctggtcaggagg

SEQ ID NO: 761189 - DNA, 16 bp, Homo sapiens
cctctggtccttctga

SEQ ID NO: 761190 - DNA, 21 bp, Homo sapiens
cctctggtcgctcctgcccac

SEQ ID NO: 761191 - DNA, 15 bp, Homo sapiens
cctctggtggctcct

SEQ ID NO: 761192 - DNA, 19 bp, Homo sapiens
cctctggtgtgtggtgagg

SEQ ID NO: 761193 - DNA, 23 bp, Homo sapiens
cctctggtgtgtggtgaggggct

SEQ ID NO: 761194 - DNA, 16 bp, Homo sapiens
cctctggttcctttca

SEQ ID NO: 761195 - DNA, 15 bp, Homo sapiens
cctctgtaggcagca

SEQ ID NO: 761196 - DNA, 18 bp, Homo sapiens
cctctgtaggcagcagag

SEQ ID NO: 761197 - DNA, 18 bp, Homo sapiens
cctctgtatagaaatcta

SEQ ID NO: 761198 - DNA, 21 bp, Homo sapiens
cctctgtcagtcacagccacc

SEQ ID NO: 761199 - DNA, 22 bp, Homo sapiens
cctctgtccaaacatttcatcc

SEQ ID NO: 761200 - DNA, 20 bp, Homo sapiens
cctctgtccaggcactgaga

SEQ ID NO: 761201 - DNA, 21 bp, Homo sapiens
cctctgtccaggcactgagat

SEQ ID NO: 761202 - DNA, 18 bp, Homo sapiens
cctctgtccccaggcctg

SEQ ID NO: 761203 - DNA, 14 bp, Homo sapiens
cctctgtctaggac

SEQ ID NO: 761204 - DNA, 12 bp, Homo sapiens
cctctgtctcat

SEQ ID NO: 761205 - DNA, 22 bp, Homo sapiens
cctctgtcttgtgaaggcaggg

SEQ ID NO: 761206 - DNA, 14 bp, Homo sapiens
cctctgtcttttct

SEQ ID NO: 761207 - DNA, 21 bp, Homo sapiens
cctctgtgaccaatgtcttga

SEQ ID NO: 761208 - DNA, 14 bp, Homo sapiens
cctctgtgccttct

SEQ ID NO: 761209 - DNA, 15 bp, Homo sapiens
cctctgtggagcgcc

SEQ ID NO: 761210 - DNA, 19 bp, Homo sapiens
cctctgtggtcacagaggg

SEQ ID NO: 761211 - DNA, 18 bp, Homo sapiens
cctctgtgtagccgccct

SEQ ID NO: 761212 - DNA, 19 bp, Homo sapiens
cctctgtgtccttccctgc

SEQ ID NO: 761213 - DNA, 21 bp, Homo sapiens
cctctgttaggtccattttct

SEQ ID NO: 761214 - DNA, 13 bp, Homo sapiens
cctctgttcattt

SEQ ID NO: 761215 - DNA, 16 bp, Homo sapiens
cctctgttctctcccc

SEQ ID NO: 761216 - DNA, 19 bp, Homo sapiens
cctctgttctctcccctca

SEQ ID NO: 761217 - DNA, 21 bp, Homo sapiens
cctctgtttctctttccttgg

SEQ ID NO: 761218 - DNA, 17 bp, Homo sapiens
cctcttaaaaaataaaa

SEQ ID NO: 761219 - DNA, 21 bp, Homo sapiens
cctcttaaagctgcctgtagt

SEQ ID NO: 761220 - DNA, 23 bp, Homo sapiens
cctcttaaagctgcctgtagtta

SEQ ID NO: 761221 - DNA, 22 bp, Homo sapiens
cctcttaagatctgactgccaa

SEQ ID NO: 761222 - DNA, 14 bp, Homo sapiens
cctcttagaaaaac

SEQ ID NO: 761223 - DNA, 13 bp, Homo sapiens
cctcttcaccccc

SEQ ID NO: 761224 - DNA, 22 bp, Homo sapiens
cctcttcactgtggccacagcc

SEQ ID NO: 761225 - DNA, 16 bp, Homo sapiens
cctcttcagaggccct

SEQ ID NO: 761226 - DNA, 15 bp, Homo sapiens
cctcttccacccatt

SEQ ID NO: 761227 - DNA, 18 bp, Homo sapiens
cctcttccagtgaacatt

SEQ ID NO: 761228 - DNA, 16 bp, Homo sapiens
cctcttccatgctgtg

SEQ ID NO: 761229 - DNA, 13 bp, Homo sapiens
cctcttcccatga

SEQ ID NO: 761230 - DNA, 17 bp, Homo sapiens
cctcttcccatgactgc

SEQ ID NO: 761231 - DNA, 13 bp, Homo sapiens
cctcttccccaga

SEQ ID NO: 761232 - DNA, 15 bp, Homo sapiens
cctcttcccccaaga

SEQ ID NO: 761233 - DNA, 15 bp, Homo sapiens
cctcttccccttgcc

SEQ ID NO: 761234 - DNA, 21 bp, Homo sapiens
cctcttccccttgcccttgcc

SEQ ID NO: 761235 - DNA, 21 bp, Homo sapiens
cctcttccctgaagagacagg

SEQ ID NO: 761236 - DNA, 13 bp, Homo sapiens
cctcttcccttcc

SEQ ID NO: 761237 - DNA, 18 bp, Homo sapiens
cctcttcccttcctccat

SEQ ID NO: 761238 - DNA, 16 bp, Homo sapiens
cctcttccgaatgggt

SEQ ID NO: 761239 - DNA, 14 bp, Homo sapiens
cctcttcctaccct

SEQ ID NO: 761240 - DNA, 19 bp, Homo sapiens
cctcttcctccctcattcc

SEQ ID NO: 761241 - DNA, 15 bp, Homo sapiens
cctcttcctccctgg

SEQ ID NO: 761242 - DNA, 13 bp, Homo sapiens
cctcttcctctga

SEQ ID NO: 761243 - DNA, 18 bp, Homo sapiens
cctcttctattttgtaaa

SEQ ID NO: 761244 - DNA, 15 bp, Homo sapiens
cctcttctcaagtgc

SEQ ID NO: 761245 - DNA, 19 bp, Homo sapiens
cctcttctcaagtgcctta

SEQ ID NO: 761246 - DNA, 20 bp, Homo sapiens
cctcttctccttgccttgct

SEQ ID NO: 761247 - DNA, 15 bp, Homo sapiens
cctcttctctcctca

SEQ ID NO: 761248 - DNA, 12 bp, Homo sapiens
cctcttctcttc

SEQ ID NO: 761249 - DNA, 21 bp, Homo sapiens
cctcttctcttgacagtctga

SEQ ID NO: 761250 - DNA, 20 bp, Homo sapiens
cctcttctgacgtgcctttt

SEQ ID NO: 761251 - DNA, 17 bp, Homo sapiens
cctcttctgggagggca

SEQ ID NO: 761252 - DNA, 17 bp, Homo sapiens
cctcttcttcttcagaa

SEQ ID NO: 761253 - DNA, 11 bp, Homo sapiens
cctcttctttt

SEQ ID NO: 761254 - DNA, 20 bp, Homo sapiens
cctcttgaccaggctgcctc

SEQ ID NO: 761255 - DNA, 15 bp, Homo sapiens
cctcttgaccctgca

SEQ ID NO: 761256 - DNA, 16 bp, Homo sapiens
cctcttgagcagtggc

SEQ ID NO: 761257 - DNA, 17 bp, Homo sapiens
cctcttgagcagtggct

SEQ ID NO: 761258 - DNA, 19 bp, Homo sapiens
cctgaaggtattggcctgt

SEQ ID NO: 761259 - DNA, 20 bp, Homo sapiens
cctgaaggtattggcctgtt

SEQ ID NO: 761260 - DNA, 14 bp, Homo sapiens
cctgaatcatgagc

SEQ ID NO: 761261 - DNA, 21 bp, Homo sapiens
cctgaatcatgagcctgctgg

SEQ ID NO: 761262 - DNA, 21 bp, Homo sapiens
cctgaatccaaactaatccat

SEQ ID NO: 761263 - DNA, 11 bp, Homo sapiens
cctgaatctga

SEQ ID NO: 761264 - DNA, 18 bp, Homo sapiens
cctgaatctgtgcaaaca

SEQ ID NO: 761265 - DNA, 22 bp, Homo sapiens
cctgaatctgtgcctgcactga

SEQ ID NO: 761266 - DNA, 18 bp, Homo sapiens
cctgaatttcttcttttc

SEQ ID NO: 761267 - DNA, 18 bp, Homo sapiens
cctgacaatggcagctag

SEQ ID NO: 761268 - DNA, 14 bp, Homo sapiens
cctgacacaccagg

SEQ ID NO: 761269 - DNA, 18 bp, Homo sapiens
gcaacaagactgccaggt

SEQ ID NO: 761270 - DNA, 17 bp, Homo sapiens
gcaacacaagctggaag

SEQ ID NO: 761271 - DNA, 23 bp, Homo sapiens
gcaacacaagctggaagcacatg

SEQ ID NO: 761272 - DNA, 13 bp, Homo sapiens
gcaacacacagac

SEQ ID NO: 761273 - DNA, 15 bp, Homo sapiens
gcaacacagccacta

SEQ ID NO: 761274 - DNA, 14 bp, Homo sapiens
gcaacagagcactt

SEQ ID NO: 761275 - DNA, 16 bp, Homo sapiens
gcaacagatcagtaaa

SEQ ID NO: 761276 - DNA, 19 bp, Homo sapiens
gcaacagcaaatcacgacc

SEQ ID NO: 761277 - DNA, 22 bp, Homo sapiens
gcaacagcctaatcccgtgccc

SEQ ID NO: 761278 - DNA, 13 bp, Homo sapiens
gcaacagcttcag

SEQ ID NO: 761279 - DNA, 19 bp, Homo sapiens
gcaacaggccattgtgaac

SEQ ID NO: 761280 - DNA, 12 bp, Homo sapiens
gcaacagggagc

SEQ ID NO: 761281 - DNA, 21 bp, Homo sapiens
gcaacaggggaggaaaaaaga

SEQ ID NO: 761282 - DNA, 22 bp, Homo sapiens
gcaacagggtatggactatctg

SEQ ID NO: 761283 - DNA, 20 bp, Homo sapiens
gcaacaggttttataatttt

SEQ ID NO: 761284 - DNA, 13 bp, Homo sapiens
gcaacatagcaaa

SEQ ID NO: 761285 - DNA, 17 bp, Homo sapiens
gcaacatatctctgccg

SEQ ID NO: 761286 - DNA, 13 bp, Homo sapiens
gcaacatccaaaa

SEQ ID NO: 761287 - DNA, 17 bp, Homo sapiens
gcaacatccaaaatagt

SEQ ID NO: 761288 - DNA, 21 bp, Homo sapiens
gcaacatctcgagccccctgg

SEQ ID NO: 761289 - DNA, 22 bp, Homo sapiens
gcaacatgaagaatgcattcaa

SEQ ID NO: 761290 - DNA, 15 bp, Homo sapiens
gcaaccaactgcccc

SEQ ID NO: 761291 - DNA, 15 bp, Homo sapiens
gcaaccaggaacagc

SEQ ID NO: 761292 - DNA, 20 bp, Homo sapiens
gcaaccaggaacagcaaatg

SEQ ID NO: 761293 - DNA, 14 bp, Homo sapiens
gcaaccaggcagct

SEQ ID NO: 761294 - DNA, 16 bp, Homo sapiens
gcaaccccagttctgc

SEQ ID NO: 761295 - DNA, 24 bp, Homo sapiens
gcaaccccagttctgctcctctcc

SEQ ID NO: 761296 - DNA, 20 bp, Homo sapiens
gcaacccctgtacccagctc

SEQ ID NO: 761297 - DNA, 21 bp, Homo sapiens
gcaacccctgtacccagctcc

SEQ ID NO: 761298 - DNA, 16 bp, Homo sapiens
gcaacccgctggagcc

SEQ ID NO: 761299 - DNA, 22 bp, Homo sapiens
gcaacccgctggagcccacagc

SEQ ID NO: 761300 - DNA, 16 bp, Homo sapiens
gcaaccctgcctgtca

SEQ ID NO: 761301 - DNA, 14 bp, Homo sapiens
gcaaccgcttccct

SEQ ID NO: 761302 - DNA, 14 bp, Homo sapiens
gcaacctacccagc

SEQ ID NO: 761303 - DNA, 18 bp, Homo sapiens
gcaacctacccagcgtgg

SEQ ID NO: 761304 - DNA, 12 bp, Homo sapiens
gcaacctcacct

SEQ ID NO: 761305 - DNA, 18 bp, Homo sapiens
gcaacctcaccttcctgt

SEQ ID NO: 761306 - DNA, 22 bp, Homo sapiens
gcaacctcaccttcctgtgggt

SEQ ID NO: 761307 - DNA, 13 bp, Homo sapiens
gcaacctccgcct

SEQ ID NO: 761308 - DNA, 20 bp, Homo sapiens
gcaacctgtggctcagggga

SEQ ID NO: 761309 - DNA, 23 bp, Homo sapiens
gcaacctttcacctttgtgtatt

SEQ ID NO: 761310 - DNA, 15 bp, Homo sapiens
gcaacgcccctccaa

SEQ ID NO: 761311 - DNA, 12 bp, Homo sapiens
gcaacggcccat

SEQ ID NO: 761312 - DNA, 18 bp, Homo sapiens
gcaacggggaggccaagt

SEQ ID NO: 761313 - DNA, 17 bp, Homo sapiens
gcaacgtagcctgggct

SEQ ID NO: 761314 - DNA, 22 bp, Homo sapiens
gcaacgtttacaccgactagcc

SEQ ID NO: 761315 - DNA, 23 bp, Homo sapiens
gcaactaaggacaaattagcatg

SEQ ID NO: 761316 - DNA, 19 bp, Homo sapiens
gcaactacagaagtggaag

SEQ ID NO: 761317 - DNA, 13 bp, Homo sapiens
gcaactcaaagag

SEQ ID NO: 761318 - DNA, 19 bp, Homo sapiens
gcaactgaataaatacctc

SEQ ID NO: 761319 - DNA, 20 bp, Homo sapiens
gcaactgacttcatttgtgc

SEQ ID NO: 761320 - DNA, 13 bp, Homo sapiens
gcaactgaggcag

SEQ ID NO: 761321 - DNA, 19 bp, Homo sapiens
gcaactgaggcagacagca

SEQ ID NO: 761322 - DNA, 12 bp, Homo sapiens
gcaactgcaaga

SEQ ID NO: 761323 - DNA, 18 bp, Homo sapiens
gcaactgcattggctttg

SEQ ID NO: 761324 - DNA, 15 bp, Homo sapiens
gcaactgcccttcca

SEQ ID NO: 761325 - DNA, 21 bp, Homo sapiens
gcaacttagatctctcctgca

SEQ ID NO: 761326 - DNA, 22 bp, Homo sapiens
gcaacttagatctctcctgcaa

SEQ ID NO: 761327 - DNA, 15 bp, Homo sapiens
gcaacttcagtttta

SEQ ID NO: 761328 - DNA, 15 bp, Homo sapiens
gcaacttccgctgag

SEQ ID NO: 761329 - DNA, 17 bp, Homo sapiens
gcaacttccgctgaggg

SEQ ID NO: 761330 - DNA, 14 bp, Homo sapiens
gcaacttcttctcc

SEQ ID NO: 761331 - DNA, 20 bp, Homo sapiens
gcaacttcttctccatccct

SEQ ID NO: 761332 - DNA, 15 bp, Homo sapiens
gcaacttgcttctaa

SEQ ID NO: 761333 - DNA, 22 bp, Homo sapiens
gcaacttgtctttttctggact

SEQ ID NO: 761334 - DNA, 16 bp, Homo sapiens
gcaacttgtgaactcc

SEQ ID NO: 761335 - DNA, 14 bp, Homo sapiens
gcaacttttaaagc

SEQ ID NO: 761336 - DNA, 16 bp, Homo sapiens
gcaacttttaaagctc

SEQ ID NO: 761337 - DNA, 11 bp, Homo sapiens
gcaacttttta

SEQ ID NO: 761338 - DNA, 14 bp, Homo sapiens
gcaagaaagcttga

SEQ ID NO: 761339 - DNA, 17 bp, Homo sapiens
gcaagaaatggcgtctg

SEQ ID NO: 761340 - DNA, 21 bp, Homo sapiens
gcaagaaatggcgtctgctct

SEQ ID NO: 761341 - DNA, 21 bp, Homo sapiens
gcaagaacccaagtgcctcac

SEQ ID NO: 761342 - DNA, 23 bp, Homo sapiens
gcaagaaggcaaaaatagtttgg

SEQ ID NO: 761343 - DNA, 17 bp, Homo sapiens
gcaagaataaaaaagaa

SEQ ID NO: 761344 - DNA, 15 bp, Homo sapiens
gcaagaattaaaact

SEQ ID NO: 761345 - DNA, 16 bp, Homo sapiens
gcaagaattaaaactg

SEQ ID NO: 761346 - DNA, 20 bp, Homo sapiens
gcaagaattaaaactgagtc

SEQ ID NO: 761347 - DNA, 21 bp, Homo sapiens
gcaagacagaaaagtgcctga

SEQ ID NO: 761348 - DNA, 12 bp, Homo sapiens
gcaagacctcat

SEQ ID NO: 761349 - DNA, 16 bp, Homo sapiens
gcaagactgaattaat

SEQ ID NO: 761350 - DNA, 19 bp, Homo sapiens
gcaagactgcaaacttttt

SEQ ID NO: 761351 - DNA, 19 bp, Homo sapiens
gcaagagaattgcttgaac

SEQ ID NO: 761352 - DNA, 21 bp, Homo sapiens
gcaagagagcagcgcccaggc

SEQ ID NO: 761353 - DNA, 13 bp, Homo sapiens
gcaagagccttgg

SEQ ID NO: 761354 - DNA, 17 bp, Homo sapiens
gcaagagggaacaaaac

SEQ ID NO: 761355 - DNA, 14 bp, Homo sapiens
gcaagagggaaggt

SEQ ID NO: 761356 - DNA, 22 bp, Homo sapiens
gcaagagggaggggacagaggc

SEQ ID NO: 761357 - DNA, 22 bp, Homo sapiens
gcaagagggggtggaggggtgt

SEQ ID NO: 761358 - DNA, 19 bp, Homo sapiens
gcaagagtgtggaggctga

SEQ ID NO: 761359 - DNA, 17 bp, Homo sapiens
gcaagatacaggaaaaa

SEQ ID NO: 761360 - DNA, 13 bp, Homo sapiens
gcaagatgaattt

SEQ ID NO: 761361 - DNA, 21 bp, Homo sapiens
gcaagatgtgaattattgaca

SEQ ID NO: 761362 - DNA, 23 bp, Homo sapiens
gcaagcaaatcccatttcttgaa

SEQ ID NO: 761363 - DNA, 14 bp, Homo sapiens
gcaagcacatctgc

SEQ ID NO: 761364 - DNA, 19 bp, Homo sapiens
gcaagcagtctaccctgtc

SEQ ID NO: 761365 - DNA, 20 bp, Homo sapiens
gcaagcatttatgtttattt

SEQ ID NO: 761366 - DNA, 11 bp, Homo sapiens
gcaagccagac

SEQ ID NO: 761367 - DNA, 22 bp, Homo sapiens
gcaagccagacctagcaggctg

SEQ ID NO: 761368 - DNA, 11 bp, Homo sapiens
gcaagccaggg

SEQ ID NO: 761369 - DNA, 16 bp, Homo sapiens
gcaagccagggcccag

SEQ ID NO: 761370 - DNA, 11 bp, Homo sapiens
gcaagccataa

SEQ ID NO: 761371 - DNA, 16 bp, Homo sapiens
gcaagccatcatcctc

SEQ ID NO: 761372 - DNA, 17 bp, Homo sapiens
gcaagccatcatcctcc

SEQ ID NO: 761373 - DNA, 14 bp, Homo sapiens
gcaagccccagggc

SEQ ID NO: 761374 - DNA, 21 bp, Homo sapiens
gcaagccccagggcctggggg

SEQ ID NO: 761375 - DNA, 14 bp, Homo sapiens
gcaagcccctcagc

SEQ ID NO: 761376 - DNA, 18 bp, Homo sapiens
gcaagcccctcagccctt

SEQ ID NO: 761377 - DNA, 23 bp, Homo sapiens
gcaagcccctcagcccttgcccc

SEQ ID NO: 761378 - DNA, 19 bp, Homo sapiens
gcaagcctgtaatcccagc

SEQ ID NO: 761379 - DNA, 20 bp, Homo sapiens
gcaagcctgtaatcccagct

SEQ ID NO: 761380 - DNA, 14 bp, Homo sapiens
cctgcaaaggccct

SEQ ID NO: 761381 - DNA, 16 bp, Homo sapiens
cctgcaaaggcccttg

SEQ ID NO: 761382 - DNA, 18 bp, Homo sapiens
cctgcaaaggcccttgtc

SEQ ID NO: 761383 - DNA, 19 bp, Homo sapiens
cctgcaaaggcccttgtca

SEQ ID NO: 761384 - DNA, 15 bp, Homo sapiens
cctgcaaatctagtg

SEQ ID NO: 761385 - DNA, 18 bp, Homo sapiens
cctgcaacttccgctgag

SEQ ID NO: 761386 - DNA, 19 bp, Homo sapiens
cctgcaacttccgctgagg

SEQ ID NO: 761387 - DNA, 13 bp, Homo sapiens
cctgcaagatgga

SEQ ID NO: 761388 - DNA, 14 bp, Homo sapiens
cctgcaagccccag

SEQ ID NO: 761389 - DNA, 16 bp, Homo sapiens
cctgcaagccccaggg

SEQ ID NO: 761390 - DNA, 17 bp, Homo sapiens
cctgcaagccccagggc

SEQ ID NO: 761391 - DNA, 19 bp, Homo sapiens
cctgcaagccccagggcct

SEQ ID NO: 761392 - DNA, 22 bp, Homo sapiens
cctgcaagccccagggcctggg

SEQ ID NO: 761393 - DNA, 21 bp, Homo sapiens
cctgcaagcctgtctgagact

SEQ ID NO: 761394 - DNA, 12 bp, Homo sapiens
cctgcaaggact

SEQ ID NO: 761395 - DNA, 19 bp, Homo sapiens
cctgcaaggtgaaacgact

SEQ ID NO: 761396 - DNA, 16 bp, Homo sapiens
cctgcaatatttgaat

SEQ ID NO: 761397 - DNA, 15 bp, Homo sapiens
cctgcaatcactttt

SEQ ID NO: 761398 - DNA, 18 bp, Homo sapiens
cctgcaatcactttttgg

SEQ ID NO: 761399 - DNA, 20 bp, Homo sapiens
cctgcacaaagcccttccat

SEQ ID NO: 761400 - DNA, 19 bp, Homo sapiens
cctgcacaataaaaatgtt

SEQ ID NO: 761401 - DNA, 12 bp, Homo sapiens
cctgcacacagg

SEQ ID NO: 761402 - DNA, 17 bp, Homo sapiens
gcaatttattaaaatga

SEQ ID NO: 761403 - DNA, 23 bp, Homo sapiens
gcaatttcaaattactctttctc

SEQ ID NO: 761404 - DNA, 14 bp, Homo sapiens
gcaatttgaattta

SEQ ID NO: 761405 - DNA, 17 bp, Homo sapiens
gcaatttgtttaaagaa

SEQ ID NO: 761406 - DNA, 20 bp, Homo sapiens
gcaatttgtttaaagaataa

SEQ ID NO: 761407 - DNA, 16 bp, Homo sapiens
gcaattttaatcccct

SEQ ID NO: 761408 - DNA, 19 bp, Homo sapiens
gcaattttaattgattatt

SEQ ID NO: 761409 - DNA, 19 bp, Homo sapiens
gcaattttagtgtattaat

SEQ ID NO: 761410 - DNA, 13 bp, Homo sapiens
gcaattttctttg

SEQ ID NO: 761411 - DNA, 23 bp, Homo sapiens
gcaatttttccatgaagtttgaa

SEQ ID NO: 761412 - DNA, 21 bp, Homo sapiens
gcacaaaagcagatacttgag

SEQ ID NO: 761413 - DNA, 14 bp, Homo sapiens
gcacaaacttcaga

SEQ ID NO: 761414 - DNA, 16 bp, Homo sapiens
gcacaaagttctcaga

SEQ ID NO: 761415 - DNA, 20 bp, Homo sapiens
gcacaaagttctcagagctc

SEQ ID NO: 761416 - DNA, 16 bp, Homo sapiens
gcacaaatatttattt

SEQ ID NO: 761417 - DNA, 19 bp, Homo sapiens
gcacaaattagttatatat

SEQ ID NO: 761418 - DNA, 21 bp, Homo sapiens
gcacaacagccctgcctgaga

SEQ ID NO: 761419 - DNA, 22 bp, Homo sapiens
gcacaagccacaagtcttccag

SEQ ID NO: 761420 - DNA, 14 bp, Homo sapiens
gcacaagcgtgttt

SEQ ID NO: 761421 - DNA, 12 bp, Homo sapiens
gcacaagctcag

SEQ ID NO: 761422 - DNA, 13 bp, Homo sapiens
gcacaagctcaga

SEQ ID NO: 761423 - DNA, 14 bp, Homo sapiens
gcacaagctcagaa

SEQ ID NO: 761424 - DNA, 23 bp, Homo sapiens
gcacaaggaatttccctgtgtgg

SEQ ID NO: 761425 - DNA, 19 bp, Homo sapiens
gcacaaggccttaatggac

SEQ ID NO: 761426 - DNA, 21 bp, Homo sapiens
gcacaaggccttgcctggcct

SEQ ID NO: 761427 - DNA, 19 bp, Homo sapiens
gcacaaggctgaccaagag

SEQ ID NO: 761428 - DNA, 19 bp, Homo sapiens
gcacaaggttggttgctaa

SEQ ID NO: 761429 - DNA, 17 bp, Homo sapiens
gcacaagttatttaaat

SEQ ID NO: 761430 - DNA, 23 bp, Homo sapiens
gcacaataactagtaataccaaa

SEQ ID NO: 761431 - DNA, 14 bp, Homo sapiens
gcacaatatttctt

SEQ ID NO: 761432 - DNA, 17 bp, Homo sapiens
gcacaatcactaaactt

SEQ ID NO: 761433 - DNA, 20 bp, Homo sapiens
gcacaatcatggctcactgc

SEQ ID NO: 761434 - DNA, 20 bp, Homo sapiens
gcacaatggtcttacattgg

SEQ ID NO: 761435 - DNA, 17 bp, Homo sapiens
gcacaatgtttgatgtc

SEQ ID NO: 761436 - DNA, 15 bp, Homo sapiens
gcacaattctgtccc

SEQ ID NO: 761437 - DNA, 22 bp, Homo sapiens
gcacaatttaatatattcaaga

SEQ ID NO: 761438 - DNA, 22 bp, Homo sapiens
gcacaatttgagactgaaattt

SEQ ID NO: 761439 - DNA, 12 bp, Homo sapiens
gcacaatttgca

SEQ ID NO: 761440 - DNA, 14 bp, Homo sapiens
gcacacaaatatta

SEQ ID NO: 761441 - DNA, 18 bp, Homo sapiens
gcacacacaaacctactg

SEQ ID NO: 761442 - DNA, 22 bp, Homo sapiens
gcacacacaaacctactgccca

SEQ ID NO: 761443 - DNA, 12 bp, Homo sapiens
gcacacacacac

SEQ ID NO: 761444 - DNA, 14 bp, Homo sapiens
gcacacacacacac

SEQ ID NO: 761445 - DNA, 16 bp, Homo sapiens
gcacacacacacacag

SEQ ID NO: 761446 - DNA, 16 bp, Homo sapiens
gcacacacacatacag

SEQ ID NO: 761447 - DNA, 15 bp, Homo sapiens
gcacacacagctcct

SEQ ID NO: 761448 - DNA, 20 bp, Homo sapiens
gcacacacctgggtggacac

SEQ ID NO: 761449 - DNA, 23 bp, Homo sapiens
gcacacacggttttggcagctga

SEQ ID NO: 761450 - DNA, 18 bp, Homo sapiens
gcacacagacggcctagg

SEQ ID NO: 761451 - DNA, 12 bp, Homo sapiens
gcacacagcagc

SEQ ID NO: 761452 - DNA, 14 bp, Homo sapiens
gcacacagcagccc

SEQ ID NO: 761453 - DNA, 17 bp, Homo sapiens
gcacacagcagcccccc

SEQ ID NO: 761454 - DNA, 13 bp, Homo sapiens
gcacacagctact

SEQ ID NO: 761455 - DNA, 12 bp, Homo sapiens
gcacacaggaca

SEQ ID NO: 761456 - DNA, 14 bp, Homo sapiens
gcacacaggacagc

SEQ ID NO: 761457 - DNA, 17 bp, Homo sapiens
gcacacaggacagcggg

SEQ ID NO: 761458 - DNA, 12 bp, Homo sapiens
gcacacagggca

SEQ ID NO: 761459 - DNA, 13 bp, Homo sapiens
gcacacagggctc

SEQ ID NO: 761460 - DNA, 14 bp, Homo sapiens
gcacacatcaccag

SEQ ID NO: 761461 - DNA, 16 bp, Homo sapiens
gcacacatcttacctc

SEQ ID NO: 761462 - DNA, 18 bp, Homo sapiens
gcacacatcttacctctc

SEQ ID NO: 761463 - DNA, 11 bp, Homo sapiens
gcacacatttt

SEQ ID NO: 761464 - DNA, 12 bp, Homo sapiens
gcacacattttt

SEQ ID NO: 761465 - DNA, 16 bp, Homo sapiens
gcacaccaagtggctg

SEQ ID NO: 761466 - DNA, 12 bp, Homo sapiens
gcacaccactgc

SEQ ID NO: 761467 - DNA, 14 bp, Homo sapiens
gcacaccactgccc

SEQ ID NO: 761468 - DNA, 18 bp, Homo sapiens
gcacaccactgccctgcc

SEQ ID NO: 761469 - DNA, 19 bp, Homo sapiens
gcacaccactgccctgcct

SEQ ID NO: 761470 - DNA, 21 bp, Homo sapiens
gcacaccactgccctgcctgc

SEQ ID NO: 761471 - DNA, 22 bp, Homo sapiens
gcacaccactgccctgcctgcc

SEQ ID NO: 761472 - DNA, 13 bp, Homo sapiens
gcacaccagccgc

SEQ ID NO: 761473 - DNA, 19 bp, Homo sapiens
gcacaccagccgctgcagg

SEQ ID NO: 761474 - DNA, 23 bp, Homo sapiens
gcacacctcggccgaggcctgcg

SEQ ID NO: 761475 - DNA, 21 bp, Homo sapiens
gcacacctgaatcagctggac

SEQ ID NO: 761476 - DNA, 19 bp, Homo sapiens
gcacaccttaggttgacat

SEQ ID NO: 761477 - DNA, 19 bp, Homo sapiens
gcacacgcacgcacacaca

SEQ ID NO: 761478 - DNA, 14 bp, Homo sapiens
gcacacgcctccca

SEQ ID NO: 761479 - DNA, 17 bp, Homo sapiens
gcacacggctggtcact

SEQ ID NO: 761480 - DNA, 20 bp, Homo sapiens
gcacacggctggtcactctg

SEQ ID NO: 761481 - DNA, 21 bp, Homo sapiens
gcacacggctggtcactctgc

SEQ ID NO: 761482 - DNA, 21 bp, Homo sapiens
gcacacgggcgagctttctct

SEQ ID NO: 761483 - DNA, 19 bp, Homo sapiens
gcacactcatgcacacaga

SEQ ID NO: 761484 - DNA, 13 bp, Homo sapiens
gcacactgaggcc

SEQ ID NO: 761485 - DNA, 12 bp, Homo sapiens
gcacactgtagc

SEQ ID NO: 761486 - DNA, 23 bp, Homo sapiens
gcacactgtgattttgccctcct

SEQ ID NO: 761487 - DNA, 16 bp, Homo sapiens
gcacacttatttatga

SEQ ID NO: 761488 - DNA, 19 bp, Homo sapiens
gcacacttatttatgaatt

SEQ ID NO: 761489 - DNA, 20 bp, Homo sapiens
gcacacttatttatgaattg

SEQ ID NO: 761490 - DNA, 13 bp, Homo sapiens
gcacactttgcca

SEQ ID NO: 761491 - DNA, 22 bp, Homo sapiens
gcacactttgccatattttcac

SEQ ID NO: 761492 - DNA, 11 bp, Homo sapiens
gcacagaaaac

SEQ ID NO: 761493 - DNA, 12 bp, Homo sapiens
gcacagaaaacc

SEQ ID NO: 761494 - DNA, 20 bp, Homo sapiens
gcacagaaacacaatatttt

SEQ ID NO: 761495 - DNA, 14 bp, Homo sapiens
gcacagaatatttt

SEQ ID NO: 761496 - DNA, 23 bp, Homo sapiens
gcacagacttctggaaggctggc

SEQ ID NO: 761497 - DNA, 12 bp, Homo sapiens
gcacagagaagc

SEQ ID NO: 761498 - DNA, 15 bp, Homo sapiens
gcacagagagggaca

SEQ ID NO: 761499 - DNA, 12 bp, Homo sapiens
gcacagagccct

SEQ ID NO: 761500 - DNA, 21 bp, Homo sapiens
gcacagagccctgaggggctg

SEQ ID NO: 761501 - DNA, 11 bp, Homo sapiens
gcacagagcct

SEQ ID NO: 761502 - DNA, 14 bp, Homo sapiens
gcacagagcctggc

SEQ ID NO: 761503 - DNA, 20 bp, Homo sapiens
gcacctgggccccactggac

SEQ ID NO: 761504 - DNA, 17 bp, Homo sapiens
gcacctggggagtggga

SEQ ID NO: 761505 - DNA, 19 bp, Homo sapiens
gcacctgtactcaggaggc

SEQ ID NO: 761506 - DNA, 17 bp, Homo sapiens
gcacctgtagtcccagc

SEQ ID NO: 761507 - DNA, 11 bp, Homo sapiens
gcacctgtccc

SEQ ID NO: 761508 - DNA, 20 bp, Homo sapiens
gcacctgtccccaccctcca

SEQ ID NO: 761509 - DNA, 20 bp, Homo sapiens
gcaccttcaagcgctccagg

SEQ ID NO: 761510 - DNA, 21 bp, Homo sapiens
gcaccttcaagcgctccaggg

SEQ ID NO: 761511 - DNA, 15 bp, Homo sapiens
gcaccttcctcactt

SEQ ID NO: 761512 - DNA, 16 bp, Homo sapiens
gcaccttcctcacttc

SEQ ID NO: 761513 - DNA, 22 bp, Homo sapiens
gcaccttggcccaggagctctg

SEQ ID NO: 761514 - DNA, 18 bp, Homo sapiens
gcaccttgtcatgtacca

SEQ ID NO: 761515 - DNA, 15 bp, Homo sapiens
gcacctttctctgag

SEQ ID NO: 761516 - DNA, 16 bp, Homo sapiens
gcacctttctctgaga

SEQ ID NO: 761517 - DNA, 19 bp, Homo sapiens
gcacctttgcacaggatgc

SEQ ID NO: 761518 - DNA, 22 bp, Homo sapiens
gcacctttgtctggatgcacac

SEQ ID NO: 761519 - DNA, 21 bp, Homo sapiens
gcaccttttataccagagacc

SEQ ID NO: 761520 - DNA, 15 bp, Homo sapiens
gcacgaacccacctg

SEQ ID NO: 761521 - DNA, 19 bp, Homo sapiens
gcacgacgccctctcccca

SEQ ID NO: 761522 - DNA, 20 bp, Homo sapiens
gcacgagtgggaaggacttg

SEQ ID NO: 761523 - DNA, 10 bp, Homo sapiens
gcacgcacac

SEQ ID NO: 761524 - DNA, 11 bp, Homo sapiens
gcacgcacaca

SEQ ID NO: 761525 - DNA, 14 bp, Homo sapiens
gcacgcacacacac

SEQ ID NO: 761526 - DNA, 16 bp, Homo sapiens
gcacgcacacacacat

SEQ ID NO: 761527 - DNA, 19 bp, Homo sapiens
gcacgcacacgcacacatc

SEQ ID NO: 761528 - DNA, 21 bp, Homo sapiens
gcacgcacacgcacacatctt

SEQ ID NO: 761529 - DNA, 22 bp, Homo sapiens
gcacgcacctgtagtcccagct

SEQ ID NO: 761530 - DNA, 17 bp, Homo sapiens
gcacgcaggcggggcag

SEQ ID NO: 761531 - DNA, 15 bp, Homo sapiens
gcacgcccatgtgtg

SEQ ID NO: 761532 - DNA, 13 bp, Homo sapiens
gcacgcctgagcg

SEQ ID NO: 761533 - DNA, 16 bp, Homo sapiens
gcacgcctgcaggctg

SEQ ID NO: 761534 - DNA, 15 bp, Homo sapiens
gcacgcctgccatct

SEQ ID NO: 761535 - DNA, 13 bp, Homo sapiens
gcacgcctgcccc

SEQ ID NO: 761536 - DNA, 19 bp, Homo sapiens
ctttcctcctccctgtgtt

SEQ ID NO: 761537 - DNA, 13 bp, Homo sapiens
ctttcctcgcctg

SEQ ID NO: 761538 - DNA, 19 bp, Homo sapiens
ctttcctcggtctcccttc

SEQ ID NO: 761539 - DNA, 17 bp, Homo sapiens
ctttcctctccctcagg

SEQ ID NO: 761540 - DNA, 20 bp, Homo sapiens
ctttcctctccctcaggggc

SEQ ID NO: 761541 - DNA, 16 bp, Homo sapiens
ctttcctctgcagcac

SEQ ID NO: 761542 - DNA, 13 bp, Homo sapiens
ctttcctcttccc

SEQ ID NO: 761543 - DNA, 15 bp, Homo sapiens
ctttcctctttctgc

SEQ ID NO: 761544 - DNA, 17 bp, Homo sapiens
ctttcctgatgcccctg

SEQ ID NO: 761545 - DNA, 12 bp, Homo sapiens
ccagccctgtcc

SEQ ID NO: 761546 - DNA, 15 bp, Homo sapiens
ccagccctgtcctgg

SEQ ID NO: 761547 - DNA, 18 bp, Homo sapiens
ccagcccttagcacagag

SEQ ID NO: 761548 - DNA, 12 bp, Homo sapiens
ccagcccttccc

SEQ ID NO: 761549 - DNA, 19 bp, Homo sapiens
ccagcccttccctggcccc

SEQ ID NO: 761550 - DNA, 23 bp, Homo sapiens
ccagcccttccctggccccgccg

SEQ ID NO: 761551 - DNA, 17 bp, Homo sapiens
ccagcccttccttgggc

SEQ ID NO: 761552 - DNA, 19 bp, Homo sapiens
ccagccgccatgctcctgg

SEQ ID NO: 761553 - DNA, 18 bp, Homo sapiens
ccagccgccccagcccct

SEQ ID NO: 761554 - DNA, 17 bp, Homo sapiens
ccagccgccctgggctg

SEQ ID NO: 761555 - DNA, 15 bp, Homo sapiens
ccagccgctgcaggg

SEQ ID NO: 761556 - DNA, 23 bp, Homo sapiens
ccagccggagggacgcggaggag

SEQ ID NO: 761557 - DNA, 14 bp, Homo sapiens
ccagccggtgcctg

SEQ ID NO: 761558 - DNA, 15 bp, Homo sapiens
ccagccggtgcctgg

SEQ ID NO: 761559 - DNA, 22 bp, Homo sapiens
ccagcctatgagcatcctgagc

SEQ ID NO: 761560 - DNA, 20 bp, Homo sapiens
ccagcctcagaaggccccag

SEQ ID NO: 761561 - DNA, 17 bp, Homo sapiens
ccagcctcattgtgcca

SEQ ID NO: 761562 - DNA, 21 bp, Homo sapiens
ccagcctcattgtgccaagcc

SEQ ID NO: 761563 - DNA, 13 bp, Homo sapiens
ccagcctccagag

SEQ ID NO: 761564 - DNA, 19 bp, Homo sapiens
ccagcctccaggcccccaa

SEQ ID NO: 761565 - DNA, 13 bp, Homo sapiens
ccagcctcccctc

SEQ ID NO: 761566 - DNA, 17 bp, Homo sapiens
ccagcctcccctcccct

SEQ ID NO: 761567 - DNA, 21 bp, Homo sapiens
ccagcctcccctcccctgggg

SEQ ID NO: 761568 - DNA, 15 bp, Homo sapiens
ccagcctccctgtct

SEQ ID NO: 761569 - DNA, 20 bp, Homo sapiens
ccagcctccctgtctccagc

SEQ ID NO: 761570 - DNA, 22 bp, Homo sapiens
ccagcctccctgtctccagctg

SEQ ID NO: 761571 - DNA, 23 bp, Homo sapiens
ccagcctccctgtctccagctgc

SEQ ID NO: 761572 - DNA, 19 bp, Homo sapiens
ccagcctccgagagggaga

SEQ ID NO: 761573 - DNA, 13 bp, Homo sapiens
ccagcctcctctg

SEQ ID NO: 761574 - DNA, 15 bp, Homo sapiens
ccagcctccttgctg

SEQ ID NO: 761575 - DNA, 19 bp, Homo sapiens
ccagcctccttgctgaccc

SEQ ID NO: 761576 - DNA, 23 bp, Homo sapiens
ccagcctctccccgctctggatc

SEQ ID NO: 761577 - DNA, 22 bp, Homo sapiens
ccagcctctcccggctgcctgc

SEQ ID NO: 761578 - DNA, 22 bp, Homo sapiens
ccagcctgaaagatacagggga

SEQ ID NO: 761579 - DNA, 19 bp, Homo sapiens
ccagcctgaacagaagctc

SEQ ID NO: 761580 - DNA, 14 bp, Homo sapiens
ccagcctgacctga

SEQ ID NO: 761581 - DNA, 17 bp, Homo sapiens
ccagcctgaccttcctt

SEQ ID NO: 761582 - DNA, 13 bp, Homo sapiens
ccagcctgccccc

SEQ ID NO: 761583 - DNA, 14 bp, Homo sapiens
ccagcctgccccct

SEQ ID NO: 761584 - DNA, 17 bp, Homo sapiens
ccagcctgccccctatc

SEQ ID NO: 761585 - DNA, 13 bp, Homo sapiens
ccagcctgctgac

SEQ ID NO: 761586 - DNA, 15 bp, Homo sapiens
ccagcctgctgacag

SEQ ID NO: 761587 - DNA, 14 bp, Homo sapiens
ccagcctggccaga

SEQ ID NO: 761588 - DNA, 21 bp, Homo sapiens
ccagcctggccagacaagaag

SEQ ID NO: 761589 - DNA, 20 bp, Homo sapiens
ccagcctggccccggccttt

SEQ ID NO: 761590 - DNA, 23 bp, Homo sapiens
ccagcctggctctgccccctccc

SEQ ID NO: 761591 - DNA, 12 bp, Homo sapiens
ccagcctgggac

SEQ ID NO: 761592 - DNA, 19 bp, Homo sapiens
ccagcctgggagcccagag

SEQ ID NO: 761593 - DNA, 18 bp, Homo sapiens
ccagcctgggcagccagg

SEQ ID NO: 761594 - DNA, 23 bp, Homo sapiens
ccagcctgggcccatctccctgc

SEQ ID NO: 761595 - DNA, 16 bp, Homo sapiens
ccagcctgggcgacag

SEQ ID NO: 761596 - DNA, 12 bp, Homo sapiens
ccagcctggggc

SEQ ID NO: 761597 - DNA, 14 bp, Homo sapiens
ccagcctggggctc

SEQ ID NO: 761598 - DNA, 23 bp, Homo sapiens
ccagcctggggctccctctctgg

SEQ ID NO: 761599 - DNA, 16 bp, Homo sapiens
ccagcctgggtgacag

SEQ ID NO: 761600 - DNA, 18 bp, Homo sapiens
ccagcctgtaccttgctg

SEQ ID NO: 761601 - DNA, 21 bp, Homo sapiens
ccagcctgtaccttgctgtgg

SEQ ID NO: 761602 - DNA, 16 bp, Homo sapiens
ccagcctgtcacccag

SEQ ID NO: 761603 - DNA, 19 bp, Homo sapiens
ccagcctgtcccatggaca

SEQ ID NO: 761604 - DNA, 13 bp, Homo sapiens
ccagcctgtgtgt

SEQ ID NO: 761605 - DNA, 20 bp, Homo sapiens
ccagccttcctctgcagctg

SEQ ID NO: 761606 - DNA, 16 bp, Homo sapiens
ccagccttgagatgct

SEQ ID NO: 761607 - DNA, 18 bp, Homo sapiens
ccagccttgagccctggc

SEQ ID NO: 761608 - DNA, 10 bp, Homo sapiens
ccagccttgt

SEQ ID NO: 761609 - DNA, 20 bp, Homo sapiens
ccagcctttgggtcctgggc

SEQ ID NO: 761610 - DNA, 22 bp, Homo sapiens
ccagcctttgggtcctgggcag

SEQ ID NO: 761611 - DNA, 17 bp, Homo sapiens
ccagcgacctctctgcc

SEQ ID NO: 761612 - DNA, 19 bp, Homo sapiens
ccagcgacctctctgcctc

SEQ ID NO: 761613 - DNA, 20 bp, Homo sapiens
ccagcgacctctctgcctct

SEQ ID NO: 761614 - DNA, 13 bp, Homo sapiens
ccagcgagccaca

SEQ ID NO: 761615 - DNA, 20 bp, Homo sapiens
ccagcgagccacaggaacgg

SEQ ID NO: 761616 - DNA, 24 bp, Homo sapiens
ccagcgccaagtaaacagggtacc

SEQ ID NO: 761617 - DNA, 13 bp, Homo sapiens
ccagcgccagggc

SEQ ID NO: 761618 - DNA, 15 bp, Homo sapiens
ccagcgccagggccc

SEQ ID NO: 761619 - DNA, 23 bp, Homo sapiens
ccagcgccagggcccaggccatg

SEQ ID NO: 761620 - DNA, 14 bp, Homo sapiens
ccagcgcccgctgg

SEQ ID NO: 761621 - DNA, 17 bp, Homo sapiens
ccagcgcccgctgggct

SEQ ID NO: 761622 - DNA, 22 bp, Homo sapiens
ccagcgcccgctgggctgagcc

SEQ ID NO: 761623 - DNA, 13 bp, Homo sapiens
ccagcgcctccct

SEQ ID NO: 761624 - DNA, 14 bp, Homo sapiens
ccagcgcctccctc

SEQ ID NO: 761625 - DNA, 17 bp, Homo sapiens
ccagcgcctccctccac

SEQ ID NO: 761626 - DNA, 18 bp, Homo sapiens
ccagcgcctccctccacc

SEQ ID NO: 761627 - DNA, 13 bp, Homo sapiens
ccagcgctctggg

SEQ ID NO: 761628 - DNA, 13 bp, Homo sapiens
ccagcggaaacag

SEQ ID NO: 761629 - DNA, 23 bp, Homo sapiens
ccagcggccccccgcacagccac

SEQ ID NO: 761630 - DNA, 15 bp, Homo sapiens
ccagcggcttagcca

SEQ ID NO: 761631 - DNA, 14 bp, Homo sapiens
ccagcggggctgct

SEQ ID NO: 761632 - DNA, 20 bp, Homo sapiens
ccagcggtccctgcagaagc

SEQ ID NO: 761633 - DNA, 14 bp, Homo sapiens
ccagcgtcaggcct

SEQ ID NO: 761634 - DNA, 20 bp, Homo sapiens
ccagcgtcaggcctacctca

SEQ ID NO: 761635 - DNA, 14 bp, Homo sapiens
ccagcgtctgcagg

SEQ ID NO: 761636 - DNA, 16 bp, Homo sapiens
ccagcgtctgcagggt

SEQ ID NO: 761637 - DNA, 23 bp, Homo sapiens
ccagcgtctgcgcggatgtagca

SEQ ID NO: 761638 - DNA, 15 bp, Homo sapiens
ccagcgtggcccagg

SEQ ID NO: 761639 - DNA, 17 bp, Homo sapiens
ccagcgtggcccaggcc

SEQ ID NO: 761640 - DNA, 18 bp, Homo sapiens
ccagcgtggcccaggccg

SEQ ID NO: 761641 - DNA, 17 bp, Homo sapiens
ccagcgtgtggagcaga

SEQ ID NO: 761642 - DNA, 17 bp, Homo sapiens
ccagcgttcccttctcc

SEQ ID NO: 761643 - DNA, 19 bp, Homo sapiens
ccagcgttcccttctcccc

SEQ ID NO: 761644 - DNA, 23 bp, Homo sapiens
ccagcgtttagtttctagaggcc

SEQ ID NO: 761645 - DNA, 20 bp, Homo sapiens
ccagctaatctgtagggctg

SEQ ID NO: 761646 - DNA, 15 bp, Homo sapiens
ccagctaatttttgt

SEQ ID NO: 761647 - DNA, 14 bp, Homo sapiens
ccagctacattcct

SEQ ID NO: 761648 - DNA, 15 bp, Homo sapiens
ccagctacattcctc

SEQ ID NO: 761649 - DNA, 20 bp, Homo sapiens
ccagctaccccttctttgca

SEQ ID NO: 761650 - DNA, 21 bp, Homo sapiens
ccagctactcagaagcctgag

SEQ ID NO: 761651 - DNA, 15 bp, Homo sapiens
ccagctactcaggag

SEQ ID NO: 761652 - DNA, 20 bp, Homo sapiens
ccagctactcaggaggctga

SEQ ID NO: 761653 - DNA, 19 bp, Homo sapiens
ccagctactctgtccaggc

SEQ ID NO: 761654 - DNA, 20 bp, Homo sapiens
ccagctactctgtccaggcc

SEQ ID NO: 761655 - DNA, 21 bp, Homo sapiens
ccagctactctgtccaggcca

SEQ ID NO: 761656 - DNA, 23 bp, Homo sapiens
ccagctactctgtccaggccact

SEQ ID NO: 761657 - DNA, 15 bp, Homo sapiens
ccagctacttcctcc

SEQ ID NO: 761658 - DNA, 17 bp, Homo sapiens
ccagctacttcctcctc

SEQ ID NO: 761659 - DNA, 20 bp, Homo sapiens
ccagctacttgggagcctga

SEQ ID NO: 761660 - DNA, 20 bp, Homo sapiens
ccagctagtttttgtatttt

SEQ ID NO: 761661 - DNA, 22 bp, Homo sapiens
ccagctcaatggactggaaggg

SEQ ID NO: 761662 - DNA, 18 bp, Homo sapiens
ccagctcagaacccaggg

SEQ ID NO: 761663 - DNA, 23 bp, Homo sapiens
ctttctgtggctaaacagatgta

SEQ ID NO: 761664 - DNA, 12 bp, Homo sapiens
ctttctgtgtgc

SEQ ID NO: 761665 - DNA, 13 bp, Homo sapiens
ctttctgttccaa

SEQ ID NO: 761666 - DNA, 13 bp, Homo sapiens
ccagcttccaaag

SEQ ID NO: 761667 - DNA, 14 bp, Homo sapiens
ccagcttccaaagc

SEQ ID NO: 761668 - DNA, 15 bp, Homo sapiens
ccagcttcgtgctgg

SEQ ID NO: 761669 - DNA, 16 bp, Homo sapiens
ccagcttctctctcca

SEQ ID NO: 761670 - DNA, 18 bp, Homo sapiens
ccagcttctctctccctg

SEQ ID NO: 761671 - DNA, 23 bp, Homo sapiens
ccagcttctggtactctcctaga

SEQ ID NO: 761672 - DNA, 13 bp, Homo sapiens
ccagcttgccccc

SEQ ID NO: 761673 - DNA, 14 bp, Homo sapiens
ccagcttgctcttc

SEQ ID NO: 761674 - DNA, 22 bp, Homo sapiens
ccagcttgctgaggggcaggga

SEQ ID NO: 761675 - DNA, 21 bp, Homo sapiens
ctttgtaagacatttgtatat

SEQ ID NO: 761676 - DNA, 15 bp, Homo sapiens
ctttgtaagagcaaa

SEQ ID NO: 761677 - DNA, 12 bp, Homo sapiens
ctttgtaataaa

SEQ ID NO: 761678 - DNA, 20 bp, Homo sapiens
ctttgtaatattttccataa

SEQ ID NO: 761679 - DNA, 19 bp, Homo sapiens
ctttgtacagagtgctttt

SEQ ID NO: 761680 - DNA, 13 bp, Homo sapiens
ctttgtaccaaaa

SEQ ID NO: 761681 - DNA, 12 bp, Homo sapiens
ctttgtacttgt

SEQ ID NO: 761682 - DNA, 21 bp, Homo sapiens
ctttgtagatccttagaggtc

SEQ ID NO: 761683 - DNA, 15 bp, Homo sapiens
ctttgtatagagaat

SEQ ID NO: 761684 - DNA, 13 bp, Homo sapiens
ctttgtatattac

SEQ ID NO: 761685 - DNA, 12 bp, Homo sapiens
ctttgtatgcac

SEQ ID NO: 761686 - DNA, 13 bp, Homo sapiens
ctttgtatgtgga

SEQ ID NO: 761687 - DNA, 17 bp, Homo sapiens
ctttgtatgtggaagta

SEQ ID NO: 761688 - DNA, 14 bp, Homo sapiens
ctttgtattataat

SEQ ID NO: 761689 - DNA, 20 bp, Homo sapiens
ctttgtattataattgttga

SEQ ID NO: 761690 - DNA, 16 bp, Homo sapiens
ctttgtcaaaaggaag

SEQ ID NO: 761691 - DNA, 21 bp, Homo sapiens
ctttgtcaataaacctgtcat

SEQ ID NO: 761692 - DNA, 12 bp, Homo sapiens
ctttgtcacttg

SEQ ID NO: 761693 - DNA, 16 bp, Homo sapiens
ctttgtcacttgccac

SEQ ID NO: 761694 - DNA, 17 bp, Homo sapiens
ctttgtcacttgccaca

SEQ ID NO: 761695 - DNA, 17 bp, Homo sapiens
ctttgtcacttttcctt

SEQ ID NO: 761696 - DNA, 18 bp, Homo sapiens
ctttgtcatctttcttct

SEQ ID NO: 761697 - DNA, 18 bp, Homo sapiens
ctttgtccccacacagcc

SEQ ID NO: 761698 - DNA, 22 bp, Homo sapiens
ctttgtcctaagagatttatct

SEQ ID NO: 761699 - DNA, 12 bp, Homo sapiens
ctttgtcctgcg

SEQ ID NO: 761700 - DNA, 23 bp, Homo sapiens
ctttgtcgctgggtcagtgctgg

SEQ ID NO: 761701 - DNA, 18 bp, Homo sapiens
ctttgtcgtggttcttaa

SEQ ID NO: 761702 - DNA, 14 bp, Homo sapiens
ctttgtcttgtact

SEQ ID NO: 761703 - DNA, 16 bp, Homo sapiens
ctttgtcttgtacttc

SEQ ID NO: 761704 - DNA, 18 bp, Homo sapiens
ctttgtcttgtacttctg

SEQ ID NO: 761705 - DNA, 21 bp, Homo sapiens
ctttgtctttctctcccttct

SEQ ID NO: 761706 - DNA, 18 bp, Homo sapiens
ctttgtctttttcctact

SEQ ID NO: 761707 - DNA, 17 bp, Homo sapiens
ctttgtgagcctatgat

SEQ ID NO: 761708 - DNA, 22 bp, Homo sapiens
ctttgtgattcaatctgtaaac

SEQ ID NO: 761709 - DNA, 23 bp, Homo sapiens
ctttgtgattcaatctgtaaact

SEQ ID NO: 761710 - DNA, 16 bp, Homo sapiens
ctttgtgcacatttat

SEQ ID NO: 761711 - DNA, 23 bp, Homo sapiens
ctttgtgcacatttatttcctcc

SEQ ID NO: 761712 - DNA, 13 bp, Homo sapiens
ctttgtgcctttg

SEQ ID NO: 761713 - DNA, 21 bp, Homo sapiens
ctttgtgcttgtcattccaga

SEQ ID NO: 761714 - DNA, 20 bp, Homo sapiens
ctttgtggatgtcttccttg

SEQ ID NO: 761715 - DNA, 20 bp, Homo sapiens
ctttgtggattctgaggccc

SEQ ID NO: 761716 - DNA, 14 bp, Homo sapiens
ctttgtggccaagg

SEQ ID NO: 761717 - DNA, 18 bp, Homo sapiens
ctttgtggccaaggagct

SEQ ID NO: 761718 - DNA, 21 bp, Homo sapiens
ctttgtggtgggcgctgggga

SEQ ID NO: 761719 - DNA, 18 bp, Homo sapiens
ctttgtggtttcttgttt

SEQ ID NO: 761720 - DNA, 13 bp, Homo sapiens
ctttgtgtaatct

SEQ ID NO: 761721 - DNA, 18 bp, Homo sapiens
ctttgtgtagctttgctc

SEQ ID NO: 761722 - DNA, 22 bp, Homo sapiens
ctttgtgtatttttcaataata

SEQ ID NO: 761723 - DNA, 15 bp, Homo sapiens
ctttgtgtgtgtgtc

SEQ ID NO: 761724 - DNA, 20 bp, Homo sapiens
ctttgtgtgtgtgtcagctg

SEQ ID NO: 761725 - DNA, 21 bp, Homo sapiens
ctttgtgtgttatattccaag

SEQ ID NO: 761726 - DNA, 14 bp, Homo sapiens
ctttgtgttcattt

SEQ ID NO: 761727 - DNA, 16 bp, Homo sapiens
ctttgtgttcatttca

SEQ ID NO: 761728 - DNA, 11 bp, Homo sapiens
ctttgtgttgg

SEQ ID NO: 761729 - DNA, 15 bp, Homo sapiens
ctttgtgtttacttt

SEQ ID NO: 761730 - DNA, 16 bp, Homo sapiens
ctttgtgtttactttt

SEQ ID NO: 761731 - DNA, 14 bp, Homo sapiens
ctttgtgtttagct

SEQ ID NO: 761732 - DNA, 14 bp, Homo sapiens
ctttgttaacctta

SEQ ID NO: 761733 - DNA, 23 bp, Homo sapiens
ctttgttaaccttaaatacactg

SEQ ID NO: 761734 - DNA, 16 bp, Homo sapiens
ctttgttaaggtcctg

SEQ ID NO: 761735 - DNA, 21 bp, Homo sapiens
ctttgttaccatactgtctct

SEQ ID NO: 761736 - DNA, 20 bp, Homo sapiens
ctttgttatttttgtttctt

SEQ ID NO: 761737 - DNA, 20 bp, Homo sapiens
ctttgttctttaggagattt

SEQ ID NO: 761738 - DNA, 15 bp, Homo sapiens
ctttgtttaaatgcc

SEQ ID NO: 761739 - DNA, 16 bp, Homo sapiens
ctttgtttaaatgcca

SEQ ID NO: 761740 - DNA, 16 bp, Homo sapiens
ctttgtttcaactgga

SEQ ID NO: 761741 - DNA, 18 bp, Homo sapiens
ctttgtttcgtggggagg

SEQ ID NO: 761742 - DNA, 17 bp, Homo sapiens
ctttgtttctgtttctt

SEQ ID NO: 761743 - DNA, 21 bp, Homo sapiens
ctttgtttctgtttcttgctc

SEQ ID NO: 761744 - DNA, 19 bp, Homo sapiens
ctttgtttctttcttcctc

SEQ ID NO: 761745 - DNA, 13 bp, Homo sapiens
ctttgtttctttt

SEQ ID NO: 761746 - DNA, 18 bp, Homo sapiens
ctttgtttgttgtcagct

SEQ ID NO: 761747 - DNA, 20 bp, Homo sapiens
ctttgtttgttgtcagctga

SEQ ID NO: 761748 - DNA, 21 bp, Homo sapiens
ctttgtttgttgtcagctgaa

SEQ ID NO: 761749 - DNA, 23 bp, Homo sapiens
ctttgttttgatgtttgtggcct

SEQ ID NO: 761750 - DNA, 18 bp, Homo sapiens
ctttgttttttgttggag

SEQ ID NO: 761751 - DNA, 15 bp, Homo sapiens
cttttaaaaaaattt

SEQ ID NO: 761752 - DNA, 22 bp, Homo sapiens
cttttaaaaaaatttttataaa

SEQ ID NO: 761753 - DNA, 17 bp, Homo sapiens
cttttaaaaaacaaaaa

SEQ ID NO: 761754 - DNA, 22 bp, Homo sapiens
cttttaaaaaacaaaaaaagac

SEQ ID NO: 761755 - DNA, 13 bp, Homo sapiens
cttttaaaaaata

SEQ ID NO: 761756 - DNA, 22 bp, Homo sapiens
cttttaaaaaatattttaagaa

SEQ ID NO: 761757 - DNA, 23 bp, Homo sapiens
cttttaaaaaatattttaagaaa

SEQ ID NO: 761758 - DNA, 18 bp, Homo sapiens
cttttaaaacacttccat

SEQ ID NO: 761759 - DNA, 21 bp, Homo sapiens
cttttaaaataagctttctca

SEQ ID NO: 761760 - DNA, 13 bp, Homo sapiens
cttttaaaatatc

SEQ ID NO: 761761 - DNA, 21 bp, Homo sapiens
cttttaaaatatcctgtaact

SEQ ID NO: 761762 - DNA, 19 bp, Homo sapiens
cttttaaaatgcaatgtaa

SEQ ID NO: 761763 - DNA, 16 bp, Homo sapiens
cttttaaaattcaaaa

SEQ ID NO: 761764 - DNA, 16 bp, Homo sapiens
cttttaaacaagtcat

SEQ ID NO: 761765 - DNA, 19 bp, Homo sapiens
cttttaaacataaagaatt

SEQ ID NO: 761766 - DNA, 20 bp, Homo sapiens
cttttaaacctcacctttgt

SEQ ID NO: 761767 - DNA, 12 bp, Homo sapiens
cttttaaactgt

SEQ ID NO: 761768 - DNA, 21 bp, Homo sapiens
cttttaaagaaaaaaattgaa

SEQ ID NO: 761769 - DNA, 22 bp, Homo sapiens
cttttaaagaaaaatatgatac

SEQ ID NO: 761770 - DNA, 13 bp, Homo sapiens
cttttaaagtatt

SEQ ID NO: 761771 - DNA, 17 bp, Homo sapiens
cttttaaagtgttactt

SEQ ID NO: 761772 - DNA, 14 bp, Homo sapiens
cttttaagaaacac

SEQ ID NO: 761773 - DNA, 19 bp, Homo sapiens
cttttaagatgtgtcttca

SEQ ID NO: 761774 - DNA, 14 bp, Homo sapiens
cttttaagcatttg

SEQ ID NO: 761775 - DNA, 16 bp, Homo sapiens
cttttaagcatttgta

SEQ ID NO: 761776 - DNA, 21 bp, Homo sapiens
cttttaagcatttgtatatta

SEQ ID NO: 761777 - DNA, 22 bp, Homo sapiens
cttttaagtatacaacaggaga

SEQ ID NO: 761778 - DNA, 15 bp, Homo sapiens
cttttaatcagtgaa

SEQ ID NO: 761779 - DNA, 13 bp, Homo sapiens
cttttaatgaaaa

SEQ ID NO: 761780 - DNA, 15 bp, Homo sapiens
cttttaatgaattta

SEQ ID NO: 761781 - DNA, 22 bp, Homo sapiens
cttttaatgaatttaaggcaaa

SEQ ID NO: 761782 - DNA, 17 bp, Homo sapiens
cttttaatgcttcattc

SEQ ID NO: 761783 - DNA, 13 bp, Homo sapiens
cttttaattcatt

SEQ ID NO: 761784 - DNA, 15 bp, Homo sapiens
cttttaattctcatt

SEQ ID NO: 761785 - DNA, 16 bp, Homo sapiens
cttttaattctcattt

SEQ ID NO: 761786 - DNA, 14 bp, Homo sapiens
cttttaattttcct

SEQ ID NO: 761787 - DNA, 13 bp, Homo sapiens
cttttaccaactt

SEQ ID NO: 761788 - DNA, 18 bp, Homo sapiens
ccaggcctgctggcatca

SEQ ID NO: 761789 - DNA, 13 bp, Homo sapiens
ccaggcctggacg

SEQ ID NO: 761790 - DNA, 15 bp, Homo sapiens
ccaggcctggacggg

SEQ ID NO: 761791 - DNA, 17 bp, Homo sapiens
ccaggcctggagggcac

SEQ ID NO: 761792 - DNA, 14 bp, Homo sapiens
ccaggcctggcctc

SEQ ID NO: 761793 - DNA, 22 bp, Homo sapiens
ccaggcctggcctcgcctgcct

SEQ ID NO: 761794 - DNA, 19 bp, Homo sapiens
ccaggcctggctccccgag

SEQ ID NO: 761795 - DNA, 16 bp, Homo sapiens
ccaggcctgggatgca

SEQ ID NO: 761796 - DNA, 16 bp, Homo sapiens
ccaggcctgggtctgt

SEQ ID NO: 761797 - DNA, 17 bp, Homo sapiens
ccaggcctgggtctgtg

SEQ ID NO: 761798 - DNA, 18 bp, Homo sapiens
ccaggcctgggtctgtgt

SEQ ID NO: 761799 - DNA, 12 bp, Homo sapiens
ccaggccttgtc

SEQ ID NO: 761800 - DNA, 13 bp, Homo sapiens
ccaggccttgtcc

SEQ ID NO: 761801 - DNA, 18 bp, Homo sapiens
ccaggcctttggagggga

SEQ ID NO: 761802 - DNA, 16 bp, Homo sapiens
ccaggcgagcctgact

SEQ ID NO: 761803 - DNA, 17 bp, Homo sapiens
ccaggcgagcctgactc

SEQ ID NO: 761804 - DNA, 18 bp, Homo sapiens
ccaggcgagcctgactct

SEQ ID NO: 761805 - DNA, 16 bp, Homo sapiens
ccaggcgcatgtctgc

SEQ ID NO: 761806 - DNA, 20 bp, Homo sapiens
ccaggcgcatgtctgcacct

SEQ ID NO: 761807 - DNA, 13 bp, Homo sapiens
cttttctgtcctg

SEQ ID NO: 761808 - DNA, 17 bp, Homo sapiens
cttttctgtcctgggca

SEQ ID NO: 761809 - DNA, 13 bp, Homo sapiens
cttttctgtgatt

SEQ ID NO: 761810 - DNA, 22 bp, Homo sapiens
cttttctgtgccagacattgct

SEQ ID NO: 761811 - DNA, 15 bp, Homo sapiens
cttttctgttattgt

SEQ ID NO: 761812 - DNA, 18 bp, Homo sapiens
cttttctgttattgtatt

SEQ ID NO: 761813 - DNA, 15 bp, Homo sapiens
cttttcttaaacctt

SEQ ID NO: 761814 - DNA, 16 bp, Homo sapiens
cttttcttaaaccttc

SEQ ID NO: 761815 - DNA, 18 bp, Homo sapiens
cttttcttactcctcctc

SEQ ID NO: 761816 - DNA, 19 bp, Homo sapiens
cttttcttactcctcctct

SEQ ID NO: 761817 - DNA, 23 bp, Homo sapiens
cttttcttactcctcctctttct

SEQ ID NO: 761818 - DNA, 13 bp, Homo sapiens
cttttcttcttcc

SEQ ID NO: 761819 - DNA, 15 bp, Homo sapiens
cttttcttcttcctg

SEQ ID NO: 761820 - DNA, 14 bp, Homo sapiens
cttttctttaaaga

SEQ ID NO: 761821 - DNA, 17 bp, Homo sapiens
cttttctttaaagaagt

SEQ ID NO: 761822 - DNA, 18 bp, Homo sapiens
cttttctttaaagaagtt

SEQ ID NO: 761823 - DNA, 17 bp, Homo sapiens
cttttctttattagctt

SEQ ID NO: 761824 - DNA, 12 bp, Homo sapiens
cttttctttcaa

SEQ ID NO: 761825 - DNA, 16 bp, Homo sapiens
cttttctttgaccaga

SEQ ID NO: 761826 - DNA, 15 bp, Homo sapiens
cttttctttgttata

SEQ ID NO: 761827 - DNA, 17 bp, Homo sapiens
cttttcttttctaccct

SEQ ID NO: 761828 - DNA, 20 bp, Homo sapiens
cttttcttttctaccctagc

SEQ ID NO: 761829 - DNA, 20 bp, Homo sapiens
cttttgaagtcttccctcag

SEQ ID NO: 761830 - DNA, 21 bp, Homo sapiens
cttttgaatccatgcttgggt

SEQ ID NO: 761831 - DNA, 19 bp, Homo sapiens
cttttgaatgatgccttta

SEQ ID NO: 761832 - DNA, 14 bp, Homo sapiens
cttttgaattgtta

SEQ ID NO: 761833 - DNA, 16 bp, Homo sapiens
cttttgaattgttaca

SEQ ID NO: 761834 - DNA, 19 bp, Homo sapiens
cttttgacaatcaaagaaa

SEQ ID NO: 761835 - DNA, 22 bp, Homo sapiens
cttttgacaatcaaagaaaaga

SEQ ID NO: 761836 - DNA, 12 bp, Homo sapiens
cttttgacactg

SEQ ID NO: 761837 - DNA, 14 bp, Homo sapiens
cttttgacatgtgg

SEQ ID NO: 761838 - DNA, 15 bp, Homo sapiens
cttttgacattttat

SEQ ID NO: 761839 - DNA, 16 bp, Homo sapiens
cttttgacggccttct

SEQ ID NO: 761840 - DNA, 16 bp, Homo sapiens
cttttgactaagaatt

SEQ ID NO: 761841 - DNA, 18 bp, Homo sapiens
cttttgactcttccgtgc

SEQ ID NO: 761842 - DNA, 21 bp, Homo sapiens
cttttgagtatggctatctat

SEQ ID NO: 761843 - DNA, 18 bp, Homo sapiens
cttttgagtgggccctgc

SEQ ID NO: 761844 - DNA, 20 bp, Homo sapiens
cttttgagtggtaatcatat

SEQ ID NO: 761845 - DNA, 22 bp, Homo sapiens
cttttgagtgttcccaatctga

SEQ ID NO: 761846 - DNA, 14 bp, Homo sapiens
cttttgatagttct

SEQ ID NO: 761847 - DNA, 23 bp, Homo sapiens
cttttgatatgcatatttgttta

SEQ ID NO: 761848 - DNA, 15 bp, Homo sapiens
cttttgatctctgct

SEQ ID NO: 761849 - DNA, 14 bp, Homo sapiens
cttttgatggggag

SEQ ID NO: 761850 - DNA, 16 bp, Homo sapiens
cttttgatggggagaa

SEQ ID NO: 761851 - DNA, 17 bp, Homo sapiens
cttttgatggggagaaa

SEQ ID NO: 761852 - DNA, 15 bp, Homo sapiens
cttttgcaaccagga

SEQ ID NO: 761853 - DNA, 16 bp, Homo sapiens
cttttgcaaccaggaa

SEQ ID NO: 761854 - DNA, 17 bp, Homo sapiens
cttttgcaaccaggaac

SEQ ID NO: 761855 - DNA, 20 bp, Homo sapiens
cttttgcacccctcccatta

SEQ ID NO: 761856 - DNA, 14 bp, Homo sapiens
cttttgcagaaaaa

SEQ ID NO: 761857 - DNA, 15 bp, Homo sapiens
cttttgcagcagagg

SEQ ID NO: 761858 - DNA, 16 bp, Homo sapiens
cttttgcagcagagga

SEQ ID NO: 761859 - DNA, 19 bp, Homo sapiens
cttttgccactttggcttc

SEQ ID NO: 761860 - DNA, 20 bp, Homo sapiens
cttttgccactttggcttct

SEQ ID NO: 761861 - DNA, 17 bp, Homo sapiens
cttttgccattaaactt

SEQ ID NO: 761862 - DNA, 18 bp, Homo sapiens
cttttgcccgttgaggta

SEQ ID NO: 761863 - DNA, 15 bp, Homo sapiens
cttttgccctttgat

SEQ ID NO: 761864 - DNA, 16 bp, Homo sapiens
cttttgcctctgccca

SEQ ID NO: 761865 - DNA, 14 bp, Homo sapiens
cttttgcctggctg

SEQ ID NO: 761866 - DNA, 20 bp, Homo sapiens
cttttgccttttgcaaccag

SEQ ID NO: 761867 - DNA, 18 bp, Homo sapiens
cttttgcgcttatttgga

SEQ ID NO: 761868 - DNA, 16 bp, Homo sapiens
cttttgctacgtgcct

SEQ ID NO: 761869 - DNA, 15 bp, Homo sapiens
cttttgctactaagt

SEQ ID NO: 761870 - DNA, 22 bp, Homo sapiens
cttttgctcttagctgtctgct

SEQ ID NO: 761871 - DNA, 11 bp, Homo sapiens
cttttgctgct

SEQ ID NO: 761872 - DNA, 14 bp, Homo sapiens
cttttgctgctgct

SEQ ID NO: 761873 - DNA, 12 bp, Homo sapiens
cttttgctgtgc

SEQ ID NO: 761874 - DNA, 13 bp, Homo sapiens
cttttgctgtgca

SEQ ID NO: 761875 - DNA, 20 bp, Homo sapiens
cttttgctttctgtttctta

SEQ ID NO: 761876 - DNA, 24 bp, Homo sapiens
cttttgctttctgtttcttaaggg

SEQ ID NO: 761877 - DNA, 17 bp, Homo sapiens
cttttgcttttggcaaa

SEQ ID NO: 761878 - DNA, 20 bp, Homo sapiens
cttttggaacatttctttct

SEQ ID NO: 761879 - DNA, 13 bp, Homo sapiens
cttttggaatcat

SEQ ID NO: 761880 - DNA, 15 bp, Homo sapiens
cttttggaatcatac

SEQ ID NO: 761881 - DNA, 23 bp, Homo sapiens
cttttggaatcatactgcctact

SEQ ID NO: 761882 - DNA, 23 bp, Homo sapiens
cttttggagaaccagggctcttc

SEQ ID NO: 761883 - DNA, 13 bp, Homo sapiens
cttttggcccccg

SEQ ID NO: 761884 - DNA, 20 bp, Homo sapiens
cttttggcccccgagctggg

SEQ ID NO: 761885 - DNA, 14 bp, Homo sapiens
cttttggccttgtg

SEQ ID NO: 761886 - DNA, 14 bp, Homo sapiens
cttttggcttccat

SEQ ID NO: 761887 - DNA, 20 bp, Homo sapiens
cttttggtaaagactggctt

SEQ ID NO: 761888 - DNA, 22 bp, Homo sapiens
cttttggtcattatttcagtgt

SEQ ID NO: 761889 - DNA, 24 bp, Homo sapiens
cttttggtcttcagcctccctcag

SEQ ID NO: 761890 - DNA, 18 bp, Homo sapiens
cttttggtgctctcacct

SEQ ID NO: 761891 - DNA, 19 bp, Homo sapiens
cttttggtgtgttggacag

SEQ ID NO: 761892 - DNA, 12 bp, Homo sapiens
cttttggtttaa

SEQ ID NO: 761893 - DNA, 20 bp, Homo sapiens
cttttggtttcaccttccct

SEQ ID NO: 761894 - DNA, 21 bp, Homo sapiens
cttttggtttcaccttccctc

SEQ ID NO: 761895 - DNA, 19 bp, Homo sapiens
cttttggtttctgcttctc

SEQ ID NO: 761896 - DNA, 21 bp, Homo sapiens
cttttggtttgggggcgccct

SEQ ID NO: 761897 - DNA, 16 bp, Homo sapiens
cttttgtaaatattct

SEQ ID NO: 761898 - DNA, 17 bp, Homo sapiens
cttttgtaaatattctt

SEQ ID NO: 761899 - DNA, 18 bp, Homo sapiens
cttttgtaaatattcttg

SEQ ID NO: 761900 - DNA, 13 bp, Homo sapiens
cttttgtaaatgt

SEQ ID NO: 761901 - DNA, 13 bp, Homo sapiens
cttttgtaagaca

SEQ ID NO: 761902 - DNA, 14 bp, Homo sapiens
cttttgtaattgtg

SEQ ID NO: 761903 - DNA, 16 bp, Homo sapiens
cttttgtaattgtgta

SEQ ID NO: 761904 - DNA, 16 bp, Homo sapiens
cttttgtaatttgaat

SEQ ID NO: 761905 - DNA, 17 bp, Homo sapiens
cttttgtacccaatact

SEQ ID NO: 761906 - DNA, 12 bp, Homo sapiens
cttttgtactga

SEQ ID NO: 761907 - DNA, 15 bp, Homo sapiens
cttttgtagatggcg

SEQ ID NO: 761908 - DNA, 15 bp, Homo sapiens
cttttgtaggctgtt

SEQ ID NO: 761909 - DNA, 20 bp, Homo sapiens
cttttgtaggctgttccctt

SEQ ID NO: 761910 - DNA, 13 bp, Homo sapiens
cttttgtatgtaa

SEQ ID NO: 761911 - DNA, 12 bp, Homo sapiens
ccaggtcctgtc

SEQ ID NO: 761912 - DNA, 15 bp, Homo sapiens
ccaggtcctgtctct

SEQ ID NO: 761913 - DNA, 22 bp, Homo sapiens
ccaggtcctgtctctgcacaga

SEQ ID NO: 761914 - DNA, 14 bp, Homo sapiens
ccaggtccttcctt

SEQ ID NO: 761915 - DNA, 16 bp, Homo sapiens
ccaggtctcaaggttc

SEQ ID NO: 761916 - DNA, 15 bp, Homo sapiens
ccaggtctcacgggc

SEQ ID NO: 761917 - DNA, 20 bp, Homo sapiens
ccaggtctcttcctttgctc

SEQ ID NO: 761918 - DNA, 16 bp, Homo sapiens
ccaggtcttcctgctt

SEQ ID NO: 761919 - DNA, 23 bp, Homo sapiens
ccaggtcttggagctgagcctct

SEQ ID NO: 761920 - DNA, 14 bp, Homo sapiens
ccaggtcttttctt

SEQ ID NO: 761921 - DNA, 20 bp, Homo sapiens
ccaggtgaggcccaagagcc

SEQ ID NO: 761922 - DNA, 22 bp, Homo sapiens
ccaggtgatttcctctaaagaa

SEQ ID NO: 761923 - DNA, 20 bp, Homo sapiens
ccaggtgcttttccctatcc

SEQ ID NO: 761924 - DNA, 16 bp, Homo sapiens
ccaggtggccactcca

SEQ ID NO: 761925 - DNA, 20 bp, Homo sapiens
ccaggtggctgacccagtcc

SEQ ID NO: 761926 - DNA, 21 bp, Homo sapiens
ccaggtggctgacccagtccc

SEQ ID NO: 761927 - DNA, 16 bp, Homo sapiens
ccaggtgggacttagc

SEQ ID NO: 761928 - DNA, 22 bp, Homo sapiens
ccaggtggttgggttctgcctt

SEQ ID NO: 761929 - DNA, 23 bp, Homo sapiens
ccaggtgtgcacgtggcatgtgg

SEQ ID NO: 761930 - DNA, 22 bp, Homo sapiens
ccaggtgtggttgctcacagct

SEQ ID NO: 761931 - DNA, 15 bp, Homo sapiens
ccaggttcaacccac

SEQ ID NO: 761932 - DNA, 15 bp, Homo sapiens
ccaggttcccccagc

SEQ ID NO: 761933 - DNA, 14 bp, Homo sapiens
ccaggttcgagacc

SEQ ID NO: 761934 - DNA, 21 bp, Homo sapiens
ccaggttctccgttagctcct

SEQ ID NO: 761935 - DNA, 23 bp, Homo sapiens
ccaggttctccgttagctcctgt

SEQ ID NO: 761936 - DNA, 24 bp, Homo sapiens
ccaggttctccgttagctcctgtg

SEQ ID NO: 761937 - DNA, 16 bp, Homo sapiens
ccaggttgaaagacct

SEQ ID NO: 761938 - DNA, 22 bp, Homo sapiens
ccaggtttaagtagatttcatg

SEQ ID NO: 761939 - DNA, 20 bp, Homo sapiens
ccagtaaaaaaaaaaaatgg

SEQ ID NO: 761940 - DNA, 22 bp, Homo sapiens
ccagtaaatgggggtgcatttg

SEQ ID NO: 761941 - DNA, 19 bp, Homo sapiens
gaaaaaatggtagcatttt

SEQ ID NO: 761942 - DNA, 14 bp, Homo sapiens
gaaaaaatgttgga

SEQ ID NO: 761943 - DNA, 12 bp, Homo sapiens
gaaaaaattaac

SEQ ID NO: 761944 - DNA, 21 bp, Homo sapiens
gaaaaacaaactcgtttttta

SEQ ID NO: 761945 - DNA, 13 bp, Homo sapiens
gaaaaacaatctt

SEQ ID NO: 761946 - DNA, 23 bp, Homo sapiens
gaaaaacaccgcttctgcctttt

SEQ ID NO: 761947 - DNA, 23 bp, Homo sapiens
gaaaaacacggcagctgtagctc

SEQ ID NO: 761948 - DNA, 15 bp, Homo sapiens
gaaaaacatcccaaa

SEQ ID NO: 761949 - DNA, 19 bp, Homo sapiens
gaaaaacatcccaaacttt

SEQ ID NO: 761950 - DNA, 23 bp, Homo sapiens
gaaaaactctgggaaataagaga

SEQ ID NO: 761951 - DNA, 19 bp, Homo sapiens
gaaaaactggctctgattg

SEQ ID NO: 761952 - DNA, 12 bp, Homo sapiens
gaaaaagaagca

SEQ ID NO: 761953 - DNA, 18 bp, Homo sapiens
gaaaaagacaatagtatt

SEQ ID NO: 761954 - DNA, 9 bp, Homo sapiens
gaaaaagag

SEQ ID NO: 761955 - DNA, 22 bp, Homo sapiens
gaaaaagatggcttatgtcatc

SEQ ID NO: 761956 - DNA, 22 bp, Homo sapiens
gaaaaagcagtaactgacaact

SEQ ID NO: 761957 - DNA, 12 bp, Homo sapiens
gaaaaagcatga

SEQ ID NO: 761958 - DNA, 18 bp, Homo sapiens
gaaaaagcatgatgggaa

SEQ ID NO: 761959 - DNA, 13 bp, Homo sapiens
gaaaaaggaaata

SEQ ID NO: 761960 - DNA, 12 bp, Homo sapiens
gaaaaaggagga

SEQ ID NO: 761961 - DNA, 23 bp, Homo sapiens
gaaaaagggattgaggagttgcc

SEQ ID NO: 761962 - DNA, 15 bp, Homo sapiens
gaaaaataaaatgtt

SEQ ID NO: 761963 - DNA, 16 bp, Homo sapiens
gaaaaataaaatgttt

SEQ ID NO: 761964 - DNA, 21 bp, Homo sapiens
gaaaaataaatgtcactgcca

SEQ ID NO: 761965 - DNA, 23 bp, Homo sapiens
gaaaaataatcaagattttaggg

SEQ ID NO: 761966 - DNA, 12 bp, Homo sapiens
gaaaaatagagc

SEQ ID NO: 761967 - DNA, 20 bp, Homo sapiens
gaaaaatagtgtctttgtga

SEQ ID NO: 761968 - DNA, 21 bp, Homo sapiens
gaaaaatataatgttgataat

SEQ ID NO: 761969 - DNA, 19 bp, Homo sapiens
gaaaaatatatactaaaca

SEQ ID NO: 761970 - DNA, 20 bp, Homo sapiens
gaaaaatatatgcttacatt

SEQ ID NO: 761971 - DNA, 19 bp, Homo sapiens
gaaaaatattcaagtaaca

SEQ ID NO: 761972 - DNA, 14 bp, Homo sapiens
gaaaaatattgcta

SEQ ID NO: 761973 - DNA, 17 bp, Homo sapiens
gaaaaatattgctaaaa

SEQ ID NO: 761974 - DNA, 22 bp, Homo sapiens
gaaaaatattgctaaaagtgca

SEQ ID NO: 761975 - DNA, 23 bp, Homo sapiens
gaaaaatattgctaaaagtgcat

SEQ ID NO: 761976 - DNA, 19 bp, Homo sapiens
gaaaaatcacatcctggcc

SEQ ID NO: 761977 - DNA, 11 bp, Homo sapiens
gaaaaatcttg

SEQ ID NO: 761978 - DNA, 17 bp, Homo sapiens
gaaaaatgaaaactttt

SEQ ID NO: 761979 - DNA, 21 bp, Homo sapiens
gaaaaatgaaaacttttgtaa

SEQ ID NO: 761980 - DNA, 16 bp, Homo sapiens
gaaaaatgccactccc

SEQ ID NO: 761981 - DNA, 17 bp, Homo sapiens
gaaaaatgctccccaca

SEQ ID NO: 761982 - DNA, 20 bp, Homo sapiens
gaaaaatgggagacagcctc

SEQ ID NO: 761983 - DNA, 20 bp, Homo sapiens
gaaaaatggttgatggaaaa

SEQ ID NO: 761984 - DNA, 15 bp, Homo sapiens
gaaaaatgtcagtct

SEQ ID NO: 761985 - DNA, 13 bp, Homo sapiens
gaaaaatgtgtaa

SEQ ID NO: 761986 - DNA, 16 bp, Homo sapiens
gaaaaattacagcttc

SEQ ID NO: 761987 - DNA, 16 bp, Homo sapiens
gaaaaattattagaac

SEQ ID NO: 761988 - DNA, 19 bp, Homo sapiens
gaaaaattattagaacatt

SEQ ID NO: 761989 - DNA, 15 bp, Homo sapiens
gaaaaattgacaaaa

SEQ ID NO: 761990 - DNA, 16 bp, Homo sapiens
gaaaaattggggagga

SEQ ID NO: 761991 - DNA, 18 bp, Homo sapiens
gaaaaatttaagcattgt

SEQ ID NO: 761992 - DNA, 20 bp, Homo sapiens
gaaaaatttaagcattgttt

SEQ ID NO: 761993 - DNA, 14 bp, Homo sapiens
gaaaaatttcacga

SEQ ID NO: 761994 - DNA, 15 bp, Homo sapiens
gaaaaatttcacgat

SEQ ID NO: 761995 - DNA, 11 bp, Homo sapiens
gaaaacaaaaa

SEQ ID NO: 761996 - DNA, 17 bp, Homo sapiens
gaaaacaaaagttttaa

SEQ ID NO: 761997 - DNA, 19 bp, Homo sapiens
gaaaacaaaattttatttt

SEQ ID NO: 761998 - DNA, 22 bp, Homo sapiens
gaaaacaaagccaaacaaaact

SEQ ID NO: 761999 - DNA, 20 bp, Homo sapiens
gaaaacaaatctataaatat

SEQ ID NO: 762000 - DNA, 16 bp, Homo sapiens
gaaaacaacaaaagaa

SEQ ID NO: 762001 - DNA, 21 bp, Homo sapiens
gaaaacaacaaaagaattttt

SEQ ID NO: 762002 - DNA, 20 bp, Homo sapiens
gaaaacaacttggcatttct

SEQ ID NO: 762003 - DNA, 21 bp, Homo sapiens
gaaaacaacttggcatttcta

SEQ ID NO: 762004 - DNA, 14 bp, Homo sapiens
gaaaacaaggaagt

SEQ ID NO: 762005 - DNA, 14 bp, Homo sapiens
gaaaacaataattt

SEQ ID NO: 762006 - DNA, 19 bp, Homo sapiens
gaaaacaattcagtggtct

SEQ ID NO: 762007 - DNA, 16 bp, Homo sapiens
gaaaacacagcctccc

SEQ ID NO: 762008 - DNA, 13 bp, Homo sapiens
gaaaacacatttt

SEQ ID NO: 762009 - DNA, 18 bp, Homo sapiens
gaaaacacatttttctta

SEQ ID NO: 762010 - DNA, 14 bp, Homo sapiens
gaaaacactgtgca

SEQ ID NO: 762011 - DNA, 12 bp, Homo sapiens
gaaaacagaaac

SEQ ID NO: 762012 - DNA, 22 bp, Homo sapiens
gaaaacagatgaccataatttt

SEQ ID NO: 762013 - DNA, 23 bp, Homo sapiens
gaaaacatctcatcatgtctatt

SEQ ID NO: 762014 - DNA, 14 bp, Homo sapiens
gaaaacatgctaca

SEQ ID NO: 762015 - DNA, 15 bp, Homo sapiens
gaaaacatgtaataa

SEQ ID NO: 762016 - DNA, 18 bp, Homo sapiens
gaaaaccaaattttaaaa

SEQ ID NO: 762017 - DNA, 15 bp, Homo sapiens
gaaaacccagagagg

SEQ ID NO: 762018 - DNA, 14 bp, Homo sapiens
gaaaaccccagcat

SEQ ID NO: 762019 - DNA, 12 bp, Homo sapiens
gaaaacctacca

SEQ ID NO: 762020 - DNA, 23 bp, Homo sapiens
gaaaacctgggggatggtcagag

SEQ ID NO: 762021 - DNA, 14 bp, Homo sapiens
gaaaacggagctga

SEQ ID NO: 762022 - DNA, 20 bp, Homo sapiens
gaaaacgggcagtctgctct

SEQ ID NO: 762023 - DNA, 16 bp, Homo sapiens
gaaaactaaggatttt

SEQ ID NO: 762024 - DNA, 19 bp, Homo sapiens
gaaaactaatgtactgtac

SEQ ID NO: 762025 - DNA, 22 bp, Homo sapiens
gaaaactatcctgcgggtttta

SEQ ID NO: 762026 - DNA, 18 bp, Homo sapiens
gaaaactattgagccttg

SEQ ID NO: 762027 - DNA, 24 bp, Homo sapiens
gaaaactattgagccttgcatgta

SEQ ID NO: 762028 - DNA, 18 bp, Homo sapiens
gaaaactgaaaatctaat

SEQ ID NO: 762029 - DNA, 16 bp, Homo sapiens
gaaaactgacagagga

SEQ ID NO: 762030 - DNA, 19 bp, Homo sapiens
gaaaactgtgttgccacag

SEQ ID NO: 762031 - DNA, 22 bp, Homo sapiens
gaaaactgttctctttaaaata

SEQ ID NO: 762032 - DNA, 11 bp, Homo sapiens
ccatagaaaag

SEQ ID NO: 762033 - DNA, 20 bp, Homo sapiens
ccatagacatcagtattctg

SEQ ID NO: 762034 - DNA, 13 bp, Homo sapiens
ccatagagtttaa

SEQ ID NO: 762035 - DNA, 16 bp, Homo sapiens
ccatagagtttaacac

SEQ ID NO: 762036 - DNA, 14 bp, Homo sapiens
ccatagatcttctg

SEQ ID NO: 762037 - DNA, 15 bp, Homo sapiens
ccatagatcttctga

SEQ ID NO: 762038 - DNA, 17 bp, Homo sapiens
ccatagatcttctgaaa

SEQ ID NO: 762039 - DNA, 21 bp, Homo sapiens
ccatagatcttctgaaatgaa

SEQ ID NO: 762040 - DNA, 12 bp, Homo sapiens
ccatagatttat

SEQ ID NO: 762041 - DNA, 21 bp, Homo sapiens
ccatagatttattttacattt

SEQ ID NO: 762042 - DNA, 18 bp, Homo sapiens
ccatagcaagattgctta

SEQ ID NO: 762043 - DNA, 13 bp, Homo sapiens
ccatagcaccctg

SEQ ID NO: 762044 - DNA, 17 bp, Homo sapiens
ccatagcataatatgaa

SEQ ID NO: 762045 - DNA, 14 bp, Homo sapiens
ccatagccccagta

SEQ ID NO: 762046 - DNA, 19 bp, Homo sapiens
ccatagcccttacctagag

SEQ ID NO: 762047 - DNA, 21 bp, Homo sapiens
ccatagctattttccttgctt

SEQ ID NO: 762048 - DNA, 14 bp, Homo sapiens
ccataggacatact

SEQ ID NO: 762049 - DNA, 18 bp, Homo sapiens
ccataggactaccgcagg

SEQ ID NO: 762050 - DNA, 22 bp, Homo sapiens
ccataggactaccgcaggcccg

SEQ ID NO: 762051 - DNA, 15 bp, Homo sapiens
ccatagggggctgca

SEQ ID NO: 762052 - DNA, 20 bp, Homo sapiens
ccataggtttctctccctcc

SEQ ID NO: 762053 - DNA, 18 bp, Homo sapiens
ccatagtcttaactggtc

SEQ ID NO: 762054 - DNA, 18 bp, Homo sapiens
ccatagtggggcctggga

SEQ ID NO: 762055 - DNA, 16 bp, Homo sapiens
ccatagttttgtttaa

SEQ ID NO: 762056 - DNA, 19 bp, Homo sapiens
ccatataagtttgaaggaa

SEQ ID NO: 762057 - DNA, 22 bp, Homo sapiens
ccatataagtttgaaggaaaca

SEQ ID NO: 762058 - DNA, 23 bp, Homo sapiens
ccatataagtttgaaggaaacag

SEQ ID NO: 762059 - DNA, 13 bp, Homo sapiens
ccatatagtctat

SEQ ID NO: 762060 - DNA, 19 bp, Homo sapiens
ccatatatgaccagaagcc

SEQ ID NO: 762061 - DNA, 18 bp, Homo sapiens
ccatatatgctgtatttc

SEQ ID NO: 762062 - DNA, 19 bp, Homo sapiens
ccatatcagaactgtgcca

SEQ ID NO: 762063 - DNA, 13 bp, Homo sapiens
ccatatcctgcct

SEQ ID NO: 762064 - DNA, 15 bp, Homo sapiens
ccatatcctggtgcc

SEQ ID NO: 762065 - DNA, 19 bp, Homo sapiens
ccatatctccatggccctg

SEQ ID NO: 762066 - DNA, 21 bp, Homo sapiens
ccatatcttaaagaaacagct

SEQ ID NO: 762067 - DNA, 16 bp, Homo sapiens
ccatatcttgccttca

SEQ ID NO: 762068 - DNA, 17 bp, Homo sapiens
ccatatcttgccttcag

SEQ ID NO: 762069 - DNA, 23 bp, Homo sapiens
ccatatcttgcgaatccaagctc

SEQ ID NO: 762070 - DNA, 14 bp, Homo sapiens
ccatatgcctacag

SEQ ID NO: 762071 - DNA, 21 bp, Homo sapiens
ccatatggaggactgtgacag

SEQ ID NO: 762072 - DNA, 14 bp, Homo sapiens
ccatattaaaatct

SEQ ID NO: 762073 - DNA, 22 bp, Homo sapiens
gaaacaagttattctcttcact

SEQ ID NO: 762074 - DNA, 22 bp, Homo sapiens
gaaacaatgttgtccaacaata

SEQ ID NO: 762075 - DNA, 22 bp, Homo sapiens
gaaacacaagagacttaaagga

SEQ ID NO: 762076 - DNA, 17 bp, Homo sapiens
gaaacacaccaggctgt

SEQ ID NO: 762077 - DNA, 23 bp, Homo sapiens
gaaacacaccaggctgtgggcct

SEQ ID NO: 762078 - DNA, 13 bp, Homo sapiens
gaaacaccattca

SEQ ID NO: 762079 - DNA, 17 bp, Homo sapiens
gaaacacccctctgtct

SEQ ID NO: 762080 - DNA, 14 bp, Homo sapiens
gaaacaccttctct

SEQ ID NO: 762081 - DNA, 15 bp, Homo sapiens
gaaacacgaaacttg

SEQ ID NO: 762082 - DNA, 16 bp, Homo sapiens
gaaacacgaaacttgt

SEQ ID NO: 762083 - DNA, 15 bp, Homo sapiens
gaaacactgcctgcc

SEQ ID NO: 762084 - DNA, 22 bp, Homo sapiens
gaaacactgcttctcggccagc

SEQ ID NO: 762085 - DNA, 13 bp, Homo sapiens
gaaacactggacc

SEQ ID NO: 762086 - DNA, 14 bp, Homo sapiens
gaaacagagaaaga

SEQ ID NO: 762087 - DNA, 15 bp, Homo sapiens
gaaacagagaaagaa

SEQ ID NO: 762088 - DNA, 21 bp, Homo sapiens
gaaacagagaaagaaaaggca

SEQ ID NO: 762089 - DNA, 14 bp, Homo sapiens
gaaacagagacagg

SEQ ID NO: 762090 - DNA, 19 bp, Homo sapiens
gaaacagagtccaatttaa

SEQ ID NO: 762091 - DNA, 21 bp, Homo sapiens
gaaacagagtggcctccctgc

SEQ ID NO: 762092 - DNA, 23 bp, Homo sapiens
gaaacagattcaggccagcccag

SEQ ID NO: 762093 - DNA, 16 bp, Homo sapiens
gaaacagatttcatac

SEQ ID NO: 762094 - DNA, 16 bp, Homo sapiens
gaaacagcatattagc

SEQ ID NO: 762095 - DNA, 12 bp, Homo sapiens
gaaacagccagc

SEQ ID NO: 762096 - DNA, 19 bp, Homo sapiens
gaaacagccatgtccaagt

SEQ ID NO: 762097 - DNA, 22 bp, Homo sapiens
gaaacagctgcttctcccccca

SEQ ID NO: 762098 - DNA, 15 bp, Homo sapiens
gaaacagctttcaag

SEQ ID NO: 762099 - DNA, 18 bp, Homo sapiens
gaaacagctttcaagtgc

SEQ ID NO: 762100 - DNA, 20 bp, Homo sapiens
gaaacagctttcaagtgcct

SEQ ID NO: 762101 - DNA, 19 bp, Homo sapiens
gaaacaggtgtgtgtgaac

SEQ ID NO: 762102 - DNA, 19 bp, Homo sapiens
gaaacagttgcatgtagta

SEQ ID NO: 762103 - DNA, 23 bp, Homo sapiens
gaaacagttgcatgtagtaacac

SEQ ID NO: 762104 - DNA, 20 bp, Homo sapiens
gaaacagttggtaacttttg

SEQ ID NO: 762105 - DNA, 23 bp, Homo sapiens
gaaacagttggtaacttttgtga

SEQ ID NO: 762106 - DNA, 18 bp, Homo sapiens
gaaacagtttcttgcttg

SEQ ID NO: 762107 - DNA, 12 bp, Homo sapiens
gaaacatacaga

SEQ ID NO: 762108 - DNA, 11 bp, Homo sapiens
gaaacatatca

SEQ ID NO: 762109 - DNA, 23 bp, Homo sapiens
gaaacatcagttactctgaaggg

SEQ ID NO: 762110 - DNA, 16 bp, Homo sapiens
gaaacatcattacaga

SEQ ID NO: 762111 - DNA, 13 bp, Homo sapiens
gaaacatgaaccc

SEQ ID NO: 762112 - DNA, 16 bp, Homo sapiens
gaaacatgaacccaaa

SEQ ID NO: 762113 - DNA, 19 bp, Homo sapiens
gaaacatgcagctcttcaa

SEQ ID NO: 762114 - DNA, 15 bp, Homo sapiens
gaaacatggttttga

SEQ ID NO: 762115 - DNA, 17 bp, Homo sapiens
gaaacattacagttcat

SEQ ID NO: 762116 - DNA, 21 bp, Homo sapiens
gaaacattagtgaaaattctg

SEQ ID NO: 762117 - DNA, 22 bp, Homo sapiens
gaaacattcacacagggctctt

SEQ ID NO: 762118 - DNA, 11 bp, Homo sapiens
gaaacatttac

SEQ ID NO: 762119 - DNA, 17 bp, Homo sapiens
gaaacatttcctttgaa

SEQ ID NO: 762120 - DNA, 13 bp, Homo sapiens
gaaacattttctt

SEQ ID NO: 762121 - DNA, 15 bp, Homo sapiens
gaaaccaaagaagaa

SEQ ID NO: 762122 - DNA, 17 bp, Homo sapiens
gaaaccaaagtctgccg

SEQ ID NO: 762123 - DNA, 19 bp, Homo sapiens
gaaaccaagtcaggccagg

SEQ ID NO: 762124 - DNA, 13 bp, Homo sapiens
gaaaccacacttc

SEQ ID NO: 762125 - DNA, 18 bp, Homo sapiens
gaaaccacagtgagcctg

SEQ ID NO: 762126 - DNA, 20 bp, Homo sapiens
gaaaccaccgtgaaccagag

SEQ ID NO: 762127 - DNA, 22 bp, Homo sapiens
gaaaccaccgtgaaccagaggg

SEQ ID NO: 762128 - DNA, 21 bp, Homo sapiens
gaaaccagctcgtgggctggg

SEQ ID NO: 762129 - DNA, 18 bp, Homo sapiens
gaaaccatgactgtgacc

SEQ ID NO: 762130 - DNA, 18 bp, Homo sapiens
gaaacccaagctcctcct

SEQ ID NO: 762131 - DNA, 23 bp, Homo sapiens
gaaacccaagctcctcctcggaa

SEQ ID NO: 762132 - DNA, 18 bp, Homo sapiens
gaaaccccccaatgtctg

SEQ ID NO: 762133 - DNA, 12 bp, Homo sapiens
gaaaccgaggcg

SEQ ID NO: 762134 - DNA, 13 bp, Homo sapiens
gaaaccgggagaa

SEQ ID NO: 762135 - DNA, 23 bp, Homo sapiens
gaaaccgtgtgtccagcattgaa

SEQ ID NO: 762136 - DNA, 21 bp, Homo sapiens
gaaacctacacactgtcatgc

SEQ ID NO: 762137 - DNA, 17 bp, Homo sapiens
gaaacctatctcaggga

SEQ ID NO: 762138 - DNA, 15 bp, Homo sapiens
gaaacctcagggctg

SEQ ID NO: 762139 - DNA, 19 bp, Homo sapiens
gaaacctcagggctgtccc

SEQ ID NO: 762140 - DNA, 12 bp, Homo sapiens
gaaacctgccct

SEQ ID NO: 762141 - DNA, 13 bp, Homo sapiens
gaaacctgccctg

SEQ ID NO: 762142 - DNA, 17 bp, Homo sapiens
gaaacctgcctttgtat

SEQ ID NO: 762143 - DNA, 18 bp, Homo sapiens
gaaacctgcctttgtatg

SEQ ID NO: 762144 - DNA, 16 bp, Homo sapiens
gaaacctgggattcag

SEQ ID NO: 762145 - DNA, 18 bp, Homo sapiens
gaaacctggggtgaatac

SEQ ID NO: 762146 - DNA, 17 bp, Homo sapiens
gaaacctttagggcagc

SEQ ID NO: 762147 - DNA, 18 bp, Homo sapiens
gaaacctttagggcagct

SEQ ID NO: 762148 - DNA, 19 bp, Homo sapiens
gaaacctttagggcagctt

SEQ ID NO: 762149 - DNA, 20 bp, Homo sapiens
gaaacctttagggcagcttg

SEQ ID NO: 762150 - DNA, 21 bp, Homo sapiens
gaaacctttagggcagcttgc

SEQ ID NO: 762151 - DNA, 20 bp, Homo sapiens
gaaaccttttcttgtatctg

SEQ ID NO: 762152 - DNA, 23 bp, Homo sapiens
gaaacgagactttccattacaag

SEQ ID NO: 762153 - DNA, 19 bp, Homo sapiens
ccatgacatttcatctggg

SEQ ID NO: 762154 - DNA, 14 bp, Homo sapiens
ccatgaccatactg

SEQ ID NO: 762155 - DNA, 15 bp, Homo sapiens
ccatgacccacccct

SEQ ID NO: 762156 - DNA, 18 bp, Homo sapiens
ccatgacccacccctgtg

SEQ ID NO: 762157 - DNA, 19 bp, Homo sapiens
ccatgacccacccctgtgc

SEQ ID NO: 762158 - DNA, 14 bp, Homo sapiens
ccatgaccccttct

SEQ ID NO: 762159 - DNA, 20 bp, Homo sapiens
ccatgaccccttctctctcc

SEQ ID NO: 762160 - DNA, 13 bp, Homo sapiens
ccatgactcttgg

SEQ ID NO: 762161 - DNA, 16 bp, Homo sapiens
ccatgactggctgtct

SEQ ID NO: 762162 - DNA, 22 bp, Homo sapiens
ccatgactggctgtctgcctgt

SEQ ID NO: 762163 - DNA, 18 bp, Homo sapiens
ccatgactgtgaccacct

SEQ ID NO: 762164 - DNA, 20 bp, Homo sapiens
ccatgagataaataaaaata

SEQ ID NO: 762165 - DNA, 23 bp, Homo sapiens
ccatgagatgatacatccaaagc

SEQ ID NO: 762166 - DNA, 13 bp, Homo sapiens
ccatgagcctgcc

SEQ ID NO: 762167 - DNA, 17 bp, Homo sapiens
ccatgagctccagaccc

SEQ ID NO: 762168 - DNA, 23 bp, Homo sapiens
ccatgagctccagacccccagca

SEQ ID NO: 762169 - DNA, 14 bp, Homo sapiens
ccatgagctcgggg

SEQ ID NO: 762170 - DNA, 15 bp, Homo sapiens
ccatgagctcggggt

SEQ ID NO: 762171 - DNA, 20 bp, Homo sapiens
ccatgaggagttgctgtttg

SEQ ID NO: 762172 - DNA, 15 bp, Homo sapiens
ccatgaggcctcagt

SEQ ID NO: 762173 - DNA, 23 bp, Homo sapiens
ccatgaggtactggtcccttcct

SEQ ID NO: 762174 - DNA, 22 bp, Homo sapiens
ccatgagttggggtctggcagc

SEQ ID NO: 762175 - DNA, 14 bp, Homo sapiens
ccatgatccctgtg

SEQ ID NO: 762176 - DNA, 23 bp, Homo sapiens
ccatgatctatacacataagcat

SEQ ID NO: 762177 - DNA, 19 bp, Homo sapiens
ccatgattaaccacttcag

SEQ ID NO: 762178 - DNA, 16 bp, Homo sapiens
ccatgatttgtcccag

SEQ ID NO: 762179 - DNA, 21 bp, Homo sapiens
ccatgatttgtcccagcctgg

SEQ ID NO: 762180 - DNA, 20 bp, Homo sapiens
ccatgcaccaggactggctg

SEQ ID NO: 762181 - DNA, 15 bp, Homo sapiens
ccatgcacctcaggg

SEQ ID NO: 762182 - DNA, 16 bp, Homo sapiens
ccatgcactgtaaata

SEQ ID NO: 762183 - DNA, 12 bp, Homo sapiens
ccatgcagacct

SEQ ID NO: 762184 - DNA, 18 bp, Homo sapiens
ccatgcagacctcatgcc

SEQ ID NO: 762185 - DNA, 17 bp, Homo sapiens
ccatgcagcccctgggc

SEQ ID NO: 762186 - DNA, 18 bp, Homo sapiens
ccatgcagcccctgggcc

SEQ ID NO: 762187 - DNA, 15 bp, Homo sapiens
ccatgcagccttggg

SEQ ID NO: 762188 - DNA, 16 bp, Homo sapiens
ccatgcagccttgggg

SEQ ID NO: 762189 - DNA, 17 bp, Homo sapiens
ccatgcaggaagaggcc

SEQ ID NO: 762190 - DNA, 19 bp, Homo sapiens
ccatgcaggaagaggccca

SEQ ID NO: 762191 - DNA, 20 bp, Homo sapiens
ccatgcaggaagaggcccac

SEQ ID NO: 762192 - DNA, 12 bp, Homo sapiens
ccatgcaggagg

SEQ ID NO: 762193 - DNA, 14 bp, Homo sapiens
ccatgcaggccctt

SEQ ID NO: 762194 - DNA, 12 bp, Homo sapiens
ccatgcaggggg

SEQ ID NO: 762195 - DNA, 13 bp, Homo sapiens
ccatgcaggtggt

SEQ ID NO: 762196 - DNA, 13 bp, Homo sapiens
ccatgccaataaa

SEQ ID NO: 762197 - DNA, 14 bp, Homo sapiens
ccatgccactgcca

SEQ ID NO: 762198 - DNA, 16 bp, Homo sapiens
ccatgccactgccagg

SEQ ID NO: 762199 - DNA, 14 bp, Homo sapiens
ccatgccagaccca

SEQ ID NO: 762200 - DNA, 15 bp, Homo sapiens
ccatgccagctggcc

SEQ ID NO: 762201 - DNA, 16 bp, Homo sapiens
ccatgcccacctgccc

SEQ ID NO: 762202 - DNA, 11 bp, Homo sapiens
ccatgccccct

SEQ ID NO: 762203 - DNA, 14 bp, Homo sapiens
ccatgccctcccag

SEQ ID NO: 762204 - DNA, 20 bp, Homo sapiens
ccatgccctcccaggaccct

SEQ ID NO: 762205 - DNA, 14 bp, Homo sapiens
ccatgcctcagccc

SEQ ID NO: 762206 - DNA, 23 bp, Homo sapiens
gaaaggtgagtttgagctgcctt

SEQ ID NO: 762207 - DNA, 19 bp, Homo sapiens
gaaaggtgctatataattg

SEQ ID NO: 762208 - DNA, 22 bp, Homo sapiens
gaaaggtgctatataattgtga

SEQ ID NO: 762209 - DNA, 20 bp, Homo sapiens
gaaaggttagagaataaatt

SEQ ID NO: 762210 - DNA, 14 bp, Homo sapiens
gaaaggttttgtat

SEQ ID NO: 762211 - DNA, 14 bp, Homo sapiens
gaaagtaagtcttt

SEQ ID NO: 762212 - DNA, 15 bp, Homo sapiens
gaaagtaagtctttt

SEQ ID NO: 762213 - DNA, 22 bp, Homo sapiens
gaaagtacactctgctgtttga

SEQ ID NO: 762214 - DNA, 14 bp, Homo sapiens
gaaagtatatactg

SEQ ID NO: 762215 - DNA, 14 bp, Homo sapiens
gaaagtatattttc

SEQ ID NO: 762216 - DNA, 20 bp, Homo sapiens
gaaagtatattttcctccca

SEQ ID NO: 762217 - DNA, 16 bp, Homo sapiens
gaaagtcaagaagaat

SEQ ID NO: 762218 - DNA, 10 bp, Homo sapiens
gaaagtcaga

SEQ ID NO: 762219 - DNA, 17 bp, Homo sapiens
gaaagtcagatgcccag

SEQ ID NO: 762220 - DNA, 19 bp, Homo sapiens
gaaagtcagctttcagagc

SEQ ID NO: 762221 - DNA, 15 bp, Homo sapiens
gaaagtctgtccttg

SEQ ID NO: 762222 - DNA, 16 bp, Homo sapiens
gaaagtctgtccttga

SEQ ID NO: 762223 - DNA, 21 bp, Homo sapiens
gaaagtgaaaaatgtaaaaca

SEQ ID NO: 762224 - DNA, 16 bp, Homo sapiens
gaaagtgaaagtccag

SEQ ID NO: 762225 - DNA, 20 bp, Homo sapiens
gaaagtgaggaaataaagtt

SEQ ID NO: 762226 - DNA, 21 bp, Homo sapiens
gaaagtgatatcccccagcct

SEQ ID NO: 762227 - DNA, 22 bp, Homo sapiens
gaaagtgatttctagaaagcct

SEQ ID NO: 762228 - DNA, 13 bp, Homo sapiens
gaaagtgatttta

SEQ ID NO: 762229 - DNA, 23 bp, Homo sapiens
gaaagtgattttatttttgcaaa

SEQ ID NO: 762230 - DNA, 16 bp, Homo sapiens
gaaagtgccagaaagt

SEQ ID NO: 762231 - DNA, 15 bp, Homo sapiens
gaaagtgtatttgga

SEQ ID NO: 762232 - DNA, 23 bp, Homo sapiens
gaaagtgtatttggaaataaagt

SEQ ID NO: 762233 - DNA, 20 bp, Homo sapiens
gaaagtgttttactcttttt

SEQ ID NO: 762234 - DNA, 22 bp, Homo sapiens
gaaagttcccccatcagttccc

SEQ ID NO: 762235 - DNA, 20 bp, Homo sapiens
gaaagttgacatgggtgggg

SEQ ID NO: 762236 - DNA, 22 bp, Homo sapiens
gaaagttgcaaggcaaatgttt

SEQ ID NO: 762237 - DNA, 22 bp, Homo sapiens
gaaagttggacttgagaaagat

SEQ ID NO: 762238 - DNA, 22 bp, Homo sapiens
gaaagttgtaaaatagaaaaag

SEQ ID NO: 762239 - DNA, 20 bp, Homo sapiens
gaaagtttcgttatattaaa

SEQ ID NO: 762240 - DNA, 22 bp, Homo sapiens
gaaagttttcagaacctcttcc

SEQ ID NO: 762241 - DNA, 14 bp, Homo sapiens
gaaataaaaccttt

SEQ ID NO: 762242 - DNA, 18 bp, Homo sapiens
gaaataaaacctttcaaa

SEQ ID NO: 762243 - DNA, 16 bp, Homo sapiens
gaaataaaatatatct

SEQ ID NO: 762244 - DNA, 23 bp, Homo sapiens
gaaataaaatgccatagtttgtg

SEQ ID NO: 762245 - DNA, 13 bp, Homo sapiens
gaaataaaccatt

SEQ ID NO: 762246 - DNA, 16 bp, Homo sapiens
gaaataaacctgcact

SEQ ID NO: 762247 - DNA, 19 bp, Homo sapiens
gaaataaacctgcactgaa

SEQ ID NO: 762248 - DNA, 17 bp, Homo sapiens
gaaataaacttcactga

SEQ ID NO: 762249 - DNA, 20 bp, Homo sapiens
gaaataaaggatgtgattgt

SEQ ID NO: 762250 - DNA, 21 bp, Homo sapiens
gaaataaaggtaaaatcactt

SEQ ID NO: 762251 - DNA, 14 bp, Homo sapiens
gaaataaatcagag

SEQ ID NO: 762252 - DNA, 23 bp, Homo sapiens
gaaataaatcagagagcaaggca

SEQ ID NO: 762253 - DNA, 17 bp, Homo sapiens
gaaataaattcctaaac

SEQ ID NO: 762254 - DNA, 19 bp, Homo sapiens
gaaataacagaagaaaata

SEQ ID NO: 762255 - DNA, 22 bp, Homo sapiens
gaaataacagaagaaaatagaa

SEQ ID NO: 762256 - DNA, 15 bp, Homo sapiens
gaaataacagctggg

SEQ ID NO: 762257 - DNA, 15 bp, Homo sapiens
gaaataacattgcac

SEQ ID NO: 762258 - DNA, 21 bp, Homo sapiens
gaaataacattgcactttata

SEQ ID NO: 762259 - DNA, 16 bp, Homo sapiens
gaaataagaaaaatca

SEQ ID NO: 762260 - DNA, 16 bp, Homo sapiens
gaaataagagcagtca

SEQ ID NO: 762261 - DNA, 12 bp, Homo sapiens
gaaataataaaa

SEQ ID NO: 762262 - DNA, 16 bp, Homo sapiens
gaaataataaaatgca

SEQ ID NO: 762263 - DNA, 17 bp, Homo sapiens
gaaataataaaatgcaa

SEQ ID NO: 762264 - DNA, 18 bp, Homo sapiens
gaaataataaaatgcaaa

SEQ ID NO: 762265 - DNA, 14 bp, Homo sapiens
gaaataataaatct

SEQ ID NO: 762266 - DNA, 19 bp, Homo sapiens
gaaataatatatttcttct

SEQ ID NO: 762267 - DNA, 17 bp, Homo sapiens
gaaataatcagtgactg

SEQ ID NO: 762268 - DNA, 13 bp, Homo sapiens
gaaataattgttg

SEQ ID NO: 762269 - DNA, 19 bp, Homo sapiens
gaaataattgttgttctgt

SEQ ID NO: 762270 - DNA, 20 bp, Homo sapiens
gaaataattgttgttctgtt

SEQ ID NO: 762271 - DNA, 21 bp, Homo sapiens
gaaataattgttgttctgtta

SEQ ID NO: 762272 - DNA, 13 bp, Homo sapiens
gaaataatttgaa

SEQ ID NO: 762273 - DNA, 16 bp, Homo sapiens
gaaataatttgaatgt

SEQ ID NO: 762274 - DNA, 21 bp, Homo sapiens
gaaataatttgaatgtatttg

SEQ ID NO: 762275 - DNA, 14 bp, Homo sapiens
ccattattatttct

SEQ ID NO: 762276 - DNA, 18 bp, Homo sapiens
ccattatttaatttgtat

SEQ ID NO: 762277 - DNA, 13 bp, Homo sapiens
ccattattttctg

SEQ ID NO: 762278 - DNA, 17 bp, Homo sapiens
ccattattttctgtcag

SEQ ID NO: 762279 - DNA, 19 bp, Homo sapiens
ccattattttctgtcagat

SEQ ID NO: 762280 - DNA, 13 bp, Homo sapiens
ccattcaattagt

SEQ ID NO: 762281 - DNA, 23 bp, Homo sapiens
ccattcacaagcctcctgtacct

SEQ ID NO: 762282 - DNA, 21 bp, Homo sapiens
ccattcactactcatgcgtga

SEQ ID NO: 762283 - DNA, 20 bp, Homo sapiens
ccattcagtgattactgtca

SEQ ID NO: 762284 - DNA, 23 bp, Homo sapiens
ccattcatattaagacagtgtac

SEQ ID NO: 762285 - DNA, 23 bp, Homo sapiens
ccattcatctctaacatatgata

SEQ ID NO: 762286 - DNA, 15 bp, Homo sapiens
ccattccaaaataca

SEQ ID NO: 762287 - DNA, 15 bp, Homo sapiens
ccattccaaaatatt

SEQ ID NO: 762288 - DNA, 16 bp, Homo sapiens
ccattccaaagcttta

SEQ ID NO: 762289 - DNA, 13 bp, Homo sapiens
ccattccactcca

SEQ ID NO: 762290 - DNA, 18 bp, Homo sapiens
ccattccactccactcag

SEQ ID NO: 762291 - DNA, 12 bp, Homo sapiens
ccattccaggta

SEQ ID NO: 762292 - DNA, 22 bp, Homo sapiens
ccattccagtcaaatctgggct

SEQ ID NO: 762293 - DNA, 18 bp, Homo sapiens
ccattccatggaaataaa

SEQ ID NO: 762294 - DNA, 11 bp, Homo sapiens
ccattccttca

SEQ ID NO: 762295 - DNA, 20 bp, Homo sapiens
ccattccttcaaataaagaa

SEQ ID NO: 762296 - DNA, 14 bp, Homo sapiens
ccattctacacaga

SEQ ID NO: 762297 - DNA, 17 bp, Homo sapiens
ccattctagatcctgca

SEQ ID NO: 762298 - DNA, 23 bp, Homo sapiens
ccattctagatcctgcaccccag

SEQ ID NO: 762299 - DNA, 15 bp, Homo sapiens
ccattctcatctgca

SEQ ID NO: 762300 - DNA, 18 bp, Homo sapiens
ccattctcatctgcaccc

SEQ ID NO: 762301 - DNA, 13 bp, Homo sapiens
ccattctccacag

SEQ ID NO: 762302 - DNA, 22 bp, Homo sapiens
ccattctccaggggtttacagt

SEQ ID NO: 762303 - DNA, 14 bp, Homo sapiens
ccattctcccagtc

SEQ ID NO: 762304 - DNA, 16 bp, Homo sapiens
ccattctctctcctgt

SEQ ID NO: 762305 - DNA, 17 bp, Homo sapiens
ccattctgaccatttca

SEQ ID NO: 762306 - DNA, 12 bp, Homo sapiens
ccattctgactc

SEQ ID NO: 762307 - DNA, 22 bp, Homo sapiens
ccattctgccgccccctcctga

SEQ ID NO: 762308 - DNA, 16 bp, Homo sapiens
ccattctgcctctcct

SEQ ID NO: 762309 - DNA, 18 bp, Homo sapiens
ccattctgcctctcctca

SEQ ID NO: 762310 - DNA, 12 bp, Homo sapiens
ccattctgtttt

SEQ ID NO: 762311 - DNA, 17 bp, Homo sapiens
ccattcttcttgctaca

SEQ ID NO: 762312 - DNA, 18 bp, Homo sapiens
ccattgaacagctgtgag

SEQ ID NO: 762313 - DNA, 20 bp, Homo sapiens
ccattgaagaagaaccagcc

SEQ ID NO: 762314 - DNA, 22 bp, Homo sapiens
ccattgaagaagaaccagccca

SEQ ID NO: 762315 - DNA, 23 bp, Homo sapiens
ccattgaagaagaaccagcccag

SEQ ID NO: 762316 - DNA, 24 bp, Homo sapiens
ccattgaagaagaaccagcccagc

SEQ ID NO: 762317 - DNA, 23 bp, Homo sapiens
ccattgaagccgactctggccct

SEQ ID NO: 762318 - DNA, 12 bp, Homo sapiens
ccattgaaggct

SEQ ID NO: 762319 - DNA, 13 bp, Homo sapiens
ccattgaattctt

SEQ ID NO: 762320 - DNA, 18 bp, Homo sapiens
ccattgacctcagctgca

SEQ ID NO: 762321 - DNA, 21 bp, Homo sapiens
ccattgacctcagctgcacat

SEQ ID NO: 762322 - DNA, 22 bp, Homo sapiens
ccattgacctcagctgcacatt

SEQ ID NO: 762323 - DNA, 14 bp, Homo sapiens
ccattgcaaacatt

SEQ ID NO: 762324 - DNA, 16 bp, Homo sapiens
ccattgccaccaggag

SEQ ID NO: 762325 - DNA, 17 bp, Homo sapiens
ccattgccccagacctg

SEQ ID NO: 762326 - DNA, 14 bp, Homo sapiens
ccattgccctggtt

SEQ ID NO: 762327 - DNA, 14 bp, Homo sapiens
ccattgctgccaag

SEQ ID NO: 762328 - DNA, 10 bp, Homo sapiens
ccattgcttc

SEQ ID NO: 762329 - DNA, 14 bp, Homo sapiens
ccattgcttcacta

SEQ ID NO: 762330 - DNA, 19 bp, Homo sapiens
ccattggacagatttcagt

SEQ ID NO: 762331 - DNA, 19 bp, Homo sapiens
ccattggacagtctccctg

SEQ ID NO: 762332 - DNA, 16 bp, Homo sapiens
ccattggagcacctgg

SEQ ID NO: 762333 - DNA, 20 bp, Homo sapiens
ccattggcctcttgtccctt

SEQ ID NO: 762334 - DNA, 21 bp, Homo sapiens
ccattggctatttaaaacttg

SEQ ID NO: 762335 - DNA, 20 bp, Homo sapiens
ccattggttcttcctttccc

SEQ ID NO: 762336 - DNA, 20 bp, Homo sapiens
ccattgtaaatctgaagaaa

SEQ ID NO: 762337 - DNA, 16 bp, Homo sapiens
ccattgtaactattaa

SEQ ID NO: 762338 - DNA, 22 bp, Homo sapiens
gaacaaatgtgtttttctatat

SEQ ID NO: 762339 - DNA, 14 bp, Homo sapiens
gaacaacaggcagg

SEQ ID NO: 762340 - DNA, 18 bp, Homo sapiens
gaacaacaggcaggggcc

SEQ ID NO: 762341 - DNA, 21 bp, Homo sapiens
gaacaacaggcaggggcccac

SEQ ID NO: 762342 - DNA, 23 bp, Homo sapiens
gaacaagcatgatcttgttactg

SEQ ID NO: 762343 - DNA, 23 bp, Homo sapiens
gaacaagcatgtctctctgccaa

SEQ ID NO: 762344 - DNA, 19 bp, Homo sapiens
gaacaagctggcttctgtg

SEQ ID NO: 762345 - DNA, 16 bp, Homo sapiens
gaacaagtcacagctg

SEQ ID NO: 762346 - DNA, 18 bp, Homo sapiens
gaacaagtcacagctgca

SEQ ID NO: 762347 - DNA, 20 bp, Homo sapiens
gaacaagtcacagctgcagc

SEQ ID NO: 762348 - DNA, 21 bp, Homo sapiens
gaacaagtgcctcctggactg

SEQ ID NO: 762349 - DNA, 18 bp, Homo sapiens
gaacaatagaataatcta

SEQ ID NO: 762350 - DNA, 18 bp, Homo sapiens
gaacaatcactattctta

SEQ ID NO: 762351 - DNA, 20 bp, Homo sapiens
gaacaatttggcaattttgt

SEQ ID NO: 762352 - DNA, 16 bp, Homo sapiens
gaacacaaaacttgaa

SEQ ID NO: 762353 - DNA, 17 bp, Homo sapiens
gaacacaaactgtaaat

SEQ ID NO: 762354 - DNA, 15 bp, Homo sapiens
gaacacaaatgaaaa

SEQ ID NO: 762355 - DNA, 24 bp, Homo sapiens
gaacacaattgatacttcaggtgc

SEQ ID NO: 762356 - DNA, 18 bp, Homo sapiens
gaacacacacgccagctc

SEQ ID NO: 762357 - DNA, 18 bp, Homo sapiens
gaacacacagactttctg

SEQ ID NO: 762358 - DNA, 12 bp, Homo sapiens
gaacacagagaa

SEQ ID NO: 762359 - DNA, 15 bp, Homo sapiens
gaacacagcatgtgc

SEQ ID NO: 762360 - DNA, 17 bp, Homo sapiens
gaacacagcatgtgcca

SEQ ID NO: 762361 - DNA, 16 bp, Homo sapiens
gaacacagtgtctgtt

SEQ ID NO: 762362 - DNA, 20 bp, Homo sapiens
gaacacagtttagtgcttta

SEQ ID NO: 762363 - DNA, 19 bp, Homo sapiens
gaacaccattgaaggctta

SEQ ID NO: 762364 - DNA, 16 bp, Homo sapiens
gaacaccctatatttt

SEQ ID NO: 762365 - DNA, 13 bp, Homo sapiens
gaacacccttaga

SEQ ID NO: 762366 - DNA, 15 bp, Homo sapiens
gaacacctggccggg

SEQ ID NO: 762367 - DNA, 15 bp, Homo sapiens
gaacacgattttcaa

SEQ ID NO: 762368 - DNA, 18 bp, Homo sapiens
gaacacgtgtgcacatgc

SEQ ID NO: 762369 - DNA, 22 bp, Homo sapiens
gaacactaactcaccagcccca

SEQ ID NO: 762370 - DNA, 18 bp, Homo sapiens
gaacactaattcataatc

SEQ ID NO: 762371 - DNA, 16 bp, Homo sapiens
gaacactagtctgtgt

SEQ ID NO: 762372 - DNA, 22 bp, Homo sapiens
gaacactatggttaaccctctc

SEQ ID NO: 762373 - DNA, 18 bp, Homo sapiens
gaacactcttttgcttta

SEQ ID NO: 762374 - DNA, 23 bp, Homo sapiens
gaacactgcactcttaagcttcc

SEQ ID NO: 762375 - DNA, 22 bp, Homo sapiens
gaacactgcctctgagttttga

SEQ ID NO: 762376 - DNA, 22 bp, Homo sapiens
gaacactggcacactgctctta

SEQ ID NO: 762377 - DNA, 19 bp, Homo sapiens
gaacactgtgaccaggctt

SEQ ID NO: 762378 - DNA, 17 bp, Homo sapiens
gaacacttagtgatcat

SEQ ID NO: 762379 - DNA, 15 bp, Homo sapiens
gaacacttttaataa

SEQ ID NO: 762380 - DNA, 21 bp, Homo sapiens
gaacagaaaacaaaagagaga

SEQ ID NO: 762381 - DNA, 12 bp, Homo sapiens
gaacagaaattg

SEQ ID NO: 762382 - DNA, 12 bp, Homo sapiens
gaacagaaggat

SEQ ID NO: 762383 - DNA, 15 bp, Homo sapiens
gaacagaatgtttta

SEQ ID NO: 762384 - DNA, 14 bp, Homo sapiens
gaacagaggcattt

SEQ ID NO: 762385 - DNA, 19 bp, Homo sapiens
gaacagagggccagagcta

SEQ ID NO: 762386 - DNA, 19 bp, Homo sapiens
gaacagatgctgagccata

SEQ ID NO: 762387 - DNA, 22 bp, Homo sapiens
gaacagatggggtctgtgactg

SEQ ID NO: 762388 - DNA, 19 bp, Homo sapiens
gaacagcagtaatcctggg

SEQ ID NO: 762389 - DNA, 22 bp, Homo sapiens
gaacagccaaatgcatggtgca

SEQ ID NO: 762390 - DNA, 18 bp, Homo sapiens
gaacagcccgccagaggc

SEQ ID NO: 762391 - DNA, 16 bp, Homo sapiens
gaacagccctcggcct

SEQ ID NO: 762392 - DNA, 15 bp, Homo sapiens
gaacagcctgcctgt

SEQ ID NO: 762393 - DNA, 21 bp, Homo sapiens
gaacagcgggagacctgtgct

SEQ ID NO: 762394 - DNA, 23 bp, Homo sapiens
gaacagctatcacgttgaaccac

SEQ ID NO: 762395 - DNA, 20 bp, Homo sapiens
gaacagctctgagatcctgg

SEQ ID NO: 762396 - DNA, 21 bp, Homo sapiens
gaaccgaggggctcaggaaaa

SEQ ID NO: 762397 - DNA, 13 bp, Homo sapiens
gaaccgcacagct

SEQ ID NO: 762398 - DNA, 14 bp, Homo sapiens
gaaccgcaccccat

SEQ ID NO: 762399 - DNA, 18 bp, Homo sapiens
gaaccgttttgaagctac

SEQ ID NO: 762400 - DNA, 19 bp, Homo sapiens
gaaccgttttgaagctact

SEQ ID NO: 762401 - DNA, 18 bp, Homo sapiens
gaacctacagttttaact

SEQ ID NO: 762402 - DNA, 23 bp, Homo sapiens
gaacctacagttttaactgtgga

SEQ ID NO: 762403 - DNA, 21 bp, Homo sapiens
gaacctactgttcctttcaga

SEQ ID NO: 762404 - DNA, 19 bp, Homo sapiens
gaacctagtactctctgct

SEQ ID NO: 762405 - DNA, 15 bp, Homo sapiens
gaacctatgaagcaa

SEQ ID NO: 762406 - DNA, 11 bp, Homo sapiens
gaacctcaggc

SEQ ID NO: 762407 - DNA, 14 bp, Homo sapiens
gaacctcccagagg

SEQ ID NO: 762408 - DNA, 20 bp, Homo sapiens
gaacctctcgccatgatcag

SEQ ID NO: 762409 - DNA, 15 bp, Homo sapiens
gaacctctgtctcat

SEQ ID NO: 762410 - DNA, 14 bp, Homo sapiens
gaacctcttcccca

SEQ ID NO: 762411 - DNA, 17 bp, Homo sapiens
gaacctcttccccagaa

SEQ ID NO: 762412 - DNA, 22 bp, Homo sapiens
gaacctgagctattttcctctg

SEQ ID NO: 762413 - DNA, 16 bp, Homo sapiens
gaacctgcaaaaaata

SEQ ID NO: 762414 - DNA, 15 bp, Homo sapiens
gaacctgcacacagg

SEQ ID NO: 762415 - DNA, 21 bp, Homo sapiens
gaacctgcacacaggacagcg

SEQ ID NO: 762416 - DNA, 16 bp, Homo sapiens
gaacctgggaggcaga

SEQ ID NO: 762417 - DNA, 18 bp, Homo sapiens
gaacctggtgtgtttctt

SEQ ID NO: 762418 - DNA, 12 bp, Homo sapiens
gaacctgtgtcc

SEQ ID NO: 762419 - DNA, 19 bp, Homo sapiens
gaaccttaatgacaacact

SEQ ID NO: 762420 - DNA, 21 bp, Homo sapiens
gaaccttaatgacaacactta

SEQ ID NO: 762421 - DNA, 15 bp, Homo sapiens
gaaccttccctccaa

SEQ ID NO: 762422 - DNA, 18 bp, Homo sapiens
gaaccttctggcctccca

SEQ ID NO: 762423 - DNA, 18 bp, Homo sapiens
gaaccttgtcccagccag

SEQ ID NO: 762424 - DNA, 24 bp, Homo sapiens
gaaccttgtcccagccagtgagga

SEQ ID NO: 762425 - DNA, 20 bp, Homo sapiens
gaacctttagaatatctttt

SEQ ID NO: 762426 - DNA, 14 bp, Homo sapiens
gaacgagcactggc

SEQ ID NO: 762427 - DNA, 21 bp, Homo sapiens
gaacgatatgtagcagaaagg

SEQ ID NO: 762428 - DNA, 16 bp, Homo sapiens
gaacgatccttcaaag

SEQ ID NO: 762429 - DNA, 16 bp, Homo sapiens
gaacgatgtgtctgta

SEQ ID NO: 762430 - DNA, 12 bp, Homo sapiens
gaacgcagcctc

SEQ ID NO: 762431 - DNA, 23 bp, Homo sapiens
gaacgctctcctcgagccctccc

SEQ ID NO: 762432 - DNA, 23 bp, Homo sapiens
gaacgctgtgatgctgtgtgccc

SEQ ID NO: 762433 - DNA, 22 bp, Homo sapiens
gaacggagccccaggcctctgt

SEQ ID NO: 762434 - DNA, 23 bp, Homo sapiens
gaacggatgctccgaggactgga

SEQ ID NO: 762435 - DNA, 21 bp, Homo sapiens
gaacggccctgcaggagcagg

SEQ ID NO: 762436 - DNA, 15 bp, Homo sapiens
gaacgggcagccaca

SEQ ID NO: 762437 - DNA, 16 bp, Homo sapiens
gaacgggcagccacag

SEQ ID NO: 762438 - DNA, 16 bp, Homo sapiens
gaacgggcatgggcct

SEQ ID NO: 762439 - DNA, 23 bp, Homo sapiens
gaacgggcatgggcctctctggg

SEQ ID NO: 762440 - DNA, 14 bp, Homo sapiens
gaacggggagaaaa

SEQ ID NO: 762441 - DNA, 15 bp, Homo sapiens
gaacggggagaaaag

SEQ ID NO: 762442 - DNA, 16 bp, Homo sapiens
gaacggggtccttcaa

SEQ ID NO: 762443 - DNA, 17 bp, Homo sapiens
gaacggtaaatttctgt

SEQ ID NO: 762444 - DNA, 20 bp, Homo sapiens
gaacgtatttagccattacc

SEQ ID NO: 762445 - DNA, 21 bp, Homo sapiens
gaacgtatttctccagaccca

SEQ ID NO: 762446 - DNA, 14 bp, Homo sapiens
gaacgtccttcctt

SEQ ID NO: 762447 - DNA, 22 bp, Homo sapiens
gaacgtgactgccccaactcct

SEQ ID NO: 762448 - DNA, 17 bp, Homo sapiens
gaacgtgtgtccaggct

SEQ ID NO: 762449 - DNA, 14 bp, Homo sapiens
gaacgttttcttct

SEQ ID NO: 762450 - DNA, 18 bp, Homo sapiens
gaacgttttcttctttcc

SEQ ID NO: 762451 - DNA, 22 bp, Homo sapiens
gaacgttttcttctttccctgg

SEQ ID NO: 762452 - DNA, 12 bp, Homo sapiens
gaacgtttttcc

SEQ ID NO: 762453 - DNA, 13 bp, Homo sapiens
gaactaaagcaaa

SEQ ID NO: 762454 - DNA, 15 bp, Homo sapiens
gaactaaagctggag

SEQ ID NO: 762455 - DNA, 19 bp, Homo sapiens
gaactaaatttttcataga

SEQ ID NO: 762456 - DNA, 14 bp, Homo sapiens
gaactaactttggt

SEQ ID NO: 762457 - DNA, 12 bp, Homo sapiens
gaactaagcact

SEQ ID NO: 762458 - DNA, 20 bp, Homo sapiens
gaactaaggactccaatgtc

SEQ ID NO: 762459 - DNA, 22 bp, Homo sapiens
gaactacgcttgctcatttttt

SEQ ID NO: 762460 - DNA, 16 bp, Homo sapiens
gaactactaaggaaaa

SEQ ID NO: 762461 - DNA, 15 bp, Homo sapiens
gaactactgtacttt

SEQ ID NO: 762462 - DNA, 23 bp, Homo sapiens
gaactactttgaaaacaattcag

SEQ ID NO: 762463 - DNA, 15 bp, Homo sapiens
gaactagtaaacata

SEQ ID NO: 762464 - DNA, 20 bp, Homo sapiens
gaactagtctacttcttaaa

SEQ ID NO: 762465 - DNA, 15 bp, Homo sapiens
gaactataaagaagt

SEQ ID NO: 762466 - DNA, 23 bp, Homo sapiens
gaactatcatttttacactattg

SEQ ID NO: 762467 - DNA, 14 bp, Homo sapiens
cccaacggggtggg

SEQ ID NO: 762468 - DNA, 14 bp, Homo sapiens
cccaacgtcccctc

SEQ ID NO: 762469 - DNA, 17 bp, Homo sapiens
cccaacgtcccctccgc

SEQ ID NO: 762470 - DNA, 18 bp, Homo sapiens
cccaactccgcccagcct

SEQ ID NO: 762471 - DNA, 13 bp, Homo sapiens
cccaactcctgga

SEQ ID NO: 762472 - DNA, 17 bp, Homo sapiens
cccaactcctggaagct

SEQ ID NO: 762473 - DNA, 23 bp, Homo sapiens
cccaactcctggaagctgtgtcc

SEQ ID NO: 762474 - DNA, 16 bp, Homo sapiens
cccaactctagctggg

SEQ ID NO: 762475 - DNA, 14 bp, Homo sapiens
cccaactctcccca

SEQ ID NO: 762476 - DNA, 15 bp, Homo sapiens
cccaactctccccag

SEQ ID NO: 762477 - DNA, 16 bp, Homo sapiens
cccaactcttcctccc

SEQ ID NO: 762478 - DNA, 13 bp, Homo sapiens
cccaactggggtt

SEQ ID NO: 762479 - DNA, 11 bp, Homo sapiens
cccaactgtct

SEQ ID NO: 762480 - DNA, 12 bp, Homo sapiens
cccaactgttat

SEQ ID NO: 762481 - DNA, 15 bp, Homo sapiens
cccaacttcaccacc

SEQ ID NO: 762482 - DNA, 17 bp, Homo sapiens
cccaacttccagaggac

SEQ ID NO: 762483 - DNA, 20 bp, Homo sapiens
cccaacttctcttgctttct

SEQ ID NO: 762484 - DNA, 21 bp, Homo sapiens
cccaagaaaccaaagtctgcc

SEQ ID NO: 762485 - DNA, 19 bp, Homo sapiens
cccaagacagatgccccag

SEQ ID NO: 762486 - DNA, 21 bp, Homo sapiens
cccaagacagatgccccagag

SEQ ID NO: 762487 - DNA, 16 bp, Homo sapiens
cccaagaccatccctg

SEQ ID NO: 762488 - DNA, 20 bp, Homo sapiens
cccaagaccatccctgaaga

SEQ ID NO: 762489 - DNA, 23 bp, Homo sapiens
cccaagaccctgccccctgccag

SEQ ID NO: 762490 - DNA, 15 bp, Homo sapiens
cccaagactgggctg

SEQ ID NO: 762491 - DNA, 24 bp, Homo sapiens
cccaagagaactcgcgctcagtaa

SEQ ID NO: 762492 - DNA, 12 bp, Homo sapiens
cccaagagagga

SEQ ID NO: 762493 - DNA, 18 bp, Homo sapiens
cccaagagaggaaggacc

SEQ ID NO: 762494 - DNA, 21 bp, Homo sapiens
cccaagagaggaaggacccct

SEQ ID NO: 762495 - DNA, 17 bp, Homo sapiens
cccaagagatgaagagt

SEQ ID NO: 762496 - DNA, 17 bp, Homo sapiens
cccaagagccctgtggc

SEQ ID NO: 762497 - DNA, 21 bp, Homo sapiens
cccaagagccctgtggccgcc

SEQ ID NO: 762498 - DNA, 23 bp, Homo sapiens
cccaagagctacgtatttaatag

SEQ ID NO: 762499 - DNA, 18 bp, Homo sapiens
cccaagaggactgagact

SEQ ID NO: 762500 - DNA, 23 bp, Homo sapiens
cccaagaggggcgggctcagagc

SEQ ID NO: 762501 - DNA, 18 bp, Homo sapiens
cccaagaggtctgagccc

SEQ ID NO: 762502 - DNA, 22 bp, Homo sapiens
cccaagataggagttctctgat

SEQ ID NO: 762503 - DNA, 19 bp, Homo sapiens
cccaagatgagctgcagcc

SEQ ID NO: 762504 - DNA, 20 bp, Homo sapiens
cccaagatgggcatcttttg

SEQ ID NO: 762505 - DNA, 23 bp, Homo sapiens
cccaagattcacacctgactctg

SEQ ID NO: 762506 - DNA, 14 bp, Homo sapiens
cccaagcagccagc

SEQ ID NO: 762507 - DNA, 12 bp, Homo sapiens
cccaagccccat

SEQ ID NO: 762508 - DNA, 18 bp, Homo sapiens
cccaagcccgacttgctg

SEQ ID NO: 762509 - DNA, 23 bp, Homo sapiens
cccaagcccgacttgctgttttg

SEQ ID NO: 762510 - DNA, 22 bp, Homo sapiens
cccaagcctgctggctgcggcc

SEQ ID NO: 762511 - DNA, 21 bp, Homo sapiens
cccaagcgcctggctgctgct

SEQ ID NO: 762512 - DNA, 12 bp, Homo sapiens
cccaagctcaga

SEQ ID NO: 762513 - DNA, 12 bp, Homo sapiens
cccaagctcctc

SEQ ID NO: 762514 - DNA, 20 bp, Homo sapiens
cccaagcttaatagccctcc

SEQ ID NO: 762515 - DNA, 14 bp, Homo sapiens
cccaagcttagaac

SEQ ID NO: 762516 - DNA, 22 bp, Homo sapiens
cccaagcttggcagccgagctc

SEQ ID NO: 762517 - DNA, 16 bp, Homo sapiens
gaagacattttgttac

SEQ ID NO: 762518 - DNA, 14 bp, Homo sapiens
gaagaccaaggcct

SEQ ID NO: 762519 - DNA, 22 bp, Homo sapiens
gaagaccaaggcctcggcagaa

SEQ ID NO: 762520 - DNA, 20 bp, Homo sapiens
gaagaccagctttgcagtga

SEQ ID NO: 762521 - DNA, 17 bp, Homo sapiens
gaagaccattctgtgac

SEQ ID NO: 762522 - DNA, 20 bp, Homo sapiens
gaagacccaggagagacaga

SEQ ID NO: 762523 - DNA, 23 bp, Homo sapiens
gaagaccctcttgcccatcctga

SEQ ID NO: 762524 - DNA, 16 bp, Homo sapiens
gaagacctaaagtgct

SEQ ID NO: 762525 - DNA, 14 bp, Homo sapiens
gaagacctgagaat

SEQ ID NO: 762526 - DNA, 22 bp, Homo sapiens
gaagaccttctagtgagcctgg

SEQ ID NO: 762527 - DNA, 15 bp, Homo sapiens
gaagacgcctgagct

SEQ ID NO: 762528 - DNA, 19 bp, Homo sapiens
gaagactcaggagtctgcc

SEQ ID NO: 762529 - DNA, 13 bp, Homo sapiens
gaagactgagaac

SEQ ID NO: 762530 - DNA, 22 bp, Homo sapiens
gaagactgcacaggtgacaagc

SEQ ID NO: 762531 - DNA, 12 bp, Homo sapiens
gaagactgctcc

SEQ ID NO: 762532 - DNA, 23 bp, Homo sapiens
gaagactgctcccggcccgcctg

SEQ ID NO: 762533 - DNA, 13 bp, Homo sapiens
gaagacttcctct

SEQ ID NO: 762534 - DNA, 15 bp, Homo sapiens
gaagagaaatacagc

SEQ ID NO: 762535 - DNA, 16 bp, Homo sapiens
gaagagaaatacagct

SEQ ID NO: 762536 - DNA, 12 bp, Homo sapiens
gaagagaaattt

SEQ ID NO: 762537 - DNA, 15 bp, Homo sapiens
gaagagaagacaaaa

SEQ ID NO: 762538 - DNA, 19 bp, Homo sapiens
gaagagaagagggcccagc

SEQ ID NO: 762539 - DNA, 15 bp, Homo sapiens
gaagagaaggcacac

SEQ ID NO: 762540 - DNA, 12 bp, Homo sapiens
gaagagagccag

SEQ ID NO: 762541 - DNA, 17 bp, Homo sapiens
gaagagatgacaaacca

SEQ ID NO: 762542 - DNA, 22 bp, Homo sapiens
gaagagatgtggcaaagtgctg

SEQ ID NO: 762543 - DNA, 16 bp, Homo sapiens
gaagagcacagagccc

SEQ ID NO: 762544 - DNA, 18 bp, Homo sapiens
gaagagcacagagccctg

SEQ ID NO: 762545 - DNA, 12 bp, Homo sapiens
gaagagcagcct

SEQ ID NO: 762546 - DNA, 13 bp, Homo sapiens
gaagagcagcctg

SEQ ID NO: 762547 - DNA, 22 bp, Homo sapiens
gaagagcaggactccaggccca

SEQ ID NO: 762548 - DNA, 23 bp, Homo sapiens
gaagagcaggactccaggcccaa

SEQ ID NO: 762549 - DNA, 17 bp, Homo sapiens
gaagagccacctggcag

SEQ ID NO: 762550 - DNA, 16 bp, Homo sapiens
gaagagcccagtctgt

SEQ ID NO: 762551 - DNA, 17 bp, Homo sapiens
gaagagcccagtctgtt

SEQ ID NO: 762552 - DNA, 22 bp, Homo sapiens
gaagagcccgcagggccatgca

SEQ ID NO: 762553 - DNA, 16 bp, Homo sapiens
gaagagccggtggtgc

SEQ ID NO: 762554 - DNA, 21 bp, Homo sapiens
gaagagcctgaagctggcctg

SEQ ID NO: 762555 - DNA, 19 bp, Homo sapiens
gaagagcgctcctctgcct

SEQ ID NO: 762556 - DNA, 16 bp, Homo sapiens
gaagagctagagaaat

SEQ ID NO: 762557 - DNA, 20 bp, Homo sapiens
gaagagctatggcccagaaa

SEQ ID NO: 762558 - DNA, 22 bp, Homo sapiens
gaagagctcccctccacagctg

SEQ ID NO: 762559 - DNA, 12 bp, Homo sapiens
gaagagctcttc

SEQ ID NO: 762560 - DNA, 21 bp, Homo sapiens
gaagagctcttcggtttctga

SEQ ID NO: 762561 - DNA, 16 bp, Homo sapiens
gaagaggaacagtgtg

SEQ ID NO: 762562 - DNA, 21 bp, Homo sapiens
gaagaggaagaaattcaggta

SEQ ID NO: 762563 - DNA, 16 bp, Homo sapiens
gaagaggactgtgtga

SEQ ID NO: 762564 - DNA, 19 bp, Homo sapiens
gaagaggagattggccagt

SEQ ID NO: 762565 - DNA, 21 bp, Homo sapiens
gaagaggagattggccagtga

SEQ ID NO: 762566 - DNA, 20 bp, Homo sapiens
gaagaggcccactagagggc

SEQ ID NO: 762567 - DNA, 22 bp, Homo sapiens
gaagaggcccactagagggccc

SEQ ID NO: 762568 - DNA, 23 bp, Homo sapiens
gaagaggcccactagagggccca

SEQ ID NO: 762569 - DNA, 20 bp, Homo sapiens
gaagaggcctgtttggcctc

SEQ ID NO: 762570 - DNA, 15 bp, Homo sapiens
gaagagggcccagcc

SEQ ID NO: 762571 - DNA, 20 bp, Homo sapiens
gaagagggcctgtgggagcc

SEQ ID NO: 762572 - DNA, 16 bp, Homo sapiens
gaagagggctgagctg

SEQ ID NO: 762573 - DNA, 16 bp, Homo sapiens
gaagaggggaggggcc

SEQ ID NO: 762574 - DNA, 23 bp, Homo sapiens
gaagaggggaggggcctagggag

SEQ ID NO: 762575 - DNA, 11 bp, Homo sapiens
gaagaggggca

SEQ ID NO: 762576 - DNA, 15 bp, Homo sapiens
gaagaggggcagccc

SEQ ID NO: 762577 - DNA, 17 bp, Homo sapiens
gaagaggggctggggca

SEQ ID NO: 762578 - DNA, 17 bp, Homo sapiens
gaagagggttttaggta

SEQ ID NO: 762579 - DNA, 22 bp, Homo sapiens
gaagaggttttatttacatttt

SEQ ID NO: 762580 - DNA, 16 bp, Homo sapiens
gaagagtcctctgaat

SEQ ID NO: 762581 - DNA, 16 bp, Homo sapiens
gaagagtctggaggga

SEQ ID NO: 762582 - DNA, 22 bp, Homo sapiens
gaagagtcttggtttctctcta

SEQ ID NO: 762583 - DNA, 14 bp, Homo sapiens
gaagagtgagaggg

SEQ ID NO: 762584 - DNA, 16 bp, Homo sapiens
gaagagtggaggtgga

SEQ ID NO: 762585 - DNA, 23 bp, Homo sapiens
gaagagttctatccccaagctgg

SEQ ID NO: 762586 - DNA, 20 bp, Homo sapiens
gaagagtttaaaagcatgaa

SEQ ID NO: 762587 - DNA, 13 bp, Homo sapiens
gaagataatcatt

SEQ ID NO: 762588 - DNA, 15 bp, Homo sapiens
gaagataatttgcat

SEQ ID NO: 762589 - DNA, 13 bp, Homo sapiens
gaagataggctct

SEQ ID NO: 762590 - DNA, 16 bp, Homo sapiens
gaagataggctctgca

SEQ ID NO: 762591 - DNA, 18 bp, Homo sapiens
gaagataggctctgcaca

SEQ ID NO: 762592 - DNA, 14 bp, Homo sapiens
gaagatagtaactg

SEQ ID NO: 762593 - DNA, 17 bp, Homo sapiens
gaagatatatttcactt

SEQ ID NO: 762594 - DNA, 14 bp, Homo sapiens
gaagatatcttgaa

SEQ ID NO: 762595 - DNA, 23 bp, Homo sapiens
gaagatattgggaaggaaatata

SEQ ID NO: 762596 - DNA, 21 bp, Homo sapiens
gaagatcagcaccctaagaga

SEQ ID NO: 762597 - DNA, 18 bp, Homo sapiens
gaagatcccccagaaaag

SEQ ID NO: 762598 - DNA, 14 bp, Homo sapiens
cccacctccctgcc

SEQ ID NO: 762599 - DNA, 16 bp, Homo sapiens
cccacctccctgcctc

SEQ ID NO: 762600 - DNA, 15 bp, Homo sapiens
cccacctccctgcgc

SEQ ID NO: 762601 - DNA, 15 bp, Homo sapiens
cccacctcctgcggc

SEQ ID NO: 762602 - DNA, 22 bp, Homo sapiens
cccacctcgctcccctctggaa

SEQ ID NO: 762603 - DNA, 14 bp, Homo sapiens
cccacctcggcaca

SEQ ID NO: 762604 - DNA, 17 bp, Homo sapiens
cccacctcggcacacac

SEQ ID NO: 762605 - DNA, 21 bp, Homo sapiens
cccacctctccctgcatcctg

SEQ ID NO: 762606 - DNA, 12 bp, Homo sapiens
cccacctcttct

SEQ ID NO: 762607 - DNA, 12 bp, Homo sapiens
cccacctcttgt

SEQ ID NO: 762608 - DNA, 17 bp, Homo sapiens
cccacctgacaatggca

SEQ ID NO: 762609 - DNA, 21 bp, Homo sapiens
cccacctgacaatggcagcta

SEQ ID NO: 762610 - DNA, 21 bp, Homo sapiens
cccacctgcgcttctgctgga

SEQ ID NO: 762611 - DNA, 13 bp, Homo sapiens
cccacctggagcc

SEQ ID NO: 762612 - DNA, 14 bp, Homo sapiens
cccacctggagccc

SEQ ID NO: 762613 - DNA, 15 bp, Homo sapiens
cccacctggccacct

SEQ ID NO: 762614 - DNA, 16 bp, Homo sapiens
cccacctggccacctg

SEQ ID NO: 762615 - DNA, 14 bp, Homo sapiens
cccacctggctccc

SEQ ID NO: 762616 - DNA, 14 bp, Homo sapiens
cccacctgggctgg

SEQ ID NO: 762617 - DNA, 15 bp, Homo sapiens
cccacctgggctggg

SEQ ID NO: 762618 - DNA, 16 bp, Homo sapiens
cccacctggggtctct

SEQ ID NO: 762619 - DNA, 16 bp, Homo sapiens
cccacctgttttctga

SEQ ID NO: 762620 - DNA, 18 bp, Homo sapiens
cccaccttggtccctctc

SEQ ID NO: 762621 - DNA, 19 bp, Homo sapiens
cccaccttggtccctctca

SEQ ID NO: 762622 - DNA, 19 bp, Homo sapiens
cccaccttgttggagcctg

SEQ ID NO: 762623 - DNA, 21 bp, Homo sapiens
cccacctttattaaaatctta

SEQ ID NO: 762624 - DNA, 21 bp, Homo sapiens
cccacctttgggatcagcctc

SEQ ID NO: 762625 - DNA, 17 bp, Homo sapiens
cccacgaacgctcttag

SEQ ID NO: 762626 - DNA, 21 bp, Homo sapiens
cccacgacccctgcctcgagg

SEQ ID NO: 762627 - DNA, 16 bp, Homo sapiens
cccacgaggggaccca

SEQ ID NO: 762628 - DNA, 14 bp, Homo sapiens
cccacgagggtctc

SEQ ID NO: 762629 - DNA, 13 bp, Homo sapiens
cccacgagtcacc

SEQ ID NO: 762630 - DNA, 20 bp, Homo sapiens
cccacgagtcacctgcaagc

SEQ ID NO: 762631 - DNA, 19 bp, Homo sapiens
cccacgattttctccagct

SEQ ID NO: 762632 - DNA, 20 bp, Homo sapiens
cccacgattttctccagctc

SEQ ID NO: 762633 - DNA, 21 bp, Homo sapiens
cccacgattttctccagctca

SEQ ID NO: 762634 - DNA, 15 bp, Homo sapiens
cccacgccggcctct

SEQ ID NO: 762635 - DNA, 18 bp, Homo sapiens
cccacgccggcctctgct

SEQ ID NO: 762636 - DNA, 15 bp, Homo sapiens
cccacgctcctgccc

SEQ ID NO: 762637 - DNA, 14 bp, Homo sapiens
cccacgctgaccat

SEQ ID NO: 762638 - DNA, 19 bp, Homo sapiens
cccacgctgaccatgcgtc

SEQ ID NO: 762639 - DNA, 14 bp, Homo sapiens
cccagcccacagag

SEQ ID NO: 762640 - DNA, 18 bp, Homo sapiens
cccagcccacagagcctg

SEQ ID NO: 762641 - DNA, 19 bp, Homo sapiens
cccagcccaccctgctcct

SEQ ID NO: 762642 - DNA, 10 bp, Homo sapiens
cccagcccag

SEQ ID NO: 762643 - DNA, 13 bp, Homo sapiens
cccagcccagagc

SEQ ID NO: 762644 - DNA, 21 bp, Homo sapiens
cccagcccagattcccctgtg

SEQ ID NO: 762645 - DNA, 15 bp, Homo sapiens
cccagccccaactcc

SEQ ID NO: 762646 - DNA, 22 bp, Homo sapiens
cccagccccactcctctgctga

SEQ ID NO: 762647 - DNA, 14 bp, Homo sapiens
cccagccccagccc

SEQ ID NO: 762648 - DNA, 22 bp, Homo sapiens
cccagccccaggcctggcctcg

SEQ ID NO: 762649 - DNA, 15 bp, Homo sapiens
cccagcccccagggc

SEQ ID NO: 762650 - DNA, 22 bp, Homo sapiens
cccagcccccccccggagctgc

SEQ ID NO: 762651 - DNA, 17 bp, Homo sapiens
cccagccccgactccag

SEQ ID NO: 762652 - DNA, 11 bp, Homo sapiens
cccagccccta

SEQ ID NO: 762653 - DNA, 19 bp, Homo sapiens
cccagcccctactgctgtg

SEQ ID NO: 762654 - DNA, 13 bp, Homo sapiens
cccagcccctaga

SEQ ID NO: 762655 - DNA, 15 bp, Homo sapiens
cccagcccctccacg

SEQ ID NO: 762656 - DNA, 23 bp, Homo sapiens
cccagcccctctcccctctctgc

SEQ ID NO: 762657 - DNA, 12 bp, Homo sapiens
cccagcccctgg

SEQ ID NO: 762658 - DNA, 19 bp, Homo sapiens
cccagccccttttctctgc

SEQ ID NO: 762659 - DNA, 14 bp, Homo sapiens
cccagccctccttc

SEQ ID NO: 762660 - DNA, 12 bp, Homo sapiens
cccagccctgct

SEQ ID NO: 762661 - DNA, 14 bp, Homo sapiens
cccagccctgctgg

SEQ ID NO: 762662 - DNA, 15 bp, Homo sapiens
cccagccctgctggg

SEQ ID NO: 762663 - DNA, 17 bp, Homo sapiens
cccagccctgctgggga

SEQ ID NO: 762664 - DNA, 18 bp, Homo sapiens
cccagccctggctctgca

SEQ ID NO: 762665 - DNA, 23 bp, Homo sapiens
cccagccctgggaaccactccca

SEQ ID NO: 762666 - DNA, 16 bp, Homo sapiens
cccagccctgtcctgg

SEQ ID NO: 762667 - DNA, 20 bp, Homo sapiens
cccagcccttagcacagaga

SEQ ID NO: 762668 - DNA, 23 bp, Homo sapiens
cccagcccttagcacagagaggg

SEQ ID NO: 762669 - DNA, 14 bp, Homo sapiens
cccagcccttcctt

SEQ ID NO: 762670 - DNA, 18 bp, Homo sapiens
cccagcccttccttgggc

SEQ ID NO: 762671 - DNA, 20 bp, Homo sapiens
cccagcccttctgcctttct

SEQ ID NO: 762672 - DNA, 18 bp, Homo sapiens
cccagccggccaatggaa

SEQ ID NO: 762673 - DNA, 14 bp, Homo sapiens
cccagccggcctct

SEQ ID NO: 762674 - DNA, 20 bp, Homo sapiens
cccagccggcctctctggcc

SEQ ID NO: 762675 - DNA, 17 bp, Homo sapiens
cccagcctacccttcct

SEQ ID NO: 762676 - DNA, 23 bp, Homo sapiens
cccagcctaggacgccaacttct

SEQ ID NO: 762677 - DNA, 22 bp, Homo sapiens
cccagcctaggtggaggcaagt

SEQ ID NO: 762678 - DNA, 13 bp, Homo sapiens
cccagcctagtca

SEQ ID NO: 762679 - DNA, 23 bp, Homo sapiens
cccagcctatgagcatcctgagc

SEQ ID NO: 762680 - DNA, 13 bp, Homo sapiens
cccagcctcagcc

SEQ ID NO: 762681 - DNA, 18 bp, Homo sapiens
cccagcctcagcccaact

SEQ ID NO: 762682 - DNA, 18 bp, Homo sapiens
cccagcctccaagctcca

SEQ ID NO: 762683 - DNA, 21 bp, Homo sapiens
cccagcctcctgagggctcca

SEQ ID NO: 762684 - DNA, 22 bp, Homo sapiens
cccagcctcctgagggctccat

SEQ ID NO: 762685 - DNA, 22 bp, Homo sapiens
cccagcctctccccgctctgga

SEQ ID NO: 762686 - DNA, 15 bp, Homo sapiens
cccagcctctggcat

SEQ ID NO: 762687 - DNA, 12 bp, Homo sapiens
cccagcctgaaa

SEQ ID NO: 762688 - DNA, 18 bp, Homo sapiens
cccagcctgaaagataca

SEQ ID NO: 762689 - DNA, 19 bp, Homo sapiens
cccagcctgaaagatacag

SEQ ID NO: 762690 - DNA, 13 bp, Homo sapiens
cccagcctgacct

SEQ ID NO: 762691 - DNA, 15 bp, Homo sapiens
cccagcctgacctga

SEQ ID NO: 762692 - DNA, 20 bp, Homo sapiens
cccagcctgacctgagactg

SEQ ID NO: 762693 - DNA, 11 bp, Homo sapiens
cccagcctgcc

SEQ ID NO: 762694 - DNA, 12 bp, Homo sapiens
cccagcctgccc

SEQ ID NO: 762695 - DNA, 14 bp, Homo sapiens
cccagcctgctgag

SEQ ID NO: 762696 - DNA, 15 bp, Homo sapiens
cccagcctggccaga

SEQ ID NO: 762697 - DNA, 17 bp, Homo sapiens
cccagcctggccagaca

SEQ ID NO: 762698 - DNA, 18 bp, Homo sapiens
cccagcctggccagacaa

SEQ ID NO: 762699 - DNA, 11 bp, Homo sapiens
cccagcctggg

SEQ ID NO: 762700 - DNA, 12 bp, Homo sapiens
cccagcctggga

SEQ ID NO: 762701 - DNA, 15 bp, Homo sapiens
cccagcctgggccat

SEQ ID NO: 762702 - DNA, 22 bp, Homo sapiens
cccagcctgggccatctcttag

SEQ ID NO: 762703 - DNA, 13 bp, Homo sapiens
cccagcctggggc

SEQ ID NO: 762704 - DNA, 24 bp, Homo sapiens
cccagcctggggctccctctctgg

SEQ ID NO: 762705 - DNA, 21 bp, Homo sapiens
cccagcctgtcctggtacagc

SEQ ID NO: 762706 - DNA, 15 bp, Homo sapiens
cccagcgctcgccac

SEQ ID NO: 762707 - DNA, 22 bp, Homo sapiens
cccagcgctcgccacgctcagt

SEQ ID NO: 762708 - DNA, 14 bp, Homo sapiens
cccagcgctctggg

SEQ ID NO: 762709 - DNA, 17 bp, Homo sapiens
cccagcggccccccgca

SEQ ID NO: 762710 - DNA, 18 bp, Homo sapiens
cccagcggcccctcccac

SEQ ID NO: 762711 - DNA, 13 bp, Homo sapiens
cccagcggcctca

SEQ ID NO: 762712 - DNA, 14 bp, Homo sapiens
cccagcggcctcag

SEQ ID NO: 762713 - DNA, 15 bp, Homo sapiens
cccagcggcctcagg

SEQ ID NO: 762714 - DNA, 17 bp, Homo sapiens
cccagcggcctcagggt

SEQ ID NO: 762715 - DNA, 21 bp, Homo sapiens
cccagcggcttagccaagccc

SEQ ID NO: 762716 - DNA, 22 bp, Homo sapiens
cccagcgggcaggttctgcctg

SEQ ID NO: 762717 - DNA, 16 bp, Homo sapiens
cccagcggttcctgtg

SEQ ID NO: 762718 - DNA, 18 bp, Homo sapiens
cccagcggttcctgtgca

SEQ ID NO: 762719 - DNA, 15 bp, Homo sapiens
cccagcgtcaggcct

SEQ ID NO: 762720 - DNA, 21 bp, Homo sapiens
cccagcgtcagtttcactccc

SEQ ID NO: 762721 - DNA, 15 bp, Homo sapiens
cccagcgtctgcagg

SEQ ID NO: 762722 - DNA, 13 bp, Homo sapiens
cccagcgtggccc

SEQ ID NO: 762723 - DNA, 16 bp, Homo sapiens
cccagcgtggcccagg

SEQ ID NO: 762724 - DNA, 18 bp, Homo sapiens
cccagcgtggcccaggcc

SEQ ID NO: 762725 - DNA, 24 bp, Homo sapiens
cccagcgtttagtttctagaggcc

SEQ ID NO: 762726 - DNA, 19 bp, Homo sapiens
cccagctaatctgtagggc

SEQ ID NO: 762727 - DNA, 20 bp, Homo sapiens
cccagctaatctgtagggct

SEQ ID NO: 762728 - DNA, 18 bp, Homo sapiens
cccagctaattgagacca

SEQ ID NO: 762729 - DNA, 14 bp, Homo sapiens
cccagctacattcc

SEQ ID NO: 762730 - DNA, 15 bp, Homo sapiens
cccagctacattcct

SEQ ID NO: 762731 - DNA, 16 bp, Homo sapiens
cccagctacattcctc

SEQ ID NO: 762732 - DNA, 18 bp, Homo sapiens
cccagctacattcctcag

SEQ ID NO: 762733 - DNA, 12 bp, Homo sapiens
gaagcctgagca

SEQ ID NO: 762734 - DNA, 15 bp, Homo sapiens
gaagcctgagcaggg

SEQ ID NO: 762735 - DNA, 16 bp, Homo sapiens
gaagcctggactctgc

SEQ ID NO: 762736 - DNA, 17 bp, Homo sapiens
gaagcctggactctgcc

SEQ ID NO: 762737 - DNA, 18 bp, Homo sapiens
gaagcctggactctgccc

SEQ ID NO: 762738 - DNA, 10 bp, Homo sapiens
gaagcctgtc

SEQ ID NO: 762739 - DNA, 23 bp, Homo sapiens
gaagccttaagccataggcccag

SEQ ID NO: 762740 - DNA, 23 bp, Homo sapiens
gaagccttcttctgccacttctg

SEQ ID NO: 762741 - DNA, 13 bp, Homo sapiens
gaagccttgctga

SEQ ID NO: 762742 - DNA, 15 bp, Homo sapiens
gaagcgactctcctg

SEQ ID NO: 762743 - DNA, 22 bp, Homo sapiens
gaagcgacttttgttctcttct

SEQ ID NO: 762744 - DNA, 20 bp, Homo sapiens
gaagcgccaggctggagata

SEQ ID NO: 762745 - DNA, 16 bp, Homo sapiens
gaagcgcttctgcacc

SEQ ID NO: 762746 - DNA, 16 bp, Homo sapiens
gaagcggatttccagg

SEQ ID NO: 762747 - DNA, 23 bp, Homo sapiens
gaagcgggctgggggtagcctgg

SEQ ID NO: 762748 - DNA, 20 bp, Homo sapiens
gaagcgtatatacttaagaa

SEQ ID NO: 762749 - DNA, 16 bp, Homo sapiens
gaagcgtcagcgggcg

SEQ ID NO: 762750 - DNA, 17 bp, Homo sapiens
gaagctaaaaggaaaag

SEQ ID NO: 762751 - DNA, 23 bp, Homo sapiens
gaagctaataaaattcgctttct

SEQ ID NO: 762752 - DNA, 22 bp, Homo sapiens
gaagctaatgaactctttcaaa

SEQ ID NO: 762753 - DNA, 22 bp, Homo sapiens
gaagctacagattgtcatagtt

SEQ ID NO: 762754 - DNA, 20 bp, Homo sapiens
gaagctactgtgtgtgtgaa

SEQ ID NO: 762755 - DNA, 22 bp, Homo sapiens
gaagctactgtgtgtgtgaatg

SEQ ID NO: 762756 - DNA, 22 bp, Homo sapiens
gaagctagacacatgaaggtaa

SEQ ID NO: 762757 - DNA, 17 bp, Homo sapiens
gaagctagatgcccctg

SEQ ID NO: 762758 - DNA, 20 bp, Homo sapiens
gaagctcacactgatgggct

SEQ ID NO: 762759 - DNA, 22 bp, Homo sapiens
gaagctcacactgatgggctgg

SEQ ID NO: 762760 - DNA, 23 bp, Homo sapiens
gaagctcacactgatgggctggg

SEQ ID NO: 762761 - DNA, 10 bp, Homo sapiens
gaagtggaag

SEQ ID NO: 762762 - DNA, 18 bp, Homo sapiens
gaagtggaccaggacagg

SEQ ID NO: 762763 - DNA, 22 bp, Homo sapiens
gaagtggaccaggacaggacca

SEQ ID NO: 762764 - DNA, 23 bp, Homo sapiens
gaagtggagacagtcctttccca

SEQ ID NO: 762765 - DNA, 21 bp, Homo sapiens
gaagtggatctgcttctccag

SEQ ID NO: 762766 - DNA, 14 bp, Homo sapiens
gaagtggcagttct

SEQ ID NO: 762767 - DNA, 16 bp, Homo sapiens
gaagtggctgccacac

SEQ ID NO: 762768 - DNA, 23 bp, Homo sapiens
gaagtggctgccacacccagggg

SEQ ID NO: 762769 - DNA, 20 bp, Homo sapiens
gaagtggctggtctggagtc

SEQ ID NO: 762770 - DNA, 16 bp, Homo sapiens
gaagtgggccaggaca

SEQ ID NO: 762771 - DNA, 18 bp, Homo sapiens
gaagtgggccaggacagg

SEQ ID NO: 762772 - DNA, 19 bp, Homo sapiens
gaagtgggccaggacaggc

SEQ ID NO: 762773 - DNA, 16 bp, Homo sapiens
gaagtggggacagatt

SEQ ID NO: 762774 - DNA, 14 bp, Homo sapiens
gaagtggggtctgg

SEQ ID NO: 762775 - DNA, 14 bp, Homo sapiens
gaagtgggtgccct

SEQ ID NO: 762776 - DNA, 16 bp, Homo sapiens
gaagtgtagggcaagg

SEQ ID NO: 762777 - DNA, 20 bp, Homo sapiens
gaagtgtcaccctgtgggtg

SEQ ID NO: 762778 - DNA, 22 bp, Homo sapiens
gaagtgtcaccctgtgggtgtc

SEQ ID NO: 762779 - DNA, 20 bp, Homo sapiens
gaagtgtccgagaactaaag

SEQ ID NO: 762780 - DNA, 13 bp, Homo sapiens
gaagtgtcttctg

SEQ ID NO: 762781 - DNA, 15 bp, Homo sapiens
gaagtgtcttctgtt

SEQ ID NO: 762782 - DNA, 20 bp, Homo sapiens
gaagtgtcttctgttcccaa

SEQ ID NO: 762783 - DNA, 15 bp, Homo sapiens
gaagtgtggaaaaat

SEQ ID NO: 762784 - DNA, 13 bp, Homo sapiens
gaagtgtggctgg

SEQ ID NO: 762785 - DNA, 13 bp, Homo sapiens
gaagtgtgtttgc

SEQ ID NO: 762786 - DNA, 18 bp, Homo sapiens
gaagtgttgaagggaggt

SEQ ID NO: 762787 - DNA, 21 bp, Homo sapiens
gaagtgttgcatggatgtttt

SEQ ID NO: 762788 - DNA, 15 bp, Homo sapiens
gaagttaacagagac

SEQ ID NO: 762789 - DNA, 22 bp, Homo sapiens
gaagttacacagaaatgctgct

SEQ ID NO: 762790 - DNA, 16 bp, Homo sapiens
gaagttactttatgtt

SEQ ID NO: 762791 - DNA, 20 bp, Homo sapiens
gaagttactttatgtttgtc

SEQ ID NO: 762792 - DNA, 15 bp, Homo sapiens
gaagttactttttgt

SEQ ID NO: 762793 - DNA, 15 bp, Homo sapiens
gaagttattttccag

SEQ ID NO: 762794 - DNA, 20 bp, Homo sapiens
gaagttctcaaagttaattc

SEQ ID NO: 762795 - DNA, 17 bp, Homo sapiens
gaagttctccagcttca

SEQ ID NO: 762796 - DNA, 13 bp, Homo sapiens
gaagttctgagcc

SEQ ID NO: 762797 - DNA, 15 bp, Homo sapiens
gaagttcttcaagag

SEQ ID NO: 762798 - DNA, 16 bp, Homo sapiens
gaagttcttcaagagg

SEQ ID NO: 762799 - DNA, 23 bp, Homo sapiens
gaagttggacagcaaaaccattg

SEQ ID NO: 762800 - DNA, 19 bp, Homo sapiens
gaagttggggcactgggcg

SEQ ID NO: 762801 - DNA, 15 bp, Homo sapiens
gaagttgtctccttc

SEQ ID NO: 762802 - DNA, 20 bp, Homo sapiens
gaagttgtgccttttatagc

SEQ ID NO: 762803 - DNA, 14 bp, Homo sapiens
gaagttgtttatca

SEQ ID NO: 762804 - DNA, 17 bp, Homo sapiens
gaagtttatttgagaaa

SEQ ID NO: 762805 - DNA, 20 bp, Homo sapiens
gaagtttatttgagaaaata

SEQ ID NO: 762806 - DNA, 15 bp, Homo sapiens
gaagtttcaagtttt

SEQ ID NO: 762807 - DNA, 14 bp, Homo sapiens
gaagtttcatttat

SEQ ID NO: 762808 - DNA, 15 bp, Homo sapiens
gaagtttcatttatg

SEQ ID NO: 762809 - DNA, 15 bp, Homo sapiens
gaagtttgtagccag

SEQ ID NO: 762810 - DNA, 13 bp, Homo sapiens
gaagttttcagga

SEQ ID NO: 762811 - DNA, 13 bp, Homo sapiens
gaagttttcagtg

SEQ ID NO: 762812 - DNA, 11 bp, Homo sapiens
gaagttttcct

SEQ ID NO: 762813 - DNA, 14 bp, Homo sapiens
gaagttttttactt

SEQ ID NO: 762814 - DNA, 16 bp, Homo sapiens
gaagttttttactttg

SEQ ID NO: 762815 - DNA, 16 bp, Homo sapiens
gaataaaaaagattct

SEQ ID NO: 762816 - DNA, 20 bp, Homo sapiens
gaataaaaaagattctacta

SEQ ID NO: 762817 - DNA, 14 bp, Homo sapiens
gaataaaaaccctg

SEQ ID NO: 762818 - DNA, 14 bp, Homo sapiens
gaataaaaggctgg

SEQ ID NO: 762819 - DNA, 20 bp, Homo sapiens
gaataaaatcctaagacaca

SEQ ID NO: 762820 - DNA, 17 bp, Homo sapiens
gaataaaatgttgaaaa

SEQ ID NO: 762821 - DNA, 19 bp, Homo sapiens
gaataaaattcctatctca

SEQ ID NO: 762822 - DNA, 19 bp, Homo sapiens
gaataaacagtgagcatat

SEQ ID NO: 762823 - DNA, 20 bp, Homo sapiens
gaataaacattttttgatcc

SEQ ID NO: 762824 - DNA, 12 bp, Homo sapiens
gaataaactaga

SEQ ID NO: 762825 - DNA, 16 bp, Homo sapiens
gaataaactgaatatt

SEQ ID NO: 762826 - DNA, 21 bp, Homo sapiens
gaataaactgaatattttgga

SEQ ID NO: 762827 - DNA, 17 bp, Homo sapiens
gaataaagaatgccatt

SEQ ID NO: 762828 - DNA, 20 bp, Homo sapiens
gaataaagaatgccatttct

SEQ ID NO: 762829 - DNA, 20 bp, Homo sapiens
gaataaaggcagttttctaa

SEQ ID NO: 762830 - DNA, 14 bp, Homo sapiens
gaataaagttgaag

SEQ ID NO: 762831 - DNA, 16 bp, Homo sapiens
gaataaagttgaagct

SEQ ID NO: 762832 - DNA, 20 bp, Homo sapiens
gaataaattatggcatttct

SEQ ID NO: 762833 - DNA, 21 bp, Homo sapiens
gaataaattatggcatttcta

SEQ ID NO: 762834 - DNA, 22 bp, Homo sapiens
gaataaattatggcatttctat

SEQ ID NO: 762835 - DNA, 21 bp, Homo sapiens
gaataaattctacctccttgt

SEQ ID NO: 762836 - DNA, 14 bp, Homo sapiens
gaataaattttcaa

SEQ ID NO: 762837 - DNA, 19 bp, Homo sapiens
gaataacaagaagcccagt

SEQ ID NO: 762838 - DNA, 15 bp, Homo sapiens
gaataacattttcta

SEQ ID NO: 762839 - DNA, 17 bp, Homo sapiens
gaataactcagaatatt

SEQ ID NO: 762840 - DNA, 21 bp, Homo sapiens
gaataactctgtggcattatt

SEQ ID NO: 762841 - DNA, 16 bp, Homo sapiens
gaataataagcaggat

SEQ ID NO: 762842 - DNA, 23 bp, Homo sapiens
gaataataagcaggatgttggcc

SEQ ID NO: 762843 - DNA, 22 bp, Homo sapiens
gaataataattatccagagttt

SEQ ID NO: 762844 - DNA, 19 bp, Homo sapiens
gaataatatcaaataaaat

SEQ ID NO: 762845 - DNA, 16 bp, Homo sapiens
gaataatatgatgcca

SEQ ID NO: 762846 - DNA, 20 bp, Homo sapiens
gaataatctattatttggag

SEQ ID NO: 762847 - DNA, 20 bp, Homo sapiens
gaataatgaaaataaaacac

SEQ ID NO: 762848 - DNA, 17 bp, Homo sapiens
gaataatgcctttgtaa

SEQ ID NO: 762849 - DNA, 14 bp, Homo sapiens
gaataatgtaaaat

SEQ ID NO: 762850 - DNA, 13 bp, Homo sapiens
gaataatgtgtta

SEQ ID NO: 762851 - DNA, 18 bp, Homo sapiens
gaataattatttatttaa

SEQ ID NO: 762852 - DNA, 20 bp, Homo sapiens
gaataattatttatttaata

SEQ ID NO: 762853 - DNA, 12 bp, Homo sapiens
gaataatttatt

SEQ ID NO: 762854 - DNA, 21 bp, Homo sapiens
gaataatttcccaattaggaa

SEQ ID NO: 762855 - DNA, 20 bp, Homo sapiens
gaataatttgtaaatgattt

SEQ ID NO: 762856 - DNA, 14 bp, Homo sapiens
gaatacaattaaag

SEQ ID NO: 762857 - DNA, 13 bp, Homo sapiens
gaatacagtgtta

SEQ ID NO: 762858 - DNA, 14 bp, Homo sapiens
gaatacataaacaa

SEQ ID NO: 762859 - DNA, 12 bp, Homo sapiens
gaatacatttta

SEQ ID NO: 762860 - DNA, 17 bp, Homo sapiens
gaatacattttattctg

SEQ ID NO: 762861 - DNA, 15 bp, Homo sapiens
gaataccactctgta

SEQ ID NO: 762862 - DNA, 23 bp, Homo sapiens
gaataccactctgtaattgcaaa

SEQ ID NO: 762863 - DNA, 14 bp, Homo sapiens
gaatacggaagagc

SEQ ID NO: 762864 - DNA, 15 bp, Homo sapiens
gaatacggaagagca

SEQ ID NO: 762865 - DNA, 13 bp, Homo sapiens
gaatactcacatt

SEQ ID NO: 762866 - DNA, 14 bp, Homo sapiens
gaatactcacattt

SEQ ID NO: 762867 - DNA, 14 bp, Homo sapiens
cttaatttatttct

SEQ ID NO: 762868 - DNA, 17 bp, Homo sapiens
cttaatttcctttttga

SEQ ID NO: 762869 - DNA, 22 bp, Homo sapiens
cttaatttcctttttgacactg

SEQ ID NO: 762870 - DNA, 23 bp, Homo sapiens
cttaatttcctttttgacactga

SEQ ID NO: 762871 - DNA, 15 bp, Homo sapiens
cttaatttctgcctt

SEQ ID NO: 762872 - DNA, 19 bp, Homo sapiens
cttaatttggataataaaa

SEQ ID NO: 762873 - DNA, 23 bp, Homo sapiens
cttaatttggataataaaaattg

SEQ ID NO: 762874 - DNA, 12 bp, Homo sapiens
cttaatttgtaa

SEQ ID NO: 762875 - DNA, 15 bp, Homo sapiens
cttaatttgtaaact

SEQ ID NO: 762876 - DNA, 19 bp, Homo sapiens
cttaatttgtaaacttctg

SEQ ID NO: 762877 - DNA, 16 bp, Homo sapiens
cttaattttttttaat

SEQ ID NO: 762878 - DNA, 13 bp, Homo sapiens
cttacaaaatgcc

SEQ ID NO: 762879 - DNA, 14 bp, Homo sapiens
cttacaaaatgcca

SEQ ID NO: 762880 - DNA, 15 bp, Homo sapiens
cttacaaaatgccaa

SEQ ID NO: 762881 - DNA, 16 bp, Homo sapiens
cttacaagccagctgg

SEQ ID NO: 762882 - DNA, 16 bp, Homo sapiens
cttacaattccctgct

SEQ ID NO: 762883 - DNA, 21 bp, Homo sapiens
cttacaattgcactgctgttc

SEQ ID NO: 762884 - DNA, 14 bp, Homo sapiens
cttacaatttgcac

SEQ ID NO: 762885 - DNA, 13 bp, Homo sapiens
cttacacacaaaa

SEQ ID NO: 762886 - DNA, 19 bp, Homo sapiens
cttacacatctcagaccct

SEQ ID NO: 762887 - DNA, 15 bp, Homo sapiens
cttacacttcttacc

SEQ ID NO: 762888 - DNA, 17 bp, Homo sapiens
cttacacttggagcccg

SEQ ID NO: 762889 - DNA, 20 bp, Homo sapiens
cttacaggaaaacctgcaga

SEQ ID NO: 762890 - DNA, 22 bp, Homo sapiens
cttacagtaaagtatagaaata

SEQ ID NO: 762891 - DNA, 16 bp, Homo sapiens
cttacagtaggagccc

SEQ ID NO: 762892 - DNA, 14 bp, Homo sapiens
cttacagttaagaa

SEQ ID NO: 762893 - DNA, 18 bp, Homo sapiens
cttacataaagctccctt

SEQ ID NO: 762894 - DNA, 21 bp, Homo sapiens
cttacatcttctgtgaaatat

SEQ ID NO: 762895 - DNA, 17 bp, Homo sapiens
cttacatcttttctaat

SEQ ID NO: 762896 - DNA, 21 bp, Homo sapiens
cttacatgttttctttgcttt

SEQ ID NO: 762897 - DNA, 15 bp, Homo sapiens
cttacattcagaaat

SEQ ID NO: 762898 - DNA, 20 bp, Homo sapiens
cttacattgttcaattagaa

SEQ ID NO: 762899 - DNA, 12 bp, Homo sapiens
cttacatttgta

SEQ ID NO: 762900 - DNA, 13 bp, Homo sapiens
cttacatttgtac

SEQ ID NO: 762901 - DNA, 16 bp, Homo sapiens
cttacatttgtacttt

SEQ ID NO: 762902 - DNA, 14 bp, Homo sapiens
cttacatttttaca

SEQ ID NO: 762903 - DNA, 15 bp, Homo sapiens
cttaccaactttctg

SEQ ID NO: 762904 - DNA, 17 bp, Homo sapiens
cttaccaactttctgta

SEQ ID NO: 762905 - DNA, 13 bp, Homo sapiens
cttaccagatgct

SEQ ID NO: 762906 - DNA, 15 bp, Homo sapiens
cttaccagtctcctc

SEQ ID NO: 762907 - DNA, 14 bp, Homo sapiens
cttaccataccact

SEQ ID NO: 762908 - DNA, 15 bp, Homo sapiens
cttaccatatgtgct

SEQ ID NO: 762909 - DNA, 23 bp, Homo sapiens
cttaccatctctaccatcatccg

SEQ ID NO: 762910 - DNA, 14 bp, Homo sapiens
cttacccaatggga

SEQ ID NO: 762911 - DNA, 17 bp, Homo sapiens
cttacccaatgggaccg

SEQ ID NO: 762912 - DNA, 21 bp, Homo sapiens
cttacccaatgggaccgtgcc

SEQ ID NO: 762913 - DNA, 15 bp, Homo sapiens
cttacccaatttccc

SEQ ID NO: 762914 - DNA, 22 bp, Homo sapiens
cttaccccagcctacccttcct

SEQ ID NO: 762915 - DNA, 19 bp, Homo sapiens
cttaccccgagacctcact

SEQ ID NO: 762916 - DNA, 17 bp, Homo sapiens
cttaccctcatgttctt

SEQ ID NO: 762917 - DNA, 19 bp, Homo sapiens
cttaccctcatgttcttaa

SEQ ID NO: 762918 - DNA, 14 bp, Homo sapiens
cttaccctcctctg

SEQ ID NO: 762919 - DNA, 21 bp, Homo sapiens
cttaccctcctctgctgggaa

SEQ ID NO: 762920 - DNA, 15 bp, Homo sapiens
cttaccgccctgcgg

SEQ ID NO: 762921 - DNA, 19 bp, Homo sapiens
cttaccgccctgcgggcca

SEQ ID NO: 762922 - DNA, 19 bp, Homo sapiens
cttacctaaacagatataa

SEQ ID NO: 762923 - DNA, 16 bp, Homo sapiens
cttacctagtgaaact

SEQ ID NO: 762924 - DNA, 18 bp, Homo sapiens
cttacctagtgaaacttt

SEQ ID NO: 762925 - DNA, 15 bp, Homo sapiens
cttacctcctgccca

SEQ ID NO: 762926 - DNA, 23 bp, Homo sapiens
cttacctctggaaccccccaggc

SEQ ID NO: 762927 - DNA, 13 bp, Homo sapiens
cttacctcttccg

SEQ ID NO: 762928 - DNA, 13 bp, Homo sapiens
cttaccttctgct

SEQ ID NO: 762929 - DNA, 17 bp, Homo sapiens
cttacctttcctgatgc

SEQ ID NO: 762930 - DNA, 18 bp, Homo sapiens
cttacctttcctgatgcc

SEQ ID NO: 762931 - DNA, 14 bp, Homo sapiens
cttaccttttccta

SEQ ID NO: 762932 - DNA, 18 bp, Homo sapiens
cttaccttttcctattct

SEQ ID NO: 762933 - DNA, 19 bp, Homo sapiens
cttaccttttcctattctg

SEQ ID NO: 762934 - DNA, 22 bp, Homo sapiens
cttacgaaaaaatggtagcatt

SEQ ID NO: 762935 - DNA, 19 bp, Homo sapiens
cttacgcccaacccttccc

SEQ ID NO: 762936 - DNA, 23 bp, Homo sapiens
cttacgtgttagacaagaactat

SEQ ID NO: 762937 - DNA, 15 bp, Homo sapiens
cttactaaaaagtat

SEQ ID NO: 762938 - DNA, 23 bp, Homo sapiens
cttactaatgtgccccatgtcca

SEQ ID NO: 762939 - DNA, 16 bp, Homo sapiens
cttactacactgagga

SEQ ID NO: 762940 - DNA, 22 bp, Homo sapiens
cttactattttgacagttattt

SEQ ID NO: 762941 - DNA, 13 bp, Homo sapiens
cttactcctcctc

SEQ ID NO: 762942 - DNA, 14 bp, Homo sapiens
cttactcctcctct

SEQ ID NO: 762943 - DNA, 23 bp, Homo sapiens
cttactcctcctctttctctccc

SEQ ID NO: 762944 - DNA, 18 bp, Homo sapiens
cttactctcctctttcct

SEQ ID NO: 762945 - DNA, 14 bp, Homo sapiens
cttactctgagccc

SEQ ID NO: 762946 - DNA, 19 bp, Homo sapiens
cttactctgagcccaggcc

SEQ ID NO: 762947 - DNA, 22 bp, Homo sapiens
cttactctgtctcccaggctgc

SEQ ID NO: 762948 - DNA, 15 bp, Homo sapiens
cttactcttcttgaa

SEQ ID NO: 762949 - DNA, 12 bp, Homo sapiens
cttactctttcc

SEQ ID NO: 762950 - DNA, 14 bp, Homo sapiens
cttactctttccta

SEQ ID NO: 762951 - DNA, 12 bp, Homo sapiens
cttactgaaggt

SEQ ID NO: 762952 - DNA, 17 bp, Homo sapiens
cttactgactttgcatt

SEQ ID NO: 762953 - DNA, 15 bp, Homo sapiens
cttactgatatattt

SEQ ID NO: 762954 - DNA, 15 bp, Homo sapiens
cttactgtacctgtt

SEQ ID NO: 762955 - DNA, 23 bp, Homo sapiens
cttactgtacctgttccttagac

SEQ ID NO: 762956 - DNA, 17 bp, Homo sapiens
cttactgtatatgtatt

SEQ ID NO: 762957 - DNA, 22 bp, Homo sapiens
cttactgtcagttgtacttctg

SEQ ID NO: 762958 - DNA, 14 bp, Homo sapiens
cttacttagtgtta

SEQ ID NO: 762959 - DNA, 15 bp, Homo sapiens
cttacttcctggcct

SEQ ID NO: 762960 - DNA, 13 bp, Homo sapiens
cttacttgcactg

SEQ ID NO: 762961 - DNA, 14 bp, Homo sapiens
cttacttgcactgt

SEQ ID NO: 762962 - DNA, 22 bp, Homo sapiens
cttacttgccaagaaaatgaag

SEQ ID NO: 762963 - DNA, 19 bp, Homo sapiens
cttactttacctctctgtc

SEQ ID NO: 762964 - DNA, 14 bp, Homo sapiens
cttactttcctgtg

SEQ ID NO: 762965 - DNA, 12 bp, Homo sapiens
cttactttgctt

SEQ ID NO: 762966 - DNA, 13 bp, Homo sapiens
cttactttgcttg

SEQ ID NO: 762967 - DNA, 21 bp, Homo sapiens
cttacttttaaggataaatca

SEQ ID NO: 762968 - DNA, 18 bp, Homo sapiens
cttagaaatgtaaactgc

SEQ ID NO: 762969 - DNA, 20 bp, Homo sapiens
cttagaaatgtaaactgcca

SEQ ID NO: 762970 - DNA, 21 bp, Homo sapiens
cttagaaatgtaaactgccat

SEQ ID NO: 762971 - DNA, 12 bp, Homo sapiens
cttagaacattt

SEQ ID NO: 762972 - DNA, 15 bp, Homo sapiens
cttagaacctttctt

SEQ ID NO: 762973 - DNA, 17 bp, Homo sapiens
cttagaacgttaaacta

SEQ ID NO: 762974 - DNA, 17 bp, Homo sapiens
cttagaagtggaccagg

SEQ ID NO: 762975 - DNA, 18 bp, Homo sapiens
cttagaagtggaccagga

SEQ ID NO: 762976 - DNA, 22 bp, Homo sapiens
cttagaagtggaccaggacagg

SEQ ID NO: 762977 - DNA, 23 bp, Homo sapiens
cttagaagtggaccaggacagga

SEQ ID NO: 762978 - DNA, 16 bp, Homo sapiens
cttagacataacaaaa

SEQ ID NO: 762979 - DNA, 17 bp, Homo sapiens
cttagacctatactgaa

SEQ ID NO: 762980 - DNA, 13 bp, Homo sapiens
cttagacctcagc

SEQ ID NO: 762981 - DNA, 17 bp, Homo sapiens
cttagacctcagcctgt

SEQ ID NO: 762982 - DNA, 21 bp, Homo sapiens
cttagacgaagaagctggcta

SEQ ID NO: 762983 - DNA, 16 bp, Homo sapiens
cttagactccttctcc

SEQ ID NO: 762984 - DNA, 20 bp, Homo sapiens
cttagactccttctccccaa

SEQ ID NO: 762985 - DNA, 19 bp, Homo sapiens
cttagacttcgactcagga

SEQ ID NO: 762986 - DNA, 17 bp, Homo sapiens
cttagacttgaaatact

SEQ ID NO: 762987 - DNA, 13 bp, Homo sapiens
cttagagaagcta

SEQ ID NO: 762988 - DNA, 14 bp, Homo sapiens
cttagaggaaaagg

SEQ ID NO: 762989 - DNA, 17 bp, Homo sapiens
cttatattttatgaaca

SEQ ID NO: 762990 - DNA, 21 bp, Homo sapiens
cttatattttatgaacattgt

SEQ ID NO: 762991 - DNA, 23 bp, Homo sapiens
cttatattttatgaacattgtac

SEQ ID NO: 762992 - DNA, 20 bp, Homo sapiens
cttatattttcagcaaagaa

SEQ ID NO: 762993 - DNA, 19 bp, Homo sapiens
cttatattttgattttaca

SEQ ID NO: 762994 - DNA, 14 bp, Homo sapiens
cttatcaaaggaca

SEQ ID NO: 762995 - DNA, 20 bp, Homo sapiens
catttgtgctagaaattttc

SEQ ID NO: 762996 - DNA, 23 bp, Homo sapiens
catttgtggcagtcccttataat

SEQ ID NO: 762997 - DNA, 13 bp, Homo sapiens
catttgttaatat

SEQ ID NO: 762998 - DNA, 22 bp, Homo sapiens
catttgttcactgaaggtgatt

SEQ ID NO: 762999 - DNA, 12 bp, Homo sapiens
catttgttcctg

SEQ ID NO: 763000 - DNA, 14 bp, Homo sapiens
catttgttcctgga

SEQ ID NO: 763001 - DNA, 18 bp, Homo sapiens
catttgtttaaacaatct

SEQ ID NO: 763002 - DNA, 23 bp, Homo sapiens
catttgtttctttctctgaggac

SEQ ID NO: 763003 - DNA, 17 bp, Homo sapiens
catttgtttgaactgat

SEQ ID NO: 763004 - DNA, 12 bp, Homo sapiens
catttgtttgac

SEQ ID NO: 763005 - DNA, 22 bp, Homo sapiens
catttgtttgaccccagtttct

SEQ ID NO: 763006 - DNA, 19 bp, Homo sapiens
catttgttttgcttttgtt

SEQ ID NO: 763007 - DNA, 13 bp, Homo sapiens
cattttaaaaaca

SEQ ID NO: 763008 - DNA, 20 bp, Homo sapiens
cattttaaaaaccaatcatt

SEQ ID NO: 763009 - DNA, 19 bp, Homo sapiens
cattttaaaaactttattg

SEQ ID NO: 763010 - DNA, 20 bp, Homo sapiens
cattttaaaaactttattgg

SEQ ID NO: 763011 - DNA, 12 bp, Homo sapiens
cattttaaacaa

SEQ ID NO: 763012 - DNA, 13 bp, Homo sapiens
cattttaaacaaa

SEQ ID NO: 763013 - DNA, 16 bp, Homo sapiens
cattttaaacaaaata

SEQ ID NO: 763014 - DNA, 22 bp, Homo sapiens
cattttaaacaaaatagaaagt

SEQ ID NO: 763015 - DNA, 23 bp, Homo sapiens
cattttaaacaaaatagaaagtt

SEQ ID NO: 763016 - DNA, 17 bp, Homo sapiens
cattttaaagttagtat

SEQ ID NO: 763017 - DNA, 17 bp, Homo sapiens
cattttaaataaaagaa

SEQ ID NO: 763018 - DNA, 14 bp, Homo sapiens
cattttaaatgaaa

SEQ ID NO: 763019 - DNA, 15 bp, Homo sapiens
cattttaaatgaaag

SEQ ID NO: 763020 - DNA, 23 bp, Homo sapiens
cattttaaattccactgaaaatt

SEQ ID NO: 763021 - DNA, 16 bp, Homo sapiens
cattttaacgctgcct

SEQ ID NO: 763022 - DNA, 16 bp, Homo sapiens
cattttaactttatca

SEQ ID NO: 763023 - DNA, 16 bp, Homo sapiens
cattttaagtgcttca

SEQ ID NO: 763024 - DNA, 18 bp, Homo sapiens
cattttaagtttgtagta

SEQ ID NO: 763025 - DNA, 21 bp, Homo sapiens
cattttaatagagatgaatca

SEQ ID NO: 763026 - DNA, 14 bp, Homo sapiens
cattttaattcatc

SEQ ID NO: 763027 - DNA, 17 bp, Homo sapiens
cattttacacatgtgct

SEQ ID NO: 763028 - DNA, 22 bp, Homo sapiens
cattttactgtacagattgctg

SEQ ID NO: 763029 - DNA, 18 bp, Homo sapiens
cattttaggaataataaa

SEQ ID NO: 763030 - DNA, 14 bp, Homo sapiens
cattttagtgactg

SEQ ID NO: 763031 - DNA, 14 bp, Homo sapiens
cattttataatttc

SEQ ID NO: 763032 - DNA, 11 bp, Homo sapiens
cattttataca

SEQ ID NO: 763033 - DNA, 16 bp, Homo sapiens
cattttatatttttgt

SEQ ID NO: 763034 - DNA, 21 bp, Homo sapiens
cattttatatttttgtacata

SEQ ID NO: 763035 - DNA, 15 bp, Homo sapiens
cattttatcattaaa

SEQ ID NO: 763036 - DNA, 22 bp, Homo sapiens
cattttattaagctttttggaa

SEQ ID NO: 763037 - DNA, 11 bp, Homo sapiens
cattttattct

SEQ ID NO: 763038 - DNA, 13 bp, Homo sapiens
cattttattgctt

SEQ ID NO: 763039 - DNA, 22 bp, Homo sapiens
cattttattttattatgcatga

SEQ ID NO: 763040 - DNA, 15 bp, Homo sapiens
cattttattttttgg

SEQ ID NO: 763041 - DNA, 15 bp, Homo sapiens
cattttcaactgctt

SEQ ID NO: 763042 - DNA, 23 bp, Homo sapiens
cattttcaataacaaaacgaaac

SEQ ID NO: 763043 - DNA, 20 bp, Homo sapiens
cattttccacggaaacagaa

SEQ ID NO: 763044 - DNA, 23 bp, Homo sapiens
cattttccacggaaacagaactc

SEQ ID NO: 763045 - DNA, 19 bp, Homo sapiens
cattttccatatcctggtg

SEQ ID NO: 763046 - DNA, 21 bp, Homo sapiens
cattttccatatcctggtgcc

SEQ ID NO: 763047 - DNA, 14 bp, Homo sapiens
cattttccccccac

SEQ ID NO: 763048 - DNA, 20 bp, Homo sapiens
cattttccccccactctccc

SEQ ID NO: 763049 - DNA, 17 bp, Homo sapiens
cattttccccttcctca

SEQ ID NO: 763050 - DNA, 17 bp, Homo sapiens
cattttcctcctctgcc

SEQ ID NO: 763051 - DNA, 21 bp, Homo sapiens
cattttcgctttcctctggtt

SEQ ID NO: 763052 - DNA, 12 bp, Homo sapiens
cattttctaaat

SEQ ID NO: 763053 - DNA, 13 bp, Homo sapiens
cattttctaaata

SEQ ID NO: 763054 - DNA, 23 bp, Homo sapiens
cattttctaaataaaaatatgta

SEQ ID NO: 763055 - DNA, 18 bp, Homo sapiens
cattttctagatacaata

SEQ ID NO: 763056 - DNA, 15 bp, Homo sapiens
cattttctctgtatg

SEQ ID NO: 763057 - DNA, 20 bp, Homo sapiens
cattttctgatgtattacat

SEQ ID NO: 763058 - DNA, 22 bp, Homo sapiens
cattttctggccagtgtttaaa

SEQ ID NO: 763059 - DNA, 23 bp, Homo sapiens
cattttctggccagtgtttaaaa

SEQ ID NO: 763060 - DNA, 20 bp, Homo sapiens
cattttcttattgcgctgct

SEQ ID NO: 763061 - DNA, 15 bp, Homo sapiens
cattttcttcacagt

SEQ ID NO: 763062 - DNA, 17 bp, Homo sapiens
cattttcttcacagtgc

SEQ ID NO: 763063 - DNA, 14 bp, Homo sapiens
cattttcttcagaa

SEQ ID NO: 763064 - DNA, 16 bp, Homo sapiens
cattttcttcagaatt

SEQ ID NO: 763065 - DNA, 21 bp, Homo sapiens
cattttcttcagaattatcca

SEQ ID NO: 763066 - DNA, 18 bp, Homo sapiens
cattttctttttaaattt

SEQ ID NO: 763067 - DNA, 16 bp, Homo sapiens
cattttgaaaagtatt

SEQ ID NO: 763068 - DNA, 23 bp, Homo sapiens
cattttgaaaagtattggttact

SEQ ID NO: 763069 - DNA, 14 bp, Homo sapiens
cattttgaaacaaa

SEQ ID NO: 763070 - DNA, 21 bp, Homo sapiens
cattttgaaagtctgtccttg

SEQ ID NO: 763071 - DNA, 13 bp, Homo sapiens
cattttgcaaaat

SEQ ID NO: 763072 - DNA, 15 bp, Homo sapiens
cattttgcaaaattt

SEQ ID NO: 763073 - DNA, 22 bp, Homo sapiens
cattttgcagaaggaaatgatg

SEQ ID NO: 763074 - DNA, 24 bp, Homo sapiens
cattttgcagaaggaaatgatgga

SEQ ID NO: 763075 - DNA, 15 bp, Homo sapiens
cattttgcagcagtg

SEQ ID NO: 763076 - DNA, 16 bp, Homo sapiens
cattttgcagcagtga

SEQ ID NO: 763077 - DNA, 21 bp, Homo sapiens
cattttgctaaatgtgaatga

SEQ ID NO: 763078 - DNA, 15 bp, Homo sapiens
cattttgctattgta

SEQ ID NO: 763079 - DNA, 17 bp, Homo sapiens
cattttgctattgtaaa

SEQ ID NO: 763080 - DNA, 22 bp, Homo sapiens
cattttggaagttttcaggact

SEQ ID NO: 763081 - DNA, 12 bp, Homo sapiens
cattttggagct

SEQ ID NO: 763082 - DNA, 18 bp, Homo sapiens
cattttgggatccttcag

SEQ ID NO: 763083 - DNA, 19 bp, Homo sapiens
cattttgggatccttcagc

SEQ ID NO: 763084 - DNA, 22 bp, Homo sapiens
cattttggtaagagacagaatg

SEQ ID NO: 763085 - DNA, 16 bp, Homo sapiens
cattttggtactttgg

SEQ ID NO: 763086 - DNA, 16 bp, Homo sapiens
cattttggtctgtttt

SEQ ID NO: 763087 - DNA, 15 bp, Homo sapiens
cattttggtgagaaa

SEQ ID NO: 763088 - DNA, 15 bp, Homo sapiens
cattttgtaaaatat

SEQ ID NO: 763089 - DNA, 16 bp, Homo sapiens
cattttgtaaaatatt

SEQ ID NO: 763090 - DNA, 18 bp, Homo sapiens
cattttgtaacaaatgaa

SEQ ID NO: 763091 - DNA, 13 bp, Homo sapiens
cattttgtaataa

SEQ ID NO: 763092 - DNA, 17 bp, Homo sapiens
cattttgtaatatttga

SEQ ID NO: 763093 - DNA, 18 bp, Homo sapiens
cattttgtgaatttgggt

SEQ ID NO: 763094 - DNA, 19 bp, Homo sapiens
cattttgtggaattttgag

SEQ ID NO: 763095 - DNA, 16 bp, Homo sapiens
cattttgttaaaatct

SEQ ID NO: 763096 - DNA, 20 bp, Homo sapiens
cattttgttaaaatctactt

SEQ ID NO: 763097 - DNA, 14 bp, Homo sapiens
cattttgttacata

SEQ ID NO: 763098 - DNA, 15 bp, Homo sapiens
cattttgttatagaa

SEQ ID NO: 763099 - DNA, 12 bp, Homo sapiens
cattttgtttct

SEQ ID NO: 763100 - DNA, 15 bp, Homo sapiens
cattttgtttctgta

SEQ ID NO: 763101 - DNA, 18 bp, Homo sapiens
cattttgttttgctctga

SEQ ID NO: 763102 - DNA, 15 bp, Homo sapiens
catttttaaacttga

SEQ ID NO: 763103 - DNA, 19 bp, Homo sapiens
catttttaaacttgaaata

SEQ ID NO: 763104 - DNA, 16 bp, Homo sapiens
catttttaaagcctgg

SEQ ID NO: 763105 - DNA, 19 bp, Homo sapiens
catttttaaagcctggctt

SEQ ID NO: 763106 - DNA, 18 bp, Homo sapiens
catttttaaatgtgtttt

SEQ ID NO: 763107 - DNA, 21 bp, Homo sapiens
catttttaagatagaacacaa

SEQ ID NO: 763108 - DNA, 20 bp, Homo sapiens
catttttaagtgctgcattt

SEQ ID NO: 763109 - DNA, 15 bp, Homo sapiens
catttttagcactgg

SEQ ID NO: 763110 - DNA, 14 bp, Homo sapiens
catttttcaaagca

SEQ ID NO: 763111 - DNA, 23 bp, Homo sapiens
ccaaagccccttgctctcccctg

SEQ ID NO: 763112 - DNA, 13 bp, Homo sapiens
ccaaagccctggt

SEQ ID NO: 763113 - DNA, 22 bp, Homo sapiens
ccaaagcctcctccagccgcca

SEQ ID NO: 763114 - DNA, 12 bp, Homo sapiens
ccaaagcctgtc

SEQ ID NO: 763115 - DNA, 17 bp, Homo sapiens
ccaaagcctgtcccagg

SEQ ID NO: 763116 - DNA, 19 bp, Homo sapiens
ccaaagcctgtcccaggac

SEQ ID NO: 763117 - DNA, 13 bp, Homo sapiens
ccaaagctgccca

SEQ ID NO: 763118 - DNA, 18 bp, Homo sapiens
ccaaagctgcccactgtt

SEQ ID NO: 763119 - DNA, 18 bp, Homo sapiens
ccaaagctgcctgtgcca

SEQ ID NO: 763120 - DNA, 19 bp, Homo sapiens
ccaaagctgcctgtgccat

SEQ ID NO: 763121 - DNA, 18 bp, Homo sapiens
ccaaagctttactactgt

SEQ ID NO: 763122 - DNA, 16 bp, Homo sapiens
ccaaagctttcatgta

SEQ ID NO: 763123 - DNA, 13 bp, Homo sapiens
ccaaagctttcct

SEQ ID NO: 763124 - DNA, 14 bp, Homo sapiens
ccaaaggaaaatgt

SEQ ID NO: 763125 - DNA, 16 bp, Homo sapiens
cttcaagcgctccagg

SEQ ID NO: 763126 - DNA, 17 bp, Homo sapiens
cttcaagcgctccaggg

SEQ ID NO: 763127 - DNA, 13 bp, Homo sapiens
cttcaagctctct

SEQ ID NO: 763128 - DNA, 15 bp, Homo sapiens
cttcaagctctctgt

SEQ ID NO: 763129 - DNA, 23 bp, Homo sapiens
cttcaaggactgtttcagtgtga

SEQ ID NO: 763130 - DNA, 22 bp, Homo sapiens
cttcaaggatatactgcagctt

SEQ ID NO: 763131 - DNA, 19 bp, Homo sapiens
cttcaaggccctcagagat

SEQ ID NO: 763132 - DNA, 15 bp, Homo sapiens
cttcaaggcctcccc

SEQ ID NO: 763133 - DNA, 16 bp, Homo sapiens
cttcaagttagctcag

SEQ ID NO: 763134 - DNA, 17 bp, Homo sapiens
cttcaagttagctcagg

SEQ ID NO: 763135 - DNA, 18 bp, Homo sapiens
cttcaagttagctcagga

SEQ ID NO: 763136 - DNA, 19 bp, Homo sapiens
cttcaagttagctcaggag

SEQ ID NO: 763137 - DNA, 20 bp, Homo sapiens
cttcaataaatctttggaaa

SEQ ID NO: 763138 - DNA, 17 bp, Homo sapiens
cttcaatataagaagca

SEQ ID NO: 763139 - DNA, 17 bp, Homo sapiens
cttcaatcggcttgtgg

SEQ ID NO: 763140 - DNA, 12 bp, Homo sapiens
cttcaatctctg

SEQ ID NO: 763141 - DNA, 13 bp, Homo sapiens
cttcaatctctgg

SEQ ID NO: 763142 - DNA, 14 bp, Homo sapiens
cttcaatctctgtt

SEQ ID NO: 763143 - DNA, 17 bp, Homo sapiens
cttcaatctctgttctg

SEQ ID NO: 763144 - DNA, 19 bp, Homo sapiens
cttcaatgggctcttccaa

SEQ ID NO: 763145 - DNA, 15 bp, Homo sapiens
cttcaatgtgtcatt

SEQ ID NO: 763146 - DNA, 14 bp, Homo sapiens
cttcaattaaaatt

SEQ ID NO: 763147 - DNA, 22 bp, Homo sapiens
cttcaattaaaattacaaaaga

SEQ ID NO: 763148 - DNA, 12 bp, Homo sapiens
cttcacaaatgt

SEQ ID NO: 763149 - DNA, 14 bp, Homo sapiens
cttcacaaatgtca

SEQ ID NO: 763150 - DNA, 16 bp, Homo sapiens
cttcacaaatgtcatt

SEQ ID NO: 763151 - DNA, 17 bp, Homo sapiens
cttcacacacaggcaac

SEQ ID NO: 763152 - DNA, 14 bp, Homo sapiens
cttcacacagacac

SEQ ID NO: 763153 - DNA, 12 bp, Homo sapiens
cttcacactgca

SEQ ID NO: 763154 - DNA, 18 bp, Homo sapiens
cttcacactgcaagagcc

SEQ ID NO: 763155 - DNA, 14 bp, Homo sapiens
cttcacaggcactc

SEQ ID NO: 763156 - DNA, 18 bp, Homo sapiens
cttcacaggcagtgcatg

SEQ ID NO: 763157 - DNA, 22 bp, Homo sapiens
cttcacaggtgaggcatggcaa

SEQ ID NO: 763158 - DNA, 17 bp, Homo sapiens
cttcacagtagagccag

SEQ ID NO: 763159 - DNA, 22 bp, Homo sapiens
cttcacagtagagccagcttgg

SEQ ID NO: 763160 - DNA, 13 bp, Homo sapiens
cttcacagtgttt

SEQ ID NO: 763161 - DNA, 17 bp, Homo sapiens
cttcacataccctcccc

SEQ ID NO: 763162 - DNA, 20 bp, Homo sapiens
cttcacatcctgtgtttcta

SEQ ID NO: 763163 - DNA, 21 bp, Homo sapiens
cttcacatcctgtgtttctag

SEQ ID NO: 763164 - DNA, 15 bp, Homo sapiens
cttcacattaaaaaa

SEQ ID NO: 763165 - DNA, 17 bp, Homo sapiens
cttcacattaaaaaatg

SEQ ID NO: 763166 - DNA, 17 bp, Homo sapiens
cttcaccaccccctgtc

SEQ ID NO: 763167 - DNA, 19 bp, Homo sapiens
cttcaccagagcatttcca

SEQ ID NO: 763168 - DNA, 22 bp, Homo sapiens
cttcacccagctaatctgtagg

SEQ ID NO: 763169 - DNA, 13 bp, Homo sapiens
cttcacccctgca

SEQ ID NO: 763170 - DNA, 21 bp, Homo sapiens
cttcacccgagttcctctggg

SEQ ID NO: 763171 - DNA, 21 bp, Homo sapiens
cttcaccctgaatggttccat

SEQ ID NO: 763172 - DNA, 15 bp, Homo sapiens
cttcaccctgagttt

SEQ ID NO: 763173 - DNA, 15 bp, Homo sapiens
cttcaccctggagcc

SEQ ID NO: 763174 - DNA, 15 bp, Homo sapiens
cttcacctcttccac

SEQ ID NO: 763175 - DNA, 16 bp, Homo sapiens
cttcacctcttccact

SEQ ID NO: 763176 - DNA, 19 bp, Homo sapiens
cttcacctgttatgtatga

SEQ ID NO: 763177 - DNA, 18 bp, Homo sapiens
cttcacctttcctctccc

SEQ ID NO: 763178 - DNA, 23 bp, Homo sapiens
cttcacctttcctctccctcagg

SEQ ID NO: 763179 - DNA, 19 bp, Homo sapiens
cttcacctttggtgcagag

SEQ ID NO: 763180 - DNA, 23 bp, Homo sapiens
cttcactaccctgattcttgatt

SEQ ID NO: 763181 - DNA, 21 bp, Homo sapiens
cttcactcatgcaaactgctt

SEQ ID NO: 763182 - DNA, 19 bp, Homo sapiens
cttcactccggtgtgcctg

SEQ ID NO: 763183 - DNA, 22 bp, Homo sapiens
cttcactccggtgtgcctgcag

SEQ ID NO: 763184 - DNA, 23 bp, Homo sapiens
cttcactccggtgtgcctgcagc

SEQ ID NO: 763185 - DNA, 17 bp, Homo sapiens
cttcactcgcccccggg

SEQ ID NO: 763186 - DNA, 13 bp, Homo sapiens
cttcactctctcc

SEQ ID NO: 763187 - DNA, 22 bp, Homo sapiens
cttcactctctccgtctgtttt

SEQ ID NO: 763188 - DNA, 15 bp, Homo sapiens
cttcactctctgaag

SEQ ID NO: 763189 - DNA, 18 bp, Homo sapiens
cttcactcttcacttgag

SEQ ID NO: 763190 - DNA, 14 bp, Homo sapiens
cttcactgaacatg

SEQ ID NO: 763191 - DNA, 13 bp, Homo sapiens
cttcactgccatg

SEQ ID NO: 763192 - DNA, 21 bp, Homo sapiens
cttcactggtgtacatcgttt

SEQ ID NO: 763193 - DNA, 14 bp, Homo sapiens
cttcactgtatata

SEQ ID NO: 763194 - DNA, 17 bp, Homo sapiens
cttcactgtatataaac

SEQ ID NO: 763195 - DNA, 18 bp, Homo sapiens
cttcactgtatataaaca

SEQ ID NO: 763196 - DNA, 12 bp, Homo sapiens
cttcactgtcac

SEQ ID NO: 763197 - DNA, 18 bp, Homo sapiens
cttcactgtcctccaagc

SEQ ID NO: 763198 - DNA, 21 bp, Homo sapiens
cttcactgtcctccaagccag

SEQ ID NO: 763199 - DNA, 19 bp, Homo sapiens
cttcactgtggccacagcc

SEQ ID NO: 763200 - DNA, 21 bp, Homo sapiens
cttcactgttccctctggctt

SEQ ID NO: 763201 - DNA, 12 bp, Homo sapiens
cttcacttgagt

SEQ ID NO: 763202 - DNA, 22 bp, Homo sapiens
cttcacttgagttggctgtgtt

SEQ ID NO: 763203 - DNA, 12 bp, Homo sapiens
cttcagaaagac

SEQ ID NO: 763204 - DNA, 18 bp, Homo sapiens
cttcagaacacacagact

SEQ ID NO: 763205 - DNA, 17 bp, Homo sapiens
cttcagaacagaggcat

SEQ ID NO: 763206 - DNA, 21 bp, Homo sapiens
cttcagaactgcccttgctgc

SEQ ID NO: 763207 - DNA, 15 bp, Homo sapiens
cttcagaagctagtg

SEQ ID NO: 763208 - DNA, 20 bp, Homo sapiens
cttcagaaggggacctgttt

SEQ ID NO: 763209 - DNA, 18 bp, Homo sapiens
cttcagaattatccatta

SEQ ID NO: 763210 - DNA, 20 bp, Homo sapiens
cttcagaattatccattacg

SEQ ID NO: 763211 - DNA, 19 bp, Homo sapiens
cttcagacacaaaagtcca

SEQ ID NO: 763212 - DNA, 22 bp, Homo sapiens
cttcagacacaggaaaaataaa

SEQ ID NO: 763213 - DNA, 22 bp, Homo sapiens
cttcagaccatcagttacagag

SEQ ID NO: 763214 - DNA, 18 bp, Homo sapiens
cttcagactttgcttccc

SEQ ID NO: 763215 - DNA, 11 bp, Homo sapiens
cttcagagagc

SEQ ID NO: 763216 - DNA, 15 bp, Homo sapiens
cttcagagagctggt

SEQ ID NO: 763217 - DNA, 19 bp, Homo sapiens
cttcagagggtttggacca

SEQ ID NO: 763218 - DNA, 22 bp, Homo sapiens
cttcagaggtctaatttagtag

SEQ ID NO: 763219 - DNA, 12 bp, Homo sapiens
cttcagagtgaa

SEQ ID NO: 763220 - DNA, 14 bp, Homo sapiens
cttcagagtgaaga

SEQ ID NO: 763221 - DNA, 16 bp, Homo sapiens
cttcagagtttgtcat

SEQ ID NO: 763222 - DNA, 15 bp, Homo sapiens
cttcagatctgaggt

SEQ ID NO: 763223 - DNA, 17 bp, Homo sapiens
cttcagatgctcttggg

SEQ ID NO: 763224 - DNA, 18 bp, Homo sapiens
cttcagatttgtgttata

SEQ ID NO: 763225 - DNA, 20 bp, Homo sapiens
cttcagcaagttagaactag

SEQ ID NO: 763226 - DNA, 21 bp, Homo sapiens
cttcagcacaggaattctcaa

SEQ ID NO: 763227 - DNA, 18 bp, Homo sapiens
cttcagcaggaagggtgg

SEQ ID NO: 763228 - DNA, 18 bp, Homo sapiens
cttcagcatatttatagc

SEQ ID NO: 763229 - DNA, 15 bp, Homo sapiens
cttcagcccaggctt

SEQ ID NO: 763230 - DNA, 22 bp, Homo sapiens
cttcagcccaggcttttgctag

SEQ ID NO: 763231 - DNA, 14 bp, Homo sapiens
cttcagcccccacc

SEQ ID NO: 763232 - DNA, 15 bp, Homo sapiens
cttcagcccccacca

SEQ ID NO: 763233 - DNA, 21 bp, Homo sapiens
cttccaaggagaccaagtcct

SEQ ID NO: 763234 - DNA, 12 bp, Homo sapiens
cttccaaggccc

SEQ ID NO: 763235 - DNA, 17 bp, Homo sapiens
cttccacaaagaaaatt

SEQ ID NO: 763236 - DNA, 18 bp, Homo sapiens
cttccacaagagtgaatt

SEQ ID NO: 763237 - DNA, 13 bp, Homo sapiens
cttccacatgtac

SEQ ID NO: 763238 - DNA, 11 bp, Homo sapiens
cttccacctca

SEQ ID NO: 763239 - DNA, 23 bp, Homo sapiens
cttccacctcagcctcccaggta

SEQ ID NO: 763240 - DNA, 15 bp, Homo sapiens
cttccacctccctcc

SEQ ID NO: 763241 - DNA, 15 bp, Homo sapiens
cttccacctcctaga

SEQ ID NO: 763242 - DNA, 18 bp, Homo sapiens
cttccacgctgtctccag

SEQ ID NO: 763243 - DNA, 21 bp, Homo sapiens
cttccacgctgtctccagacc

SEQ ID NO: 763244 - DNA, 17 bp, Homo sapiens
cttccactccttctctc

SEQ ID NO: 763245 - DNA, 18 bp, Homo sapiens
cttccactgagggcagtc

SEQ ID NO: 763246 - DNA, 16 bp, Homo sapiens
cttccactgtagctat

SEQ ID NO: 763247 - DNA, 21 bp, Homo sapiens
cttccactgtgtgttgacact

SEQ ID NO: 763248 - DNA, 16 bp, Homo sapiens
cttccagaaggcagca

SEQ ID NO: 763249 - DNA, 16 bp, Homo sapiens
cttccagaatgctgaa

SEQ ID NO: 763250 - DNA, 14 bp, Homo sapiens
cttccagagccaga

SEQ ID NO: 763251 - DNA, 19 bp, Homo sapiens
cttccagaggacagctctg

SEQ ID NO: 763252 - DNA, 17 bp, Homo sapiens
cttccagatcactgcca

SEQ ID NO: 763253 - DNA, 21 bp, Homo sapiens
cttccagccacattgagactt

SEQ ID NO: 763254 - DNA, 22 bp, Homo sapiens
cttccagccacattgagacttt

SEQ ID NO: 763255 - DNA, 17 bp, Homo sapiens
ccaaccccacccagctc

SEQ ID NO: 763256 - DNA, 16 bp, Homo sapiens
ccaacccccaccccac

SEQ ID NO: 763257 - DNA, 18 bp, Homo sapiens
ccaacccccaccccacac

SEQ ID NO: 763258 - DNA, 18 bp, Homo sapiens
ccaacccccagaggtggc

SEQ ID NO: 763259 - DNA, 18 bp, Homo sapiens
ccaaccccccacctgcca

SEQ ID NO: 763260 - DNA, 16 bp, Homo sapiens
ccaacccccctcctgc

SEQ ID NO: 763261 - DNA, 19 bp, Homo sapiens
ccaacccccctcctgctcc

SEQ ID NO: 763262 - DNA, 22 bp, Homo sapiens
ccaacccccctcctgctcctcc

SEQ ID NO: 763263 - DNA, 12 bp, Homo sapiens
ccaaccctagca

SEQ ID NO: 763264 - DNA, 19 bp, Homo sapiens
ccaaccctatctcctgaca

SEQ ID NO: 763265 - DNA, 20 bp, Homo sapiens
ccaaccctatctcctgacag

SEQ ID NO: 763266 - DNA, 23 bp, Homo sapiens
ccaaccctatctcctgacagaag

SEQ ID NO: 763267 - DNA, 16 bp, Homo sapiens
ccaaccctgcccctgc

SEQ ID NO: 763268 - DNA, 13 bp, Homo sapiens
ccaaccctgccgt

SEQ ID NO: 763269 - DNA, 20 bp, Homo sapiens
ccaaccctgggctggggagg

SEQ ID NO: 763270 - DNA, 21 bp, Homo sapiens
ccaaccctgggctggggagga

SEQ ID NO: 763271 - DNA, 22 bp, Homo sapiens
ccaaccctgggctggggaggag

SEQ ID NO: 763272 - DNA, 16 bp, Homo sapiens
ccaaccctgtttcctg

SEQ ID NO: 763273 - DNA, 18 bp, Homo sapiens
ccaaccctgtttcctgag

SEQ ID NO: 763274 - DNA, 14 bp, Homo sapiens
ccaacccttcccca

SEQ ID NO: 763275 - DNA, 16 bp, Homo sapiens
ccaaccgtgtctgtct

SEQ ID NO: 763276 - DNA, 18 bp, Homo sapiens
ccaacctcaatgccctgc

SEQ ID NO: 763277 - DNA, 14 bp, Homo sapiens
ccaacctcagggct

SEQ ID NO: 763278 - DNA, 18 bp, Homo sapiens
ccaacctcagggctccca

SEQ ID NO: 763279 - DNA, 20 bp, Homo sapiens
ccaacctcagggctcccagg

SEQ ID NO: 763280 - DNA, 12 bp, Homo sapiens
ccaacctccagt

SEQ ID NO: 763281 - DNA, 18 bp, Homo sapiens
ccaacctccagtgtcagg

SEQ ID NO: 763282 - DNA, 14 bp, Homo sapiens
ccaacctcctgacc

SEQ ID NO: 763283 - DNA, 20 bp, Homo sapiens
ccaacctctttttcctcctg

SEQ ID NO: 763284 - DNA, 21 bp, Homo sapiens
ccaacctctttttcctcctgg

SEQ ID NO: 763285 - DNA, 13 bp, Homo sapiens
ccaacctgaccaa

SEQ ID NO: 763286 - DNA, 12 bp, Homo sapiens
ccaacctgctct

SEQ ID NO: 763287 - DNA, 12 bp, Homo sapiens
ccaacctgctga

SEQ ID NO: 763288 - DNA, 13 bp, Homo sapiens
ccaacctggacaa

SEQ ID NO: 763289 - DNA, 18 bp, Homo sapiens
ccaacctgttcttagagt

SEQ ID NO: 763290 - DNA, 21 bp, Homo sapiens
ccaacctgttcttagagtgta

SEQ ID NO: 763291 - DNA, 23 bp, Homo sapiens
ccaaccttagatgttctaagtct

SEQ ID NO: 763292 - DNA, 12 bp, Homo sapiens
ccaaccttccca

SEQ ID NO: 763293 - DNA, 18 bp, Homo sapiens
ccaacctttccctcaccc

SEQ ID NO: 763294 - DNA, 20 bp, Homo sapiens
ccaacctttccctcaccccc

SEQ ID NO: 763295 - DNA, 20 bp, Homo sapiens
ccaacgagacacattgcctt

SEQ ID NO: 763296 - DNA, 14 bp, Homo sapiens
ccaacgagcctcct

SEQ ID NO: 763297 - DNA, 13 bp, Homo sapiens
ccaacgcccctgt

SEQ ID NO: 763298 - DNA, 19 bp, Homo sapiens
ccaacgcccctgtggccaa

SEQ ID NO: 763299 - DNA, 23 bp, Homo sapiens
ccaacgcccctgtggccaactgc

SEQ ID NO: 763300 - DNA, 19 bp, Homo sapiens
ccaacgcctcctgtcccca

SEQ ID NO: 763301 - DNA, 14 bp, Homo sapiens
ccaactaagccctc

SEQ ID NO: 763302 - DNA, 15 bp, Homo sapiens
ccaactaagccctcg

SEQ ID NO: 763303 - DNA, 19 bp, Homo sapiens
ccaactaatgccttactct

SEQ ID NO: 763304 - DNA, 20 bp, Homo sapiens
ccaactaatgccttactctt

SEQ ID NO: 763305 - DNA, 12 bp, Homo sapiens
ccaactccagga

SEQ ID NO: 763306 - DNA, 20 bp, Homo sapiens
ccaactccaggaaagagcag

SEQ ID NO: 763307 - DNA, 14 bp, Homo sapiens
ccaactccaggggc

SEQ ID NO: 763308 - DNA, 15 bp, Homo sapiens
ccaactccaggggca

SEQ ID NO: 763309 - DNA, 16 bp, Homo sapiens
ccaactccaggggcac

SEQ ID NO: 763310 - DNA, 18 bp, Homo sapiens
ccaactccaggggcacct

SEQ ID NO: 763311 - DNA, 16 bp, Homo sapiens
ccaactcctaatttta

SEQ ID NO: 763312 - DNA, 22 bp, Homo sapiens
ccaactcctggaagctgtgtcc

SEQ ID NO: 763313 - DNA, 21 bp, Homo sapiens
ccaactctaaagccaagcact

SEQ ID NO: 763314 - DNA, 22 bp, Homo sapiens
ccaactctaaagccaagcactt

SEQ ID NO: 763315 - DNA, 12 bp, Homo sapiens
ccaactctcccc

SEQ ID NO: 763316 - DNA, 18 bp, Homo sapiens
ccaactctccccagtgcc

SEQ ID NO: 763317 - DNA, 20 bp, Homo sapiens
ccaactctccccagtgcctg

SEQ ID NO: 763318 - DNA, 22 bp, Homo sapiens
ccaactctccccagtgcctgcc

SEQ ID NO: 763319 - DNA, 16 bp, Homo sapiens
ccaactctgagcccat

SEQ ID NO: 763320 - DNA, 22 bp, Homo sapiens
ccaactctgagcccatgttctg

SEQ ID NO: 763321 - DNA, 14 bp, Homo sapiens
ccaactctgcactc

SEQ ID NO: 763322 - DNA, 16 bp, Homo sapiens
ccaactctgcactcca

SEQ ID NO: 763323 - DNA, 15 bp, Homo sapiens
ccaactcttcctccc

SEQ ID NO: 763324 - DNA, 18 bp, Homo sapiens
ccaactgacctgccagcc

SEQ ID NO: 763325 - DNA, 14 bp, Homo sapiens
ccaactgattttgt

SEQ ID NO: 763326 - DNA, 12 bp, Homo sapiens
ccaactgcacaa

SEQ ID NO: 763327 - DNA, 12 bp, Homo sapiens
ccaactgcccta

SEQ ID NO: 763328 - DNA, 16 bp, Homo sapiens
ccaactggcttctgtg

SEQ ID NO: 763329 - DNA, 17 bp, Homo sapiens
ccaactgggcccaagac

SEQ ID NO: 763330 - DNA, 18 bp, Homo sapiens
ccaactgtgttcattaga

SEQ ID NO: 763331 - DNA, 20 bp, Homo sapiens
ccaactgtgttgtattaaca

SEQ ID NO: 763332 - DNA, 21 bp, Homo sapiens
ccaacttcatttgatgctaaa

SEQ ID NO: 763333 - DNA, 11 bp, Homo sapiens
ccaacttccca

SEQ ID NO: 763334 - DNA, 15 bp, Homo sapiens
ccaacttctcccacc

SEQ ID NO: 763335 - DNA, 22 bp, Homo sapiens
ccaacttctcccaccccttggc

SEQ ID NO: 763336 - DNA, 23 bp, Homo sapiens
ccaacttctcccaccccttggcc

SEQ ID NO: 763337 - DNA, 14 bp, Homo sapiens
ccaacttgaaggat

SEQ ID NO: 763338 - DNA, 13 bp, Homo sapiens
ccaacttgccaca

SEQ ID NO: 763339 - DNA, 16 bp, Homo sapiens
ccaacttgccacatgt

SEQ ID NO: 763340 - DNA, 22 bp, Homo sapiens
ccaacttggcagctttttctgt

SEQ ID NO: 763341 - DNA, 17 bp, Homo sapiens
ccaacttgtaaatacac

SEQ ID NO: 763342 - DNA, 13 bp, Homo sapiens
ccaactttctgta

SEQ ID NO: 763343 - DNA, 21 bp, Homo sapiens
ccaagaaaaataattaaaaaa

SEQ ID NO: 763344 - DNA, 13 bp, Homo sapiens
ccaagaaaatatc

SEQ ID NO: 763345 - DNA, 20 bp, Homo sapiens
ccaagaaaccaaagtctgcc

SEQ ID NO: 763346 - DNA, 21 bp, Homo sapiens
ccaagaaaccaaagtctgccg

SEQ ID NO: 763347 - DNA, 12 bp, Homo sapiens
ccaagaaactga

SEQ ID NO: 763348 - DNA, 15 bp, Homo sapiens
ccaagaaagatgtat

SEQ ID NO: 763349 - DNA, 19 bp, Homo sapiens
ccaagaaagcttcttcaga

SEQ ID NO: 763350 - DNA, 15 bp, Homo sapiens
ccaagaaatggaatc

SEQ ID NO: 763351 - DNA, 22 bp, Homo sapiens
ccaagaactgcagatagcccag

SEQ ID NO: 763352 - DNA, 14 bp, Homo sapiens
ccaagaactgcatg

SEQ ID NO: 763353 - DNA, 16 bp, Homo sapiens
ccaagaagcctgcagg

SEQ ID NO: 763354 - DNA, 17 bp, Homo sapiens
ccaagaagtttaaggaa

SEQ ID NO: 763355 - DNA, 18 bp, Homo sapiens
cttccccagactcagctc

SEQ ID NO: 763356 - DNA, 23 bp, Homo sapiens
cttccccagactcagctccagaa

SEQ ID NO: 763357 - DNA, 14 bp, Homo sapiens
cttccccagagagg

SEQ ID NO: 763358 - DNA, 23 bp, Homo sapiens
cttccccagagaggcactcagtg

SEQ ID NO: 763359 - DNA, 18 bp, Homo sapiens
cttccccagcccttagca

SEQ ID NO: 763360 - DNA, 19 bp, Homo sapiens
cttccccagcccttagcac

SEQ ID NO: 763361 - DNA, 14 bp, Homo sapiens
cttccccagcgtcc

SEQ ID NO: 763362 - DNA, 12 bp, Homo sapiens
cttccccaggcc

SEQ ID NO: 763363 - DNA, 16 bp, Homo sapiens
cttccccaggcccacc

SEQ ID NO: 763364 - DNA, 18 bp, Homo sapiens
cttccccaggcccaccat

SEQ ID NO: 763365 - DNA, 13 bp, Homo sapiens
cttccccatcagc

SEQ ID NO: 763366 - DNA, 18 bp, Homo sapiens
cttccccatcagctccca

SEQ ID NO: 763367 - DNA, 22 bp, Homo sapiens
cttccccatctttgatccttct

SEQ ID NO: 763368 - DNA, 13 bp, Homo sapiens
cttcccccaccac

SEQ ID NO: 763369 - DNA, 15 bp, Homo sapiens
cttcccccaccacca

SEQ ID NO: 763370 - DNA, 16 bp, Homo sapiens
cttcccccaccaccaa

SEQ ID NO: 763371 - DNA, 14 bp, Homo sapiens
cttcccccagccca

SEQ ID NO: 763372 - DNA, 14 bp, Homo sapiens
cttcccccatccct

SEQ ID NO: 763373 - DNA, 15 bp, Homo sapiens
cttcccccatcccta

SEQ ID NO: 763374 - DNA, 23 bp, Homo sapiens
cttcccccatccctaccactgtg

SEQ ID NO: 763375 - DNA, 20 bp, Homo sapiens
cttcccccctctcctcccag

SEQ ID NO: 763376 - DNA, 22 bp, Homo sapiens
cttcccccctctcctcccagct

SEQ ID NO: 763377 - DNA, 16 bp, Homo sapiens
cttccccctcccaggg

SEQ ID NO: 763378 - DNA, 21 bp, Homo sapiens
cttccccgtcccctgcagcct

SEQ ID NO: 763379 - DNA, 16 bp, Homo sapiens
cttcccctagacctcc

SEQ ID NO: 763380 - DNA, 12 bp, Homo sapiens
cttcccctcact

SEQ ID NO: 763381 - DNA, 21 bp, Homo sapiens
cttcccctcccccactcctct

SEQ ID NO: 763382 - DNA, 16 bp, Homo sapiens
ccaagagccgacaatg

SEQ ID NO: 763383 - DNA, 17 bp, Homo sapiens
ccaagaggactgagact

SEQ ID NO: 763384 - DNA, 12 bp, Homo sapiens
ccaagaggctga

SEQ ID NO: 763385 - DNA, 23 bp, Homo sapiens
ccaagaggctggttttggcatct

SEQ ID NO: 763386 - DNA, 19 bp, Homo sapiens
ccaagaggggcgggctcag

SEQ ID NO: 763387 - DNA, 23 bp, Homo sapiens
ccaagaggggcgggctcagagct

SEQ ID NO: 763388 - DNA, 14 bp, Homo sapiens
ccaagaggtctgag

SEQ ID NO: 763389 - DNA, 15 bp, Homo sapiens
ccaagagtaacttta

SEQ ID NO: 763390 - DNA, 17 bp, Homo sapiens
ccaagagtaactttact

SEQ ID NO: 763391 - DNA, 17 bp, Homo sapiens
ccaagataaatgagctg

SEQ ID NO: 763392 - DNA, 22 bp, Homo sapiens
ccaagataggagttctctgatg

SEQ ID NO: 763393 - DNA, 16 bp, Homo sapiens
ccaagatcgcgccact

SEQ ID NO: 763394 - DNA, 14 bp, Homo sapiens
ccaagattctactc

SEQ ID NO: 763395 - DNA, 22 bp, Homo sapiens
ccaagattctactcttgtcatt

SEQ ID NO: 763396 - DNA, 16 bp, Homo sapiens
ccaagattttcctctt

SEQ ID NO: 763397 - DNA, 16 bp, Homo sapiens
ccaagattttgaagga

SEQ ID NO: 763398 - DNA, 19 bp, Homo sapiens
ccaagcaaattaggaacct

SEQ ID NO: 763399 - DNA, 20 bp, Homo sapiens
ccaagcacagagcctggccc

SEQ ID NO: 763400 - DNA, 13 bp, Homo sapiens
ccaagcacagcag

SEQ ID NO: 763401 - DNA, 22 bp, Homo sapiens
ccaagcacctccaaccaaataa

SEQ ID NO: 763402 - DNA, 19 bp, Homo sapiens
ccaagcactttcagtccaa

SEQ ID NO: 763403 - DNA, 14 bp, Homo sapiens
ccaagcagactcca

SEQ ID NO: 763404 - DNA, 18 bp, Homo sapiens
ccaagcagactccagccc

SEQ ID NO: 763405 - DNA, 13 bp, Homo sapiens
ccaagcagccagc

SEQ ID NO: 763406 - DNA, 18 bp, Homo sapiens
ccaagcagccagccagtc

SEQ ID NO: 763407 - DNA, 18 bp, Homo sapiens
ccaagcaggaaatgaaaa

SEQ ID NO: 763408 - DNA, 20 bp, Homo sapiens
ccaagcagtgcctgcctatg

SEQ ID NO: 763409 - DNA, 13 bp, Homo sapiens
ccaagcatagaga

SEQ ID NO: 763410 - DNA, 18 bp, Homo sapiens
ccaagcatcaccctggga

SEQ ID NO: 763411 - DNA, 13 bp, Homo sapiens
ccaagcatttcat

SEQ ID NO: 763412 - DNA, 14 bp, Homo sapiens
ccaagcatttcatg

SEQ ID NO: 763413 - DNA, 22 bp, Homo sapiens
ccaagcatttcatgaaaaagct

SEQ ID NO: 763414 - DNA, 22 bp, Homo sapiens
ccaagccaagggaacctgtgtc

SEQ ID NO: 763415 - DNA, 19 bp, Homo sapiens
ccaagccagaggctgggtt

SEQ ID NO: 763416 - DNA, 19 bp, Homo sapiens
ccaagcccctgccctgggg

SEQ ID NO: 763417 - DNA, 20 bp, Homo sapiens
ccaagcccctgccctgggga

SEQ ID NO: 763418 - DNA, 22 bp, Homo sapiens
ccaagcccctgccctggggaga

SEQ ID NO: 763419 - DNA, 18 bp, Homo sapiens
ccaagcccgacttgctgt

SEQ ID NO: 763420 - DNA, 22 bp, Homo sapiens
ccaagcccgacttgctgttttg

SEQ ID NO: 763421 - DNA, 21 bp, Homo sapiens
ccaagcccttttacagctctt

SEQ ID NO: 763422 - DNA, 23 bp, Homo sapiens
ccaagccgtggcttcccgctcag

SEQ ID NO: 763423 - DNA, 15 bp, Homo sapiens
ccaagcctccacagc

SEQ ID NO: 763424 - DNA, 18 bp, Homo sapiens
ccaagcctccacagcgag

SEQ ID NO: 763425 - DNA, 11 bp, Homo sapiens
ccaagcctgct

SEQ ID NO: 763426 - DNA, 13 bp, Homo sapiens
ccaagcctgctgg

SEQ ID NO: 763427 - DNA, 14 bp, Homo sapiens
ccaagcctgctggc

SEQ ID NO: 763428 - DNA, 15 bp, Homo sapiens
ccaagcctgctggct

SEQ ID NO: 763429 - DNA, 17 bp, Homo sapiens
ccaagcctgctggctgc

SEQ ID NO: 763430 - DNA, 20 bp, Homo sapiens
ccaagcctgctgtgtccttc

SEQ ID NO: 763431 - DNA, 12 bp, Homo sapiens
ccaagcctggca

SEQ ID NO: 763432 - DNA, 18 bp, Homo sapiens
ccaagcctggcacccacc

SEQ ID NO: 763433 - DNA, 21 bp, Homo sapiens
ccaagcctggcacccaccgtc

SEQ ID NO: 763434 - DNA, 11 bp, Homo sapiens
ccaagcctggg

SEQ ID NO: 763435 - DNA, 12 bp, Homo sapiens
ccaagccttggc

SEQ ID NO: 763436 - DNA, 16 bp, Homo sapiens
ccaagcgaccaaggat

SEQ ID NO: 763437 - DNA, 13 bp, Homo sapiens
ccaagcggccctg

SEQ ID NO: 763438 - DNA, 22 bp, Homo sapiens
ccaagcgggggcgtggctggcc

SEQ ID NO: 763439 - DNA, 18 bp, Homo sapiens
ccaagcgttcctggcctt

SEQ ID NO: 763440 - DNA, 18 bp, Homo sapiens
ccaagctatctaaagttt

SEQ ID NO: 763441 - DNA, 20 bp, Homo sapiens
ccaagctattcctttccctt

SEQ ID NO: 763442 - DNA, 23 bp, Homo sapiens
ccaagctattcctttcccttcct

SEQ ID NO: 763443 - DNA, 13 bp, Homo sapiens
ccaagctcacagt

SEQ ID NO: 763444 - DNA, 22 bp, Homo sapiens
ccaagctccaaatccaaggaaa

SEQ ID NO: 763445 - DNA, 13 bp, Homo sapiens
ccaagctccaagc

SEQ ID NO: 763446 - DNA, 15 bp, Homo sapiens
ccaagctccaagccc

SEQ ID NO: 763447 - DNA, 11 bp, Homo sapiens
ccaagctccct

SEQ ID NO: 763448 - DNA, 16 bp, Homo sapiens
ccaagctccctggagc

SEQ ID NO: 763449 - DNA, 21 bp, Homo sapiens
ccaagctccctggagccctgt

SEQ ID NO: 763450 - DNA, 15 bp, Homo sapiens
ccaagctctctgcat

SEQ ID NO: 763451 - DNA, 16 bp, Homo sapiens
ccaagctgaagctaca

SEQ ID NO: 763452 - DNA, 17 bp, Homo sapiens
ccaagctgagtttccta

SEQ ID NO: 763453 - DNA, 12 bp, Homo sapiens
ccaagctgcaca

SEQ ID NO: 763454 - DNA, 23 bp, Homo sapiens
ccaagctgcctcccctctccttc

SEQ ID NO: 763455 - DNA, 16 bp, Homo sapiens
ccaagctgcctctggg

SEQ ID NO: 763456 - DNA, 17 bp, Homo sapiens
ccaagctgcctctgggc

SEQ ID NO: 763457 - DNA, 19 bp, Homo sapiens
ccaagctgcctctgggcca

SEQ ID NO: 763458 - DNA, 18 bp, Homo sapiens
ccaagctgtggcagccgt

SEQ ID NO: 763459 - DNA, 21 bp, Homo sapiens
ccaagctgtggcagccgtccc

SEQ ID NO: 763460 - DNA, 23 bp, Homo sapiens
ccaagctgtggcagccgtcccag

SEQ ID NO: 763461 - DNA, 14 bp, Homo sapiens
ccaagctgttttct

SEQ ID NO: 763462 - DNA, 18 bp, Homo sapiens
ccaagctgttttcttcta

SEQ ID NO: 763463 - DNA, 18 bp, Homo sapiens
ccaagcttaatagccctc

SEQ ID NO: 763464 - DNA, 11 bp, Homo sapiens
ccaagcttccc

SEQ ID NO: 763465 - DNA, 12 bp, Homo sapiens
ccaagcttccct

SEQ ID NO: 763466 - DNA, 20 bp, Homo sapiens
ccaagctttgaggctctgtc

SEQ ID NO: 763467 - DNA, 16 bp, Homo sapiens
ccaaggaaaattgaaa

SEQ ID NO: 763468 - DNA, 17 bp, Homo sapiens
ccaaggaaaattgaaag

SEQ ID NO: 763469 - DNA, 22 bp, Homo sapiens
ccaaggaaacgctacctctctg

SEQ ID NO: 763470 - DNA, 18 bp, Homo sapiens
ccaaggaagctccttcct

SEQ ID NO: 763471 - DNA, 19 bp, Homo sapiens
ccaaggaaggagcccctga

SEQ ID NO: 763472 - DNA, 15 bp, Homo sapiens
ccaaggacccctcac

SEQ ID NO: 763473 - DNA, 22 bp, Homo sapiens
ccaaggacccctcaccttgcaa

SEQ ID NO: 763474 - DNA, 14 bp, Homo sapiens
ccaaggactgaggg

SEQ ID NO: 763475 - DNA, 13 bp, Homo sapiens
ccaaggactgccg

SEQ ID NO: 763476 - DNA, 14 bp, Homo sapiens
ccaaggagaaacag

SEQ ID NO: 763477 - DNA, 20 bp, Homo sapiens
cttcctgtttcagacccccc

SEQ ID NO: 763478 - DNA, 18 bp, Homo sapiens
cttcctgtttttcacatt

SEQ ID NO: 763479 - DNA, 12 bp, Homo sapiens
cttccttcagga

SEQ ID NO: 763480 - DNA, 12 bp, Homo sapiens
cttccttcagtt

SEQ ID NO: 763481 - DNA, 14 bp, Homo sapiens
cttccttccctggc

SEQ ID NO: 763482 - DNA, 16 bp, Homo sapiens
cttccttccctgggct

SEQ ID NO: 763483 - DNA, 21 bp, Homo sapiens
cttccttccctgggctgtgct

SEQ ID NO: 763484 - DNA, 11 bp, Homo sapiens
cttccttctgg

SEQ ID NO: 763485 - DNA, 13 bp, Homo sapiens
cttccttctggga

SEQ ID NO: 763486 - DNA, 21 bp, Homo sapiens
cttccttgaagaactgcaggc

SEQ ID NO: 763487 - DNA, 13 bp, Homo sapiens
cttccttgactgt

SEQ ID NO: 763488 - DNA, 21 bp, Homo sapiens
cttccttgactgtctagccac

SEQ ID NO: 763489 - DNA, 23 bp, Homo sapiens
cttccttgagacacggagcccag

SEQ ID NO: 763490 - DNA, 12 bp, Homo sapiens
cttccttgcccc

SEQ ID NO: 763491 - DNA, 14 bp, Homo sapiens
cttccttgctctcc

SEQ ID NO: 763492 - DNA, 16 bp, Homo sapiens
cttccttgctctgcac

SEQ ID NO: 763493 - DNA, 19 bp, Homo sapiens
cttccttgctgtcctaggc

SEQ ID NO: 763494 - DNA, 21 bp, Homo sapiens
cttccttgggcgtctccccca

SEQ ID NO: 763495 - DNA, 15 bp, Homo sapiens
cttcctttaaaaaac

SEQ ID NO: 763496 - DNA, 14 bp, Homo sapiens
cttcctttccctgg

SEQ ID NO: 763497 - DNA, 16 bp, Homo sapiens
cttcctttccctggag

SEQ ID NO: 763498 - DNA, 11 bp, Homo sapiens
cttcctttcct

SEQ ID NO: 763499 - DNA, 17 bp, Homo sapiens
cttcctttcctctgcag

SEQ ID NO: 763500 - DNA, 22 bp, Homo sapiens
cttcctttctaatcctatctgg

SEQ ID NO: 763501 - DNA, 12 bp, Homo sapiens
cttcctttctcc

SEQ ID NO: 763502 - DNA, 15 bp, Homo sapiens
cttcctttctccagg

SEQ ID NO: 763503 - DNA, 12 bp, Homo sapiens
cttcctttctct

SEQ ID NO: 763504 - DNA, 21 bp, Homo sapiens
cttcctttctctttctctctt

SEQ ID NO: 763505 - DNA, 13 bp, Homo sapiens
cttccttttaact

SEQ ID NO: 763506 - DNA, 15 bp, Homo sapiens
cttccttttccctgc

SEQ ID NO: 763507 - DNA, 16 bp, Homo sapiens
cttccttttccctgct

SEQ ID NO: 763508 - DNA, 14 bp, Homo sapiens
cttcgaaaggcctt

SEQ ID NO: 763509 - DNA, 13 bp, Homo sapiens
cttcgaactccag

SEQ ID NO: 763510 - DNA, 13 bp, Homo sapiens
cttcgaagtattc

SEQ ID NO: 763511 - DNA, 16 bp, Homo sapiens
cttcgacatgctgcca

SEQ ID NO: 763512 - DNA, 23 bp, Homo sapiens
cttcgaccacagcaagccatcat

SEQ ID NO: 763513 - DNA, 23 bp, Homo sapiens
cttcgaggacaggaaaggcccca

SEQ ID NO: 763514 - DNA, 17 bp, Homo sapiens
cttcgcaaactgatgga

SEQ ID NO: 763515 - DNA, 19 bp, Homo sapiens
cttcgcaccttgctgtgtg

SEQ ID NO: 763516 - DNA, 20 bp, Homo sapiens
cttcgcaccttgctgtgtga

SEQ ID NO: 763517 - DNA, 18 bp, Homo sapiens
ccaatattgtacagtttt

SEQ ID NO: 763518 - DNA, 20 bp, Homo sapiens
ccaatcacgagatcttcctt

SEQ ID NO: 763519 - DNA, 22 bp, Homo sapiens
ccaatcacgagatcttccttcc

SEQ ID NO: 763520 - DNA, 13 bp, Homo sapiens
ccaatcagagagc

SEQ ID NO: 763521 - DNA, 16 bp, Homo sapiens
ccaatcagagagccta

SEQ ID NO: 763522 - DNA, 19 bp, Homo sapiens
ccaatcagcttttgttcta

SEQ ID NO: 763523 - DNA, 20 bp, Homo sapiens
ccaatcagcttttgttctag

SEQ ID NO: 763524 - DNA, 21 bp, Homo sapiens
ccaatccaggccaaagcccca

SEQ ID NO: 763525 - DNA, 21 bp, Homo sapiens
ccaatcccctccttgggcact

SEQ ID NO: 763526 - DNA, 17 bp, Homo sapiens
ccaatcccggtcatgct

SEQ ID NO: 763527 - DNA, 13 bp, Homo sapiens
ccaatccctctcc

SEQ ID NO: 763528 - DNA, 14 bp, Homo sapiens
ccaatccctgccac

SEQ ID NO: 763529 - DNA, 13 bp, Homo sapiens
ccaatcctatgtt

SEQ ID NO: 763530 - DNA, 14 bp, Homo sapiens
ccaatcggactgcc

SEQ ID NO: 763531 - DNA, 19 bp, Homo sapiens
ccaatcggactgccaaatt

SEQ ID NO: 763532 - DNA, 16 bp, Homo sapiens
ccaatcggctacccct

SEQ ID NO: 763533 - DNA, 18 bp, Homo sapiens
ccaatcggctacccctcg

SEQ ID NO: 763534 - DNA, 16 bp, Homo sapiens
ccaatcggtgtgtagt

SEQ ID NO: 763535 - DNA, 19 bp, Homo sapiens
ccaatctattgcttcacca

SEQ ID NO: 763536 - DNA, 19 bp, Homo sapiens
ccaatcttaccagatgcta

SEQ ID NO: 763537 - DNA, 22 bp, Homo sapiens
ccaatctttctatataaaatgt

SEQ ID NO: 763538 - DNA, 23 bp, Homo sapiens
ccaatgaaaaaatgtatatgcac

SEQ ID NO: 763539 - DNA, 18 bp, Homo sapiens
ccaatgaaaaaattaaaa

SEQ ID NO: 763540 - DNA, 17 bp, Homo sapiens
ccaatgacttccctgct

SEQ ID NO: 763541 - DNA, 21 bp, Homo sapiens
ccaatgatacccaacagttta

SEQ ID NO: 763542 - DNA, 18 bp, Homo sapiens
ccaatgcacctaaagaaa

SEQ ID NO: 763543 - DNA, 23 bp, Homo sapiens
ccaatgcatgcagccactgtgct

SEQ ID NO: 763544 - DNA, 15 bp, Homo sapiens
ccaatgcctttttag

SEQ ID NO: 763545 - DNA, 14 bp, Homo sapiens
ccaatggaaacctc

SEQ ID NO: 763546 - DNA, 15 bp, Homo sapiens
ccaatggaaacctca

SEQ ID NO: 763547 - DNA, 21 bp, Homo sapiens
ccaatggagactgtctcaaga

SEQ ID NO: 763548 - DNA, 22 bp, Homo sapiens
ccaatggctgagcctcgtgtcc

SEQ ID NO: 763549 - DNA, 14 bp, Homo sapiens
ccaatgggaagcag

SEQ ID NO: 763550 - DNA, 19 bp, Homo sapiens
ccaatggtgatcctctatt

SEQ ID NO: 763551 - DNA, 22 bp, Homo sapiens
ccaatggtgatcctctattttg

SEQ ID NO: 763552 - DNA, 12 bp, Homo sapiens
ccaatggtgctt

SEQ ID NO: 763553 - DNA, 21 bp, Homo sapiens
ccaatggtgcttcccccaccc

SEQ ID NO: 763554 - DNA, 17 bp, Homo sapiens
ccaatgtaggagctgcc

SEQ ID NO: 763555 - DNA, 20 bp, Homo sapiens
ccaatgtaggagctgccttg

SEQ ID NO: 763556 - DNA, 17 bp, Homo sapiens
ccaatgtatgtgtggct

SEQ ID NO: 763557 - DNA, 16 bp, Homo sapiens
ccaatgtctcccacac

SEQ ID NO: 763558 - DNA, 13 bp, Homo sapiens
ccaatgtcttttg

SEQ ID NO: 763559 - DNA, 15 bp, Homo sapiens
ccaatgtgttttctg

SEQ ID NO: 763560 - DNA, 12 bp, Homo sapiens
ccaatgttttat

SEQ ID NO: 763561 - DNA, 14 bp, Homo sapiens
ccaatgttttattg

SEQ ID NO: 763562 - DNA, 19 bp, Homo sapiens
ccaattacagggtgactca

SEQ ID NO: 763563 - DNA, 22 bp, Homo sapiens
ccaattacagggtgactcacag

SEQ ID NO: 763564 - DNA, 15 bp, Homo sapiens
ccaattagtttcctt

SEQ ID NO: 763565 - DNA, 18 bp, Homo sapiens
ccaattattgttacacat

SEQ ID NO: 763566 - DNA, 22 bp, Homo sapiens
ccaattcaaaaataaattagaa

SEQ ID NO: 763567 - DNA, 12 bp, Homo sapiens
ccaattctaaat

SEQ ID NO: 763568 - DNA, 22 bp, Homo sapiens
ccaattctgcctgcctcctccc

SEQ ID NO: 763569 - DNA, 16 bp, Homo sapiens
ccaattgactctcaca

SEQ ID NO: 763570 - DNA, 22 bp, Homo sapiens
ccaattgatgttttacgtgcaa

SEQ ID NO: 763571 - DNA, 13 bp, Homo sapiens
ccaattgcctctt

SEQ ID NO: 763572 - DNA, 21 bp, Homo sapiens
ccaattggtgcttcagccctg

SEQ ID NO: 763573 - DNA, 13 bp, Homo sapiens
ccaattgtgctgc

SEQ ID NO: 763574 - DNA, 15 bp, Homo sapiens
ccaattgtgctgcca

SEQ ID NO: 763575 - DNA, 16 bp, Homo sapiens
ccaattgtgctgccat

SEQ ID NO: 763576 - DNA, 10 bp, Homo sapiens
ccaatttaag

SEQ ID NO: 763577 - DNA, 19 bp, Homo sapiens
ccaatttcaagttccaagt

SEQ ID NO: 763578 - DNA, 17 bp, Homo sapiens
ccaatttcccggagcca

SEQ ID NO: 763579 - DNA, 22 bp, Homo sapiens
ccaatttcggattttttccaaa

SEQ ID NO: 763580 - DNA, 20 bp, Homo sapiens
ccaatttggtaaaaatgctg

SEQ ID NO: 763581 - DNA, 15 bp, Homo sapiens
ccaatttgtctccta

SEQ ID NO: 763582 - DNA, 22 bp, Homo sapiens
ccaatttgtctcctactctgtg

SEQ ID NO: 763583 - DNA, 22 bp, Homo sapiens
ccaattttaatttagtaaatgt

SEQ ID NO: 763584 - DNA, 13 bp, Homo sapiens
ccacaaaaacagg

SEQ ID NO: 763585 - DNA, 16 bp, Homo sapiens
ccacaaaagacagacc

SEQ ID NO: 763586 - DNA, 19 bp, Homo sapiens
ccacaaaagacagacccag

SEQ ID NO: 763587 - DNA, 22 bp, Homo sapiens
ccacaaaagacagacccagtga

SEQ ID NO: 763588 - DNA, 11 bp, Homo sapiens
ccacaaacaat

SEQ ID NO: 763589 - DNA, 16 bp, Homo sapiens
ccacaaaccctgctga

SEQ ID NO: 763590 - DNA, 23 bp, Homo sapiens
ccacaaaccctgctgaacacagt

SEQ ID NO: 763591 - DNA, 17 bp, Homo sapiens
ccacaaacggagcccct

SEQ ID NO: 763592 - DNA, 20 bp, Homo sapiens
ccacaaacggagcccctgaa

SEQ ID NO: 763593 - DNA, 22 bp, Homo sapiens
ccacaaacggagcccctgaaag

SEQ ID NO: 763594 - DNA, 23 bp, Homo sapiens
ccacaaacggagcccctgaaagc

SEQ ID NO: 763595 - DNA, 22 bp, Homo sapiens
ccacaaagcaaaggcagtcccg

SEQ ID NO: 763596 - DNA, 14 bp, Homo sapiens
ccacaaagccttat

SEQ ID NO: 763597 - DNA, 23 bp, Homo sapiens
ccacaaagccttatcaagtgtct

SEQ ID NO: 763598 - DNA, 13 bp, Homo sapiens
ccacaacacacag

SEQ ID NO: 763599 - DNA, 21 bp, Homo sapiens
ccacagcgagggcagctgcta

SEQ ID NO: 763600 - DNA, 13 bp, Homo sapiens
ccacagcgccagc

SEQ ID NO: 763601 - DNA, 11 bp, Homo sapiens
ccacagctacc

SEQ ID NO: 763602 - DNA, 16 bp, Homo sapiens
ccacagctcccacccc

SEQ ID NO: 763603 - DNA, 17 bp, Homo sapiens
ccacagctcccacccca

SEQ ID NO: 763604 - DNA, 12 bp, Homo sapiens
ccacagctctgg

SEQ ID NO: 763605 - DNA, 13 bp, Homo sapiens
ccacagctctggg

SEQ ID NO: 763606 - DNA, 16 bp, Homo sapiens
ccacagctgaagagca

SEQ ID NO: 763607 - DNA, 19 bp, Homo sapiens
ccacagctgaagagcaagg

SEQ ID NO: 763608 - DNA, 12 bp, Homo sapiens
ccacagctgcag

SEQ ID NO: 763609 - DNA, 13 bp, Homo sapiens
ccacagctgcagc

SEQ ID NO: 763610 - DNA, 15 bp, Homo sapiens
ccacagctgcagctg

SEQ ID NO: 763611 - DNA, 21 bp, Homo sapiens
ccacagctgcagctgatccat

SEQ ID NO: 763612 - DNA, 12 bp, Homo sapiens
ccacagctgctg

SEQ ID NO: 763613 - DNA, 17 bp, Homo sapiens
ccacagctgctggagaa

SEQ ID NO: 763614 - DNA, 15 bp, Homo sapiens
ccacagctgctgttc

SEQ ID NO: 763615 - DNA, 23 bp, Homo sapiens
ccacagctgctgttctcaggaca

SEQ ID NO: 763616 - DNA, 13 bp, Homo sapiens
ccacagctgggca

SEQ ID NO: 763617 - DNA, 17 bp, Homo sapiens
ccacagcttcctgaggg

SEQ ID NO: 763618 - DNA, 15 bp, Homo sapiens
ccacagcttttgcaa

SEQ ID NO: 763619 - DNA, 14 bp, Homo sapiens
ccacaggaaagtgt

SEQ ID NO: 763620 - DNA, 18 bp, Homo sapiens
ccacaggacacgaaggct

SEQ ID NO: 763621 - DNA, 20 bp, Homo sapiens
ccacaggacacgaaggctgc

SEQ ID NO: 763622 - DNA, 21 bp, Homo sapiens
ccacaggacatttctctaaga

SEQ ID NO: 763623 - DNA, 21 bp, Homo sapiens
ccacaggactgagccctctca

SEQ ID NO: 763624 - DNA, 19 bp, Homo sapiens
ccacaggagggccagcgct

SEQ ID NO: 763625 - DNA, 22 bp, Homo sapiens
ccacaggagttgtgagccctct

SEQ ID NO: 763626 - DNA, 14 bp, Homo sapiens
ccacaggcagtcca

SEQ ID NO: 763627 - DNA, 19 bp, Homo sapiens
ccacaggcagtccaggcct

SEQ ID NO: 763628 - DNA, 17 bp, Homo sapiens
ccacaggcccttcctct

SEQ ID NO: 763629 - DNA, 22 bp, Homo sapiens
ccacaggcccttcctctccact

SEQ ID NO: 763630 - DNA, 17 bp, Homo sapiens
ccacaggctagatcccc

SEQ ID NO: 763631 - DNA, 17 bp, Homo sapiens
ccacagggctaagagct

SEQ ID NO: 763632 - DNA, 22 bp, Homo sapiens
ccacagggttcaaaatgtctgt

SEQ ID NO: 763633 - DNA, 17 bp, Homo sapiens
ccacaggtcatcagatg

SEQ ID NO: 763634 - DNA, 21 bp, Homo sapiens
ccacaggtcatcagatgcctg

SEQ ID NO: 763635 - DNA, 17 bp, Homo sapiens
ccacaggtgaggggcag

SEQ ID NO: 763636 - DNA, 19 bp, Homo sapiens
ccacaggtgaggggcagga

SEQ ID NO: 763637 - DNA, 18 bp, Homo sapiens
ccacaggtgcgggaccat

SEQ ID NO: 763638 - DNA, 15 bp, Homo sapiens
ccacagtagtcttga

SEQ ID NO: 763639 - DNA, 18 bp, Homo sapiens
ccacagtcccccacccac

SEQ ID NO: 763640 - DNA, 18 bp, Homo sapiens
ccacagtgctgcttctct

SEQ ID NO: 763641 - DNA, 17 bp, Homo sapiens
ccacagtggggctgcag

SEQ ID NO: 763642 - DNA, 22 bp, Homo sapiens
ccacagtggggctgcaggcagg

SEQ ID NO: 763643 - DNA, 19 bp, Homo sapiens
ccacagtgtcactggtcag

SEQ ID NO: 763644 - DNA, 16 bp, Homo sapiens
ccacagttgccaccac

SEQ ID NO: 763645 - DNA, 22 bp, Homo sapiens
ccacagttgccaccacctctgt

SEQ ID NO: 763646 - DNA, 14 bp, Homo sapiens
cttctcccttcttg

SEQ ID NO: 763647 - DNA, 20 bp, Homo sapiens
cttctcctacttagggaaga

SEQ ID NO: 763648 - DNA, 18 bp, Homo sapiens
cttctcctccccacccgc

SEQ ID NO: 763649 - DNA, 18 bp, Homo sapiens
cttctcctcttgtaaata

SEQ ID NO: 763650 - DNA, 23 bp, Homo sapiens
cttctcctcttgtaaataaagcc

SEQ ID NO: 763651 - DNA, 20 bp, Homo sapiens
cttctcctttcacaaccttc

SEQ ID NO: 763652 - DNA, 16 bp, Homo sapiens
cttctcgcttttgcca

SEQ ID NO: 763653 - DNA, 23 bp, Homo sapiens
cttctcggcttggatcctgggct

SEQ ID NO: 763654 - DNA, 15 bp, Homo sapiens
cttctcgtgtttgct

SEQ ID NO: 763655 - DNA, 19 bp, Homo sapiens
cttctcgtgtttgcttaaa

SEQ ID NO: 763656 - DNA, 13 bp, Homo sapiens
cttctctacagac

SEQ ID NO: 763657 - DNA, 19 bp, Homo sapiens
cttctctacagaggtgaaa

SEQ ID NO: 763658 - DNA, 20 bp, Homo sapiens
cttctctacccatcttaaaa

SEQ ID NO: 763659 - DNA, 13 bp, Homo sapiens
cttctctataaaa

SEQ ID NO: 763660 - DNA, 17 bp, Homo sapiens
cttctctataaaaaata

SEQ ID NO: 763661 - DNA, 15 bp, Homo sapiens
cttctctatcctctc

SEQ ID NO: 763662 - DNA, 23 bp, Homo sapiens
cttctctatcctctctctctcta

SEQ ID NO: 763663 - DNA, 18 bp, Homo sapiens
cttctctccacagtgttg

SEQ ID NO: 763664 - DNA, 12 bp, Homo sapiens
cttctctccact

SEQ ID NO: 763665 - DNA, 14 bp, Homo sapiens
cttctctccagctg

SEQ ID NO: 763666 - DNA, 13 bp, Homo sapiens
cttctctcctcag

SEQ ID NO: 763667 - DNA, 12 bp, Homo sapiens
cttctctctcca

SEQ ID NO: 763668 - DNA, 13 bp, Homo sapiens
cttctctctccag

SEQ ID NO: 763669 - DNA, 23 bp, Homo sapiens
cttctctctccagaaacagctgc

SEQ ID NO: 763670 - DNA, 15 bp, Homo sapiens
cttctctctccaggg

SEQ ID NO: 763671 - DNA, 17 bp, Homo sapiens
cttctctctccctgtca

SEQ ID NO: 763672 - DNA, 19 bp, Homo sapiens
cttctctctgttcccttcc

SEQ ID NO: 763673 - DNA, 23 bp, Homo sapiens
cttctctctgttcccttcctcac

SEQ ID NO: 763674 - DNA, 20 bp, Homo sapiens
cttctctcttcaatctctgg

SEQ ID NO: 763675 - DNA, 17 bp, Homo sapiens
cttctctgacttctgcc

SEQ ID NO: 763676 - DNA, 22 bp, Homo sapiens
cttctctgcagtaaaacacatt

SEQ ID NO: 763677 - DNA, 13 bp, Homo sapiens
cttctctgcccac

SEQ ID NO: 763678 - DNA, 16 bp, Homo sapiens
cttctctgctccacca

SEQ ID NO: 763679 - DNA, 20 bp, Homo sapiens
cttctctgctccttattccc

SEQ ID NO: 763680 - DNA, 14 bp, Homo sapiens
cttctctgctgcct

SEQ ID NO: 763681 - DNA, 17 bp, Homo sapiens
cttctctgctgcctctg

SEQ ID NO: 763682 - DNA, 21 bp, Homo sapiens
cttctctgctgcctctgtgga

SEQ ID NO: 763683 - DNA, 16 bp, Homo sapiens
cttctctgggtcccgg

SEQ ID NO: 763684 - DNA, 14 bp, Homo sapiens
cttctctgtgtgca

SEQ ID NO: 763685 - DNA, 14 bp, Homo sapiens
cttctcttaattta

SEQ ID NO: 763686 - DNA, 15 bp, Homo sapiens
cttctcttaatttaa

SEQ ID NO: 763687 - DNA, 22 bp, Homo sapiens
cttctcttccttttatcagtag

SEQ ID NO: 763688 - DNA, 18 bp, Homo sapiens
cttctcttctttctgaag

SEQ ID NO: 763689 - DNA, 21 bp, Homo sapiens
cttctcttgaaaagttcaggg

SEQ ID NO: 763690 - DNA, 23 bp, Homo sapiens
cttctcttgacagtctgaagctc

SEQ ID NO: 763691 - DNA, 13 bp, Homo sapiens
cttctcttgcttt

SEQ ID NO: 763692 - DNA, 12 bp, Homo sapiens
cttctcttgtga

SEQ ID NO: 763693 - DNA, 12 bp, Homo sapiens
cttctctttgtg

SEQ ID NO: 763694 - DNA, 15 bp, Homo sapiens
cttctctttgtgcag

SEQ ID NO: 763695 - DNA, 18 bp, Homo sapiens
cttctcttttcctcgcag

SEQ ID NO: 763696 - DNA, 23 bp, Homo sapiens
cttctcttttcctcgcagatgat

SEQ ID NO: 763697 - DNA, 15 bp, Homo sapiens
cttctgaaatgaaac

SEQ ID NO: 763698 - DNA, 17 bp, Homo sapiens
cttctgaactcaaactg

SEQ ID NO: 763699 - DNA, 14 bp, Homo sapiens
cttctgaagatgga

SEQ ID NO: 763700 - DNA, 23 bp, Homo sapiens
cttctgaagtgtgtccatcctga

SEQ ID NO: 763701 - DNA, 15 bp, Homo sapiens
cttctgaatatttta

SEQ ID NO: 763702 - DNA, 16 bp, Homo sapiens
cttctgaatgctgcta

SEQ ID NO: 763703 - DNA, 14 bp, Homo sapiens
cttctgaccacact

SEQ ID NO: 763704 - DNA, 17 bp, Homo sapiens
cttctgaccacacttcc

SEQ ID NO: 763705 - DNA, 23 bp, Homo sapiens
cttctgaccccacttatgctgct

SEQ ID NO: 763706 - DNA, 15 bp, Homo sapiens
cttctgaccttgctg

SEQ ID NO: 763707 - DNA, 20 bp, Homo sapiens
cttctgacgtgccttttgca

SEQ ID NO: 763708 - DNA, 22 bp, Homo sapiens
cttctgacgtgccttttgcacc

SEQ ID NO: 763709 - DNA, 16 bp, Homo sapiens
cttctgactttacttg

SEQ ID NO: 763710 - DNA, 22 bp, Homo sapiens
cttctgagacatccctgattct

SEQ ID NO: 763711 - DNA, 22 bp, Homo sapiens
cttctgagcccggtaagagcaa

SEQ ID NO: 763712 - DNA, 12 bp, Homo sapiens
cttctgagctcc

SEQ ID NO: 763713 - DNA, 13 bp, Homo sapiens
cttctgagctcca

SEQ ID NO: 763714 - DNA, 17 bp, Homo sapiens
cttctgagctccacctc

SEQ ID NO: 763715 - DNA, 20 bp, Homo sapiens
cttctgagctccacctctgg

SEQ ID NO: 763716 - DNA, 23 bp, Homo sapiens
cttctgagctccacctctggtgg

SEQ ID NO: 763717 - DNA, 23 bp, Homo sapiens
cttctgaggaccgctgataagca

SEQ ID NO: 763718 - DNA, 23 bp, Homo sapiens
cttctgagtaattaataaagaaa

SEQ ID NO: 763719 - DNA, 16 bp, Homo sapiens
cttctgagtattctca

SEQ ID NO: 763720 - DNA, 14 bp, Homo sapiens
cttctgagtggtgt

SEQ ID NO: 763721 - DNA, 13 bp, Homo sapiens
cttcttgaatata

SEQ ID NO: 763722 - DNA, 20 bp, Homo sapiens
cttcttgctgccctgcccca

SEQ ID NO: 763723 - DNA, 23 bp, Homo sapiens
cttcttgctgccctgccccaagt

SEQ ID NO: 763724 - DNA, 13 bp, Homo sapiens
cttcttggcgctg

SEQ ID NO: 763725 - DNA, 19 bp, Homo sapiens
cttcttggcttctgggacc

SEQ ID NO: 763726 - DNA, 23 bp, Homo sapiens
cttcttgggagtatgttgtcata

SEQ ID NO: 763727 - DNA, 19 bp, Homo sapiens
cttcttgggccccagaccc

SEQ ID NO: 763728 - DNA, 11 bp, Homo sapiens
cttcttgggct

SEQ ID NO: 763729 - DNA, 13 bp, Homo sapiens
cttcttgggctga

SEQ ID NO: 763730 - DNA, 20 bp, Homo sapiens
cttcttgggctgagtgcagc

SEQ ID NO: 763731 - DNA, 17 bp, Homo sapiens
cttcttgggtctgccct

SEQ ID NO: 763732 - DNA, 20 bp, Homo sapiens
cttcttgggtctgccctgcc

SEQ ID NO: 763733 - DNA, 17 bp, Homo sapiens
cttcttggtttggggag

SEQ ID NO: 763734 - DNA, 18 bp, Homo sapiens
cttcttggtttggggaga

SEQ ID NO: 763735 - DNA, 20 bp, Homo sapiens
cttcttggtttggggagaaa

SEQ ID NO: 763736 - DNA, 22 bp, Homo sapiens
cttcttggttttctctctggat

SEQ ID NO: 763737 - DNA, 13 bp, Homo sapiens
cttcttgttcccc

SEQ ID NO: 763738 - DNA, 16 bp, Homo sapiens
cttcttgttctgagat

SEQ ID NO: 763739 - DNA, 17 bp, Homo sapiens
cttctttaattgatcta

SEQ ID NO: 763740 - DNA, 17 bp, Homo sapiens
cttctttactaacactg

SEQ ID NO: 763741 - DNA, 19 bp, Homo sapiens
cttctttactaacactggc

SEQ ID NO: 763742 - DNA, 21 bp, Homo sapiens
cttctttagaccctcgggccc

SEQ ID NO: 763743 - DNA, 21 bp, Homo sapiens
cttctttagcatttttatgca

SEQ ID NO: 763744 - DNA, 14 bp, Homo sapiens
cttctttatactgt

SEQ ID NO: 763745 - DNA, 20 bp, Homo sapiens
cttctttatactgtaattta

SEQ ID NO: 763746 - DNA, 14 bp, Homo sapiens
cttctttccagtat

SEQ ID NO: 763747 - DNA, 15 bp, Homo sapiens
cttctttccattctt

SEQ ID NO: 763748 - DNA, 21 bp, Homo sapiens
cttctttccattcttcttgct

SEQ ID NO: 763749 - DNA, 22 bp, Homo sapiens
cttctttccctggacaggcagc

SEQ ID NO: 763750 - DNA, 16 bp, Homo sapiens
cttctttctagagcag

SEQ ID NO: 763751 - DNA, 13 bp, Homo sapiens
cttctttctttta

SEQ ID NO: 763752 - DNA, 21 bp, Homo sapiens
cttctttgctgcattcctttt

SEQ ID NO: 763753 - DNA, 18 bp, Homo sapiens
cttcttttcctgcagggg

SEQ ID NO: 763754 - DNA, 14 bp, Homo sapiens
cttcttttccttta

SEQ ID NO: 763755 - DNA, 15 bp, Homo sapiens
cttcttttgaacatc

SEQ ID NO: 763756 - DNA, 16 bp, Homo sapiens
cttcttttgattatgt

SEQ ID NO: 763757 - DNA, 22 bp, Homo sapiens
cttcttttgtggtgtcttccat

SEQ ID NO: 763758 - DNA, 23 bp, Homo sapiens
cttctttttattttcttttgtaa

SEQ ID NO: 763759 - DNA, 15 bp, Homo sapiens
cttctttttctggac

SEQ ID NO: 763760 - DNA, 22 bp, Homo sapiens
cttctttttctggactctggac

SEQ ID NO: 763761 - DNA, 14 bp, Homo sapiens
cttcttttttaagt

SEQ ID NO: 763762 - DNA, 17 bp, Homo sapiens
cttcttttttaagttgt

SEQ ID NO: 763763 - DNA, 16 bp, Homo sapiens
cttgaaaaaaaacagt

SEQ ID NO: 763764 - DNA, 20 bp, Homo sapiens
cttgaaaaaaaacagtggat

SEQ ID NO: 763765 - DNA, 22 bp, Homo sapiens
cttgaaaactgtgcaacttttt

SEQ ID NO: 763766 - DNA, 17 bp, Homo sapiens
cttgaaaagttcaggga

SEQ ID NO: 763767 - DNA, 19 bp, Homo sapiens
cttgaaaagttcagggacc

SEQ ID NO: 763768 - DNA, 20 bp, Homo sapiens
cttgaaaagttcagggaccg

SEQ ID NO: 763769 - DNA, 16 bp, Homo sapiens
cttgaaaataagaata

SEQ ID NO: 763770 - DNA, 20 bp, Homo sapiens
cttgaaaatatatgatggct

SEQ ID NO: 763771 - DNA, 23 bp, Homo sapiens
cttgaaaatattttttatatata

SEQ ID NO: 763772 - DNA, 23 bp, Homo sapiens
cttgaaacagattcaggccagcc

SEQ ID NO: 763773 - DNA, 20 bp, Homo sapiens
cttgaaacctgttaaaacaa

SEQ ID NO: 763774 - DNA, 22 bp, Homo sapiens
cttgaaacgtttgccccatggg

SEQ ID NO: 763775 - DNA, 13 bp, Homo sapiens
cttgaaagatttt

SEQ ID NO: 763776 - DNA, 20 bp, Homo sapiens
ccacccagcccttccttggg

SEQ ID NO: 763777 - DNA, 11 bp, Homo sapiens
ccacccagctg

SEQ ID NO: 763778 - DNA, 12 bp, Homo sapiens
ccacccagctgg

SEQ ID NO: 763779 - DNA, 20 bp, Homo sapiens
ccacccagctggtcctgtgg

SEQ ID NO: 763780 - DNA, 22 bp, Homo sapiens
ccacccagctggtcctgtggat

SEQ ID NO: 763781 - DNA, 18 bp, Homo sapiens
ccacccaggagggagggg

SEQ ID NO: 763782 - DNA, 23 bp, Homo sapiens
ccacccaggagggagggggctat

SEQ ID NO: 763783 - DNA, 13 bp, Homo sapiens
ccacccaggctgc

SEQ ID NO: 763784 - DNA, 14 bp, Homo sapiens
ccacccaggctgca

SEQ ID NO: 763785 - DNA, 16 bp, Homo sapiens
ccacccaggctgcact

SEQ ID NO: 763786 - DNA, 17 bp, Homo sapiens
ccacccaggctgcactg

SEQ ID NO: 763787 - DNA, 18 bp, Homo sapiens
ccacccagggctccctcc

SEQ ID NO: 763788 - DNA, 12 bp, Homo sapiens
ccacccaggtcc

SEQ ID NO: 763789 - DNA, 12 bp, Homo sapiens
ccacccagtgct

SEQ ID NO: 763790 - DNA, 15 bp, Homo sapiens
ccacccagtgctgcc

SEQ ID NO: 763791 - DNA, 22 bp, Homo sapiens
ccacccagtgctgccatgccac

SEQ ID NO: 763792 - DNA, 16 bp, Homo sapiens
ccacccagttacaggg

SEQ ID NO: 763793 - DNA, 21 bp, Homo sapiens
ccacccatcgtccaccccagt

SEQ ID NO: 763794 - DNA, 20 bp, Homo sapiens
ccacccatcttcctgctgct

SEQ ID NO: 763795 - DNA, 14 bp, Homo sapiens
ccacccatggggag

SEQ ID NO: 763796 - DNA, 15 bp, Homo sapiens
ccacccatggggagg

SEQ ID NO: 763797 - DNA, 17 bp, Homo sapiens
ccacccatggggaggag

SEQ ID NO: 763798 - DNA, 14 bp, Homo sapiens
ccacccatgtcacc

SEQ ID NO: 763799 - DNA, 16 bp, Homo sapiens
ccacccattcttcccg

SEQ ID NO: 763800 - DNA, 12 bp, Homo sapiens
ccaccccaacat

SEQ ID NO: 763801 - DNA, 11 bp, Homo sapiens
ccaccccaccc

SEQ ID NO: 763802 - DNA, 15 bp, Homo sapiens
ccaccccacctcttg

SEQ ID NO: 763803 - DNA, 21 bp, Homo sapiens
ccaccccagaaatcactgtga

SEQ ID NO: 763804 - DNA, 13 bp, Homo sapiens
ccaccccagcaca

SEQ ID NO: 763805 - DNA, 14 bp, Homo sapiens
ccaccccagcacag

SEQ ID NO: 763806 - DNA, 15 bp, Homo sapiens
ccaccccagcacagc

SEQ ID NO: 763807 - DNA, 22 bp, Homo sapiens
ccaccccagcacagccacctcc

SEQ ID NO: 763808 - DNA, 12 bp, Homo sapiens
ccaccccaggac

SEQ ID NO: 763809 - DNA, 17 bp, Homo sapiens
ccaccccatgagctcgg

SEQ ID NO: 763810 - DNA, 15 bp, Homo sapiens
ccaccccattaaaaa

SEQ ID NO: 763811 - DNA, 18 bp, Homo sapiens
ccacccccaacccccaga

SEQ ID NO: 763812 - DNA, 13 bp, Homo sapiens
ccacccccaaggt

SEQ ID NO: 763813 - DNA, 13 bp, Homo sapiens
ccacccccagccc

SEQ ID NO: 763814 - DNA, 15 bp, Homo sapiens
ccacccccaggcctc

SEQ ID NO: 763815 - DNA, 20 bp, Homo sapiens
ccacccccaggcctcctagg

SEQ ID NO: 763816 - DNA, 21 bp, Homo sapiens
ccacccccaggtcttcctgct

SEQ ID NO: 763817 - DNA, 19 bp, Homo sapiens
ccacccccagtctccaggg

SEQ ID NO: 763818 - DNA, 12 bp, Homo sapiens
ccacccccatct

SEQ ID NO: 763819 - DNA, 13 bp, Homo sapiens
ccacccccatctt

SEQ ID NO: 763820 - DNA, 22 bp, Homo sapiens
ccacccccatgtggcagcccat

SEQ ID NO: 763821 - DNA, 22 bp, Homo sapiens
ccaccccccactcagtgcctcc

SEQ ID NO: 763822 - DNA, 14 bp, Homo sapiens
ccaccccccagcct

SEQ ID NO: 763823 - DNA, 13 bp, Homo sapiens
ccacccccctcat

SEQ ID NO: 763824 - DNA, 16 bp, Homo sapiens
ccacccccctcctccc

SEQ ID NO: 763825 - DNA, 18 bp, Homo sapiens
ccacccccgccacggcca

SEQ ID NO: 763826 - DNA, 19 bp, Homo sapiens
ccaccccctccccagggga

SEQ ID NO: 763827 - DNA, 14 bp, Homo sapiens
ccaccccctgccct

SEQ ID NO: 763828 - DNA, 15 bp, Homo sapiens
ccaccccctgccctg

SEQ ID NO: 763829 - DNA, 16 bp, Homo sapiens
ccaccccctgggcaga

SEQ ID NO: 763830 - DNA, 24 bp, Homo sapiens
ccaccccctgtcccattctagatc

SEQ ID NO: 763831 - DNA, 12 bp, Homo sapiens
ccaccccctgtt

SEQ ID NO: 763832 - DNA, 14 bp, Homo sapiens
ccaccccctgttcc

SEQ ID NO: 763833 - DNA, 17 bp, Homo sapiens
ccaccccctgttccctg

SEQ ID NO: 763834 - DNA, 18 bp, Homo sapiens
ccaccccctgttccctgt

SEQ ID NO: 763835 - DNA, 18 bp, Homo sapiens
ccacccccttcagtgccc

SEQ ID NO: 763836 - DNA, 20 bp, Homo sapiens
ccacccccttcagtgcccac

SEQ ID NO: 763837 - DNA, 19 bp, Homo sapiens
ccaccccgaaatcagcccc

SEQ ID NO: 763838 - DNA, 15 bp, Homo sapiens
ccaccccggcctcca

SEQ ID NO: 763839 - DNA, 14 bp, Homo sapiens
ccaccccgggctct

SEQ ID NO: 763840 - DNA, 18 bp, Homo sapiens
ccaccccgggctctctgc

SEQ ID NO: 763841 - DNA, 17 bp, Homo sapiens
ccaccccgtgccacccg

SEQ ID NO: 763842 - DNA, 14 bp, Homo sapiens
ccacccctccacgt

SEQ ID NO: 763843 - DNA, 13 bp, Homo sapiens
ccacctccgccag

SEQ ID NO: 763844 - DNA, 16 bp, Homo sapiens
ccacctccgccagacc

SEQ ID NO: 763845 - DNA, 24 bp, Homo sapiens
ccacctcctaccccttcctgtcct

SEQ ID NO: 763846 - DNA, 19 bp, Homo sapiens
ccacctcctccccctgttc

SEQ ID NO: 763847 - DNA, 20 bp, Homo sapiens
ccacctcctccccctgttct

SEQ ID NO: 763848 - DNA, 22 bp, Homo sapiens
ccacctcctccccctgttctgt

SEQ ID NO: 763849 - DNA, 11 bp, Homo sapiens
ccacctcctgc

SEQ ID NO: 763850 - DNA, 18 bp, Homo sapiens
ccacctcctgcggctcag

SEQ ID NO: 763851 - DNA, 16 bp, Homo sapiens
ccacctccttccagca

SEQ ID NO: 763852 - DNA, 21 bp, Homo sapiens
ccacctcgctcccctctggaa

SEQ ID NO: 763853 - DNA, 22 bp, Homo sapiens
ccacctcgctcccctctggaat

SEQ ID NO: 763854 - DNA, 15 bp, Homo sapiens
ccacctcggcacaca

SEQ ID NO: 763855 - DNA, 20 bp, Homo sapiens
ccacctcggcctcccagagt

SEQ ID NO: 763856 - DNA, 19 bp, Homo sapiens
ccacctcggtcactccaac

SEQ ID NO: 763857 - DNA, 22 bp, Homo sapiens
ccacctctcacgggccctgccc

SEQ ID NO: 763858 - DNA, 14 bp, Homo sapiens
ccacctctccaagg

SEQ ID NO: 763859 - DNA, 15 bp, Homo sapiens
ccacctctccaaggg

SEQ ID NO: 763860 - DNA, 16 bp, Homo sapiens
ccacctctccaagggc

SEQ ID NO: 763861 - DNA, 16 bp, Homo sapiens
ccacctctccaagtct

SEQ ID NO: 763862 - DNA, 23 bp, Homo sapiens
ccacctctccaagtctctctgtg

SEQ ID NO: 763863 - DNA, 12 bp, Homo sapiens
ccacctctccct

SEQ ID NO: 763864 - DNA, 17 bp, Homo sapiens
ccacctctccctgaccc

SEQ ID NO: 763865 - DNA, 17 bp, Homo sapiens
ccacctctctcctttgc

SEQ ID NO: 763866 - DNA, 24 bp, Homo sapiens
ccacctctctcctttgctgaggcc

SEQ ID NO: 763867 - DNA, 13 bp, Homo sapiens
ccacctctctttt

SEQ ID NO: 763868 - DNA, 21 bp, Homo sapiens
ccacctctcttttcctctctg

SEQ ID NO: 763869 - DNA, 22 bp, Homo sapiens
ccacctctcttttcctctctgt

SEQ ID NO: 763870 - DNA, 11 bp, Homo sapiens
ccacctctggt

SEQ ID NO: 763871 - DNA, 21 bp, Homo sapiens
ccacctctggtggctcctcct

SEQ ID NO: 763872 - DNA, 21 bp, Homo sapiens
ccacctctgtggcattgaaat

SEQ ID NO: 763873 - DNA, 13 bp, Homo sapiens
ccacctctgtggg

SEQ ID NO: 763874 - DNA, 23 bp, Homo sapiens
ccacctctgtgggcactggtggg

SEQ ID NO: 763875 - DNA, 20 bp, Homo sapiens
ccacctcttctcttcctgta

SEQ ID NO: 763876 - DNA, 23 bp, Homo sapiens
ccacctcttctcttcctgtaaca

SEQ ID NO: 763877 - DNA, 16 bp, Homo sapiens
ccacctgaaagcctgt

SEQ ID NO: 763878 - DNA, 18 bp, Homo sapiens
ccacctgacaatggcagc

SEQ ID NO: 763879 - DNA, 16 bp, Homo sapiens
ccacctgacacaccag

SEQ ID NO: 763880 - DNA, 18 bp, Homo sapiens
ccacctgacggctgggga

SEQ ID NO: 763881 - DNA, 14 bp, Homo sapiens
ccacctgaggtggg

SEQ ID NO: 763882 - DNA, 16 bp, Homo sapiens
ccacctgaggtgggcc

SEQ ID NO: 763883 - DNA, 22 bp, Homo sapiens
ccacctgaggtgggcccaggac

SEQ ID NO: 763884 - DNA, 11 bp, Homo sapiens
ccacctgcaag

SEQ ID NO: 763885 - DNA, 17 bp, Homo sapiens
ccacctgcaagatggac

SEQ ID NO: 763886 - DNA, 12 bp, Homo sapiens
ccacctgcagga

SEQ ID NO: 763887 - DNA, 9 bp, Homo sapiens
ccacctgcc

SEQ ID NO: 763888 - DNA, 12 bp, Homo sapiens
ccacctgccaca

SEQ ID NO: 763889 - DNA, 20 bp, Homo sapiens
ccacctgccacccccaggtc

SEQ ID NO: 763890 - DNA, 15 bp, Homo sapiens
ccacctgcccatcac

SEQ ID NO: 763891 - DNA, 21 bp, Homo sapiens
ccacctgcccccttctcccac

SEQ ID NO: 763892 - DNA, 23 bp, Homo sapiens
ccacctgcctgcgtcttccgccc

SEQ ID NO: 763893 - DNA, 20 bp, Homo sapiens
ccacctgccttggcctccca

SEQ ID NO: 763894 - DNA, 20 bp, Homo sapiens
ccacctggacacacactcac

SEQ ID NO: 763895 - DNA, 16 bp, Homo sapiens
ccacctggagcccgct

SEQ ID NO: 763896 - DNA, 20 bp, Homo sapiens
ccacctggcagggctcacac

SEQ ID NO: 763897 - DNA, 15 bp, Homo sapiens
ccacctggccacctg

SEQ ID NO: 763898 - DNA, 11 bp, Homo sapiens
ccacctggctc

SEQ ID NO: 763899 - DNA, 15 bp, Homo sapiens
ccacctgggaacaca

SEQ ID NO: 763900 - DNA, 17 bp, Homo sapiens
ccacctgggctgggcgc

SEQ ID NO: 763901 - DNA, 20 bp, Homo sapiens
ccacctggggtctctctccc

SEQ ID NO: 763902 - DNA, 21 bp, Homo sapiens
ccacctggggtctctctccct

SEQ ID NO: 763903 - DNA, 22 bp, Homo sapiens
ccacctggggtctctctcccta

SEQ ID NO: 763904 - DNA, 18 bp, Homo sapiens
ccacctgtagctgaagca

SEQ ID NO: 763905 - DNA, 17 bp, Homo sapiens
ccacctgtccggcccag

SEQ ID NO: 763906 - DNA, 20 bp, Homo sapiens
ccacctgtccggcccagtgc

SEQ ID NO: 763907 - DNA, 18 bp, Homo sapiens
cttgatacccccctctgt

SEQ ID NO: 763908 - DNA, 21 bp, Homo sapiens
cttgatacccccctctgtctt

SEQ ID NO: 763909 - DNA, 15 bp, Homo sapiens
cttgatatcattcag

SEQ ID NO: 763910 - DNA, 18 bp, Homo sapiens
cttgatcagttaagaaat

SEQ ID NO: 763911 - DNA, 22 bp, Homo sapiens
cttgatcagttaagaaatttca

SEQ ID NO: 763912 - DNA, 14 bp, Homo sapiens
cttgatccagaaga

SEQ ID NO: 763913 - DNA, 16 bp, Homo sapiens
cttgatccagaagagc

SEQ ID NO: 763914 - DNA, 20 bp, Homo sapiens
cttgatctgtgatttcttct

SEQ ID NO: 763915 - DNA, 13 bp, Homo sapiens
cttgatcttaaag

SEQ ID NO: 763916 - DNA, 15 bp, Homo sapiens
cttgatcttaaagat

SEQ ID NO: 763917 - DNA, 13 bp, Homo sapiens
cttgatctttgag

SEQ ID NO: 763918 - DNA, 18 bp, Homo sapiens
cttgatctttgagcccat

SEQ ID NO: 763919 - DNA, 13 bp, Homo sapiens
cttgatgaagcaa

SEQ ID NO: 763920 - DNA, 18 bp, Homo sapiens
cttgatgaccaaagtcct

SEQ ID NO: 763921 - DNA, 14 bp, Homo sapiens
cttgatgactgctg

SEQ ID NO: 763922 - DNA, 15 bp, Homo sapiens
cttgatgactgctga

SEQ ID NO: 763923 - DNA, 17 bp, Homo sapiens
cttgatgactgctgatt

SEQ ID NO: 763924 - DNA, 21 bp, Homo sapiens
cttgatgatgtggaaatgctg

SEQ ID NO: 763925 - DNA, 15 bp, Homo sapiens
cttgatgcacagaga

SEQ ID NO: 763926 - DNA, 14 bp, Homo sapiens
cttgatgccagagg

SEQ ID NO: 763927 - DNA, 20 bp, Homo sapiens
cttgatgccagagggccagc

SEQ ID NO: 763928 - DNA, 22 bp, Homo sapiens
cttgatgccagagggccagcag

SEQ ID NO: 763929 - DNA, 12 bp, Homo sapiens
cttgatgtgaaa

SEQ ID NO: 763930 - DNA, 17 bp, Homo sapiens
cttgatgtgaagataat

SEQ ID NO: 763931 - DNA, 22 bp, Homo sapiens
cttgatgtgaagataatttgca

SEQ ID NO: 763932 - DNA, 15 bp, Homo sapiens
cttgatgtttagaaa

SEQ ID NO: 763933 - DNA, 21 bp, Homo sapiens
cttgatgtttagaaaagtatt

SEQ ID NO: 763934 - DNA, 13 bp, Homo sapiens
cttgattaaatca

SEQ ID NO: 763935 - DNA, 14 bp, Homo sapiens
cttgattaaatcaa

SEQ ID NO: 763936 - DNA, 17 bp, Homo sapiens
cttgattataaatgttt

SEQ ID NO: 763937 - DNA, 21 bp, Homo sapiens
cttgattcaggaggtcatctg

SEQ ID NO: 763938 - DNA, 20 bp, Homo sapiens
cttgattcatctctggtttt

SEQ ID NO: 763939 - DNA, 14 bp, Homo sapiens
cttgattcctggct

SEQ ID NO: 763940 - DNA, 15 bp, Homo sapiens
cttgattcctggctc

SEQ ID NO: 763941 - DNA, 23 bp, Homo sapiens
cttgattcctggctctaccctgt

SEQ ID NO: 763942 - DNA, 15 bp, Homo sapiens
cttgattgagaaaga

SEQ ID NO: 763943 - DNA, 18 bp, Homo sapiens
cttgatttatttgcttct

SEQ ID NO: 763944 - DNA, 17 bp, Homo sapiens
cttgatttgatctttgt

SEQ ID NO: 763945 - DNA, 19 bp, Homo sapiens
cttgatttgatgtgacttt

SEQ ID NO: 763946 - DNA, 20 bp, Homo sapiens
cttgatttgatgtgactttt

SEQ ID NO: 763947 - DNA, 21 bp, Homo sapiens
cttgatttgggtggaaaacag

SEQ ID NO: 763948 - DNA, 18 bp, Homo sapiens
cttgcaaagcgacagatt

SEQ ID NO: 763949 - DNA, 16 bp, Homo sapiens
cttgcaaatgggagct

SEQ ID NO: 763950 - DNA, 16 bp, Homo sapiens
cttgcaactaaggaca

SEQ ID NO: 763951 - DNA, 14 bp, Homo sapiens
cttgcaagccataa

SEQ ID NO: 763952 - DNA, 21 bp, Homo sapiens
cttgcaataaagttattcaga

SEQ ID NO: 763953 - DNA, 19 bp, Homo sapiens
cttgcaatataacattcta

SEQ ID NO: 763954 - DNA, 17 bp, Homo sapiens
cttgcacacccactgcc

SEQ ID NO: 763955 - DNA, 19 bp, Homo sapiens
cttgcacagtcactgctct

SEQ ID NO: 763956 - DNA, 22 bp, Homo sapiens
cttgcaccccaaagctttcctg

SEQ ID NO: 763957 - DNA, 18 bp, Homo sapiens
cttgcacccctcactctg

SEQ ID NO: 763958 - DNA, 18 bp, Homo sapiens
cttgcacccgcctctccc

SEQ ID NO: 763959 - DNA, 12 bp, Homo sapiens
cttgcacctgca

SEQ ID NO: 763960 - DNA, 14 bp, Homo sapiens
cttgcacctgcatc

SEQ ID NO: 763961 - DNA, 19 bp, Homo sapiens
cttgcacgaccgccccagt

SEQ ID NO: 763962 - DNA, 21 bp, Homo sapiens
cttgcactaaagtatgtaaag

SEQ ID NO: 763963 - DNA, 16 bp, Homo sapiens
cttgcactcctcacac

SEQ ID NO: 763964 - DNA, 13 bp, Homo sapiens
cttgcactccttc

SEQ ID NO: 763965 - DNA, 19 bp, Homo sapiens
cttgcgcctcagccctcag

SEQ ID NO: 763966 - DNA, 15 bp, Homo sapiens
cttgcgtcctgcaga

SEQ ID NO: 763967 - DNA, 16 bp, Homo sapiens
cttgcgtcctgcagag

SEQ ID NO: 763968 - DNA, 13 bp, Homo sapiens
cttgcgtggacag

SEQ ID NO: 763969 - DNA, 16 bp, Homo sapiens
cttgcgtggacagtca

SEQ ID NO: 763970 - DNA, 17 bp, Homo sapiens
cttgctaaagcactttg

SEQ ID NO: 763971 - DNA, 17 bp, Homo sapiens
cttgctacacccctttt

SEQ ID NO: 763972 - DNA, 22 bp, Homo sapiens
cttgctacaccccttttccagt

SEQ ID NO: 763973 - DNA, 20 bp, Homo sapiens
cttgctaccagtatttagaa

SEQ ID NO: 763974 - DNA, 23 bp, Homo sapiens
cttgctacttatcatttttgtat

SEQ ID NO: 763975 - DNA, 20 bp, Homo sapiens
cttgctagctagccagccaa

SEQ ID NO: 763976 - DNA, 19 bp, Homo sapiens
cttgctatattgcccaggc

SEQ ID NO: 763977 - DNA, 20 bp, Homo sapiens
cttgctatgttgcccaagct

SEQ ID NO: 763978 - DNA, 21 bp, Homo sapiens
cttgctcagtgcctcctggcc

SEQ ID NO: 763979 - DNA, 13 bp, Homo sapiens
cttgctccagggt

SEQ ID NO: 763980 - DNA, 16 bp, Homo sapiens
cttgctcccaacccat

SEQ ID NO: 763981 - DNA, 20 bp, Homo sapiens
cttgctccctgtgtccacct

SEQ ID NO: 763982 - DNA, 18 bp, Homo sapiens
cttgctcctgccaaccac

SEQ ID NO: 763983 - DNA, 14 bp, Homo sapiens
cttgctcctgggga

SEQ ID NO: 763984 - DNA, 19 bp, Homo sapiens
cttgctctcccctgccctg

SEQ ID NO: 763985 - DNA, 20 bp, Homo sapiens
cttgctctctctccctgcct

SEQ ID NO: 763986 - DNA, 15 bp, Homo sapiens
cttgctctctggcct

SEQ ID NO: 763987 - DNA, 22 bp, Homo sapiens
cttgctctctggccttttccta

SEQ ID NO: 763988 - DNA, 12 bp, Homo sapiens
cttgctctgagc

SEQ ID NO: 763989 - DNA, 13 bp, Homo sapiens
cttgctctgcacc

SEQ ID NO: 763990 - DNA, 14 bp, Homo sapiens
cttgctctgcaccc

SEQ ID NO: 763991 - DNA, 12 bp, Homo sapiens
cttgctctgtcc

SEQ ID NO: 763992 - DNA, 14 bp, Homo sapiens
cttgctctgtcccc

SEQ ID NO: 763993 - DNA, 18 bp, Homo sapiens
cttgctctgtcccccagg

SEQ ID NO: 763994 - DNA, 12 bp, Homo sapiens
cttgctctgtct

SEQ ID NO: 763995 - DNA, 22 bp, Homo sapiens
cttgctctgtctcccaggctgg

SEQ ID NO: 763996 - DNA, 19 bp, Homo sapiens
cttgctctgttacccaggc

SEQ ID NO: 763997 - DNA, 22 bp, Homo sapiens
cttgctctgttacccaggctgg

SEQ ID NO: 763998 - DNA, 16 bp, Homo sapiens
cttgctcttctttctg

SEQ ID NO: 763999 - DNA, 19 bp, Homo sapiens
cttgctctttctactctga

SEQ ID NO: 764000 - DNA, 22 bp, Homo sapiens
cttgctctttctactctgaact

SEQ ID NO: 764001 - DNA, 17 bp, Homo sapiens
cttgctgaccccaggtc

SEQ ID NO: 764002 - DNA, 20 bp, Homo sapiens
cttgctgaccccaggtcagc

SEQ ID NO: 764003 - DNA, 21 bp, Homo sapiens
cttgctgaccccaggtcagcc

SEQ ID NO: 764004 - DNA, 22 bp, Homo sapiens
cttgctgatggctgctagattt

SEQ ID NO: 764005 - DNA, 15 bp, Homo sapiens
cttgctgatggcttg

SEQ ID NO: 764006 - DNA, 21 bp, Homo sapiens
cttgctgcaagcacagccctt

SEQ ID NO: 764007 - DNA, 16 bp, Homo sapiens
cttgctgcactcttgc

SEQ ID NO: 764008 - DNA, 21 bp, Homo sapiens
cttgctgcactcttgcacatg

SEQ ID NO: 764009 - DNA, 12 bp, Homo sapiens
cttgctgcaggc

SEQ ID NO: 764010 - DNA, 21 bp, Homo sapiens
cttgctgcaggccctccctct

SEQ ID NO: 764011 - DNA, 17 bp, Homo sapiens
cttgctgccatgatgta

SEQ ID NO: 764012 - DNA, 16 bp, Homo sapiens
cttgctgccctgcccc

SEQ ID NO: 764013 - DNA, 21 bp, Homo sapiens
cttgctggacggggactgggg

SEQ ID NO: 764014 - DNA, 20 bp, Homo sapiens
cttgctggccccagccctgc

SEQ ID NO: 764015 - DNA, 13 bp, Homo sapiens
cttgctgggccag

SEQ ID NO: 764016 - DNA, 15 bp, Homo sapiens
cttgctggggtccag

SEQ ID NO: 764017 - DNA, 16 bp, Homo sapiens
cttgctggtctagtca

SEQ ID NO: 764018 - DNA, 18 bp, Homo sapiens
cttgctgtaactcagaca

SEQ ID NO: 764019 - DNA, 19 bp, Homo sapiens
cttgctgtaactcagacat

SEQ ID NO: 764020 - DNA, 12 bp, Homo sapiens
cttgctgtcact

SEQ ID NO: 764021 - DNA, 17 bp, Homo sapiens
cttgctgtccaggcagc

SEQ ID NO: 764022 - DNA, 20 bp, Homo sapiens
cttgctgtccaggcagctcc

SEQ ID NO: 764023 - DNA, 16 bp, Homo sapiens
cttgctgtcctaggcc

SEQ ID NO: 764024 - DNA, 12 bp, Homo sapiens
cttgctgtctct

SEQ ID NO: 764025 - DNA, 21 bp, Homo sapiens
cttgctgtctctgctcgccct

SEQ ID NO: 764026 - DNA, 19 bp, Homo sapiens
cttgctgtgtgaccctggg

SEQ ID NO: 764027 - DNA, 21 bp, Homo sapiens
cttgctgtgtgacctgaggcc

SEQ ID NO: 764028 - DNA, 15 bp, Homo sapiens
cttgctgttcttgaa

SEQ ID NO: 764029 - DNA, 21 bp, Homo sapiens
cttgctgttgacatatttaat

SEQ ID NO: 764030 - DNA, 23 bp, Homo sapiens
cttgctgttgacatatttaatgt

SEQ ID NO: 764031 - DNA, 16 bp, Homo sapiens
cttgctgttggtcatg

SEQ ID NO: 764032 - DNA, 20 bp, Homo sapiens
cttgctgttggtcatgtggg

SEQ ID NO: 764033 - DNA, 19 bp, Homo sapiens
cttgctgtttgtcctgaga

SEQ ID NO: 764034 - DNA, 13 bp, Homo sapiens
cttgcttaaattt

SEQ ID NO: 764035 - DNA, 23 bp, Homo sapiens
cttgcttaaatttcttatgtgac

SEQ ID NO: 764036 - DNA, 18 bp, Homo sapiens
cttgcttagagtgcccag

SEQ ID NO: 764037 - DNA, 17 bp, Homo sapiens
ccactagtgcaaatcat

SEQ ID NO: 764038 - DNA, 14 bp, Homo sapiens
ccactatctgggtg

SEQ ID NO: 764039 - DNA, 19 bp, Homo sapiens
ccactcaaaatatgtcaac

SEQ ID NO: 764040 - DNA, 20 bp, Homo sapiens
ccactcaaattaatctttct

SEQ ID NO: 764041 - DNA, 20 bp, Homo sapiens
ccactcaccacaagctgagc

SEQ ID NO: 764042 - DNA, 18 bp, Homo sapiens
ccactcaccccctttgct

SEQ ID NO: 764043 - DNA, 18 bp, Homo sapiens
ccactcactaggccccca

SEQ ID NO: 764044 - DNA, 15 bp, Homo sapiens
ccactcactccagcc

SEQ ID NO: 764045 - DNA, 13 bp, Homo sapiens
ccactcagaggcc

SEQ ID NO: 764046 - DNA, 16 bp, Homo sapiens
ccactcagaggccccc

SEQ ID NO: 764047 - DNA, 22 bp, Homo sapiens
ccactcagaggcccccagtggg

SEQ ID NO: 764048 - DNA, 20 bp, Homo sapiens
ccactcagccatttccccct

SEQ ID NO: 764049 - DNA, 16 bp, Homo sapiens
ccactcagcccctagg

SEQ ID NO: 764050 - DNA, 12 bp, Homo sapiens
ccactcaggcca

SEQ ID NO: 764051 - DNA, 21 bp, Homo sapiens
ccactcagtactgtacagggt

SEQ ID NO: 764052 - DNA, 20 bp, Homo sapiens
ccactccaagatgccctcat

SEQ ID NO: 764053 - DNA, 13 bp, Homo sapiens
ccactccaagccc

SEQ ID NO: 764054 - DNA, 20 bp, Homo sapiens
ccactccaagccccctggca

SEQ ID NO: 764055 - DNA, 15 bp, Homo sapiens
ccactccaccctgtt

SEQ ID NO: 764056 - DNA, 20 bp, Homo sapiens
ccactccaccctgttagttt

SEQ ID NO: 764057 - DNA, 21 bp, Homo sapiens
ccactccagacccctggcttt

SEQ ID NO: 764058 - DNA, 18 bp, Homo sapiens
ccactccagcgctgagtg

SEQ ID NO: 764059 - DNA, 16 bp, Homo sapiens
ccactccagctctgag

SEQ ID NO: 764060 - DNA, 11 bp, Homo sapiens
ccactccccca

SEQ ID NO: 764061 - DNA, 15 bp, Homo sapiens
ccactcccccaccca

SEQ ID NO: 764062 - DNA, 22 bp, Homo sapiens
ccactcccccacccatggggag

SEQ ID NO: 764063 - DNA, 15 bp, Homo sapiens
ccactcccctcacac

SEQ ID NO: 764064 - DNA, 14 bp, Homo sapiens
ccactccctgggac

SEQ ID NO: 764065 - DNA, 20 bp, Homo sapiens
ccactcccttgctggcccca

SEQ ID NO: 764066 - DNA, 13 bp, Homo sapiens
ccactcccttggt

SEQ ID NO: 764067 - DNA, 16 bp, Homo sapiens
ccactccgagaggtgg

SEQ ID NO: 764068 - DNA, 23 bp, Homo sapiens
ccactccgagaggtgggccagtc

SEQ ID NO: 764069 - DNA, 17 bp, Homo sapiens
ccactcctatggaaaag

SEQ ID NO: 764070 - DNA, 13 bp, Homo sapiens
ccactcctccctc

SEQ ID NO: 764071 - DNA, 13 bp, Homo sapiens
ccactcctctccc

SEQ ID NO: 764072 - DNA, 17 bp, Homo sapiens
ccactcctctcccacag

SEQ ID NO: 764073 - DNA, 12 bp, Homo sapiens
ccactcctctga

SEQ ID NO: 764074 - DNA, 15 bp, Homo sapiens
ccactcctctgctga

SEQ ID NO: 764075 - DNA, 21 bp, Homo sapiens
ccactcctgtcccgccttcct

SEQ ID NO: 764076 - DNA, 23 bp, Homo sapiens
ccactcggatggaccaacctgct

SEQ ID NO: 764077 - DNA, 19 bp, Homo sapiens
ccactctaccctcccaccc

SEQ ID NO: 764078 - DNA, 21 bp, Homo sapiens
ccactctaccctcccaccccc

SEQ ID NO: 764079 - DNA, 15 bp, Homo sapiens
ccactctcactccac

SEQ ID NO: 764080 - DNA, 17 bp, Homo sapiens
ccactctcattccccag

SEQ ID NO: 764081 - DNA, 16 bp, Homo sapiens
ccactctccccacact

SEQ ID NO: 764082 - DNA, 22 bp, Homo sapiens
ccactctcccctccctcttcct

SEQ ID NO: 764083 - DNA, 15 bp, Homo sapiens
ccactctctcaccca

SEQ ID NO: 764084 - DNA, 16 bp, Homo sapiens
ccactctctcacccac

SEQ ID NO: 764085 - DNA, 13 bp, Homo sapiens
ccactctgcggcc

SEQ ID NO: 764086 - DNA, 20 bp, Homo sapiens
ccactctggtggccacttca

SEQ ID NO: 764087 - DNA, 15 bp, Homo sapiens
ccacttaagttcttt

SEQ ID NO: 764088 - DNA, 21 bp, Homo sapiens
ccacttagaaattgcatttcc

SEQ ID NO: 764089 - DNA, 17 bp, Homo sapiens
ccacttagtgctggtcc

SEQ ID NO: 764090 - DNA, 21 bp, Homo sapiens
ccacttagttaaaattgattt

SEQ ID NO: 764091 - DNA, 18 bp, Homo sapiens
ccacttatgctgctgtga

SEQ ID NO: 764092 - DNA, 22 bp, Homo sapiens
ccacttattccccattcttcct

SEQ ID NO: 764093 - DNA, 19 bp, Homo sapiens
ccacttatttattgttgcc

SEQ ID NO: 764094 - DNA, 24 bp, Homo sapiens
ccacttcacccccaacttcaccac

SEQ ID NO: 764095 - DNA, 13 bp, Homo sapiens
ccacttcactgcg

SEQ ID NO: 764096 - DNA, 22 bp, Homo sapiens
ccacttcccatctccagggaag

SEQ ID NO: 764097 - DNA, 14 bp, Homo sapiens
ccacttcctcctac

SEQ ID NO: 764098 - DNA, 19 bp, Homo sapiens
ccacttcctcctacctggg

SEQ ID NO: 764099 - DNA, 16 bp, Homo sapiens
ccacttcctttcctac

SEQ ID NO: 764100 - DNA, 13 bp, Homo sapiens
ccacttcctttta

SEQ ID NO: 764101 - DNA, 19 bp, Homo sapiens
ccacttctccatgctgcaa

SEQ ID NO: 764102 - DNA, 11 bp, Homo sapiens
ccacttctccc

SEQ ID NO: 764103 - DNA, 13 bp, Homo sapiens
ccacttctcccca

SEQ ID NO: 764104 - DNA, 14 bp, Homo sapiens
ccacttctctgctg

SEQ ID NO: 764105 - DNA, 15 bp, Homo sapiens
ccacttctctgctgc

SEQ ID NO: 764106 - DNA, 13 bp, Homo sapiens
ccacttctctggg

SEQ ID NO: 764107 - DNA, 21 bp, Homo sapiens
ccacttctgcgggctccctcc

SEQ ID NO: 764108 - DNA, 23 bp, Homo sapiens
ccacttctgcgggctccctcctc

SEQ ID NO: 764109 - DNA, 14 bp, Homo sapiens
ccacttctggccac

SEQ ID NO: 764110 - DNA, 15 bp, Homo sapiens
ccacttctggccaca

SEQ ID NO: 764111 - DNA, 15 bp, Homo sapiens
ccacttctggcctcc

SEQ ID NO: 764112 - DNA, 19 bp, Homo sapiens
ccacttctggcctccagcc

SEQ ID NO: 764113 - DNA, 20 bp, Homo sapiens
ccacttctggcctccagcct

SEQ ID NO: 764114 - DNA, 22 bp, Homo sapiens
ccacttctggcttcagccccca

SEQ ID NO: 764115 - DNA, 18 bp, Homo sapiens
ccacttctgtgggcatgg

SEQ ID NO: 764116 - DNA, 20 bp, Homo sapiens
ccacttctgtgggcatggcc

SEQ ID NO: 764117 - DNA, 19 bp, Homo sapiens
ccacttcttaaaggcctgg

SEQ ID NO: 764118 - DNA, 15 bp, Homo sapiens
ccacttcttcctttc

SEQ ID NO: 764119 - DNA, 12 bp, Homo sapiens
ccacttcttggt

SEQ ID NO: 764120 - DNA, 18 bp, Homo sapiens
ccacttcttggttcctgg

SEQ ID NO: 764121 - DNA, 19 bp, Homo sapiens
ccacttcttgttccccact

SEQ ID NO: 764122 - DNA, 20 bp, Homo sapiens
ccacttcttgttccccactg

SEQ ID NO: 764123 - DNA, 14 bp, Homo sapiens
ccacttgaaatgtt

SEQ ID NO: 764124 - DNA, 17 bp, Homo sapiens
ccacttgaaatgttagt

SEQ ID NO: 764125 - DNA, 15 bp, Homo sapiens
ccacttgacattcct

SEQ ID NO: 764126 - DNA, 16 bp, Homo sapiens
ccacttgacattcctt

SEQ ID NO: 764127 - DNA, 16 bp, Homo sapiens
ccacttgattgagaaa

SEQ ID NO: 764128 - DNA, 12 bp, Homo sapiens
ccacttgcctct

SEQ ID NO: 764129 - DNA, 19 bp, Homo sapiens
ccacttgcctcttccttga

SEQ ID NO: 764130 - DNA, 13 bp, Homo sapiens
ccacttgcctggg

SEQ ID NO: 764131 - DNA, 12 bp, Homo sapiens
ccacttgccttt

SEQ ID NO: 764132 - DNA, 21 bp, Homo sapiens
ccacttgctgcactcttgcac

SEQ ID NO: 764133 - DNA, 15 bp, Homo sapiens
ccacttggcccagaa

SEQ ID NO: 764134 - DNA, 16 bp, Homo sapiens
ccacttgggtcttccc

SEQ ID NO: 764135 - DNA, 21 bp, Homo sapiens
ccacttgtatatatggatcag

SEQ ID NO: 764136 - DNA, 20 bp, Homo sapiens
ccacttgtcccactatctgg

SEQ ID NO: 764137 - DNA, 18 bp, Homo sapiens
ccactttacccacctaga

SEQ ID NO: 764138 - DNA, 13 bp, Homo sapiens
ccactttcagagc

SEQ ID NO: 764139 - DNA, 22 bp, Homo sapiens
ccactttcagagcccccagccc

SEQ ID NO: 764140 - DNA, 23 bp, Homo sapiens
ccactttcagagcccccagccct

SEQ ID NO: 764141 - DNA, 15 bp, Homo sapiens
ccactttctgttcct

SEQ ID NO: 764142 - DNA, 20 bp, Homo sapiens
ccactttgcacagctctccg

SEQ ID NO: 764143 - DNA, 13 bp, Homo sapiens
ccactttgctggt

SEQ ID NO: 764144 - DNA, 17 bp, Homo sapiens
ccactttgctgttcctt

SEQ ID NO: 764145 - DNA, 14 bp, Homo sapiens
ccactttggcttct

SEQ ID NO: 764146 - DNA, 20 bp, Homo sapiens
ccactttggcttctcctgtg

SEQ ID NO: 764147 - DNA, 21 bp, Homo sapiens
ccactttggtacatggccagt

SEQ ID NO: 764148 - DNA, 20 bp, Homo sapiens
ccactttgttctttaggaga

SEQ ID NO: 764149 - DNA, 16 bp, Homo sapiens
ccactttgttggccct

SEQ ID NO: 764150 - DNA, 22 bp, Homo sapiens
ccactttgtttcgtggggaggt

SEQ ID NO: 764151 - DNA, 21 bp, Homo sapiens
ccacttttaaaggaatgtgaa

SEQ ID NO: 764152 - DNA, 23 bp, Homo sapiens
ccacttttgaagtcttccctcag

SEQ ID NO: 764153 - DNA, 21 bp, Homo sapiens
ccacttttgcccacctcttct

SEQ ID NO: 764154 - DNA, 14 bp, Homo sapiens
ccacttttgttctt

SEQ ID NO: 764155 - DNA, 21 bp, Homo sapiens
ccacttttgttcttggtttgt

SEQ ID NO: 764156 - DNA, 14 bp, Homo sapiens
ccactttttcttat

SEQ ID NO: 764157 - DNA, 16 bp, Homo sapiens
ccagaaaaatgaaaag

SEQ ID NO: 764158 - DNA, 15 bp, Homo sapiens
ccagaaaaccccagc

SEQ ID NO: 764159 - DNA, 15 bp, Homo sapiens
ccagaaacagctgct

SEQ ID NO: 764160 - DNA, 20 bp, Homo sapiens
ccagaaacagctgcttctcc

SEQ ID NO: 764161 - DNA, 22 bp, Homo sapiens
ccagaaacagctgcttctcccc

SEQ ID NO: 764162 - DNA, 21 bp, Homo sapiens
ccagaaacagtgggagccctg

SEQ ID NO: 764163 - DNA, 15 bp, Homo sapiens
ccagaaactcctgtt

SEQ ID NO: 764164 - DNA, 23 bp, Homo sapiens
ccagaaactccttttgctgtctt

SEQ ID NO: 764165 - DNA, 15 bp, Homo sapiens
ccagaaagcctcctg

SEQ ID NO: 764166 - DNA, 13 bp, Homo sapiens
ccagaaagctgag

SEQ ID NO: 764167 - DNA, 22 bp, Homo sapiens
cttggcttacctgacctcttgc

SEQ ID NO: 764168 - DNA, 13 bp, Homo sapiens
cttggcttccaga

SEQ ID NO: 764169 - DNA, 15 bp, Homo sapiens
cttggcttctgggac

SEQ ID NO: 764170 - DNA, 13 bp, Homo sapiens
cttggcttctgtg

SEQ ID NO: 764171 - DNA, 18 bp, Homo sapiens
cttggctttcagagccag

SEQ ID NO: 764172 - DNA, 20 bp, Homo sapiens
cttggctttcagagccagcc

SEQ ID NO: 764173 - DNA, 15 bp, Homo sapiens
cttggctttcatgtt

SEQ ID NO: 764174 - DNA, 16 bp, Homo sapiens
cttggctttctccctc

SEQ ID NO: 764175 - DNA, 22 bp, Homo sapiens
cttggctttgtcacttttcctt

SEQ ID NO: 764176 - DNA, 19 bp, Homo sapiens
cttgggaaggaaggcagtg

SEQ ID NO: 764177 - DNA, 13 bp, Homo sapiens
cttgggaaggaca

SEQ ID NO: 764178 - DNA, 16 bp, Homo sapiens
cttgggaaggacacag

SEQ ID NO: 764179 - DNA, 19 bp, Homo sapiens
cttgggaaggacacagcag

SEQ ID NO: 764180 - DNA, 23 bp, Homo sapiens
cttgggaaggacacagcagtatt

SEQ ID NO: 764181 - DNA, 18 bp, Homo sapiens
cttgggaatggatcctgg

SEQ ID NO: 764182 - DNA, 18 bp, Homo sapiens
cttgggacagccagagct

SEQ ID NO: 764183 - DNA, 19 bp, Homo sapiens
cttgggacagccagagctg

SEQ ID NO: 764184 - DNA, 22 bp, Homo sapiens
cttgggactcaggtctgtaact

SEQ ID NO: 764185 - DNA, 17 bp, Homo sapiens
cttgggactgggtttgg

SEQ ID NO: 764186 - DNA, 21 bp, Homo sapiens
cttgggagcctgaggcaggag

SEQ ID NO: 764187 - DNA, 19 bp, Homo sapiens
cttgggagctgctgggcta

SEQ ID NO: 764188 - DNA, 23 bp, Homo sapiens
cttgggaggacatgcgtgtgtca

SEQ ID NO: 764189 - DNA, 23 bp, Homo sapiens
cttgggaggctgaggcaggagaa

SEQ ID NO: 764190 - DNA, 19 bp, Homo sapiens
cttgggagggtcaggctgt

SEQ ID NO: 764191 - DNA, 16 bp, Homo sapiens
cttgggagtatgttgt

SEQ ID NO: 764192 - DNA, 22 bp, Homo sapiens
cttgggatagtgttctgctcct

SEQ ID NO: 764193 - DNA, 23 bp, Homo sapiens
cttgggatagtgttctgctcctg

SEQ ID NO: 764194 - DNA, 13 bp, Homo sapiens
cttgggcagagct

SEQ ID NO: 764195 - DNA, 18 bp, Homo sapiens
cttgggcagagctggctc

SEQ ID NO: 764196 - DNA, 20 bp, Homo sapiens
cttgggcagagctggctctg

SEQ ID NO: 764197 - DNA, 13 bp, Homo sapiens
cttgggcagttct

SEQ ID NO: 764198 - DNA, 17 bp, Homo sapiens
cttgggcatccacccag

SEQ ID NO: 764199 - DNA, 19 bp, Homo sapiens
cttgggcatccacccagtg

SEQ ID NO: 764200 - DNA, 23 bp, Homo sapiens
cttgggcatccacccagtgctgc

SEQ ID NO: 764201 - DNA, 19 bp, Homo sapiens
cttgggccaaatccgctct

SEQ ID NO: 764202 - DNA, 14 bp, Homo sapiens
cttgggccactgtg

SEQ ID NO: 764203 - DNA, 15 bp, Homo sapiens
cttgggcccagctgg

SEQ ID NO: 764204 - DNA, 16 bp, Homo sapiens
cttgggcccagctggg

SEQ ID NO: 764205 - DNA, 23 bp, Homo sapiens
cttgggccccagaccccagggca

SEQ ID NO: 764206 - DNA, 13 bp, Homo sapiens
cttgggccctcct

SEQ ID NO: 764207 - DNA, 16 bp, Homo sapiens
cttgggcctttcagtc

SEQ ID NO: 764208 - DNA, 14 bp, Homo sapiens
cttgtcacaataaa

SEQ ID NO: 764209 - DNA, 16 bp, Homo sapiens
cttgtcacaataaatg

SEQ ID NO: 764210 - DNA, 17 bp, Homo sapiens
cttgtcacaataaatgt

SEQ ID NO: 764211 - DNA, 22 bp, Homo sapiens
cttgtcacccaaagcctgtccc

SEQ ID NO: 764212 - DNA, 22 bp, Homo sapiens
cttgtcactggtagaccaaaat

SEQ ID NO: 764213 - DNA, 13 bp, Homo sapiens
cttgtcagagctg

SEQ ID NO: 764214 - DNA, 21 bp, Homo sapiens
cttgtcagagctgggaggggt

SEQ ID NO: 764215 - DNA, 23 bp, Homo sapiens
cttgtcatggaaaatgtcctgtg

SEQ ID NO: 764216 - DNA, 18 bp, Homo sapiens
cttgtcattccagagtgc

SEQ ID NO: 764217 - DNA, 17 bp, Homo sapiens
cttgtcattgagcctgg

SEQ ID NO: 764218 - DNA, 21 bp, Homo sapiens
cttgtcattgagcctggcaat

SEQ ID NO: 764219 - DNA, 21 bp, Homo sapiens
cttgtcattgccttcgctcca

SEQ ID NO: 764220 - DNA, 14 bp, Homo sapiens
cttgtccacattct

SEQ ID NO: 764221 - DNA, 12 bp, Homo sapiens
cttgtccagctg

SEQ ID NO: 764222 - DNA, 16 bp, Homo sapiens
cttgtccaggaactgc

SEQ ID NO: 764223 - DNA, 19 bp, Homo sapiens
cttgtcccaattaaaatac

SEQ ID NO: 764224 - DNA, 18 bp, Homo sapiens
cttgtcccactatctggg

SEQ ID NO: 764225 - DNA, 15 bp, Homo sapiens
cttgtcctcagccag

SEQ ID NO: 764226 - DNA, 15 bp, Homo sapiens
cttgtcctgaagccc

SEQ ID NO: 764227 - DNA, 15 bp, Homo sapiens
cttgtcctgccagct

SEQ ID NO: 764228 - DNA, 19 bp, Homo sapiens
cttgtcctgccagctgcct

SEQ ID NO: 764229 - DNA, 22 bp, Homo sapiens
cttgtcctgccagctgccttcc

SEQ ID NO: 764230 - DNA, 17 bp, Homo sapiens
cttgtcctggcccttca

SEQ ID NO: 764231 - DNA, 22 bp, Homo sapiens
cttgtcctggcccttcagtctg

SEQ ID NO: 764232 - DNA, 21 bp, Homo sapiens
cttgtcgcgcgtctcccatcc

SEQ ID NO: 764233 - DNA, 15 bp, Homo sapiens
cttgtcgggggccca

SEQ ID NO: 764234 - DNA, 20 bp, Homo sapiens
cttgtctgaggcctcatccc

SEQ ID NO: 764235 - DNA, 14 bp, Homo sapiens
cttgtctgggtgca

SEQ ID NO: 764236 - DNA, 15 bp, Homo sapiens
cttgtctgggtgcag

SEQ ID NO: 764237 - DNA, 21 bp, Homo sapiens
cttgtctgggtgcagctgggc

SEQ ID NO: 764238 - DNA, 12 bp, Homo sapiens
cttgtctgtgtg

SEQ ID NO: 764239 - DNA, 23 bp, Homo sapiens
cttgtcttcccccctctcctccc

SEQ ID NO: 764240 - DNA, 24 bp, Homo sapiens
cttgtcttcccccctctcctccca

SEQ ID NO: 764241 - DNA, 15 bp, Homo sapiens
cttgtcttgaaaact

SEQ ID NO: 764242 - DNA, 17 bp, Homo sapiens
cttgtctttactgacaa

SEQ ID NO: 764243 - DNA, 15 bp, Homo sapiens
cttgtgacagtgcct

SEQ ID NO: 764244 - DNA, 20 bp, Homo sapiens
cttgtgacagtgcctcttcc

SEQ ID NO: 764245 - DNA, 12 bp, Homo sapiens
cttgtgacatat

SEQ ID NO: 764246 - DNA, 21 bp, Homo sapiens
cttgtgacatattatgtcttc

SEQ ID NO: 764247 - DNA, 17 bp, Homo sapiens
cttgtgacgtgcactgt

SEQ ID NO: 764248 - DNA, 15 bp, Homo sapiens
cttgtgactgaaggg

SEQ ID NO: 764249 - DNA, 18 bp, Homo sapiens
cttgtgactgaaggggca

SEQ ID NO: 764250 - DNA, 15 bp, Homo sapiens
cttgtgagagcccat

SEQ ID NO: 764251 - DNA, 13 bp, Homo sapiens
cttgtgaggcttc

SEQ ID NO: 764252 - DNA, 17 bp, Homo sapiens
cttgtgagtggataatc

SEQ ID NO: 764253 - DNA, 16 bp, Homo sapiens
cttgtgattcctaccc

SEQ ID NO: 764254 - DNA, 21 bp, Homo sapiens
cttgtgatttccatttctgat

SEQ ID NO: 764255 - DNA, 16 bp, Homo sapiens
cttgtgatttctttaa

SEQ ID NO: 764256 - DNA, 23 bp, Homo sapiens
cttgtgcaccctctatcccaata

SEQ ID NO: 764257 - DNA, 12 bp, Homo sapiens
cttgtgcactta

SEQ ID NO: 764258 - DNA, 15 bp, Homo sapiens
cttgtgcagtgttga

SEQ ID NO: 764259 - DNA, 22 bp, Homo sapiens
cttgtgcataattcttccaaag

SEQ ID NO: 764260 - DNA, 14 bp, Homo sapiens
cttgtgcatttggt

SEQ ID NO: 764261 - DNA, 17 bp, Homo sapiens
cttgtgccacaccctcc

SEQ ID NO: 764262 - DNA, 17 bp, Homo sapiens
cttgtgccctgccccca

SEQ ID NO: 764263 - DNA, 12 bp, Homo sapiens
cttgtgcctccc

SEQ ID NO: 764264 - DNA, 17 bp, Homo sapiens
cttgtgcctcccttccc

SEQ ID NO: 764265 - DNA, 18 bp, Homo sapiens
cttgtgcctcccttccca

SEQ ID NO: 764266 - DNA, 14 bp, Homo sapiens
cttgtgcctgctcc

SEQ ID NO: 764267 - DNA, 23 bp, Homo sapiens
cttgtgctcacgctcccccgcag

SEQ ID NO: 764268 - DNA, 19 bp, Homo sapiens
cttgtgctcctctcgcaca

SEQ ID NO: 764269 - DNA, 20 bp, Homo sapiens
cttgtgctgatcgtgctaaa

SEQ ID NO: 764270 - DNA, 12 bp, Homo sapiens
cttgtgcttctt

SEQ ID NO: 764271 - DNA, 13 bp, Homo sapiens
cttgtggactggc

SEQ ID NO: 764272 - DNA, 17 bp, Homo sapiens
cttgtggatggaaatgt

SEQ ID NO: 764273 - DNA, 22 bp, Homo sapiens
cttgtggccttttttataacta

SEQ ID NO: 764274 - DNA, 22 bp, Homo sapiens
cttgtggcttgggacatggcac

SEQ ID NO: 764275 - DNA, 19 bp, Homo sapiens
cttgtgggcaaaggcaggg

SEQ ID NO: 764276 - DNA, 14 bp, Homo sapiens
cttgtgggctggtg

SEQ ID NO: 764277 - DNA, 16 bp, Homo sapiens
cttgtggggacccagg

SEQ ID NO: 764278 - DNA, 17 bp, Homo sapiens
cttgtggggacccaggc

SEQ ID NO: 764279 - DNA, 18 bp, Homo sapiens
cttgtggggacccaggct

SEQ ID NO: 764280 - DNA, 24 bp, Homo sapiens
cttgtgggtccatgctaacaaaga

SEQ ID NO: 764281 - DNA, 22 bp, Homo sapiens
cttgtggttataacttaatgaa

SEQ ID NO: 764282 - DNA, 12 bp, Homo sapiens
cttgtggtttgt

SEQ ID NO: 764283 - DNA, 20 bp, Homo sapiens
cttgtgtactgataaaatac

SEQ ID NO: 764284 - DNA, 18 bp, Homo sapiens
cttgtgtagatttgaaaa

SEQ ID NO: 764285 - DNA, 20 bp, Homo sapiens
cttgtgtagatttgaaaatt

SEQ ID NO: 764286 - DNA, 21 bp, Homo sapiens
cttgtgtagatttgaaaattg

SEQ ID NO: 764287 - DNA, 23 bp, Homo sapiens
cttgtgtatatgtataaattaat

SEQ ID NO: 764288 - DNA, 23 bp, Homo sapiens
cttgtgtatattttaatgaatat

SEQ ID NO: 764289 - DNA, 14 bp, Homo sapiens
cttgtgtcccatga

SEQ ID NO: 764290 - DNA, 18 bp, Homo sapiens
cttgtgtctctgtgcttt

SEQ ID NO: 764291 - DNA, 10 bp, Homo sapiens
cttgtgtctg

SEQ ID NO: 764292 - DNA, 18 bp, Homo sapiens
cttgtgtggcttggagga

SEQ ID NO: 764293 - DNA, 17 bp, Homo sapiens
cttgtgtgtcaggccct

SEQ ID NO: 764294 - DNA, 20 bp, Homo sapiens
cttgtgtgtcaggccctctg

SEQ ID NO: 764295 - DNA, 16 bp, Homo sapiens
cttgtgtgtgccctgg

SEQ ID NO: 764296 - DNA, 18 bp, Homo sapiens
ccagagagcaactctgag

SEQ ID NO: 764297 - DNA, 15 bp, Homo sapiens
ccagagagcagctcc

SEQ ID NO: 764298 - DNA, 13 bp, Homo sapiens
ccagagagcaggc

SEQ ID NO: 764299 - DNA, 21 bp, Homo sapiens
ccagagagcaggcaggggcat

SEQ ID NO: 764300 - DNA, 16 bp, Homo sapiens
ccagagagcaggggag

SEQ ID NO: 764301 - DNA, 17 bp, Homo sapiens
ccagagagcaggggagc

SEQ ID NO: 764302 - DNA, 13 bp, Homo sapiens
ccagagagcctcc

SEQ ID NO: 764303 - DNA, 21 bp, Homo sapiens
ccagagagcctggtgctgctg

SEQ ID NO: 764304 - DNA, 22 bp, Homo sapiens
ccagagagcctggtgctgctgc

SEQ ID NO: 764305 - DNA, 14 bp, Homo sapiens
ccagagaggagcac

SEQ ID NO: 764306 - DNA, 15 bp, Homo sapiens
ccagagaggagcacc

SEQ ID NO: 764307 - DNA, 16 bp, Homo sapiens
ccagagaggagcacct

SEQ ID NO: 764308 - DNA, 17 bp, Homo sapiens
ccagagaggagcacctg

SEQ ID NO: 764309 - DNA, 13 bp, Homo sapiens
ccagagaggcact

SEQ ID NO: 764310 - DNA, 15 bp, Homo sapiens
ccagagagggcccag

SEQ ID NO: 764311 - DNA, 17 bp, Homo sapiens
ccagagagggcccagct

SEQ ID NO: 764312 - DNA, 20 bp, Homo sapiens
ccagagagggcccagctgta

SEQ ID NO: 764313 - DNA, 21 bp, Homo sapiens
ccagagagggcccagctgtag

SEQ ID NO: 764314 - DNA, 15 bp, Homo sapiens
ccagagagtggctcc

SEQ ID NO: 764315 - DNA, 22 bp, Homo sapiens
ccagagagtggctcctcccggt

SEQ ID NO: 764316 - DNA, 18 bp, Homo sapiens
ccagagatgcctccaccg

SEQ ID NO: 764317 - DNA, 13 bp, Homo sapiens
ccagagcaaaata

SEQ ID NO: 764318 - DNA, 23 bp, Homo sapiens
ccagagcaccccctgctccacca

SEQ ID NO: 764319 - DNA, 14 bp, Homo sapiens
ccagagcagagagc

SEQ ID NO: 764320 - DNA, 14 bp, Homo sapiens
ccagagcagagcct

SEQ ID NO: 764321 - DNA, 15 bp, Homo sapiens
ccagagcaggaagca

SEQ ID NO: 764322 - DNA, 12 bp, Homo sapiens
ccagagcaggag

SEQ ID NO: 764323 - DNA, 16 bp, Homo sapiens
ccagagcaggagcccc

SEQ ID NO: 764324 - DNA, 21 bp, Homo sapiens
ccagagcaggaggcccctggc

SEQ ID NO: 764325 - DNA, 22 bp, Homo sapiens
ccagagcattacgtgagccagg

SEQ ID NO: 764326 - DNA, 23 bp, Homo sapiens
ccagagcattacgtgagccaggt

SEQ ID NO: 764327 - DNA, 11 bp, Homo sapiens
ccagagccaaa

SEQ ID NO: 764328 - DNA, 15 bp, Homo sapiens
ccagagccaaatttt

SEQ ID NO: 764329 - DNA, 14 bp, Homo sapiens
ccagagccagcctg

SEQ ID NO: 764330 - DNA, 14 bp, Homo sapiens
cttgttggagcctg

SEQ ID NO: 764331 - DNA, 15 bp, Homo sapiens
cttgttggagcctgc

SEQ ID NO: 764332 - DNA, 15 bp, Homo sapiens
cttgttggtcagagg

SEQ ID NO: 764333 - DNA, 19 bp, Homo sapiens
cttgttgtctccacttgta

SEQ ID NO: 764334 - DNA, 22 bp, Homo sapiens
cttgttgtctccacttgtatat

SEQ ID NO: 764335 - DNA, 15 bp, Homo sapiens
cttgttgtgacacat

SEQ ID NO: 764336 - DNA, 20 bp, Homo sapiens
cttgttgttggttgtttttt

SEQ ID NO: 764337 - DNA, 16 bp, Homo sapiens
cttgttgttttactaa

SEQ ID NO: 764338 - DNA, 22 bp, Homo sapiens
cttgttgtttttaagtcctgta

SEQ ID NO: 764339 - DNA, 18 bp, Homo sapiens
cttgtttaacatatatat

SEQ ID NO: 764340 - DNA, 16 bp, Homo sapiens
cttgtttatagccact

SEQ ID NO: 764341 - DNA, 18 bp, Homo sapiens
cttgtttatcagatacat

SEQ ID NO: 764342 - DNA, 22 bp, Homo sapiens
cttgtttatcagatacatcact

SEQ ID NO: 764343 - DNA, 16 bp, Homo sapiens
cttgtttatgatattt

SEQ ID NO: 764344 - DNA, 21 bp, Homo sapiens
cttgtttctgggtccctgctc

SEQ ID NO: 764345 - DNA, 14 bp, Homo sapiens
cttgtttcttttca

SEQ ID NO: 764346 - DNA, 23 bp, Homo sapiens
cttgtttgagagagaatgaggaa

SEQ ID NO: 764347 - DNA, 18 bp, Homo sapiens
cttgtttgagtttttcct

SEQ ID NO: 764348 - DNA, 21 bp, Homo sapiens
cttgtttgagtttttcctccc

SEQ ID NO: 764349 - DNA, 22 bp, Homo sapiens
cttgtttgagtttttcctccca

SEQ ID NO: 764350 - DNA, 13 bp, Homo sapiens
cttgtttgatttc

SEQ ID NO: 764351 - DNA, 18 bp, Homo sapiens
cttgtttgatttcaacat

SEQ ID NO: 764352 - DNA, 21 bp, Homo sapiens
cttgtttggtttggtttgctt

SEQ ID NO: 764353 - DNA, 13 bp, Homo sapiens
cttgtttgttgca

SEQ ID NO: 764354 - DNA, 14 bp, Homo sapiens
cttgttttatatac

SEQ ID NO: 764355 - DNA, 14 bp, Homo sapiens
cttgttttccaaag

SEQ ID NO: 764356 - DNA, 16 bp, Homo sapiens
cttgttttccaaagaa

SEQ ID NO: 764357 - DNA, 22 bp, Homo sapiens
cttgttttccagtctcttgtac

SEQ ID NO: 764358 - DNA, 14 bp, Homo sapiens
cttgttttcttgcc

SEQ ID NO: 764359 - DNA, 18 bp, Homo sapiens
cttgttttcttgccaatg

SEQ ID NO: 764360 - DNA, 19 bp, Homo sapiens
cttgttttgtttgcttcca

SEQ ID NO: 764361 - DNA, 18 bp, Homo sapiens
cttgtttttattaattta

SEQ ID NO: 764362 - DNA, 18 bp, Homo sapiens
cttgtttttccactactg

SEQ ID NO: 764363 - DNA, 15 bp, Homo sapiens
ctttaaaaaaacaat

SEQ ID NO: 764364 - DNA, 21 bp, Homo sapiens
ctttaaaaaagactgaacatg

SEQ ID NO: 764365 - DNA, 22 bp, Homo sapiens
ctttaaaaaagactgaacatgt

SEQ ID NO: 764366 - DNA, 23 bp, Homo sapiens
ctttaaaaaagactgaacatgtt

SEQ ID NO: 764367 - DNA, 15 bp, Homo sapiens
ctttaaaaaattctc

SEQ ID NO: 764368 - DNA, 12 bp, Homo sapiens
ctttaaaaagga

SEQ ID NO: 764369 - DNA, 21 bp, Homo sapiens
ctttaaaaagggaagaaactg

SEQ ID NO: 764370 - DNA, 21 bp, Homo sapiens
ctttaaaaccagtaacgtgct

SEQ ID NO: 764371 - DNA, 20 bp, Homo sapiens
ctttaaaacgcgtctgcctg

SEQ ID NO: 764372 - DNA, 15 bp, Homo sapiens
ctttaaaagaatgac

SEQ ID NO: 764373 - DNA, 18 bp, Homo sapiens
ctttaaaagcgacctctc

SEQ ID NO: 764374 - DNA, 14 bp, Homo sapiens
ctttaaaaggcaac

SEQ ID NO: 764375 - DNA, 15 bp, Homo sapiens
ctttaaaaggcaact

SEQ ID NO: 764376 - DNA, 21 bp, Homo sapiens
ctttaaaagtatctttaacaa

SEQ ID NO: 764377 - DNA, 18 bp, Homo sapiens
ctttaaaataaaaaagca

SEQ ID NO: 764378 - DNA, 21 bp, Homo sapiens
ctttaaaataaaaaagcaaaa

SEQ ID NO: 764379 - DNA, 22 bp, Homo sapiens
ctttaaaatatttgtctttaaa

SEQ ID NO: 764380 - DNA, 12 bp, Homo sapiens
ctttaaaatgcg

SEQ ID NO: 764381 - DNA, 22 bp, Homo sapiens
ctttaaacctgtagaatcaatt

SEQ ID NO: 764382 - DNA, 17 bp, Homo sapiens
ctttaaacctttcataa

SEQ ID NO: 764383 - DNA, 15 bp, Homo sapiens
ctttaaactcaggga

SEQ ID NO: 764384 - DNA, 22 bp, Homo sapiens
ctttaaactcagggacagagcc

SEQ ID NO: 764385 - DNA, 10 bp, Homo sapiens
ctttaaagaa

SEQ ID NO: 764386 - DNA, 14 bp, Homo sapiens
ctttaaagagagtt

SEQ ID NO: 764387 - DNA, 15 bp, Homo sapiens
ctttaaagagagttt

SEQ ID NO: 764388 - DNA, 14 bp, Homo sapiens
ctttaaagctcagg

SEQ ID NO: 764389 - DNA, 22 bp, Homo sapiens
ctttaaagctgagagaccctgg

SEQ ID NO: 764390 - DNA, 18 bp, Homo sapiens
ctttaaaggaaaaaatgt

SEQ ID NO: 764391 - DNA, 21 bp, Homo sapiens
ctttaaaggcatctacacaat

SEQ ID NO: 764392 - DNA, 16 bp, Homo sapiens
ctttaaaggcccagcc

SEQ ID NO: 764393 - DNA, 18 bp, Homo sapiens
ctttaaaggcccagcccc

SEQ ID NO: 764394 - DNA, 21 bp, Homo sapiens
ctttaaaggtttttaaattgt

SEQ ID NO: 764395 - DNA, 17 bp, Homo sapiens
ctttaaagtaaaggcct

SEQ ID NO: 764396 - DNA, 22 bp, Homo sapiens
ctttaaagtatgaatctatgcc

SEQ ID NO: 764397 - DNA, 13 bp, Homo sapiens
ctttaaagttctt

SEQ ID NO: 764398 - DNA, 16 bp, Homo sapiens
ctttaaataaattaag

SEQ ID NO: 764399 - DNA, 15 bp, Homo sapiens
ctttaaatctgtgat

SEQ ID NO: 764400 - DNA, 17 bp, Homo sapiens
ctttaacaattgtctta

SEQ ID NO: 764401 - DNA, 21 bp, Homo sapiens
ctttaacatacaagaaaatgt

SEQ ID NO: 764402 - DNA, 18 bp, Homo sapiens
ctttaaccagtctgaagt

SEQ ID NO: 764403 - DNA, 16 bp, Homo sapiens
ctttaacctgaacctt

SEQ ID NO: 764404 - DNA, 17 bp, Homo sapiens
ctttaacctgaaccttg

SEQ ID NO: 764405 - DNA, 22 bp, Homo sapiens
ctttaactcccattaccatgta

SEQ ID NO: 764406 - DNA, 18 bp, Homo sapiens
ctttaactgacaagccat

SEQ ID NO: 764407 - DNA, 23 bp, Homo sapiens
ctttaactgccgtaatttaactt

SEQ ID NO: 764408 - DNA, 22 bp, Homo sapiens
ctttaactgtgtgaccagcgga

SEQ ID NO: 764409 - DNA, 15 bp, Homo sapiens
ctttaacttaaatag

SEQ ID NO: 764410 - DNA, 19 bp, Homo sapiens
ctttaagaaccttaatgac

SEQ ID NO: 764411 - DNA, 23 bp, Homo sapiens
ctttaagaaccttaatgacaaca

SEQ ID NO: 764412 - DNA, 20 bp, Homo sapiens
ctttaagaaccttattttga

SEQ ID NO: 764413 - DNA, 23 bp, Homo sapiens
ctttaagacatactccttccatc

SEQ ID NO: 764414 - DNA, 16 bp, Homo sapiens
ctttaagccaaagaaa

SEQ ID NO: 764415 - DNA, 21 bp, Homo sapiens
ctttaagccaaagaaacaagc

SEQ ID NO: 764416 - DNA, 22 bp, Homo sapiens
ctttaagccatagaccctgagg

SEQ ID NO: 764417 - DNA, 12 bp, Homo sapiens
ctttaaggaaaa

SEQ ID NO: 764418 - DNA, 20 bp, Homo sapiens
ctttaaggggaggaaccaga

SEQ ID NO: 764419 - DNA, 21 bp, Homo sapiens
ctttaataaattgcttactga

SEQ ID NO: 764420 - DNA, 22 bp, Homo sapiens
ctttaataacaaggagatttct

SEQ ID NO: 764421 - DNA, 16 bp, Homo sapiens
ctttaatgatatgctt

SEQ ID NO: 764422 - DNA, 22 bp, Homo sapiens
ctttaatgatatgcttgtaact

SEQ ID NO: 764423 - DNA, 14 bp, Homo sapiens
ctttaatgcatcta

SEQ ID NO: 764424 - DNA, 19 bp, Homo sapiens
ctttaatgctgtctttgtg

SEQ ID NO: 764425 - DNA, 17 bp, Homo sapiens
ctttaatgttttttgcc

SEQ ID NO: 764426 - DNA, 12 bp, Homo sapiens
ctttaattatat

SEQ ID NO: 764427 - DNA, 20 bp, Homo sapiens
ccagatagtgtagctgagga

SEQ ID NO: 764428 - DNA, 14 bp, Homo sapiens
ccagatataaaata

SEQ ID NO: 764429 - DNA, 17 bp, Homo sapiens
ccagatataactgtctt

SEQ ID NO: 764430 - DNA, 19 bp, Homo sapiens
ccagatatgaacagggccc

SEQ ID NO: 764431 - DNA, 13 bp, Homo sapiens
ccagatcagtcag

SEQ ID NO: 764432 - DNA, 16 bp, Homo sapiens
ccagatccagactgta

SEQ ID NO: 764433 - DNA, 17 bp, Homo sapiens
ccagatccgctccagcg

SEQ ID NO: 764434 - DNA, 14 bp, Homo sapiens
ccagatcctcacaa

SEQ ID NO: 764435 - DNA, 17 bp, Homo sapiens
ccagatcctcacaacca

SEQ ID NO: 764436 - DNA, 12 bp, Homo sapiens
ccagatctccca

SEQ ID NO: 764437 - DNA, 15 bp, Homo sapiens
ccagatctgcctggg

SEQ ID NO: 764438 - DNA, 17 bp, Homo sapiens
ccagatctgcctgggcc

SEQ ID NO: 764439 - DNA, 19 bp, Homo sapiens
ccagatctgcctgggcctg

SEQ ID NO: 764440 - DNA, 15 bp, Homo sapiens
ccagatctttctctt

SEQ ID NO: 764441 - DNA, 13 bp, Homo sapiens
ccagatgaacatt

SEQ ID NO: 764442 - DNA, 23 bp, Homo sapiens
ccagatgccttctagattcactg

SEQ ID NO: 764443 - DNA, 22 bp, Homo sapiens
ccagatgcggggacaggctgga

SEQ ID NO: 764444 - DNA, 16 bp, Homo sapiens
ccagatggactccagc

SEQ ID NO: 764445 - DNA, 17 bp, Homo sapiens
ccagatggactccagcc

SEQ ID NO: 764446 - DNA, 13 bp, Homo sapiens
ccagatggcccct

SEQ ID NO: 764447 - DNA, 17 bp, Homo sapiens
ccagatggcccctccac

SEQ ID NO: 764448 - DNA, 20 bp, Homo sapiens
ccagatgtaaagaacgcgac

SEQ ID NO: 764449 - DNA, 19 bp, Homo sapiens
ccagatgtgcttttattta

SEQ ID NO: 764450 - DNA, 23 bp, Homo sapiens
ccagatgtgtcccccccaggcct

SEQ ID NO: 764451 - DNA, 13 bp, Homo sapiens
ccagccaacccct

SEQ ID NO: 764452 - DNA, 21 bp, Homo sapiens
ccagccaaggataccggacac

SEQ ID NO: 764453 - DNA, 17 bp, Homo sapiens
ccagccaatttcccgga

SEQ ID NO: 764454 - DNA, 24 bp, Homo sapiens
ccagccaccaccctcaggtgcctc

SEQ ID NO: 764455 - DNA, 21 bp, Homo sapiens
ccagccaccccgggctctctg

SEQ ID NO: 764456 - DNA, 22 bp, Homo sapiens
ccagccaccccgggctctctgc

SEQ ID NO: 764457 - DNA, 18 bp, Homo sapiens
ccagccacccctgccact

SEQ ID NO: 764458 - DNA, 20 bp, Homo sapiens
ccagccacccctgccactca

SEQ ID NO: 764459 - DNA, 16 bp, Homo sapiens
ccagccacggagggag

SEQ ID NO: 764460 - DNA, 15 bp, Homo sapiens
ccagccactccaagc

SEQ ID NO: 764461 - DNA, 16 bp, Homo sapiens
ccagccactccaagcc

SEQ ID NO: 764462 - DNA, 20 bp, Homo sapiens
ccagccactcgggaggctga

SEQ ID NO: 764463 - DNA, 21 bp, Homo sapiens
ccagccactgccaagcttcct

SEQ ID NO: 764464 - DNA, 22 bp, Homo sapiens
ccagccagaacgtggctctgct

SEQ ID NO: 764465 - DNA, 20 bp, Homo sapiens
ccagccagaggcatctgagg

SEQ ID NO: 764466 - DNA, 21 bp, Homo sapiens
ccagccagatggactccagcc

SEQ ID NO: 764467 - DNA, 15 bp, Homo sapiens
ccagccagccacccc

SEQ ID NO: 764468 - DNA, 15 bp, Homo sapiens
ccagccagccctggc

SEQ ID NO: 764469 - DNA, 14 bp, Homo sapiens
ccagccagcctcag

SEQ ID NO: 764470 - DNA, 19 bp, Homo sapiens
ccagccagcctcagaaggc

SEQ ID NO: 764471 - DNA, 13 bp, Homo sapiens
ccagccagcgcct

SEQ ID NO: 764472 - DNA, 15 bp, Homo sapiens
ccagccagcgcctcc

SEQ ID NO: 764473 - DNA, 12 bp, Homo sapiens
ccagccagctgc

SEQ ID NO: 764474 - DNA, 13 bp, Homo sapiens
ccagccagctgca

SEQ ID NO: 764475 - DNA, 14 bp, Homo sapiens
ccagccagctgcag

SEQ ID NO: 764476 - DNA, 16 bp, Homo sapiens
ccagccagctgcaggg

SEQ ID NO: 764477 - DNA, 21 bp, Homo sapiens
ccagccagctgcagggcacgg

SEQ ID NO: 764478 - DNA, 12 bp, Homo sapiens
ccagccaggcag

SEQ ID NO: 764479 - DNA, 17 bp, Homo sapiens
ccagccaggcgggctca

SEQ ID NO: 764480 - DNA, 21 bp, Homo sapiens
ccagccaggcgggctcaagga

SEQ ID NO: 764481 - DNA, 14 bp, Homo sapiens
ccagccagtcttgc

SEQ ID NO: 764482 - DNA, 22 bp, Homo sapiens
ccagccagtcttgcctaggcca

SEQ ID NO: 764483 - DNA, 18 bp, Homo sapiens
ccagccatcaagagactg

SEQ ID NO: 764484 - DNA, 14 bp, Homo sapiens
ccagccatgccagc

SEQ ID NO: 764485 - DNA, 18 bp, Homo sapiens
ccagccatgtctgcattt

SEQ ID NO: 764486 - DNA, 13 bp, Homo sapiens
ccagccattgtaa

SEQ ID NO: 764487 - DNA, 23 bp, Homo sapiens
ccagcccaaaccttgggccctgg

SEQ ID NO: 764488 - DNA, 21 bp, Homo sapiens
ccagcccaaaggggacaggcc

SEQ ID NO: 764489 - DNA, 22 bp, Homo sapiens
ccagcccaaaggggacaggcct

SEQ ID NO: 764490 - DNA, 13 bp, Homo sapiens
ccagcccacagag

SEQ ID NO: 764491 - DNA, 16 bp, Homo sapiens
ccagcccacagagcct

SEQ ID NO: 764492 - DNA, 17 bp, Homo sapiens
ccagcccactgcctcct

SEQ ID NO: 764493 - DNA, 12 bp, Homo sapiens
ccagcccagacc

SEQ ID NO: 764494 - DNA, 20 bp, Homo sapiens
ccagcccagacccccagtgt

SEQ ID NO: 764495 - DNA, 12 bp, Homo sapiens
ccagcccagagc

SEQ ID NO: 764496 - DNA, 16 bp, Homo sapiens
ccagcccagagccacc

SEQ ID NO: 764497 - DNA, 14 bp, Homo sapiens
ccagcccagatgtt

SEQ ID NO: 764498 - DNA, 15 bp, Homo sapiens
ccagcccagatgttt

SEQ ID NO: 764499 - DNA, 23 bp, Homo sapiens
ccagcccagattcccctgtgtca

SEQ ID NO: 764500 - DNA, 15 bp, Homo sapiens
ccagcccagccaggc

SEQ ID NO: 764501 - DNA, 16 bp, Homo sapiens
ccagcccagccaggcc

SEQ ID NO: 764502 - DNA, 13 bp, Homo sapiens
ccagcccagcctg

SEQ ID NO: 764503 - DNA, 13 bp, Homo sapiens
ccagcccagggct

SEQ ID NO: 764504 - DNA, 21 bp, Homo sapiens
ccagcccatccattaggccag

SEQ ID NO: 764505 - DNA, 14 bp, Homo sapiens
ccagcccattgctg

SEQ ID NO: 764506 - DNA, 23 bp, Homo sapiens
ccagcccattggccgagctcctg

SEQ ID NO: 764507 - DNA, 13 bp, Homo sapiens
ccagccccaactc

SEQ ID NO: 764508 - DNA, 13 bp, Homo sapiens
ccagccccaagct

SEQ ID NO: 764509 - DNA, 17 bp, Homo sapiens
ccagccccacccaggag

SEQ ID NO: 764510 - DNA, 18 bp, Homo sapiens
ccagccccacccaggagg

SEQ ID NO: 764511 - DNA, 17 bp, Homo sapiens
ccagccccacccccagc

SEQ ID NO: 764512 - DNA, 18 bp, Homo sapiens
ccagccccactcctctgc

SEQ ID NO: 764513 - DNA, 16 bp, Homo sapiens
ccagccccactgccag

SEQ ID NO: 764514 - DNA, 20 bp, Homo sapiens
ccagccccactgccagcagc

SEQ ID NO: 764515 - DNA, 13 bp, Homo sapiens
ccagccccaggcc

SEQ ID NO: 764516 - DNA, 14 bp, Homo sapiens
ccagccccaggcct

SEQ ID NO: 764517 - DNA, 16 bp, Homo sapiens
ccagccccaggcctgg

SEQ ID NO: 764518 - DNA, 19 bp, Homo sapiens
ccagcccccaggaagacat

SEQ ID NO: 764519 - DNA, 13 bp, Homo sapiens
ccagcccccccac

SEQ ID NO: 764520 - DNA, 16 bp, Homo sapiens
ccagcccccccaccca

SEQ ID NO: 764521 - DNA, 20 bp, Homo sapiens
ccagcccccccacccacccc

SEQ ID NO: 764522 - DNA, 20 bp, Homo sapiens
ccagcccccgccccagagtg

SEQ ID NO: 764523 - DNA, 16 bp, Homo sapiens
ccagccccctccagct

SEQ ID NO: 764524 - DNA, 21 bp, Homo sapiens
ccagccccgactccagccagc

SEQ ID NO: 764525 - DNA, 22 bp, Homo sapiens
ccagccccgactccagccagcg

SEQ ID NO: 764526 - DNA, 18 bp, Homo sapiens
ccagcccctaagccccgt

SEQ ID NO: 764527 - DNA, 21 bp, Homo sapiens
ccagcccctagaaacccaagc

SEQ ID NO: 764528 - DNA, 16 bp, Homo sapiens
ccagcccctcccacca

SEQ ID NO: 764529 - DNA, 14 bp, Homo sapiens
ccagcccctctggt

SEQ ID NO: 764530 - DNA, 17 bp, Homo sapiens
ccagcccctcttcccca

SEQ ID NO: 764531 - DNA, 18 bp, Homo sapiens
ccagcccctcttggagaa

SEQ ID NO: 764532 - DNA, 21 bp, Homo sapiens
ccagcccctcttggagaagtc

SEQ ID NO: 764533 - DNA, 14 bp, Homo sapiens
ccagcccctggggc

SEQ ID NO: 764534 - DNA, 11 bp, Homo sapiens
ccagcccctgt

SEQ ID NO: 764535 - DNA, 19 bp, Homo sapiens
ccagcccctgtatggcact

SEQ ID NO: 764536 - DNA, 21 bp, Homo sapiens
ccagccccttctcagaatcta

SEQ ID NO: 764537 - DNA, 15 bp, Homo sapiens
ccagccccttctccc

SEQ ID NO: 764538 - DNA, 16 bp, Homo sapiens
ccagccccttctccca

SEQ ID NO: 764539 - DNA, 19 bp, Homo sapiens
ccagccccttttctctgct

SEQ ID NO: 764540 - DNA, 22 bp, Homo sapiens
ccagccccttttctctgctctt

SEQ ID NO: 764541 - DNA, 17 bp, Homo sapiens
ccagcccgacagtgcca

SEQ ID NO: 764542 - DNA, 13 bp, Homo sapiens
ccagcccgcggcc

SEQ ID NO: 764543 - DNA, 17 bp, Homo sapiens
ccagcccggaggggact

SEQ ID NO: 764544 - DNA, 17 bp, Homo sapiens
ccagcccggcctgctcc

SEQ ID NO: 764545 - DNA, 20 bp, Homo sapiens
ccagcccgggagcctaggac

SEQ ID NO: 764546 - DNA, 21 bp, Homo sapiens
ccagcccgggagcctaggacc

SEQ ID NO: 764547 - DNA, 13 bp, Homo sapiens
ccagccctagctg

SEQ ID NO: 764548 - DNA, 14 bp, Homo sapiens
ccagccctagctgt

SEQ ID NO: 764549 - DNA, 23 bp, Homo sapiens
ccagccctagctgtcccatgggg

SEQ ID NO: 764550 - DNA, 21 bp, Homo sapiens
ccagccctccccatggagcca

SEQ ID NO: 764551 - DNA, 21 bp, Homo sapiens
ccagccctccccgcagtggga

SEQ ID NO: 764552 - DNA, 14 bp, Homo sapiens
ccagccctccctgt

SEQ ID NO: 764553 - DNA, 15 bp, Homo sapiens
ccagccctccctgtc

SEQ ID NO: 764554 - DNA, 18 bp, Homo sapiens
ccagccctccttcagggg

SEQ ID NO: 764555 - DNA, 13 bp, Homo sapiens
ccagccctgccca

SEQ ID NO: 764556 - DNA, 16 bp, Homo sapiens
ccagccctgcccaccc

SEQ ID NO: 764557 - DNA, 13 bp, Homo sapiens
ccagccctgctgg

SEQ ID NO: 764558 - DNA, 20 bp, Homo sapiens
ctttattttattgaaatgta

SEQ ID NO: 764559 - DNA, 12 bp, Homo sapiens
ctttattttccc

SEQ ID NO: 764560 - DNA, 19 bp, Homo sapiens
ctttatttttctctttctc

SEQ ID NO: 764561 - DNA, 15 bp, Homo sapiens
ctttatttttgtata

SEQ ID NO: 764562 - DNA, 14 bp, Homo sapiens
ctttatttttgtta

SEQ ID NO: 764563 - DNA, 21 bp, Homo sapiens
ctttatttttgttaatattaa

SEQ ID NO: 764564 - DNA, 19 bp, Homo sapiens
ctttcaaaaccttttgaaa

SEQ ID NO: 764565 - DNA, 16 bp, Homo sapiens
ctttcaaaccagcttc

SEQ ID NO: 764566 - DNA, 18 bp, Homo sapiens
ctttcaaaccagcttcat

SEQ ID NO: 764567 - DNA, 19 bp, Homo sapiens
ctttcaaatttagaaacta

SEQ ID NO: 764568 - DNA, 16 bp, Homo sapiens
ctttcaagatctaaat

SEQ ID NO: 764569 - DNA, 20 bp, Homo sapiens
ctttcaagcagtcgtgcctg

SEQ ID NO: 764570 - DNA, 14 bp, Homo sapiens
ctttcaaggaaagt

SEQ ID NO: 764571 - DNA, 15 bp, Homo sapiens
ctttcaaggctgggg

SEQ ID NO: 764572 - DNA, 18 bp, Homo sapiens
ctttcaaggctggggcat

SEQ ID NO: 764573 - DNA, 14 bp, Homo sapiens
ctgcctcctgctct

SEQ ID NO: 764574 - DNA, 15 bp, Homo sapiens
ctgcctcctgctctc

SEQ ID NO: 764575 - DNA, 20 bp, Homo sapiens
ctgcctcctgttttctccct

SEQ ID NO: 764576 - DNA, 15 bp, Homo sapiens
ctgcctcgaaacaca

SEQ ID NO: 764577 - DNA, 18 bp, Homo sapiens
ctgcctcgaaacacagaa

SEQ ID NO: 764578 - DNA, 12 bp, Homo sapiens
ctgcctcgaggg

SEQ ID NO: 764579 - DNA, 22 bp, Homo sapiens
ctgcctcgagggccgcctgcct

SEQ ID NO: 764580 - DNA, 22 bp, Homo sapiens
ctgcctcgctcaccgctggccc

SEQ ID NO: 764581 - DNA, 23 bp, Homo sapiens
ctgcctcgctcaccgctggccct

SEQ ID NO: 764582 - DNA, 14 bp, Homo sapiens
ctgcctctatgccc

SEQ ID NO: 764583 - DNA, 16 bp, Homo sapiens
ctgcctctatgccctg

SEQ ID NO: 764584 - DNA, 18 bp, Homo sapiens
ctgcctctatgccctgca

SEQ ID NO: 764585 - DNA, 19 bp, Homo sapiens
ctgcctctatgccctgcag

SEQ ID NO: 764586 - DNA, 22 bp, Homo sapiens
ctgcctctcatcaactgaatga

SEQ ID NO: 764587 - DNA, 15 bp, Homo sapiens
ctgcctctcccatca

SEQ ID NO: 764588 - DNA, 22 bp, Homo sapiens
ctgcctctcccatcacttccct

SEQ ID NO: 764589 - DNA, 15 bp, Homo sapiens
ctgcctctccccaaa

SEQ ID NO: 764590 - DNA, 14 bp, Homo sapiens
ctgcctctccctct

SEQ ID NO: 764591 - DNA, 15 bp, Homo sapiens
ctgcctctccctggg

SEQ ID NO: 764592 - DNA, 16 bp, Homo sapiens
ctgcctctcctcagga

SEQ ID NO: 764593 - DNA, 15 bp, Homo sapiens
ctgcctctcttcttc

SEQ ID NO: 764594 - DNA, 20 bp, Homo sapiens
ctgcctctcttcttcccctt

SEQ ID NO: 764595 - DNA, 21 bp, Homo sapiens
ctgcctctgacagcagcctgt

SEQ ID NO: 764596 - DNA, 18 bp, Homo sapiens
ctgcctctgaccccagca

SEQ ID NO: 764597 - DNA, 11 bp, Homo sapiens
ctgcctctgag

SEQ ID NO: 764598 - DNA, 11 bp, Homo sapiens
ctgcctctgct

SEQ ID NO: 764599 - DNA, 12 bp, Homo sapiens
ctgcctctgctc

SEQ ID NO: 764600 - DNA, 13 bp, Homo sapiens
ctgcctctgctcc

SEQ ID NO: 764601 - DNA, 20 bp, Homo sapiens
ctgcctctggaaaactattg

SEQ ID NO: 764602 - DNA, 14 bp, Homo sapiens
ctgcctctgtggaa

SEQ ID NO: 764603 - DNA, 13 bp, Homo sapiens
ctgcctcttctct

SEQ ID NO: 764604 - DNA, 17 bp, Homo sapiens
ctgcctcttctgggagg

SEQ ID NO: 764605 - DNA, 18 bp, Homo sapiens
ctgcctcttggcctcacg

SEQ ID NO: 764606 - DNA, 14 bp, Homo sapiens
ctgcctcttggctt

SEQ ID NO: 764607 - DNA, 19 bp, Homo sapiens
ctgcctctttccctaggaa

SEQ ID NO: 764608 - DNA, 16 bp, Homo sapiens
ctgcctgaaacagcca

SEQ ID NO: 764609 - DNA, 18 bp, Homo sapiens
ctgcctgaaacagccatg

SEQ ID NO: 764610 - DNA, 18 bp, Homo sapiens
ctgcctgacactgagccc

SEQ ID NO: 764611 - DNA, 19 bp, Homo sapiens
ctgcctgacactgagcccc

SEQ ID NO: 764612 - DNA, 11 bp, Homo sapiens
ctgcctgaccc

SEQ ID NO: 764613 - DNA, 15 bp, Homo sapiens
ctgcctgagggcccc

SEQ ID NO: 764614 - DNA, 21 bp, Homo sapiens
ctgcctgagggcccctctgcc

SEQ ID NO: 764615 - DNA, 22 bp, Homo sapiens
ctgcctgagggcccctctgccc

SEQ ID NO: 764616 - DNA, 18 bp, Homo sapiens
ctgcctgatccctgaacc

SEQ ID NO: 764617 - DNA, 19 bp, Homo sapiens
ctgcctgcaatatttgaat

SEQ ID NO: 764618 - DNA, 14 bp, Homo sapiens
ctgcctgcactccc

SEQ ID NO: 764619 - DNA, 21 bp, Homo sapiens
ctgcctgcactccctggcctt

SEQ ID NO: 764620 - DNA, 22 bp, Homo sapiens
ctgcctgcagaggtctgtgctg

SEQ ID NO: 764621 - DNA, 14 bp, Homo sapiens
ctgcctgcagcaca

SEQ ID NO: 764622 - DNA, 18 bp, Homo sapiens
ctgcctgcagcacatgcg

SEQ ID NO: 764623 - DNA, 21 bp, Homo sapiens
ctgcctgcagtactttacctc

SEQ ID NO: 764624 - DNA, 19 bp, Homo sapiens
ctgcctgcatggcatcaga

SEQ ID NO: 764625 - DNA, 12 bp, Homo sapiens
ctgcctgcccac

SEQ ID NO: 764626 - DNA, 19 bp, Homo sapiens
ctgcctgcccacttagccg

SEQ ID NO: 764627 - DNA, 16 bp, Homo sapiens
ctgcctgccccacacg

SEQ ID NO: 764628 - DNA, 20 bp, Homo sapiens
ctgcctgccccacacggact

SEQ ID NO: 764629 - DNA, 19 bp, Homo sapiens
ctgcctgccccacccaccc

SEQ ID NO: 764630 - DNA, 22 bp, Homo sapiens
ctgcctgccccacccaccccac

SEQ ID NO: 764631 - DNA, 15 bp, Homo sapiens
ctgcctgccccccag

SEQ ID NO: 764632 - DNA, 14 bp, Homo sapiens
ctgcctgccccgcc

SEQ ID NO: 764633 - DNA, 21 bp, Homo sapiens
ctgcctgccccgcccccagtc

SEQ ID NO: 764634 - DNA, 22 bp, Homo sapiens
ctgcctgccccgcccccagtcc

SEQ ID NO: 764635 - DNA, 16 bp, Homo sapiens
ctgcctgccgctgcac

SEQ ID NO: 764636 - DNA, 20 bp, Homo sapiens
ctgcctgccgctgcaggaaa

SEQ ID NO: 764637 - DNA, 15 bp, Homo sapiens
ctgcctgcctccacc

SEQ ID NO: 764638 - DNA, 19 bp, Homo sapiens
ctgcctgcctcctccctcc

SEQ ID NO: 764639 - DNA, 16 bp, Homo sapiens
ctgcctgccttggcct

SEQ ID NO: 764640 - DNA, 14 bp, Homo sapiens
ctgcctgcggccca

SEQ ID NO: 764641 - DNA, 15 bp, Homo sapiens
ctgcctgctccttgg

SEQ ID NO: 764642 - DNA, 17 bp, Homo sapiens
ctgcctgctgtgctggg

SEQ ID NO: 764643 - DNA, 21 bp, Homo sapiens
ctgcctggatgaggcacttct

SEQ ID NO: 764644 - DNA, 22 bp, Homo sapiens
ctgcctggcacagaccaggcct

SEQ ID NO: 764645 - DNA, 16 bp, Homo sapiens
ctgcctggccactgct

SEQ ID NO: 764646 - DNA, 15 bp, Homo sapiens
ctgcctggccaggca

SEQ ID NO: 764647 - DNA, 21 bp, Homo sapiens
ctgcctggccaggcagatctg

SEQ ID NO: 764648 - DNA, 13 bp, Homo sapiens
ctgcctggccatg

SEQ ID NO: 764649 - DNA, 19 bp, Homo sapiens
ctgcctggccatgctgtcc

SEQ ID NO: 764650 - DNA, 21 bp, Homo sapiens
ctgcctggccatgctgtccct

SEQ ID NO: 764651 - DNA, 12 bp, Homo sapiens
ctgcctggcccc

SEQ ID NO: 764652 - DNA, 13 bp, Homo sapiens
ctgcctggcctgg

SEQ ID NO: 764653 - DNA, 17 bp, Homo sapiens
ctgcctgggatgggctc

SEQ ID NO: 764654 - DNA, 11 bp, Homo sapiens
ctgcctgggcc

SEQ ID NO: 764655 - DNA, 22 bp, Homo sapiens
ctgcctgggccatgcgaggggc

SEQ ID NO: 764656 - DNA, 20 bp, Homo sapiens
ctgcctgggccgtggcacag

SEQ ID NO: 764657 - DNA, 15 bp, Homo sapiens
ctgcctgggcctgtg

SEQ ID NO: 764658 - DNA, 16 bp, Homo sapiens
ctgcctgggcctgtgc

SEQ ID NO: 764659 - DNA, 20 bp, Homo sapiens
ctgcctgggcctgtgcagca

SEQ ID NO: 764660 - DNA, 13 bp, Homo sapiens
ctgcctgggcctt

SEQ ID NO: 764661 - DNA, 21 bp, Homo sapiens
ctgcctgggccttggctgggc

SEQ ID NO: 764662 - DNA, 12 bp, Homo sapiens
ctgcctgggctg

SEQ ID NO: 764663 - DNA, 21 bp, Homo sapiens
ctgcctgggctgttggcactc

SEQ ID NO: 764664 - DNA, 24 bp, Homo sapiens
ctgcctgggctgttggcactcaca

SEQ ID NO: 764665 - DNA, 22 bp, Homo sapiens
ctgcctggggcctccagaagct

SEQ ID NO: 764666 - DNA, 21 bp, Homo sapiens
ctgcctggggtggcctggccc

SEQ ID NO: 764667 - DNA, 16 bp, Homo sapiens
ctgcctggtctgtctg

SEQ ID NO: 764668 - DNA, 17 bp, Homo sapiens
ctgcctggtctgtctgg

SEQ ID NO: 764669 - DNA, 18 bp, Homo sapiens
ctgcctggtctgtctgga

SEQ ID NO: 764670 - DNA, 19 bp, Homo sapiens
ctgcctggttttatttata

SEQ ID NO: 764671 - DNA, 20 bp, Homo sapiens
ctgcctgtagcaatggccag

SEQ ID NO: 764672 - DNA, 18 bp, Homo sapiens
ctgcctgtagttaggaaa

SEQ ID NO: 764673 - DNA, 18 bp, Homo sapiens
ctgcctgtcacctgggag

SEQ ID NO: 764674 - DNA, 12 bp, Homo sapiens
ctgcctgtcccc

SEQ ID NO: 764675 - DNA, 13 bp, Homo sapiens
ctgcctgtcccca

SEQ ID NO: 764676 - DNA, 21 bp, Homo sapiens
ctgcctgtccccaaacaggac

SEQ ID NO: 764677 - DNA, 17 bp, Homo sapiens
ctgcctgtccccatgct

SEQ ID NO: 764678 - DNA, 16 bp, Homo sapiens
ctgcctgtccctctca

SEQ ID NO: 764679 - DNA, 20 bp, Homo sapiens
ctgcctgtccctctcaggca

SEQ ID NO: 764680 - DNA, 23 bp, Homo sapiens
ctgcctgtccctctcaggcatgc

SEQ ID NO: 764681 - DNA, 12 bp, Homo sapiens
ctgcctgtctgc

SEQ ID NO: 764682 - DNA, 13 bp, Homo sapiens
ctgcctgtctgcc

SEQ ID NO: 764683 - DNA, 13 bp, Homo sapiens
ctgcctgtgcatg

SEQ ID NO: 764684 - DNA, 19 bp, Homo sapiens
ctgcctgtgccatgcccaa

SEQ ID NO: 764685 - DNA, 13 bp, Homo sapiens
ctgcctgtgcccg

SEQ ID NO: 764686 - DNA, 13 bp, Homo sapiens
ctgcctgtggcct

SEQ ID NO: 764687 - DNA, 23 bp, Homo sapiens
ctgcctgtggccttgcccgccag

SEQ ID NO: 764688 - DNA, 22 bp, Homo sapiens
ctgcctgtggcgccgtctccag

SEQ ID NO: 764689 - DNA, 17 bp, Homo sapiens
ctgcctgttataactct

SEQ ID NO: 764690 - DNA, 20 bp, Homo sapiens
ctgcctgttataactctgca

SEQ ID NO: 764691 - DNA, 15 bp, Homo sapiens
ctgcctgttcccatt

SEQ ID NO: 764692 - DNA, 16 bp, Homo sapiens
ctgcctgttggcaggc

SEQ ID NO: 764693 - DNA, 18 bp, Homo sapiens
ctgccttaaaaccaaaga

SEQ ID NO: 764694 - DNA, 17 bp, Homo sapiens
ctgccttaaacacacat

SEQ ID NO: 764695 - DNA, 16 bp, Homo sapiens
ctgccttactggtttc

SEQ ID NO: 764696 - DNA, 23 bp, Homo sapiens
ctgccttactggtttccccaggg

SEQ ID NO: 764697 - DNA, 18 bp, Homo sapiens
ctgccttagcctcttgga

SEQ ID NO: 764698 - DNA, 20 bp, Homo sapiens
caggcagagagtacagactg

SEQ ID NO: 764699 - DNA, 13 bp, Homo sapiens
caggcagagctga

SEQ ID NO: 764700 - DNA, 17 bp, Homo sapiens
caggcagaggttttaat

SEQ ID NO: 764701 - DNA, 22 bp, Homo sapiens
caggcagaggttttaatgtctg

SEQ ID NO: 764702 - DNA, 21 bp, Homo sapiens
caggcagagtggcgtggcctc

SEQ ID NO: 764703 - DNA, 23 bp, Homo sapiens
caggcagagtggcgtggcctccc

SEQ ID NO: 764704 - DNA, 17 bp, Homo sapiens
caggcagatctgtgccc

SEQ ID NO: 764705 - DNA, 14 bp, Homo sapiens
caggcagcactgac

SEQ ID NO: 764706 - DNA, 17 bp, Homo sapiens
caggcagcagacacatg

SEQ ID NO: 764707 - DNA, 16 bp, Homo sapiens
caggcagcccagcagt

SEQ ID NO: 764708 - DNA, 11 bp, Homo sapiens
caggcagcctc

SEQ ID NO: 764709 - DNA, 17 bp, Homo sapiens
caggcagcctcctttgt

SEQ ID NO: 764710 - DNA, 13 bp, Homo sapiens
caggcagccttga

SEQ ID NO: 764711 - DNA, 16 bp, Homo sapiens
caggcagcgcagggct

SEQ ID NO: 764712 - DNA, 18 bp, Homo sapiens
caggcagcgcagggctgg

SEQ ID NO: 764713 - DNA, 19 bp, Homo sapiens
caggcagcgcagggctggc

SEQ ID NO: 764714 - DNA, 13 bp, Homo sapiens
caggcagcgccaa

SEQ ID NO: 764715 - DNA, 20 bp, Homo sapiens
caggcagcgccaagtgcgtg

SEQ ID NO: 764716 - DNA, 16 bp, Homo sapiens
caggcagctatttcag

SEQ ID NO: 764717 - DNA, 22 bp, Homo sapiens
caggcagctatttcagcctcct

SEQ ID NO: 764718 - DNA, 10 bp, Homo sapiens
caggcagctc

SEQ ID NO: 764719 - DNA, 17 bp, Homo sapiens
caggcagctccctcctg

SEQ ID NO: 764720 - DNA, 14 bp, Homo sapiens
caggcagctcgagg

SEQ ID NO: 764721 - DNA, 15 bp, Homo sapiens
caggcagctgagacc

SEQ ID NO: 764722 - DNA, 13 bp, Homo sapiens
caggcagcttcca

SEQ ID NO: 764723 - DNA, 18 bp, Homo sapiens
caggcaggcactgtggcc

SEQ ID NO: 764724 - DNA, 20 bp, Homo sapiens
caggcaggccagatggcccc

SEQ ID NO: 764725 - DNA, 13 bp, Homo sapiens
caggcaggccagg

SEQ ID NO: 764726 - DNA, 23 bp, Homo sapiens
caggcaggcgggccggggcaggg

SEQ ID NO: 764727 - DNA, 16 bp, Homo sapiens
caggcagggagaaggg

SEQ ID NO: 764728 - DNA, 17 bp, Homo sapiens
caggcagggagaagggc

SEQ ID NO: 764729 - DNA, 14 bp, Homo sapiens
caggcagggagggc

SEQ ID NO: 764730 - DNA, 22 bp, Homo sapiens
caggcagggccaacccttctcc

SEQ ID NO: 764731 - DNA, 16 bp, Homo sapiens
caggcagggctgcaga

SEQ ID NO: 764732 - DNA, 11 bp, Homo sapiens
caggcaggggc

SEQ ID NO: 764733 - DNA, 13 bp, Homo sapiens
caggcaggggcat

SEQ ID NO: 764734 - DNA, 16 bp, Homo sapiens
caggcaggggcccact

SEQ ID NO: 764735 - DNA, 22 bp, Homo sapiens
caggcaggggcccacttggggc

SEQ ID NO: 764736 - DNA, 21 bp, Homo sapiens
caggcaggggtgagagcaccc

SEQ ID NO: 764737 - DNA, 23 bp, Homo sapiens
caggcaggggtgggggtggaggc

SEQ ID NO: 764738 - DNA, 14 bp, Homo sapiens
caggcaggtcacag

SEQ ID NO: 764739 - DNA, 14 bp, Homo sapiens
caggcaggtctgca

SEQ ID NO: 764740 - DNA, 17 bp, Homo sapiens
caggcagtccaggcctc

SEQ ID NO: 764741 - DNA, 23 bp, Homo sapiens
caggcagtccaggcctctctctg

SEQ ID NO: 764742 - DNA, 16 bp, Homo sapiens
caggcagtcgggggct

SEQ ID NO: 764743 - DNA, 18 bp, Homo sapiens
caggcagtcgggggctgg

SEQ ID NO: 764744 - DNA, 21 bp, Homo sapiens
caggcagtcgggggctggcct

SEQ ID NO: 764745 - DNA, 22 bp, Homo sapiens
caggcagtcgggggctggccta

SEQ ID NO: 764746 - DNA, 23 bp, Homo sapiens
caggcagtcgggggctggcctag

SEQ ID NO: 764747 - DNA, 24 bp, Homo sapiens
caggcagtcgggggctggcctagg

SEQ ID NO: 764748 - DNA, 17 bp, Homo sapiens
caggcagttaggtgctg

SEQ ID NO: 764749 - DNA, 18 bp, Homo sapiens
caggcatagaggcttctc

SEQ ID NO: 764750 - DNA, 19 bp, Homo sapiens
caggcatagaggcttctcc

SEQ ID NO: 764751 - DNA, 23 bp, Homo sapiens
caggcatagaggcttctccgcca

SEQ ID NO: 764752 - DNA, 16 bp, Homo sapiens
caggcataggcctggg

SEQ ID NO: 764753 - DNA, 19 bp, Homo sapiens
caggcataggcctgggtgc

SEQ ID NO: 764754 - DNA, 13 bp, Homo sapiens
caggcatctcctt

SEQ ID NO: 764755 - DNA, 20 bp, Homo sapiens
caggcatctgttagcagagt

SEQ ID NO: 764756 - DNA, 23 bp, Homo sapiens
caggcatctgttagcagagtctg

SEQ ID NO: 764757 - DNA, 14 bp, Homo sapiens
caggcatgagccac

SEQ ID NO: 764758 - DNA, 18 bp, Homo sapiens
caggcatgagccactgca

SEQ ID NO: 764759 - DNA, 19 bp, Homo sapiens
caggcatgcagctgcctgg

SEQ ID NO: 764760 - DNA, 20 bp, Homo sapiens
caggcatgcagctgcctggg

SEQ ID NO: 764761 - DNA, 23 bp, Homo sapiens
caggcatgggtgcaaggaaaatt

SEQ ID NO: 764762 - DNA, 17 bp, Homo sapiens
caggcatggtggcccac

SEQ ID NO: 764763 - DNA, 18 bp, Homo sapiens
caggcatgtgccaccacg

SEQ ID NO: 764764 - DNA, 15 bp, Homo sapiens
caggcattcctgaag

SEQ ID NO: 764765 - DNA, 18 bp, Homo sapiens
caggcattcctgaaggga

SEQ ID NO: 764766 - DNA, 14 bp, Homo sapiens
caggcattgaggaa

SEQ ID NO: 764767 - DNA, 22 bp, Homo sapiens
caggcattgctttgccctggag

SEQ ID NO: 764768 - DNA, 23 bp, Homo sapiens
caggcattgctttgccctggagc

SEQ ID NO: 764769 - DNA, 15 bp, Homo sapiens
caggcattggatatt

SEQ ID NO: 764770 - DNA, 16 bp, Homo sapiens
caggcatttagccctc

SEQ ID NO: 764771 - DNA, 15 bp, Homo sapiens
caggcatttgccaag

SEQ ID NO: 764772 - DNA, 19 bp, Homo sapiens
caggccaagagcagaggca

SEQ ID NO: 764773 - DNA, 23 bp, Homo sapiens
caggccaagagcagaggcagcga

SEQ ID NO: 764774 - DNA, 18 bp, Homo sapiens
caggccaagcccaataca

SEQ ID NO: 764775 - DNA, 13 bp, Homo sapiens
caggccaccagga

SEQ ID NO: 764776 - DNA, 15 bp, Homo sapiens
caggccaccaggatg

SEQ ID NO: 764777 - DNA, 16 bp, Homo sapiens
caggccaccaggatgg

SEQ ID NO: 764778 - DNA, 14 bp, Homo sapiens
caggccaccctcca

SEQ ID NO: 764779 - DNA, 12 bp, Homo sapiens
caggccacctcc

SEQ ID NO: 764780 - DNA, 19 bp, Homo sapiens
caggccacctccccagcat

SEQ ID NO: 764781 - DNA, 19 bp, Homo sapiens
caggccacctgcccccttc

SEQ ID NO: 764782 - DNA, 23 bp, Homo sapiens
caggccacctgcccccttctccc

SEQ ID NO: 764783 - DNA, 18 bp, Homo sapiens
caggccactagtgacagt

SEQ ID NO: 764784 - DNA, 14 bp, Homo sapiens
caggccactgtggc

SEQ ID NO: 764785 - DNA, 18 bp, Homo sapiens
caggccactgtggccaga

SEQ ID NO: 764786 - DNA, 21 bp, Homo sapiens
caggccactgtggccagagct

SEQ ID NO: 764787 - DNA, 23 bp, Homo sapiens
caggccactgtggccagagctgg

SEQ ID NO: 764788 - DNA, 15 bp, Homo sapiens
caggccacttgatga

SEQ ID NO: 764789 - DNA, 11 bp, Homo sapiens
caggccagatg

SEQ ID NO: 764790 - DNA, 16 bp, Homo sapiens
caggccagatggcccc

SEQ ID NO: 764791 - DNA, 23 bp, Homo sapiens
caggccagatggcccctccactg

SEQ ID NO: 764792 - DNA, 17 bp, Homo sapiens
caggccagcccagccag

SEQ ID NO: 764793 - DNA, 17 bp, Homo sapiens
caggccagcccccccac

SEQ ID NO: 764794 - DNA, 19 bp, Homo sapiens
caggccagcccccccaccc

SEQ ID NO: 764795 - DNA, 11 bp, Homo sapiens
caggccagcct

SEQ ID NO: 764796 - DNA, 17 bp, Homo sapiens
ctctggaatgtttttcc

SEQ ID NO: 764797 - DNA, 16 bp, Homo sapiens
ctctggacaaagcgtt

SEQ ID NO: 764798 - DNA, 21 bp, Homo sapiens
ctctggacaatctcacacctt

SEQ ID NO: 764799 - DNA, 19 bp, Homo sapiens
ctctggacactctatatgt

SEQ ID NO: 764800 - DNA, 17 bp, Homo sapiens
ctctggacagcagaagc

SEQ ID NO: 764801 - DNA, 13 bp, Homo sapiens
ctctggacctcag

SEQ ID NO: 764802 - DNA, 18 bp, Homo sapiens
ctctggacctcaggaggg

SEQ ID NO: 764803 - DNA, 20 bp, Homo sapiens
ctctggacctcaggagggca

SEQ ID NO: 764804 - DNA, 21 bp, Homo sapiens
ctctggacctcaggagggcag

SEQ ID NO: 764805 - DNA, 15 bp, Homo sapiens
ctctggacggcaggc

SEQ ID NO: 764806 - DNA, 15 bp, Homo sapiens
ctctggactggcctg

SEQ ID NO: 764807 - DNA, 19 bp, Homo sapiens
ctctggactggctagagtc

SEQ ID NO: 764808 - DNA, 22 bp, Homo sapiens
ctctggagaggaagccagtgga

SEQ ID NO: 764809 - DNA, 11 bp, Homo sapiens
ctctggagcag

SEQ ID NO: 764810 - DNA, 13 bp, Homo sapiens
ctctggagcagcc

SEQ ID NO: 764811 - DNA, 14 bp, Homo sapiens
ctctggagcatttc

SEQ ID NO: 764812 - DNA, 15 bp, Homo sapiens
ctctggagcatttct

SEQ ID NO: 764813 - DNA, 13 bp, Homo sapiens
ctctggagcccct

SEQ ID NO: 764814 - DNA, 16 bp, Homo sapiens
ctctggagcccctcct

SEQ ID NO: 764815 - DNA, 21 bp, Homo sapiens
ctctggaggaagttctccagc

SEQ ID NO: 764816 - DNA, 20 bp, Homo sapiens
ctctggaggcctctggccct

SEQ ID NO: 764817 - DNA, 14 bp, Homo sapiens
ctctggaggggagg

SEQ ID NO: 764818 - DNA, 15 bp, Homo sapiens
ctctggaggggaggg

SEQ ID NO: 764819 - DNA, 20 bp, Homo sapiens
ctctggaggggtgtggctcc

SEQ ID NO: 764820 - DNA, 21 bp, Homo sapiens
ctctggaggggtgtggctcct

SEQ ID NO: 764821 - DNA, 18 bp, Homo sapiens
ctctggaggtgctgctct

SEQ ID NO: 764822 - DNA, 12 bp, Homo sapiens
ctctggagtggc

SEQ ID NO: 764823 - DNA, 15 bp, Homo sapiens
ctctggagtggccac

SEQ ID NO: 764824 - DNA, 22 bp, Homo sapiens
ctctggatcaaagtaggcagga

SEQ ID NO: 764825 - DNA, 15 bp, Homo sapiens
ctctggatcctgcac

SEQ ID NO: 764826 - DNA, 17 bp, Homo sapiens
ctctggatcctgcactc

SEQ ID NO: 764827 - DNA, 23 bp, Homo sapiens
ctctggatggaacgggcatgggc

SEQ ID NO: 764828 - DNA, 20 bp, Homo sapiens
ctctggatggcaccagaggc

SEQ ID NO: 764829 - DNA, 16 bp, Homo sapiens
ctctggattcagcctt

SEQ ID NO: 764830 - DNA, 18 bp, Homo sapiens
ctctggattcagccttct

SEQ ID NO: 764831 - DNA, 18 bp, Homo sapiens
ctctggattcccttttga

SEQ ID NO: 764832 - DNA, 23 bp, Homo sapiens
ctctggattgggacgcacagtgc

SEQ ID NO: 764833 - DNA, 14 bp, Homo sapiens
ctctggattttgaa

SEQ ID NO: 764834 - DNA, 22 bp, Homo sapiens
ctctggcacagtgatgccgggc

SEQ ID NO: 764835 - DNA, 13 bp, Homo sapiens
ctctggcaccaca

SEQ ID NO: 764836 - DNA, 19 bp, Homo sapiens
ctctggcaggcttccccct

SEQ ID NO: 764837 - DNA, 16 bp, Homo sapiens
ctctggccaaatatgc

SEQ ID NO: 764838 - DNA, 16 bp, Homo sapiens
ctctggccaccctggc

SEQ ID NO: 764839 - DNA, 19 bp, Homo sapiens
ctctggcccagaaagcctc

SEQ ID NO: 764840 - DNA, 21 bp, Homo sapiens
ctctggccctggggtgtgtct

SEQ ID NO: 764841 - DNA, 13 bp, Homo sapiens
ctctggcccttgg

SEQ ID NO: 764842 - DNA, 13 bp, Homo sapiens
ctctggcctccca

SEQ ID NO: 764843 - DNA, 15 bp, Homo sapiens
ctctggccttttcct

SEQ ID NO: 764844 - DNA, 16 bp, Homo sapiens
ctctggcggcttcctg

SEQ ID NO: 764845 - DNA, 19 bp, Homo sapiens
ctctggcggtggccacagc

SEQ ID NO: 764846 - DNA, 19 bp, Homo sapiens
ctctggctagaggccagcc

SEQ ID NO: 764847 - DNA, 22 bp, Homo sapiens
ctctggctagaggccagcccca

SEQ ID NO: 764848 - DNA, 19 bp, Homo sapiens
ctctggctcagcctgtctc

SEQ ID NO: 764849 - DNA, 15 bp, Homo sapiens
ctctggctccagctg

SEQ ID NO: 764850 - DNA, 16 bp, Homo sapiens
ctctggctccagctgg

SEQ ID NO: 764851 - DNA, 15 bp, Homo sapiens
ctctggctgaaccct

SEQ ID NO: 764852 - DNA, 13 bp, Homo sapiens
ctctggctggtct

SEQ ID NO: 764853 - DNA, 13 bp, Homo sapiens
ctctggcttccag

SEQ ID NO: 764854 - DNA, 20 bp, Homo sapiens
ctctggcttctgaagagcct

SEQ ID NO: 764855 - DNA, 15 bp, Homo sapiens
ctctggcttgcccca

SEQ ID NO: 764856 - DNA, 18 bp, Homo sapiens
ctctggcttgccccagga

SEQ ID NO: 764857 - DNA, 23 bp, Homo sapiens
ctctggcttgccccaggactctg

SEQ ID NO: 764858 - DNA, 22 bp, Homo sapiens
ctctggctttcccaggagatgg

SEQ ID NO: 764859 - DNA, 15 bp, Homo sapiens
ctctgggaacctccc

SEQ ID NO: 764860 - DNA, 17 bp, Homo sapiens
ctctgggaacctcccag

SEQ ID NO: 764861 - DNA, 14 bp, Homo sapiens
ctctgggagaaaat

SEQ ID NO: 764862 - DNA, 20 bp, Homo sapiens
ctctgggagaaaatcatcaa

SEQ ID NO: 764863 - DNA, 16 bp, Homo sapiens
ctctgggagagccagc

SEQ ID NO: 764864 - DNA, 17 bp, Homo sapiens
ctctgggagagccagct

SEQ ID NO: 764865 - DNA, 18 bp, Homo sapiens
ctctgggagagccagctt

SEQ ID NO: 764866 - DNA, 22 bp, Homo sapiens
ctctgggagagccagctttgct

SEQ ID NO: 764867 - DNA, 21 bp, Homo sapiens
ctctgggagtccccatcccat

SEQ ID NO: 764868 - DNA, 20 bp, Homo sapiens
ctctgggatgtgtagccttc

SEQ ID NO: 764869 - DNA, 22 bp, Homo sapiens
ctctgggatgtgtagccttctc

SEQ ID NO: 764870 - DNA, 18 bp, Homo sapiens
ctctgggatttatgctca

SEQ ID NO: 764871 - DNA, 18 bp, Homo sapiens
ctctgggcacagtgctgc

SEQ ID NO: 764872 - DNA, 20 bp, Homo sapiens
ctctgggcacagtgctgccc

SEQ ID NO: 764873 - DNA, 23 bp, Homo sapiens
ctctgggcagcctgctttggcct

SEQ ID NO: 764874 - DNA, 20 bp, Homo sapiens
ctctgggccattctccacag

SEQ ID NO: 764875 - DNA, 10 bp, Homo sapiens
ctctgggcct

SEQ ID NO: 764876 - DNA, 20 bp, Homo sapiens
ctctgggcctctttttgccc

SEQ ID NO: 764877 - DNA, 17 bp, Homo sapiens
ctctgggcctgtgtgtg

SEQ ID NO: 764878 - DNA, 21 bp, Homo sapiens
ctctgggcctgtgtgtgggtg

SEQ ID NO: 764879 - DNA, 17 bp, Homo sapiens
ctctgggctatggacac

SEQ ID NO: 764880 - DNA, 21 bp, Homo sapiens
ctctgggctatggacacaggg

SEQ ID NO: 764881 - DNA, 12 bp, Homo sapiens
ctctgggctcag

SEQ ID NO: 764882 - DNA, 15 bp, Homo sapiens
ctctgggctcagggc

SEQ ID NO: 764883 - DNA, 18 bp, Homo sapiens
ctcttaatattgagaatc

SEQ ID NO: 764884 - DNA, 19 bp, Homo sapiens
ctcttaatattgagaatca

SEQ ID NO: 764885 - DNA, 12 bp, Homo sapiens
ctcttaatctgt

SEQ ID NO: 764886 - DNA, 13 bp, Homo sapiens
ctcttaatctgtg

SEQ ID NO: 764887 - DNA, 17 bp, Homo sapiens
ctcttacagctttgcct

SEQ ID NO: 764888 - DNA, 13 bp, Homo sapiens
ctcttacattttc

SEQ ID NO: 764889 - DNA, 18 bp, Homo sapiens
ctcttaccgtagcctccg

SEQ ID NO: 764890 - DNA, 20 bp, Homo sapiens
ctcttacctgttatttatca

SEQ ID NO: 764891 - DNA, 18 bp, Homo sapiens
ctcttactacactgagga

SEQ ID NO: 764892 - DNA, 18 bp, Homo sapiens
ctcttactctttcctatt

SEQ ID NO: 764893 - DNA, 17 bp, Homo sapiens
ctcttactttgcttgag

SEQ ID NO: 764894 - DNA, 23 bp, Homo sapiens
ctcttactttgcttgagaatcct

SEQ ID NO: 764895 - DNA, 19 bp, Homo sapiens
ctcttacttttccagtctg

SEQ ID NO: 764896 - DNA, 23 bp, Homo sapiens
ctcttacttttccagtctgtaca

SEQ ID NO: 764897 - DNA, 23 bp, Homo sapiens
ctcttagaggaaggagataggga

SEQ ID NO: 764898 - DNA, 18 bp, Homo sapiens
ctcttagattcttaattc

SEQ ID NO: 764899 - DNA, 18 bp, Homo sapiens
ctcttagcaaaaacatgt

SEQ ID NO: 764900 - DNA, 18 bp, Homo sapiens
ctcttagcagcttccaga

SEQ ID NO: 764901 - DNA, 19 bp, Homo sapiens
ctcttagcagcttccagat

SEQ ID NO: 764902 - DNA, 21 bp, Homo sapiens
ctcttagctactgtatgcaaa

SEQ ID NO: 764903 - DNA, 13 bp, Homo sapiens
ctcttagctgagt

SEQ ID NO: 764904 - DNA, 16 bp, Homo sapiens
ctcttagtcccaagct

SEQ ID NO: 764905 - DNA, 18 bp, Homo sapiens
ctcttagtctaggtcctt

SEQ ID NO: 764906 - DNA, 16 bp, Homo sapiens
ctcttatagaatattt

SEQ ID NO: 764907 - DNA, 22 bp, Homo sapiens
ctcttatcctctctctcttcta

SEQ ID NO: 764908 - DNA, 18 bp, Homo sapiens
ctcttcaaaaagcagagt

SEQ ID NO: 764909 - DNA, 15 bp, Homo sapiens
ctcttcaaagcagag

SEQ ID NO: 764910 - DNA, 17 bp, Homo sapiens
ctcttcaaattagaaga

SEQ ID NO: 764911 - DNA, 17 bp, Homo sapiens
ctcttcaagcatcctca

SEQ ID NO: 764912 - DNA, 16 bp, Homo sapiens
ctcttcaatctctgga

SEQ ID NO: 764913 - DNA, 14 bp, Homo sapiens
ctcttcaatctctt

SEQ ID NO: 764914 - DNA, 22 bp, Homo sapiens
ctcttcacccctacactgtgaa

SEQ ID NO: 764915 - DNA, 17 bp, Homo sapiens
ctcttcactaccctgat

SEQ ID NO: 764916 - DNA, 21 bp, Homo sapiens
ctcttcactaccctgattctt

SEQ ID NO: 764917 - DNA, 17 bp, Homo sapiens
ctcttcactgtggccac

SEQ ID NO: 764918 - DNA, 14 bp, Homo sapiens
ctcttcacttgagt

SEQ ID NO: 764919 - DNA, 22 bp, Homo sapiens
ctcttcacttgagttggctgtg

SEQ ID NO: 764920 - DNA, 13 bp, Homo sapiens
ctcttcagaggcc

SEQ ID NO: 764921 - DNA, 23 bp, Homo sapiens
ctcttcaggaagaaaggagtctg

SEQ ID NO: 764922 - DNA, 13 bp, Homo sapiens
ctcttcaggaggc

SEQ ID NO: 764923 - DNA, 19 bp, Homo sapiens
ctcttcaggaggccctggt

SEQ ID NO: 764924 - DNA, 14 bp, Homo sapiens
ctcttcaggttctt

SEQ ID NO: 764925 - DNA, 19 bp, Homo sapiens
cagcaggcccagcatgcag

SEQ ID NO: 764926 - DNA, 14 bp, Homo sapiens
cagcaggcctccct

SEQ ID NO: 764927 - DNA, 16 bp, Homo sapiens
cagcaggcctctggtt

SEQ ID NO: 764928 - DNA, 20 bp, Homo sapiens
cagcaggcctctggttgcct

SEQ ID NO: 764929 - DNA, 13 bp, Homo sapiens
cagcaggctcctg

SEQ ID NO: 764930 - DNA, 15 bp, Homo sapiens
cagcaggctcctggc

SEQ ID NO: 764931 - DNA, 21 bp, Homo sapiens
cagcaggctcctggctgtgcc

SEQ ID NO: 764932 - DNA, 22 bp, Homo sapiens
cagcaggctcctggctgtgccc

SEQ ID NO: 764933 - DNA, 23 bp, Homo sapiens
cagcaggctcctggctgtgccca

SEQ ID NO: 764934 - DNA, 21 bp, Homo sapiens
cagcagggactgtaaacacag

SEQ ID NO: 764935 - DNA, 20 bp, Homo sapiens
cagcagggagggcttctgcc

SEQ ID NO: 764936 - DNA, 15 bp, Homo sapiens
cagcagggatgccct

SEQ ID NO: 764937 - DNA, 22 bp, Homo sapiens
cagcagggatgccctggaggtg

SEQ ID NO: 764938 - DNA, 16 bp, Homo sapiens
cagcagggccactccc

SEQ ID NO: 764939 - DNA, 11 bp, Homo sapiens
cagcagggcta

SEQ ID NO: 764940 - DNA, 19 bp, Homo sapiens
cagcagggctaccctgagc

SEQ ID NO: 764941 - DNA, 21 bp, Homo sapiens
cagcagggctaccctgagctg

SEQ ID NO: 764942 - DNA, 14 bp, Homo sapiens
cagcagggctgggc

SEQ ID NO: 764943 - DNA, 18 bp, Homo sapiens
cagcaggggggctgtgcc

SEQ ID NO: 764944 - DNA, 19 bp, Homo sapiens
cagcaggggggctgtgcca

SEQ ID NO: 764945 - DNA, 14 bp, Homo sapiens
cagcaggggtgtga

SEQ ID NO: 764946 - DNA, 20 bp, Homo sapiens
cagcagggtagtctggtttc

SEQ ID NO: 764947 - DNA, 17 bp, Homo sapiens
cagcagggtcttgctgt

SEQ ID NO: 764948 - DNA, 18 bp, Homo sapiens
cagcaggtgattggacca

SEQ ID NO: 764949 - DNA, 15 bp, Homo sapiens
cagcaggtgctgggc

SEQ ID NO: 764950 - DNA, 22 bp, Homo sapiens
cagcaggtgctgggctggactg

SEQ ID NO: 764951 - DNA, 16 bp, Homo sapiens
cagcaggtgtggtggc

SEQ ID NO: 764952 - DNA, 18 bp, Homo sapiens
cagcaggtgtggtggctc

SEQ ID NO: 764953 - DNA, 21 bp, Homo sapiens
cagcaggtgtggtggctcatg

SEQ ID NO: 764954 - DNA, 22 bp, Homo sapiens
cagcaggtgtggtggctcatgg

SEQ ID NO: 764955 - DNA, 19 bp, Homo sapiens
cagcagtcctttgtaaaca

SEQ ID NO: 764956 - DNA, 21 bp, Homo sapiens
cagcagtgaatgctagacaga

SEQ ID NO: 764957 - DNA, 15 bp, Homo sapiens
cagcagtgagactgg

SEQ ID NO: 764958 - DNA, 19 bp, Homo sapiens
cagcagtgagtctcttcag

SEQ ID NO: 764959 - DNA, 19 bp, Homo sapiens
cagcagtgatctcagggca

SEQ ID NO: 764960 - DNA, 21 bp, Homo sapiens
cagcagtgatctcagggcaga

SEQ ID NO: 764961 - DNA, 16 bp, Homo sapiens
cagcagtgtcatcaga

SEQ ID NO: 764962 - DNA, 14 bp, Homo sapiens
cagcagtgtggaga

SEQ ID NO: 764963 - DNA, 17 bp, Homo sapiens
cagcagtgtggagaccc

SEQ ID NO: 764964 - DNA, 18 bp, Homo sapiens
cagcagtgtggagaccct

SEQ ID NO: 764965 - DNA, 13 bp, Homo sapiens
cagcagtgttccc

SEQ ID NO: 764966 - DNA, 19 bp, Homo sapiens
cagcagtgttccccatctg

SEQ ID NO: 764967 - DNA, 20 bp, Homo sapiens
cagcagttttcaagtcaaat

SEQ ID NO: 764968 - DNA, 19 bp, Homo sapiens
cagcatagcaagacacatc

SEQ ID NO: 764969 - DNA, 15 bp, Homo sapiens
cagcatagcctgcct

SEQ ID NO: 764970 - DNA, 14 bp, Homo sapiens
cagcatagggggga

SEQ ID NO: 764971 - DNA, 19 bp, Homo sapiens
cagcataggggggagggtc

SEQ ID NO: 764972 - DNA, 21 bp, Homo sapiens
cagcatagggtcactttgcca

SEQ ID NO: 764973 - DNA, 19 bp, Homo sapiens
cagcatagtactggcacaa

SEQ ID NO: 764974 - DNA, 23 bp, Homo sapiens
cagcatcagggttaagaagactt

SEQ ID NO: 764975 - DNA, 20 bp, Homo sapiens
cagcatcatggaggtttgaa

SEQ ID NO: 764976 - DNA, 20 bp, Homo sapiens
cagcatcattttgcattcaa

SEQ ID NO: 764977 - DNA, 22 bp, Homo sapiens
cagcatcattttgcattcaaat

SEQ ID NO: 764978 - DNA, 13 bp, Homo sapiens
cagcatccagcct

SEQ ID NO: 764979 - DNA, 19 bp, Homo sapiens
cagcatcccagccagggtt

SEQ ID NO: 764980 - DNA, 19 bp, Homo sapiens
cagcatccctggagcagga

SEQ ID NO: 764981 - DNA, 21 bp, Homo sapiens
cagcatcccttcccacatgcc

SEQ ID NO: 764982 - DNA, 21 bp, Homo sapiens
cagcatcggacaagaccccca

SEQ ID NO: 764983 - DNA, 22 bp, Homo sapiens
cagcatcggacaagacccccag

SEQ ID NO: 764984 - DNA, 19 bp, Homo sapiens
cagcatcgggagcacccag

SEQ ID NO: 764985 - DNA, 17 bp, Homo sapiens
cagcatcgggggcctgc

SEQ ID NO: 764986 - DNA, 18 bp, Homo sapiens
cagcatcgggggcctgca

SEQ ID NO: 764987 - DNA, 17 bp, Homo sapiens
cagcatctcagcgccag

SEQ ID NO: 764988 - DNA, 13 bp, Homo sapiens
cagcatctcttct

SEQ ID NO: 764989 - DNA, 14 bp, Homo sapiens
cagcatctggctgt

SEQ ID NO: 764990 - DNA, 13 bp, Homo sapiens
cagcatgaataaa

SEQ ID NO: 764991 - DNA, 15 bp, Homo sapiens
cagcatgaataaaac

SEQ ID NO: 764992 - DNA, 24 bp, Homo sapiens
cagcatgaataaaacactcatccc

SEQ ID NO: 764993 - DNA, 18 bp, Homo sapiens
cagcatgacaaaaataac

SEQ ID NO: 764994 - DNA, 22 bp, Homo sapiens
cagcatgacaaaaataacactg

SEQ ID NO: 764995 - DNA, 23 bp, Homo sapiens
cagcatgacaaaaataacactgt

SEQ ID NO: 764996 - DNA, 16 bp, Homo sapiens
cagcatgagactttct

SEQ ID NO: 764997 - DNA, 17 bp, Homo sapiens
cagcatgcaccacgggc

SEQ ID NO: 764998 - DNA, 20 bp, Homo sapiens
cagcatgcccagattcccag

SEQ ID NO: 764999 - DNA, 16 bp, Homo sapiens
cagcatgccccttggc

SEQ ID NO: 765000 - DNA, 20 bp, Homo sapiens
cagcatgccccttggctgga

SEQ ID NO: 765001 - DNA, 23 bp, Homo sapiens
cagcatgccccttggctggatca

SEQ ID NO: 765002 - DNA, 14 bp, Homo sapiens
cagcatgcttgggc

SEQ ID NO: 765003 - DNA, 18 bp, Homo sapiens
cagcatggaaaaatggtt

SEQ ID NO: 765004 - DNA, 15 bp, Homo sapiens
ctctttagtataatt

SEQ ID NO: 765005 - DNA, 16 bp, Homo sapiens
ctctttatgcttgctt

SEQ ID NO: 765006 - DNA, 17 bp, Homo sapiens
ctctttatgcttgcttg

SEQ ID NO: 765007 - DNA, 14 bp, Homo sapiens
ctctttattgtctg

SEQ ID NO: 765008 - DNA, 16 bp, Homo sapiens
ctctttatttttctct

SEQ ID NO: 765009 - DNA, 12 bp, Homo sapiens
ctctttcaaaac

SEQ ID NO: 765010 - DNA, 11 bp, Homo sapiens
ctctttcaaag

SEQ ID NO: 765011 - DNA, 14 bp, Homo sapiens
ctctttcacattgt

SEQ ID NO: 765012 - DNA, 16 bp, Homo sapiens
ctctttcatttgctaa

SEQ ID NO: 765013 - DNA, 13 bp, Homo sapiens
ctctttccctgcg

SEQ ID NO: 765014 - DNA, 20 bp, Homo sapiens
ctctttcctatttcagtgtt

SEQ ID NO: 765015 - DNA, 20 bp, Homo sapiens
ctctttccttggctcccatt

SEQ ID NO: 765016 - DNA, 20 bp, Homo sapiens
ctctttctcaaagagggggc

SEQ ID NO: 765017 - DNA, 23 bp, Homo sapiens
ctctttctcaaagagggggctct

SEQ ID NO: 765018 - DNA, 13 bp, Homo sapiens
ctctttctctccc

SEQ ID NO: 765019 - DNA, 15 bp, Homo sapiens
ctctttctctccttt

SEQ ID NO: 765020 - DNA, 19 bp, Homo sapiens
ctctttctctcctttcttt

SEQ ID NO: 765021 - DNA, 13 bp, Homo sapiens
ctctttctctctt

SEQ ID NO: 765022 - DNA, 12 bp, Homo sapiens
ctctttctctgc

SEQ ID NO: 765023 - DNA, 15 bp, Homo sapiens
ctctttctctgccag

SEQ ID NO: 765024 - DNA, 12 bp, Homo sapiens
ctctttctcttt

SEQ ID NO: 765025 - DNA, 13 bp, Homo sapiens
ctctttctctttc

SEQ ID NO: 765026 - DNA, 14 bp, Homo sapiens
ctctttctctttct

SEQ ID NO: 765027 - DNA, 18 bp, Homo sapiens
ctctttctgaaggaagag

SEQ ID NO: 765028 - DNA, 14 bp, Homo sapiens
ctctttctgctctg

SEQ ID NO: 765029 - DNA, 17 bp, Homo sapiens
ctctttctggcctgcct

SEQ ID NO: 765030 - DNA, 12 bp, Homo sapiens
ctctttctgggc

SEQ ID NO: 765031 - DNA, 22 bp, Homo sapiens
ctctttgaaatagtctgtgtga

SEQ ID NO: 765032 - DNA, 20 bp, Homo sapiens
ctctttgaagaaaagaaaaa

SEQ ID NO: 765033 - DNA, 12 bp, Homo sapiens
ctctttgaattt

SEQ ID NO: 765034 - DNA, 19 bp, Homo sapiens
ctctttgacaactaaaatt

SEQ ID NO: 765035 - DNA, 23 bp, Homo sapiens
ctctttgacaattcctagataaa

SEQ ID NO: 765036 - DNA, 19 bp, Homo sapiens
ctctttgactgtcagcaag

SEQ ID NO: 765037 - DNA, 11 bp, Homo sapiens
ctctttgatta

SEQ ID NO: 765038 - DNA, 13 bp, Homo sapiens
ctctttgattatt

SEQ ID NO: 765039 - DNA, 17 bp, Homo sapiens
ctctttgctgcagagaa

SEQ ID NO: 765040 - DNA, 12 bp, Homo sapiens
ctctttgctttg

SEQ ID NO: 765041 - DNA, 13 bp, Homo sapiens
ctctttgctttgc

SEQ ID NO: 765042 - DNA, 15 bp, Homo sapiens
ctctttgctttgctt

SEQ ID NO: 765043 - DNA, 22 bp, Homo sapiens
ctctttgctttgctttctgctc

SEQ ID NO: 765044 - DNA, 21 bp, Homo sapiens
ctctttgggaatgtttgtctc

SEQ ID NO: 765045 - DNA, 22 bp, Homo sapiens
ctctttgggcctctcctgccct

SEQ ID NO: 765046 - DNA, 23 bp, Homo sapiens
ctctttgggggaaacgggctcct

SEQ ID NO: 765047 - DNA, 19 bp, Homo sapiens
ctctttggggtcagccagg

SEQ ID NO: 765048 - DNA, 19 bp, Homo sapiens
ctctttgggtccattcaga

SEQ ID NO: 765049 - DNA, 21 bp, Homo sapiens
ctctttggtggcatggaaggg

SEQ ID NO: 765050 - DNA, 14 bp, Homo sapiens
ctctttgtaataaa

SEQ ID NO: 765051 - DNA, 15 bp, Homo sapiens
ctctttgtaataaaa

SEQ ID NO: 765052 - DNA, 14 bp, Homo sapiens
ctctttgtgcagtg

SEQ ID NO: 765053 - DNA, 18 bp, Homo sapiens
ctctttgttatttgaaaa

SEQ ID NO: 765054 - DNA, 20 bp, Homo sapiens
ctctttgttcttcctgtctc

SEQ ID NO: 765055 - DNA, 18 bp, Homo sapiens
ctctttgtttctgtttct

SEQ ID NO: 765056 - DNA, 19 bp, Homo sapiens
ctcttttaatggcatttct

SEQ ID NO: 765057 - DNA, 13 bp, Homo sapiens
ctgagctgggccc

SEQ ID NO: 765058 - DNA, 11 bp, Homo sapiens
ctgagctgggg

SEQ ID NO: 765059 - DNA, 24 bp, Homo sapiens
ctgagctggggaggtgggaggcca

SEQ ID NO: 765060 - DNA, 12 bp, Homo sapiens
ctgagctggggc

SEQ ID NO: 765061 - DNA, 15 bp, Homo sapiens
ctgagctggggccac

SEQ ID NO: 765062 - DNA, 17 bp, Homo sapiens
ctgagctgggggaagaa

SEQ ID NO: 765063 - DNA, 11 bp, Homo sapiens
ctgagctgtga

SEQ ID NO: 765064 - DNA, 20 bp, Homo sapiens
ctgagctgtgacattgctgg

SEQ ID NO: 765065 - DNA, 22 bp, Homo sapiens
ctgagctgtgacattgctggtc

SEQ ID NO: 765066 - DNA, 17 bp, Homo sapiens
ctgagcttagccttgtg

SEQ ID NO: 765067 - DNA, 18 bp, Homo sapiens
ctgagcttagccttgtgc

SEQ ID NO: 765068 - DNA, 20 bp, Homo sapiens
ctgagcttagccttgtgccc

SEQ ID NO: 765069 - DNA, 15 bp, Homo sapiens
ctgagcttctctgtg

SEQ ID NO: 765070 - DNA, 14 bp, Homo sapiens
ctgagcttctgaga

SEQ ID NO: 765071 - DNA, 22 bp, Homo sapiens
ctgagcttgcagagatgaggcc

SEQ ID NO: 765072 - DNA, 15 bp, Homo sapiens
ctgagcttggaggaa

SEQ ID NO: 765073 - DNA, 16 bp, Homo sapiens
ctgagctttagacagc

SEQ ID NO: 765074 - DNA, 21 bp, Homo sapiens
ctgagctttagacagcagagc

SEQ ID NO: 765075 - DNA, 22 bp, Homo sapiens
ctgagctttggggacagttggc

SEQ ID NO: 765076 - DNA, 18 bp, Homo sapiens
ctgagcttttcatggaag

SEQ ID NO: 765077 - DNA, 22 bp, Homo sapiens
ctgaggaagcagttggggccct

SEQ ID NO: 765078 - DNA, 16 bp, Homo sapiens
ctgaggaattttcttt

SEQ ID NO: 765079 - DNA, 14 bp, Homo sapiens
ctgaggacaaagtg

SEQ ID NO: 765080 - DNA, 23 bp, Homo sapiens
ctgaggacaaagtggaggagggc

SEQ ID NO: 765081 - DNA, 17 bp, Homo sapiens
ctgaggacacaccccac

SEQ ID NO: 765082 - DNA, 14 bp, Homo sapiens
ctgaggacagctgt

SEQ ID NO: 765083 - DNA, 15 bp, Homo sapiens
ctgaggacagctgtc

SEQ ID NO: 765084 - DNA, 15 bp, Homo sapiens
ctgaggacaggctct

SEQ ID NO: 765085 - DNA, 23 bp, Homo sapiens
ctgaggacaggctctagagagag

SEQ ID NO: 765086 - DNA, 17 bp, Homo sapiens
caggaaaattgaatgca

SEQ ID NO: 765087 - DNA, 23 bp, Homo sapiens
caggaaacagttgcatgtagtaa

SEQ ID NO: 765088 - DNA, 20 bp, Homo sapiens
caggaaaccacaaccttgca

SEQ ID NO: 765089 - DNA, 19 bp, Homo sapiens
caggaaactccacatctgc

SEQ ID NO: 765090 - DNA, 23 bp, Homo sapiens
caggaaactccacatctgcctta

SEQ ID NO: 765091 - DNA, 21 bp, Homo sapiens
caggaaagccacatcttgctc

SEQ ID NO: 765092 - DNA, 14 bp, Homo sapiens
caggaaagccctcc

SEQ ID NO: 765093 - DNA, 15 bp, Homo sapiens
caggaaagccctccc

SEQ ID NO: 765094 - DNA, 20 bp, Homo sapiens
caggaaagcgcctccaaccc

SEQ ID NO: 765095 - DNA, 14 bp, Homo sapiens
caggaaaggctgta

SEQ ID NO: 765096 - DNA, 18 bp, Homo sapiens
caggaaagtgttattttt

SEQ ID NO: 765097 - DNA, 15 bp, Homo sapiens
caggaaatatatatg

SEQ ID NO: 765098 - DNA, 22 bp, Homo sapiens
caggaacacccgactcctcaaa

SEQ ID NO: 765099 - DNA, 13 bp, Homo sapiens
caggaacagaagg

SEQ ID NO: 765100 - DNA, 15 bp, Homo sapiens
caggaacagaaggat

SEQ ID NO: 765101 - DNA, 14 bp, Homo sapiens
caggaacagctatg

SEQ ID NO: 765102 - DNA, 22 bp, Homo sapiens
caggaacagctatgggagcccc

SEQ ID NO: 765103 - DNA, 19 bp, Homo sapiens
caggaacagtggctgggtg

SEQ ID NO: 765104 - DNA, 18 bp, Homo sapiens
caggaaccaaaaagagca

SEQ ID NO: 765105 - DNA, 23 bp, Homo sapiens
caggaaccaaaaagagcatccct

SEQ ID NO: 765106 - DNA, 16 bp, Homo sapiens
caggaaccacaccaca

SEQ ID NO: 765107 - DNA, 14 bp, Homo sapiens
caggaaccacagat

SEQ ID NO: 765108 - DNA, 17 bp, Homo sapiens
caggaaccagggcctcc

SEQ ID NO: 765109 - DNA, 20 bp, Homo sapiens
caggaaccagggcctccctg

SEQ ID NO: 765110 - DNA, 20 bp, Homo sapiens
caggaacccttgcatccatt

SEQ ID NO: 765111 - DNA, 22 bp, Homo sapiens
caggaaccgaacatatcatttg

SEQ ID NO: 765112 - DNA, 14 bp, Homo sapiens
caggaacgagcact

SEQ ID NO: 765113 - DNA, 15 bp, Homo sapiens
caggaacgagcactg

SEQ ID NO: 765114 - DNA, 22 bp, Homo sapiens
caggaacgctctcctcgagccc

SEQ ID NO: 765115 - DNA, 22 bp, Homo sapiens
caggaacggccctgcaggagca

SEQ ID NO: 765116 - DNA, 23 bp, Homo sapiens
caggaacggccctgcaggagcag

SEQ ID NO: 765117 - DNA, 14 bp, Homo sapiens
caggaactcccagc

SEQ ID NO: 765118 - DNA, 22 bp, Homo sapiens
caggaactctaaggtacacact

SEQ ID NO: 765119 - DNA, 17 bp, Homo sapiens
caggaactgcctgggcc

SEQ ID NO: 765120 - DNA, 13 bp, Homo sapiens
caggaactgggcc

SEQ ID NO: 765121 - DNA, 21 bp, Homo sapiens
caggaagaaatcacagaatca

SEQ ID NO: 765122 - DNA, 22 bp, Homo sapiens
caggaagaaatcacagaatcat

SEQ ID NO: 765123 - DNA, 13 bp, Homo sapiens
caggaagaagaga

SEQ ID NO: 765124 - DNA, 14 bp, Homo sapiens
caggaagagctatg

SEQ ID NO: 765125 - DNA, 12 bp, Homo sapiens
caggaagaggcc

SEQ ID NO: 765126 - DNA, 18 bp, Homo sapiens
caggaagatcccccagaa

SEQ ID NO: 765127 - DNA, 20 bp, Homo sapiens
caggaagatgtatgctttga

SEQ ID NO: 765128 - DNA, 14 bp, Homo sapiens
caggaagcacccca

SEQ ID NO: 765129 - DNA, 15 bp, Homo sapiens
caggaagcaccccat

SEQ ID NO: 765130 - DNA, 16 bp, Homo sapiens
caggaagcaccccatg

SEQ ID NO: 765131 - DNA, 12 bp, Homo sapiens
caggaagccaga

SEQ ID NO: 765132 - DNA, 14 bp, Homo sapiens
caggaagccagagc

SEQ ID NO: 765133 - DNA, 16 bp, Homo sapiens
caggaagcccaattgc

SEQ ID NO: 765134 - DNA, 23 bp, Homo sapiens
caggaagccgccagtacttgtca

SEQ ID NO: 765135 - DNA, 14 bp, Homo sapiens
caggaagccggtgc

SEQ ID NO: 765136 - DNA, 22 bp, Homo sapiens
caggaagccggtgcctgggtgg

SEQ ID NO: 765137 - DNA, 15 bp, Homo sapiens
caggaagccgtcctg

SEQ ID NO: 765138 - DNA, 16 bp, Homo sapiens
caggaagctctcttaa

SEQ ID NO: 765139 - DNA, 19 bp, Homo sapiens
caggaagctctcttaaaat

SEQ ID NO: 765140 - DNA, 19 bp, Homo sapiens
caggaagctttttgtatta

SEQ ID NO: 765141 - DNA, 16 bp, Homo sapiens
caggaaggaccccaca

SEQ ID NO: 765142 - DNA, 12 bp, Homo sapiens
caggaaggagag

SEQ ID NO: 765143 - DNA, 15 bp, Homo sapiens
caggaaggcagctgc

SEQ ID NO: 765144 - DNA, 16 bp, Homo sapiens
caggaaggcagctgct

SEQ ID NO: 765145 - DNA, 18 bp, Homo sapiens
caggaaggcagctgctct

SEQ ID NO: 765146 - DNA, 23 bp, Homo sapiens
caggaagggaaagcgggcagccc

SEQ ID NO: 765147 - DNA, 21 bp, Homo sapiens
caggaaggtaaaaacccagcg

SEQ ID NO: 765148 - DNA, 18 bp, Homo sapiens
caggaaggtgcctggcca

SEQ ID NO: 765149 - DNA, 16 bp, Homo sapiens
caggaagtaaaataaa

SEQ ID NO: 765150 - DNA, 21 bp, Homo sapiens
caggaagtcccttgccatcct

SEQ ID NO: 765151 - DNA, 20 bp, Homo sapiens
caggaagtgtttatgaggaa

SEQ ID NO: 765152 - DNA, 23 bp, Homo sapiens
caggaagtgtttatgaggaaaca

SEQ ID NO: 765153 - DNA, 17 bp, Homo sapiens
caggaatatatgtgtgc

SEQ ID NO: 765154 - DNA, 17 bp, Homo sapiens
caggaatattttccaaa

SEQ ID NO: 765155 - DNA, 14 bp, Homo sapiens
caggaatggctgca

SEQ ID NO: 765156 - DNA, 17 bp, Homo sapiens
caggaatgtgtggcaga

SEQ ID NO: 765157 - DNA, 17 bp, Homo sapiens
caggaatgtgtggcctg

SEQ ID NO: 765158 - DNA, 15 bp, Homo sapiens
caggaattctcaaga

SEQ ID NO: 765159 - DNA, 23 bp, Homo sapiens
caggaattctcaagacctgagta

SEQ ID NO: 765160 - DNA, 20 bp, Homo sapiens
caggaatttgaagctgcagt

SEQ ID NO: 765161 - DNA, 14 bp, Homo sapiens
caggaattttattt

SEQ ID NO: 765162 - DNA, 16 bp, Homo sapiens
caggacagcagcactc

SEQ ID NO: 765163 - DNA, 20 bp, Homo sapiens
caggacagcatcccttccca

SEQ ID NO: 765164 - DNA, 14 bp, Homo sapiens
caggacagccagca

SEQ ID NO: 765165 - DNA, 12 bp, Homo sapiens
caggacaggccc

SEQ ID NO: 765166 - DNA, 13 bp, Homo sapiens
caggacaggcccg

SEQ ID NO: 765167 - DNA, 16 bp, Homo sapiens
caggacagtgcttcag

SEQ ID NO: 765168 - DNA, 13 bp, Homo sapiens
caggacagtttat

SEQ ID NO: 765169 - DNA, 16 bp, Homo sapiens
caggacatgatactga

SEQ ID NO: 765170 - DNA, 22 bp, Homo sapiens
caggacatgcggtagccagcac

SEQ ID NO: 765171 - DNA, 23 bp, Homo sapiens
caggacatgcggtagccagcaca

SEQ ID NO: 765172 - DNA, 19 bp, Homo sapiens
caggacatttggaaatcag

SEQ ID NO: 765173 - DNA, 21 bp, Homo sapiens
caggaccaaaaaacctcactg

SEQ ID NO: 765174 - DNA, 14 bp, Homo sapiens
caggaccaaggggg

SEQ ID NO: 765175 - DNA, 16 bp, Homo sapiens
caggaccaagggggcg

SEQ ID NO: 765176 - DNA, 19 bp, Homo sapiens
caggaccaagggggcgggg

SEQ ID NO: 765177 - DNA, 22 bp, Homo sapiens
caggaccaagggggcggggact

SEQ ID NO: 765178 - DNA, 20 bp, Homo sapiens
caggaccaatggctgagcct

SEQ ID NO: 765179 - DNA, 16 bp, Homo sapiens
caggaccacaaaaatg

SEQ ID NO: 765180 - DNA, 14 bp, Homo sapiens
caggaccagctggg

SEQ ID NO: 765181 - DNA, 15 bp, Homo sapiens
caggaccagctgggg

SEQ ID NO: 765182 - DNA, 21 bp, Homo sapiens
caggaccagtcaacctgggca

SEQ ID NO: 765183 - DNA, 22 bp, Homo sapiens
caggaccatgggaccaggtctt

SEQ ID NO: 765184 - DNA, 14 bp, Homo sapiens
caggacccagagga

SEQ ID NO: 765185 - DNA, 15 bp, Homo sapiens
caggacccaggccct

SEQ ID NO: 765186 - DNA, 24 bp, Homo sapiens
caggacccaggccctccatgggct

SEQ ID NO: 765187 - DNA, 14 bp, Homo sapiens
caggacccagggtc

SEQ ID NO: 765188 - DNA, 16 bp, Homo sapiens
caggacccagggtccc

SEQ ID NO: 765189 - DNA, 15 bp, Homo sapiens
caggaccccagctct

SEQ ID NO: 765190 - DNA, 20 bp, Homo sapiens
caggacccgcctgctcccat

SEQ ID NO: 765191 - DNA, 20 bp, Homo sapiens
caggaccctcagccctggcc

SEQ ID NO: 765192 - DNA, 23 bp, Homo sapiens
caggaccctgtcctgcagtccca

SEQ ID NO: 765193 - DNA, 19 bp, Homo sapiens
caggacctagagccgggca

SEQ ID NO: 765194 - DNA, 22 bp, Homo sapiens
caggacctcagagtccaggccc

SEQ ID NO: 765195 - DNA, 16 bp, Homo sapiens
caggacctcaggtgag

SEQ ID NO: 765196 - DNA, 23 bp, Homo sapiens
caggacctcaggtgagaagcaga

SEQ ID NO: 765197 - DNA, 22 bp, Homo sapiens
caggacctcccttccgaccctc

SEQ ID NO: 765198 - DNA, 23 bp, Homo sapiens
caggacctcccttccgaccctct

SEQ ID NO: 765199 - DNA, 19 bp, Homo sapiens
caggacctctgtaggcagc

SEQ ID NO: 765200 - DNA, 17 bp, Homo sapiens
ctgcacattcctggccc

SEQ ID NO: 765201 - DNA, 21 bp, Homo sapiens
ctgcacattcctggccccggg

SEQ ID NO: 765202 - DNA, 21 bp, Homo sapiens
ctgcacattgcctgttctgct

SEQ ID NO: 765203 - DNA, 15 bp, Homo sapiens
ctgcaccaccatgcc

SEQ ID NO: 765204 - DNA, 13 bp, Homo sapiens
ctgcaccagagca

SEQ ID NO: 765205 - DNA, 15 bp, Homo sapiens
ctgcaccagagtgaa

SEQ ID NO: 765206 - DNA, 14 bp, Homo sapiens
ctgcaccagcaggt

SEQ ID NO: 765207 - DNA, 15 bp, Homo sapiens
ctgcacccagctcca

SEQ ID NO: 765208 - DNA, 14 bp, Homo sapiens
ctgcacccctgggc

SEQ ID NO: 765209 - DNA, 16 bp, Homo sapiens
ctgcacccctgggcca

SEQ ID NO: 765210 - DNA, 19 bp, Homo sapiens
ctgcaccccttctctcctc

SEQ ID NO: 765211 - DNA, 20 bp, Homo sapiens
ctgcaccccttctctcctcc

SEQ ID NO: 765212 - DNA, 17 bp, Homo sapiens
ctgcaccctcaggcagg

SEQ ID NO: 765213 - DNA, 14 bp, Homo sapiens
ctgcaccctccacc

SEQ ID NO: 765214 - DNA, 17 bp, Homo sapiens
ctgcaccctccctccga

SEQ ID NO: 765215 - DNA, 18 bp, Homo sapiens
ctgcaccctgcgcctcca

SEQ ID NO: 765216 - DNA, 20 bp, Homo sapiens
ctgcaccctgcgcctccaga

SEQ ID NO: 765217 - DNA, 15 bp, Homo sapiens
ctgcaccctggaaag

SEQ ID NO: 765218 - DNA, 18 bp, Homo sapiens
ctgcaccctggaaagggg

SEQ ID NO: 765219 - DNA, 20 bp, Homo sapiens
ctgcacccttcttttctcat

SEQ ID NO: 765220 - DNA, 16 bp, Homo sapiens
ctgcaccgaccccggg

SEQ ID NO: 765221 - DNA, 18 bp, Homo sapiens
ctgcaccgccgcagaagc

SEQ ID NO: 765222 - DNA, 17 bp, Homo sapiens
ctgcaccgtactgtgga

SEQ ID NO: 765223 - DNA, 15 bp, Homo sapiens
ctgcaccgtctcact

SEQ ID NO: 765224 - DNA, 11 bp, Homo sapiens
ctgcacctccc

SEQ ID NO: 765225 - DNA, 13 bp, Homo sapiens
ctgcacctccgct

SEQ ID NO: 765226 - DNA, 23 bp, Homo sapiens
ctgcacctccgcttgccagaggc

SEQ ID NO: 765227 - DNA, 11 bp, Homo sapiens
ctgcacctcct

SEQ ID NO: 765228 - DNA, 19 bp, Homo sapiens
ctgcacctcctaccctccc

SEQ ID NO: 765229 - DNA, 24 bp, Homo sapiens
ctgcacctcctaccctcccaccag

SEQ ID NO: 765230 - DNA, 21 bp, Homo sapiens
ctgcacctgattagttgaaag

SEQ ID NO: 765231 - DNA, 11 bp, Homo sapiens
ctgcacctgca

SEQ ID NO: 765232 - DNA, 17 bp, Homo sapiens
ctgcacctgccagcctg

SEQ ID NO: 765233 - DNA, 16 bp, Homo sapiens
ctgcacctgcccagct

SEQ ID NO: 765234 - DNA, 15 bp, Homo sapiens
ctgcacctggcctgg

SEQ ID NO: 765235 - DNA, 18 bp, Homo sapiens
ctgcacctggcctgggcc

SEQ ID NO: 765236 - DNA, 13 bp, Homo sapiens
ctgcacgctcccc

SEQ ID NO: 765237 - DNA, 15 bp, Homo sapiens
ctgcacgctgcccag

SEQ ID NO: 765238 - DNA, 15 bp, Homo sapiens
ctgcacgtgcgggtg

SEQ ID NO: 765239 - DNA, 19 bp, Homo sapiens
ctgcacgttgctgaaggtc

SEQ ID NO: 765240 - DNA, 20 bp, Homo sapiens
ctgcactaaagccagcctga

SEQ ID NO: 765241 - DNA, 21 bp, Homo sapiens
ctgcactaaagccagcctgac

SEQ ID NO: 765242 - DNA, 23 bp, Homo sapiens
ctgcactaaagccagcctgacct

SEQ ID NO: 765243 - DNA, 14 bp, Homo sapiens
ctgcactactgaca

SEQ ID NO: 765244 - DNA, 16 bp, Homo sapiens
ctgcactactgacatg

SEQ ID NO: 765245 - DNA, 13 bp, Homo sapiens
ctgcactaggact

SEQ ID NO: 765246 - DNA, 16 bp, Homo sapiens
ctgcactaggcaggta

SEQ ID NO: 765247 - DNA, 14 bp, Homo sapiens
ctgcactccagcct

SEQ ID NO: 765248 - DNA, 18 bp, Homo sapiens
ctgcactccagcctgggc

SEQ ID NO: 765249 - DNA, 19 bp, Homo sapiens
ctgcactccagcctgggcg

SEQ ID NO: 765250 - DNA, 20 bp, Homo sapiens
ctgcactccagcctgggcga

SEQ ID NO: 765251 - DNA, 18 bp, Homo sapiens
ctgcactccagcctgggt

SEQ ID NO: 765252 - DNA, 19 bp, Homo sapiens
ctgcactccagcctgggtg

SEQ ID NO: 765253 - DNA, 11 bp, Homo sapiens
ctgcactccat

SEQ ID NO: 765254 - DNA, 16 bp, Homo sapiens
ctgcactccatggcca

SEQ ID NO: 765255 - DNA, 19 bp, Homo sapiens
ctgcactccatggccaccc

SEQ ID NO: 765256 - DNA, 21 bp, Homo sapiens
ctgcactccatggccaccccg

SEQ ID NO: 765257 - DNA, 18 bp, Homo sapiens
ctgcactccctcctggag

SEQ ID NO: 765258 - DNA, 17 bp, Homo sapiens
ctgcactcctgaacaca

SEQ ID NO: 765259 - DNA, 12 bp, Homo sapiens
ctgcactcttga

SEQ ID NO: 765260 - DNA, 17 bp, Homo sapiens
ctgcactgaaacctgag

SEQ ID NO: 765261 - DNA, 21 bp, Homo sapiens
ctgcactgagagggcaaggaa

SEQ ID NO: 765262 - DNA, 13 bp, Homo sapiens
ctgcactgcagtg

SEQ ID NO: 765263 - DNA, 22 bp, Homo sapiens
ctgcactggagccacaggcagg

SEQ ID NO: 765264 - DNA, 18 bp, Homo sapiens
ctgcactgggaaggaaac

SEQ ID NO: 765265 - DNA, 16 bp, Homo sapiens
ctgcactggggagccc

SEQ ID NO: 765266 - DNA, 17 bp, Homo sapiens
ctgcactgttgctgact

SEQ ID NO: 765267 - DNA, 20 bp, Homo sapiens
ctgcactttcccccttcccg

SEQ ID NO: 765268 - DNA, 14 bp, Homo sapiens
ctgcactttgttta

SEQ ID NO: 765269 - DNA, 15 bp, Homo sapiens
ctgcactttgtttag

SEQ ID NO: 765270 - DNA, 23 bp, Homo sapiens
ctgcagaacgtattggtccagct

SEQ ID NO: 765271 - DNA, 17 bp, Homo sapiens
ctgcagaagccagaagg

SEQ ID NO: 765272 - DNA, 18 bp, Homo sapiens
ctgcagaagccagaaggt

SEQ ID NO: 765273 - DNA, 13 bp, Homo sapiens
ctgcagaaggaaa

SEQ ID NO: 765274 - DNA, 16 bp, Homo sapiens
ctgcagaaggccaaga

SEQ ID NO: 765275 - DNA, 18 bp, Homo sapiens
ctgcagaataaaatctct

SEQ ID NO: 765276 - DNA, 19 bp, Homo sapiens
ctgcagaatccctttgcac

SEQ ID NO: 765277 - DNA, 18 bp, Homo sapiens
ctgcagaatgactccacc

SEQ ID NO: 765278 - DNA, 22 bp, Homo sapiens
ctgcagacacctggactgagcc

SEQ ID NO: 765279 - DNA, 22 bp, Homo sapiens
ctgcagacagacctcaagggac

SEQ ID NO: 765280 - DNA, 12 bp, Homo sapiens
ctgcagacattc

SEQ ID NO: 765281 - DNA, 19 bp, Homo sapiens
ctgcagacctcaagccatc

SEQ ID NO: 765282 - DNA, 20 bp, Homo sapiens
ctgcagacctcaagccatca

SEQ ID NO: 765283 - DNA, 15 bp, Homo sapiens
ctgcagacctcactg

SEQ ID NO: 765284 - DNA, 17 bp, Homo sapiens
ctgcagacctcactgtc

SEQ ID NO: 765285 - DNA, 19 bp, Homo sapiens
ctgcagacctcactgtcag

SEQ ID NO: 765286 - DNA, 14 bp, Homo sapiens
ctgcagacttccca

SEQ ID NO: 765287 - DNA, 15 bp, Homo sapiens
ctgcagacttcccag

SEQ ID NO: 765288 - DNA, 15 bp, Homo sapiens
ctgcagagcaataac

SEQ ID NO: 765289 - DNA, 14 bp, Homo sapiens
ctgcagagcacaaa

SEQ ID NO: 765290 - DNA, 17 bp, Homo sapiens
ctgcagagcagcagcac

SEQ ID NO: 765291 - DNA, 18 bp, Homo sapiens
ctgcagagcccggcccca

SEQ ID NO: 765292 - DNA, 22 bp, Homo sapiens
ctgcagagcccggccccacctc

SEQ ID NO: 765293 - DNA, 16 bp, Homo sapiens
ctgcagaggaccacag

SEQ ID NO: 765294 - DNA, 22 bp, Homo sapiens
ctgcagagggagacggccctgc

SEQ ID NO: 765295 - DNA, 23 bp, Homo sapiens
ctgcagaggggaaaccagtgtag

SEQ ID NO: 765296 - DNA, 20 bp, Homo sapiens
ctgcagaggggctttctgga

SEQ ID NO: 765297 - DNA, 22 bp, Homo sapiens
ctgcagaggggctttctggaga

SEQ ID NO: 765298 - DNA, 13 bp, Homo sapiens
ctgcagagggtta

SEQ ID NO: 765299 - DNA, 16 bp, Homo sapiens
ctgcagaggtctgtgc

SEQ ID NO: 765300 - DNA, 23 bp, Homo sapiens
ctgcagaggtctgtgctgaggcc

SEQ ID NO: 765301 - DNA, 17 bp, Homo sapiens
ctgcagatagcccagga

SEQ ID NO: 765302 - DNA, 18 bp, Homo sapiens
ctgcagatagcccaggag

SEQ ID NO: 765303 - DNA, 22 bp, Homo sapiens
ctgcagatagcccaggagcaac

SEQ ID NO: 765304 - DNA, 21 bp, Homo sapiens
ctgcagatgccaccctagcca

SEQ ID NO: 765305 - DNA, 21 bp, Homo sapiens
ctgcagatgtgcggagcggga

SEQ ID NO: 765306 - DNA, 16 bp, Homo sapiens
ctgcagcaataaagca

SEQ ID NO: 765307 - DNA, 13 bp, Homo sapiens
ctgcagcacatgc

SEQ ID NO: 765308 - DNA, 22 bp, Homo sapiens
ctgcagcacatgcgggctcgcc

SEQ ID NO: 765309 - DNA, 15 bp, Homo sapiens
ctgcagcacctccag

SEQ ID NO: 765310 - DNA, 17 bp, Homo sapiens
ctgcagcacctccaggc

SEQ ID NO: 765311 - DNA, 18 bp, Homo sapiens
ctgcagcacctccaggcc

SEQ ID NO: 765312 - DNA, 19 bp, Homo sapiens
ctgcagcacgcggccttgt

SEQ ID NO: 765313 - DNA, 12 bp, Homo sapiens
ctgcagcacttt

SEQ ID NO: 765314 - DNA, 13 bp, Homo sapiens
ctgcagcagagtg

SEQ ID NO: 765315 - DNA, 14 bp, Homo sapiens
ctgcagcagagtga

SEQ ID NO: 765316 - DNA, 19 bp, Homo sapiens
ctgcagcagagtgagcaag

SEQ ID NO: 765317 - DNA, 14 bp, Homo sapiens
ctgcagcagggcag

SEQ ID NO: 765318 - DNA, 18 bp, Homo sapiens
ctgcagcaggtgctgggc

SEQ ID NO: 765319 - DNA, 19 bp, Homo sapiens
ctgcagcatgacctgtgac

SEQ ID NO: 765320 - DNA, 20 bp, Homo sapiens
ctgcagcatggtccctgcct

SEQ ID NO: 765321 - DNA, 12 bp, Homo sapiens
ctgcagccacca

SEQ ID NO: 765322 - DNA, 14 bp, Homo sapiens
ctgcagccagccca

SEQ ID NO: 765323 - DNA, 15 bp, Homo sapiens
ctgcagccagcccag

SEQ ID NO: 765324 - DNA, 16 bp, Homo sapiens
ctgcagccagcccagc

SEQ ID NO: 765325 - DNA, 16 bp, Homo sapiens
caggacctgcctagca

SEQ ID NO: 765326 - DNA, 20 bp, Homo sapiens
caggacctgggacctcccct

SEQ ID NO: 765327 - DNA, 17 bp, Homo sapiens
caggacctgtgctttga

SEQ ID NO: 765328 - DNA, 13 bp, Homo sapiens
caggaccttgggc

SEQ ID NO: 765329 - DNA, 19 bp, Homo sapiens
caggacgaaaaagaggcat

SEQ ID NO: 765330 - DNA, 18 bp, Homo sapiens
caggacgccactcatttc

SEQ ID NO: 765331 - DNA, 19 bp, Homo sapiens
caggacgccactcatttca

SEQ ID NO: 765332 - DNA, 21 bp, Homo sapiens
caggacgccactcatttcatc

SEQ ID NO: 765333 - DNA, 19 bp, Homo sapiens
caggacgctgaccgtggag

SEQ ID NO: 765334 - DNA, 16 bp, Homo sapiens
caggacggctcctcag

SEQ ID NO: 765335 - DNA, 19 bp, Homo sapiens
caggacggctcctcagagc

SEQ ID NO: 765336 - DNA, 21 bp, Homo sapiens
caggactacaataccctaccc

SEQ ID NO: 765337 - DNA, 18 bp, Homo sapiens
caggactatagcccaggt

SEQ ID NO: 765338 - DNA, 21 bp, Homo sapiens
caggactatagcccaggtcct

SEQ ID NO: 765339 - DNA, 18 bp, Homo sapiens
caggactccccaggccag

SEQ ID NO: 765340 - DNA, 13 bp, Homo sapiens
caggactcctggc

SEQ ID NO: 765341 - DNA, 16 bp, Homo sapiens
caggactcctggcagg

SEQ ID NO: 765342 - DNA, 20 bp, Homo sapiens
caggactctgcccagaccac

SEQ ID NO: 765343 - DNA, 13 bp, Homo sapiens
caggactctgcct

SEQ ID NO: 765344 - DNA, 20 bp, Homo sapiens
caggactctgcgggaggctg

SEQ ID NO: 765345 - DNA, 23 bp, Homo sapiens
caggactctgcgggaggctgggg

SEQ ID NO: 765346 - DNA, 23 bp, Homo sapiens
caggactctttgaagaaaagaaa

SEQ ID NO: 765347 - DNA, 21 bp, Homo sapiens
caggactgaattgtccccagt

SEQ ID NO: 765348 - DNA, 23 bp, Homo sapiens
caggactgcaaaaatccttctcc

SEQ ID NO: 765349 - DNA, 14 bp, Homo sapiens
caggactgtgactc

SEQ ID NO: 765350 - DNA, 23 bp, Homo sapiens
caggacttaacggctccaggatt

SEQ ID NO: 765351 - DNA, 20 bp, Homo sapiens
caggacttggtctgatttca

SEQ ID NO: 765352 - DNA, 21 bp, Homo sapiens
caggagaaagccgggggaggg

SEQ ID NO: 765353 - DNA, 17 bp, Homo sapiens
caggagaaccactacat

SEQ ID NO: 765354 - DNA, 15 bp, Homo sapiens
caggagaagaacaag

SEQ ID NO: 765355 - DNA, 14 bp, Homo sapiens
caggagaagagagg

SEQ ID NO: 765356 - DNA, 16 bp, Homo sapiens
caggagaagctcagct

SEQ ID NO: 765357 - DNA, 19 bp, Homo sapiens
caggagaaggccaattcct

SEQ ID NO: 765358 - DNA, 15 bp, Homo sapiens
caggagaagggctgg

SEQ ID NO: 765359 - DNA, 19 bp, Homo sapiens
caggagaagggctggggcc

SEQ ID NO: 765360 - DNA, 16 bp, Homo sapiens
caggagaatcgcttga

SEQ ID NO: 765361 - DNA, 23 bp, Homo sapiens
caggagaatcgcttgaacctggg

SEQ ID NO: 765362 - DNA, 19 bp, Homo sapiens
caggagaatggggttcctg

SEQ ID NO: 765363 - DNA, 21 bp, Homo sapiens
caggagaatggggttcctgct

SEQ ID NO: 765364 - DNA, 13 bp, Homo sapiens
caggagacaaaag

SEQ ID NO: 765365 - DNA, 13 bp, Homo sapiens
caggagacattac

SEQ ID NO: 765366 - DNA, 22 bp, Homo sapiens
caggagactggcgtgaacccag

SEQ ID NO: 765367 - DNA, 15 bp, Homo sapiens
caggagactgggctc

SEQ ID NO: 765368 - DNA, 16 bp, Homo sapiens
caggagactgggctct

SEQ ID NO: 765369 - DNA, 19 bp, Homo sapiens
caggagactgggctctggc

SEQ ID NO: 765370 - DNA, 14 bp, Homo sapiens
caggagagagccag

SEQ ID NO: 765371 - DNA, 21 bp, Homo sapiens
caggagagagccaggatgccc

SEQ ID NO: 765372 - DNA, 13 bp, Homo sapiens
caggagagccagc

SEQ ID NO: 765373 - DNA, 17 bp, Homo sapiens
caggagagccagccctc

SEQ ID NO: 765374 - DNA, 19 bp, Homo sapiens
caggagagccagccctccc

SEQ ID NO: 765375 - DNA, 13 bp, Homo sapiens
caggagagcctgg

SEQ ID NO: 765376 - DNA, 19 bp, Homo sapiens
caggagagggatacaagag

SEQ ID NO: 765377 - DNA, 15 bp, Homo sapiens
caggagaggggcaga

SEQ ID NO: 765378 - DNA, 20 bp, Homo sapiens
caggagagtgtgtgggcagg

SEQ ID NO: 765379 - DNA, 22 bp, Homo sapiens
caggagagtgtgtgggcagggt

SEQ ID NO: 765380 - DNA, 23 bp, Homo sapiens
caggagagtgtgtgggcagggtt

SEQ ID NO: 765381 - DNA, 18 bp, Homo sapiens
caggagatggagggcttg

SEQ ID NO: 765382 - DNA, 20 bp, Homo sapiens
caggagatggagggcttggc

SEQ ID NO: 765383 - DNA, 18 bp, Homo sapiens
caggagatgggtccaggg

SEQ ID NO: 765384 - DNA, 21 bp, Homo sapiens
caggagattggatttgctgtg

SEQ ID NO: 765385 - DNA, 19 bp, Homo sapiens
caggagcaaatgtttctgc

SEQ ID NO: 765386 - DNA, 14 bp, Homo sapiens
caggagcagcagcc

SEQ ID NO: 765387 - DNA, 15 bp, Homo sapiens
caggagcagcagcca

SEQ ID NO: 765388 - DNA, 16 bp, Homo sapiens
caggagcagcagccag

SEQ ID NO: 765389 - DNA, 18 bp, Homo sapiens
caggagcagcagccagca

SEQ ID NO: 765390 - DNA, 21 bp, Homo sapiens
caggagcagcagccagcacca

SEQ ID NO: 765391 - DNA, 18 bp, Homo sapiens
caggagcagggcggctgc

SEQ ID NO: 765392 - DNA, 22 bp, Homo sapiens
caggagcagggcggctgccgac

SEQ ID NO: 765393 - DNA, 16 bp, Homo sapiens
caggagcagtatcatg

SEQ ID NO: 765394 - DNA, 22 bp, Homo sapiens
caggagcccccaacacaggcaa

SEQ ID NO: 765395 - DNA, 23 bp, Homo sapiens
caggagcccccaacacaggcaag

SEQ ID NO: 765396 - DNA, 14 bp, Homo sapiens
caggagccccgcca

SEQ ID NO: 765397 - DNA, 21 bp, Homo sapiens
caggagccgaagcccaggggc

SEQ ID NO: 765398 - DNA, 12 bp, Homo sapiens
caggagcctagc

SEQ ID NO: 765399 - DNA, 20 bp, Homo sapiens
caggagcctagcggagccca

SEQ ID NO: 765400 - DNA, 23 bp, Homo sapiens
caggagcctagcggagcccagcc

SEQ ID NO: 765401 - DNA, 11 bp, Homo sapiens
caggagcctcc

SEQ ID NO: 765402 - DNA, 14 bp, Homo sapiens
caggagcctccctg

SEQ ID NO: 765403 - DNA, 11 bp, Homo sapiens
caggagcctgg

SEQ ID NO: 765404 - DNA, 12 bp, Homo sapiens
caggagcctggc

SEQ ID NO: 765405 - DNA, 19 bp, Homo sapiens
caggagcctggtccttccc

SEQ ID NO: 765406 - DNA, 21 bp, Homo sapiens
caggagcctggtccttccctg

SEQ ID NO: 765407 - DNA, 15 bp, Homo sapiens
caggagcctgtgcct

SEQ ID NO: 765408 - DNA, 16 bp, Homo sapiens
caggagcctgtgcctc

SEQ ID NO: 765409 - DNA, 16 bp, Homo sapiens
caggagcgcaagatag

SEQ ID NO: 765410 - DNA, 13 bp, Homo sapiens
caggagctctgcg

SEQ ID NO: 765411 - DNA, 20 bp, Homo sapiens
caggagctcttcaggcctcc

SEQ ID NO: 765412 - DNA, 23 bp, Homo sapiens
caggagctcttcaggcctccctc

SEQ ID NO: 765413 - DNA, 18 bp, Homo sapiens
caggagctgagtcacctc

SEQ ID NO: 765414 - DNA, 13 bp, Homo sapiens
caggagctgccca

SEQ ID NO: 765415 - DNA, 19 bp, Homo sapiens
caggagctgtcaccaagga

SEQ ID NO: 765416 - DNA, 17 bp, Homo sapiens
caggagcttgggcagtg

SEQ ID NO: 765417 - DNA, 20 bp, Homo sapiens
caggagcttgggcagtgccc

SEQ ID NO: 765418 - DNA, 14 bp, Homo sapiens
caggagcttttgtg

SEQ ID NO: 765419 - DNA, 17 bp, Homo sapiens
caggaggaggctgccct

SEQ ID NO: 765420 - DNA, 16 bp, Homo sapiens
caggaggattccttgt

SEQ ID NO: 765421 - DNA, 14 bp, Homo sapiens
caggaggattgcct

SEQ ID NO: 765422 - DNA, 11 bp, Homo sapiens
caggaggcaga

SEQ ID NO: 765423 - DNA, 15 bp, Homo sapiens
caggaggccaataaa

SEQ ID NO: 765424 - DNA, 16 bp, Homo sapiens
caggaggcccctggcc

SEQ ID NO: 765425 - DNA, 20 bp, Homo sapiens
caggaggcccctggcccagc

SEQ ID NO: 765426 - DNA, 14 bp, Homo sapiens
caggaggccctggt

SEQ ID NO: 765427 - DNA, 18 bp, Homo sapiens
caggaggccgaggcagga

SEQ ID NO: 765428 - DNA, 15 bp, Homo sapiens
caggaggcctgcacc

SEQ ID NO: 765429 - DNA, 17 bp, Homo sapiens
caggaggcgcccttggc

SEQ ID NO: 765430 - DNA, 13 bp, Homo sapiens
caggaggcggcag

SEQ ID NO: 765431 - DNA, 13 bp, Homo sapiens
caggaggctgagg

SEQ ID NO: 765432 - DNA, 18 bp, Homo sapiens
caggaggctgaggcagaa

SEQ ID NO: 765433 - DNA, 21 bp, Homo sapiens
caggaggctgaggcagaagaa

SEQ ID NO: 765434 - DNA, 17 bp, Homo sapiens
caggaggctgaggcagg

SEQ ID NO: 765435 - DNA, 19 bp, Homo sapiens
caggaggctgaggcaggag

SEQ ID NO: 765436 - DNA, 20 bp, Homo sapiens
caggaggctgaggcaggagg

SEQ ID NO: 765437 - DNA, 21 bp, Homo sapiens
caggaggctgaggcaggagga

SEQ ID NO: 765438 - DNA, 13 bp, Homo sapiens
caggaggctggag

SEQ ID NO: 765439 - DNA, 15 bp, Homo sapiens
caggaggctggagga

SEQ ID NO: 765440 - DNA, 18 bp, Homo sapiens
caggaggctggaggaagg

SEQ ID NO: 765441 - DNA, 21 bp, Homo sapiens
caggaggcttggaaagcatca

SEQ ID NO: 765442 - DNA, 22 bp, Homo sapiens
caggaggctttaagctccagct

SEQ ID NO: 765443 - DNA, 12 bp, Homo sapiens
caggagggacct

SEQ ID NO: 765444 - DNA, 11 bp, Homo sapiens
caggagggagg

SEQ ID NO: 765445 - DNA, 17 bp, Homo sapiens
caggagggaggcgggga

SEQ ID NO: 765446 - DNA, 12 bp, Homo sapiens
caggagggaggg

SEQ ID NO: 765447 - DNA, 19 bp, Homo sapiens
caggagggcaagggccatg

SEQ ID NO: 765448 - DNA, 18 bp, Homo sapiens
caggagggcacagcaggg

SEQ ID NO: 765449 - DNA, 17 bp, Homo sapiens
ctgcagccagcccagcc

SEQ ID NO: 765450 - DNA, 22 bp, Homo sapiens
ctgcagccagcccagcccagct

SEQ ID NO: 765451 - DNA, 18 bp, Homo sapiens
ctgcatctgaccagcagc

SEQ ID NO: 765452 - DNA, 19 bp, Homo sapiens
ctgcatctgaccagcagcg

SEQ ID NO: 765453 - DNA, 14 bp, Homo sapiens
ctgcatcttaacat

SEQ ID NO: 765454 - DNA, 13 bp, Homo sapiens
ctgcatcttcttg

SEQ ID NO: 765455 - DNA, 16 bp, Homo sapiens
ctgcatcttggggaca

SEQ ID NO: 765456 - DNA, 23 bp, Homo sapiens
ctgcatgcctggtctttcctctg

SEQ ID NO: 765457 - DNA, 13 bp, Homo sapiens
ctgcatgctctgg

SEQ ID NO: 765458 - DNA, 18 bp, Homo sapiens
ctgcatgctctggaagcc

SEQ ID NO: 765459 - DNA, 21 bp, Homo sapiens
ctgcatgctctggaagcctgg

SEQ ID NO: 765460 - DNA, 17 bp, Homo sapiens
ctgcatgcttagagcat

SEQ ID NO: 765461 - DNA, 17 bp, Homo sapiens
ctgcatggacctaacat

SEQ ID NO: 765462 - DNA, 18 bp, Homo sapiens
ctgcatggacctaacatt

SEQ ID NO: 765463 - DNA, 14 bp, Homo sapiens
ctgcatggagcctg

SEQ ID NO: 765464 - DNA, 20 bp, Homo sapiens
ctgcatgggggcaccgggct

SEQ ID NO: 765465 - DNA, 21 bp, Homo sapiens
ctgcatgggggcaccgggctc

SEQ ID NO: 765466 - DNA, 23 bp, Homo sapiens
ctgcatggtgtttatgcacacag

SEQ ID NO: 765467 - DNA, 15 bp, Homo sapiens
ctgcatgtgacttct

SEQ ID NO: 765468 - DNA, 21 bp, Homo sapiens
ctgcatgtggcttttttaaaa

SEQ ID NO: 765469 - DNA, 15 bp, Homo sapiens
ctgcattagaaatta

SEQ ID NO: 765470 - DNA, 20 bp, Homo sapiens
ctgcattcaccttagtgcaa

SEQ ID NO: 765471 - DNA, 15 bp, Homo sapiens
ctgcattcattttta

SEQ ID NO: 765472 - DNA, 16 bp, Homo sapiens
ctgcattcccaggaaa

SEQ ID NO: 765473 - DNA, 12 bp, Homo sapiens
ctgcattccgca

SEQ ID NO: 765474 - DNA, 19 bp, Homo sapiens
ctgcattcctttttcttca

SEQ ID NO: 765475 - DNA, 16 bp, Homo sapiens
ctgcattctctcccat

SEQ ID NO: 765476 - DNA, 19 bp, Homo sapiens
ctgcattctctcccatcct

SEQ ID NO: 765477 - DNA, 21 bp, Homo sapiens
ctgcattctctcccatcctgg

SEQ ID NO: 765478 - DNA, 14 bp, Homo sapiens
ctgcattcttaaca

SEQ ID NO: 765479 - DNA, 17 bp, Homo sapiens
ctgcattgagaactgca

SEQ ID NO: 765480 - DNA, 20 bp, Homo sapiens
ctgcattgttattgtggaag

SEQ ID NO: 765481 - DNA, 22 bp, Homo sapiens
ctgcattgttattgtggaagat

SEQ ID NO: 765482 - DNA, 15 bp, Homo sapiens
ctgcatttaaaaaaa

SEQ ID NO: 765483 - DNA, 23 bp, Homo sapiens
ctgcatttaaatttgatttccat

SEQ ID NO: 765484 - DNA, 17 bp, Homo sapiens
ctgcatttcggtggcta

SEQ ID NO: 765485 - DNA, 13 bp, Homo sapiens
ctgcatttctgag

SEQ ID NO: 765486 - DNA, 13 bp, Homo sapiens
ctgcatttgtgaa

SEQ ID NO: 765487 - DNA, 22 bp, Homo sapiens
ctgcatttgtgaaatgatggtg

SEQ ID NO: 765488 - DNA, 21 bp, Homo sapiens
ctgcattttaattttaaccaa

SEQ ID NO: 765489 - DNA, 23 bp, Homo sapiens
ctgcattttcctcttgtcctggc

SEQ ID NO: 765490 - DNA, 18 bp, Homo sapiens
ctgcatttttagaccatt

SEQ ID NO: 765491 - DNA, 22 bp, Homo sapiens
ctgcatttttcactttgctctc

SEQ ID NO: 765492 - DNA, 23 bp, Homo sapiens
ctgcatttttcactttgctctca

SEQ ID NO: 765493 - DNA, 15 bp, Homo sapiens
ctgccaaaaccacat

SEQ ID NO: 765494 - DNA, 12 bp, Homo sapiens
ctgccaaacaca

SEQ ID NO: 765495 - DNA, 16 bp, Homo sapiens
ctgccaaaggatgtga

SEQ ID NO: 765496 - DNA, 18 bp, Homo sapiens
ctgccaaaggatgtgata

SEQ ID NO: 765497 - DNA, 19 bp, Homo sapiens
ctgccaaaggatgtgatat

SEQ ID NO: 765498 - DNA, 18 bp, Homo sapiens
ctgccaaagtgcctggga

SEQ ID NO: 765499 - DNA, 19 bp, Homo sapiens
ctgccaaagtgcctgggaa

SEQ ID NO: 765500 - DNA, 16 bp, Homo sapiens
ctgccaaataaatcat

SEQ ID NO: 765501 - DNA, 15 bp, Homo sapiens
ctgccaaccatacct

SEQ ID NO: 765502 - DNA, 16 bp, Homo sapiens
ctgccaacgcctcctg

SEQ ID NO: 765503 - DNA, 16 bp, Homo sapiens
ctgccaagcttcctgt

SEQ ID NO: 765504 - DNA, 20 bp, Homo sapiens
ctgccaagcttcctgtgccc

SEQ ID NO: 765505 - DNA, 21 bp, Homo sapiens
ctgccaagcttcctgtgccct

SEQ ID NO: 765506 - DNA, 11 bp, Homo sapiens
ctgccaagggt

SEQ ID NO: 765507 - DNA, 17 bp, Homo sapiens
ctgccaaggtggaggga

SEQ ID NO: 765508 - DNA, 20 bp, Homo sapiens
ctgccaatgctccagctgtc

SEQ ID NO: 765509 - DNA, 16 bp, Homo sapiens
ctgccaatgtgggctg

SEQ ID NO: 765510 - DNA, 19 bp, Homo sapiens
ctgccacaaaccaccagga

SEQ ID NO: 765511 - DNA, 18 bp, Homo sapiens
ctgccacactcagtcccc

SEQ ID NO: 765512 - DNA, 14 bp, Homo sapiens
ctgccacactgatg

SEQ ID NO: 765513 - DNA, 17 bp, Homo sapiens
ctgccacactgatggct

SEQ ID NO: 765514 - DNA, 13 bp, Homo sapiens
ctgccacacttca

SEQ ID NO: 765515 - DNA, 13 bp, Homo sapiens
ctgccacagagaa

SEQ ID NO: 765516 - DNA, 18 bp, Homo sapiens
ctgccacatccagcttgt

SEQ ID NO: 765517 - DNA, 19 bp, Homo sapiens
ctgccacatggagccccct

SEQ ID NO: 765518 - DNA, 23 bp, Homo sapiens
ctgccaccacgtctgccaggccc

SEQ ID NO: 765519 - DNA, 18 bp, Homo sapiens
ctgccaccaggccacctc

SEQ ID NO: 765520 - DNA, 20 bp, Homo sapiens
ctgccaccagggagcttcct

SEQ ID NO: 765521 - DNA, 23 bp, Homo sapiens
ctgccaccagggagcttcctggc

SEQ ID NO: 765522 - DNA, 12 bp, Homo sapiens
ctgccaccagtc

SEQ ID NO: 765523 - DNA, 14 bp, Homo sapiens
ctgccaccagtcac

SEQ ID NO: 765524 - DNA, 17 bp, Homo sapiens
ctgccaccatcctgctg

SEQ ID NO: 765525 - DNA, 19 bp, Homo sapiens
ctgccaccatcctgctgct

SEQ ID NO: 765526 - DNA, 14 bp, Homo sapiens
ctgccacccacctc

SEQ ID NO: 765527 - DNA, 15 bp, Homo sapiens
ctgccacccacctcc

SEQ ID NO: 765528 - DNA, 16 bp, Homo sapiens
ctgccacccccaggtc

SEQ ID NO: 765529 - DNA, 16 bp, Homo sapiens
ctgccacccctcttct

SEQ ID NO: 765530 - DNA, 17 bp, Homo sapiens
ctgccaccccttcctcc

SEQ ID NO: 765531 - DNA, 18 bp, Homo sapiens
ctgccaccccttcctccc

SEQ ID NO: 765532 - DNA, 19 bp, Homo sapiens
ctgccaccccttcctcccc

SEQ ID NO: 765533 - DNA, 19 bp, Homo sapiens
ctgccacccgcttcctgtt

SEQ ID NO: 765534 - DNA, 19 bp, Homo sapiens
ctgccaccgactgcccagc

SEQ ID NO: 765535 - DNA, 22 bp, Homo sapiens
ctgccaccgtgggggaactgac

SEQ ID NO: 765536 - DNA, 14 bp, Homo sapiens
ctgccacctcccct

SEQ ID NO: 765537 - DNA, 15 bp, Homo sapiens
ctgccacctccctga

SEQ ID NO: 765538 - DNA, 17 bp, Homo sapiens
ctgccacctccctgacc

SEQ ID NO: 765539 - DNA, 14 bp, Homo sapiens
ctgccactcaccct

SEQ ID NO: 765540 - DNA, 17 bp, Homo sapiens
ctgccactctctgggac

SEQ ID NO: 765541 - DNA, 21 bp, Homo sapiens
ctgccactctctgggactctc

SEQ ID NO: 765542 - DNA, 17 bp, Homo sapiens
ctgccactgcacaccag

SEQ ID NO: 765543 - DNA, 13 bp, Homo sapiens
ctgccactgggct

SEQ ID NO: 765544 - DNA, 14 bp, Homo sapiens
ctgccactgggctc

SEQ ID NO: 765545 - DNA, 16 bp, Homo sapiens
ctgccactgggctctg

SEQ ID NO: 765546 - DNA, 18 bp, Homo sapiens
ctgccactgggctctgga

SEQ ID NO: 765547 - DNA, 17 bp, Homo sapiens
ctgccacttctgcgggc

SEQ ID NO: 765548 - DNA, 19 bp, Homo sapiens
ctgccacttctgcgggctc

SEQ ID NO: 765549 - DNA, 11 bp, Homo sapiens
ctgccagcagc

SEQ ID NO: 765550 - DNA, 21 bp, Homo sapiens
ctgccagcagcagcaggtgat

SEQ ID NO: 765551 - DNA, 14 bp, Homo sapiens
ctgccagccagcag

SEQ ID NO: 765552 - DNA, 20 bp, Homo sapiens
ctgccagccagcagccagct

SEQ ID NO: 765553 - DNA, 16 bp, Homo sapiens
ctgccagcccactgcc

SEQ ID NO: 765554 - DNA, 22 bp, Homo sapiens
ctgccagcccactgcctcctgc

SEQ ID NO: 765555 - DNA, 22 bp, Homo sapiens
ctgccagccgaccctcctggcc

SEQ ID NO: 765556 - DNA, 19 bp, Homo sapiens
ctgccagcctggcttctgg

SEQ ID NO: 765557 - DNA, 20 bp, Homo sapiens
ctgccagccttgagccctgg

SEQ ID NO: 765558 - DNA, 22 bp, Homo sapiens
ctgccagccttgagccctggct

SEQ ID NO: 765559 - DNA, 19 bp, Homo sapiens
ctgccagctgccttcctca

SEQ ID NO: 765560 - DNA, 23 bp, Homo sapiens
ctgccagctgccttcctcatccc

SEQ ID NO: 765561 - DNA, 21 bp, Homo sapiens
ctgccaggaaacaagggaagg

SEQ ID NO: 765562 - DNA, 16 bp, Homo sapiens
ctgccaggcacacaca

SEQ ID NO: 765563 - DNA, 17 bp, Homo sapiens
ctgccaggcacctggcc

SEQ ID NO: 765564 - DNA, 18 bp, Homo sapiens
ctgccaggcacctggcct

SEQ ID NO: 765565 - DNA, 19 bp, Homo sapiens
ctgccaggcacctggcctg

SEQ ID NO: 765566 - DNA, 23 bp, Homo sapiens
ctgccaggcacctggcctgctgg

SEQ ID NO: 765567 - DNA, 12 bp, Homo sapiens
ctgccaggcagg

SEQ ID NO: 765568 - DNA, 13 bp, Homo sapiens
ctgccaggcatgg

SEQ ID NO: 765569 - DNA, 15 bp, Homo sapiens
ctgccaggccagcct

SEQ ID NO: 765570 - DNA, 17 bp, Homo sapiens
ctgccaggccagcctcc

SEQ ID NO: 765571 - DNA, 19 bp, Homo sapiens
ctgccaggccagcctccga

SEQ ID NO: 765572 - DNA, 18 bp, Homo sapiens
ctgccaggcccatctcag

SEQ ID NO: 765573 - DNA, 16 bp, Homo sapiens
ctgccccacttctggc

SEQ ID NO: 765574 - DNA, 19 bp, Homo sapiens
ctgccccacttctggcatg

SEQ ID NO: 765575 - DNA, 14 bp, Homo sapiens
ctgccccagccaga

SEQ ID NO: 765576 - DNA, 14 bp, Homo sapiens
ctgccccagcccag

SEQ ID NO: 765577 - DNA, 15 bp, Homo sapiens
ctgccccagcccaga

SEQ ID NO: 765578 - DNA, 19 bp, Homo sapiens
ctgccccagcccctaagcc

SEQ ID NO: 765579 - DNA, 14 bp, Homo sapiens
ctgccccagctctg

SEQ ID NO: 765580 - DNA, 16 bp, Homo sapiens
ctgccccagctctggc

SEQ ID NO: 765581 - DNA, 16 bp, Homo sapiens
ctgccccagctgactg

SEQ ID NO: 765582 - DNA, 10 bp, Homo sapiens
ctgccccagg

SEQ ID NO: 765583 - DNA, 21 bp, Homo sapiens
ctgccccagggcctgcttccc

SEQ ID NO: 765584 - DNA, 18 bp, Homo sapiens
ctgccccagtagtcagaa

SEQ ID NO: 765585 - DNA, 23 bp, Homo sapiens
ctgccccagtcgttagaatatag

SEQ ID NO: 765586 - DNA, 16 bp, Homo sapiens
ctgccccatcctccag

SEQ ID NO: 765587 - DNA, 18 bp, Homo sapiens
ctgccccatcctccagca

SEQ ID NO: 765588 - DNA, 22 bp, Homo sapiens
ctgccccatcctccagcaggga

SEQ ID NO: 765589 - DNA, 21 bp, Homo sapiens
ctgcccccacgagggtcagga

SEQ ID NO: 765590 - DNA, 14 bp, Homo sapiens
ctgcccccactgtc

SEQ ID NO: 765591 - DNA, 18 bp, Homo sapiens
ctgcccccagcccaaagg

SEQ ID NO: 765592 - DNA, 13 bp, Homo sapiens
ctgcccccatcca

SEQ ID NO: 765593 - DNA, 19 bp, Homo sapiens
ctgcccccatccagccacg

SEQ ID NO: 765594 - DNA, 20 bp, Homo sapiens
ctgcccccatctccccaggc

SEQ ID NO: 765595 - DNA, 23 bp, Homo sapiens
ctgcccccatctccccaggcctc

SEQ ID NO: 765596 - DNA, 21 bp, Homo sapiens
ctgccccccaaggttctggtt

SEQ ID NO: 765597 - DNA, 22 bp, Homo sapiens
ctgccccccaaggttctggttc

SEQ ID NO: 765598 - DNA, 16 bp, Homo sapiens
ctgccccccagcctct

SEQ ID NO: 765599 - DNA, 19 bp, Homo sapiens
ctgccccccagcctctggc

SEQ ID NO: 765600 - DNA, 14 bp, Homo sapiens
ctgccccccagtct

SEQ ID NO: 765601 - DNA, 16 bp, Homo sapiens
ctgccccccagtctcc

SEQ ID NO: 765602 - DNA, 19 bp, Homo sapiens
ctgccccccagtctcccca

SEQ ID NO: 765603 - DNA, 19 bp, Homo sapiens
ctgccccccgaggctgcta

SEQ ID NO: 765604 - DNA, 21 bp, Homo sapiens
ctgcccccgcgggttctagac

SEQ ID NO: 765605 - DNA, 20 bp, Homo sapiens
ctgccccctatcttgtcctg

SEQ ID NO: 765606 - DNA, 21 bp, Homo sapiens
ctgccccctcgggggcctgtg

SEQ ID NO: 765607 - DNA, 14 bp, Homo sapiens
ctgccccctgccag

SEQ ID NO: 765608 - DNA, 15 bp, Homo sapiens
ctgccccctgccagc

SEQ ID NO: 765609 - DNA, 18 bp, Homo sapiens
ctgccccctgccagccga

SEQ ID NO: 765610 - DNA, 15 bp, Homo sapiens
ctgccccctgccagt

SEQ ID NO: 765611 - DNA, 18 bp, Homo sapiens
ctgccccctgccagtgaa

SEQ ID NO: 765612 - DNA, 13 bp, Homo sapiens
ctgccccctgctg

SEQ ID NO: 765613 - DNA, 13 bp, Homo sapiens
ctgccccctgggc

SEQ ID NO: 765614 - DNA, 20 bp, Homo sapiens
ctgccccctgggctggggcc

SEQ ID NO: 765615 - DNA, 20 bp, Homo sapiens
ctgcccccttccccagccct

SEQ ID NO: 765616 - DNA, 17 bp, Homo sapiens
ctgcccccttctcccac

SEQ ID NO: 765617 - DNA, 20 bp, Homo sapiens
ctgcccccttctcccacact

SEQ ID NO: 765618 - DNA, 23 bp, Homo sapiens
ctgcccccttctcccacactgct

SEQ ID NO: 765619 - DNA, 14 bp, Homo sapiens
ctgccccgccccca

SEQ ID NO: 765620 - DNA, 17 bp, Homo sapiens
ctgccccgcccccagtc

SEQ ID NO: 765621 - DNA, 19 bp, Homo sapiens
ctgccccggacctacctcc

SEQ ID NO: 765622 - DNA, 20 bp, Homo sapiens
ctgccccggacctacctccc

SEQ ID NO: 765623 - DNA, 14 bp, Homo sapiens
ctgccccggcctcc

SEQ ID NO: 765624 - DNA, 17 bp, Homo sapiens
ctgccccggcctcctcg

SEQ ID NO: 765625 - DNA, 19 bp, Homo sapiens
ctgccccgggtgcctcaga

SEQ ID NO: 765626 - DNA, 19 bp, Homo sapiens
ctgccccgtagagaatgtg

SEQ ID NO: 765627 - DNA, 19 bp, Homo sapiens
ctgccccgtgtgaatgtag

SEQ ID NO: 765628 - DNA, 19 bp, Homo sapiens
ctgccccgttccctgtcag

SEQ ID NO: 765629 - DNA, 22 bp, Homo sapiens
ctgccccgttccctgtcagagg

SEQ ID NO: 765630 - DNA, 12 bp, Homo sapiens
ctgcccctagga

SEQ ID NO: 765631 - DNA, 13 bp, Homo sapiens
ctgcccctaggat

SEQ ID NO: 765632 - DNA, 21 bp, Homo sapiens
ctgcccctaggatgctgcagc

SEQ ID NO: 765633 - DNA, 15 bp, Homo sapiens
ctgcccctcaggggg

SEQ ID NO: 765634 - DNA, 22 bp, Homo sapiens
ctgcccctcccccaacccccac

SEQ ID NO: 765635 - DNA, 16 bp, Homo sapiens
ctgcccctcccccagc

SEQ ID NO: 765636 - DNA, 19 bp, Homo sapiens
ctgcccctccccgtccctg

SEQ ID NO: 765637 - DNA, 20 bp, Homo sapiens
ctgcccctccccgtccctgt

SEQ ID NO: 765638 - DNA, 17 bp, Homo sapiens
ctgcccctcctggagca

SEQ ID NO: 765639 - DNA, 17 bp, Homo sapiens
ctgcccctctcaccaaa

SEQ ID NO: 765640 - DNA, 12 bp, Homo sapiens
ctgcccctctgt

SEQ ID NO: 765641 - DNA, 14 bp, Homo sapiens
ctgcccctctgttc

SEQ ID NO: 765642 - DNA, 16 bp, Homo sapiens
ctgcccctctgttctc

SEQ ID NO: 765643 - DNA, 17 bp, Homo sapiens
ctgcccctctttctctt

SEQ ID NO: 765644 - DNA, 10 bp, Homo sapiens
ctgcccctgc

SEQ ID NO: 765645 - DNA, 16 bp, Homo sapiens
ctgcccctgccccgtc

SEQ ID NO: 765646 - DNA, 17 bp, Homo sapiens
ctgcccctgccccgtca

SEQ ID NO: 765647 - DNA, 13 bp, Homo sapiens
ctgcccctgcctg

SEQ ID NO: 765648 - DNA, 15 bp, Homo sapiens
ctgcccctgctgctt

SEQ ID NO: 765649 - DNA, 14 bp, Homo sapiens
ctgcccctgctgtg

SEQ ID NO: 765650 - DNA, 16 bp, Homo sapiens
ctgcccctgctgtgct

SEQ ID NO: 765651 - DNA, 14 bp, Homo sapiens
ctgcccctggacct

SEQ ID NO: 765652 - DNA, 12 bp, Homo sapiens
ctgcccctgtct

SEQ ID NO: 765653 - DNA, 19 bp, Homo sapiens
ctgcccctgttgaggtggg

SEQ ID NO: 765654 - DNA, 15 bp, Homo sapiens
ctgccccttgcaagc

SEQ ID NO: 765655 - DNA, 19 bp, Homo sapiens
ctgccccttgggcatccac

SEQ ID NO: 765656 - DNA, 14 bp, Homo sapiens
ctgcccgagctggt

SEQ ID NO: 765657 - DNA, 15 bp, Homo sapiens
ctgcccgagctggtg

SEQ ID NO: 765658 - DNA, 14 bp, Homo sapiens
ctgcccgcagagcc

SEQ ID NO: 765659 - DNA, 17 bp, Homo sapiens
ctgcccgcagagcccac

SEQ ID NO: 765660 - DNA, 19 bp, Homo sapiens
ctgcccgcgggagacagct

SEQ ID NO: 765661 - DNA, 13 bp, Homo sapiens
ctgcccgctccca

SEQ ID NO: 765662 - DNA, 13 bp, Homo sapiens
ctgcccggcaggg

SEQ ID NO: 765663 - DNA, 18 bp, Homo sapiens
ctgcccggcgcctgccct

SEQ ID NO: 765664 - DNA, 13 bp, Homo sapiens
ctgcccgggcccc

SEQ ID NO: 765665 - DNA, 17 bp, Homo sapiens
ctgcccggggagctgca

SEQ ID NO: 765666 - DNA, 21 bp, Homo sapiens
ctgcccggggagctgcagagc

SEQ ID NO: 765667 - DNA, 23 bp, Homo sapiens
ctgcccggggagctgcagagcag

SEQ ID NO: 765668 - DNA, 22 bp, Homo sapiens
ctgcccggggcagctgccagag

SEQ ID NO: 765669 - DNA, 20 bp, Homo sapiens
ctgcccggtggtttgccatg

SEQ ID NO: 765670 - DNA, 17 bp, Homo sapiens
ctgcccgtcttcagcct

SEQ ID NO: 765671 - DNA, 20 bp, Homo sapiens
ctgccctaagcccccagggc

SEQ ID NO: 765672 - DNA, 22 bp, Homo sapiens
ctgccctaagcccccagggcct

SEQ ID NO: 765673 - DNA, 15 bp, Homo sapiens
ctgccctagctgacc

SEQ ID NO: 765674 - DNA, 20 bp, Homo sapiens
ctgccctatgggcctgccgg

SEQ ID NO: 765675 - DNA, 13 bp, Homo sapiens
ctgccctcaggga

SEQ ID NO: 765676 - DNA, 23 bp, Homo sapiens
ctgccctcattactgggccttag

SEQ ID NO: 765677 - DNA, 10 bp, Homo sapiens
ctgccctccc

SEQ ID NO: 765678 - DNA, 16 bp, Homo sapiens
ctgccctcccgcacct

SEQ ID NO: 765679 - DNA, 23 bp, Homo sapiens
ctgccctcccgcaccttcctcct

SEQ ID NO: 765680 - DNA, 20 bp, Homo sapiens
ctgccctccctcggccccac

SEQ ID NO: 765681 - DNA, 15 bp, Homo sapiens
ctgccctccggagga

SEQ ID NO: 765682 - DNA, 20 bp, Homo sapiens
ctgccctccggaggagcagc

SEQ ID NO: 765683 - DNA, 23 bp, Homo sapiens
ctgccctccggaggagcagcctc

SEQ ID NO: 765684 - DNA, 17 bp, Homo sapiens
ctgccctccttaatttg

SEQ ID NO: 765685 - DNA, 16 bp, Homo sapiens
ctgccctcgtggccag

SEQ ID NO: 765686 - DNA, 22 bp, Homo sapiens
ctgccctctcccaaaaaactac

SEQ ID NO: 765687 - DNA, 13 bp, Homo sapiens
ctgccctctccct

SEQ ID NO: 765688 - DNA, 15 bp, Homo sapiens
ctgccctctccctgt

SEQ ID NO: 765689 - DNA, 11 bp, Homo sapiens
ctgccctctgc

SEQ ID NO: 765690 - DNA, 18 bp, Homo sapiens
ctgccctctgctctgcct

SEQ ID NO: 765691 - DNA, 22 bp, Homo sapiens
ctgccctctgctctgcctggag

SEQ ID NO: 765692 - DNA, 14 bp, Homo sapiens
ctgccctctgctgc

SEQ ID NO: 765693 - DNA, 16 bp, Homo sapiens
ctgccctctgctgctg

SEQ ID NO: 765694 - DNA, 18 bp, Homo sapiens
ctgccctctgctgctgcc

SEQ ID NO: 765695 - DNA, 21 bp, Homo sapiens
cagcccctagaaacccaagct

SEQ ID NO: 765696 - DNA, 12 bp, Homo sapiens
cagcccctagga

SEQ ID NO: 765697 - DNA, 22 bp, Homo sapiens
cagcccctatagcactgagctc

SEQ ID NO: 765698 - DNA, 21 bp, Homo sapiens
cagcccctcccaccacagcag

SEQ ID NO: 765699 - DNA, 13 bp, Homo sapiens
cagcccctctggt

SEQ ID NO: 765700 - DNA, 16 bp, Homo sapiens
cagcccctctggtcgc

SEQ ID NO: 765701 - DNA, 11 bp, Homo sapiens
cagcccctctt

SEQ ID NO: 765702 - DNA, 22 bp, Homo sapiens
cagcccctcttcccttcctcca

SEQ ID NO: 765703 - DNA, 23 bp, Homo sapiens
cagcccctcttcccttcctccat

SEQ ID NO: 765704 - DNA, 23 bp, Homo sapiens
cagcccctcttgccccccacccc

SEQ ID NO: 765705 - DNA, 14 bp, Homo sapiens
cagcccctgatctc

SEQ ID NO: 765706 - DNA, 20 bp, Homo sapiens
cagcccctggacccctgggg

SEQ ID NO: 765707 - DNA, 13 bp, Homo sapiens
cagcccctggccc

SEQ ID NO: 765708 - DNA, 18 bp, Homo sapiens
cagcccctgggcccttgt

SEQ ID NO: 765709 - DNA, 22 bp, Homo sapiens
cagcccctgggcccttgtgctc

SEQ ID NO: 765710 - DNA, 14 bp, Homo sapiens
cagcccctggggcc

SEQ ID NO: 765711 - DNA, 20 bp, Homo sapiens
cagccccttctcagaatcta

SEQ ID NO: 765712 - DNA, 18 bp, Homo sapiens
cagccccttctcccagca

SEQ ID NO: 765713 - DNA, 20 bp, Homo sapiens
cagccccttctcccagcaca

SEQ ID NO: 765714 - DNA, 12 bp, Homo sapiens
cagcccctttcc

SEQ ID NO: 765715 - DNA, 16 bp, Homo sapiens
cagcccctttgcctct

SEQ ID NO: 765716 - DNA, 19 bp, Homo sapiens
cagcccctttgcctctgtc

SEQ ID NO: 765717 - DNA, 14 bp, Homo sapiens
cagccccttttctc

SEQ ID NO: 765718 - DNA, 18 bp, Homo sapiens
cagccccttttctctgct

SEQ ID NO: 765719 - DNA, 14 bp, Homo sapiens
cagcccgcacacct

SEQ ID NO: 765720 - DNA, 15 bp, Homo sapiens
cagcccgcacacctg

SEQ ID NO: 765721 - DNA, 16 bp, Homo sapiens
cagcccgcacacctgc

SEQ ID NO: 765722 - DNA, 15 bp, Homo sapiens
cagcccgccagaggc

SEQ ID NO: 765723 - DNA, 19 bp, Homo sapiens
cagcccgcccactgggtaa

SEQ ID NO: 765724 - DNA, 14 bp, Homo sapiens
cagcccgccgcccg

SEQ ID NO: 765725 - DNA, 16 bp, Homo sapiens
cagcccgcggcctgga

SEQ ID NO: 765726 - DNA, 19 bp, Homo sapiens
cagcccgctaggctcgcct

SEQ ID NO: 765727 - DNA, 17 bp, Homo sapiens
cagcccgctctctggct

SEQ ID NO: 765728 - DNA, 19 bp, Homo sapiens
cagcccggctgctgcttgg

SEQ ID NO: 765729 - DNA, 14 bp, Homo sapiens
cagcccggctggtt

SEQ ID NO: 765730 - DNA, 22 bp, Homo sapiens
cagcccggctggttttgtaaga

SEQ ID NO: 765731 - DNA, 14 bp, Homo sapiens
cagcccgggagcct

SEQ ID NO: 765732 - DNA, 20 bp, Homo sapiens
cagcccgggagcctaggacc

SEQ ID NO: 765733 - DNA, 21 bp, Homo sapiens
cagcccgggtgtgcctgccct

SEQ ID NO: 765734 - DNA, 22 bp, Homo sapiens
cagcccgggtgtgcctgccctg

SEQ ID NO: 765735 - DNA, 17 bp, Homo sapiens
cagcccgtgcaccctgg

SEQ ID NO: 765736 - DNA, 15 bp, Homo sapiens
cagcccgtgtggccc

SEQ ID NO: 765737 - DNA, 20 bp, Homo sapiens
cagcccgtgtggccccttca

SEQ ID NO: 765738 - DNA, 16 bp, Homo sapiens
cagccctaaacatcat

SEQ ID NO: 765739 - DNA, 17 bp, Homo sapiens
cagccctaaggatctct

SEQ ID NO: 765740 - DNA, 19 bp, Homo sapiens
cagccctagctgtcccatg

SEQ ID NO: 765741 - DNA, 20 bp, Homo sapiens
cagccctatggatgtggggt

SEQ ID NO: 765742 - DNA, 12 bp, Homo sapiens
cagccctcacct

SEQ ID NO: 765743 - DNA, 12 bp, Homo sapiens
cagccctcacta

SEQ ID NO: 765744 - DNA, 15 bp, Homo sapiens
cagccctccatggtc

SEQ ID NO: 765745 - DNA, 13 bp, Homo sapiens
cagccctccctgt

SEQ ID NO: 765746 - DNA, 18 bp, Homo sapiens
cagccctccctgtcctcc

SEQ ID NO: 765747 - DNA, 20 bp, Homo sapiens
cagccctcctacgcagatgc

SEQ ID NO: 765748 - DNA, 13 bp, Homo sapiens
cagccctcctcac

SEQ ID NO: 765749 - DNA, 14 bp, Homo sapiens
cagccctcctcacc

SEQ ID NO: 765750 - DNA, 22 bp, Homo sapiens
cagccctcctcaccccgtctgg

SEQ ID NO: 765751 - DNA, 14 bp, Homo sapiens
cagccctcggcctc

SEQ ID NO: 765752 - DNA, 12 bp, Homo sapiens
cagccctgaggt

SEQ ID NO: 765753 - DNA, 22 bp, Homo sapiens
cagccctgagtggtcactggtc

SEQ ID NO: 765754 - DNA, 15 bp, Homo sapiens
cagccctgcagccca

SEQ ID NO: 765755 - DNA, 15 bp, Homo sapiens
cagccctgcccaccc

SEQ ID NO: 765756 - DNA, 14 bp, Homo sapiens
ctgaaatttcagat

SEQ ID NO: 765757 - DNA, 18 bp, Homo sapiens
ctgaaatttctcattagt

SEQ ID NO: 765758 - DNA, 21 bp, Homo sapiens
ctgaaatttgttatacttcaa

SEQ ID NO: 765759 - DNA, 23 bp, Homo sapiens
ctgaaatttgttatacttcaaaa

SEQ ID NO: 765760 - DNA, 18 bp, Homo sapiens
ctgaaattttagaaatat

SEQ ID NO: 765761 - DNA, 19 bp, Homo sapiens
ctgaacaaaacctacacac

SEQ ID NO: 765762 - DNA, 16 bp, Homo sapiens
ctgaacaagaattgga

SEQ ID NO: 765763 - DNA, 21 bp, Homo sapiens
ctgaacaataggctgttccca

SEQ ID NO: 765764 - DNA, 17 bp, Homo sapiens
ctgaacacacacgccag

SEQ ID NO: 765765 - DNA, 19 bp, Homo sapiens
ctgaacacacacgccagct

SEQ ID NO: 765766 - DNA, 13 bp, Homo sapiens
ctgaacacagtgt

SEQ ID NO: 765767 - DNA, 16 bp, Homo sapiens
ctgaacacagtgtctg

SEQ ID NO: 765768 - DNA, 12 bp, Homo sapiens
ctgaacacatgt

SEQ ID NO: 765769 - DNA, 17 bp, Homo sapiens
ctgaacacatgtgtatg

SEQ ID NO: 765770 - DNA, 18 bp, Homo sapiens
ctgaacaccattgaaggc

SEQ ID NO: 765771 - DNA, 13 bp, Homo sapiens
ctgaacaggctgg

SEQ ID NO: 765772 - DNA, 16 bp, Homo sapiens
ctgaacaggctggggc

SEQ ID NO: 765773 - DNA, 20 bp, Homo sapiens
ctgaacatccttccttccca

SEQ ID NO: 765774 - DNA, 19 bp, Homo sapiens
ctgaacatctgagtcctgg

SEQ ID NO: 765775 - DNA, 14 bp, Homo sapiens
ctgaacatgcctgc

SEQ ID NO: 765776 - DNA, 17 bp, Homo sapiens
ctgaacatgcctgccaa

SEQ ID NO: 765777 - DNA, 12 bp, Homo sapiens
ctgaacatgttt

SEQ ID NO: 765778 - DNA, 20 bp, Homo sapiens
ctgaacatgtttacaggttt

SEQ ID NO: 765779 - DNA, 12 bp, Homo sapiens
ctgaaccaaagc

SEQ ID NO: 765780 - DNA, 16 bp, Homo sapiens
ctgaaccaaagcctct

SEQ ID NO: 765781 - DNA, 21 bp, Homo sapiens
ctgaaccacgaggctgccccc

SEQ ID NO: 765782 - DNA, 11 bp, Homo sapiens
ctgaaccactg

SEQ ID NO: 765783 - DNA, 19 bp, Homo sapiens
ctgaaccactgcttctctt

SEQ ID NO: 765784 - DNA, 13 bp, Homo sapiens
ctgaaccagccac

SEQ ID NO: 765785 - DNA, 15 bp, Homo sapiens
ctgaacccacacctg

SEQ ID NO: 765786 - DNA, 12 bp, Homo sapiens
ctgaacccagct

SEQ ID NO: 765787 - DNA, 14 bp, Homo sapiens
ctgaaccccatggg

SEQ ID NO: 765788 - DNA, 16 bp, Homo sapiens
ctgaaccccatgggct

SEQ ID NO: 765789 - DNA, 17 bp, Homo sapiens
ctgaaccccatgggctt

SEQ ID NO: 765790 - DNA, 20 bp, Homo sapiens
ctgaaccccatgggcttgga

SEQ ID NO: 765791 - DNA, 21 bp, Homo sapiens
ctgaaccccgtcgaggggctc

SEQ ID NO: 765792 - DNA, 12 bp, Homo sapiens
ctgaacccctgg

SEQ ID NO: 765793 - DNA, 17 bp, Homo sapiens
ctgaacccctggccagc

SEQ ID NO: 765794 - DNA, 21 bp, Homo sapiens
ctgaacccgtccattcagaaa

SEQ ID NO: 765795 - DNA, 13 bp, Homo sapiens
ctgaaccctgtgc

SEQ ID NO: 765796 - DNA, 20 bp, Homo sapiens
ctgaacccttgtgcttggtg

SEQ ID NO: 765797 - DNA, 18 bp, Homo sapiens
ctgaaccgactgaccctg

SEQ ID NO: 765798 - DNA, 19 bp, Homo sapiens
ctgaaccgactgaccctga

SEQ ID NO: 765799 - DNA, 20 bp, Homo sapiens
ctgaaccgactgaccctgag

SEQ ID NO: 765800 - DNA, 18 bp, Homo sapiens
ctgaaccgcacagctcag

SEQ ID NO: 765801 - DNA, 21 bp, Homo sapiens
ctgaaccgcacagctcaggag

SEQ ID NO: 765802 - DNA, 23 bp, Homo sapiens
ctgaaccgcacagctcaggaggc

SEQ ID NO: 765803 - DNA, 23 bp, Homo sapiens
ctgaaccttaggctttgtatgac

SEQ ID NO: 765804 - DNA, 17 bp, Homo sapiens
ctgaacggggagaaaag

SEQ ID NO: 765805 - DNA, 21 bp, Homo sapiens
ctgaacgttttcttctttccc

SEQ ID NO: 765806 - DNA, 23 bp, Homo sapiens
ctgaacgttttcttctttccctg

SEQ ID NO: 765807 - DNA, 16 bp, Homo sapiens
ctgaactacaagtgta

SEQ ID NO: 765808 - DNA, 13 bp, Homo sapiens
ctgaactccaccg

SEQ ID NO: 765809 - DNA, 23 bp, Homo sapiens
ctgaactccaccgaccaactgcc

SEQ ID NO: 765810 - DNA, 19 bp, Homo sapiens
ctgaactccatacagcctc

SEQ ID NO: 765811 - DNA, 18 bp, Homo sapiens
ctgaactccttccccact

SEQ ID NO: 765812 - DNA, 18 bp, Homo sapiens
ctgaactcttaggcacat

SEQ ID NO: 765813 - DNA, 14 bp, Homo sapiens
ctgaactcttcaga

SEQ ID NO: 765814 - DNA, 13 bp, Homo sapiens
ctgaactgaacac

SEQ ID NO: 765815 - DNA, 14 bp, Homo sapiens
ctgaactgacaatg

SEQ ID NO: 765816 - DNA, 18 bp, Homo sapiens
ctgaactgacaatgaagg

SEQ ID NO: 765817 - DNA, 20 bp, Homo sapiens
cagccgtgccttcagctcta

SEQ ID NO: 765818 - DNA, 21 bp, Homo sapiens
cagccgtgtaaccatggaccc

SEQ ID NO: 765819 - DNA, 14 bp, Homo sapiens
cagccgttttcctc

SEQ ID NO: 765820 - DNA, 17 bp, Homo sapiens
cagccgttttcctcatc

SEQ ID NO: 765821 - DNA, 16 bp, Homo sapiens
cagcctaagatgaaga

SEQ ID NO: 765822 - DNA, 21 bp, Homo sapiens
cagcctaatgagagtgcactg

SEQ ID NO: 765823 - DNA, 12 bp, Homo sapiens
cagcctacagtt

SEQ ID NO: 765824 - DNA, 17 bp, Homo sapiens
cagcctacccttcctgc

SEQ ID NO: 765825 - DNA, 19 bp, Homo sapiens
cagcctacccttcctgcat

SEQ ID NO: 765826 - DNA, 17 bp, Homo sapiens
cagcctagcacagcagc

SEQ ID NO: 765827 - DNA, 15 bp, Homo sapiens
cagcctagccgacct

SEQ ID NO: 765828 - DNA, 19 bp, Homo sapiens
cagcctagccgacctcagc

SEQ ID NO: 765829 - DNA, 20 bp, Homo sapiens
cagcctagccgacctcagcc

SEQ ID NO: 765830 - DNA, 18 bp, Homo sapiens
cagcctagggcagacaat

SEQ ID NO: 765831 - DNA, 18 bp, Homo sapiens
cagcctaggggtcaggga

SEQ ID NO: 765832 - DNA, 15 bp, Homo sapiens
cagcctaggtggagg

SEQ ID NO: 765833 - DNA, 13 bp, Homo sapiens
cagcctatgagca

SEQ ID NO: 765834 - DNA, 23 bp, Homo sapiens
cagcctatgagcatcctgagccc

SEQ ID NO: 765835 - DNA, 21 bp, Homo sapiens
cagcctatgggggctctcgga

SEQ ID NO: 765836 - DNA, 19 bp, Homo sapiens
cagcctcaacctcctgggt

SEQ ID NO: 765837 - DNA, 21 bp, Homo sapiens
cagcctcaaggccctcggagc

SEQ ID NO: 765838 - DNA, 12 bp, Homo sapiens
cagcctcacaga

SEQ ID NO: 765839 - DNA, 13 bp, Homo sapiens
cagcctcacagaa

SEQ ID NO: 765840 - DNA, 23 bp, Homo sapiens
cagcctcagaaggccccagagag

SEQ ID NO: 765841 - DNA, 13 bp, Homo sapiens
cagcctcagactg

SEQ ID NO: 765842 - DNA, 15 bp, Homo sapiens
cagcctcagagtggt

SEQ ID NO: 765843 - DNA, 16 bp, Homo sapiens
cagcctcagcccaact

SEQ ID NO: 765844 - DNA, 22 bp, Homo sapiens
cagcctcatactcctgggctca

SEQ ID NO: 765845 - DNA, 17 bp, Homo sapiens
cagcctcattctgaggc

SEQ ID NO: 765846 - DNA, 20 bp, Homo sapiens
cagcctcattctgaggcctg

SEQ ID NO: 765847 - DNA, 22 bp, Homo sapiens
cagcctcattgtgccaagcctt

SEQ ID NO: 765848 - DNA, 21 bp, Homo sapiens
cagcctccaaagtggagctgg

SEQ ID NO: 765849 - DNA, 22 bp, Homo sapiens
cagcctccaaagtggagctggg

SEQ ID NO: 765850 - DNA, 14 bp, Homo sapiens
cagcctccagagaa

SEQ ID NO: 765851 - DNA, 20 bp, Homo sapiens
cagcctccagagaagccccg

SEQ ID NO: 765852 - DNA, 16 bp, Homo sapiens
cagcctccagagccag

SEQ ID NO: 765853 - DNA, 14 bp, Homo sapiens
cagcctccagggcc

SEQ ID NO: 765854 - DNA, 17 bp, Homo sapiens
cagcctccatgctgcct

SEQ ID NO: 765855 - DNA, 18 bp, Homo sapiens
cagcctccatgctgcctc

SEQ ID NO: 765856 - DNA, 20 bp, Homo sapiens
cagcctccatgctgcctcca

SEQ ID NO: 765857 - DNA, 13 bp, Homo sapiens
cagcctcccaaag

SEQ ID NO: 765858 - DNA, 22 bp, Homo sapiens
cagcctcccaagtagctgggat

SEQ ID NO: 765859 - DNA, 12 bp, Homo sapiens
cagcctcccaca

SEQ ID NO: 765860 - DNA, 20 bp, Homo sapiens
cagcctcccatccagggccc

SEQ ID NO: 765861 - DNA, 23 bp, Homo sapiens
cagcctccccaccccagtgggaa

SEQ ID NO: 765862 - DNA, 21 bp, Homo sapiens
cagcctccccagtagctggga

SEQ ID NO: 765863 - DNA, 11 bp, Homo sapiens
cagcctcccct

SEQ ID NO: 765864 - DNA, 13 bp, Homo sapiens
cagcctcccctcc

SEQ ID NO: 765865 - DNA, 14 bp, Homo sapiens
cagcctcccctccc

SEQ ID NO: 765866 - DNA, 19 bp, Homo sapiens
cagcctcccctgccagggc

SEQ ID NO: 765867 - DNA, 22 bp, Homo sapiens
cagcctcccgagtagctgggat

SEQ ID NO: 765868 - DNA, 11 bp, Homo sapiens
cagcctccctc

SEQ ID NO: 765869 - DNA, 12 bp, Homo sapiens
cagcctccctca

SEQ ID NO: 765870 - DNA, 16 bp, Homo sapiens
cagcctccctcagccc

SEQ ID NO: 765871 - DNA, 22 bp, Homo sapiens
cagcctccctcagcccccagga

SEQ ID NO: 765872 - DNA, 22 bp, Homo sapiens
cagcctccctctgacctgcagg

SEQ ID NO: 765873 - DNA, 12 bp, Homo sapiens
cagcctccctga

SEQ ID NO: 765874 - DNA, 15 bp, Homo sapiens
cagcctccctgagcc

SEQ ID NO: 765875 - DNA, 16 bp, Homo sapiens
cagcctccctgagcct

SEQ ID NO: 765876 - DNA, 17 bp, Homo sapiens
cagcctccctgagcctg

SEQ ID NO: 765877 - DNA, 12 bp, Homo sapiens
cagcctccctgt

SEQ ID NO: 765878 - DNA, 15 bp, Homo sapiens
cagcctccctgtctc

SEQ ID NO: 765879 - DNA, 17 bp, Homo sapiens
cagcctccctgtctcca

SEQ ID NO: 765880 - DNA, 19 bp, Homo sapiens
cagcctccgagagggagag

SEQ ID NO: 765881 - DNA, 21 bp, Homo sapiens
cagcctccgtcatccatgccc

SEQ ID NO: 765882 - DNA, 22 bp, Homo sapiens
cagcctccgtcatccatgccct

SEQ ID NO: 765883 - DNA, 14 bp, Homo sapiens
ctgaagggaccccc

SEQ ID NO: 765884 - DNA, 21 bp, Homo sapiens
ctgaaggggcacaccactgcc

SEQ ID NO: 765885 - DNA, 15 bp, Homo sapiens
ctgaaggtaaaattg

SEQ ID NO: 765886 - DNA, 17 bp, Homo sapiens
ctgaaggtaaaattgaa

SEQ ID NO: 765887 - DNA, 18 bp, Homo sapiens
ctgaaggtattggcctgt

SEQ ID NO: 765888 - DNA, 19 bp, Homo sapiens
ctgaaggttttttttttaa

SEQ ID NO: 765889 - DNA, 22 bp, Homo sapiens
ctgaaggttttttttttaagtg

SEQ ID NO: 765890 - DNA, 22 bp, Homo sapiens
ctgaagtcacatcacaggacac

SEQ ID NO: 765891 - DNA, 16 bp, Homo sapiens
ctgaagtcactgcaca

SEQ ID NO: 765892 - DNA, 22 bp, Homo sapiens
ctgaagtcattgtcgctcagca

SEQ ID NO: 765893 - DNA, 22 bp, Homo sapiens
ctgaagtcccagatacttgggg

SEQ ID NO: 765894 - DNA, 16 bp, Homo sapiens
ctgaagtcttttctgt

SEQ ID NO: 765895 - DNA, 18 bp, Homo sapiens
ctgaagtcttttctgtca

SEQ ID NO: 765896 - DNA, 18 bp, Homo sapiens
ctgaagtgagcacagcct

SEQ ID NO: 765897 - DNA, 19 bp, Homo sapiens
ctgaagtgagcacagccta

SEQ ID NO: 765898 - DNA, 21 bp, Homo sapiens
ctgaagtgagcacagcctagg

SEQ ID NO: 765899 - DNA, 22 bp, Homo sapiens
ctgaagtgcatccaaaggtgct

SEQ ID NO: 765900 - DNA, 20 bp, Homo sapiens
ctgaagtgcctactgggggg

SEQ ID NO: 765901 - DNA, 20 bp, Homo sapiens
ctgaagtggctggtagaaaa

SEQ ID NO: 765902 - DNA, 22 bp, Homo sapiens
ctgaagtgggaaaaaatagact

SEQ ID NO: 765903 - DNA, 22 bp, Homo sapiens
ctgaagtggtttgcaggtcagc

SEQ ID NO: 765904 - DNA, 23 bp, Homo sapiens
ctgaagtggtttgcaggtcagcc

SEQ ID NO: 765905 - DNA, 19 bp, Homo sapiens
ctgaagtgtgtccatcctg

SEQ ID NO: 765906 - DNA, 14 bp, Homo sapiens
ctgaagttgctgct

SEQ ID NO: 765907 - DNA, 13 bp, Homo sapiens
ctgaagtttcaca

SEQ ID NO: 765908 - DNA, 15 bp, Homo sapiens
ctgaagtttcattta

SEQ ID NO: 765909 - DNA, 14 bp, Homo sapiens
ctgaataaaaaaga

SEQ ID NO: 765910 - DNA, 19 bp, Homo sapiens
ctgaataaaaaagattcta

SEQ ID NO: 765911 - DNA, 14 bp, Homo sapiens
ctgaataaaccagt

SEQ ID NO: 765912 - DNA, 21 bp, Homo sapiens
ctgaataaactcaaaactctt

SEQ ID NO: 765913 - DNA, 21 bp, Homo sapiens
ctgaataaatacctcttagct

SEQ ID NO: 765914 - DNA, 17 bp, Homo sapiens
ctgaataaatggtagta

SEQ ID NO: 765915 - DNA, 16 bp, Homo sapiens
ctgaataaattcagta

SEQ ID NO: 765916 - DNA, 19 bp, Homo sapiens
ctgaataatgctaccagga

SEQ ID NO: 765917 - DNA, 16 bp, Homo sapiens
ctgaataatttcttac

SEQ ID NO: 765918 - DNA, 19 bp, Homo sapiens
ctgaataccactctgtaat

SEQ ID NO: 765919 - DNA, 19 bp, Homo sapiens
ctgaatagtcttcagagat

SEQ ID NO: 765920 - DNA, 20 bp, Homo sapiens
ctgaatatttatatttcact

SEQ ID NO: 765921 - DNA, 21 bp, Homo sapiens
ctgaatatttatatttcacta

SEQ ID NO: 765922 - DNA, 22 bp, Homo sapiens
ctgaatattttttatttctaag

SEQ ID NO: 765923 - DNA, 17 bp, Homo sapiens
ctgaatcagaaaagcta

SEQ ID NO: 765924 - DNA, 18 bp, Homo sapiens
ctgaatcatgagcctgct

SEQ ID NO: 765925 - DNA, 20 bp, Homo sapiens
ctgaatcatgagcctgctgg

SEQ ID NO: 765926 - DNA, 15 bp, Homo sapiens
ctgaatcatttctta

SEQ ID NO: 765927 - DNA, 16 bp, Homo sapiens
ctgaatcccatcaggc

SEQ ID NO: 765928 - DNA, 12 bp, Homo sapiens
ctgaatctcata

SEQ ID NO: 765929 - DNA, 15 bp, Homo sapiens
ctgaatctgctacca

SEQ ID NO: 765930 - DNA, 22 bp, Homo sapiens
ctgaatctgctaccaaaacagt

SEQ ID NO: 765931 - DNA, 17 bp, Homo sapiens
ctgaatctgtgcaaaca

SEQ ID NO: 765932 - DNA, 23 bp, Homo sapiens
ctgaatctgtgcctgcactgaga

SEQ ID NO: 765933 - DNA, 21 bp, Homo sapiens
ctgaatcttttttttatataa

SEQ ID NO: 765934 - DNA, 22 bp, Homo sapiens
ctgaatgaaccttctggcctcc

SEQ ID NO: 765935 - DNA, 16 bp, Homo sapiens
ctgaatgactaatcag

SEQ ID NO: 765936 - DNA, 13 bp, Homo sapiens
ctgaatgccccct

SEQ ID NO: 765937 - DNA, 21 bp, Homo sapiens
ctgaatgccccctgcttactt

SEQ ID NO: 765938 - DNA, 10 bp, Homo sapiens
cagcctggca

SEQ ID NO: 765939 - DNA, 16 bp, Homo sapiens
cagcctggcttctgga

SEQ ID NO: 765940 - DNA, 17 bp, Homo sapiens
cagcctggcttctggag

SEQ ID NO: 765941 - DNA, 19 bp, Homo sapiens
cagcctggcttctggagcc

SEQ ID NO: 765942 - DNA, 13 bp, Homo sapiens
cagcctgggacac

SEQ ID NO: 765943 - DNA, 17 bp, Homo sapiens
cagcctgggactcccag

SEQ ID NO: 765944 - DNA, 18 bp, Homo sapiens
cagcctgggactcccagt

SEQ ID NO: 765945 - DNA, 20 bp, Homo sapiens
cagcctgggactcccagtga

SEQ ID NO: 765946 - DNA, 19 bp, Homo sapiens
cagcctgggagcccagagg

SEQ ID NO: 765947 - DNA, 20 bp, Homo sapiens
cagcctgggagcccagaggg

SEQ ID NO: 765948 - DNA, 20 bp, Homo sapiens
cagcctgggcagcatagcaa

SEQ ID NO: 765949 - DNA, 12 bp, Homo sapiens
cagcctgggcca

SEQ ID NO: 765950 - DNA, 13 bp, Homo sapiens
cagcctgggccca

SEQ ID NO: 765951 - DNA, 22 bp, Homo sapiens
cagcctgggcccatctccctgc

SEQ ID NO: 765952 - DNA, 11 bp, Homo sapiens
cagcctgggcg

SEQ ID NO: 765953 - DNA, 15 bp, Homo sapiens
cagcctgggcgacag

SEQ ID NO: 765954 - DNA, 16 bp, Homo sapiens
cagcctgggctccctc

SEQ ID NO: 765955 - DNA, 19 bp, Homo sapiens
cagcctgggctccctcttg

SEQ ID NO: 765956 - DNA, 17 bp, Homo sapiens
cagcctggggcggtgtg

SEQ ID NO: 765957 - DNA, 20 bp, Homo sapiens
cagcctggggcggtgtgtgt

SEQ ID NO: 765958 - DNA, 12 bp, Homo sapiens
cagcctggggct

SEQ ID NO: 765959 - DNA, 15 bp, Homo sapiens
cagcctggggctctc

SEQ ID NO: 765960 - DNA, 20 bp, Homo sapiens
cagcctggggttgtccccgc

SEQ ID NO: 765961 - DNA, 12 bp, Homo sapiens
cagcctgggtct

SEQ ID NO: 765962 - DNA, 13 bp, Homo sapiens
cagcctgggtctg

SEQ ID NO: 765963 - DNA, 17 bp, Homo sapiens
cagcctgggtgacagag

SEQ ID NO: 765964 - DNA, 18 bp, Homo sapiens
cagcctgggtgacagagc

SEQ ID NO: 765965 - DNA, 19 bp, Homo sapiens
cagcctggtccatgcaggg

SEQ ID NO: 765966 - DNA, 23 bp, Homo sapiens
cagcctggtccatgcagggggct

SEQ ID NO: 765967 - DNA, 15 bp, Homo sapiens
cagcctggtgggcct

SEQ ID NO: 765968 - DNA, 16 bp, Homo sapiens
cagcctgtaccttgct

SEQ ID NO: 765969 - DNA, 16 bp, Homo sapiens
cagcctgtcacccagc

SEQ ID NO: 765970 - DNA, 14 bp, Homo sapiens
cagcctgtcctggt

SEQ ID NO: 765971 - DNA, 16 bp, Homo sapiens
cagcctgtcctggtac

SEQ ID NO: 765972 - DNA, 17 bp, Homo sapiens
cagcctgtcctggtaca

SEQ ID NO: 765973 - DNA, 17 bp, Homo sapiens
cagcctgtctcgggctg

SEQ ID NO: 765974 - DNA, 14 bp, Homo sapiens
cagcctgtgcctgc

SEQ ID NO: 765975 - DNA, 17 bp, Homo sapiens
cagcctgtgcctgcctt

SEQ ID NO: 765976 - DNA, 19 bp, Homo sapiens
cagcctgtgcctgcctttg

SEQ ID NO: 765977 - DNA, 14 bp, Homo sapiens
cagcctgtgctgcc

SEQ ID NO: 765978 - DNA, 12 bp, Homo sapiens
cagcctgtggca

SEQ ID NO: 765979 - DNA, 21 bp, Homo sapiens
cagcctgtggcggtgcctggg

SEQ ID NO: 765980 - DNA, 14 bp, Homo sapiens
cagccttaagctta

SEQ ID NO: 765981 - DNA, 14 bp, Homo sapiens
cagccttaatagac

SEQ ID NO: 765982 - DNA, 22 bp, Homo sapiens
cagccttaatagacttctctta

SEQ ID NO: 765983 - DNA, 17 bp, Homo sapiens
cagccttaccttggggc

SEQ ID NO: 765984 - DNA, 14 bp, Homo sapiens
cagccttagctgcc

SEQ ID NO: 765985 - DNA, 15 bp, Homo sapiens
cagccttatgtgtta

SEQ ID NO: 765986 - DNA, 24 bp, Homo sapiens
cagccttcataggcggtcatgtgt

SEQ ID NO: 765987 - DNA, 16 bp, Homo sapiens
cagccttccccagctc

SEQ ID NO: 765988 - DNA, 16 bp, Homo sapiens
cagccttccccttgcc

SEQ ID NO: 765989 - DNA, 15 bp, Homo sapiens
cagccttcctctgca

SEQ ID NO: 765990 - DNA, 23 bp, Homo sapiens
cagccttcgtgtggctcctggta

SEQ ID NO: 765991 - DNA, 13 bp, Homo sapiens
cagccttctgagt

SEQ ID NO: 765992 - DNA, 16 bp, Homo sapiens
cagccttctgagtagc

SEQ ID NO: 765993 - DNA, 19 bp, Homo sapiens
cagccttgaactcctggcc

SEQ ID NO: 765994 - DNA, 15 bp, Homo sapiens
cagccttgagatgct

SEQ ID NO: 765995 - DNA, 18 bp, Homo sapiens
cagccttgagccctggct

SEQ ID NO: 765996 - DNA, 19 bp, Homo sapiens
cagccttgagccctggctg

SEQ ID NO: 765997 - DNA, 15 bp, Homo sapiens
cagccttgcgctgtc

SEQ ID NO: 765998 - DNA, 18 bp, Homo sapiens
cagccttgcgctgtccca

SEQ ID NO: 765999 - DNA, 19 bp, Homo sapiens
cagccttgcgctgtcccag

SEQ ID NO: 766000 - DNA, 22 bp, Homo sapiens
cagccttgcgctgtcccaggca

SEQ ID NO: 766001 - DNA, 15 bp, Homo sapiens
cagccttgggggggc

SEQ ID NO: 766002 - DNA, 22 bp, Homo sapiens
cagccttgggggggctgccttt

SEQ ID NO: 766003 - DNA, 20 bp, Homo sapiens
cagccttgtcctcccaggct

SEQ ID NO: 766004 - DNA, 18 bp, Homo sapiens
cagcctttaggtctttag

SEQ ID NO: 766005 - DNA, 15 bp, Homo sapiens
cagcctttccagcct

SEQ ID NO: 766006 - DNA, 17 bp, Homo sapiens
cagcctttgcctccccg

SEQ ID NO: 766007 - DNA, 16 bp, Homo sapiens
cagcctttgctccctc

SEQ ID NO: 766008 - DNA, 11 bp, Homo sapiens
cagcctttgtt

SEQ ID NO: 766009 - DNA, 21 bp, Homo sapiens
cagccttttctggtccctctt

SEQ ID NO: 766010 - DNA, 12 bp, Homo sapiens
ctgacagctgct

SEQ ID NO: 766011 - DNA, 23 bp, Homo sapiens
ctgacagctgctcctagagggag

SEQ ID NO: 766012 - DNA, 15 bp, Homo sapiens
ctgacaggcagcctg

SEQ ID NO: 766013 - DNA, 21 bp, Homo sapiens
ctgacagggacatgccctgtg

SEQ ID NO: 766014 - DNA, 14 bp, Homo sapiens
ctgacagggagcag

SEQ ID NO: 766015 - DNA, 12 bp, Homo sapiens
ctgacagggcca

SEQ ID NO: 766016 - DNA, 20 bp, Homo sapiens
ctgacaggtgatgctctggc

SEQ ID NO: 766017 - DNA, 22 bp, Homo sapiens
ctgacaggtgatgctctggctt

SEQ ID NO: 766018 - DNA, 23 bp, Homo sapiens
ctgacaggtgatgctctggcttg

SEQ ID NO: 766019 - DNA, 19 bp, Homo sapiens
ctgacagtccacaggggcc

SEQ ID NO: 766020 - DNA, 19 bp, Homo sapiens
ctgacagtttacagacgct

SEQ ID NO: 766021 - DNA, 19 bp, Homo sapiens
ctgacatcagaggtatctt

SEQ ID NO: 766022 - DNA, 12 bp, Homo sapiens
ctgacatccctt

SEQ ID NO: 766023 - DNA, 21 bp, Homo sapiens
ctgacatcccttcctggaaac

SEQ ID NO: 766024 - DNA, 17 bp, Homo sapiens
ctgacatgccctccctt

SEQ ID NO: 766025 - DNA, 20 bp, Homo sapiens
ctgacatgccctcccttctc

SEQ ID NO: 766026 - DNA, 19 bp, Homo sapiens
ctgacatgtaagaaaatgt

SEQ ID NO: 766027 - DNA, 20 bp, Homo sapiens
ctgacatgtaagaaaatgtt

SEQ ID NO: 766028 - DNA, 21 bp, Homo sapiens
ctgacatgtggggccaggtca

SEQ ID NO: 766029 - DNA, 15 bp, Homo sapiens
ctgacattaacagtt

SEQ ID NO: 766030 - DNA, 17 bp, Homo sapiens
ctgacattcacctgccc

SEQ ID NO: 766031 - DNA, 15 bp, Homo sapiens
ctgacattctgattc

SEQ ID NO: 766032 - DNA, 16 bp, Homo sapiens
ctgacattgccaaaaa

SEQ ID NO: 766033 - DNA, 21 bp, Homo sapiens
ctgacattgccaaaaaggata

SEQ ID NO: 766034 - DNA, 20 bp, Homo sapiens
ctgacattgctccaagatgt

SEQ ID NO: 766035 - DNA, 18 bp, Homo sapiens
ctgacatttggagtgttc

SEQ ID NO: 766036 - DNA, 21 bp, Homo sapiens
ctgacatttggagtgttcccc

SEQ ID NO: 766037 - DNA, 21 bp, Homo sapiens
ctgacattttctttcatgggc

SEQ ID NO: 766038 - DNA, 15 bp, Homo sapiens
ctgaccaaacagcca

SEQ ID NO: 766039 - DNA, 22 bp, Homo sapiens
ctgaccaagactgagccagctt

SEQ ID NO: 766040 - DNA, 17 bp, Homo sapiens
ctgaccaagagagaaag

SEQ ID NO: 766041 - DNA, 19 bp, Homo sapiens
ctgaccaatattgtacagt

SEQ ID NO: 766042 - DNA, 16 bp, Homo sapiens
ctgaccaattgtgctg

SEQ ID NO: 766043 - DNA, 15 bp, Homo sapiens
ctgaccacacgcggg

SEQ ID NO: 766044 - DNA, 18 bp, Homo sapiens
ctgaccacacttcctgtc

SEQ ID NO: 766045 - DNA, 15 bp, Homo sapiens
ctgaccacagcacag

SEQ ID NO: 766046 - DNA, 18 bp, Homo sapiens
ctgaccacagcacagcca

SEQ ID NO: 766047 - DNA, 16 bp, Homo sapiens
ctgaccaccctcccct

SEQ ID NO: 766048 - DNA, 22 bp, Homo sapiens
ctgaccacgctttctagctgtt

SEQ ID NO: 766049 - DNA, 20 bp, Homo sapiens
ctgaccagcagcgcctttcc

SEQ ID NO: 766050 - DNA, 14 bp, Homo sapiens
ctgaccagctggag

SEQ ID NO: 766051 - DNA, 16 bp, Homo sapiens
ctgaccagctggagtg

SEQ ID NO: 766052 - DNA, 23 bp, Homo sapiens
ctgaccagctggagtgagggcct

SEQ ID NO: 766053 - DNA, 19 bp, Homo sapiens
ctgaccaggcccaaggagg

SEQ ID NO: 766054 - DNA, 17 bp, Homo sapiens
ctgaccaggcgcccggg

SEQ ID NO: 766055 - DNA, 22 bp, Homo sapiens
ctgaccatattgtgcttcacag

SEQ ID NO: 766056 - DNA, 19 bp, Homo sapiens
ctgaccatgcactatattt

SEQ ID NO: 766057 - DNA, 15 bp, Homo sapiens
ctgaccatgcgtcag

SEQ ID NO: 766058 - DNA, 15 bp, Homo sapiens
ctgaccatgctcatc

SEQ ID NO: 766059 - DNA, 21 bp, Homo sapiens
ctgaccatgctcatctgctgg

SEQ ID NO: 766060 - DNA, 22 bp, Homo sapiens
cagcggaggggtttgggagtca

SEQ ID NO: 766061 - DNA, 17 bp, Homo sapiens
cagcggattgctctgga

SEQ ID NO: 766062 - DNA, 17 bp, Homo sapiens
cagcggcagtgggcctg

SEQ ID NO: 766063 - DNA, 17 bp, Homo sapiens
cagcggcccctcccaca

SEQ ID NO: 766064 - DNA, 18 bp, Homo sapiens
cagcggcccctcccacac

SEQ ID NO: 766065 - DNA, 15 bp, Homo sapiens
cagcggcccctgcat

SEQ ID NO: 766066 - DNA, 11 bp, Homo sapiens
cagcggcctca

SEQ ID NO: 766067 - DNA, 13 bp, Homo sapiens
cagcggcctcagg

SEQ ID NO: 766068 - DNA, 21 bp, Homo sapiens
cagcggccttgaagacagagc

SEQ ID NO: 766069 - DNA, 21 bp, Homo sapiens
cagcggctcccctctgcttct

SEQ ID NO: 766070 - DNA, 14 bp, Homo sapiens
cagcggcttagcca

SEQ ID NO: 766071 - DNA, 23 bp, Homo sapiens
cagcggcttagccaagccctaag

SEQ ID NO: 766072 - DNA, 18 bp, Homo sapiens
cagcgggcgctgctggga

SEQ ID NO: 766073 - DNA, 14 bp, Homo sapiens
cagcggggctgctc

SEQ ID NO: 766074 - DNA, 17 bp, Homo sapiens
cagcggggctgctcacc

SEQ ID NO: 766075 - DNA, 15 bp, Homo sapiens
cagcgggtctcctcc

SEQ ID NO: 766076 - DNA, 16 bp, Homo sapiens
cagcgggtctcctccc

SEQ ID NO: 766077 - DNA, 18 bp, Homo sapiens
cagcgggtctcctcccag

SEQ ID NO: 766078 - DNA, 22 bp, Homo sapiens
cagcgggtctcctcccagcggc

SEQ ID NO: 766079 - DNA, 18 bp, Homo sapiens
cagcggtccaaagttatc

SEQ ID NO: 766080 - DNA, 15 bp, Homo sapiens
cagcggtccatgggt

SEQ ID NO: 766081 - DNA, 18 bp, Homo sapiens
cagcggtccatgggtctg

SEQ ID NO: 766082 - DNA, 20 bp, Homo sapiens
cagcggttcctgtgcagatg

SEQ ID NO: 766083 - DNA, 17 bp, Homo sapiens
cagcgtagcctctccgg

SEQ ID NO: 766084 - DNA, 12 bp, Homo sapiens
cagcgtagtgtt

SEQ ID NO: 766085 - DNA, 21 bp, Homo sapiens
cagcgtcagctgctccctggc

SEQ ID NO: 766086 - DNA, 13 bp, Homo sapiens
cagcgtcaggcct

SEQ ID NO: 766087 - DNA, 14 bp, Homo sapiens
cagcgtcaggccta

SEQ ID NO: 766088 - DNA, 20 bp, Homo sapiens
cagcgtcaggcctacctcaa

SEQ ID NO: 766089 - DNA, 16 bp, Homo sapiens
cagcgtcctcctctgt

SEQ ID NO: 766090 - DNA, 18 bp, Homo sapiens
cagcgtcctcctctgtga

SEQ ID NO: 766091 - DNA, 15 bp, Homo sapiens
cagcgtcctgtccac

SEQ ID NO: 766092 - DNA, 13 bp, Homo sapiens
cagcgtctgcagg

SEQ ID NO: 766093 - DNA, 15 bp, Homo sapiens
cagcgtctgcagggt

SEQ ID NO: 766094 - DNA, 18 bp, Homo sapiens
cagcgtctgcagggtgac

SEQ ID NO: 766095 - DNA, 23 bp, Homo sapiens
cagcgtctgcagggtgacgcctg

SEQ ID NO: 766096 - DNA, 16 bp, Homo sapiens
cagcgtgcacatctgc

SEQ ID NO: 766097 - DNA, 19 bp, Homo sapiens
cagcgtgctttaaaaaata

SEQ ID NO: 766098 - DNA, 17 bp, Homo sapiens
cagcgtggcttttccta

SEQ ID NO: 766099 - DNA, 14 bp, Homo sapiens
cagcgtgggctctg

SEQ ID NO: 766100 - DNA, 14 bp, Homo sapiens
cagcgtgtggagca

SEQ ID NO: 766101 - DNA, 17 bp, Homo sapiens
cagcgtttatggtgctt

SEQ ID NO: 766102 - DNA, 14 bp, Homo sapiens
cagcgtttctatga

SEQ ID NO: 766103 - DNA, 21 bp, Homo sapiens
cagctaaaataagctcagtga

SEQ ID NO: 766104 - DNA, 19 bp, Homo sapiens
cagctaaatgtaacttatt

SEQ ID NO: 766105 - DNA, 14 bp, Homo sapiens
cagctaatctgtag

SEQ ID NO: 766106 - DNA, 17 bp, Homo sapiens
cagctaatctgtagggc

SEQ ID NO: 766107 - DNA, 22 bp, Homo sapiens
cagctaattctactcacagtgc

SEQ ID NO: 766108 - DNA, 14 bp, Homo sapiens
cagctacattcctc

SEQ ID NO: 766109 - DNA, 22 bp, Homo sapiens
cagctacattcctcagctgcca

SEQ ID NO: 766110 - DNA, 12 bp, Homo sapiens
cagctacctgag

SEQ ID NO: 766111 - DNA, 15 bp, Homo sapiens
cagctacctgagacg

SEQ ID NO: 766112 - DNA, 16 bp, Homo sapiens
cagctactcaactgga

SEQ ID NO: 766113 - DNA, 19 bp, Homo sapiens
cagctactcaagaggctga

SEQ ID NO: 766114 - DNA, 20 bp, Homo sapiens
cagctactcagaagcctgag

SEQ ID NO: 766115 - DNA, 14 bp, Homo sapiens
cagctactcaggag

SEQ ID NO: 766116 - DNA, 18 bp, Homo sapiens
cagctactcaggaggctg

SEQ ID NO: 766117 - DNA, 19 bp, Homo sapiens
cagctactcgggaggctga

SEQ ID NO: 766118 - DNA, 23 bp, Homo sapiens
cagctactcgggaggctgaggca

SEQ ID NO: 766119 - DNA, 24 bp, Homo sapiens
cagctactcgggaggctgaggcag

SEQ ID NO: 766120 - DNA, 15 bp, Homo sapiens
cagctactctcccca

SEQ ID NO: 766121 - DNA, 23 bp, Homo sapiens
cagctactctccccacgagggct

SEQ ID NO: 766122 - DNA, 16 bp, Homo sapiens
cagctactgatttttg

SEQ ID NO: 766123 - DNA, 15 bp, Homo sapiens
cagctactggaatgg

SEQ ID NO: 766124 - DNA, 18 bp, Homo sapiens
cagctactggaatggtgt

SEQ ID NO: 766125 - DNA, 14 bp, Homo sapiens
cagctactgtaact

SEQ ID NO: 766126 - DNA, 21 bp, Homo sapiens
cagctactgtaacttttttaa

SEQ ID NO: 766127 - DNA, 15 bp, Homo sapiens
cagctacttcctcct

SEQ ID NO: 766128 - DNA, 18 bp, Homo sapiens
cagctacttgggagcctg

SEQ ID NO: 766129 - DNA, 19 bp, Homo sapiens
cagctacttgggaggctga

SEQ ID NO: 766130 - DNA, 16 bp, Homo sapiens
cagctagaatttctgg

SEQ ID NO: 766131 - DNA, 21 bp, Homo sapiens
cagctagactggagtgaggct

SEQ ID NO: 766132 - DNA, 16 bp, Homo sapiens
cagctaggactgagga

SEQ ID NO: 766133 - DNA, 13 bp, Homo sapiens
cagctatacagga

SEQ ID NO: 766134 - DNA, 17 bp, Homo sapiens
cagctatccagtgactt

SEQ ID NO: 766135 - DNA, 19 bp, Homo sapiens
cagctatcgaacttcacaa

SEQ ID NO: 766136 - DNA, 14 bp, Homo sapiens
cagctatctgtcat

SEQ ID NO: 766137 - DNA, 13 bp, Homo sapiens
ctgacggctgggg

SEQ ID NO: 766138 - DNA, 19 bp, Homo sapiens
ctgacgtagaaagatcctt

SEQ ID NO: 766139 - DNA, 19 bp, Homo sapiens
ctgacgtcagcgcaccaaa

SEQ ID NO: 766140 - DNA, 18 bp, Homo sapiens
ctgacgtgggcatcattt

SEQ ID NO: 766141 - DNA, 15 bp, Homo sapiens
ctgacgttccgggca

SEQ ID NO: 766142 - DNA, 18 bp, Homo sapiens
ctgactactactctgcca

SEQ ID NO: 766143 - DNA, 19 bp, Homo sapiens
ctgactactactctgccaa

SEQ ID NO: 766144 - DNA, 17 bp, Homo sapiens
ctgactactggctctca

SEQ ID NO: 766145 - DNA, 14 bp, Homo sapiens
ctgactcacaagaa

SEQ ID NO: 766146 - DNA, 17 bp, Homo sapiens
ctgactcacaagaagac

SEQ ID NO: 766147 - DNA, 21 bp, Homo sapiens
ctgactcagggctcctgggtt

SEQ ID NO: 766148 - DNA, 12 bp, Homo sapiens
ctgactccagag

SEQ ID NO: 766149 - DNA, 14 bp, Homo sapiens
ctgactccagagtc

SEQ ID NO: 766150 - DNA, 15 bp, Homo sapiens
ctgactccagagtct

SEQ ID NO: 766151 - DNA, 18 bp, Homo sapiens
ctgactccctccccaccc

SEQ ID NO: 766152 - DNA, 19 bp, Homo sapiens
ctgactccctccccaccca

SEQ ID NO: 766153 - DNA, 19 bp, Homo sapiens
ctgactcctctaagccact

SEQ ID NO: 766154 - DNA, 20 bp, Homo sapiens
ctgactcctctggctttccc

SEQ ID NO: 766155 - DNA, 15 bp, Homo sapiens
ctgactcctggactc

SEQ ID NO: 766156 - DNA, 16 bp, Homo sapiens
ctgactcctggactcc

SEQ ID NO: 766157 - DNA, 15 bp, Homo sapiens
ctgactccttagaga

SEQ ID NO: 766158 - DNA, 17 bp, Homo sapiens
ctgactcggtttctcca

SEQ ID NO: 766159 - DNA, 14 bp, Homo sapiens
ctgactctcacctg

SEQ ID NO: 766160 - DNA, 21 bp, Homo sapiens
ctgactctctgagctggggag

SEQ ID NO: 766161 - DNA, 15 bp, Homo sapiens
ctgactctgactcat

SEQ ID NO: 766162 - DNA, 20 bp, Homo sapiens
ctgactctgagtccactgct

SEQ ID NO: 766163 - DNA, 21 bp, Homo sapiens
ctgactctgagtccactgctc

SEQ ID NO: 766164 - DNA, 22 bp, Homo sapiens
ctgactgaaggaaaagcaagaa

SEQ ID NO: 766165 - DNA, 24 bp, Homo sapiens
ctgactgatagcttacactgagga

SEQ ID NO: 766166 - DNA, 19 bp, Homo sapiens
ctgactgatgttgagggaa

SEQ ID NO: 766167 - DNA, 23 bp, Homo sapiens
ctgactgcaccagcgcccccaga

SEQ ID NO: 766168 - DNA, 23 bp, Homo sapiens
ctgactgcactgttgctgactac

SEQ ID NO: 766169 - DNA, 21 bp, Homo sapiens
ctgactgctcagaacttgctg

SEQ ID NO: 766170 - DNA, 12 bp, Homo sapiens
ctgactgggagt

SEQ ID NO: 766171 - DNA, 21 bp, Homo sapiens
ctgactgggccacagccccga

SEQ ID NO: 766172 - DNA, 16 bp, Homo sapiens
ctgactggggctgggg

SEQ ID NO: 766173 - DNA, 18 bp, Homo sapiens
ctgactggggctggggtg

SEQ ID NO: 766174 - DNA, 14 bp, Homo sapiens
ctgactggttgtca

SEQ ID NO: 766175 - DNA, 17 bp, Homo sapiens
ctgactgtactcctccc

SEQ ID NO: 766176 - DNA, 19 bp, Homo sapiens
ctgactgtggccccctccg

SEQ ID NO: 766177 - DNA, 15 bp, Homo sapiens
ctgactgttggctct

SEQ ID NO: 766178 - DNA, 18 bp, Homo sapiens
ctgactgttttttttgca

SEQ ID NO: 766179 - DNA, 18 bp, Homo sapiens
ctgacttaagcaaaagaa

SEQ ID NO: 766180 - DNA, 18 bp, Homo sapiens
ctgacttctagctgtctg

SEQ ID NO: 766181 - DNA, 19 bp, Homo sapiens
ctgacttctagctgtctgt

SEQ ID NO: 766182 - DNA, 15 bp, Homo sapiens
cagctgttcctgtgt

SEQ ID NO: 766183 - DNA, 20 bp, Homo sapiens
cagctgttcttagtgacaca

SEQ ID NO: 766184 - DNA, 15 bp, Homo sapiens
cagctgttgagaaaa

SEQ ID NO: 766185 - DNA, 14 bp, Homo sapiens
cagctgtttaagat

SEQ ID NO: 766186 - DNA, 14 bp, Homo sapiens
cagctgtttctcat

SEQ ID NO: 766187 - DNA, 17 bp, Homo sapiens
cagctgtttctcatgaa

SEQ ID NO: 766188 - DNA, 12 bp, Homo sapiens
cagctgttttca

SEQ ID NO: 766189 - DNA, 16 bp, Homo sapiens
cagctgttttcaaagc

SEQ ID NO: 766190 - DNA, 21 bp, Homo sapiens
cagctgttttcaaagcccccg

SEQ ID NO: 766191 - DNA, 22 bp, Homo sapiens
cagctgttttgttgacattctg

SEQ ID NO: 766192 - DNA, 14 bp, Homo sapiens
cagcttaagcgttc

SEQ ID NO: 766193 - DNA, 15 bp, Homo sapiens
cagcttaattctcct

SEQ ID NO: 766194 - DNA, 20 bp, Homo sapiens
cagcttaattctccttccca

SEQ ID NO: 766195 - DNA, 22 bp, Homo sapiens
cagcttaattctccttcccaga

SEQ ID NO: 766196 - DNA, 17 bp, Homo sapiens
cagcttagagttcttct

SEQ ID NO: 766197 - DNA, 17 bp, Homo sapiens
cagcttagatttcatag

SEQ ID NO: 766198 - DNA, 19 bp, Homo sapiens
cagcttagatttcatagtt

SEQ ID NO: 766199 - DNA, 18 bp, Homo sapiens
cagcttagggccctggag

SEQ ID NO: 766200 - DNA, 16 bp, Homo sapiens
cagcttatacgaaata

SEQ ID NO: 766201 - DNA, 15 bp, Homo sapiens
cagcttatctctttt

SEQ ID NO: 766202 - DNA, 22 bp, Homo sapiens
cagcttatctcttttatatttg

SEQ ID NO: 766203 - DNA, 21 bp, Homo sapiens
cagcttatgggatccttgtct

SEQ ID NO: 766204 - DNA, 18 bp, Homo sapiens
cagcttcaacttttctct

SEQ ID NO: 766205 - DNA, 14 bp, Homo sapiens
cagcttcaccagag

SEQ ID NO: 766206 - DNA, 16 bp, Homo sapiens
cagcttcaccctgtca

SEQ ID NO: 766207 - DNA, 11 bp, Homo sapiens
cagcttcagct

SEQ ID NO: 766208 - DNA, 20 bp, Homo sapiens
cagcttcatgcctttgtaag

SEQ ID NO: 766209 - DNA, 21 bp, Homo sapiens
cagcttcatgcctttgtaagt

SEQ ID NO: 766210 - DNA, 18 bp, Homo sapiens
cagcttcattatctgagt

SEQ ID NO: 766211 - DNA, 13 bp, Homo sapiens
cagcttcatttgt

SEQ ID NO: 766212 - DNA, 17 bp, Homo sapiens
cagcttcatttgtgtca

SEQ ID NO: 766213 - DNA, 19 bp, Homo sapiens
cagcttcattttatttttg

SEQ ID NO: 766214 - DNA, 17 bp, Homo sapiens
cagcttccaaagcctag

SEQ ID NO: 766215 - DNA, 14 bp, Homo sapiens
cagcttcctcacac

SEQ ID NO: 766216 - DNA, 18 bp, Homo sapiens
cagcttcgaggacaggaa

SEQ ID NO: 766217 - DNA, 20 bp, Homo sapiens
cagcttcggggccggtgagg

SEQ ID NO: 766218 - DNA, 16 bp, Homo sapiens
cagcttcgtgctggag

SEQ ID NO: 766219 - DNA, 20 bp, Homo sapiens
cagcttcgtttattttcaag

SEQ ID NO: 766220 - DNA, 14 bp, Homo sapiens
cagcttctaagagc

SEQ ID NO: 766221 - DNA, 17 bp, Homo sapiens
cagcttctccaagcatc

SEQ ID NO: 766222 - DNA, 16 bp, Homo sapiens
cagcttctcctgtgtg

SEQ ID NO: 766223 - DNA, 16 bp, Homo sapiens
cagcttctctctccag

SEQ ID NO: 766224 - DNA, 23 bp, Homo sapiens
cagcttctctctccctgtcacac

SEQ ID NO: 766225 - DNA, 12 bp, Homo sapiens
cagcttctctgc

SEQ ID NO: 766226 - DNA, 15 bp, Homo sapiens
cagcttctctgcagt

SEQ ID NO: 766227 - DNA, 16 bp, Homo sapiens
cagcttctctgcagta

SEQ ID NO: 766228 - DNA, 21 bp, Homo sapiens
cagcttctggtactctcctag

SEQ ID NO: 766229 - DNA, 19 bp, Homo sapiens
cagcttcttcacaggcact

SEQ ID NO: 766230 - DNA, 24 bp, Homo sapiens
cagcttcttgcactccttccctaa

SEQ ID NO: 766231 - DNA, 20 bp, Homo sapiens
cagcttcttttgtctcccag

SEQ ID NO: 766232 - DNA, 14 bp, Homo sapiens
cagcttgaacctgc

SEQ ID NO: 766233 - DNA, 16 bp, Homo sapiens
cagcttgaacctgctt

SEQ ID NO: 766234 - DNA, 22 bp, Homo sapiens
cagcttgagccgggcccctggg

SEQ ID NO: 766235 - DNA, 12 bp, Homo sapiens
cagcttgccccg

SEQ ID NO: 766236 - DNA, 14 bp, Homo sapiens
cagcttgctgaggg

SEQ ID NO: 766237 - DNA, 17 bp, Homo sapiens
cagcttgggcccagctg

SEQ ID NO: 766238 - DNA, 20 bp, Homo sapiens
cagcttgggcccagctgggc

SEQ ID NO: 766239 - DNA, 21 bp, Homo sapiens
cagcttgggcccagctgggct

SEQ ID NO: 766240 - DNA, 19 bp, Homo sapiens
cagcttgggcttcttcctc

SEQ ID NO: 766241 - DNA, 21 bp, Homo sapiens
cagcttgggcttcttcctcct

SEQ ID NO: 766242 - DNA, 22 bp, Homo sapiens
cagcttgggcttcttcctcctc

SEQ ID NO: 766243 - DNA, 23 bp, Homo sapiens
cagcttgggcttcttcctcctcc

SEQ ID NO: 766244 - DNA, 24 bp, Homo sapiens
cagcttgggtcaggttcttgcctt

SEQ ID NO: 766245 - DNA, 20 bp, Homo sapiens
cagcttgggtgataaaataa

SEQ ID NO: 766246 - DNA, 15 bp, Homo sapiens
cagcttgtaggagct

SEQ ID NO: 766247 - DNA, 20 bp, Homo sapiens
cagcttgtggcaagtgaatt

SEQ ID NO: 766248 - DNA, 19 bp, Homo sapiens
cagctttaaactcagggac

SEQ ID NO: 766249 - DNA, 20 bp, Homo sapiens
cagctttaaactcagggaca

SEQ ID NO: 766250 - DNA, 21 bp, Homo sapiens
cagctttaaactcagggacag

SEQ ID NO: 766251 - DNA, 22 bp, Homo sapiens
cagctttaaactcagggacaga

SEQ ID NO: 766252 - DNA, 17 bp, Homo sapiens
cagctttactttaaaat

SEQ ID NO: 766253 - DNA, 18 bp, Homo sapiens
cagctttcagctcttaaa

SEQ ID NO: 766254 - DNA, 20 bp, Homo sapiens
cagctttcatgattagcaag

SEQ ID NO: 766255 - DNA, 15 bp, Homo sapiens
cagctttctgggatg

SEQ ID NO: 766256 - DNA, 21 bp, Homo sapiens
cagctttctgggatgtcacag

SEQ ID NO: 766257 - DNA, 23 bp, Homo sapiens
cagctttgactttatctcctgct

SEQ ID NO: 766258 - DNA, 20 bp, Homo sapiens
cagctttgagaagccttcag

SEQ ID NO: 766259 - DNA, 17 bp, Homo sapiens
cagctttgatccctgac

SEQ ID NO: 766260 - DNA, 20 bp, Homo sapiens
cagctttgatccctgacatc

SEQ ID NO: 766261 - DNA, 14 bp, Homo sapiens
cagctttgccttcc

SEQ ID NO: 766262 - DNA, 18 bp, Homo sapiens
cagctttgccttccacgc

SEQ ID NO: 766263 - DNA, 12 bp, Homo sapiens
cagctttgctgc

SEQ ID NO: 766264 - DNA, 13 bp, Homo sapiens
cagctttgctgct

SEQ ID NO: 766265 - DNA, 22 bp, Homo sapiens
cagctttgtttgttgtcagctg

SEQ ID NO: 766266 - DNA, 13 bp, Homo sapiens
cagcttttcaaac

SEQ ID NO: 766267 - DNA, 15 bp, Homo sapiens
cagcttttctgatgg

SEQ ID NO: 766268 - DNA, 14 bp, Homo sapiens
cagcttttgttcta

SEQ ID NO: 766269 - DNA, 15 bp, Homo sapiens
ctgagatatgaacat

SEQ ID NO: 766270 - DNA, 19 bp, Homo sapiens
ctgagatatggcattgcac

SEQ ID NO: 766271 - DNA, 21 bp, Homo sapiens
ctgagatcaaaacggttttac

SEQ ID NO: 766272 - DNA, 18 bp, Homo sapiens
ctgagatcccctgagccc

SEQ ID NO: 766273 - DNA, 14 bp, Homo sapiens
ctgagatcgtgccg

SEQ ID NO: 766274 - DNA, 19 bp, Homo sapiens
ctgagatcgtgctactgca

SEQ ID NO: 766275 - DNA, 16 bp, Homo sapiens
ctgagatgatgcatga

SEQ ID NO: 766276 - DNA, 18 bp, Homo sapiens
ctgagatgatgcatgatg

SEQ ID NO: 766277 - DNA, 16 bp, Homo sapiens
ctgagatgccccgagc

SEQ ID NO: 766278 - DNA, 19 bp, Homo sapiens
ctgagatgctaatttattt

SEQ ID NO: 766279 - DNA, 14 bp, Homo sapiens
ctgagatgctgggc

SEQ ID NO: 766280 - DNA, 15 bp, Homo sapiens
ctgagatgctgggct

SEQ ID NO: 766281 - DNA, 19 bp, Homo sapiens
ctgagatgctgggctgtct

SEQ ID NO: 766282 - DNA, 15 bp, Homo sapiens
ctgagatggaaaagt

SEQ ID NO: 766283 - DNA, 15 bp, Homo sapiens
ctgagatggagctgc

SEQ ID NO: 766284 - DNA, 18 bp, Homo sapiens
ctgagatgttttaccatc

SEQ ID NO: 766285 - DNA, 21 bp, Homo sapiens
ctgagattgcagatgtgagcc

SEQ ID NO: 766286 - DNA, 23 bp, Homo sapiens
ctgagattgtgtttgttcataat

SEQ ID NO: 766287 - DNA, 20 bp, Homo sapiens
ctgagatttttttgtgtatg

SEQ ID NO: 766288 - DNA, 21 bp, Homo sapiens
ctgagatttttttgtgtatgt

SEQ ID NO: 766289 - DNA, 20 bp, Homo sapiens
ctgagcaaatgtggctcctg

SEQ ID NO: 766290 - DNA, 23 bp, Homo sapiens
ctgagcaacagagtgagaccctg

SEQ ID NO: 766291 - DNA, 24 bp, Homo sapiens
ctgagcaacagagtgagaccctgt

SEQ ID NO: 766292 - DNA, 13 bp, Homo sapiens
ctgagcaataact

SEQ ID NO: 766293 - DNA, 17 bp, Homo sapiens
ctgagcaatctgaccct

SEQ ID NO: 766294 - DNA, 16 bp, Homo sapiens
ctgagcaatgtctgtg

SEQ ID NO: 766295 - DNA, 18 bp, Homo sapiens
ctgagcaatgtctgtgct

SEQ ID NO: 766296 - DNA, 18 bp, Homo sapiens
ctgagcacaggtgacaga

SEQ ID NO: 766297 - DNA, 18 bp, Homo sapiens
ctgagcacagtcaggggc

SEQ ID NO: 766298 - DNA, 19 bp, Homo sapiens
ctgagcacagtcaggggct

SEQ ID NO: 766299 - DNA, 21 bp, Homo sapiens
ctgagcacatagtgtcctgcc

SEQ ID NO: 766300 - DNA, 23 bp, Homo sapiens
ctgagcacatagtgtcctgccca

SEQ ID NO: 766301 - DNA, 15 bp, Homo sapiens
ctgagcaccctctcc

SEQ ID NO: 766302 - DNA, 16 bp, Homo sapiens
ctgagcaccctctgga

SEQ ID NO: 766303 - DNA, 19 bp, Homo sapiens
cagatgtggggctgagctg

SEQ ID NO: 766304 - DNA, 23 bp, Homo sapiens
cagatgtgtctgggagagcctgg

SEQ ID NO: 766305 - DNA, 17 bp, Homo sapiens
cagatgttaaaataaat

SEQ ID NO: 766306 - DNA, 18 bp, Homo sapiens
cagatgttaaaataaatg

SEQ ID NO: 766307 - DNA, 23 bp, Homo sapiens
cagatgtttccagacttccttga

SEQ ID NO: 766308 - DNA, 23 bp, Homo sapiens
cagatgtttcgagtaaacttgaa

SEQ ID NO: 766309 - DNA, 22 bp, Homo sapiens
cagatgtttcttttgtatgtaa

SEQ ID NO: 766310 - DNA, 20 bp, Homo sapiens
cagatgttttacgcaaggaa

SEQ ID NO: 766311 - DNA, 22 bp, Homo sapiens
cagatgttttacgcaaggaagg

SEQ ID NO: 766312 - DNA, 17 bp, Homo sapiens
cagatgttttacgtctg

SEQ ID NO: 766313 - DNA, 23 bp, Homo sapiens
cagatgttttggtcaagtagttt

SEQ ID NO: 766314 - DNA, 21 bp, Homo sapiens
cagattactgctttaatcaga

SEQ ID NO: 766315 - DNA, 18 bp, Homo sapiens
cagattcactttgtttat

SEQ ID NO: 766316 - DNA, 15 bp, Homo sapiens
cagattcaggccagc

SEQ ID NO: 766317 - DNA, 19 bp, Homo sapiens
cagattcaggccagcccag

SEQ ID NO: 766318 - DNA, 22 bp, Homo sapiens
cagattcataaagtaatgatga

SEQ ID NO: 766319 - DNA, 16 bp, Homo sapiens
cagattccaacatttc

SEQ ID NO: 766320 - DNA, 14 bp, Homo sapiens
cacttcactgtgag

SEQ ID NO: 766321 - DNA, 15 bp, Homo sapiens
cacttcactgtgagg

SEQ ID NO: 766322 - DNA, 19 bp, Homo sapiens
cacttcagacacaggaaaa

SEQ ID NO: 766323 - DNA, 20 bp, Homo sapiens
cacttcagacacaggaaaaa

SEQ ID NO: 766324 - DNA, 16 bp, Homo sapiens
cacttcagagagctgg

SEQ ID NO: 766325 - DNA, 13 bp, Homo sapiens
cacttcagatctg

SEQ ID NO: 766326 - DNA, 19 bp, Homo sapiens
cacttcagatctgaggttg

SEQ ID NO: 766327 - DNA, 15 bp, Homo sapiens
cacttcaggctcttc

SEQ ID NO: 766328 - DNA, 20 bp, Homo sapiens
cacttcaggctcttctcctt

SEQ ID NO: 766329 - DNA, 19 bp, Homo sapiens
cacttcaggtccgtgggcc

SEQ ID NO: 766330 - DNA, 15 bp, Homo sapiens
cacttcattccagca

SEQ ID NO: 766331 - DNA, 17 bp, Homo sapiens
cacttcattccagcagc

SEQ ID NO: 766332 - DNA, 18 bp, Homo sapiens
cacttcattccagcagct

SEQ ID NO: 766333 - DNA, 21 bp, Homo sapiens
cacttcattccagcagctgca

SEQ ID NO: 766334 - DNA, 16 bp, Homo sapiens
cacttcattgagagtt

SEQ ID NO: 766335 - DNA, 22 bp, Homo sapiens
cacttcattgagagttttgtct

SEQ ID NO: 766336 - DNA, 15 bp, Homo sapiens
cacttccagagccag

SEQ ID NO: 766337 - DNA, 16 bp, Homo sapiens
cacttccagagccaga

SEQ ID NO: 766338 - DNA, 18 bp, Homo sapiens
cacttccagatatccaca

SEQ ID NO: 766339 - DNA, 19 bp, Homo sapiens
cacttccagatatccacat

SEQ ID NO: 766340 - DNA, 18 bp, Homo sapiens
cacttccagtctggagag

SEQ ID NO: 766341 - DNA, 23 bp, Homo sapiens
cacttccattggttcttcctttc

SEQ ID NO: 766342 - DNA, 21 bp, Homo sapiens
cacttcccatctccagggaag

SEQ ID NO: 766343 - DNA, 20 bp, Homo sapiens
cacttcccctccaagaccct

SEQ ID NO: 766344 - DNA, 16 bp, Homo sapiens
cacttccctctgtttc

SEQ ID NO: 766345 - DNA, 17 bp, Homo sapiens
cacttccctctgtttct

SEQ ID NO: 766346 - DNA, 14 bp, Homo sapiens
cacttccctgggcc

SEQ ID NO: 766347 - DNA, 15 bp, Homo sapiens
cacttccctgggcct

SEQ ID NO: 766348 - DNA, 11 bp, Homo sapiens
cacttcctcct

SEQ ID NO: 766349 - DNA, 16 bp, Homo sapiens
cacttcctcctacctg

SEQ ID NO: 766350 - DNA, 21 bp, Homo sapiens
cacttcctcctacctggggac

SEQ ID NO: 766351 - DNA, 12 bp, Homo sapiens
cacttcctgcct

SEQ ID NO: 766352 - DNA, 17 bp, Homo sapiens
cacttcctgtccagaga

SEQ ID NO: 766353 - DNA, 18 bp, Homo sapiens
cacttcctgtccagagag

SEQ ID NO: 766354 - DNA, 15 bp, Homo sapiens
cacttcctgtccttg

SEQ ID NO: 766355 - DNA, 17 bp, Homo sapiens
cacttcctgttttataa

SEQ ID NO: 766356 - DNA, 12 bp, Homo sapiens
cacttcctttcc

SEQ ID NO: 766357 - DNA, 15 bp, Homo sapiens
cacttcctttcctac

SEQ ID NO: 766358 - DNA, 15 bp, Homo sapiens
cacttccttttaact

SEQ ID NO: 766359 - DNA, 17 bp, Homo sapiens
cacttctaaatagcaat

SEQ ID NO: 766360 - DNA, 12 bp, Homo sapiens
cacttctaaatt

SEQ ID NO: 766361 - DNA, 21 bp, Homo sapiens
cacttctaaattaatggtaaa

SEQ ID NO: 766362 - DNA, 18 bp, Homo sapiens
cacttctagtggtctcac

SEQ ID NO: 766363 - DNA, 19 bp, Homo sapiens
cacttctagtggtctcacc

SEQ ID NO: 766364 - DNA, 13 bp, Homo sapiens
cacttctatttaa

SEQ ID NO: 766365 - DNA, 23 bp, Homo sapiens
cacttctcatcatattgtatgta

SEQ ID NO: 766366 - DNA, 13 bp, Homo sapiens
cacttctccaaga

SEQ ID NO: 766367 - DNA, 13 bp, Homo sapiens
cacttctccccgc

SEQ ID NO: 766368 - DNA, 23 bp, Homo sapiens
cacttctgaccttgctgccacaa

SEQ ID NO: 766369 - DNA, 14 bp, Homo sapiens
ctccccttggacct

SEQ ID NO: 766370 - DNA, 18 bp, Homo sapiens
ctccccttggacctccag

SEQ ID NO: 766371 - DNA, 12 bp, Homo sapiens
ctccccttgggc

SEQ ID NO: 766372 - DNA, 21 bp, Homo sapiens
ctccccttggttctgcactgt

SEQ ID NO: 766373 - DNA, 19 bp, Homo sapiens
ctccccttttctatgttgc

SEQ ID NO: 766374 - DNA, 20 bp, Homo sapiens
ctccccttttctatgttgct

SEQ ID NO: 766375 - DNA, 14 bp, Homo sapiens
ctcccgaaaaatgt

SEQ ID NO: 766376 - DNA, 17 bp, Homo sapiens
ctcccgaaaaatgtgtg

SEQ ID NO: 766377 - DNA, 20 bp, Homo sapiens
ctcccgaaaaatgtgtggtt

SEQ ID NO: 766378 - DNA, 22 bp, Homo sapiens
ctcccgaaaaatgtgtggttct

SEQ ID NO: 766379 - DNA, 16 bp, Homo sapiens
ctcccgaaagcctttc

SEQ ID NO: 766380 - DNA, 15 bp, Homo sapiens
ctcccgacagcccat

SEQ ID NO: 766381 - DNA, 12 bp, Homo sapiens
ctcccgagctcc

SEQ ID NO: 766382 - DNA, 14 bp, Homo sapiens
ctcccgagctcctc

SEQ ID NO: 766383 - DNA, 18 bp, Homo sapiens
ctcccgagtagctgggat

SEQ ID NO: 766384 - DNA, 19 bp, Homo sapiens
ctcccgagtagctgggatt

SEQ ID NO: 766385 - DNA, 16 bp, Homo sapiens
ctcccgagtggggcct

SEQ ID NO: 766386 - DNA, 20 bp, Homo sapiens
ctcccgcaccttcctcctcc

SEQ ID NO: 766387 - DNA, 22 bp, Homo sapiens
ctcccgcatttctcatgcttct

SEQ ID NO: 766388 - DNA, 13 bp, Homo sapiens
ctcccgcccccca

SEQ ID NO: 766389 - DNA, 23 bp, Homo sapiens
ctcccgccccccacacttccctg

SEQ ID NO: 766390 - DNA, 20 bp, Homo sapiens
ctcccgccccgggctggccc

SEQ ID NO: 766391 - DNA, 14 bp, Homo sapiens
ctcccgctcccagg

SEQ ID NO: 766392 - DNA, 14 bp, Homo sapiens
ctcccgctgcacac

SEQ ID NO: 766393 - DNA, 13 bp, Homo sapiens
ctcccgctgctgc

SEQ ID NO: 766394 - DNA, 16 bp, Homo sapiens
ctcccgctgctgctgc

SEQ ID NO: 766395 - DNA, 17 bp, Homo sapiens
ctcccgctgctgctgct

SEQ ID NO: 766396 - DNA, 17 bp, Homo sapiens
ctcccggcatgggaaag

SEQ ID NO: 766397 - DNA, 13 bp, Homo sapiens
ctcccggccctca

SEQ ID NO: 766398 - DNA, 22 bp, Homo sapiens
ctcccgggccaagacagatgga

SEQ ID NO: 766399 - DNA, 15 bp, Homo sapiens
ctcccgggccacgcc

SEQ ID NO: 766400 - DNA, 16 bp, Homo sapiens
ctcccgggccacgccc

SEQ ID NO: 766401 - DNA, 15 bp, Homo sapiens
ctcccgggccctccc

SEQ ID NO: 766402 - DNA, 14 bp, Homo sapiens
ctcccggggacgct

SEQ ID NO: 766403 - DNA, 18 bp, Homo sapiens
ctcccggggcccaggact

SEQ ID NO: 766404 - DNA, 15 bp, Homo sapiens
ctcccggttcttcca

SEQ ID NO: 766405 - DNA, 14 bp, Homo sapiens
ctcccgtcagggcc

SEQ ID NO: 766406 - DNA, 15 bp, Homo sapiens
ctcccgtcagggccc

SEQ ID NO: 766407 - DNA, 16 bp, Homo sapiens
ctcccgtcagggccca

SEQ ID NO: 766408 - DNA, 15 bp, Homo sapiens
ctcccgtgtgtggtt

SEQ ID NO: 766409 - DNA, 18 bp, Homo sapiens
ctcccgtgtgtggttgga

SEQ ID NO: 766410 - DNA, 14 bp, Homo sapiens
ctccctacattccc

SEQ ID NO: 766411 - DNA, 19 bp, Homo sapiens
ctccctacattccccagag

SEQ ID NO: 766412 - DNA, 20 bp, Homo sapiens
ctccctacccaatgtctccc

SEQ ID NO: 766413 - DNA, 22 bp, Homo sapiens
ctccctacccaatgtctcccac

SEQ ID NO: 766414 - DNA, 23 bp, Homo sapiens
ctccctacccaatgtctcccaca

SEQ ID NO: 766415 - DNA, 14 bp, Homo sapiens
ctccctactcccct

SEQ ID NO: 766416 - DNA, 17 bp, Homo sapiens
ctccctagactgcatcc

SEQ ID NO: 766417 - DNA, 15 bp, Homo sapiens
ctccctagcccttcc

SEQ ID NO: 766418 - DNA, 17 bp, Homo sapiens
ctccctagcccttccag

SEQ ID NO: 766419 - DNA, 20 bp, Homo sapiens
ctccctagcccttccagcct

SEQ ID NO: 766420 - DNA, 14 bp, Homo sapiens
ctccctagtctcca

SEQ ID NO: 766421 - DNA, 19 bp, Homo sapiens
ctccctatatgcacccctg

SEQ ID NO: 766422 - DNA, 23 bp, Homo sapiens
ctccctatctaaccctcccatgg

SEQ ID NO: 766423 - DNA, 12 bp, Homo sapiens
ctccctcaactg

SEQ ID NO: 766424 - DNA, 15 bp, Homo sapiens
ctccctcaccctgag

SEQ ID NO: 766425 - DNA, 15 bp, Homo sapiens
ctccctcagccccca

SEQ ID NO: 766426 - DNA, 18 bp, Homo sapiens
ctccctcagcccctcttg

SEQ ID NO: 766427 - DNA, 19 bp, Homo sapiens
ctccctcagctctctggga

SEQ ID NO: 766428 - DNA, 17 bp, Homo sapiens
ctccctcaggggcaggt

SEQ ID NO: 766429 - DNA, 22 bp, Homo sapiens
ctccctcaggggcaggtggtgg

SEQ ID NO: 766430 - DNA, 19 bp, Homo sapiens
ctccctcatggctctggca

SEQ ID NO: 766431 - DNA, 16 bp, Homo sapiens
ctccctcattcatctt

SEQ ID NO: 766432 - DNA, 17 bp, Homo sapiens
ctccctcattcatcttg

SEQ ID NO: 766433 - DNA, 17 bp, Homo sapiens
ctccctccaagcctggc

SEQ ID NO: 766434 - DNA, 16 bp, Homo sapiens
ctccctccaccccagg

SEQ ID NO: 766435 - DNA, 17 bp, Homo sapiens
ctccctccaccccagga

SEQ ID NO: 766436 - DNA, 14 bp, Homo sapiens
ctccctccactcct

SEQ ID NO: 766437 - DNA, 14 bp, Homo sapiens
ctccctcccacact

SEQ ID NO: 766438 - DNA, 22 bp, Homo sapiens
ctccctcccagaaaaactggct

SEQ ID NO: 766439 - DNA, 15 bp, Homo sapiens
ctccctcccagctgc

SEQ ID NO: 766440 - DNA, 17 bp, Homo sapiens
ctccctcccagctgcac

SEQ ID NO: 766441 - DNA, 15 bp, Homo sapiens
ctccctcccatcctc

SEQ ID NO: 766442 - DNA, 20 bp, Homo sapiens
ctccctccccaaatggctgc

SEQ ID NO: 766443 - DNA, 21 bp, Homo sapiens
ctccctccccaaatggctgct

SEQ ID NO: 766444 - DNA, 15 bp, Homo sapiens
ctccctccccaccca

SEQ ID NO: 766445 - DNA, 20 bp, Homo sapiens
ctccctccccagctccggag

SEQ ID NO: 766446 - DNA, 16 bp, Homo sapiens
ctccctccccgtctca

SEQ ID NO: 766447 - DNA, 20 bp, Homo sapiens
ctccctcccggctgccccca

SEQ ID NO: 766448 - DNA, 21 bp, Homo sapiens
ctccctccctagcccttccag

SEQ ID NO: 766449 - DNA, 13 bp, Homo sapiens
ctccctccctctc

SEQ ID NO: 766450 - DNA, 13 bp, Homo sapiens
ctccctccctctt

SEQ ID NO: 766451 - DNA, 14 bp, Homo sapiens
ctccctcccttcct

SEQ ID NO: 766452 - DNA, 18 bp, Homo sapiens
ctccctccgactccagat

SEQ ID NO: 766453 - DNA, 13 bp, Homo sapiens
ctccctccgcctc

SEQ ID NO: 766454 - DNA, 20 bp, Homo sapiens
ctccctccgcctcccatccc

SEQ ID NO: 766455 - DNA, 14 bp, Homo sapiens
ctccctcctcaggg

SEQ ID NO: 766456 - DNA, 15 bp, Homo sapiens
ctccctcctccaggc

SEQ ID NO: 766457 - DNA, 16 bp, Homo sapiens
ctccctcctccaggcc

SEQ ID NO: 766458 - DNA, 14 bp, Homo sapiens
ctccctcctgcaca

SEQ ID NO: 766459 - DNA, 19 bp, Homo sapiens
ctccctcctgccgactcct

SEQ ID NO: 766460 - DNA, 19 bp, Homo sapiens
ctccctcctggagcatccc

SEQ ID NO: 766461 - DNA, 15 bp, Homo sapiens
ctccctcctggagct

SEQ ID NO: 766462 - DNA, 20 bp, Homo sapiens
ctccctcggccccacccacc

SEQ ID NO: 766463 - DNA, 16 bp, Homo sapiens
ctccctcgtgggcttg

SEQ ID NO: 766464 - DNA, 14 bp, Homo sapiens
ctccctctatttat

SEQ ID NO: 766465 - DNA, 17 bp, Homo sapiens
ctccctctctcatgaga

SEQ ID NO: 766466 - DNA, 16 bp, Homo sapiens
ctccctctctcttctg

SEQ ID NO: 766467 - DNA, 17 bp, Homo sapiens
ctccctctctcttctgc

SEQ ID NO: 766468 - DNA, 14 bp, Homo sapiens
ctccctctcttccg

SEQ ID NO: 766469 - DNA, 18 bp, Homo sapiens
ctccctctgacctgcagg

SEQ ID NO: 766470 - DNA, 21 bp, Homo sapiens
ctccctctgacctgcaggcca

SEQ ID NO: 766471 - DNA, 12 bp, Homo sapiens
ctccctctgccc

SEQ ID NO: 766472 - DNA, 13 bp, Homo sapiens
ctccctctgcccc

SEQ ID NO: 766473 - DNA, 22 bp, Homo sapiens
ctccctctgccttcaggcttct

SEQ ID NO: 766474 - DNA, 13 bp, Homo sapiens
ctccctctggatc

SEQ ID NO: 766475 - DNA, 14 bp, Homo sapiens
ctccctctggtccc

SEQ ID NO: 766476 - DNA, 21 bp, Homo sapiens
ctccctctgttaggtccattt

SEQ ID NO: 766477 - DNA, 14 bp, Homo sapiens
ctccctcttcactg

SEQ ID NO: 766478 - DNA, 18 bp, Homo sapiens
ctccctcttcactgtggc

SEQ ID NO: 766479 - DNA, 23 bp, Homo sapiens
ctccctcttcactgtggccacag

SEQ ID NO: 766480 - DNA, 16 bp, Homo sapiens
ctccctcttccttccc

SEQ ID NO: 766481 - DNA, 14 bp, Homo sapiens
ctccctctttccca

SEQ ID NO: 766482 - DNA, 14 bp, Homo sapiens
ctccctgaccctgt

SEQ ID NO: 766483 - DNA, 16 bp, Homo sapiens
ctccctgaccctgtat

SEQ ID NO: 766484 - DNA, 19 bp, Homo sapiens
ctccctgaccttagcgttc

SEQ ID NO: 766485 - DNA, 21 bp, Homo sapiens
ctccctgaccttagcgttctg

SEQ ID NO: 766486 - DNA, 22 bp, Homo sapiens
ctccctgaccttagcgttctgg

SEQ ID NO: 766487 - DNA, 16 bp, Homo sapiens
ctccctgactccctgt

SEQ ID NO: 766488 - DNA, 17 bp, Homo sapiens
ctccctgactccctgtg

SEQ ID NO: 766489 - DNA, 19 bp, Homo sapiens
ctccctgactccctgtggg

SEQ ID NO: 766490 - DNA, 14 bp, Homo sapiens
ctccctgacttttc

SEQ ID NO: 766491 - DNA, 15 bp, Homo sapiens
ctccctgagcctgca

SEQ ID NO: 766492 - DNA, 23 bp, Homo sapiens
ctctcacttaccccgagacctca

SEQ ID NO: 766493 - DNA, 16 bp, Homo sapiens
ctctcacttctaaatt

SEQ ID NO: 766494 - DNA, 16 bp, Homo sapiens
ctctcagaaggtattc

SEQ ID NO: 766495 - DNA, 13 bp, Homo sapiens
ctctcagacccag

SEQ ID NO: 766496 - DNA, 22 bp, Homo sapiens
ctctcagaggcctgctgccagt

SEQ ID NO: 766497 - DNA, 15 bp, Homo sapiens
ctctcagagtgacag

SEQ ID NO: 766498 - DNA, 20 bp, Homo sapiens
ctctcagatacccagtggaa

SEQ ID NO: 766499 - DNA, 19 bp, Homo sapiens
ctctcagcatagcctgcct

SEQ ID NO: 766500 - DNA, 23 bp, Homo sapiens
ctctcagcatagcctgcctgatc

SEQ ID NO: 766501 - DNA, 19 bp, Homo sapiens
ctctcagccagctgtttaa

SEQ ID NO: 766502 - DNA, 15 bp, Homo sapiens
ctctcagctggcagt

SEQ ID NO: 766503 - DNA, 20 bp, Homo sapiens
ctctcagctggcagtgcaat

SEQ ID NO: 766504 - DNA, 13 bp, Homo sapiens
ctctcaggagcac

SEQ ID NO: 766505 - DNA, 15 bp, Homo sapiens
ctctcaggagcacag

SEQ ID NO: 766506 - DNA, 21 bp, Homo sapiens
ctctcaggagcacaggcagct

SEQ ID NO: 766507 - DNA, 16 bp, Homo sapiens
ctctcaggcatgcctg

SEQ ID NO: 766508 - DNA, 17 bp, Homo sapiens
ctctcagtctctgagca

SEQ ID NO: 766509 - DNA, 23 bp, Homo sapiens
ctctcagtgaaggtggggagaag

SEQ ID NO: 766510 - DNA, 20 bp, Homo sapiens
ctctcagtgccctccagccc

SEQ ID NO: 766511 - DNA, 13 bp, Homo sapiens
ctctcagtgtttt

SEQ ID NO: 766512 - DNA, 17 bp, Homo sapiens
ctctcagttctctccct

SEQ ID NO: 766513 - DNA, 12 bp, Homo sapiens
ctctcatattcg

SEQ ID NO: 766514 - DNA, 17 bp, Homo sapiens
ctctcatcaactgaatg

SEQ ID NO: 766515 - DNA, 20 bp, Homo sapiens
ctctcatcaccccagaggcc

SEQ ID NO: 766516 - DNA, 18 bp, Homo sapiens
ctctcatccccctgtgga

SEQ ID NO: 766517 - DNA, 21 bp, Homo sapiens
ctctcatctgatcacttcatg

SEQ ID NO: 766518 - DNA, 22 bp, Homo sapiens
ctctcatggtacctgctcatgg

SEQ ID NO: 766519 - DNA, 20 bp, Homo sapiens
ctctcatgtccccttcctgt

SEQ ID NO: 766520 - DNA, 19 bp, Homo sapiens
ctctcatgtccctccaggg

SEQ ID NO: 766521 - DNA, 20 bp, Homo sapiens
ctctcattccccaggtggct

SEQ ID NO: 766522 - DNA, 23 bp, Homo sapiens
ctctcattgtcttgttatgtaca

SEQ ID NO: 766523 - DNA, 19 bp, Homo sapiens
ctctccaaaggggctgctg

SEQ ID NO: 766524 - DNA, 20 bp, Homo sapiens
ctctccaaaggggctgctgg

SEQ ID NO: 766525 - DNA, 23 bp, Homo sapiens
ctctccaaaggggctgctggggc

SEQ ID NO: 766526 - DNA, 23 bp, Homo sapiens
ctctccaaatattattcaagtgc

SEQ ID NO: 766527 - DNA, 14 bp, Homo sapiens
ctctccaaccactg

SEQ ID NO: 766528 - DNA, 20 bp, Homo sapiens
ctctccaaccactgtgccac

SEQ ID NO: 766529 - DNA, 13 bp, Homo sapiens
ctctccaacctgg

SEQ ID NO: 766530 - DNA, 14 bp, Homo sapiens
ctctccaacctgga

SEQ ID NO: 766531 - DNA, 15 bp, Homo sapiens
ctctccaagggcttc

SEQ ID NO: 766532 - DNA, 21 bp, Homo sapiens
ctctccaagggcttctgcacc

SEQ ID NO: 766533 - DNA, 17 bp, Homo sapiens
ctctccaagtctctctg

SEQ ID NO: 766534 - DNA, 21 bp, Homo sapiens
ctctccaagtctctctgtgaa

SEQ ID NO: 766535 - DNA, 19 bp, Homo sapiens
ctctccaagtgccagaggt

SEQ ID NO: 766536 - DNA, 17 bp, Homo sapiens
ctctccaatgttctatt

SEQ ID NO: 766537 - DNA, 21 bp, Homo sapiens
ctctccacagtgttgtgcccc

SEQ ID NO: 766538 - DNA, 14 bp, Homo sapiens
ctctccaccctcct

SEQ ID NO: 766539 - DNA, 14 bp, Homo sapiens
ctctccacctcagc

SEQ ID NO: 766540 - DNA, 15 bp, Homo sapiens
ctctccacctcagcc

SEQ ID NO: 766541 - DNA, 13 bp, Homo sapiens
ctctccacggtag

SEQ ID NO: 766542 - DNA, 13 bp, Homo sapiens
ctctccactccat

SEQ ID NO: 766543 - DNA, 20 bp, Homo sapiens
ctctccagaaacagctgctt

SEQ ID NO: 766544 - DNA, 21 bp, Homo sapiens
ctctccagaaacagctgcttc

SEQ ID NO: 766545 - DNA, 12 bp, Homo sapiens
ctctccagactg

SEQ ID NO: 766546 - DNA, 20 bp, Homo sapiens
ctctccagatgtttccagac

SEQ ID NO: 766547 - DNA, 16 bp, Homo sapiens
ctctccagctgactaa

SEQ ID NO: 766548 - DNA, 18 bp, Homo sapiens
ctctccagctgactaaac

SEQ ID NO: 766549 - DNA, 13 bp, Homo sapiens
ctctccaggcacc

SEQ ID NO: 766550 - DNA, 14 bp, Homo sapiens
ctctccaggcccca

SEQ ID NO: 766551 - DNA, 21 bp, Homo sapiens
ctctccatacctgcccctgcc

SEQ ID NO: 766552 - DNA, 17 bp, Homo sapiens
ctctcccacatcccact

SEQ ID NO: 766553 - DNA, 16 bp, Homo sapiens
ctctcccaccctaagg

SEQ ID NO: 766554 - DNA, 18 bp, Homo sapiens
ctctcccaccctaagggc

SEQ ID NO: 766555 - DNA, 20 bp, Homo sapiens
ctctcccaccctaagggcag

SEQ ID NO: 766556 - DNA, 16 bp, Homo sapiens
ctctcccacttcctcc

SEQ ID NO: 766557 - DNA, 19 bp, Homo sapiens
ctctcccacttcctcctac

SEQ ID NO: 766558 - DNA, 11 bp, Homo sapiens
ctctcccaggg

SEQ ID NO: 766559 - DNA, 13 bp, Homo sapiens
ctctcccagggat

SEQ ID NO: 766560 - DNA, 15 bp, Homo sapiens
ctctcccagtccatt

SEQ ID NO: 766561 - DNA, 17 bp, Homo sapiens
ctctcccagtgaactcc

SEQ ID NO: 766562 - DNA, 19 bp, Homo sapiens
ctctcccagtgaactcctg

SEQ ID NO: 766563 - DNA, 14 bp, Homo sapiens
ctctcccatcactt

SEQ ID NO: 766564 - DNA, 13 bp, Homo sapiens
ctctcccatcccc

SEQ ID NO: 766565 - DNA, 19 bp, Homo sapiens
ctctcccattgtccctctg

SEQ ID NO: 766566 - DNA, 15 bp, Homo sapiens
ctctccccacactaa

SEQ ID NO: 766567 - DNA, 17 bp, Homo sapiens
ctctccccagtgcctgc

SEQ ID NO: 766568 - DNA, 20 bp, Homo sapiens
ctctccccctatttattgac

SEQ ID NO: 766569 - DNA, 19 bp, Homo sapiens
ctctccccctcctccaggg

SEQ ID NO: 766570 - DNA, 17 bp, Homo sapiens
ctctccccctctgtctt

SEQ ID NO: 766571 - DNA, 13 bp, Homo sapiens
ctctcccccttca

SEQ ID NO: 766572 - DNA, 16 bp, Homo sapiens
ctctcccccttcagct

SEQ ID NO: 766573 - DNA, 21 bp, Homo sapiens
ctctcccccttcagctcctga

SEQ ID NO: 766574 - DNA, 23 bp, Homo sapiens
ctctccccggtaatgtcactgtt

SEQ ID NO: 766575 - DNA, 19 bp, Homo sapiens
ctctcccctccctcttcct

SEQ ID NO: 766576 - DNA, 22 bp, Homo sapiens
ctctcccctccctcttccttcc

SEQ ID NO: 766577 - DNA, 15 bp, Homo sapiens
ctctcccctcccttg

SEQ ID NO: 766578 - DNA, 13 bp, Homo sapiens
ctctcccctcctg

SEQ ID NO: 766579 - DNA, 14 bp, Homo sapiens
ctctcccctcctgc

SEQ ID NO: 766580 - DNA, 18 bp, Homo sapiens
ctctcccctcctgctggg

SEQ ID NO: 766581 - DNA, 15 bp, Homo sapiens
ctctcccctgacctg

SEQ ID NO: 766582 - DNA, 16 bp, Homo sapiens
ctctcccctgccctgc

SEQ ID NO: 766583 - DNA, 17 bp, Homo sapiens
ctctcccggttcttcca

SEQ ID NO: 766584 - DNA, 23 bp, Homo sapiens
ctctccctacctccctcctcagg

SEQ ID NO: 766585 - DNA, 24 bp, Homo sapiens
ctctccctacctccctcctcaggg

SEQ ID NO: 766586 - DNA, 12 bp, Homo sapiens
ctctccctcagg

SEQ ID NO: 766587 - DNA, 19 bp, Homo sapiens
ctctccctcaggggcaggt

SEQ ID NO: 766588 - DNA, 12 bp, Homo sapiens
ctctccctctgg

SEQ ID NO: 766589 - DNA, 18 bp, Homo sapiens
ctctccctctggccctgc

SEQ ID NO: 766590 - DNA, 21 bp, Homo sapiens
ctctccctctggccctgcctt

SEQ ID NO: 766591 - DNA, 13 bp, Homo sapiens
ctctccctgaccc

SEQ ID NO: 766592 - DNA, 18 bp, Homo sapiens
ctctccctgacggctgcc

SEQ ID NO: 766593 - DNA, 22 bp, Homo sapiens
ctctccctgcactccctcctgg

SEQ ID NO: 766594 - DNA, 14 bp, Homo sapiens
ctctccctgcatcc

SEQ ID NO: 766595 - DNA, 12 bp, Homo sapiens
ctctccctgggt

SEQ ID NO: 766596 - DNA, 18 bp, Homo sapiens
ctctccctgtcacacact

SEQ ID NO: 766597 - DNA, 20 bp, Homo sapiens
ctctccctgtcacacactgg

SEQ ID NO: 766598 - DNA, 23 bp, Homo sapiens
ctctccctgtcacacactggacc

SEQ ID NO: 766599 - DNA, 19 bp, Homo sapiens
ctctccctgtgttctgggc

SEQ ID NO: 766600 - DNA, 20 bp, Homo sapiens
ctctccctgtgttctgggct

SEQ ID NO: 766601 - DNA, 21 bp, Homo sapiens
ctctccctgtgttctgggctg

SEQ ID NO: 766602 - DNA, 23 bp, Homo sapiens
ctctccctgtgttctgggctggg

SEQ ID NO: 766603 - DNA, 13 bp, Homo sapiens
ctctcccttccct

SEQ ID NO: 766604 - DNA, 14 bp, Homo sapiens
ctctcccttccctc

SEQ ID NO: 766605 - DNA, 16 bp, Homo sapiens
ctctcccttccctcct

SEQ ID NO: 766606 - DNA, 21 bp, Homo sapiens
ctctccggggccatttgcaat

SEQ ID NO: 766607 - DNA, 17 bp, Homo sapiens
ctctcctactcggctct

SEQ ID NO: 766608 - DNA, 18 bp, Homo sapiens
ctctcctactcggctctg

SEQ ID NO: 766609 - DNA, 14 bp, Homo sapiens
ctctcctagagaca

SEQ ID NO: 766610 - DNA, 17 bp, Homo sapiens
ctctcctagcccctctc

SEQ ID NO: 766611 - DNA, 16 bp, Homo sapiens
ctctcctcccagctgc

SEQ ID NO: 766612 - DNA, 20 bp, Homo sapiens
ctctcctccccctcctaggg

SEQ ID NO: 766613 - DNA, 13 bp, Homo sapiens
ctctcctccgcca

SEQ ID NO: 766614 - DNA, 16 bp, Homo sapiens
ctctctttctagaggt

SEQ ID NO: 766615 - DNA, 16 bp, Homo sapiens
ctctctttctccctca

SEQ ID NO: 766616 - DNA, 17 bp, Homo sapiens
ctctcttttcctctctg

SEQ ID NO: 766617 - DNA, 18 bp, Homo sapiens
ctctctttttggaggtgc

SEQ ID NO: 766618 - DNA, 21 bp, Homo sapiens
ctctgaaaagcaattgccctg

SEQ ID NO: 766619 - DNA, 17 bp, Homo sapiens
ctctgaaaccagtgtta

SEQ ID NO: 766620 - DNA, 17 bp, Homo sapiens
cacttgttccagctctt

SEQ ID NO: 766621 - DNA, 14 bp, Homo sapiens
cacttgttgtttta

SEQ ID NO: 766622 - DNA, 17 bp, Homo sapiens
cacttgttttaaaatgc

SEQ ID NO: 766623 - DNA, 18 bp, Homo sapiens
cactttaaccctctcttc

SEQ ID NO: 766624 - DNA, 24 bp, Homo sapiens
cactttaattgaagaactgcactt

SEQ ID NO: 766625 - DNA, 14 bp, Homo sapiens
cactttacccacct

SEQ ID NO: 766626 - DNA, 17 bp, Homo sapiens
cactttagacatttttg

SEQ ID NO: 766627 - DNA, 20 bp, Homo sapiens
cactttagacatttttgtgc

SEQ ID NO: 766628 - DNA, 23 bp, Homo sapiens
cactttagacatttttgtgccat

SEQ ID NO: 766629 - DNA, 17 bp, Homo sapiens
cactttagggctgtaaa

SEQ ID NO: 766630 - DNA, 13 bp, Homo sapiens
cactttattgcta

SEQ ID NO: 766631 - DNA, 12 bp, Homo sapiens
cactttcacgtg

SEQ ID NO: 766632 - DNA, 23 bp, Homo sapiens
cactttcagagcccccagccctg

SEQ ID NO: 766633 - DNA, 24 bp, Homo sapiens
cactttcagagcccccagccctgg

SEQ ID NO: 766634 - DNA, 22 bp, Homo sapiens
cactttccaccaagtgtctaga

SEQ ID NO: 766635 - DNA, 12 bp, Homo sapiens
cactttccactt

SEQ ID NO: 766636 - DNA, 13 bp, Homo sapiens
cactttccacttc

SEQ ID NO: 766637 - DNA, 18 bp, Homo sapiens
cactttccacttcttcct

SEQ ID NO: 766638 - DNA, 19 bp, Homo sapiens
cactttccacttcttcctt

SEQ ID NO: 766639 - DNA, 18 bp, Homo sapiens
cactttcccccttcccgc

SEQ ID NO: 766640 - DNA, 20 bp, Homo sapiens
cactttccctagaaagccat

SEQ ID NO: 766641 - DNA, 19 bp, Homo sapiens
cactttctacaatgtgaac

SEQ ID NO: 766642 - DNA, 19 bp, Homo sapiens
cactttctcagttttcata

SEQ ID NO: 766643 - DNA, 22 bp, Homo sapiens
cactttctcatgatttacagag

SEQ ID NO: 766644 - DNA, 19 bp, Homo sapiens
cactttctgttccttcctc

SEQ ID NO: 766645 - DNA, 17 bp, Homo sapiens
cactttgaaaagttgga

SEQ ID NO: 766646 - DNA, 20 bp, Homo sapiens
cactttgaaaagttggaagg

SEQ ID NO: 766647 - DNA, 17 bp, Homo sapiens
cactttgaaaatatttc

SEQ ID NO: 766648 - DNA, 14 bp, Homo sapiens
cactttgaagggca

SEQ ID NO: 766649 - DNA, 19 bp, Homo sapiens
cactttgcacgacgccctc

SEQ ID NO: 766650 - DNA, 23 bp, Homo sapiens
cactttgcacgacgccctctccc

SEQ ID NO: 766651 - DNA, 23 bp, Homo sapiens
cactttgcatatgagccgtgaac

SEQ ID NO: 766652 - DNA, 21 bp, Homo sapiens
cactttgccaaggctctcccc

SEQ ID NO: 766653 - DNA, 12 bp, Homo sapiens
cactttgctctg

SEQ ID NO: 766654 - DNA, 13 bp, Homo sapiens
cactttgctctgg

SEQ ID NO: 766655 - DNA, 20 bp, Homo sapiens
cactttggatttcatcagac

SEQ ID NO: 766656 - DNA, 12 bp, Homo sapiens
cactttggggga

SEQ ID NO: 766657 - DNA, 19 bp, Homo sapiens
cactttggtacatggccag

SEQ ID NO: 766658 - DNA, 20 bp, Homo sapiens
cactttgtctgtacatactg

SEQ ID NO: 766659 - DNA, 18 bp, Homo sapiens
cactttgttctttaggag

SEQ ID NO: 766660 - DNA, 21 bp, Homo sapiens
cactttgttgcaagatgtgaa

SEQ ID NO: 766661 - DNA, 17 bp, Homo sapiens
cactttgtttatgcata

SEQ ID NO: 766662 - DNA, 20 bp, Homo sapiens
cactttgtttcgtggggagg

SEQ ID NO: 766663 - DNA, 21 bp, Homo sapiens
cactttgtttcgtggggaggt

SEQ ID NO: 766664 - DNA, 16 bp, Homo sapiens
cacttttaaaaaacaa

SEQ ID NO: 766665 - DNA, 17 bp, Homo sapiens
cacttttaatgaacaaa

SEQ ID NO: 766666 - DNA, 20 bp, Homo sapiens
cacttttcaatcccaattct

SEQ ID NO: 766667 - DNA, 15 bp, Homo sapiens
cacttttcatatcat

SEQ ID NO: 766668 - DNA, 16 bp, Homo sapiens
cacttttcctccctca

SEQ ID NO: 766669 - DNA, 17 bp, Homo sapiens
cacttttgacaaaggca

SEQ ID NO: 766670 - DNA, 18 bp, Homo sapiens
cacttttgacaaaggcaa

SEQ ID NO: 766671 - DNA, 21 bp, Homo sapiens
cacttttgttaacagtatttc

SEQ ID NO: 766672 - DNA, 15 bp, Homo sapiens
cacttttgttctgct

SEQ ID NO: 766673 - DNA, 19 bp, Homo sapiens
cacttttgttctgctttat

SEQ ID NO: 766674 - DNA, 14 bp, Homo sapiens
cacttttgttcttg

SEQ ID NO: 766675 - DNA, 13 bp, Homo sapiens
ctccaggccctcc

SEQ ID NO: 766676 - DNA, 13 bp, Homo sapiens
ctccaggcctgcc

SEQ ID NO: 766677 - DNA, 15 bp, Homo sapiens
ctccaggcctgcctc

SEQ ID NO: 766678 - DNA, 18 bp, Homo sapiens
ctccaggcctgcctccca

SEQ ID NO: 766679 - DNA, 19 bp, Homo sapiens
ctccaggcctgcctcccac

SEQ ID NO: 766680 - DNA, 20 bp, Homo sapiens
ctccaggcctgcctcccact

SEQ ID NO: 766681 - DNA, 20 bp, Homo sapiens
ctccaggcctgttgctatag

SEQ ID NO: 766682 - DNA, 13 bp, Homo sapiens
ctccaggcgccgg

SEQ ID NO: 766683 - DNA, 21 bp, Homo sapiens
ctccagggaaggtggccacag

SEQ ID NO: 766684 - DNA, 22 bp, Homo sapiens
ctccagggaaggtggccacagc

SEQ ID NO: 766685 - DNA, 17 bp, Homo sapiens
ctccagggacccttgcc

SEQ ID NO: 766686 - DNA, 22 bp, Homo sapiens
ctccagggacccttgcctgcct

SEQ ID NO: 766687 - DNA, 24 bp, Homo sapiens
ctccagggacccttgcctgcctcc

SEQ ID NO: 766688 - DNA, 14 bp, Homo sapiens
ctccagggagtccc

SEQ ID NO: 766689 - DNA, 17 bp, Homo sapiens
ctccagggagtcccctc

SEQ ID NO: 766690 - DNA, 14 bp, Homo sapiens
ctccagggcagcct

SEQ ID NO: 766691 - DNA, 18 bp, Homo sapiens
ctccagggccacgtgcca

SEQ ID NO: 766692 - DNA, 16 bp, Homo sapiens
ctccagggccccccaa

SEQ ID NO: 766693 - DNA, 21 bp, Homo sapiens
ctccagggccgtgagggcaag

SEQ ID NO: 766694 - DNA, 15 bp, Homo sapiens
ctccagggctccaaa

SEQ ID NO: 766695 - DNA, 23 bp, Homo sapiens
ctccaggggcccttgggacagcc

SEQ ID NO: 766696 - DNA, 16 bp, Homo sapiens
ctccaggggctcctgg

SEQ ID NO: 766697 - DNA, 15 bp, Homo sapiens
ctccaggggctgctt

SEQ ID NO: 766698 - DNA, 22 bp, Homo sapiens
ctccaggggctgcttcctcctg

SEQ ID NO: 766699 - DNA, 19 bp, Homo sapiens
ctccaggggggacaatatg

SEQ ID NO: 766700 - DNA, 17 bp, Homo sapiens
ctccagggtcttgggct

SEQ ID NO: 766701 - DNA, 22 bp, Homo sapiens
ctccagggtcttgggctactgg

SEQ ID NO: 766702 - DNA, 19 bp, Homo sapiens
ctccagggtggcagcaaca

SEQ ID NO: 766703 - DNA, 16 bp, Homo sapiens
ctccagggtgtgtgct

SEQ ID NO: 766704 - DNA, 17 bp, Homo sapiens
ctccaggtcagctgccc

SEQ ID NO: 766705 - DNA, 16 bp, Homo sapiens
ctccaggtctcacggg

SEQ ID NO: 766706 - DNA, 17 bp, Homo sapiens
ctccaggtggctctgag

SEQ ID NO: 766707 - DNA, 14 bp, Homo sapiens
ctccagtacgtccc

SEQ ID NO: 766708 - DNA, 18 bp, Homo sapiens
ctccagtacgtcccgctg

SEQ ID NO: 766709 - DNA, 21 bp, Homo sapiens
ctccagtacgtcccgctgctg

SEQ ID NO: 766710 - DNA, 22 bp, Homo sapiens
ctccagtacgtcccgctgctgt

SEQ ID NO: 766711 - DNA, 15 bp, Homo sapiens
ctccagtagctcctg

SEQ ID NO: 766712 - DNA, 20 bp, Homo sapiens
ctccagtattcttgtcaaaa

SEQ ID NO: 766713 - DNA, 16 bp, Homo sapiens
ctccagtcacactccc

SEQ ID NO: 766714 - DNA, 22 bp, Homo sapiens
ctccagtcatctgtaagagctt

SEQ ID NO: 766715 - DNA, 22 bp, Homo sapiens
ctccagtcatggtactacccca

SEQ ID NO: 766716 - DNA, 23 bp, Homo sapiens
ctccagtctcatctatgtcatat

SEQ ID NO: 766717 - DNA, 12 bp, Homo sapiens
ctccagtctgct

SEQ ID NO: 766718 - DNA, 13 bp, Homo sapiens
ctccagtgaaact

SEQ ID NO: 766719 - DNA, 18 bp, Homo sapiens
ctccagtgccgctcctgc

SEQ ID NO: 766720 - DNA, 20 bp, Homo sapiens
ctccagtgccgctcctgctt

SEQ ID NO: 766721 - DNA, 14 bp, Homo sapiens
ctccagtgggctga

SEQ ID NO: 766722 - DNA, 22 bp, Homo sapiens
ctccagtgggctgatgctggga

SEQ ID NO: 766723 - DNA, 19 bp, Homo sapiens
ctccagtggttgctgttga

SEQ ID NO: 766724 - DNA, 16 bp, Homo sapiens
ctccagtgttgcctcc

SEQ ID NO: 766725 - DNA, 20 bp, Homo sapiens
ctccagtgttgcctcctccc

SEQ ID NO: 766726 - DNA, 22 bp, Homo sapiens
ctccagtgttgcctcctcccat

SEQ ID NO: 766727 - DNA, 15 bp, Homo sapiens
ctccagttctttata

SEQ ID NO: 766728 - DNA, 14 bp, Homo sapiens
ctccagttgattat

SEQ ID NO: 766729 - DNA, 21 bp, Homo sapiens
ctccagttgggactcaggata

SEQ ID NO: 766730 - DNA, 20 bp, Homo sapiens
ctccagtttgcacctgtccc

SEQ ID NO: 766731 - DNA, 21 bp, Homo sapiens
ctccagtttgcacctgtcccc

SEQ ID NO: 766732 - DNA, 16 bp, Homo sapiens
ctccagtttgcatttg

SEQ ID NO: 766733 - DNA, 23 bp, Homo sapiens
ctccagttttctcctctgcttct

SEQ ID NO: 766734 - DNA, 21 bp, Homo sapiens
ctccagtttttgtttttgcat

SEQ ID NO: 766735 - DNA, 15 bp, Homo sapiens
ctccatacagcctct

SEQ ID NO: 766736 - DNA, 21 bp, Homo sapiens
ctccatacagcctctacagcc

SEQ ID NO: 766737 - DNA, 14 bp, Homo sapiens
ctccatagctcctt

SEQ ID NO: 766738 - DNA, 14 bp, Homo sapiens
ctccatatctcctt

SEQ ID NO: 766739 - DNA, 16 bp, Homo sapiens
ctccatatctccttcc

SEQ ID NO: 766740 - DNA, 15 bp, Homo sapiens
ctccatcaccctctt

SEQ ID NO: 766741 - DNA, 20 bp, Homo sapiens
ctcccagcagagcccaccag

SEQ ID NO: 766742 - DNA, 23 bp, Homo sapiens
ctcccagcagagcccaccagcca

SEQ ID NO: 766743 - DNA, 16 bp, Homo sapiens
ctcccagcccattgct

SEQ ID NO: 766744 - DNA, 20 bp, Homo sapiens
ctcccagcccattgctgcca

SEQ ID NO: 766745 - DNA, 19 bp, Homo sapiens
ctcccagccctatggatgt

SEQ ID NO: 766746 - DNA, 12 bp, Homo sapiens
ctcccagcctgc

SEQ ID NO: 766747 - DNA, 14 bp, Homo sapiens
ctcccagcctgctg

SEQ ID NO: 766748 - DNA, 15 bp, Homo sapiens
ctcccagcctgctga

SEQ ID NO: 766749 - DNA, 13 bp, Homo sapiens
ctcccagcggcct

SEQ ID NO: 766750 - DNA, 17 bp, Homo sapiens
ctcccagctaattgaga

SEQ ID NO: 766751 - DNA, 23 bp, Homo sapiens
ctcccagctcctttctcctgtga

SEQ ID NO: 766752 - DNA, 15 bp, Homo sapiens
ctcccagctctagac

SEQ ID NO: 766753 - DNA, 20 bp, Homo sapiens
ctcccaggaccctccactca

SEQ ID NO: 766754 - DNA, 22 bp, Homo sapiens
ctcccaggaccctccactcact

SEQ ID NO: 766755 - DNA, 16 bp, Homo sapiens
ctcccaggagacagtt

SEQ ID NO: 766756 - DNA, 19 bp, Homo sapiens
ctcccaggagacagttcaa

SEQ ID NO: 766757 - DNA, 12 bp, Homo sapiens
ctcccaggcaag

SEQ ID NO: 766758 - DNA, 18 bp, Homo sapiens
ctcccaggcaagcagctg

SEQ ID NO: 766759 - DNA, 18 bp, Homo sapiens
ctcccaggccccctgcat

SEQ ID NO: 766760 - DNA, 18 bp, Homo sapiens
ctcccaggcctgcctgca

SEQ ID NO: 766761 - DNA, 14 bp, Homo sapiens
ctcccaggcgcccc

SEQ ID NO: 766762 - DNA, 13 bp, Homo sapiens
ctcccaggctctc

SEQ ID NO: 766763 - DNA, 19 bp, Homo sapiens
ctcccaggctggagtgcag

SEQ ID NO: 766764 - DNA, 13 bp, Homo sapiens
ctcccagggagtg

SEQ ID NO: 766765 - DNA, 18 bp, Homo sapiens
ctcccagggagtgagcag

SEQ ID NO: 766766 - DNA, 19 bp, Homo sapiens
ctcccagggagtgagcagc

SEQ ID NO: 766767 - DNA, 22 bp, Homo sapiens
ctcccagggatgctctttgtaa

SEQ ID NO: 766768 - DNA, 16 bp, Homo sapiens
ctcccagggccagggc

SEQ ID NO: 766769 - DNA, 19 bp, Homo sapiens
ctcccagggccagggccct

SEQ ID NO: 766770 - DNA, 23 bp, Homo sapiens
ctcccagggccagggccctgcag

SEQ ID NO: 766771 - DNA, 16 bp, Homo sapiens
ctcccagggcctcctg

SEQ ID NO: 766772 - DNA, 15 bp, Homo sapiens
ctcccaggggactgt

SEQ ID NO: 766773 - DNA, 17 bp, Homo sapiens
ctcccaggggagccagc

SEQ ID NO: 766774 - DNA, 20 bp, Homo sapiens
ctcccaggggagccagctgc

SEQ ID NO: 766775 - DNA, 18 bp, Homo sapiens
ctcccaggggtctccctg

SEQ ID NO: 766776 - DNA, 22 bp, Homo sapiens
ctcccaggggtctccctggctc

SEQ ID NO: 766777 - DNA, 11 bp, Homo sapiens
ctcccagggtg

SEQ ID NO: 766778 - DNA, 18 bp, Homo sapiens
ctcccaggtaccagctgc

SEQ ID NO: 766779 - DNA, 19 bp, Homo sapiens
ctcccaggtaccagctgcg

SEQ ID NO: 766780 - DNA, 19 bp, Homo sapiens
ctcccaggttcccccagca

SEQ ID NO: 766781 - DNA, 18 bp, Homo sapiens
ctcccagtccatttccaa

SEQ ID NO: 766782 - DNA, 14 bp, Homo sapiens
ctcccagtcctcca

SEQ ID NO: 766783 - DNA, 18 bp, Homo sapiens
ctcccagtcctccagacc

SEQ ID NO: 766784 - DNA, 20 bp, Homo sapiens
ctcccagtctcatctcctga

SEQ ID NO: 766785 - DNA, 18 bp, Homo sapiens
ctcccagtgaactcctgc

SEQ ID NO: 766786 - DNA, 20 bp, Homo sapiens
ctcccagtgaactcctgcca

SEQ ID NO: 766787 - DNA, 21 bp, Homo sapiens
ctcccagtgaactcctgccag

SEQ ID NO: 766788 - DNA, 21 bp, Homo sapiens
ctcccatcattacccttccct

SEQ ID NO: 766789 - DNA, 16 bp, Homo sapiens
ctcccatcattccttc

SEQ ID NO: 766790 - DNA, 14 bp, Homo sapiens
ctcccatccagggc

SEQ ID NO: 766791 - DNA, 14 bp, Homo sapiens
ctcccatccccctg

SEQ ID NO: 766792 - DNA, 17 bp, Homo sapiens
ctcccatccccctgccc

SEQ ID NO: 766793 - DNA, 23 bp, Homo sapiens
ctcccatcccctggactgggagg

SEQ ID NO: 766794 - DNA, 13 bp, Homo sapiens
ctcccatcctcac

SEQ ID NO: 766795 - DNA, 14 bp, Homo sapiens
ctcccatcctcacc

SEQ ID NO: 766796 - DNA, 16 bp, Homo sapiens
ctcccatcctcaccca

SEQ ID NO: 766797 - DNA, 16 bp, Homo sapiens
ctcccatcctccagcc

SEQ ID NO: 766798 - DNA, 21 bp, Homo sapiens
ctcccatcctccccagcgcca

SEQ ID NO: 766799 - DNA, 14 bp, Homo sapiens
ctcccatcctgatc

SEQ ID NO: 766800 - DNA, 13 bp, Homo sapiens
ctcccatcctggg

SEQ ID NO: 766801 - DNA, 16 bp, Homo sapiens
ctcccatcctggggca

SEQ ID NO: 766802 - DNA, 19 bp, Homo sapiens
cactttttggaattgtctt

SEQ ID NO: 766803 - DNA, 20 bp, Homo sapiens
cactttttgtattttttcct

SEQ ID NO: 766804 - DNA, 22 bp, Homo sapiens
cactttttgtattttttcctta

SEQ ID NO: 766805 - DNA, 14 bp, Homo sapiens
cactttttgtgaat

SEQ ID NO: 766806 - DNA, 23 bp, Homo sapiens
cacttttttatgaagaaaaagta

SEQ ID NO: 766807 - DNA, 17 bp, Homo sapiens
cacttttttctgccttg

SEQ ID NO: 766808 - DNA, 15 bp, Homo sapiens
cactttttttacttc

SEQ ID NO: 766809 - DNA, 17 bp, Homo sapiens
cactttttttctttttc

SEQ ID NO: 766810 - DNA, 20 bp, Homo sapiens
cagaaaaaaagagtgaaaaa

SEQ ID NO: 766811 - DNA, 11 bp, Homo sapiens
cagaaaaacaa

SEQ ID NO: 766812 - DNA, 19 bp, Homo sapiens
cagaaaaacgtgttgcctt

SEQ ID NO: 766813 - DNA, 15 bp, Homo sapiens
cagaaaaaggcagtg

SEQ ID NO: 766814 - DNA, 21 bp, Homo sapiens
cagaaaaataaatgtcactgc

SEQ ID NO: 766815 - DNA, 13 bp, Homo sapiens
cagaaaacaactt

SEQ ID NO: 766816 - DNA, 20 bp, Homo sapiens
cagaaaacaacttggcattt

SEQ ID NO: 766817 - DNA, 22 bp, Homo sapiens
cagaaaacaacttggcatttct

SEQ ID NO: 766818 - DNA, 19 bp, Homo sapiens
cagaaaacccttgggccag

SEQ ID NO: 766819 - DNA, 20 bp, Homo sapiens
cagaaaacccttgggccaga

SEQ ID NO: 766820 - DNA, 23 bp, Homo sapiens
cagaaaagaaagctacagaagaa

SEQ ID NO: 766821 - DNA, 19 bp, Homo sapiens
cagaaaagaggagaccctg

SEQ ID NO: 766822 - DNA, 17 bp, Homo sapiens
cagaaaagatgaatttg

SEQ ID NO: 766823 - DNA, 14 bp, Homo sapiens
cagaaaagcacctg

SEQ ID NO: 766824 - DNA, 15 bp, Homo sapiens
cagaaaagctcagag

SEQ ID NO: 766825 - DNA, 15 bp, Homo sapiens
cagaaaagtgcctga

SEQ ID NO: 766826 - DNA, 17 bp, Homo sapiens
cagaaaagtgcctgagc

SEQ ID NO: 766827 - DNA, 20 bp, Homo sapiens
cagaaaataacagatgctgg

SEQ ID NO: 766828 - DNA, 23 bp, Homo sapiens
cagaaaataaggcacccatctgt

SEQ ID NO: 766829 - DNA, 14 bp, Homo sapiens
cagaaaatgttgag

SEQ ID NO: 766830 - DNA, 23 bp, Homo sapiens
cagaaaattctgtgccttgtttt

SEQ ID NO: 766831 - DNA, 11 bp, Homo sapiens
cagaaacacaa

SEQ ID NO: 766832 - DNA, 14 bp, Homo sapiens
cagaaacacaaacg

SEQ ID NO: 766833 - DNA, 18 bp, Homo sapiens
cagaaacacccctctgtc

SEQ ID NO: 766834 - DNA, 13 bp, Homo sapiens
cagaaacagggca

SEQ ID NO: 766835 - DNA, 14 bp, Homo sapiens
cagaaacagggcag

SEQ ID NO: 766836 - DNA, 16 bp, Homo sapiens
cagaaacagggcagca

SEQ ID NO: 766837 - DNA, 19 bp, Homo sapiens
cagaaacatcagttactct

SEQ ID NO: 766838 - DNA, 23 bp, Homo sapiens
cagaaacatcagttactctgaag

SEQ ID NO: 766839 - DNA, 19 bp, Homo sapiens
cagaaacatgccagaagga

SEQ ID NO: 766840 - DNA, 18 bp, Homo sapiens
cagaaaccagaaaagcaa

SEQ ID NO: 766841 - DNA, 15 bp, Homo sapiens
cagaaaccattctag

SEQ ID NO: 766842 - DNA, 22 bp, Homo sapiens
cagaaacccggcttcctgtgct

SEQ ID NO: 766843 - DNA, 20 bp, Homo sapiens
cagaaacctatctcagggag

SEQ ID NO: 766844 - DNA, 22 bp, Homo sapiens
cagaaacctatctcagggaggg

SEQ ID NO: 766845 - DNA, 20 bp, Homo sapiens
cagaaacgtgttaaaggttt

SEQ ID NO: 766846 - DNA, 23 bp, Homo sapiens
cagaaactcctgtttctccttag

SEQ ID NO: 766847 - DNA, 23 bp, Homo sapiens
cagaaactccttttgctgtcttt

SEQ ID NO: 766848 - DNA, 17 bp, Homo sapiens
cagaaactgaaccaaca

SEQ ID NO: 766849 - DNA, 22 bp, Homo sapiens
cagaaactgaaccaacagaagc

SEQ ID NO: 766850 - DNA, 19 bp, Homo sapiens
cagaaagaactttaaagct

SEQ ID NO: 766851 - DNA, 14 bp, Homo sapiens
cagaaagaagcagt

SEQ ID NO: 766852 - DNA, 18 bp, Homo sapiens
cagaaagaagcagttctc

SEQ ID NO: 766853 - DNA, 22 bp, Homo sapiens
cagaaagaattgatcagaatcc

SEQ ID NO: 766854 - DNA, 21 bp, Homo sapiens
cagaaagcactacaatcatgg

SEQ ID NO: 766855 - DNA, 18 bp, Homo sapiens
cagaaagcataaaattct

SEQ ID NO: 766856 - DNA, 21 bp, Homo sapiens
cagaaagcctcctgccccctg

SEQ ID NO: 766857 - DNA, 19 bp, Homo sapiens
cagaaagcctctctctccc

SEQ ID NO: 766858 - DNA, 15 bp, Homo sapiens
cagaaagctgcctgg

SEQ ID NO: 766859 - DNA, 20 bp, Homo sapiens
cagaaaggatatttaagaaa

SEQ ID NO: 766860 - DNA, 18 bp, Homo sapiens
cagaaagtaagcatttcc

SEQ ID NO: 766861 - DNA, 19 bp, Homo sapiens
cagaaagtgataagtgcag

SEQ ID NO: 766862 - DNA, 15 bp, Homo sapiens
ctccccagccctggc

SEQ ID NO: 766863 - DNA, 19 bp, Homo sapiens
ctccccaggcatttgccaa

SEQ ID NO: 766864 - DNA, 16 bp, Homo sapiens
ctccccaggcctccag

SEQ ID NO: 766865 - DNA, 21 bp, Homo sapiens
ctccccagggagctctgggga

SEQ ID NO: 766866 - DNA, 16 bp, Homo sapiens
ctccccaggtccagct

SEQ ID NO: 766867 - DNA, 13 bp, Homo sapiens
ctccccagtacag

SEQ ID NO: 766868 - DNA, 21 bp, Homo sapiens
ctccccagtacaggggtgctg

SEQ ID NO: 766869 - DNA, 19 bp, Homo sapiens
ctccccagtgcctgccact

SEQ ID NO: 766870 - DNA, 17 bp, Homo sapiens
ctccccatacacacaca

SEQ ID NO: 766871 - DNA, 15 bp, Homo sapiens
ctccccatcccatgt

SEQ ID NO: 766872 - DNA, 12 bp, Homo sapiens
ctccccatctcg

SEQ ID NO: 766873 - DNA, 16 bp, Homo sapiens
ctccccatctgtccag

SEQ ID NO: 766874 - DNA, 12 bp, Homo sapiens
ctccccatggag

SEQ ID NO: 766875 - DNA, 17 bp, Homo sapiens
ctccccatggagccagc

SEQ ID NO: 766876 - DNA, 14 bp, Homo sapiens
ctccccatgtgtcc

SEQ ID NO: 766877 - DNA, 19 bp, Homo sapiens
ctccccatttcccatctgc

SEQ ID NO: 766878 - DNA, 21 bp, Homo sapiens
ctccccatttcccatctgcac

SEQ ID NO: 766879 - DNA, 17 bp, Homo sapiens
ctcccccaaacagactc

SEQ ID NO: 766880 - DNA, 22 bp, Homo sapiens
ctcccccaaccaaggaaggagc

SEQ ID NO: 766881 - DNA, 12 bp, Homo sapiens
ctcccccaaccc

SEQ ID NO: 766882 - DNA, 17 bp, Homo sapiens
ctcccccaccactcagg

SEQ ID NO: 766883 - DNA, 21 bp, Homo sapiens
ctcccccacccatggggagga

SEQ ID NO: 766884 - DNA, 14 bp, Homo sapiens
ctcccccaccccct

SEQ ID NO: 766885 - DNA, 13 bp, Homo sapiens
ctcccccacctga

SEQ ID NO: 766886 - DNA, 16 bp, Homo sapiens
ctcccccactcctcta

SEQ ID NO: 766887 - DNA, 18 bp, Homo sapiens
ctcccccagagtgctgtc

SEQ ID NO: 766888 - DNA, 13 bp, Homo sapiens
ctcccccagcaga

SEQ ID NO: 766889 - DNA, 13 bp, Homo sapiens
ctcccccagctcc

SEQ ID NO: 766890 - DNA, 11 bp, Homo sapiens
ctcccccatcc

SEQ ID NO: 766891 - DNA, 19 bp, Homo sapiens
ctcccccatccccaccact

SEQ ID NO: 766892 - DNA, 20 bp, Homo sapiens
ctcccccatccccaccactg

SEQ ID NO: 766893 - DNA, 15 bp, Homo sapiens
ctcccccatcctccc

SEQ ID NO: 766894 - DNA, 13 bp, Homo sapiens
ctccccccagacc

SEQ ID NO: 766895 - DNA, 18 bp, Homo sapiens
ctccccccagctccctgc

SEQ ID NO: 766896 - DNA, 17 bp, Homo sapiens
ctccccccatcccaggg

SEQ ID NO: 766897 - DNA, 15 bp, Homo sapiens
ctccccccgcccacc

SEQ ID NO: 766898 - DNA, 16 bp, Homo sapiens
ctcccccgacactgct

SEQ ID NO: 766899 - DNA, 21 bp, Homo sapiens
ctcccccgtgttcccctcttg

SEQ ID NO: 766900 - DNA, 21 bp, Homo sapiens
ctccccctaaacccctgtccc

SEQ ID NO: 766901 - DNA, 19 bp, Homo sapiens
ctccccctacccatatccc

SEQ ID NO: 766902 - DNA, 15 bp, Homo sapiens
ctccccctccccagg

SEQ ID NO: 766903 - DNA, 16 bp, Homo sapiens
ctccccctcctagggg

SEQ ID NO: 766904 - DNA, 12 bp, Homo sapiens
ctccccctctgc

SEQ ID NO: 766905 - DNA, 13 bp, Homo sapiens
ctccccctgccag

SEQ ID NO: 766906 - DNA, 17 bp, Homo sapiens
ctccccctgccagtgcc

SEQ ID NO: 766907 - DNA, 12 bp, Homo sapiens
ctccccctgggc

SEQ ID NO: 766908 - DNA, 13 bp, Homo sapiens
ctccccctgggct

SEQ ID NO: 766909 - DNA, 16 bp, Homo sapiens
ctcccccttcccttgg

SEQ ID NO: 766910 - DNA, 12 bp, Homo sapiens
ctcccccttgtc

SEQ ID NO: 766911 - DNA, 23 bp, Homo sapiens
ctcccccttgtcttcccccctct

SEQ ID NO: 766912 - DNA, 17 bp, Homo sapiens
ctccccgaggctgcccc

SEQ ID NO: 766913 - DNA, 21 bp, Homo sapiens
ctccccgaggctgccccaggc

SEQ ID NO: 766914 - DNA, 16 bp, Homo sapiens
ctccccgagggctcag

SEQ ID NO: 766915 - DNA, 14 bp, Homo sapiens
ctccccgcccctgt

SEQ ID NO: 766916 - DNA, 20 bp, Homo sapiens
ctccccgcccctgtggccct

SEQ ID NO: 766917 - DNA, 14 bp, Homo sapiens
ctccccgcctccac

SEQ ID NO: 766918 - DNA, 16 bp, Homo sapiens
ctccccgcctccactc

SEQ ID NO: 766919 - DNA, 20 bp, Homo sapiens
ctccccgcctccactctagt

SEQ ID NO: 766920 - DNA, 21 bp, Homo sapiens
ctccccgctccgtctctgtcc

SEQ ID NO: 766921 - DNA, 14 bp, Homo sapiens
ctccccgctctgga

SEQ ID NO: 766922 - DNA, 15 bp, Homo sapiens
ctccccgctctggat

SEQ ID NO: 766923 - DNA, 15 bp, Homo sapiens
ctccccggcaggcct

SEQ ID NO: 766924 - DNA, 21 bp, Homo sapiens
ctccccggcaggcctgagaat

SEQ ID NO: 766925 - DNA, 22 bp, Homo sapiens
ctccccggcaggcctgagaatg

SEQ ID NO: 766926 - DNA, 14 bp, Homo sapiens
ctccccgtccctgt

SEQ ID NO: 766927 - DNA, 18 bp, Homo sapiens
ctcccctatccacccagc

SEQ ID NO: 766928 - DNA, 23 bp, Homo sapiens
ctcccctatccacccagcccatt

SEQ ID NO: 766929 - DNA, 15 bp, Homo sapiens
ctcccctcacatcct

SEQ ID NO: 766930 - DNA, 14 bp, Homo sapiens
ctattttaattact

SEQ ID NO: 766931 - DNA, 19 bp, Homo sapiens
ctattttactttgtacttg

SEQ ID NO: 766932 - DNA, 23 bp, Homo sapiens
ctattttatatgatgggggaaaa

SEQ ID NO: 766933 - DNA, 18 bp, Homo sapiens
ctattttcataatcagta

SEQ ID NO: 766934 - DNA, 21 bp, Homo sapiens
ctattttcataatcagtaaat

SEQ ID NO: 766935 - DNA, 14 bp, Homo sapiens
ctattttcatttgt

SEQ ID NO: 766936 - DNA, 15 bp, Homo sapiens
ctattttctaaagac

SEQ ID NO: 766937 - DNA, 14 bp, Homo sapiens
ctattttctacaat

SEQ ID NO: 766938 - DNA, 12 bp, Homo sapiens
ctattttctatt

SEQ ID NO: 766939 - DNA, 17 bp, Homo sapiens
ctattttggattgtata

SEQ ID NO: 766940 - DNA, 23 bp, Homo sapiens
ctattttgggtattaatatatag

SEQ ID NO: 766941 - DNA, 16 bp, Homo sapiens
ctccacccttggcctg

SEQ ID NO: 766942 - DNA, 17 bp, Homo sapiens
ctccaccgaccaactgc

SEQ ID NO: 766943 - DNA, 20 bp, Homo sapiens
ctccaccgaccaactgccct

SEQ ID NO: 766944 - DNA, 23 bp, Homo sapiens
ctccaccgagccacgcagtgcct

SEQ ID NO: 766945 - DNA, 19 bp, Homo sapiens
ctccaccgctgcctaagtg

SEQ ID NO: 766946 - DNA, 15 bp, Homo sapiens
ctccacctagactgt

SEQ ID NO: 766947 - DNA, 13 bp, Homo sapiens
ctccacctcagcc

SEQ ID NO: 766948 - DNA, 12 bp, Homo sapiens
ctccacctctgg

SEQ ID NO: 766949 - DNA, 13 bp, Homo sapiens
ctccacctctggt

SEQ ID NO: 766950 - DNA, 20 bp, Homo sapiens
ctccaccttgttacacatta

SEQ ID NO: 766951 - DNA, 13 bp, Homo sapiens
ctccacgcaggcg

SEQ ID NO: 766952 - DNA, 19 bp, Homo sapiens
ctccacgcctcctggccag

SEQ ID NO: 766953 - DNA, 17 bp, Homo sapiens
ctccacggtgcgtggct

SEQ ID NO: 766954 - DNA, 20 bp, Homo sapiens
ctccacggtgcgtggctgtg

SEQ ID NO: 766955 - DNA, 21 bp, Homo sapiens
ctccacggtgcgtggctgtgg

SEQ ID NO: 766956 - DNA, 22 bp, Homo sapiens
ctccacggtgcgtggctgtggc

SEQ ID NO: 766957 - DNA, 22 bp, Homo sapiens
ctccacgtctttcctgctacaa

SEQ ID NO: 766958 - DNA, 16 bp, Homo sapiens
ctccacgtgtccgtcc

SEQ ID NO: 766959 - DNA, 23 bp, Homo sapiens
ctccacgtgtccgtccacccttc

SEQ ID NO: 766960 - DNA, 15 bp, Homo sapiens
ctccacgttctgctc

SEQ ID NO: 766961 - DNA, 20 bp, Homo sapiens
ctccacgttctgctcatcat

SEQ ID NO: 766962 - DNA, 13 bp, Homo sapiens
ctccactcactcc

SEQ ID NO: 766963 - DNA, 15 bp, Homo sapiens
ctccactcactccag

SEQ ID NO: 766964 - DNA, 18 bp, Homo sapiens
ctccactcagctgtcctg

SEQ ID NO: 766965 - DNA, 23 bp, Homo sapiens
ctccactcagctgtcctgcagca

SEQ ID NO: 766966 - DNA, 16 bp, Homo sapiens
ctccactcaggtgcac

SEQ ID NO: 766967 - DNA, 15 bp, Homo sapiens
ctccactccacctcc

SEQ ID NO: 766968 - DNA, 17 bp, Homo sapiens
ctccactccagctctga

SEQ ID NO: 766969 - DNA, 19 bp, Homo sapiens
ctccactccagctctgaga

SEQ ID NO: 766970 - DNA, 12 bp, Homo sapiens
ctccactccatg

SEQ ID NO: 766971 - DNA, 16 bp, Homo sapiens
ctccactcccccacct

SEQ ID NO: 766972 - DNA, 21 bp, Homo sapiens
ctccactcccccacctgacaa

SEQ ID NO: 766973 - DNA, 20 bp, Homo sapiens
ctccactctagttctagatg

SEQ ID NO: 766974 - DNA, 21 bp, Homo sapiens
ctccactctccttcgtgtctc

SEQ ID NO: 766975 - DNA, 18 bp, Homo sapiens
ctccactctgattcacct

SEQ ID NO: 766976 - DNA, 21 bp, Homo sapiens
ctccactctgattcacctctt

SEQ ID NO: 766977 - DNA, 13 bp, Homo sapiens
ctccactctgctt

SEQ ID NO: 766978 - DNA, 17 bp, Homo sapiens
ctccactctgcttctct

SEQ ID NO: 766979 - DNA, 16 bp, Homo sapiens
ctccactgccctggca

SEQ ID NO: 766980 - DNA, 20 bp, Homo sapiens
ctccactgccctggcagcag

SEQ ID NO: 766981 - DNA, 13 bp, Homo sapiens
ctccactggatgg

SEQ ID NO: 766982 - DNA, 16 bp, Homo sapiens
ctccactggatggagg

SEQ ID NO: 766983 - DNA, 24 bp, Homo sapiens
ctccactggggaatgctcccagct

SEQ ID NO: 766984 - DNA, 11 bp, Homo sapiens
ctccactgtca

SEQ ID NO: 766985 - DNA, 16 bp, Homo sapiens
ctccactgtcacattg

SEQ ID NO: 766986 - DNA, 23 bp, Homo sapiens
ctccactgtgcctttgcaaatca

SEQ ID NO: 766987 - DNA, 22 bp, Homo sapiens
ctccactgttgggtgggtgggc

SEQ ID NO: 766988 - DNA, 20 bp, Homo sapiens
ctccacttctggtcccctgt

SEQ ID NO: 766989 - DNA, 22 bp, Homo sapiens
ctccacttctggtcccctgtgg

SEQ ID NO: 766990 - DNA, 24 bp, Homo sapiens
ctccacttctggtcccctgtggtg

SEQ ID NO: 766991 - DNA, 19 bp, Homo sapiens
ctccacttggccaaacttt

SEQ ID NO: 766992 - DNA, 13 bp, Homo sapiens
ctccacttgtata

SEQ ID NO: 766993 - DNA, 23 bp, Homo sapiens
ctccacttgtatatatggatcag

SEQ ID NO: 766994 - DNA, 17 bp, Homo sapiens
ctccactttctcatccg

SEQ ID NO: 766995 - DNA, 15 bp, Homo sapiens
ctccactttgttgga

SEQ ID NO: 766996 - DNA, 13 bp, Homo sapiens
ctccactttttct

SEQ ID NO: 766997 - DNA, 18 bp, Homo sapiens
ctccagaaaaatgaaaag

SEQ ID NO: 766998 - DNA, 16 bp, Homo sapiens
ctccagaaacagctgc

SEQ ID NO: 766999 - DNA, 14 bp, Homo sapiens
ctccagaagatgcc

SEQ ID NO: 767000 - DNA, 20 bp, Homo sapiens
ctccagaagatgccagcttc

SEQ ID NO: 767001 - DNA, 18 bp, Homo sapiens
ctccagaagcctctggct

SEQ ID NO: 767002 - DNA, 12 bp, Homo sapiens
ctccagaagctg

SEQ ID NO: 767003 - DNA, 14 bp, Homo sapiens
ctccagaagctgct

SEQ ID NO: 767004 - DNA, 17 bp, Homo sapiens
ctccagaatctgctgtt

SEQ ID NO: 767005 - DNA, 14 bp, Homo sapiens
ctccagaatgtaag

SEQ ID NO: 767006 - DNA, 23 bp, Homo sapiens
ctccagaatgtaagaaaacaaaa

SEQ ID NO: 767007 - DNA, 14 bp, Homo sapiens
ctccagacccagag

SEQ ID NO: 767008 - DNA, 15 bp, Homo sapiens
ctccagacccagagg

SEQ ID NO: 767009 - DNA, 17 bp, Homo sapiens
ctccagacccagaggcc

SEQ ID NO: 767010 - DNA, 21 bp, Homo sapiens
ctccagacccccaccccttcc

SEQ ID NO: 767011 - DNA, 22 bp, Homo sapiens
ctccagacccccaccccttccc

SEQ ID NO: 767012 - DNA, 14 bp, Homo sapiens
ctccagacccccag

SEQ ID NO: 767013 - DNA, 17 bp, Homo sapiens
ctccagacccctggctt

SEQ ID NO: 767014 - DNA, 13 bp, Homo sapiens
ctccagaccctgc

SEQ ID NO: 767015 - DNA, 17 bp, Homo sapiens
ctccagactcacttgcc

SEQ ID NO: 767016 - DNA, 18 bp, Homo sapiens
ctccagactcacttgcca

SEQ ID NO: 767017 - DNA, 16 bp, Homo sapiens
ctccagagacagggaa

SEQ ID NO: 767018 - DNA, 17 bp, Homo sapiens
ctccagagccagcctgg

SEQ ID NO: 767019 - DNA, 18 bp, Homo sapiens
ctccagagccagcctggg

SEQ ID NO: 767020 - DNA, 13 bp, Homo sapiens
ctccagaggacct

SEQ ID NO: 767021 - DNA, 14 bp, Homo sapiens
ctccagaggacctg

SEQ ID NO: 767022 - DNA, 14 bp, Homo sapiens
ctccagagggacag

SEQ ID NO: 767023 - DNA, 13 bp, Homo sapiens
ctccagagggcac

SEQ ID NO: 767024 - DNA, 21 bp, Homo sapiens
ctccagagggcactctgcttg

SEQ ID NO: 767025 - DNA, 12 bp, Homo sapiens
ctccagagtctg

SEQ ID NO: 767026 - DNA, 23 bp, Homo sapiens
ctccagagtctgagcccccggct

SEQ ID NO: 767027 - DNA, 21 bp, Homo sapiens
ctccagagtgtgcagactgat

SEQ ID NO: 767028 - DNA, 22 bp, Homo sapiens
ctccagataactctctttcctt

SEQ ID NO: 767029 - DNA, 13 bp, Homo sapiens
ctccagatagaga

SEQ ID NO: 767030 - DNA, 16 bp, Homo sapiens
ctccagatagagaaat

SEQ ID NO: 767031 - DNA, 20 bp, Homo sapiens
ctccagatatgaacagggcc

SEQ ID NO: 767032 - DNA, 16 bp, Homo sapiens
ctccagatgcagggca

SEQ ID NO: 767033 - DNA, 21 bp, Homo sapiens
ctccagatgcagggcagtcat

SEQ ID NO: 767034 - DNA, 17 bp, Homo sapiens
ctccagatgtttccaga

SEQ ID NO: 767035 - DNA, 14 bp, Homo sapiens
ctccagattctgat

SEQ ID NO: 767036 - DNA, 18 bp, Homo sapiens
ctccagcaactgcccttc

SEQ ID NO: 767037 - DNA, 20 bp, Homo sapiens
ctccagcaccttctttctgg

SEQ ID NO: 767038 - DNA, 19 bp, Homo sapiens
ctccagcaggaaggacccc

SEQ ID NO: 767039 - DNA, 13 bp, Homo sapiens
ctccagcatccag

SEQ ID NO: 767040 - DNA, 14 bp, Homo sapiens
ctccagcatccagc

SEQ ID NO: 767041 - DNA, 19 bp, Homo sapiens
ctccagcatccagcctgtg

SEQ ID NO: 767042 - DNA, 21 bp, Homo sapiens
ctccagcatccagcctgtgtg

SEQ ID NO: 767043 - DNA, 14 bp, Homo sapiens
ctccagccaacccc

SEQ ID NO: 767044 - DNA, 20 bp, Homo sapiens
ctccagccaacccctgtgga

SEQ ID NO: 767045 - DNA, 12 bp, Homo sapiens
ctccagccagca

SEQ ID NO: 767046 - DNA, 22 bp, Homo sapiens
ctccagccagcgcctccctcca

SEQ ID NO: 767047 - DNA, 16 bp, Homo sapiens
ctccagccccgcgacc

SEQ ID NO: 767048 - DNA, 16 bp, Homo sapiens
ctccagcccctcttgg

SEQ ID NO: 767049 - DNA, 21 bp, Homo sapiens
ctccagcccctcttggagaag

SEQ ID NO: 767050 - DNA, 12 bp, Homo sapiens
ctccagcccctg

SEQ ID NO: 767051 - DNA, 14 bp, Homo sapiens
ctccagcccctgga

SEQ ID NO: 767052 - DNA, 15 bp, Homo sapiens
ctccagcccctggac

SEQ ID NO: 767053 - DNA, 13 bp, Homo sapiens
ctccagcccctgt

SEQ ID NO: 767054 - DNA, 14 bp, Homo sapiens
ctccagcccctgtc

SEQ ID NO: 767055 - DNA, 15 bp, Homo sapiens
ctccagcccctgtcc

SEQ ID NO: 767056 - DNA, 16 bp, Homo sapiens
ctccagcccctgtccc

SEQ ID NO: 767057 - DNA, 16 bp, Homo sapiens
ctccagcccctttgcc

SEQ ID NO: 767058 - DNA, 19 bp, Homo sapiens
ctccagcccctttgcctct

SEQ ID NO: 767059 - DNA, 21 bp, Homo sapiens
ctccagcccctttgcctctgt

SEQ ID NO: 767060 - DNA, 14 bp, Homo sapiens
ctccagcccgggag

SEQ ID NO: 767061 - DNA, 20 bp, Homo sapiens
ctccagcccgggagcctagg

SEQ ID NO: 767062 - DNA, 21 bp, Homo sapiens
ctccagcccgggagcctagga

SEQ ID NO: 767063 - DNA, 23 bp, Homo sapiens
ctccagcccgggagcctaggacc

SEQ ID NO: 767064 - DNA, 21 bp, Homo sapiens
ctccagcctccctgtctccag

SEQ ID NO: 767065 - DNA, 23 bp, Homo sapiens
ctccagcctccctgtctccagct

SEQ ID NO: 767066 - DNA, 14 bp, Homo sapiens
ctccagcctctccc

SEQ ID NO: 767067 - DNA, 16 bp, Homo sapiens
ctccagcctctcccgg

SEQ ID NO: 767068 - DNA, 22 bp, Homo sapiens
ctccagcctctcccggctgcct

SEQ ID NO: 767069 - DNA, 12 bp, Homo sapiens
ctccagcctggg

SEQ ID NO: 767070 - DNA, 13 bp, Homo sapiens
ctccagcctgggg

SEQ ID NO: 767071 - DNA, 19 bp, Homo sapiens
ctccagcctttgctccctc

SEQ ID NO: 767072 - DNA, 15 bp, Homo sapiens
ctccagcggccctgt

SEQ ID NO: 767073 - DNA, 19 bp, Homo sapiens
ctccagcggccctgtcatc

SEQ ID NO: 767074 - DNA, 18 bp, Homo sapiens
ctccagcgtcagctgctc

SEQ ID NO: 767075 - DNA, 17 bp, Homo sapiens
ctccagctcagaaccca

SEQ ID NO: 767076 - DNA, 20 bp, Homo sapiens
ctccagctcagaacccaggg

SEQ ID NO: 767077 - DNA, 15 bp, Homo sapiens
ctccagctcatatgc

SEQ ID NO: 767078 - DNA, 12 bp, Homo sapiens
ctccagctctga

SEQ ID NO: 767079 - DNA, 20 bp, Homo sapiens
ctccagctctggcttcctgc

SEQ ID NO: 767080 - DNA, 20 bp, Homo sapiens
ctccagctgactaaactttt

SEQ ID NO: 767081 - DNA, 14 bp, Homo sapiens
ctccagctgcacca

SEQ ID NO: 767082 - DNA, 17 bp, Homo sapiens
ctccagctgcaccagag

SEQ ID NO: 767083 - DNA, 11 bp, Homo sapiens
ctccagctgcc

SEQ ID NO: 767084 - DNA, 12 bp, Homo sapiens
ctccagctgcct

SEQ ID NO: 767085 - DNA, 15 bp, Homo sapiens
ctccagctgcctggg

SEQ ID NO: 767086 - DNA, 19 bp, Homo sapiens
ctccagctgttcagctggt

SEQ ID NO: 767087 - DNA, 19 bp, Homo sapiens
ctccagcttctggtactct

SEQ ID NO: 767088 - DNA, 21 bp, Homo sapiens
ctccagcttctggtactctcc

SEQ ID NO: 767089 - DNA, 18 bp, Homo sapiens
ctccagcttttcctcagg

SEQ ID NO: 767090 - DNA, 20 bp, Homo sapiens
ctccaggaaagagcagtcag

SEQ ID NO: 767091 - DNA, 16 bp, Homo sapiens
ctccaggacgaggagg

SEQ ID NO: 767092 - DNA, 18 bp, Homo sapiens
ctccaggagagagccagg

SEQ ID NO: 767093 - DNA, 19 bp, Homo sapiens
ctccaggagagagccagga

SEQ ID NO: 767094 - DNA, 13 bp, Homo sapiens
ctccaggaggggc

SEQ ID NO: 767095 - DNA, 14 bp, Homo sapiens
ctccaggaggggcc

SEQ ID NO: 767096 - DNA, 21 bp, Homo sapiens
ctccaggaggggcctgggcag

SEQ ID NO: 767097 - DNA, 20 bp, Homo sapiens
ctccaggatttataaagcaa

SEQ ID NO: 767098 - DNA, 23 bp, Homo sapiens
ctccaggattttaatttcaggaa

SEQ ID NO: 767099 - DNA, 19 bp, Homo sapiens
ctccaggcagcagacacat

SEQ ID NO: 767100 - DNA, 14 bp, Homo sapiens
ctccaggcaggcca

SEQ ID NO: 767101 - DNA, 20 bp, Homo sapiens
ctccaggcatatgtttcccc

SEQ ID NO: 767102 - DNA, 22 bp, Homo sapiens
ctccaggcatatgtttccccat

SEQ ID NO: 767103 - DNA, 14 bp, Homo sapiens
ctccaggccaggtg

SEQ ID NO: 767104 - DNA, 15 bp, Homo sapiens
ctccaggccaggtgg

SEQ ID NO: 767105 - DNA, 16 bp, Homo sapiens
ctccaggcccccaact

SEQ ID NO: 767106 - DNA, 19 bp, Homo sapiens
cctgccctccctcagccgt

SEQ ID NO: 767107 - DNA, 23 bp, Homo sapiens
cctgccctccggaggagcagcct

SEQ ID NO: 767108 - DNA, 19 bp, Homo sapiens
cctgccctcctgagcctcc

SEQ ID NO: 767109 - DNA, 22 bp, Homo sapiens
cctgccctcgtggccagcccgg

SEQ ID NO: 767110 - DNA, 23 bp, Homo sapiens
cctgccctcgtggccagcccggc

SEQ ID NO: 767111 - DNA, 20 bp, Homo sapiens
cctgccctctgctctgcctg

SEQ ID NO: 767112 - DNA, 23 bp, Homo sapiens
cctgccctctgctctgcctggag

SEQ ID NO: 767113 - DNA, 11 bp, Homo sapiens
cctgccctgca

SEQ ID NO: 767114 - DNA, 15 bp, Homo sapiens
cctgccctgcagcac

SEQ ID NO: 767115 - DNA, 13 bp, Homo sapiens
cctgccctgccca

SEQ ID NO: 767116 - DNA, 13 bp, Homo sapiens
cctgccctgcctg

SEQ ID NO: 767117 - DNA, 14 bp, Homo sapiens
cctgccctgccttg

SEQ ID NO: 767118 - DNA, 16 bp, Homo sapiens
cctgccctgccttgcc

SEQ ID NO: 767119 - DNA, 20 bp, Homo sapiens
cctgccctgctgccgcctcc

SEQ ID NO: 767120 - DNA, 12 bp, Homo sapiens
cctgccctgtcc

SEQ ID NO: 767121 - DNA, 13 bp, Homo sapiens
cctgccctgtgcc

SEQ ID NO: 767122 - DNA, 14 bp, Homo sapiens
cctgccctgtgccg

SEQ ID NO: 767123 - DNA, 18 bp, Homo sapiens
cctgccctgtgccgcact

SEQ ID NO: 767124 - DNA, 13 bp, Homo sapiens
cctgcccttccct

SEQ ID NO: 767125 - DNA, 15 bp, Homo sapiens
cctgcccttccctct

SEQ ID NO: 767126 - DNA, 16 bp, Homo sapiens
cctgcccttcctcagg

SEQ ID NO: 767127 - DNA, 17 bp, Homo sapiens
cctgcccttcctcctga

SEQ ID NO: 767128 - DNA, 23 bp, Homo sapiens
cctgcccttctgacccaaagcaa

SEQ ID NO: 767129 - DNA, 10 bp, Homo sapiens
cctgcccttg

SEQ ID NO: 767130 - DNA, 16 bp, Homo sapiens
cctgcccttggcacca

SEQ ID NO: 767131 - DNA, 19 bp, Homo sapiens
cctgccgaaaacaggagca

SEQ ID NO: 767132 - DNA, 14 bp, Homo sapiens
cctgccgcccaaag

SEQ ID NO: 767133 - DNA, 14 bp, Homo sapiens
cctgccgctgcacc

SEQ ID NO: 767134 - DNA, 15 bp, Homo sapiens
cctgccgctgcacct

SEQ ID NO: 767135 - DNA, 14 bp, Homo sapiens
cctgccgctgcagg

SEQ ID NO: 767136 - DNA, 19 bp, Homo sapiens
cctgccgctgcaggaaaca

SEQ ID NO: 767137 - DNA, 15 bp, Homo sapiens
cctgccggacacagc

SEQ ID NO: 767138 - DNA, 23 bp, Homo sapiens
cctgccgggctgagggcctgctg

SEQ ID NO: 767139 - DNA, 16 bp, Homo sapiens
cctgccggtgggaccc

SEQ ID NO: 767140 - DNA, 17 bp, Homo sapiens
cctgccgtcaccaccac

SEQ ID NO: 767141 - DNA, 17 bp, Homo sapiens
cctgcctagcatggggt

SEQ ID NO: 767142 - DNA, 15 bp, Homo sapiens
cctgcctcagcaatt

SEQ ID NO: 767143 - DNA, 17 bp, Homo sapiens
cctgcctcagccttcca

SEQ ID NO: 767144 - DNA, 14 bp, Homo sapiens
cctgcctccacccg

SEQ ID NO: 767145 - DNA, 14 bp, Homo sapiens
cctgcctccaggaa

SEQ ID NO: 767146 - DNA, 13 bp, Homo sapiens
cctgcctcccaag

SEQ ID NO: 767147 - DNA, 22 bp, Homo sapiens
cctgcctcccatgcctggtccc

SEQ ID NO: 767148 - DNA, 17 bp, Homo sapiens
cctgcctcccttgactt

SEQ ID NO: 767149 - DNA, 18 bp, Homo sapiens
cctgcctccctttctggg

SEQ ID NO: 767150 - DNA, 14 bp, Homo sapiens
cctgcctcctaggc

SEQ ID NO: 767151 - DNA, 15 bp, Homo sapiens
cctgcctcctaggct

SEQ ID NO: 767152 - DNA, 21 bp, Homo sapiens
cctgcctcctaggctggaagc

SEQ ID NO: 767153 - DNA, 14 bp, Homo sapiens
cctgcctcctcatc

SEQ ID NO: 767154 - DNA, 16 bp, Homo sapiens
cctgcctcctccctcc

SEQ ID NO: 767155 - DNA, 17 bp, Homo sapiens
cctgcctcctccctccc

SEQ ID NO: 767156 - DNA, 23 bp, Homo sapiens
cctgcctcctccctcccagctgc

SEQ ID NO: 767157 - DNA, 13 bp, Homo sapiens
cctgcctcctgcc

SEQ ID NO: 767158 - DNA, 14 bp, Homo sapiens
cctgcctcctgcca

SEQ ID NO: 767159 - DNA, 20 bp, Homo sapiens
cctgcctcctgcctgcccct

SEQ ID NO: 767160 - DNA, 20 bp, Homo sapiens
cctgcctcctggaggaccag

SEQ ID NO: 767161 - DNA, 19 bp, Homo sapiens
cctgcctcgagggccgcct

SEQ ID NO: 767162 - DNA, 15 bp, Homo sapiens
cctgcctcttgtttc

SEQ ID NO: 767163 - DNA, 21 bp, Homo sapiens
cctgcctcttgtttctgtgcc

SEQ ID NO: 767164 - DNA, 17 bp, Homo sapiens
cctgcctgacagccttc

SEQ ID NO: 767165 - DNA, 14 bp, Homo sapiens
cctgcctgagccca

SEQ ID NO: 767166 - DNA, 17 bp, Homo sapiens
cctgcctgagcccagga

SEQ ID NO: 767167 - DNA, 12 bp, Homo sapiens
cctgcctgaggg

SEQ ID NO: 767168 - DNA, 14 bp, Homo sapiens
cctgcctgagggcc

SEQ ID NO: 767169 - DNA, 13 bp, Homo sapiens
cctgcctgcacct

SEQ ID NO: 767170 - DNA, 13 bp, Homo sapiens
cctgcctgccatg

SEQ ID NO: 767171 - DNA, 14 bp, Homo sapiens
cctgcctgccatgt

SEQ ID NO: 767172 - DNA, 14 bp, Homo sapiens
cctgcctgcccact

SEQ ID NO: 767173 - DNA, 18 bp, Homo sapiens
cctgcctgccgctgcacc

SEQ ID NO: 767174 - DNA, 15 bp, Homo sapiens
cctgcctgcctccac

SEQ ID NO: 767175 - DNA, 13 bp, Homo sapiens
cctgcctgcgtct

SEQ ID NO: 767176 - DNA, 18 bp, Homo sapiens
cctgcctgcgtcttccgc

SEQ ID NO: 767177 - DNA, 13 bp, Homo sapiens
cctgcctggccag

SEQ ID NO: 767178 - DNA, 23 bp, Homo sapiens
cctgcctggccaggcagatctgt

SEQ ID NO: 767179 - DNA, 12 bp, Homo sapiens
cctgcctggccc

SEQ ID NO: 767180 - DNA, 14 bp, Homo sapiens
cctgcctggcccct

SEQ ID NO: 767181 - DNA, 17 bp, Homo sapiens
cctgcctgggccttggc

SEQ ID NO: 767182 - DNA, 12 bp, Homo sapiens
cctgcctgtctg

SEQ ID NO: 767183 - DNA, 13 bp, Homo sapiens
cctgcctgtctgc

SEQ ID NO: 767184 - DNA, 18 bp, Homo sapiens
cctgcctgtctgtctctc

SEQ ID NO: 767185 - DNA, 14 bp, Homo sapiens
cctgcctgtgcatg

SEQ ID NO: 767186 - DNA, 19 bp, Homo sapiens
cctgcctgttggcaggccc

SEQ ID NO: 767187 - DNA, 17 bp, Homo sapiens
cctgccttaggcctacc

SEQ ID NO: 767188 - DNA, 11 bp, Homo sapiens
cctgccttcct

SEQ ID NO: 767189 - DNA, 22 bp, Homo sapiens
cctgccttcctcctgggccctc

SEQ ID NO: 767190 - DNA, 18 bp, Homo sapiens
cctgccttcttcggggaa

SEQ ID NO: 767191 - DNA, 14 bp, Homo sapiens
cctgccttgccgct

SEQ ID NO: 767192 - DNA, 17 bp, Homo sapiens
cctgccttgccgctccc

SEQ ID NO: 767193 - DNA, 22 bp, Homo sapiens
cctgccttgccgctccccttgg

SEQ ID NO: 767194 - DNA, 23 bp, Homo sapiens
cctgccttggcctcccaaagtgc

SEQ ID NO: 767195 - DNA, 18 bp, Homo sapiens
cctgcctttaagccaaag

SEQ ID NO: 767196 - DNA, 15 bp, Homo sapiens
cctgcctttgtatgt

SEQ ID NO: 767197 - DNA, 18 bp, Homo sapiens
cctgcctttgtatgtgga

SEQ ID NO: 767198 - DNA, 11 bp, Homo sapiens
cctgcctttta

SEQ ID NO: 767199 - DNA, 15 bp, Homo sapiens
cctgcgaaggggccc

SEQ ID NO: 767200 - DNA, 17 bp, Homo sapiens
cctgcgaaggggccctg

SEQ ID NO: 767201 - DNA, 19 bp, Homo sapiens
cctgcgaaggggccctggt

SEQ ID NO: 767202 - DNA, 20 bp, Homo sapiens
cctgcgaaggggccctggtc

SEQ ID NO: 767203 - DNA, 20 bp, Homo sapiens
cctgcgaagtggctctcagg

SEQ ID NO: 767204 - DNA, 17 bp, Homo sapiens
cctgcgacagcttgtga

SEQ ID NO: 767205 - DNA, 23 bp, Homo sapiens
cctgcgagacccaaggctcactg

SEQ ID NO: 767206 - DNA, 13 bp, Homo sapiens
cctgcgagacgca

SEQ ID NO: 767207 - DNA, 18 bp, Homo sapiens
cctgcgagacgcacacag

SEQ ID NO: 767208 - DNA, 22 bp, Homo sapiens
cctgcgagggccgcccgctccc

SEQ ID NO: 767209 - DNA, 22 bp, Homo sapiens
cctgcgcccagtccttccacct

SEQ ID NO: 767210 - DNA, 14 bp, Homo sapiens
cctgcgcccttgag

SEQ ID NO: 767211 - DNA, 15 bp, Homo sapiens
cctgcgctgacaagg

SEQ ID NO: 767212 - DNA, 17 bp, Homo sapiens
cctgcgcttctgctgga

SEQ ID NO: 767213 - DNA, 18 bp, Homo sapiens
cctgcggaggcggtggca

SEQ ID NO: 767214 - DNA, 17 bp, Homo sapiens
cctgcggagtgaagagg

SEQ ID NO: 767215 - DNA, 15 bp, Homo sapiens
cctgcggcctccacc

SEQ ID NO: 767216 - DNA, 16 bp, Homo sapiens
cctgcggcctgctgga

SEQ ID NO: 767217 - DNA, 16 bp, Homo sapiens
cctgcggcgccagcct

SEQ ID NO: 767218 - DNA, 18 bp, Homo sapiens
cctgcggcgccagcctca

SEQ ID NO: 767219 - DNA, 19 bp, Homo sapiens
cctgcggctcagccttgca

SEQ ID NO: 767220 - DNA, 20 bp, Homo sapiens
cctgcggctcagccttgcac

SEQ ID NO: 767221 - DNA, 16 bp, Homo sapiens
cctgcgggccacaggg

SEQ ID NO: 767222 - DNA, 16 bp, Homo sapiens
cctgcgggccagggtc

SEQ ID NO: 767223 - DNA, 21 bp, Homo sapiens
cctgcgggcgcgggcagccac

SEQ ID NO: 767224 - DNA, 12 bp, Homo sapiens
cctgcgggctgc

SEQ ID NO: 767225 - DNA, 21 bp, Homo sapiens
cctgcgggcttttccccggtc

SEQ ID NO: 767226 - DNA, 24 bp, Homo sapiens
cctgcgggtgaacaaagcagccac

SEQ ID NO: 767227 - DNA, 18 bp, Homo sapiens
cctgcgtcctcctcacct

SEQ ID NO: 767228 - DNA, 20 bp, Homo sapiens
cctgcgtcctcctcacctca

SEQ ID NO: 767229 - DNA, 17 bp, Homo sapiens
cctgcgtcttccgcccc

SEQ ID NO: 767230 - DNA, 23 bp, Homo sapiens
cctgcgtcttccgcccctgcctg

SEQ ID NO: 767231 - DNA, 15 bp, Homo sapiens
cctgcgtgccgggag

SEQ ID NO: 767232 - DNA, 22 bp, Homo sapiens
cctgcgtgccgggagaggactc

SEQ ID NO: 767233 - DNA, 14 bp, Homo sapiens
cctgcgttcagccc

SEQ ID NO: 767234 - DNA, 15 bp, Homo sapiens
cctgcgttcagcccc

SEQ ID NO: 767235 - DNA, 16 bp, Homo sapiens
cctgcgttcagcccct

SEQ ID NO: 767236 - DNA, 18 bp, Homo sapiens
cctgcgttcagcccctga

SEQ ID NO: 767237 - DNA, 14 bp, Homo sapiens
cctgcgttggagcc

SEQ ID NO: 767238 - DNA, 17 bp, Homo sapiens
cctgcgttggagccact

SEQ ID NO: 767239 - DNA, 20 bp, Homo sapiens
cctgcgttggagccactcct

SEQ ID NO: 767240 - DNA, 19 bp, Homo sapiens
cctgcgttggtccagagcg

SEQ ID NO: 767241 - DNA, 16 bp, Homo sapiens
cctgctaaggctcctc

SEQ ID NO: 767242 - DNA, 18 bp, Homo sapiens
cctgctaaggctcctcct

SEQ ID NO: 767243 - DNA, 13 bp, Homo sapiens
cctgctaatagct

SEQ ID NO: 767244 - DNA, 17 bp, Homo sapiens
cctgctaatagctgcta

SEQ ID NO: 767245 - DNA, 15 bp, Homo sapiens
cctgctacaagtgtt

SEQ ID NO: 767246 - DNA, 20 bp, Homo sapiens
cctgctactcctgtgctctg

SEQ ID NO: 767247 - DNA, 18 bp, Homo sapiens
cctgctagcaggccccct

SEQ ID NO: 767248 - DNA, 19 bp, Homo sapiens
cctgctagcaggcccccta

SEQ ID NO: 767249 - DNA, 19 bp, Homo sapiens
cctgctatgacagctggct

SEQ ID NO: 767250 - DNA, 22 bp, Homo sapiens
cctgctattactaaggagtaat

SEQ ID NO: 767251 - DNA, 21 bp, Homo sapiens
cctgctcaactctacccctgc

SEQ ID NO: 767252 - DNA, 17 bp, Homo sapiens
cctgctcacagggatgc

SEQ ID NO: 767253 - DNA, 14 bp, Homo sapiens
cctgctcagcagcc

SEQ ID NO: 767254 - DNA, 15 bp, Homo sapiens
cctgctcagcagcca

SEQ ID NO: 767255 - DNA, 16 bp, Homo sapiens
cctgctcagcagccag

SEQ ID NO: 767256 - DNA, 17 bp, Homo sapiens
cctgctcagcagccagt

SEQ ID NO: 767257 - DNA, 22 bp, Homo sapiens
cctgctcagcagccagtctcag

SEQ ID NO: 767258 - DNA, 22 bp, Homo sapiens
cctgctcagtgcttgggctcca

SEQ ID NO: 767259 - DNA, 16 bp, Homo sapiens
cctgctccaccagcag

SEQ ID NO: 767260 - DNA, 12 bp, Homo sapiens
cctgctccagct

SEQ ID NO: 767261 - DNA, 13 bp, Homo sapiens
cctgctccatcgc

SEQ ID NO: 767262 - DNA, 14 bp, Homo sapiens
cctgctcccagcag

SEQ ID NO: 767263 - DNA, 23 bp, Homo sapiens
cctgctcccagcagccctaagga

SEQ ID NO: 767264 - DNA, 13 bp, Homo sapiens
cctgctcccagcc

SEQ ID NO: 767265 - DNA, 15 bp, Homo sapiens
cctgctcccagcctg

SEQ ID NO: 767266 - DNA, 17 bp, Homo sapiens
cctgctcccatcctcac

SEQ ID NO: 767267 - DNA, 22 bp, Homo sapiens
cctgctcccatcctcacccaga

SEQ ID NO: 767268 - DNA, 14 bp, Homo sapiens
cctgctcccccacc

SEQ ID NO: 767269 - DNA, 16 bp, Homo sapiens
cctgctccgccaggaa

SEQ ID NO: 767270 - DNA, 18 bp, Homo sapiens
cctgctccgttggtcagc

SEQ ID NO: 767271 - DNA, 18 bp, Homo sapiens
cctgctcctaagggtaga

SEQ ID NO: 767272 - DNA, 20 bp, Homo sapiens
cctgctcctcactggaggag

SEQ ID NO: 767273 - DNA, 18 bp, Homo sapiens
cctgctcctcatgggaag

SEQ ID NO: 767274 - DNA, 12 bp, Homo sapiens
cctgctcctccc

SEQ ID NO: 767275 - DNA, 13 bp, Homo sapiens
cctgctcctccct

SEQ ID NO: 767276 - DNA, 17 bp, Homo sapiens
cctgctcctccctggct

SEQ ID NO: 767277 - DNA, 12 bp, Homo sapiens
cctgctcctcct

SEQ ID NO: 767278 - DNA, 17 bp, Homo sapiens
cctgctcctcctgccct

SEQ ID NO: 767279 - DNA, 13 bp, Homo sapiens
cctgctcctgcag

SEQ ID NO: 767280 - DNA, 15 bp, Homo sapiens
cctgctcctgcagca

SEQ ID NO: 767281 - DNA, 18 bp, Homo sapiens
cctgctctacccatgagc

SEQ ID NO: 767282 - DNA, 19 bp, Homo sapiens
cctgctctacccatgagcc

SEQ ID NO: 767283 - DNA, 12 bp, Homo sapiens
cctgctctctgc

SEQ ID NO: 767284 - DNA, 15 bp, Homo sapiens
cctgctctcttcagg

SEQ ID NO: 767285 - DNA, 16 bp, Homo sapiens
cctgctctcttcagga

SEQ ID NO: 767286 - DNA, 12 bp, Homo sapiens
cctgctctgccc

SEQ ID NO: 767287 - DNA, 14 bp, Homo sapiens
cctgctctggtccc

SEQ ID NO: 767288 - DNA, 18 bp, Homo sapiens
cctgctctgtccccaaag

SEQ ID NO: 767289 - DNA, 23 bp, Homo sapiens
cctgctctttctacatgactggg

SEQ ID NO: 767290 - DNA, 18 bp, Homo sapiens
cctgctcttttgtgatga

SEQ ID NO: 767291 - DNA, 20 bp, Homo sapiens
cctgctgaacacagtgtctg

SEQ ID NO: 767292 - DNA, 22 bp, Homo sapiens
cctgctgaacacagtgtctgtt

SEQ ID NO: 767293 - DNA, 13 bp, Homo sapiens
cctgctgacagac

SEQ ID NO: 767294 - DNA, 14 bp, Homo sapiens
cctgctgacctgtg

SEQ ID NO: 767295 - DNA, 18 bp, Homo sapiens
cctgctgacctgtgcaca

SEQ ID NO: 767296 - DNA, 13 bp, Homo sapiens
cctgctgagagcc

SEQ ID NO: 767297 - DNA, 17 bp, Homo sapiens
cctgctgagagccccca

SEQ ID NO: 767298 - DNA, 23 bp, Homo sapiens
cctgctgagatgaggaggggagc

SEQ ID NO: 767299 - DNA, 14 bp, Homo sapiens
cctgctgaggcctt

SEQ ID NO: 767300 - DNA, 16 bp, Homo sapiens
cctgctgaggccttct

SEQ ID NO: 767301 - DNA, 21 bp, Homo sapiens
cctgctgaggccttctcttga

SEQ ID NO: 767302 - DNA, 15 bp, Homo sapiens
cctgctgagtcccag

SEQ ID NO: 767303 - DNA, 18 bp, Homo sapiens
cctgctgagtcccaggct

SEQ ID NO: 767304 - DNA, 19 bp, Homo sapiens
cctgctgagtcccaggctg

SEQ ID NO: 767305 - DNA, 20 bp, Homo sapiens
cctgctgagtcccaggctga

SEQ ID NO: 767306 - DNA, 17 bp, Homo sapiens
cctgctgattgattttt

SEQ ID NO: 767307 - DNA, 21 bp, Homo sapiens
cctgctgattgatttttttct

SEQ ID NO: 767308 - DNA, 15 bp, Homo sapiens
cctgctgcaccctgc

SEQ ID NO: 767309 - DNA, 23 bp, Homo sapiens
cctgctgcaccctgcgcctccag

SEQ ID NO: 767310 - DNA, 17 bp, Homo sapiens
cctgctgcactaggact

SEQ ID NO: 767311 - DNA, 19 bp, Homo sapiens
cctgctgccagtgcagcca

SEQ ID NO: 767312 - DNA, 22 bp, Homo sapiens
cctgctgccccagctgactgtg

SEQ ID NO: 767313 - DNA, 21 bp, Homo sapiens
cctgctgccgcctcccagcct

SEQ ID NO: 767314 - DNA, 23 bp, Homo sapiens
cctgctgcctccccaaccctgcc

SEQ ID NO: 767315 - DNA, 14 bp, Homo sapiens
cctgctgcctgctg

SEQ ID NO: 767316 - DNA, 16 bp, Homo sapiens
cctgctgcctgctgag

SEQ ID NO: 767317 - DNA, 15 bp, Homo sapiens
cctgctgccttttct

SEQ ID NO: 767318 - DNA, 16 bp, Homo sapiens
cctgctgccttttctg

SEQ ID NO: 767319 - DNA, 22 bp, Homo sapiens
cctgctgcgtcagaccagtact

SEQ ID NO: 767320 - DNA, 23 bp, Homo sapiens
cctgctgcgtcagaccagtactg

SEQ ID NO: 767321 - DNA, 14 bp, Homo sapiens
cctgctgcgtcccc

SEQ ID NO: 767322 - DNA, 18 bp, Homo sapiens
cctgctgcgtccccactc

SEQ ID NO: 767323 - DNA, 19 bp, Homo sapiens
cctgctgcgtccccactcc

SEQ ID NO: 767324 - DNA, 15 bp, Homo sapiens
cctgctgctgctgcc

SEQ ID NO: 767325 - DNA, 20 bp, Homo sapiens
cctgctgctgtaactgctga

SEQ ID NO: 767326 - DNA, 21 bp, Homo sapiens
cctgctgctgtaactgctgag

SEQ ID NO: 767327 - DNA, 22 bp, Homo sapiens
cctgctgctgtaactgctgagc

SEQ ID NO: 767328 - DNA, 23 bp, Homo sapiens
cctgctgctgtaactgctgagcc

SEQ ID NO: 767329 - DNA, 16 bp, Homo sapiens
cctgctgcttgggacg

SEQ ID NO: 767330 - DNA, 22 bp, Homo sapiens
cctgctggaaaccacacttctt

SEQ ID NO: 767331 - DNA, 16 bp, Homo sapiens
cctgctggaagcccag

SEQ ID NO: 767332 - DNA, 16 bp, Homo sapiens
cctgctggaggcctca

SEQ ID NO: 767333 - DNA, 11 bp, Homo sapiens
cctgctggcag

SEQ ID NO: 767334 - DNA, 15 bp, Homo sapiens
cctgctggcagggcc

SEQ ID NO: 767335 - DNA, 17 bp, Homo sapiens
cctgctggcagggccag

SEQ ID NO: 767336 - DNA, 21 bp, Homo sapiens
cctgctggcagggccagggca

SEQ ID NO: 767337 - DNA, 13 bp, Homo sapiens
cctgctggcatca

SEQ ID NO: 767338 - DNA, 17 bp, Homo sapiens
cctgctggcccctcacc

SEQ ID NO: 767339 - DNA, 11 bp, Homo sapiens
cctgctggctg

SEQ ID NO: 767340 - DNA, 15 bp, Homo sapiens
cccagcggcccctcc

SEQ ID NO: 767341 - DNA, 19 bp, Homo sapiens
cccagcggcccctcccaca

SEQ ID NO: 767342 - DNA, 20 bp, Homo sapiens
cccagcggcccctcccacac

SEQ ID NO: 767343 - DNA, 16 bp, Homo sapiens
cccagcggcctcaggg

SEQ ID NO: 767344 - DNA, 16 bp, Homo sapiens
cccagcggcctccggc

SEQ ID NO: 767345 - DNA, 20 bp, Homo sapiens
cccagcggcttagccaagcc

SEQ ID NO: 767346 - DNA, 20 bp, Homo sapiens
cccagcggttcctgtgcaga

SEQ ID NO: 767347 - DNA, 14 bp, Homo sapiens
cccagcgtcaggcc

SEQ ID NO: 767348 - DNA, 17 bp, Homo sapiens
cccagcgtctgcagggt

SEQ ID NO: 767349 - DNA, 19 bp, Homo sapiens
cccagcgtggcccaggccg

SEQ ID NO: 767350 - DNA, 15 bp, Homo sapiens
cccagcgtggcctcc

SEQ ID NO: 767351 - DNA, 19 bp, Homo sapiens
cccagctaattgagaccac

SEQ ID NO: 767352 - DNA, 19 bp, Homo sapiens
cccagctacattcctcagc

SEQ ID NO: 767353 - DNA, 21 bp, Homo sapiens
cccagctacattcctcagctg

SEQ ID NO: 767354 - DNA, 23 bp, Homo sapiens
cccagctacattcctcagctgcc

SEQ ID NO: 767355 - DNA, 14 bp, Homo sapiens
cccagctacctcaa

SEQ ID NO: 767356 - DNA, 17 bp, Homo sapiens
cccagctactcagaagc

SEQ ID NO: 767357 - DNA, 21 bp, Homo sapiens
cccagctactcagaagcctga

SEQ ID NO: 767358 - DNA, 22 bp, Homo sapiens
cccagctactcagaagcctgag

SEQ ID NO: 767359 - DNA, 14 bp, Homo sapiens
cccagctactcagg

SEQ ID NO: 767360 - DNA, 20 bp, Homo sapiens
cccagctactcaggaggctg

SEQ ID NO: 767361 - DNA, 21 bp, Homo sapiens
cccagctactctgtccaggcc

SEQ ID NO: 767362 - DNA, 21 bp, Homo sapiens
cccagctactgaaccagccac

SEQ ID NO: 767363 - DNA, 15 bp, Homo sapiens
cccagctacttggga

SEQ ID NO: 767364 - DNA, 16 bp, Homo sapiens
cccagctacttgggaa

SEQ ID NO: 767365 - DNA, 19 bp, Homo sapiens
cccagctacttgggagcct

SEQ ID NO: 767366 - DNA, 22 bp, Homo sapiens
cccagctacttgggagcctgag

SEQ ID NO: 767367 - DNA, 23 bp, Homo sapiens
cccagctacttgggaggctgagg

SEQ ID NO: 767368 - DNA, 22 bp, Homo sapiens
cccagctcatgtaggtgagcct

SEQ ID NO: 767369 - DNA, 12 bp, Homo sapiens
cccagctccagc

SEQ ID NO: 767370 - DNA, 16 bp, Homo sapiens
cccagctccaggggcc

SEQ ID NO: 767371 - DNA, 21 bp, Homo sapiens
cccagctccccccgcccaccc

SEQ ID NO: 767372 - DNA, 16 bp, Homo sapiens
cccagctccctgcacc

SEQ ID NO: 767373 - DNA, 17 bp, Homo sapiens
cccagctccctgcaccg

SEQ ID NO: 767374 - DNA, 20 bp, Homo sapiens
cccagctccgacctctctca

SEQ ID NO: 767375 - DNA, 22 bp, Homo sapiens
cccagctccgacctctctcagc

SEQ ID NO: 767376 - DNA, 15 bp, Homo sapiens
cccagctccgcctgc

SEQ ID NO: 767377 - DNA, 12 bp, Homo sapiens
cccagctcctca

SEQ ID NO: 767378 - DNA, 14 bp, Homo sapiens
cccagctcctcaca

SEQ ID NO: 767379 - DNA, 16 bp, Homo sapiens
cccagctcctctgagc

SEQ ID NO: 767380 - DNA, 17 bp, Homo sapiens
cccagctcctctgagcc

SEQ ID NO: 767381 - DNA, 20 bp, Homo sapiens
cccagctcctctgagccata

SEQ ID NO: 767382 - DNA, 17 bp, Homo sapiens
cccagctccttggctgc

SEQ ID NO: 767383 - DNA, 22 bp, Homo sapiens
cccagctccttggctgcagcca

SEQ ID NO: 767384 - DNA, 23 bp, Homo sapiens
cccagctccttggctgcagccat

SEQ ID NO: 767385 - DNA, 21 bp, Homo sapiens
cccagctcctttctcctgtga

SEQ ID NO: 767386 - DNA, 20 bp, Homo sapiens
cccagctccttttgtcccca

SEQ ID NO: 767387 - DNA, 23 bp, Homo sapiens
cccagctccttttgtccccaggg

SEQ ID NO: 767388 - DNA, 23 bp, Homo sapiens
cccagctctaagcagccaggagg

SEQ ID NO: 767389 - DNA, 23 bp, Homo sapiens
cccagctctagacaaccctgcaa

SEQ ID NO: 767390 - DNA, 12 bp, Homo sapiens
cccagctctccc

SEQ ID NO: 767391 - DNA, 15 bp, Homo sapiens
cccagctctcccaca

SEQ ID NO: 767392 - DNA, 19 bp, Homo sapiens
cccagctctccctctggcc

SEQ ID NO: 767393 - DNA, 12 bp, Homo sapiens
cccagctctgaa

SEQ ID NO: 767394 - DNA, 14 bp, Homo sapiens
cccagctctgaccc

SEQ ID NO: 767395 - DNA, 11 bp, Homo sapiens
cccagctctgc

SEQ ID NO: 767396 - DNA, 19 bp, Homo sapiens
cccagctctggatgaaggc

SEQ ID NO: 767397 - DNA, 20 bp, Homo sapiens
cccagctcttctccccaggt

SEQ ID NO: 767398 - DNA, 17 bp, Homo sapiens
cccagctcttgctctct

SEQ ID NO: 767399 - DNA, 21 bp, Homo sapiens
cccagctcttgctctcttgtg

SEQ ID NO: 767400 - DNA, 13 bp, Homo sapiens
cccagctgactgt

SEQ ID NO: 767401 - DNA, 14 bp, Homo sapiens
cccagctgactgtg

SEQ ID NO: 767402 - DNA, 21 bp, Homo sapiens
cccagctgactgtggccccct

SEQ ID NO: 767403 - DNA, 9 bp, Homo sapiens
cccagctgc

SEQ ID NO: 767404 - DNA, 21 bp, Homo sapiens
cccagctgcacctgccagcct

SEQ ID NO: 767405 - DNA, 23 bp, Homo sapiens
cccagctgcacctgccagcctgg

SEQ ID NO: 767406 - DNA, 12 bp, Homo sapiens
cccagctgcaga

SEQ ID NO: 767407 - DNA, 15 bp, Homo sapiens
cccagctgccaggcg

SEQ ID NO: 767408 - DNA, 17 bp, Homo sapiens
cccagctgccaggcggc

SEQ ID NO: 767409 - DNA, 22 bp, Homo sapiens
cccagctgccaggcggccctgg

SEQ ID NO: 767410 - DNA, 12 bp, Homo sapiens
cccagctgctcc

SEQ ID NO: 767411 - DNA, 16 bp, Homo sapiens
cccagctgctcccctg

SEQ ID NO: 767412 - DNA, 18 bp, Homo sapiens
cccagctgctcccctgga

SEQ ID NO: 767413 - DNA, 20 bp, Homo sapiens
cccagctggcccgtgacaga

SEQ ID NO: 767414 - DNA, 14 bp, Homo sapiens
cccagctgggaggc

SEQ ID NO: 767415 - DNA, 17 bp, Homo sapiens
cccagctgggaggcaag

SEQ ID NO: 767416 - DNA, 20 bp, Homo sapiens
cccagctgggaggcaagagg

SEQ ID NO: 767417 - DNA, 12 bp, Homo sapiens
cccagctgggct

SEQ ID NO: 767418 - DNA, 13 bp, Homo sapiens
cccagctgggctc

SEQ ID NO: 767419 - DNA, 14 bp, Homo sapiens
cccagctgggctct

SEQ ID NO: 767420 - DNA, 20 bp, Homo sapiens
cccagctgggctctgccacc

SEQ ID NO: 767421 - DNA, 13 bp, Homo sapiens
cccagctggtcct

SEQ ID NO: 767422 - DNA, 14 bp, Homo sapiens
cccagctggtcctg

SEQ ID NO: 767423 - DNA, 15 bp, Homo sapiens
cccagctggtcctgt

SEQ ID NO: 767424 - DNA, 13 bp, Homo sapiens
cccagctggtggc

SEQ ID NO: 767425 - DNA, 19 bp, Homo sapiens
cccagctggtgggaagcgt

SEQ ID NO: 767426 - DNA, 15 bp, Homo sapiens
cccagctgtagccat

SEQ ID NO: 767427 - DNA, 16 bp, Homo sapiens
cccagctgtagccatg

SEQ ID NO: 767428 - DNA, 22 bp, Homo sapiens
cccagctgtagccatggctcag

SEQ ID NO: 767429 - DNA, 24 bp, Homo sapiens
cccagctgtagccatggctcaggc

SEQ ID NO: 767430 - DNA, 22 bp, Homo sapiens
cccagcttctctctccctgtca

SEQ ID NO: 767431 - DNA, 15 bp, Homo sapiens
cccagcttgaaacct

SEQ ID NO: 767432 - DNA, 23 bp, Homo sapiens
cccagcttgctgaggggcaggga

SEQ ID NO: 767433 - DNA, 20 bp, Homo sapiens
cccagcttgggcccagctgg

SEQ ID NO: 767434 - DNA, 18 bp, Homo sapiens
cccagcttgtaggagctg

SEQ ID NO: 767435 - DNA, 17 bp, Homo sapiens
cccagctttctcctctg

SEQ ID NO: 767436 - DNA, 17 bp, Homo sapiens
cccaggaacgctctcct

SEQ ID NO: 767437 - DNA, 15 bp, Homo sapiens
cccaggaactgggcc

SEQ ID NO: 767438 - DNA, 13 bp, Homo sapiens
cccaggaagccgg

SEQ ID NO: 767439 - DNA, 22 bp, Homo sapiens
cccaggaagccggtgcctgggt

SEQ ID NO: 767440 - DNA, 12 bp, Homo sapiens
cccaggaaggga

SEQ ID NO: 767441 - DNA, 18 bp, Homo sapiens
cccaggacaagcacgagg

SEQ ID NO: 767442 - DNA, 17 bp, Homo sapiens
cccaggacaggatccag

SEQ ID NO: 767443 - DNA, 15 bp, Homo sapiens
cccaggaccagctgg

SEQ ID NO: 767444 - DNA, 18 bp, Homo sapiens
cccaggaccagctggggc

SEQ ID NO: 767445 - DNA, 21 bp, Homo sapiens
cccaggaccagctggggcgtg

SEQ ID NO: 767446 - DNA, 16 bp, Homo sapiens
cccaggaccctccact

SEQ ID NO: 767447 - DNA, 16 bp, Homo sapiens
cccaggacctggctgc

SEQ ID NO: 767448 - DNA, 23 bp, Homo sapiens
cccaggacgccactcatttcatc

SEQ ID NO: 767449 - DNA, 20 bp, Homo sapiens
cccaggacgcttctgaatgc

SEQ ID NO: 767450 - DNA, 16 bp, Homo sapiens
cccaggactcaccctc

SEQ ID NO: 767451 - DNA, 19 bp, Homo sapiens
cccaggactctggcacttc

SEQ ID NO: 767452 - DNA, 21 bp, Homo sapiens
cccaggagacagaccacttgc

SEQ ID NO: 767453 - DNA, 15 bp, Homo sapiens
cccaggagacagttc

SEQ ID NO: 767454 - DNA, 17 bp, Homo sapiens
cccaggagacagttcaa

SEQ ID NO: 767455 - DNA, 15 bp, Homo sapiens
cccaggagagccagc

SEQ ID NO: 767456 - DNA, 18 bp, Homo sapiens
cccaggagagccagccct

SEQ ID NO: 767457 - DNA, 23 bp, Homo sapiens
cccaggagagccagccctccctg

SEQ ID NO: 767458 - DNA, 16 bp, Homo sapiens
cccaggagagccccca

SEQ ID NO: 767459 - DNA, 18 bp, Homo sapiens
cccaggagagcccccacc

SEQ ID NO: 767460 - DNA, 20 bp, Homo sapiens
cccaggagatgggtccaggg

SEQ ID NO: 767461 - DNA, 23 bp, Homo sapiens
caaatgaggaaaccaagataaat

SEQ ID NO: 767462 - DNA, 21 bp, Homo sapiens
caaatgagggaagaacattat

SEQ ID NO: 767463 - DNA, 18 bp, Homo sapiens
caaatgagtaacatttgc

SEQ ID NO: 767464 - DNA, 15 bp, Homo sapiens
caaatgatcctagta

SEQ ID NO: 767465 - DNA, 21 bp, Homo sapiens
caaatgatgtgcaaaaccttt

SEQ ID NO: 767466 - DNA, 19 bp, Homo sapiens
caaatgcaaaaactctttg

SEQ ID NO: 767467 - DNA, 18 bp, Homo sapiens
caaatgcaaaattagtac

SEQ ID NO: 767468 - DNA, 23 bp, Homo sapiens
caaatgcaaatttctataaattt

SEQ ID NO: 767469 - DNA, 15 bp, Homo sapiens
caaatgcaatttgat

SEQ ID NO: 767470 - DNA, 16 bp, Homo sapiens
caaatgccagggcccg

SEQ ID NO: 767471 - DNA, 15 bp, Homo sapiens
caaatgcccaaggat

SEQ ID NO: 767472 - DNA, 16 bp, Homo sapiens
caaatgctcaaagaaa

SEQ ID NO: 767473 - DNA, 15 bp, Homo sapiens
caaatgctgtattct

SEQ ID NO: 767474 - DNA, 18 bp, Homo sapiens
caaatggagaagctgcag

SEQ ID NO: 767475 - DNA, 16 bp, Homo sapiens
caaatggaggcttttc

SEQ ID NO: 767476 - DNA, 22 bp, Homo sapiens
caaatggattttgggagtgact

SEQ ID NO: 767477 - DNA, 14 bp, Homo sapiens
caaatggcagtttt

SEQ ID NO: 767478 - DNA, 21 bp, Homo sapiens
caaatggccagttttctggta

SEQ ID NO: 767479 - DNA, 19 bp, Homo sapiens
caaatggccattttaaaat

SEQ ID NO: 767480 - DNA, 22 bp, Homo sapiens
caaatggcgtctggaagtccaa

SEQ ID NO: 767481 - DNA, 13 bp, Homo sapiens
caaatgggaaaaa

SEQ ID NO: 767482 - DNA, 17 bp, Homo sapiens
caaatgggagctgagca

SEQ ID NO: 767483 - DNA, 20 bp, Homo sapiens
caaatgggagctgagcagcc

SEQ ID NO: 767484 - DNA, 22 bp, Homo sapiens
caaatgggcagctccatcctct

SEQ ID NO: 767485 - DNA, 15 bp, Homo sapiens
caaatgtaaaattat

SEQ ID NO: 767486 - DNA, 15 bp, Homo sapiens
caaatgtaatagttt

SEQ ID NO: 767487 - DNA, 20 bp, Homo sapiens
caaatgtaatagtttatctt

SEQ ID NO: 767488 - DNA, 21 bp, Homo sapiens
caaatgtaatagtttatctta

SEQ ID NO: 767489 - DNA, 18 bp, Homo sapiens
caaatgtagttttgtata

SEQ ID NO: 767490 - DNA, 13 bp, Homo sapiens
caaatgtattgat

SEQ ID NO: 767491 - DNA, 16 bp, Homo sapiens
caaatgtcattgtcta

SEQ ID NO: 767492 - DNA, 17 bp, Homo sapiens
caaatgtcattgtctac

SEQ ID NO: 767493 - DNA, 20 bp, Homo sapiens
caaatgtcggggttggggtg

SEQ ID NO: 767494 - DNA, 22 bp, Homo sapiens
caaatgtcggggttggggtggg

SEQ ID NO: 767495 - DNA, 16 bp, Homo sapiens
caaatgtgatcaactg

SEQ ID NO: 767496 - DNA, 19 bp, Homo sapiens
caaatgtgccatactaatg

SEQ ID NO: 767497 - DNA, 14 bp, Homo sapiens
caaatgtgctttga

SEQ ID NO: 767498 - DNA, 18 bp, Homo sapiens
caaatgtgctttgagaag

SEQ ID NO: 767499 - DNA, 19 bp, Homo sapiens
caaatgtggcctccatgtg

SEQ ID NO: 767500 - DNA, 20 bp, Homo sapiens
caaatgtgtacatggcagag

SEQ ID NO: 767501 - DNA, 14 bp, Homo sapiens
caaatgtgtcagaa

SEQ ID NO: 767502 - DNA, 16 bp, Homo sapiens
caaatgttaactgcca

SEQ ID NO: 767503 - DNA, 15 bp, Homo sapiens
caaatgttcatcctc

SEQ ID NO: 767504 - DNA, 13 bp, Homo sapiens
caaatgttgacct

SEQ ID NO: 767505 - DNA, 17 bp, Homo sapiens
caaatgtttatttaaaa

SEQ ID NO: 767506 - DNA, 15 bp, Homo sapiens
caaatgtttccttaa

SEQ ID NO: 767507 - DNA, 18 bp, Homo sapiens
caaatgtttccttaaaca

SEQ ID NO: 767508 - DNA, 20 bp, Homo sapiens
caaatgtttgaaaacaaaaa

SEQ ID NO: 767509 - DNA, 17 bp, Homo sapiens
caaatgttttgaaatga

SEQ ID NO: 767510 - DNA, 21 bp, Homo sapiens
caaattaaaacaaatatacat

SEQ ID NO: 767511 - DNA, 22 bp, Homo sapiens
caaattaaaacaaatatacatt

SEQ ID NO: 767512 - DNA, 19 bp, Homo sapiens
caaattaaaacatatttca

SEQ ID NO: 767513 - DNA, 21 bp, Homo sapiens
caaattaaaacatatttcatt

SEQ ID NO: 767514 - DNA, 13 bp, Homo sapiens
caaattaactgta

SEQ ID NO: 767515 - DNA, 17 bp, Homo sapiens
caaattaataatcttat

SEQ ID NO: 767516 - DNA, 12 bp, Homo sapiens
caaattagaaaa

SEQ ID NO: 767517 - DNA, 15 bp, Homo sapiens
caaattagaagacat

SEQ ID NO: 767518 - DNA, 14 bp, Homo sapiens
caaattagaggaga

SEQ ID NO: 767519 - DNA, 16 bp, Homo sapiens
caaattagcatgcaag

SEQ ID NO: 767520 - DNA, 17 bp, Homo sapiens
caaattagcatgcaagc

SEQ ID NO: 767521 - DNA, 18 bp, Homo sapiens
caaattagcatgcaagct

SEQ ID NO: 767522 - DNA, 19 bp, Homo sapiens
caaattagcatgcaagctt

SEQ ID NO: 767523 - DNA, 14 bp, Homo sapiens
caaattagttatat

SEQ ID NO: 767524 - DNA, 16 bp, Homo sapiens
caaattagttggtttg

SEQ ID NO: 767525 - DNA, 18 bp, Homo sapiens
caaattataagggccctg

SEQ ID NO: 767526 - DNA, 14 bp, Homo sapiens
caaattatagaaac

SEQ ID NO: 767527 - DNA, 23 bp, Homo sapiens
caaattatagaaacaatactgtt

SEQ ID NO: 767528 - DNA, 22 bp, Homo sapiens
caaattatatgctaattaaata

SEQ ID NO: 767529 - DNA, 13 bp, Homo sapiens
caaattatcttga

SEQ ID NO: 767530 - DNA, 15 bp, Homo sapiens
caaattattaattgt

SEQ ID NO: 767531 - DNA, 12 bp, Homo sapiens
caaattatttat

SEQ ID NO: 767532 - DNA, 20 bp, Homo sapiens
caaattatttgtgtaataga

SEQ ID NO: 767533 - DNA, 14 bp, Homo sapiens
caaattattttaat

SEQ ID NO: 767534 - DNA, 13 bp, Homo sapiens
caaattcaaataa

SEQ ID NO: 767535 - DNA, 22 bp, Homo sapiens
caaattcaagagctagaaaaat

SEQ ID NO: 767536 - DNA, 14 bp, Homo sapiens
caaattcagcctac

SEQ ID NO: 767537 - DNA, 20 bp, Homo sapiens
caaattcatttcatggtgac

SEQ ID NO: 767538 - DNA, 15 bp, Homo sapiens
caaattctactttaa

SEQ ID NO: 767539 - DNA, 21 bp, Homo sapiens
caaattctcaacctaccaccc

SEQ ID NO: 767540 - DNA, 15 bp, Homo sapiens
caaattctcaccaaa

SEQ ID NO: 767541 - DNA, 14 bp, Homo sapiens
caaattcttctgaa

SEQ ID NO: 767542 - DNA, 14 bp, Homo sapiens
caaattcttttgaa

SEQ ID NO: 767543 - DNA, 16 bp, Homo sapiens
caaattcttttgaatt

SEQ ID NO: 767544 - DNA, 14 bp, Homo sapiens
caaattgagataat

SEQ ID NO: 767545 - DNA, 20 bp, Homo sapiens
caaattgccctatgctgtgc

SEQ ID NO: 767546 - DNA, 22 bp, Homo sapiens
caaattgctcctaagcttcaaa

SEQ ID NO: 767547 - DNA, 14 bp, Homo sapiens
caaattgcttctag

SEQ ID NO: 767548 - DNA, 22 bp, Homo sapiens
caaattgcttttttccaaaaca

SEQ ID NO: 767549 - DNA, 21 bp, Homo sapiens
caaattggaatggaactactg

SEQ ID NO: 767550 - DNA, 21 bp, Homo sapiens
caacatctttgcgaaaagata

SEQ ID NO: 767551 - DNA, 18 bp, Homo sapiens
caacatgagtgtattttt

SEQ ID NO: 767552 - DNA, 23 bp, Homo sapiens
caacatgcattgccatgaatttc

SEQ ID NO: 767553 - DNA, 23 bp, Homo sapiens
caacatgcctgccccaaacaaat

SEQ ID NO: 767554 - DNA, 18 bp, Homo sapiens
caacatggaatttttcca

SEQ ID NO: 767555 - DNA, 13 bp, Homo sapiens
caacatggagaaa

SEQ ID NO: 767556 - DNA, 23 bp, Homo sapiens
caacatggagaaaccctgtctct

SEQ ID NO: 767557 - DNA, 10 bp, Homo sapiens
caacatggga

SEQ ID NO: 767558 - DNA, 19 bp, Homo sapiens
caacatgggagggatcagc

SEQ ID NO: 767559 - DNA, 20 bp, Homo sapiens
caacatgggagggatcagcc

SEQ ID NO: 767560 - DNA, 17 bp, Homo sapiens
caacatgtggctcctcc

SEQ ID NO: 767561 - DNA, 17 bp, Homo sapiens
caacatgttactgacca

SEQ ID NO: 767562 - DNA, 20 bp, Homo sapiens
caacatgttactgaccagca

SEQ ID NO: 767563 - DNA, 13 bp, Homo sapiens
caacatgtttctg

SEQ ID NO: 767564 - DNA, 15 bp, Homo sapiens
caacattaaaactca

SEQ ID NO: 767565 - DNA, 15 bp, Homo sapiens
caacattaaacacaa

SEQ ID NO: 767566 - DNA, 21 bp, Homo sapiens
caacattcctttcttgtgccc

SEQ ID NO: 767567 - DNA, 23 bp, Homo sapiens
caacattcctttcttgtgccctg

SEQ ID NO: 767568 - DNA, 10 bp, Homo sapiens
caacattgtg

SEQ ID NO: 767569 - DNA, 12 bp, Homo sapiens
caacatttctgt

SEQ ID NO: 767570 - DNA, 14 bp, Homo sapiens
caacatttctgtat

SEQ ID NO: 767571 - DNA, 19 bp, Homo sapiens
caacatttctgtatactgt

SEQ ID NO: 767572 - DNA, 20 bp, Homo sapiens
caacatttcttaaattattt

SEQ ID NO: 767573 - DNA, 17 bp, Homo sapiens
caacatttttttttctc

SEQ ID NO: 767574 - DNA, 15 bp, Homo sapiens
caaccaaccagcagg

SEQ ID NO: 767575 - DNA, 19 bp, Homo sapiens
caaccaactatccaagtgt

SEQ ID NO: 767576 - DNA, 18 bp, Homo sapiens
caaccaactgccccaggg

SEQ ID NO: 767577 - DNA, 22 bp, Homo sapiens
caaccaagaggatttcttcaaa

SEQ ID NO: 767578 - DNA, 14 bp, Homo sapiens
caaccaaggaagga

SEQ ID NO: 767579 - DNA, 15 bp, Homo sapiens
caaccaaggaaggag

SEQ ID NO: 767580 - DNA, 17 bp, Homo sapiens
caaccaaggaaggagcc

SEQ ID NO: 767581 - DNA, 20 bp, Homo sapiens
caaccaagtcatgtgcattt

SEQ ID NO: 767582 - DNA, 19 bp, Homo sapiens
caaccacatgtcccagatc

SEQ ID NO: 767583 - DNA, 14 bp, Homo sapiens
caaccaccgctccc

SEQ ID NO: 767584 - DNA, 21 bp, Homo sapiens
caaccactaagaattcaaact

SEQ ID NO: 767585 - DNA, 15 bp, Homo sapiens
caaccactgtgccac

SEQ ID NO: 767586 - DNA, 16 bp, Homo sapiens
caaccactgtgccact

SEQ ID NO: 767587 - DNA, 17 bp, Homo sapiens
caaccacttttaaacat

SEQ ID NO: 767588 - DNA, 17 bp, Homo sapiens
caaccagaattgtcctc

SEQ ID NO: 767589 - DNA, 18 bp, Homo sapiens
caaccagaattgtcctca

SEQ ID NO: 767590 - DNA, 20 bp, Homo sapiens
caaccagagtcacccagttg

SEQ ID NO: 767591 - DNA, 12 bp, Homo sapiens
caaccagccttt

SEQ ID NO: 767592 - DNA, 15 bp, Homo sapiens
caaccagctaagaaa

SEQ ID NO: 767593 - DNA, 16 bp, Homo sapiens
ccaggggaaggccctg

SEQ ID NO: 767594 - DNA, 18 bp, Homo sapiens
ccaggggaaggccctgag

SEQ ID NO: 767595 - DNA, 16 bp, Homo sapiens
ccaggggacgtgggcc

SEQ ID NO: 767596 - DNA, 20 bp, Homo sapiens
ccaggggagaatgcagccca

SEQ ID NO: 767597 - DNA, 22 bp, Homo sapiens
ccaggggagaatgcagcccacc

SEQ ID NO: 767598 - DNA, 12 bp, Homo sapiens
ccaggggagcca

SEQ ID NO: 767599 - DNA, 19 bp, Homo sapiens
ccaggggagccagctgctt

SEQ ID NO: 767600 - DNA, 20 bp, Homo sapiens
ccaggggcaggcagggctgc

SEQ ID NO: 767601 - DNA, 22 bp, Homo sapiens
ccaggggcaggcagggctgcag

SEQ ID NO: 767602 - DNA, 18 bp, Homo sapiens
ccaggggcccaccctctg

SEQ ID NO: 767603 - DNA, 21 bp, Homo sapiens
ccaggggcccccgtgttcagg

SEQ ID NO: 767604 - DNA, 13 bp, Homo sapiens
ccaggggctcctg

SEQ ID NO: 767605 - DNA, 18 bp, Homo sapiens
ccagggggaaggccaagg

SEQ ID NO: 767606 - DNA, 19 bp, Homo sapiens
ccagggggaaggccaaggg

SEQ ID NO: 767607 - DNA, 23 bp, Homo sapiens
ccagggggatatgggtcctctgg

SEQ ID NO: 767608 - DNA, 17 bp, Homo sapiens
ccaggggtaacctggcc

SEQ ID NO: 767609 - DNA, 12 bp, Homo sapiens
ccaggggtcagc

SEQ ID NO: 767610 - DNA, 14 bp, Homo sapiens
ccaggggtctccct

SEQ ID NO: 767611 - DNA, 17 bp, Homo sapiens
ccaggggtctccctgga

SEQ ID NO: 767612 - DNA, 19 bp, Homo sapiens
ccaggggtctccctggagt

SEQ ID NO: 767613 - DNA, 21 bp, Homo sapiens
ccaggggtctccctggctccc

SEQ ID NO: 767614 - DNA, 19 bp, Homo sapiens
ccaggggtctgtctgcttt

SEQ ID NO: 767615 - DNA, 21 bp, Homo sapiens
ccaggggtgatttcagagagg

SEQ ID NO: 767616 - DNA, 13 bp, Homo sapiens
ccaggggtgcccc

SEQ ID NO: 767617 - DNA, 15 bp, Homo sapiens
ccaggggtgccccct

SEQ ID NO: 767618 - DNA, 17 bp, Homo sapiens
ccaggggtgccccctcc

SEQ ID NO: 767619 - DNA, 17 bp, Homo sapiens
ccagggtcccaccccca

SEQ ID NO: 767620 - DNA, 14 bp, Homo sapiens
ccagggtcccagga

SEQ ID NO: 767621 - DNA, 21 bp, Homo sapiens
ccagggtcccctccccagctc

SEQ ID NO: 767622 - DNA, 16 bp, Homo sapiens
ccagggtcccctgcca

SEQ ID NO: 767623 - DNA, 20 bp, Homo sapiens
ccagggtccgcaccagctgc

SEQ ID NO: 767624 - DNA, 24 bp, Homo sapiens
ccagggtccgcaccagctgctctg

SEQ ID NO: 767625 - DNA, 15 bp, Homo sapiens
ccagggtcctgtgcc

SEQ ID NO: 767626 - DNA, 16 bp, Homo sapiens
ccagggtcctgtgcct

SEQ ID NO: 767627 - DNA, 19 bp, Homo sapiens
ccagggtcctgtgcctgga

SEQ ID NO: 767628 - DNA, 16 bp, Homo sapiens
ccagggtctctccctc

SEQ ID NO: 767629 - DNA, 15 bp, Homo sapiens
ccagggtctggcaga

SEQ ID NO: 767630 - DNA, 16 bp, Homo sapiens
ccagggtctggcagag

SEQ ID NO: 767631 - DNA, 16 bp, Homo sapiens
ccagggtctgtgtgaa

SEQ ID NO: 767632 - DNA, 20 bp, Homo sapiens
ccagggtctgtgtgaatgtg

SEQ ID NO: 767633 - DNA, 14 bp, Homo sapiens
ccagggtcttccct

SEQ ID NO: 767634 - DNA, 14 bp, Homo sapiens
ccagggtgagagct

SEQ ID NO: 767635 - DNA, 16 bp, Homo sapiens
ccagggtgcagtgtga

SEQ ID NO: 767636 - DNA, 19 bp, Homo sapiens
ccagggtggaccaggcctg

SEQ ID NO: 767637 - DNA, 21 bp, Homo sapiens
ccagggtggaccaggcctgga

SEQ ID NO: 767638 - DNA, 17 bp, Homo sapiens
ccagggtggagctgaga

SEQ ID NO: 767639 - DNA, 22 bp, Homo sapiens
ccagggtggagctgagaagagg

SEQ ID NO: 767640 - DNA, 14 bp, Homo sapiens
ccagggtggcagca

SEQ ID NO: 767641 - DNA, 18 bp, Homo sapiens
ccagggtggctgccagcc

SEQ ID NO: 767642 - DNA, 18 bp, Homo sapiens
ccagggtgggaagagaag

SEQ ID NO: 767643 - DNA, 15 bp, Homo sapiens
ccagggtgggctggg

SEQ ID NO: 767644 - DNA, 16 bp, Homo sapiens
ccagggtgggctgggg

SEQ ID NO: 767645 - DNA, 18 bp, Homo sapiens
ccagggtggttagaggaa

SEQ ID NO: 767646 - DNA, 22 bp, Homo sapiens
ccagggtgtgactcgggagctg

SEQ ID NO: 767647 - DNA, 14 bp, Homo sapiens
ccagggtgtgtgct

SEQ ID NO: 767648 - DNA, 22 bp, Homo sapiens
ccagggttcccccagccctgtg

SEQ ID NO: 767649 - DNA, 16 bp, Homo sapiens
ccagggttgaccccag

SEQ ID NO: 767650 - DNA, 18 bp, Homo sapiens
ccagggttgaccccagag

SEQ ID NO: 767651 - DNA, 16 bp, Homo sapiens
ccagggttgatcacac

SEQ ID NO: 767652 - DNA, 22 bp, Homo sapiens
ccagggttgatcacactctggg

SEQ ID NO: 767653 - DNA, 18 bp, Homo sapiens
ccaggtaatgagggactg

SEQ ID NO: 767654 - DNA, 23 bp, Homo sapiens
ccaggtaatgagggactggaacc

SEQ ID NO: 767655 - DNA, 18 bp, Homo sapiens
ccaggtacaggagaggca

SEQ ID NO: 767656 - DNA, 23 bp, Homo sapiens
ccaggtacaggagaggcagcatg

SEQ ID NO: 767657 - DNA, 16 bp, Homo sapiens
ccaggtaccacccttc

SEQ ID NO: 767658 - DNA, 18 bp, Homo sapiens
ccaggtaccagctgcgct

SEQ ID NO: 767659 - DNA, 20 bp, Homo sapiens
ccaggtactgcattctctcc

SEQ ID NO: 767660 - DNA, 19 bp, Homo sapiens
ccaggtagcaagagagcag

SEQ ID NO: 767661 - DNA, 13 bp, Homo sapiens
ccaggtagctggg

SEQ ID NO: 767662 - DNA, 20 bp, Homo sapiens
ccaggtagctgggattacag

SEQ ID NO: 767663 - DNA, 16 bp, Homo sapiens
ccaggtatctccagga

SEQ ID NO: 767664 - DNA, 17 bp, Homo sapiens
ccaggtatctccaggat

SEQ ID NO: 767665 - DNA, 15 bp, Homo sapiens
ccaggtatggctctg

SEQ ID NO: 767666 - DNA, 17 bp, Homo sapiens
ccaggtatggctctgca

SEQ ID NO: 767667 - DNA, 20 bp, Homo sapiens
ccaggtcaccatcctcagag

SEQ ID NO: 767668 - DNA, 20 bp, Homo sapiens
ccaggtcaccctttgctgtg

SEQ ID NO: 767669 - DNA, 13 bp, Homo sapiens
ccaggtcagccct

SEQ ID NO: 767670 - DNA, 17 bp, Homo sapiens
ccaggtcagccctgtgt

SEQ ID NO: 767671 - DNA, 22 bp, Homo sapiens
ccaggtcaggatgcacatttct

SEQ ID NO: 767672 - DNA, 23 bp, Homo sapiens
ccaggtcaggatgcacatttctg

SEQ ID NO: 767673 - DNA, 14 bp, Homo sapiens
ccaggtccagctct

SEQ ID NO: 767674 - DNA, 16 bp, Homo sapiens
ccaggtccagctctgg

SEQ ID NO: 767675 - DNA, 19 bp, Homo sapiens
ccaggtccagctctggagg

SEQ ID NO: 767676 - DNA, 15 bp, Homo sapiens
ccaggtcccccgact

SEQ ID NO: 767677 - DNA, 21 bp, Homo sapiens
ccaggtcccccgactgcctgt

SEQ ID NO: 767678 - DNA, 18 bp, Homo sapiens
ccaggtcttcctgctttc

SEQ ID NO: 767679 - DNA, 21 bp, Homo sapiens
ccaggtcttggagctgagcct

SEQ ID NO: 767680 - DNA, 22 bp, Homo sapiens
ccaggtcttggagctgagcctc

SEQ ID NO: 767681 - DNA, 21 bp, Homo sapiens
ccaggtgagtgtgagggcagc

SEQ ID NO: 767682 - DNA, 22 bp, Homo sapiens
ccaggtgagtgtgagggcagca

SEQ ID NO: 767683 - DNA, 16 bp, Homo sapiens
ccaggtgcagccccag

SEQ ID NO: 767684 - DNA, 13 bp, Homo sapiens
ccaggtgcatctg

SEQ ID NO: 767685 - DNA, 17 bp, Homo sapiens
ccaggtgcatctgcagg

SEQ ID NO: 767686 - DNA, 18 bp, Homo sapiens
ccaggtgcctttcaaatt

SEQ ID NO: 767687 - DNA, 21 bp, Homo sapiens
ccaggtgcctttcaaatttag

SEQ ID NO: 767688 - DNA, 15 bp, Homo sapiens
ccaggtgcggcctgg

SEQ ID NO: 767689 - DNA, 16 bp, Homo sapiens
ccaggtgcggcctggg

SEQ ID NO: 767690 - DNA, 17 bp, Homo sapiens
ccaggtgcggcctgggg

SEQ ID NO: 767691 - DNA, 21 bp, Homo sapiens
ccaggtgcgtgtgtctctgtc

SEQ ID NO: 767692 - DNA, 23 bp, Homo sapiens
ccaggtgcgtgtgtctctgtctc

SEQ ID NO: 767693 - DNA, 22 bp, Homo sapiens
ccaggtgctacacccttttcca

SEQ ID NO: 767694 - DNA, 20 bp, Homo sapiens
ccaggtggaaggcagacagc

SEQ ID NO: 767695 - DNA, 16 bp, Homo sapiens
ccaggtggctgaccca

SEQ ID NO: 767696 - DNA, 22 bp, Homo sapiens
ccaggtggctgacccagtccct

SEQ ID NO: 767697 - DNA, 16 bp, Homo sapiens
ccaggtgtgcacgtgg

SEQ ID NO: 767698 - DNA, 22 bp, Homo sapiens
ccaggtgtgtccacctgggcat

SEQ ID NO: 767699 - DNA, 18 bp, Homo sapiens
ccaggtgttgccatttct

SEQ ID NO: 767700 - DNA, 13 bp, Homo sapiens
ccaggttaaaatt

SEQ ID NO: 767701 - DNA, 21 bp, Homo sapiens
ccaggttaaaattttaatttc

SEQ ID NO: 767702 - DNA, 18 bp, Homo sapiens
ccaggttccacagaggac

SEQ ID NO: 767703 - DNA, 17 bp, Homo sapiens
ccaggttcccccagcaa

SEQ ID NO: 767704 - DNA, 17 bp, Homo sapiens
ccaggttcgagacccaa

SEQ ID NO: 767705 - DNA, 22 bp, Homo sapiens
ccaggttctccgttagctcctg

SEQ ID NO: 767706 - DNA, 19 bp, Homo sapiens
ccaggtttaagtagatttc

SEQ ID NO: 767707 - DNA, 16 bp, Homo sapiens
ccaggtttagacagta

SEQ ID NO: 767708 - DNA, 20 bp, Homo sapiens
ccagtaaatgggggtgcatt

SEQ ID NO: 767709 - DNA, 20 bp, Homo sapiens
ccagtaacgcgtcttcctga

SEQ ID NO: 767710 - DNA, 18 bp, Homo sapiens
ccagtaacgtgctgctca

SEQ ID NO: 767711 - DNA, 23 bp, Homo sapiens
ccagtaacgtgctgctcaaggac

SEQ ID NO: 767712 - DNA, 16 bp, Homo sapiens
ccagtaacttttttgt

SEQ ID NO: 767713 - DNA, 19 bp, Homo sapiens
ccagtacagtattctttta

SEQ ID NO: 767714 - DNA, 18 bp, Homo sapiens
ccagtacctagctggctc

SEQ ID NO: 767715 - DNA, 16 bp, Homo sapiens
ccagtacctttgtcac

SEQ ID NO: 767716 - DNA, 14 bp, Homo sapiens
ccagtacttgtcat

SEQ ID NO: 767717 - DNA, 22 bp, Homo sapiens
ccagtagaccttgttacttctg

SEQ ID NO: 767718 - DNA, 19 bp, Homo sapiens
ccagtagctgggattacag

SEQ ID NO: 767719 - DNA, 20 bp, Homo sapiens
ccagtaggggcttataataa

SEQ ID NO: 767720 - DNA, 22 bp, Homo sapiens
ccagtagttttgacacttccca

SEQ ID NO: 767721 - DNA, 13 bp, Homo sapiens
ccagtatcgctca

SEQ ID NO: 767722 - DNA, 18 bp, Homo sapiens
ccagtatctatatatgtg

SEQ ID NO: 767723 - DNA, 16 bp, Homo sapiens
ccagtattactgctgc

SEQ ID NO: 767724 - DNA, 18 bp, Homo sapiens
ccagtattactgctgctg

SEQ ID NO: 767725 - DNA, 22 bp, Homo sapiens
ccagtattatattatcatatct

SEQ ID NO: 767726 - DNA, 22 bp, Homo sapiens
ccagtattctaaagttttgcaa

SEQ ID NO: 767727 - DNA, 16 bp, Homo sapiens
ccagtattctcagagc

SEQ ID NO: 767728 - DNA, 12 bp, Homo sapiens
ccagtattcttg

SEQ ID NO: 767729 - DNA, 9 bp, Homo sapiens
ccagtattt

SEQ ID NO: 767730 - DNA, 17 bp, Homo sapiens
ccagtatttagaagcca

SEQ ID NO: 767731 - DNA, 18 bp, Homo sapiens
ccagtatttagaagccaa

SEQ ID NO: 767732 - DNA, 14 bp, Homo sapiens
ccagtattttaaaa

SEQ ID NO: 767733 - DNA, 14 bp, Homo sapiens
ccagtatttttaaa

SEQ ID NO: 767734 - DNA, 16 bp, Homo sapiens
ccagtcaaatctgggc

SEQ ID NO: 767735 - DNA, 15 bp, Homo sapiens
ccagtcacactcccc

SEQ ID NO: 767736 - DNA, 17 bp, Homo sapiens
ccagtcacattgccatc

SEQ ID NO: 767737 - DNA, 17 bp, Homo sapiens
ccagtcaccttctgggc

SEQ ID NO: 767738 - DNA, 18 bp, Homo sapiens
ccagtcaccttctgggca

SEQ ID NO: 767739 - DNA, 17 bp, Homo sapiens
ccagtcactgctgcaag

SEQ ID NO: 767740 - DNA, 13 bp, Homo sapiens
ccagtcagaaata

SEQ ID NO: 767741 - DNA, 19 bp, Homo sapiens
ccagtcaggtagttgcaat

SEQ ID NO: 767742 - DNA, 19 bp, Homo sapiens
ccagtcatcctgccctgca

SEQ ID NO: 767743 - DNA, 22 bp, Homo sapiens
ccagtcatcctgccctgcagca

SEQ ID NO: 767744 - DNA, 21 bp, Homo sapiens
ccagtcatctgtaagagcttg

SEQ ID NO: 767745 - DNA, 13 bp, Homo sapiens
ccagtcattgtac

SEQ ID NO: 767746 - DNA, 17 bp, Homo sapiens
ccagtccacctgaggaa

SEQ ID NO: 767747 - DNA, 19 bp, Homo sapiens
ccagtccactcctgacccc

SEQ ID NO: 767748 - DNA, 13 bp, Homo sapiens
ccagtccaggctg

SEQ ID NO: 767749 - DNA, 15 bp, Homo sapiens
ccagtccaggctgcc

SEQ ID NO: 767750 - DNA, 22 bp, Homo sapiens
ccagtcccacactgtggccagg

SEQ ID NO: 767751 - DNA, 15 bp, Homo sapiens
ccagtccccacccct

SEQ ID NO: 767752 - DNA, 14 bp, Homo sapiens
ccagtccccagccc

SEQ ID NO: 767753 - DNA, 18 bp, Homo sapiens
ccagtccccagccctggg

SEQ ID NO: 767754 - DNA, 19 bp, Homo sapiens
ccagtccccagccctgggc

SEQ ID NO: 767755 - DNA, 18 bp, Homo sapiens
ccagtccccctgccccag

SEQ ID NO: 767756 - DNA, 12 bp, Homo sapiens
ccagtccctggg

SEQ ID NO: 767757 - DNA, 14 bp, Homo sapiens
ccagtcctcactgt

SEQ ID NO: 767758 - DNA, 17 bp, Homo sapiens
ccagtcctcactgtcct

SEQ ID NO: 767759 - DNA, 13 bp, Homo sapiens
ccagtcctccact

SEQ ID NO: 767760 - DNA, 21 bp, Homo sapiens
ccagtcctccactcgacccag

SEQ ID NO: 767761 - DNA, 15 bp, Homo sapiens
ccagtcctgcctggc

SEQ ID NO: 767762 - DNA, 17 bp, Homo sapiens
ccagtcctgcctggcca

SEQ ID NO: 767763 - DNA, 12 bp, Homo sapiens
ccagtcctgcta

SEQ ID NO: 767764 - DNA, 15 bp, Homo sapiens
ccagtcctgggttgt

SEQ ID NO: 767765 - DNA, 23 bp, Homo sapiens
ccagtcctgggttgtttccagga

SEQ ID NO: 767766 - DNA, 20 bp, Homo sapiens
ccagtcctggtcctggctgc

SEQ ID NO: 767767 - DNA, 13 bp, Homo sapiens
ccagtccttccac

SEQ ID NO: 767768 - DNA, 22 bp, Homo sapiens
ccagtcgtgatgtggaggaaga

SEQ ID NO: 767769 - DNA, 19 bp, Homo sapiens
ccagtcgttatttctgttt

SEQ ID NO: 767770 - DNA, 21 bp, Homo sapiens
ccagtctatttccactgaaca

SEQ ID NO: 767771 - DNA, 22 bp, Homo sapiens
ccagtctatttccactgaacaa

SEQ ID NO: 767772 - DNA, 13 bp, Homo sapiens
ccagtctcagaga

SEQ ID NO: 767773 - DNA, 23 bp, Homo sapiens
ccagtctcagagaccagcactca

SEQ ID NO: 767774 - DNA, 14 bp, Homo sapiens
ccagtctccaggga

SEQ ID NO: 767775 - DNA, 12 bp, Homo sapiens
ccagtctcccag

SEQ ID NO: 767776 - DNA, 13 bp, Homo sapiens
ccagtctcctcac

SEQ ID NO: 767777 - DNA, 17 bp, Homo sapiens
ccagtctctcttaaagt

SEQ ID NO: 767778 - DNA, 23 bp, Homo sapiens
ccagtctgaagtgcctactgggg

SEQ ID NO: 767779 - DNA, 13 bp, Homo sapiens
ccagtctgaccct

SEQ ID NO: 767780 - DNA, 17 bp, Homo sapiens
ccagtctgctgccctcc

SEQ ID NO: 767781 - DNA, 20 bp, Homo sapiens
ccagtctggaaaacagaaac

SEQ ID NO: 767782 - DNA, 18 bp, Homo sapiens
ccagtctgtctactgtgg

SEQ ID NO: 767783 - DNA, 22 bp, Homo sapiens
ccagtcttcctgacactttaat

SEQ ID NO: 767784 - DNA, 17 bp, Homo sapiens
ccagtcttgcctaggcc

SEQ ID NO: 767785 - DNA, 12 bp, Homo sapiens
ccagtcttgtgt

SEQ ID NO: 767786 - DNA, 20 bp, Homo sapiens
ccagtctttaaaggcccagc

SEQ ID NO: 767787 - DNA, 21 bp, Homo sapiens
ccagtctttaaaggcccagcc

SEQ ID NO: 767788 - DNA, 16 bp, Homo sapiens
ccagtgaaccaaagag

SEQ ID NO: 767789 - DNA, 17 bp, Homo sapiens
ccagtgaactcctgcca

SEQ ID NO: 767790 - DNA, 23 bp, Homo sapiens
ccagtgaacttacacttggagcc

SEQ ID NO: 767791 - DNA, 20 bp, Homo sapiens
ccagtgaagtccttcagtga

SEQ ID NO: 767792 - DNA, 19 bp, Homo sapiens
ccagtgaatccctgggagc

SEQ ID NO: 767793 - DNA, 17 bp, Homo sapiens
ccagtgaatctgtttca

SEQ ID NO: 767794 - DNA, 14 bp, Homo sapiens
ccagtgacaacatc

SEQ ID NO: 767795 - DNA, 11 bp, Homo sapiens
ccagtgacact

SEQ ID NO: 767796 - DNA, 19 bp, Homo sapiens
ccagtgacacttcagagag

SEQ ID NO: 767797 - DNA, 24 bp, Homo sapiens
ccagtgacacttcagagagctggt

SEQ ID NO: 767798 - DNA, 14 bp, Homo sapiens
ccagtgacagctag

SEQ ID NO: 767799 - DNA, 18 bp, Homo sapiens
ccagtgacctgctgggta

SEQ ID NO: 767800 - DNA, 20 bp, Homo sapiens
ccagtgacttgttctgagta

SEQ ID NO: 767801 - DNA, 15 bp, Homo sapiens
ccagtgagaagctga

SEQ ID NO: 767802 - DNA, 21 bp, Homo sapiens
ccagtgagatgagggatgggc

SEQ ID NO: 767803 - DNA, 18 bp, Homo sapiens
ccagtgaggatgacagtg

SEQ ID NO: 767804 - DNA, 17 bp, Homo sapiens
ccagtgaggatgctgca

SEQ ID NO: 767805 - DNA, 14 bp, Homo sapiens
ccagtgagggctgg

SEQ ID NO: 767806 - DNA, 12 bp, Homo sapiens
ccagtgagtgta

SEQ ID NO: 767807 - DNA, 18 bp, Homo sapiens
ccagtgcaacagcactgg

SEQ ID NO: 767808 - DNA, 21 bp, Homo sapiens
ccagtgcacctccctccccag

SEQ ID NO: 767809 - DNA, 14 bp, Homo sapiens
ccagtgcactgaaa

SEQ ID NO: 767810 - DNA, 12 bp, Homo sapiens
ccagtgcagcca

SEQ ID NO: 767811 - DNA, 18 bp, Homo sapiens
ccagtgcagtttctaagc

SEQ ID NO: 767812 - DNA, 23 bp, Homo sapiens
ccagtgcagtttggtgtgtcctc

SEQ ID NO: 767813 - DNA, 13 bp, Homo sapiens
ccagtgccagctc

SEQ ID NO: 767814 - DNA, 16 bp, Homo sapiens
ccagtgccagctccag

SEQ ID NO: 767815 - DNA, 15 bp, Homo sapiens
ccagtgccagggtgg

SEQ ID NO: 767816 - DNA, 22 bp, Homo sapiens
ccagtgccagggtgggctgggg

SEQ ID NO: 767817 - DNA, 14 bp, Homo sapiens
ccagtgccattcca

SEQ ID NO: 767818 - DNA, 17 bp, Homo sapiens
ccagtgccgctcctgct

SEQ ID NO: 767819 - DNA, 18 bp, Homo sapiens
ccagtgccgctcctgctt

SEQ ID NO: 767820 - DNA, 16 bp, Homo sapiens
ccagtgcctgccactc

SEQ ID NO: 767821 - DNA, 23 bp, Homo sapiens
ccagtgcctgccactctctggga

SEQ ID NO: 767822 - DNA, 23 bp, Homo sapiens
ccagtgccttacctcctgcccag

SEQ ID NO: 767823 - DNA, 19 bp, Homo sapiens
ccagtgcgctcgttccggt

SEQ ID NO: 767824 - DNA, 18 bp, Homo sapiens
ccagtgcggacccttccc

SEQ ID NO: 767825 - DNA, 19 bp, Homo sapiens
ccagtgcggttcctcatct

SEQ ID NO: 767826 - DNA, 18 bp, Homo sapiens
ccagtgctcaccagccct

SEQ ID NO: 767827 - DNA, 15 bp, Homo sapiens
ccagtgctctgcctc

SEQ ID NO: 767828 - DNA, 16 bp, Homo sapiens
ccagtgctctgcctca

SEQ ID NO: 767829 - DNA, 18 bp, Homo sapiens
ccagtgctctgcctcaga

SEQ ID NO: 767830 - DNA, 13 bp, Homo sapiens
ccagtgctgccat

SEQ ID NO: 767831 - DNA, 21 bp, Homo sapiens
ccagtgctgccatgccactgc

SEQ ID NO: 767832 - DNA, 14 bp, Homo sapiens
ccagtgctgctgta

SEQ ID NO: 767833 - DNA, 13 bp, Homo sapiens
ccagtgctgcttc

SEQ ID NO: 767834 - DNA, 16 bp, Homo sapiens
ccagtgctgcttcttg

SEQ ID NO: 767835 - DNA, 23 bp, Homo sapiens
ccagtgctggaagggaggaaggc

SEQ ID NO: 767836 - DNA, 19 bp, Homo sapiens
ccagtgcttagcaaaaaat

SEQ ID NO: 767837 - DNA, 12 bp, Homo sapiens
ccagtgcttctc

SEQ ID NO: 767838 - DNA, 22 bp, Homo sapiens
ccagtgcttctccaacactgaa

SEQ ID NO: 767839 - DNA, 17 bp, Homo sapiens
ccagtggaagttcttca

SEQ ID NO: 767840 - DNA, 18 bp, Homo sapiens
ccagtggaattccaactt

SEQ ID NO: 767841 - DNA, 17 bp, Homo sapiens
atcagttcattagaaat

SEQ ID NO: 767842 - DNA, 21 bp, Homo sapiens
atcagttcattagaaatattt

SEQ ID NO: 767843 - DNA, 14 bp, Homo sapiens
atcagttcctttgt

SEQ ID NO: 767844 - DNA, 15 bp, Homo sapiens
atcagttgactttaa

SEQ ID NO: 767845 - DNA, 16 bp, Homo sapiens
atcagttgactttaag

SEQ ID NO: 767846 - DNA, 22 bp, Homo sapiens
atcagttgaggccaggagttta

SEQ ID NO: 767847 - DNA, 23 bp, Homo sapiens
atcagttggagtttgtgtctgtt

SEQ ID NO: 767848 - DNA, 16 bp, Homo sapiens
atcagtttcatgaaat

SEQ ID NO: 767849 - DNA, 24 bp, Homo sapiens
atcagttttggaatctaagctgtt

SEQ ID NO: 767850 - DNA, 13 bp, Homo sapiens
atcataaaataaa

SEQ ID NO: 767851 - DNA, 13 bp, Homo sapiens
atcataaagtcag

SEQ ID NO: 767852 - DNA, 22 bp, Homo sapiens
atcataagttatgcctctgaca

SEQ ID NO: 767853 - DNA, 12 bp, Homo sapiens
atcataattaca

SEQ ID NO: 767854 - DNA, 17 bp, Homo sapiens
atcatacagttttcatt

SEQ ID NO: 767855 - DNA, 21 bp, Homo sapiens
atcatactgagacttgttctt

SEQ ID NO: 767856 - DNA, 19 bp, Homo sapiens
atcatacttaacatttcat

SEQ ID NO: 767857 - DNA, 18 bp, Homo sapiens
atcatagaaaattgaaac

SEQ ID NO: 767858 - DNA, 12 bp, Homo sapiens
atcatagaaatg

SEQ ID NO: 767859 - DNA, 23 bp, Homo sapiens
atcatagtgtacccatctttaat

SEQ ID NO: 767860 - DNA, 22 bp, Homo sapiens
atcatatatatagttatgcata

SEQ ID NO: 767861 - DNA, 18 bp, Homo sapiens
atcatatcaattggcagt

SEQ ID NO: 767862 - DNA, 16 bp, Homo sapiens
atcatatgattctgct

SEQ ID NO: 767863 - DNA, 16 bp, Homo sapiens
atcatatgtgtcttta

SEQ ID NO: 767864 - DNA, 19 bp, Homo sapiens
atcatatgtgtctttatag

SEQ ID NO: 767865 - DNA, 16 bp, Homo sapiens
atcatattgtatgtaa

SEQ ID NO: 767866 - DNA, 20 bp, Homo sapiens
atcatattttgttgtgcact

SEQ ID NO: 767867 - DNA, 16 bp, Homo sapiens
atcatcaagaagggct

SEQ ID NO: 767868 - DNA, 20 bp, Homo sapiens
atcatcaagaagggctgcat

SEQ ID NO: 767869 - DNA, 21 bp, Homo sapiens
atcatcaagaagggctgcatg

SEQ ID NO: 767870 - DNA, 22 bp, Homo sapiens
atcatcaagaagggctgcatga

SEQ ID NO: 767871 - DNA, 18 bp, Homo sapiens
atcatcaagtaatacaaa

SEQ ID NO: 767872 - DNA, 21 bp, Homo sapiens
atcatcacgtatgttatacaa

SEQ ID NO: 767873 - DNA, 13 bp, Homo sapiens
atcatcactgtaa

SEQ ID NO: 767874 - DNA, 15 bp, Homo sapiens
atcatcactgtaaag

SEQ ID NO: 767875 - DNA, 19 bp, Homo sapiens
atcatcactgtaaagacaa

SEQ ID NO: 767876 - DNA, 13 bp, Homo sapiens
atcatcagggcct

SEQ ID NO: 767877 - DNA, 14 bp, Homo sapiens
atcatcagtgcctc

SEQ ID NO: 767878 - DNA, 20 bp, Homo sapiens
atcatccacccgctgcccct

SEQ ID NO: 767879 - DNA, 14 bp, Homo sapiens
atcatcccagctgc

SEQ ID NO: 767880 - DNA, 12 bp, Homo sapiens
atcatccctttc

SEQ ID NO: 767881 - DNA, 13 bp, Homo sapiens
atcatcctcatgt

SEQ ID NO: 767882 - DNA, 17 bp, Homo sapiens
atcatcctgttttctct

SEQ ID NO: 767883 - DNA, 13 bp, Homo sapiens
atcatcgccagag

SEQ ID NO: 767884 - DNA, 16 bp, Homo sapiens
atcatcgccagaggtg

SEQ ID NO: 767885 - DNA, 16 bp, Homo sapiens
atcatctataaagaag

SEQ ID NO: 767886 - DNA, 20 bp, Homo sapiens
atcatgaaaagaggaacagg

SEQ ID NO: 767887 - DNA, 13 bp, Homo sapiens
atcatgaaacact

SEQ ID NO: 767888 - DNA, 14 bp, Homo sapiens
atcatgaaatatgc

SEQ ID NO: 767889 - DNA, 19 bp, Homo sapiens
atcatgaacagctctgaga

SEQ ID NO: 767890 - DNA, 16 bp, Homo sapiens
atcatgaagccttgct

SEQ ID NO: 767891 - DNA, 16 bp, Homo sapiens
atcatgaatgctttta

SEQ ID NO: 767892 - DNA, 19 bp, Homo sapiens
atcatgaattcccttttaa

SEQ ID NO: 767893 - DNA, 17 bp, Homo sapiens
atcatgaattttaaagt

SEQ ID NO: 767894 - DNA, 13 bp, Homo sapiens
atcatgacatgtt

SEQ ID NO: 767895 - DNA, 18 bp, Homo sapiens
atcatgacttctttacta

SEQ ID NO: 767896 - DNA, 16 bp, Homo sapiens
atcatgatagacttgt

SEQ ID NO: 767897 - DNA, 17 bp, Homo sapiens
atcatgatggaaaaaat

SEQ ID NO: 767898 - DNA, 19 bp, Homo sapiens
atcatgcacacaattagat

SEQ ID NO: 767899 - DNA, 14 bp, Homo sapiens
atcatgcatagagt

SEQ ID NO: 767900 - DNA, 15 bp, Homo sapiens
atcatgcatagagtg

SEQ ID NO: 767901 - DNA, 13 bp, Homo sapiens
atcatgcattgtt

SEQ ID NO: 767902 - DNA, 17 bp, Homo sapiens
atcatgccttgataaat

SEQ ID NO: 767903 - DNA, 19 bp, Homo sapiens
atcatgccttgataaatat

SEQ ID NO: 767904 - DNA, 24 bp, Homo sapiens
atcatgccttgataaatatatatg

SEQ ID NO: 767905 - DNA, 21 bp, Homo sapiens
atcatgcggtgggtgctgcca

SEQ ID NO: 767906 - DNA, 19 bp, Homo sapiens
atcatgcgttttatatctt

SEQ ID NO: 767907 - DNA, 17 bp, Homo sapiens
atcatgctcatgtatat

SEQ ID NO: 767908 - DNA, 19 bp, Homo sapiens
atcatgctggaacctgcaa

SEQ ID NO: 767909 - DNA, 23 bp, Homo sapiens
atcatgcttatgttaaactctgt

SEQ ID NO: 767910 - DNA, 18 bp, Homo sapiens
atcatggaatatttatag

SEQ ID NO: 767911 - DNA, 22 bp, Homo sapiens
atcatggaccaaatgtgccata

SEQ ID NO: 767912 - DNA, 12 bp, Homo sapiens
atcatggagtga

SEQ ID NO: 767913 - DNA, 20 bp, Homo sapiens
atcatggctcactgcagcct

SEQ ID NO: 767914 - DNA, 22 bp, Homo sapiens
atcatgggaaaagaccagggct

SEQ ID NO: 767915 - DNA, 14 bp, Homo sapiens
atcatgggccagag

SEQ ID NO: 767916 - DNA, 22 bp, Homo sapiens
atcatggtagagaatctctccc

SEQ ID NO: 767917 - DNA, 18 bp, Homo sapiens
atcatggtatttgaccat

SEQ ID NO: 767918 - DNA, 18 bp, Homo sapiens
atcatggtcaagttccca

SEQ ID NO: 767919 - DNA, 18 bp, Homo sapiens
atcatgtactttttagta

SEQ ID NO: 767920 - DNA, 18 bp, Homo sapiens
atcatgtcaggcctgtgt

SEQ ID NO: 767921 - DNA, 16 bp, Homo sapiens
atcatgtccatacact

SEQ ID NO: 767922 - DNA, 21 bp, Homo sapiens
atcatgtcgtaggtaaactaa

SEQ ID NO: 767923 - DNA, 16 bp, Homo sapiens
atcatgtctattgtcc

SEQ ID NO: 767924 - DNA, 12 bp, Homo sapiens
atcatgtctgta

SEQ ID NO: 767925 - DNA, 15 bp, Homo sapiens
atcatgtctgtatac

SEQ ID NO: 767926 - DNA, 22 bp, Homo sapiens
atcatgtctgtatactcctgtc

SEQ ID NO: 767927 - DNA, 23 bp, Homo sapiens
atcatgtctgtatactcctgtca

SEQ ID NO: 767928 - DNA, 16 bp, Homo sapiens
atcatgtcttgtgcat

SEQ ID NO: 767929 - DNA, 17 bp, Homo sapiens
atcatgtcttgtgcata

SEQ ID NO: 767930 - DNA, 22 bp, Homo sapiens
atcatgtgctcagaagaggaaa

SEQ ID NO: 767931 - DNA, 22 bp, Homo sapiens
atcatgtggcccaactctcctg

SEQ ID NO: 767932 - DNA, 17 bp, Homo sapiens
atcatgttaaattagaa

SEQ ID NO: 767933 - DNA, 19 bp, Homo sapiens
atcatgttaatagacagta

SEQ ID NO: 767934 - DNA, 14 bp, Homo sapiens
atcatgttatttta

SEQ ID NO: 767935 - DNA, 14 bp, Homo sapiens
atcatgttgttgtg

SEQ ID NO: 767936 - DNA, 17 bp, Homo sapiens
atcatgtttatgagaaa

SEQ ID NO: 767937 - DNA, 16 bp, Homo sapiens
atcatgtttctgagac

SEQ ID NO: 767938 - DNA, 18 bp, Homo sapiens
atcatgtttctgagacca

SEQ ID NO: 767939 - DNA, 14 bp, Homo sapiens
atcattaaaaatta

SEQ ID NO: 767940 - DNA, 12 bp, Homo sapiens
atcattaaaata

SEQ ID NO: 767941 - DNA, 15 bp, Homo sapiens
atcattaaaatatat

SEQ ID NO: 767942 - DNA, 16 bp, Homo sapiens
atcattaaaatatatg

SEQ ID NO: 767943 - DNA, 17 bp, Homo sapiens
atcattaaaatatatgt

SEQ ID NO: 767944 - DNA, 23 bp, Homo sapiens
atcattaaaatatatgttctgca

SEQ ID NO: 767945 - DNA, 13 bp, Homo sapiens
atcattaaacaaa

SEQ ID NO: 767946 - DNA, 20 bp, Homo sapiens
atcattacccttccctgcac

SEQ ID NO: 767947 - DNA, 22 bp, Homo sapiens
atcattagagcttaaattgtca

SEQ ID NO: 767948 - DNA, 14 bp, Homo sapiens
atcattagttttag

SEQ ID NO: 767949 - DNA, 23 bp, Homo sapiens
atcattataaacgtgatgatcag

SEQ ID NO: 767950 - DNA, 15 bp, Homo sapiens
atcattcatttttgt

SEQ ID NO: 767951 - DNA, 11 bp, Homo sapiens
atcattccagt

SEQ ID NO: 767952 - DNA, 13 bp, Homo sapiens
atcattccctctc

SEQ ID NO: 767953 - DNA, 14 bp, Homo sapiens
atcattcctttcca

SEQ ID NO: 767954 - DNA, 15 bp, Homo sapiens
atcattctacagaat

SEQ ID NO: 767955 - DNA, 15 bp, Homo sapiens
atcattgaagtatat

SEQ ID NO: 767956 - DNA, 18 bp, Homo sapiens
atcattgattgtcagcta

SEQ ID NO: 767957 - DNA, 22 bp, Homo sapiens
atcattgtacatagcatgttta

SEQ ID NO: 767958 - DNA, 22 bp, Homo sapiens
atcatttattttttacattatt

SEQ ID NO: 767959 - DNA, 13 bp, Homo sapiens
atcatttcagcca

SEQ ID NO: 767960 - DNA, 17 bp, Homo sapiens
atcatttctgccatgat

SEQ ID NO: 767961 - DNA, 22 bp, Homo sapiens
atcatttctgccatgatgttta

SEQ ID NO: 767962 - DNA, 18 bp, Homo sapiens
atcatttcttgggccctc

SEQ ID NO: 767963 - DNA, 15 bp, Homo sapiens
atcatttgcccttaa

SEQ ID NO: 767964 - DNA, 13 bp, Homo sapiens
atcatttgctttt

SEQ ID NO: 767965 - DNA, 18 bp, Homo sapiens
atcatttggcttgctgtt

SEQ ID NO: 767966 - DNA, 18 bp, Homo sapiens
ccagtggacctagcctgg

SEQ ID NO: 767967 - DNA, 14 bp, Homo sapiens
ccagtggagctggt

SEQ ID NO: 767968 - DNA, 16 bp, Homo sapiens
ccagtggaggtttgtc

SEQ ID NO: 767969 - DNA, 18 bp, Homo sapiens
ccagtggattcccacagc

SEQ ID NO: 767970 - DNA, 12 bp, Homo sapiens
ccagtggcacag

SEQ ID NO: 767971 - DNA, 22 bp, Homo sapiens
ccagtggcactgaagtggccct

SEQ ID NO: 767972 - DNA, 19 bp, Homo sapiens
ccagtggcccccgggcctg

SEQ ID NO: 767973 - DNA, 13 bp, Homo sapiens
ccagtggcctttc

SEQ ID NO: 767974 - DNA, 22 bp, Homo sapiens
ccagtggcgggtgatggccagc

SEQ ID NO: 767975 - DNA, 20 bp, Homo sapiens
ccagtggcgttgttgcatgt

SEQ ID NO: 767976 - DNA, 18 bp, Homo sapiens
ccagtgggaactgtgcaa

SEQ ID NO: 767977 - DNA, 12 bp, Homo sapiens
ccagtgggaggg

SEQ ID NO: 767978 - DNA, 13 bp, Homo sapiens
ccagtgggagggg

SEQ ID NO: 767979 - DNA, 17 bp, Homo sapiens
ccagtgggatgggctct

SEQ ID NO: 767980 - DNA, 21 bp, Homo sapiens
ccagtgggatgggctctacct

SEQ ID NO: 767981 - DNA, 18 bp, Homo sapiens
ccagtgggccagccacag

SEQ ID NO: 767982 - DNA, 19 bp, Homo sapiens
ccagtgggccagccacaga

SEQ ID NO: 767983 - DNA, 17 bp, Homo sapiens
ccagtgggctgcacgct

SEQ ID NO: 767984 - DNA, 22 bp, Homo sapiens
ccagtgggctgtgttgactgct

SEQ ID NO: 767985 - DNA, 15 bp, Homo sapiens
ccagtggggacaggg

SEQ ID NO: 767986 - DNA, 17 bp, Homo sapiens
ccagtggggacagggag

SEQ ID NO: 767987 - DNA, 23 bp, Homo sapiens
ccagtggggacagggagggggac

SEQ ID NO: 767988 - DNA, 13 bp, Homo sapiens
ccagtggggcctg

SEQ ID NO: 767989 - DNA, 17 bp, Homo sapiens
ccagtggggcctgtgga

SEQ ID NO: 767990 - DNA, 18 bp, Homo sapiens
ccagtggggcctgtggaa

SEQ ID NO: 767991 - DNA, 22 bp, Homo sapiens
ccagtgggtgatgcttttgctg

SEQ ID NO: 767992 - DNA, 14 bp, Homo sapiens
ccagtggttgctgt

SEQ ID NO: 767993 - DNA, 19 bp, Homo sapiens
ccagtgtcaagttgtgctt

SEQ ID NO: 767994 - DNA, 14 bp, Homo sapiens
ccagtgtcccctcc

SEQ ID NO: 767995 - DNA, 16 bp, Homo sapiens
ccagtgtccttagaac

SEQ ID NO: 767996 - DNA, 15 bp, Homo sapiens
ccagtgtgatcccaa

SEQ ID NO: 767997 - DNA, 21 bp, Homo sapiens
ccagtgtgcccaaaagccatg

SEQ ID NO: 767998 - DNA, 22 bp, Homo sapiens
ccagtgtgggaatgcggcaaga

SEQ ID NO: 767999 - DNA, 13 bp, Homo sapiens
ccagtgtgggctt

SEQ ID NO: 768000 - DNA, 20 bp, Homo sapiens
ccagtgttagggaagggcct

SEQ ID NO: 768001 - DNA, 20 bp, Homo sapiens
ccagtgttcctgaagctgct

SEQ ID NO: 768002 - DNA, 16 bp, Homo sapiens
ccagtgttgcctcctc

SEQ ID NO: 768003 - DNA, 22 bp, Homo sapiens
ccagtgttgtggatttaacaga

SEQ ID NO: 768004 - DNA, 21 bp, Homo sapiens
ccagtgttgtgggcttcctgc

SEQ ID NO: 768005 - DNA, 11 bp, Homo sapiens
ccagtgttttc

SEQ ID NO: 768006 - DNA, 17 bp, Homo sapiens
ccagttaaaaaaaattt

SEQ ID NO: 768007 - DNA, 13 bp, Homo sapiens
ccagttaaagatt

SEQ ID NO: 768008 - DNA, 14 bp, Homo sapiens
ccagttaaagatta

SEQ ID NO: 768009 - DNA, 15 bp, Homo sapiens
ccagttaaggaaaga

SEQ ID NO: 768010 - DNA, 16 bp, Homo sapiens
ccagttaatttttcca

SEQ ID NO: 768011 - DNA, 18 bp, Homo sapiens
ccagttacccaaaatctg

SEQ ID NO: 768012 - DNA, 14 bp, Homo sapiens
ccagttcaggagtc

SEQ ID NO: 768013 - DNA, 18 bp, Homo sapiens
ccagttcaggagtcccaa

SEQ ID NO: 768014 - DNA, 22 bp, Homo sapiens
ccagttcctaccgtactccctg

SEQ ID NO: 768015 - DNA, 17 bp, Homo sapiens
ccagttcctatgacaca

SEQ ID NO: 768016 - DNA, 18 bp, Homo sapiens
ccagttcctatgacacag

SEQ ID NO: 768017 - DNA, 19 bp, Homo sapiens
ccagttcctgctctctgct

SEQ ID NO: 768018 - DNA, 20 bp, Homo sapiens
ccagttcctgctctctgctc

SEQ ID NO: 768019 - DNA, 21 bp, Homo sapiens
ccagttcctgtaacaggtgtg

SEQ ID NO: 768020 - DNA, 22 bp, Homo sapiens
ccagttctcgttttgggccaga

SEQ ID NO: 768021 - DNA, 15 bp, Homo sapiens
ccagttgccatctgc

SEQ ID NO: 768022 - DNA, 15 bp, Homo sapiens
ccagttgctgtggac

SEQ ID NO: 768023 - DNA, 18 bp, Homo sapiens
ccagttgctgtggaccaa

SEQ ID NO: 768024 - DNA, 12 bp, Homo sapiens
ccagttgggact

SEQ ID NO: 768025 - DNA, 18 bp, Homo sapiens
ccagttgggagcactgga

SEQ ID NO: 768026 - DNA, 19 bp, Homo sapiens
ccagttgggagcactggag

SEQ ID NO: 768027 - DNA, 21 bp, Homo sapiens
ccagttgggctcgcactgccc

SEQ ID NO: 768028 - DNA, 12 bp, Homo sapiens
ccagtttcccac

SEQ ID NO: 768029 - DNA, 13 bp, Homo sapiens
ccagtttcccacc

SEQ ID NO: 768030 - DNA, 14 bp, Homo sapiens
ccagtttcccacca

SEQ ID NO: 768031 - DNA, 11 bp, Homo sapiens
ccagtttctcc

SEQ ID NO: 768032 - DNA, 14 bp, Homo sapiens
ccagtttgcagaaa

SEQ ID NO: 768033 - DNA, 15 bp, Homo sapiens
ccagtttgcatttgg

SEQ ID NO: 768034 - DNA, 14 bp, Homo sapiens
ccagtttggggtgc

SEQ ID NO: 768035 - DNA, 22 bp, Homo sapiens
ccagtttgggtaaaatactttt

SEQ ID NO: 768036 - DNA, 14 bp, Homo sapiens
ccagttttcatttt

SEQ ID NO: 768037 - DNA, 19 bp, Homo sapiens
ccagtttttaaaatgctgc

SEQ ID NO: 768038 - DNA, 21 bp, Homo sapiens
ccagtttttgtttttgcatga

SEQ ID NO: 768039 - DNA, 19 bp, Homo sapiens
ccataaaacattaagaaaa

SEQ ID NO: 768040 - DNA, 20 bp, Homo sapiens
ccataaaacattaagaaaat

SEQ ID NO: 768041 - DNA, 14 bp, Homo sapiens
ccataaagataatg

SEQ ID NO: 768042 - DNA, 17 bp, Homo sapiens
ccataaagtctgagaaa

SEQ ID NO: 768043 - DNA, 18 bp, Homo sapiens
ccataaagtctgagaaat

SEQ ID NO: 768044 - DNA, 12 bp, Homo sapiens
ccataaatcaat

SEQ ID NO: 768045 - DNA, 13 bp, Homo sapiens
ccataacacttga

SEQ ID NO: 768046 - DNA, 18 bp, Homo sapiens
ccataacgtgcccccaga

SEQ ID NO: 768047 - DNA, 13 bp, Homo sapiens
ccataactgaaca

SEQ ID NO: 768048 - DNA, 12 bp, Homo sapiens
ccataacttgaa

SEQ ID NO: 768049 - DNA, 17 bp, Homo sapiens
ccataagggggtgggaa

SEQ ID NO: 768050 - DNA, 20 bp, Homo sapiens
ccataaggtttcgtttctgt

SEQ ID NO: 768051 - DNA, 22 bp, Homo sapiens
ccataaggtttcgtttctgtat

SEQ ID NO: 768052 - DNA, 20 bp, Homo sapiens
ccataagtaagaaatttcta

SEQ ID NO: 768053 - DNA, 21 bp, Homo sapiens
ccataagtttaactgtatttt

SEQ ID NO: 768054 - DNA, 19 bp, Homo sapiens
ccataataaccctgccagt

SEQ ID NO: 768055 - DNA, 23 bp, Homo sapiens
ccataatgctaatttaaagagac

SEQ ID NO: 768056 - DNA, 13 bp, Homo sapiens
ccataatgtcttt

SEQ ID NO: 768057 - DNA, 20 bp, Homo sapiens
ccataattatgaaaactcat

SEQ ID NO: 768058 - DNA, 20 bp, Homo sapiens
ccataattatgacagttata

SEQ ID NO: 768059 - DNA, 23 bp, Homo sapiens
ccataattttcttcatgcaatga

SEQ ID NO: 768060 - DNA, 20 bp, Homo sapiens
ccataattttgcatactgaa

SEQ ID NO: 768061 - DNA, 16 bp, Homo sapiens
ccataattttttttaa

SEQ ID NO: 768062 - DNA, 13 bp, Homo sapiens
ccatacaatgtat

SEQ ID NO: 768063 - DNA, 14 bp, Homo sapiens
ccatacaatgtatg

SEQ ID NO: 768064 - DNA, 20 bp, Homo sapiens
ccatacaatgtatgtacaat

SEQ ID NO: 768065 - DNA, 15 bp, Homo sapiens
ccatacaatttcatc

SEQ ID NO: 768066 - DNA, 15 bp, Homo sapiens
ccatacacagaggag

SEQ ID NO: 768067 - DNA, 16 bp, Homo sapiens
ccatacacagaggagt

SEQ ID NO: 768068 - DNA, 13 bp, Homo sapiens
ccatacagcctct

SEQ ID NO: 768069 - DNA, 13 bp, Homo sapiens
ccatacagctcta

SEQ ID NO: 768070 - DNA, 19 bp, Homo sapiens
ccatacataaaagaaataa

SEQ ID NO: 768071 - DNA, 23 bp, Homo sapiens
ccatccggtggcctattccagga

SEQ ID NO: 768072 - DNA, 15 bp, Homo sapiens
ccatcctaccaatgc

SEQ ID NO: 768073 - DNA, 20 bp, Homo sapiens
ccatcctaccaatgcatgca

SEQ ID NO: 768074 - DNA, 12 bp, Homo sapiens
ccatcctaccca

SEQ ID NO: 768075 - DNA, 18 bp, Homo sapiens
ccatcctacccagcgtgg

SEQ ID NO: 768076 - DNA, 20 bp, Homo sapiens
ccatcctacccagcgtggcc

SEQ ID NO: 768077 - DNA, 22 bp, Homo sapiens
ccatcctcaaacgacagaggag

SEQ ID NO: 768078 - DNA, 21 bp, Homo sapiens
ccatcctcagaggctgagccc

SEQ ID NO: 768079 - DNA, 16 bp, Homo sapiens
ccatcctcatccctga

SEQ ID NO: 768080 - DNA, 16 bp, Homo sapiens
ccatcctccagcaggg

SEQ ID NO: 768081 - DNA, 17 bp, Homo sapiens
ccatcctccagcaggga

SEQ ID NO: 768082 - DNA, 18 bp, Homo sapiens
ccatcctccagccctgcc

SEQ ID NO: 768083 - DNA, 13 bp, Homo sapiens
ccatcctccagct

SEQ ID NO: 768084 - DNA, 14 bp, Homo sapiens
ccatcctcctggga

SEQ ID NO: 768085 - DNA, 13 bp, Homo sapiens
ccatcctgactga

SEQ ID NO: 768086 - DNA, 11 bp, Homo sapiens
ccatcctgatg

SEQ ID NO: 768087 - DNA, 18 bp, Homo sapiens
ccatcctgcaaaggccct

SEQ ID NO: 768088 - DNA, 15 bp, Homo sapiens
ccatcctgcagcctc

SEQ ID NO: 768089 - DNA, 18 bp, Homo sapiens
ccatcctgcagcctcctc

SEQ ID NO: 768090 - DNA, 22 bp, Homo sapiens
ccatcctgcagcctcctcctga

SEQ ID NO: 768091 - DNA, 11 bp, Homo sapiens
ccatcctgcca

SEQ ID NO: 768092 - DNA, 13 bp, Homo sapiens
ccatcctggcccc

SEQ ID NO: 768093 - DNA, 14 bp, Homo sapiens
ccatcctggcccct

SEQ ID NO: 768094 - DNA, 18 bp, Homo sapiens
ccatcctggcccctccag

SEQ ID NO: 768095 - DNA, 19 bp, Homo sapiens
ccatcctggcccctccaga

SEQ ID NO: 768096 - DNA, 14 bp, Homo sapiens
ccatcgcgccagcg

SEQ ID NO: 768097 - DNA, 18 bp, Homo sapiens
ccatcggccctgtcccct

SEQ ID NO: 768098 - DNA, 19 bp, Homo sapiens
atccatgttagtttttact

SEQ ID NO: 768099 - DNA, 16 bp, Homo sapiens
atccatgtttgtaaaa

SEQ ID NO: 768100 - DNA, 22 bp, Homo sapiens
atccattacgtgcatttaaact

SEQ ID NO: 768101 - DNA, 16 bp, Homo sapiens
atccattatcctttat

SEQ ID NO: 768102 - DNA, 21 bp, Homo sapiens
atccattatcctttattttat

SEQ ID NO: 768103 - DNA, 22 bp, Homo sapiens
atccattcacaagcctcctgta

SEQ ID NO: 768104 - DNA, 14 bp, Homo sapiens
atccattcctcagg

SEQ ID NO: 768105 - DNA, 14 bp, Homo sapiens
atccattggagaag

SEQ ID NO: 768106 - DNA, 21 bp, Homo sapiens
atccatttactgacacttcct

SEQ ID NO: 768107 - DNA, 22 bp, Homo sapiens
atccatttactgacacttcctg

SEQ ID NO: 768108 - DNA, 22 bp, Homo sapiens
atccatttcatctatttctgag

SEQ ID NO: 768109 - DNA, 18 bp, Homo sapiens
atccatttgaataaaatg

SEQ ID NO: 768110 - DNA, 18 bp, Homo sapiens
atcccaaaccattactga

SEQ ID NO: 768111 - DNA, 14 bp, Homo sapiens
atcccaaaggatga

SEQ ID NO: 768112 - DNA, 22 bp, Homo sapiens
atcccaaaggatgagaatgtga

SEQ ID NO: 768113 - DNA, 15 bp, Homo sapiens
atcccaaagttgttg

SEQ ID NO: 768114 - DNA, 15 bp, Homo sapiens
atcccaacagccatg

SEQ ID NO: 768115 - DNA, 15 bp, Homo sapiens
atcccaacattctgc

SEQ ID NO: 768116 - DNA, 17 bp, Homo sapiens
atcccaacattctgcaa

SEQ ID NO: 768117 - DNA, 14 bp, Homo sapiens
atcccaagaaatgg

SEQ ID NO: 768118 - DNA, 17 bp, Homo sapiens
atcccaagacccagggc

SEQ ID NO: 768119 - DNA, 17 bp, Homo sapiens
atcccaagctagtgagc

SEQ ID NO: 768120 - DNA, 15 bp, Homo sapiens
atcccaagtgccagt

SEQ ID NO: 768121 - DNA, 19 bp, Homo sapiens
atcccaatcaaagaattac

SEQ ID NO: 768122 - DNA, 21 bp, Homo sapiens
atcccaatcaaagaattacag

SEQ ID NO: 768123 - DNA, 22 bp, Homo sapiens
atcccaatcaaagaattacagt

SEQ ID NO: 768124 - DNA, 15 bp, Homo sapiens
atcccaatctttcta

SEQ ID NO: 768125 - DNA, 17 bp, Homo sapiens
atcccaatctttctata

SEQ ID NO: 768126 - DNA, 18 bp, Homo sapiens
atcccaatctttctatat

SEQ ID NO: 768127 - DNA, 16 bp, Homo sapiens
atcccaattctgtccc

SEQ ID NO: 768128 - DNA, 12 bp, Homo sapiens
atcccacacagg

SEQ ID NO: 768129 - DNA, 16 bp, Homo sapiens
atcccacatttccatg

SEQ ID NO: 768130 - DNA, 14 bp, Homo sapiens
atcccaccaaatca

SEQ ID NO: 768131 - DNA, 20 bp, Homo sapiens
atcccaccaaatcatcctga

SEQ ID NO: 768132 - DNA, 20 bp, Homo sapiens
atcccacccaacagctcaga

SEQ ID NO: 768133 - DNA, 19 bp, Homo sapiens
atcccaccccctcctcccc

SEQ ID NO: 768134 - DNA, 21 bp, Homo sapiens
atcccactggatctggcttac

SEQ ID NO: 768135 - DNA, 20 bp, Homo sapiens
atcccactgtatagatccac

SEQ ID NO: 768136 - DNA, 16 bp, Homo sapiens
atcccacttcctttcc

SEQ ID NO: 768137 - DNA, 18 bp, Homo sapiens
atcccacttcctttccta

SEQ ID NO: 768138 - DNA, 20 bp, Homo sapiens
atcccagaaagtatatactg

SEQ ID NO: 768139 - DNA, 17 bp, Homo sapiens
atcccagacccattcct

SEQ ID NO: 768140 - DNA, 15 bp, Homo sapiens
atcccagacccctct

SEQ ID NO: 768141 - DNA, 15 bp, Homo sapiens
atcccagagaacaat

SEQ ID NO: 768142 - DNA, 19 bp, Homo sapiens
atcccagagaacaatcact

SEQ ID NO: 768143 - DNA, 14 bp, Homo sapiens
atcccagcacctgc

SEQ ID NO: 768144 - DNA, 20 bp, Homo sapiens
atcccagcactttgggaggc

SEQ ID NO: 768145 - DNA, 22 bp, Homo sapiens
atcccagcactttgggaggctg

SEQ ID NO: 768146 - DNA, 14 bp, Homo sapiens
atcccagcagccca

SEQ ID NO: 768147 - DNA, 18 bp, Homo sapiens
atcccagcagcccaagct

SEQ ID NO: 768148 - DNA, 22 bp, Homo sapiens
atcccagccggccaatggaaac

SEQ ID NO: 768149 - DNA, 15 bp, Homo sapiens
atcccagcctgtggt

SEQ ID NO: 768150 - DNA, 18 bp, Homo sapiens
atcccagctacttgggaa

SEQ ID NO: 768151 - DNA, 22 bp, Homo sapiens
atcccagcttcggcatttgatc

SEQ ID NO: 768152 - DNA, 17 bp, Homo sapiens
atcccagcttgcccccg

SEQ ID NO: 768153 - DNA, 17 bp, Homo sapiens
atcccagggaaggactt

SEQ ID NO: 768154 - DNA, 16 bp, Homo sapiens
atcccagggtcccacc

SEQ ID NO: 768155 - DNA, 19 bp, Homo sapiens
atcccagggtcccaccccc

SEQ ID NO: 768156 - DNA, 21 bp, Homo sapiens
atcccaggtgcgtgtgtctct

SEQ ID NO: 768157 - DNA, 23 bp, Homo sapiens
atcccatctctacaaaaaatgca

SEQ ID NO: 768158 - DNA, 12 bp, Homo sapiens
atcccatctctc

SEQ ID NO: 768159 - DNA, 15 bp, Homo sapiens
atcccatctctccca

SEQ ID NO: 768160 - DNA, 16 bp, Homo sapiens
atcccattctttataa

SEQ ID NO: 768161 - DNA, 17 bp, Homo sapiens
atcccattgccctggtt

SEQ ID NO: 768162 - DNA, 14 bp, Homo sapiens
atcccatttaaaaa

SEQ ID NO: 768163 - DNA, 15 bp, Homo sapiens
atcccatttaaaaaa

SEQ ID NO: 768164 - DNA, 21 bp, Homo sapiens
atcccatttagtgtgaatatt

SEQ ID NO: 768165 - DNA, 15 bp, Homo sapiens
atcccatttcccaaa

SEQ ID NO: 768166 - DNA, 15 bp, Homo sapiens
atcccatttcttgaa

SEQ ID NO: 768167 - DNA, 16 bp, Homo sapiens
atcccatttcttgaaa

SEQ ID NO: 768168 - DNA, 16 bp, Homo sapiens
atcccattttcatcct

SEQ ID NO: 768169 - DNA, 17 bp, Homo sapiens
atcccattttcatcctg

SEQ ID NO: 768170 - DNA, 18 bp, Homo sapiens
atcccattttcatcctga

SEQ ID NO: 768171 - DNA, 22 bp, Homo sapiens
atcccattttcatcctgagccc

SEQ ID NO: 768172 - DNA, 23 bp, Homo sapiens
atccccaaaacaggccaggtgtg

SEQ ID NO: 768173 - DNA, 17 bp, Homo sapiens
atccccaaactccttta

SEQ ID NO: 768174 - DNA, 13 bp, Homo sapiens
atccccaactcca

SEQ ID NO: 768175 - DNA, 15 bp, Homo sapiens
atccccaagtgcctg

SEQ ID NO: 768176 - DNA, 16 bp, Homo sapiens
atccccaagtgtgaac

SEQ ID NO: 768177 - DNA, 19 bp, Homo sapiens
atccccacagctggctctg

SEQ ID NO: 768178 - DNA, 12 bp, Homo sapiens
atccccaccagc

SEQ ID NO: 768179 - DNA, 13 bp, Homo sapiens
atccccaccagct

SEQ ID NO: 768180 - DNA, 17 bp, Homo sapiens
atccccacgacccctgc

SEQ ID NO: 768181 - DNA, 21 bp, Homo sapiens
atccccactaggttcttttcc

SEQ ID NO: 768182 - DNA, 15 bp, Homo sapiens
atccccagagcccag

SEQ ID NO: 768183 - DNA, 17 bp, Homo sapiens
atccccagagcccagct

SEQ ID NO: 768184 - DNA, 23 bp, Homo sapiens
atccccagagcccagctcttgct

SEQ ID NO: 768185 - DNA, 16 bp, Homo sapiens
atccccagctttctcc

SEQ ID NO: 768186 - DNA, 19 bp, Homo sapiens
atccccaggtccccaaact

SEQ ID NO: 768187 - DNA, 17 bp, Homo sapiens
atccccatcctccagct

SEQ ID NO: 768188 - DNA, 20 bp, Homo sapiens
atccccatcctccagcttct

SEQ ID NO: 768189 - DNA, 19 bp, Homo sapiens
atccccatctccctgcctg

SEQ ID NO: 768190 - DNA, 20 bp, Homo sapiens
atccccatctccctgcctgg

SEQ ID NO: 768191 - DNA, 12 bp, Homo sapiens
atcccccagcct

SEQ ID NO: 768192 - DNA, 11 bp, Homo sapiens
atcccccccag

SEQ ID NO: 768193 - DNA, 13 bp, Homo sapiens
ccatgagctgctc

SEQ ID NO: 768194 - DNA, 14 bp, Homo sapiens
ccatgagctgctca

SEQ ID NO: 768195 - DNA, 17 bp, Homo sapiens
ccatgaggaaggaacag

SEQ ID NO: 768196 - DNA, 17 bp, Homo sapiens
ccatgaggtactggtcc

SEQ ID NO: 768197 - DNA, 15 bp, Homo sapiens
ccatgaggtcttccc

SEQ ID NO: 768198 - DNA, 21 bp, Homo sapiens
ccatgagtattagcttaccca

SEQ ID NO: 768199 - DNA, 19 bp, Homo sapiens
ccatgagttccagaaagta

SEQ ID NO: 768200 - DNA, 23 bp, Homo sapiens
ccatgagttggggtctggcagcc

SEQ ID NO: 768201 - DNA, 12 bp, Homo sapiens
ccatgatctgta

SEQ ID NO: 768202 - DNA, 19 bp, Homo sapiens
ccatgatctgtatttaatg

SEQ ID NO: 768203 - DNA, 13 bp, Homo sapiens
ccatgatgtatat

SEQ ID NO: 768204 - DNA, 23 bp, Homo sapiens
ccatgattctatttatatgtaca

SEQ ID NO: 768205 - DNA, 22 bp, Homo sapiens
ccatgatttttggtatttatgt

SEQ ID NO: 768206 - DNA, 13 bp, Homo sapiens
ccatgcaaaccat

SEQ ID NO: 768207 - DNA, 21 bp, Homo sapiens
ccatgcaccaggactggctgt

SEQ ID NO: 768208 - DNA, 21 bp, Homo sapiens
ccatgcactatatttgtatat

SEQ ID NO: 768209 - DNA, 15 bp, Homo sapiens
ccatgcagaacacca

SEQ ID NO: 768210 - DNA, 19 bp, Homo sapiens
ccatgcagcccctgggccc

SEQ ID NO: 768211 - DNA, 19 bp, Homo sapiens
ccatgcagccttggggcat

SEQ ID NO: 768212 - DNA, 17 bp, Homo sapiens
ccatgcaggccctttga

SEQ ID NO: 768213 - DNA, 20 bp, Homo sapiens
ccatgccaaagctagggtgg

SEQ ID NO: 768214 - DNA, 21 bp, Homo sapiens
ccatgccacgttccacagttg

SEQ ID NO: 768215 - DNA, 13 bp, Homo sapiens
ccatgccagagag

SEQ ID NO: 768216 - DNA, 22 bp, Homo sapiens
ccatgccagattctgcctctct

SEQ ID NO: 768217 - DNA, 12 bp, Homo sapiens
ccatgccagctg

SEQ ID NO: 768218 - DNA, 14 bp, Homo sapiens
ccatgccaggaacc

SEQ ID NO: 768219 - DNA, 15 bp, Homo sapiens
ccatgcccacctgcc

SEQ ID NO: 768220 - DNA, 14 bp, Homo sapiens
ccatgccccacccc

SEQ ID NO: 768221 - DNA, 21 bp, Homo sapiens
ccatgccccacccccctcctc

SEQ ID NO: 768222 - DNA, 23 bp, Homo sapiens
ccatgccccacccccctcctccc

SEQ ID NO: 768223 - DNA, 18 bp, Homo sapiens
ccatgccccagctctgga

SEQ ID NO: 768224 - DNA, 20 bp, Homo sapiens
ccatgcccccttcgctcctc

SEQ ID NO: 768225 - DNA, 14 bp, Homo sapiens
atcccgaaaatctc

SEQ ID NO: 768226 - DNA, 17 bp, Homo sapiens
atcccgagcacctccac

SEQ ID NO: 768227 - DNA, 13 bp, Homo sapiens
atcccgagtctgg

SEQ ID NO: 768228 - DNA, 15 bp, Homo sapiens
atcccgagtctggga

SEQ ID NO: 768229 - DNA, 22 bp, Homo sapiens
atcccgcctcttcttcttcaga

SEQ ID NO: 768230 - DNA, 18 bp, Homo sapiens
atcccgcttagcctgcct

SEQ ID NO: 768231 - DNA, 19 bp, Homo sapiens
atcccgcttagcctgcctc

SEQ ID NO: 768232 - DNA, 22 bp, Homo sapiens
atcccgcttagcctgcctcacc

SEQ ID NO: 768233 - DNA, 13 bp, Homo sapiens
atccctacatgta

SEQ ID NO: 768234 - DNA, 19 bp, Homo sapiens
atccctagaagagcacaga

SEQ ID NO: 768235 - DNA, 22 bp, Homo sapiens
atccctagaagagcacagagcc

SEQ ID NO: 768236 - DNA, 21 bp, Homo sapiens
atccctagtccccctgttttc

SEQ ID NO: 768237 - DNA, 17 bp, Homo sapiens
atccctcccccagcaga

SEQ ID NO: 768238 - DNA, 15 bp, Homo sapiens
atccctccttaagag

SEQ ID NO: 768239 - DNA, 17 bp, Homo sapiens
atccctcgatattttta

SEQ ID NO: 768240 - DNA, 19 bp, Homo sapiens
atccctcggaagccgtctg

SEQ ID NO: 768241 - DNA, 20 bp, Homo sapiens
atccctctacagagcttccc

SEQ ID NO: 768242 - DNA, 21 bp, Homo sapiens
atccctctacagagcttccct

SEQ ID NO: 768243 - DNA, 23 bp, Homo sapiens
atccctctacagagcttccctga

SEQ ID NO: 768244 - DNA, 13 bp, Homo sapiens
atccctctccact

SEQ ID NO: 768245 - DNA, 24 bp, Homo sapiens
atccctctccactcttctctcctt

SEQ ID NO: 768246 - DNA, 14 bp, Homo sapiens
atccctctcctccc

SEQ ID NO: 768247 - DNA, 22 bp, Homo sapiens
atccctgaagacgagcatcccc

SEQ ID NO: 768248 - DNA, 18 bp, Homo sapiens
atccctgactggccaaac

SEQ ID NO: 768249 - DNA, 15 bp, Homo sapiens
atccctgccactggg

SEQ ID NO: 768250 - DNA, 13 bp, Homo sapiens
atccctgcccagc

SEQ ID NO: 768251 - DNA, 19 bp, Homo sapiens
atccctgcggcctccacac

SEQ ID NO: 768252 - DNA, 18 bp, Homo sapiens
atccctgcttgcccgctc

SEQ ID NO: 768253 - DNA, 23 bp, Homo sapiens
atccctgcttgcccgctcccaca

SEQ ID NO: 768254 - DNA, 11 bp, Homo sapiens
atccctgggcc

SEQ ID NO: 768255 - DNA, 19 bp, Homo sapiens
atccctgggggccttgggt

SEQ ID NO: 768256 - DNA, 21 bp, Homo sapiens
atccctggtcgtctatcccag

SEQ ID NO: 768257 - DNA, 15 bp, Homo sapiens
atccctgtaaattgc

SEQ ID NO: 768258 - DNA, 15 bp, Homo sapiens
atccctgtactctga

SEQ ID NO: 768259 - DNA, 18 bp, Homo sapiens
atccctgtgttgtctcta

SEQ ID NO: 768260 - DNA, 18 bp, Homo sapiens
atccctgttacccagaga

SEQ ID NO: 768261 - DNA, 12 bp, Homo sapiens
atccctgttcat

SEQ ID NO: 768262 - DNA, 14 bp, Homo sapiens
atccctgttcattg

SEQ ID NO: 768263 - DNA, 14 bp, Homo sapiens
atccctgtttaata

SEQ ID NO: 768264 - DNA, 20 bp, Homo sapiens
atccctgtttaatatttaaa

SEQ ID NO: 768265 - DNA, 23 bp, Homo sapiens
atccctgtttaatatttaaacag

SEQ ID NO: 768266 - DNA, 13 bp, Homo sapiens
atcccttaaaatt

SEQ ID NO: 768267 - DNA, 15 bp, Homo sapiens
atcccttaagaagtt

SEQ ID NO: 768268 - DNA, 17 bp, Homo sapiens
atcccttattagttaca

SEQ ID NO: 768269 - DNA, 19 bp, Homo sapiens
atcccttcccacatgcctg

SEQ ID NO: 768270 - DNA, 20 bp, Homo sapiens
atcccttcccacatgcctgc

SEQ ID NO: 768271 - DNA, 15 bp, Homo sapiens
atcccttcctggaaa

SEQ ID NO: 768272 - DNA, 17 bp, Homo sapiens
atcccttcctggaaaca

SEQ ID NO: 768273 - DNA, 22 bp, Homo sapiens
atcccttcctggaaacagcatg

SEQ ID NO: 768274 - DNA, 23 bp, Homo sapiens
atcccttcctggaaacagcatga

SEQ ID NO: 768275 - DNA, 19 bp, Homo sapiens
atcccttccttttagccta

SEQ ID NO: 768276 - DNA, 17 bp, Homo sapiens
atcccttcggagccaac

SEQ ID NO: 768277 - DNA, 15 bp, Homo sapiens
atcccttggggaagg

SEQ ID NO: 768278 - DNA, 17 bp, Homo sapiens
atccctttcctggtttc

SEQ ID NO: 768279 - DNA, 22 bp, Homo sapiens
atccctttgtctgtcaatcaca

SEQ ID NO: 768280 - DNA, 22 bp, Homo sapiens
atcccttttcctttctggcccc

SEQ ID NO: 768281 - DNA, 13 bp, Homo sapiens
atccgaagggaat

SEQ ID NO: 768282 - DNA, 15 bp, Homo sapiens
atccgactgcccctg

SEQ ID NO: 768283 - DNA, 18 bp, Homo sapiens
atccgagcgacggctcct

SEQ ID NO: 768284 - DNA, 12 bp, Homo sapiens
atccgaggcagg

SEQ ID NO: 768285 - DNA, 13 bp, Homo sapiens
atccgaggcaggg

SEQ ID NO: 768286 - DNA, 18 bp, Homo sapiens
atccgcctacctcagcct

SEQ ID NO: 768287 - DNA, 22 bp, Homo sapiens
atccgcctgtgggcgcatacta

SEQ ID NO: 768288 - DNA, 20 bp, Homo sapiens
atccgcggggaccctgccga

SEQ ID NO: 768289 - DNA, 12 bp, Homo sapiens
atccgctctctt

SEQ ID NO: 768290 - DNA, 14 bp, Homo sapiens
atccgctctcttcc

SEQ ID NO: 768291 - DNA, 12 bp, Homo sapiens
atccgctgccac

SEQ ID NO: 768292 - DNA, 13 bp, Homo sapiens
atccgctgccacc

SEQ ID NO: 768293 - DNA, 20 bp, Homo sapiens
atccgctgccagccttgagc

SEQ ID NO: 768294 - DNA, 16 bp, Homo sapiens
atccggctgctcctcc

SEQ ID NO: 768295 - DNA, 21 bp, Homo sapiens
atccggctgctcctccagccc

SEQ ID NO: 768296 - DNA, 17 bp, Homo sapiens
atccgtcattgctgctg

SEQ ID NO: 768297 - DNA, 13 bp, Homo sapiens
atccgtcctgggc

SEQ ID NO: 768298 - DNA, 15 bp, Homo sapiens
atccgtcctgggcgt

SEQ ID NO: 768299 - DNA, 22 bp, Homo sapiens
atccgtctgtctgtcgcccttc

SEQ ID NO: 768300 - DNA, 21 bp, Homo sapiens
atccgtctttggcctcctcca

SEQ ID NO: 768301 - DNA, 13 bp, Homo sapiens
atccgtgtatttg

SEQ ID NO: 768302 - DNA, 16 bp, Homo sapiens
atcctaaactttagac

SEQ ID NO: 768303 - DNA, 20 bp, Homo sapiens
atcctaagacacaaatgcat

SEQ ID NO: 768304 - DNA, 21 bp, Homo sapiens
atcctaatgacttctaaaaat

SEQ ID NO: 768305 - DNA, 16 bp, Homo sapiens
atcctaatttctcctc

SEQ ID NO: 768306 - DNA, 23 bp, Homo sapiens
atcctaatttctcctcccttcct

SEQ ID NO: 768307 - DNA, 17 bp, Homo sapiens
atcctacagtacaatca

SEQ ID NO: 768308 - DNA, 15 bp, Homo sapiens
atcctaccaatgcat

SEQ ID NO: 768309 - DNA, 16 bp, Homo sapiens
atcctaccaatgcatg

SEQ ID NO: 768310 - DNA, 22 bp, Homo sapiens
atcctaccccctcttcaaagca

SEQ ID NO: 768311 - DNA, 21 bp, Homo sapiens
atcctaccctcgggcccacct

SEQ ID NO: 768312 - DNA, 16 bp, Homo sapiens
atcctacctgttttgt

SEQ ID NO: 768313 - DNA, 20 bp, Homo sapiens
atcctagacttgaaagtttt

SEQ ID NO: 768314 - DNA, 18 bp, Homo sapiens
atccttcaaaataaaaag

SEQ ID NO: 768315 - DNA, 23 bp, Homo sapiens
atccttcaaagtctcaatgaaat

SEQ ID NO: 768316 - DNA, 20 bp, Homo sapiens
atccttcaagaactctgggc

SEQ ID NO: 768317 - DNA, 15 bp, Homo sapiens
atccttcagcacagg

SEQ ID NO: 768318 - DNA, 17 bp, Homo sapiens
atccttccagtggctcg

SEQ ID NO: 768319 - DNA, 14 bp, Homo sapiens
atccttccccaact

SEQ ID NO: 768320 - DNA, 19 bp, Homo sapiens
atccttccccaacttccct

SEQ ID NO: 768321 - DNA, 21 bp, Homo sapiens
atccttccccaacttccctag

SEQ ID NO: 768322 - DNA, 16 bp, Homo sapiens
atccttccctgctctt

SEQ ID NO: 768323 - DNA, 16 bp, Homo sapiens
atccttccctttggag

SEQ ID NO: 768324 - DNA, 17 bp, Homo sapiens
atccttccctttggaga

SEQ ID NO: 768325 - DNA, 20 bp, Homo sapiens
atccttcgtgaacatcccct

SEQ ID NO: 768326 - DNA, 13 bp, Homo sapiens
atccttctgagct

SEQ ID NO: 768327 - DNA, 14 bp, Homo sapiens
atccttctgagctc

SEQ ID NO: 768328 - DNA, 19 bp, Homo sapiens
atccttctgagctccacct

SEQ ID NO: 768329 - DNA, 20 bp, Homo sapiens
atccttctgagctccacctc

SEQ ID NO: 768330 - DNA, 22 bp, Homo sapiens
atccttgatgcaagtgcaacct

SEQ ID NO: 768331 - DNA, 18 bp, Homo sapiens
atccttgctgcagcttct

SEQ ID NO: 768332 - DNA, 13 bp, Homo sapiens
atccttggaaacc

SEQ ID NO: 768333 - DNA, 17 bp, Homo sapiens
atccttggagagcagct

SEQ ID NO: 768334 - DNA, 12 bp, Homo sapiens
atccttggctga

SEQ ID NO: 768335 - DNA, 19 bp, Homo sapiens
atccttggctttcagagcc

SEQ ID NO: 768336 - DNA, 17 bp, Homo sapiens
atccttgggggctccca

SEQ ID NO: 768337 - DNA, 22 bp, Homo sapiens
atccttgggggctcccagggca

SEQ ID NO: 768338 - DNA, 18 bp, Homo sapiens
atccttggtgctcttgct

SEQ ID NO: 768339 - DNA, 12 bp, Homo sapiens
atccttgtcttt

SEQ ID NO: 768340 - DNA, 23 bp, Homo sapiens
atccttgtctttactgacaagaa

SEQ ID NO: 768341 - DNA, 19 bp, Homo sapiens
atccttgtcttttgagcta

SEQ ID NO: 768342 - DNA, 19 bp, Homo sapiens
atccttgtgacttacaatt

SEQ ID NO: 768343 - DNA, 21 bp, Homo sapiens
atcctttagggttctgcctct

SEQ ID NO: 768344 - DNA, 21 bp, Homo sapiens
atcctttattttattgaaatg

SEQ ID NO: 768345 - DNA, 20 bp, Homo sapiens
atcctttcaaaagaagagtt

SEQ ID NO: 768346 - DNA, 17 bp, Homo sapiens
atcctttcatatagtta

SEQ ID NO: 768347 - DNA, 18 bp, Homo sapiens
atcctttcattaggcaaa

SEQ ID NO: 768348 - DNA, 15 bp, Homo sapiens
atcctttccctctcc

SEQ ID NO: 768349 - DNA, 17 bp, Homo sapiens
atcctttccctctccca

SEQ ID NO: 768350 - DNA, 20 bp, Homo sapiens
atcctttccctctcccagtc

SEQ ID NO: 768351 - DNA, 23 bp, Homo sapiens
atcctttcctctagcttttctat

SEQ ID NO: 768352 - DNA, 15 bp, Homo sapiens
atcctttctgccccc

SEQ ID NO: 768353 - DNA, 23 bp, Homo sapiens
atccttttccagaaatacctgtc

SEQ ID NO: 768354 - DNA, 22 bp, Homo sapiens
ccatgtcacctggctgctaggc

SEQ ID NO: 768355 - DNA, 13 bp, Homo sapiens
ccatgtcagacac

SEQ ID NO: 768356 - DNA, 21 bp, Homo sapiens
ccatgtcagataagtgtaaat

SEQ ID NO: 768357 - DNA, 19 bp, Homo sapiens
ccatgtcagatgggaaatc

SEQ ID NO: 768358 - DNA, 13 bp, Homo sapiens
ccatgtccaaaga

SEQ ID NO: 768359 - DNA, 17 bp, Homo sapiens
ccatgtccaaagaggct

SEQ ID NO: 768360 - DNA, 18 bp, Homo sapiens
ccatgtccaaagaggctg

SEQ ID NO: 768361 - DNA, 23 bp, Homo sapiens
ccatgtccaaagaggctgcccct

SEQ ID NO: 768362 - DNA, 15 bp, Homo sapiens
ccatgtccaatggag

SEQ ID NO: 768363 - DNA, 15 bp, Homo sapiens
ccatgtcgcctctgc

SEQ ID NO: 768364 - DNA, 16 bp, Homo sapiens
ccatgtcgcctctgca

SEQ ID NO: 768365 - DNA, 15 bp, Homo sapiens
ccatgtcttctgctg

SEQ ID NO: 768366 - DNA, 16 bp, Homo sapiens
ccatgtcttctgctgt

SEQ ID NO: 768367 - DNA, 22 bp, Homo sapiens
ccatgtctttctggaaaggaaa

SEQ ID NO: 768368 - DNA, 21 bp, Homo sapiens
ccatgtgaaaaggcaaaaagc

SEQ ID NO: 768369 - DNA, 16 bp, Homo sapiens
ccatgtgaacagcata

SEQ ID NO: 768370 - DNA, 21 bp, Homo sapiens
ccatgtgattaatgttttcat

SEQ ID NO: 768371 - DNA, 22 bp, Homo sapiens
ccatgtgattaatgttttcatt

SEQ ID NO: 768372 - DNA, 13 bp, Homo sapiens
ccatgtgcaataa

SEQ ID NO: 768373 - DNA, 17 bp, Homo sapiens
ccatgtgcaataagatt

SEQ ID NO: 768374 - DNA, 13 bp, Homo sapiens
ccatgtgcatata

SEQ ID NO: 768375 - DNA, 19 bp, Homo sapiens
ccatgtgccttgtccagga

SEQ ID NO: 768376 - DNA, 21 bp, Homo sapiens
ccatgtggataactttacaga

SEQ ID NO: 768377 - DNA, 11 bp, Homo sapiens
ccatgtggcca

SEQ ID NO: 768378 - DNA, 14 bp, Homo sapiens
ccatgtggccacaa

SEQ ID NO: 768379 - DNA, 15 bp, Homo sapiens
ccatgtggcctgccc

SEQ ID NO: 768380 - DNA, 18 bp, Homo sapiens
ccatgtggcctgcccagc

SEQ ID NO: 768381 - DNA, 15 bp, Homo sapiens
ccatgtggctgaaga

SEQ ID NO: 768382 - DNA, 17 bp, Homo sapiens
ccatgtggtggcacagg

SEQ ID NO: 768383 - DNA, 16 bp, Homo sapiens
ccatgtgtacattctg

SEQ ID NO: 768384 - DNA, 20 bp, Homo sapiens
ccatgtgtcacttgtgcttt

SEQ ID NO: 768385 - DNA, 15 bp, Homo sapiens
ccatgtgtcccctca

SEQ ID NO: 768386 - DNA, 16 bp, Homo sapiens
ccatgtgtcccctcac

SEQ ID NO: 768387 - DNA, 14 bp, Homo sapiens
ccatgtgtgctaat

SEQ ID NO: 768388 - DNA, 23 bp, Homo sapiens
ccatgttaaatgacttgattgta

SEQ ID NO: 768389 - DNA, 21 bp, Homo sapiens
ccatgttaagtcctccctgac

SEQ ID NO: 768390 - DNA, 18 bp, Homo sapiens
ccatgttagtttttactt

SEQ ID NO: 768391 - DNA, 17 bp, Homo sapiens
ccatgttattctctcac

SEQ ID NO: 768392 - DNA, 13 bp, Homo sapiens
ccatgttcattat

SEQ ID NO: 768393 - DNA, 15 bp, Homo sapiens
ccatgttcattataa

SEQ ID NO: 768394 - DNA, 16 bp, Homo sapiens
ccatgttcattataat

SEQ ID NO: 768395 - DNA, 12 bp, Homo sapiens
ccatgttccctt

SEQ ID NO: 768396 - DNA, 14 bp, Homo sapiens
ccatgttgcgttca

SEQ ID NO: 768397 - DNA, 14 bp, Homo sapiens
ccatgttgctgcca

SEQ ID NO: 768398 - DNA, 15 bp, Homo sapiens
ccatgttgctgccaa

SEQ ID NO: 768399 - DNA, 20 bp, Homo sapiens
ccatgttggccaggatggtc

SEQ ID NO: 768400 - DNA, 18 bp, Homo sapiens
ccatgttggccaggctgg

SEQ ID NO: 768401 - DNA, 19 bp, Homo sapiens
ccatgttggccaggctggt

SEQ ID NO: 768402 - DNA, 16 bp, Homo sapiens
ccatgttgtaatgctg

SEQ ID NO: 768403 - DNA, 20 bp, Homo sapiens
ccatgttgtaatgctgcact

SEQ ID NO: 768404 - DNA, 22 bp, Homo sapiens
ccatgtttcaaacaagaaacat

SEQ ID NO: 768405 - DNA, 13 bp, Homo sapiens
ccatgtttcaaat

SEQ ID NO: 768406 - DNA, 16 bp, Homo sapiens
ccatgtttttgccaaa

SEQ ID NO: 768407 - DNA, 23 bp, Homo sapiens
ccatgtttttggggacactgaca

SEQ ID NO: 768408 - DNA, 14 bp, Homo sapiens
ccattaaaactgct

SEQ ID NO: 768409 - DNA, 17 bp, Homo sapiens
ccattaaaataaaacaa

SEQ ID NO: 768410 - DNA, 18 bp, Homo sapiens
ccattaaaataaaacaag

SEQ ID NO: 768411 - DNA, 21 bp, Homo sapiens
ccattaaaataaaacaagcct

SEQ ID NO: 768412 - DNA, 23 bp, Homo sapiens
ccattaaaataaaacaagcctta

SEQ ID NO: 768413 - DNA, 19 bp, Homo sapiens
ccattaaagtcagaagttt

SEQ ID NO: 768414 - DNA, 15 bp, Homo sapiens
ccattaaagtctgaa

SEQ ID NO: 768415 - DNA, 16 bp, Homo sapiens
ccattaaagtctgaat

SEQ ID NO: 768416 - DNA, 15 bp, Homo sapiens
ccattaaagttctca

SEQ ID NO: 768417 - DNA, 20 bp, Homo sapiens
ccattaaatccgcaaacagc

SEQ ID NO: 768418 - DNA, 14 bp, Homo sapiens
ccattaattacata

SEQ ID NO: 768419 - DNA, 12 bp, Homo sapiens
ccattaatttaa

SEQ ID NO: 768420 - DNA, 15 bp, Homo sapiens
ccattaatttaaatg

SEQ ID NO: 768421 - DNA, 12 bp, Homo sapiens
ccattacatgtt

SEQ ID NO: 768422 - DNA, 16 bp, Homo sapiens
ccattaccatgtaatg

SEQ ID NO: 768423 - DNA, 15 bp, Homo sapiens
ccattaccccatacc

SEQ ID NO: 768424 - DNA, 16 bp, Homo sapiens
ccattaccccataccc

SEQ ID NO: 768425 - DNA, 13 bp, Homo sapiens
ccattacctgtac

SEQ ID NO: 768426 - DNA, 14 bp, Homo sapiens
ccattacctgtacc

SEQ ID NO: 768427 - DNA, 19 bp, Homo sapiens
ccattacttgtataaatac

SEQ ID NO: 768428 - DNA, 17 bp, Homo sapiens
ccattagagcacagctt

SEQ ID NO: 768429 - DNA, 16 bp, Homo sapiens
ccattagagtcagcct

SEQ ID NO: 768430 - DNA, 14 bp, Homo sapiens
ccattaggccagca

SEQ ID NO: 768431 - DNA, 18 bp, Homo sapiens
ccattatatttgcattat

SEQ ID NO: 768432 - DNA, 23 bp, Homo sapiens
ccattatatttgcattatgtatt

SEQ ID NO: 768433 - DNA, 17 bp, Homo sapiens
ccattattatttctgtt

SEQ ID NO: 768434 - DNA, 19 bp, Homo sapiens
ccattattatttctgttct

SEQ ID NO: 768435 - DNA, 19 bp, Homo sapiens
ccattattgagttcctcct

SEQ ID NO: 768436 - DNA, 17 bp, Homo sapiens
ccatttttcaaagcaat

SEQ ID NO: 768437 - DNA, 18 bp, Homo sapiens
ccatttttcaaagcaatt

SEQ ID NO: 768438 - DNA, 21 bp, Homo sapiens
cccaaaaatatctcctccaat

SEQ ID NO: 768439 - DNA, 22 bp, Homo sapiens
cccaaaaatgttcccttgacca

SEQ ID NO: 768440 - DNA, 14 bp, Homo sapiens
cccaaaaccacagc

SEQ ID NO: 768441 - DNA, 21 bp, Homo sapiens
cccaaaaccacagccctgtca

SEQ ID NO: 768442 - DNA, 23 bp, Homo sapiens
cccaaaagaaactgacatgccct

SEQ ID NO: 768443 - DNA, 19 bp, Homo sapiens
cccaaaagaggtgtcatgc

SEQ ID NO: 768444 - DNA, 20 bp, Homo sapiens
cccaaaatctgattagaagt

SEQ ID NO: 768445 - DNA, 17 bp, Homo sapiens
cccaaacaaatatgcaa

SEQ ID NO: 768446 - DNA, 20 bp, Homo sapiens
cccaaacaaatatgcaaaag

SEQ ID NO: 768447 - DNA, 22 bp, Homo sapiens
cccaaacaccttccagctcctg

SEQ ID NO: 768448 - DNA, 18 bp, Homo sapiens
cccaaaccatgagaattt

SEQ ID NO: 768449 - DNA, 13 bp, Homo sapiens
cccaaaccccagc

SEQ ID NO: 768450 - DNA, 19 bp, Homo sapiens
cccaaacccttaactgaca

SEQ ID NO: 768451 - DNA, 14 bp, Homo sapiens
cccaaaccttgggc

SEQ ID NO: 768452 - DNA, 16 bp, Homo sapiens
cccaaacgccctttcc

SEQ ID NO: 768453 - DNA, 21 bp, Homo sapiens
cccaaactccccttccctggg

SEQ ID NO: 768454 - DNA, 23 bp, Homo sapiens
cccaaactgttgattattagcca

SEQ ID NO: 768455 - DNA, 16 bp, Homo sapiens
cccaaactttaaaatg

SEQ ID NO: 768456 - DNA, 21 bp, Homo sapiens
cccaaagaatgtttatagcaa

SEQ ID NO: 768457 - DNA, 13 bp, Homo sapiens
cccaaagcacatg

SEQ ID NO: 768458 - DNA, 14 bp, Homo sapiens
cccaaagctttcct

SEQ ID NO: 768459 - DNA, 17 bp, Homo sapiens
cccaaagctttcctgcc

SEQ ID NO: 768460 - DNA, 20 bp, Homo sapiens
cccaaagctttcctgcccca

SEQ ID NO: 768461 - DNA, 20 bp, Homo sapiens
cccaaaggacgcctgcagga

SEQ ID NO: 768462 - DNA, 18 bp, Homo sapiens
cccaaaggggacaggcct

SEQ ID NO: 768463 - DNA, 14 bp, Homo sapiens
cccaaagtcctctg

SEQ ID NO: 768464 - DNA, 16 bp, Homo sapiens
cccaaagtctgtgtga

SEQ ID NO: 768465 - DNA, 23 bp, Homo sapiens
cccaaagttgttgtaacctgctg

SEQ ID NO: 768466 - DNA, 14 bp, Homo sapiens
cccaaatcaataca

SEQ ID NO: 768467 - DNA, 14 bp, Homo sapiens
cccaaatggctgct

SEQ ID NO: 768468 - DNA, 19 bp, Homo sapiens
cccaaattataagggccct

SEQ ID NO: 768469 - DNA, 20 bp, Homo sapiens
cccaaattataagggccctg

SEQ ID NO: 768470 - DNA, 12 bp, Homo sapiens
cccaaattttaa

SEQ ID NO: 768471 - DNA, 17 bp, Homo sapiens
cccaacaaaccatccag

SEQ ID NO: 768472 - DNA, 13 bp, Homo sapiens
cccaacacaaaga

SEQ ID NO: 768473 - DNA, 12 bp, Homo sapiens
cccaacaccaaa

SEQ ID NO: 768474 - DNA, 12 bp, Homo sapiens
cccaacacctgc

SEQ ID NO: 768475 - DNA, 15 bp, Homo sapiens
cccaacacctgcctc

SEQ ID NO: 768476 - DNA, 16 bp, Homo sapiens
cccaacacctgctgcg

SEQ ID NO: 768477 - DNA, 19 bp, Homo sapiens
cccaacagatgcttttctg

SEQ ID NO: 768478 - DNA, 19 bp, Homo sapiens
cccaacagccttagctgcc

SEQ ID NO: 768479 - DNA, 21 bp, Homo sapiens
cccaacagccttagctgccag

SEQ ID NO: 768480 - DNA, 12 bp, Homo sapiens
cccaacagttta

SEQ ID NO: 768481 - DNA, 22 bp, Homo sapiens
cccaacatgggagggatcagcc

SEQ ID NO: 768482 - DNA, 14 bp, Homo sapiens
cccaacattctgca

SEQ ID NO: 768483 - DNA, 15 bp, Homo sapiens
cccaaccaaccagca

SEQ ID NO: 768484 - DNA, 20 bp, Homo sapiens
cccaaccaaccagcagggta

SEQ ID NO: 768485 - DNA, 17 bp, Homo sapiens
atctacaagccaaaagt

SEQ ID NO: 768486 - DNA, 13 bp, Homo sapiens
atctacaatcagt

SEQ ID NO: 768487 - DNA, 18 bp, Homo sapiens
atctacaatcagttgact

SEQ ID NO: 768488 - DNA, 21 bp, Homo sapiens
atctacagtaatgaaatgttt

SEQ ID NO: 768489 - DNA, 15 bp, Homo sapiens
atctacccaaaggat

SEQ ID NO: 768490 - DNA, 20 bp, Homo sapiens
atctaccccagactagatgt

SEQ ID NO: 768491 - DNA, 16 bp, Homo sapiens
atctacccgtgcctgg

SEQ ID NO: 768492 - DNA, 14 bp, Homo sapiens
atctacctgttctg

SEQ ID NO: 768493 - DNA, 16 bp, Homo sapiens
atctacctgttctgta

SEQ ID NO: 768494 - DNA, 17 bp, Homo sapiens
atctacctgttctgtag

SEQ ID NO: 768495 - DNA, 18 bp, Homo sapiens
atctacctgttctgtagc

SEQ ID NO: 768496 - DNA, 17 bp, Homo sapiens
atctactgaatgacctc

SEQ ID NO: 768497 - DNA, 17 bp, Homo sapiens
atctactggaaatgtag

SEQ ID NO: 768498 - DNA, 23 bp, Homo sapiens
atctactggaaatgtagcactta

SEQ ID NO: 768499 - DNA, 13 bp, Homo sapiens
atctacttccaaa

SEQ ID NO: 768500 - DNA, 15 bp, Homo sapiens
atctacttccaaact

SEQ ID NO: 768501 - DNA, 19 bp, Homo sapiens
atctacttccaaactaatt

SEQ ID NO: 768502 - DNA, 20 bp, Homo sapiens
atctacttctgtaattgtgt

SEQ ID NO: 768503 - DNA, 23 bp, Homo sapiens
atctacttctgtaattgtgtgga

SEQ ID NO: 768504 - DNA, 23 bp, Homo sapiens
atctactttttgaacttttcatt

SEQ ID NO: 768505 - DNA, 19 bp, Homo sapiens
atctagaagagtctattgt

SEQ ID NO: 768506 - DNA, 20 bp, Homo sapiens
atctagaagagtctattgtc

SEQ ID NO: 768507 - DNA, 21 bp, Homo sapiens
atctagaagagtctattgtct

SEQ ID NO: 768508 - DNA, 21 bp, Homo sapiens
atctagaagctggtaaaaatg

SEQ ID NO: 768509 - DNA, 14 bp, Homo sapiens
atctagaattttta

SEQ ID NO: 768510 - DNA, 16 bp, Homo sapiens
atctagacaatttctt

SEQ ID NO: 768511 - DNA, 19 bp, Homo sapiens
atctagacattcttttaat

SEQ ID NO: 768512 - DNA, 15 bp, Homo sapiens
atctagcactcctca

SEQ ID NO: 768513 - DNA, 14 bp, Homo sapiens
atctagcagctggc

SEQ ID NO: 768514 - DNA, 18 bp, Homo sapiens
atctagcagtaaatactt

SEQ ID NO: 768515 - DNA, 21 bp, Homo sapiens
atctagccagcccctcttccc

SEQ ID NO: 768516 - DNA, 17 bp, Homo sapiens
atctagccgatggaaaa

SEQ ID NO: 768517 - DNA, 17 bp, Homo sapiens
atctagcgcaattgaag

SEQ ID NO: 768518 - DNA, 18 bp, Homo sapiens
atctagcttcttcagaga

SEQ ID NO: 768519 - DNA, 16 bp, Homo sapiens
atctaggagaggagaa

SEQ ID NO: 768520 - DNA, 16 bp, Homo sapiens
atctaggatgtgatga

SEQ ID NO: 768521 - DNA, 18 bp, Homo sapiens
atctaggtggagttgaaa

SEQ ID NO: 768522 - DNA, 21 bp, Homo sapiens
atctaggtggagttgaaagag

SEQ ID NO: 768523 - DNA, 15 bp, Homo sapiens
atctaggtgtggctg

SEQ ID NO: 768524 - DNA, 20 bp, Homo sapiens
atctaggtgtggctgtgaag

SEQ ID NO: 768525 - DNA, 12 bp, Homo sapiens
atctagtagttg

SEQ ID NO: 768526 - DNA, 14 bp, Homo sapiens
atctagtgcagctg

SEQ ID NO: 768527 - DNA, 18 bp, Homo sapiens
atctagtgcagctgattt

SEQ ID NO: 768528 - DNA, 16 bp, Homo sapiens
atctagtttacagaaa

SEQ ID NO: 768529 - DNA, 17 bp, Homo sapiens
atctagtttacagaaaa

SEQ ID NO: 768530 - DNA, 23 bp, Homo sapiens
atctataaggtgctctctttctg

SEQ ID NO: 768531 - DNA, 22 bp, Homo sapiens
atctataagtagtaaatcagaa

SEQ ID NO: 768532 - DNA, 16 bp, Homo sapiens
atctatacatatcttt

SEQ ID NO: 768533 - DNA, 17 bp, Homo sapiens
atctatagaaagctata

SEQ ID NO: 768534 - DNA, 21 bp, Homo sapiens
atctataggaagattgaacct

SEQ ID NO: 768535 - DNA, 22 bp, Homo sapiens
atctataggcagcttctaagag

SEQ ID NO: 768536 - DNA, 14 bp, Homo sapiens
atctatataaaata

SEQ ID NO: 768537 - DNA, 17 bp, Homo sapiens
atctatatatgtatcta

SEQ ID NO: 768538 - DNA, 23 bp, Homo sapiens
atctatatgtacttgtcaaagaa

SEQ ID NO: 768539 - DNA, 16 bp, Homo sapiens
atctatctatttgagg

SEQ ID NO: 768540 - DNA, 19 bp, Homo sapiens
atctatctcatctatctca

SEQ ID NO: 768541 - DNA, 20 bp, Homo sapiens
atctatctggtgatttctag

SEQ ID NO: 768542 - DNA, 13 bp, Homo sapiens
atctatcttccaa

SEQ ID NO: 768543 - DNA, 15 bp, Homo sapiens
atctatggaaatgtg

SEQ ID NO: 768544 - DNA, 22 bp, Homo sapiens
atctatggaaatgtgagaaatg

SEQ ID NO: 768545 - DNA, 18 bp, Homo sapiens
atctatggcttatttcta

SEQ ID NO: 768546 - DNA, 19 bp, Homo sapiens
atctatggctttaaataaa

SEQ ID NO: 768547 - DNA, 15 bp, Homo sapiens
atctatgtcatattt

SEQ ID NO: 768548 - DNA, 21 bp, Homo sapiens
atctatgtcgtgttttcaagg

SEQ ID NO: 768549 - DNA, 13 bp, Homo sapiens
atctatgtggaaa

SEQ ID NO: 768550 - DNA, 12 bp, Homo sapiens
atctatgtgttt

SEQ ID NO: 768551 - DNA, 21 bp, Homo sapiens
atctatgtgtttctgtaacaa

SEQ ID NO: 768552 - DNA, 17 bp, Homo sapiens
atctatgtttgtgtgat

SEQ ID NO: 768553 - DNA, 22 bp, Homo sapiens
atctatgtttgtgtgatttcct

SEQ ID NO: 768554 - DNA, 14 bp, Homo sapiens
atctattaaagtga

SEQ ID NO: 768555 - DNA, 16 bp, Homo sapiens
atctattaaagtgact

SEQ ID NO: 768556 - DNA, 15 bp, Homo sapiens
atctattaatatatg

SEQ ID NO: 768557 - DNA, 16 bp, Homo sapiens
cccaccaccacgcctg

SEQ ID NO: 768558 - DNA, 13 bp, Homo sapiens
cccaccaccccat

SEQ ID NO: 768559 - DNA, 18 bp, Homo sapiens
cccaccaccttggactcc

SEQ ID NO: 768560 - DNA, 22 bp, Homo sapiens
cccaccaccttggactcctccc

SEQ ID NO: 768561 - DNA, 20 bp, Homo sapiens
cccaccacgatgtggccctg

SEQ ID NO: 768562 - DNA, 13 bp, Homo sapiens
cccaccactcagg

SEQ ID NO: 768563 - DNA, 16 bp, Homo sapiens
cccaccactgatatca

SEQ ID NO: 768564 - DNA, 20 bp, Homo sapiens
cccaccagagccgggaggaa

SEQ ID NO: 768565 - DNA, 22 bp, Homo sapiens
cccaccagccagccctggccca

SEQ ID NO: 768566 - DNA, 12 bp, Homo sapiens
cccaccagctcc

SEQ ID NO: 768567 - DNA, 15 bp, Homo sapiens
cccaccagctccaca

SEQ ID NO: 768568 - DNA, 13 bp, Homo sapiens
cccaccagctcgt

SEQ ID NO: 768569 - DNA, 13 bp, Homo sapiens
cccaccaggagca

SEQ ID NO: 768570 - DNA, 22 bp, Homo sapiens
cccaccaggagcacctggaccc

SEQ ID NO: 768571 - DNA, 16 bp, Homo sapiens
cccaccagtgtagcat

SEQ ID NO: 768572 - DNA, 22 bp, Homo sapiens
cccaccagtgtagcatcttcct

SEQ ID NO: 768573 - DNA, 20 bp, Homo sapiens
cccaccatggaccagcccat

SEQ ID NO: 768574 - DNA, 16 bp, Homo sapiens
cccaccattctacctg

SEQ ID NO: 768575 - DNA, 15 bp, Homo sapiens
cccacccaagcttgg

SEQ ID NO: 768576 - DNA, 18 bp, Homo sapiens
cccacccaagcttggcag

SEQ ID NO: 768577 - DNA, 11 bp, Homo sapiens
cccacccaccc

SEQ ID NO: 768578 - DNA, 11 bp, Homo sapiens
cccacccacct

SEQ ID NO: 768579 - DNA, 13 bp, Homo sapiens
cccacccacctcc

SEQ ID NO: 768580 - DNA, 20 bp, Homo sapiens
cccacccacgcatacacaca

SEQ ID NO: 768581 - DNA, 18 bp, Homo sapiens
cccacccagctccaggcc

SEQ ID NO: 768582 - DNA, 14 bp, Homo sapiens
cccacccagctggt

SEQ ID NO: 768583 - DNA, 16 bp, Homo sapiens
cccacccagctggtcc

SEQ ID NO: 768584 - DNA, 21 bp, Homo sapiens
cccacccagctggtcctgtgg

SEQ ID NO: 768585 - DNA, 15 bp, Homo sapiens
cccacccatcttcct

SEQ ID NO: 768586 - DNA, 16 bp, Homo sapiens
cccacccatcttcctg

SEQ ID NO: 768587 - DNA, 21 bp, Homo sapiens
cccacccatcttcctgctgct

SEQ ID NO: 768588 - DNA, 16 bp, Homo sapiens
cccacccatggggagg

SEQ ID NO: 768589 - DNA, 14 bp, Homo sapiens
cccaccccaactct

SEQ ID NO: 768590 - DNA, 23 bp, Homo sapiens
cccaccccaactctccccagtgc

SEQ ID NO: 768591 - DNA, 12 bp, Homo sapiens
cccaccccacac

SEQ ID NO: 768592 - DNA, 13 bp, Homo sapiens
cccaccccacact

SEQ ID NO: 768593 - DNA, 17 bp, Homo sapiens
cccaccccaccccaccc

SEQ ID NO: 768594 - DNA, 15 bp, Homo sapiens
cccaccccaccccct

SEQ ID NO: 768595 - DNA, 21 bp, Homo sapiens
cccaccccagaaatcactgtg

SEQ ID NO: 768596 - DNA, 16 bp, Homo sapiens
cccaccccagcacagc

SEQ ID NO: 768597 - DNA, 20 bp, Homo sapiens
cccaccccagcacagccacc

SEQ ID NO: 768598 - DNA, 22 bp, Homo sapiens
cccaccccagcacagccacctc

SEQ ID NO: 768599 - DNA, 22 bp, Homo sapiens
cccaccccatccagccagaccc

SEQ ID NO: 768600 - DNA, 16 bp, Homo sapiens
cccacccccagccccg

SEQ ID NO: 768601 - DNA, 15 bp, Homo sapiens
cccacccccaggcct

SEQ ID NO: 768602 - DNA, 13 bp, Homo sapiens
cccacccccagtg

SEQ ID NO: 768603 - DNA, 15 bp, Homo sapiens
cccacccccctcctc

SEQ ID NO: 768604 - DNA, 22 bp, Homo sapiens
cccacccccctctctttctctg

SEQ ID NO: 768605 - DNA, 23 bp, Homo sapiens
cccacccccctctctttctctgg

SEQ ID NO: 768606 - DNA, 17 bp, Homo sapiens
cccacccccgccatgca

SEQ ID NO: 768607 - DNA, 12 bp, Homo sapiens
cccaccccctca

SEQ ID NO: 768608 - DNA, 17 bp, Homo sapiens
cccaccccctccccagg

SEQ ID NO: 768609 - DNA, 13 bp, Homo sapiens
cccaccccctgcc

SEQ ID NO: 768610 - DNA, 18 bp, Homo sapiens
cccaccccctgccctgca

SEQ ID NO: 768611 - DNA, 16 bp, Homo sapiens
cccaccccctgggcag

SEQ ID NO: 768612 - DNA, 16 bp, Homo sapiens
cccacccccttctctg

SEQ ID NO: 768613 - DNA, 19 bp, Homo sapiens
cccaccccgccgttccctg

SEQ ID NO: 768614 - DNA, 16 bp, Homo sapiens
cccacccctcactccc

SEQ ID NO: 768615 - DNA, 12 bp, Homo sapiens
cccacccctgca

SEQ ID NO: 768616 - DNA, 15 bp, Homo sapiens
cccacccctgcacag

SEQ ID NO: 768617 - DNA, 16 bp, Homo sapiens
cccacccctgtgctcc

SEQ ID NO: 768618 - DNA, 14 bp, Homo sapiens
atctgagaatcttt

SEQ ID NO: 768619 - DNA, 21 bp, Homo sapiens
atctgagatttttttgtgtat

SEQ ID NO: 768620 - DNA, 13 bp, Homo sapiens
atctgagcaataa

SEQ ID NO: 768621 - DNA, 16 bp, Homo sapiens
atctgagcaataactt

SEQ ID NO: 768622 - DNA, 18 bp, Homo sapiens
atctgagcaataacttct

SEQ ID NO: 768623 - DNA, 15 bp, Homo sapiens
atctgagccagtgct

SEQ ID NO: 768624 - DNA, 23 bp, Homo sapiens
atctgagctcccacctcccttcc

SEQ ID NO: 768625 - DNA, 14 bp, Homo sapiens
atctgagggaaatg

SEQ ID NO: 768626 - DNA, 22 bp, Homo sapiens
atctgagggaaatgttttgtaa

SEQ ID NO: 768627 - DNA, 23 bp, Homo sapiens
atctgagggaaatgttttgtaaa

SEQ ID NO: 768628 - DNA, 16 bp, Homo sapiens
atctgagggaggaggc

SEQ ID NO: 768629 - DNA, 22 bp, Homo sapiens
atctgagggaggaggccacctc

SEQ ID NO: 768630 - DNA, 23 bp, Homo sapiens
atctgagggaggaggccacctct

SEQ ID NO: 768631 - DNA, 21 bp, Homo sapiens
atctgaggttggatttgctca

SEQ ID NO: 768632 - DNA, 16 bp, Homo sapiens
atctgagtaggtctgg

SEQ ID NO: 768633 - DNA, 13 bp, Homo sapiens
atctgagttgcca

SEQ ID NO: 768634 - DNA, 18 bp, Homo sapiens
atctgataaaattgtgat

SEQ ID NO: 768635 - DNA, 22 bp, Homo sapiens
atctgataaaattgtgatgttt

SEQ ID NO: 768636 - DNA, 20 bp, Homo sapiens
atctgatcaagagtccggat

SEQ ID NO: 768637 - DNA, 13 bp, Homo sapiens
atctgatctgtga

SEQ ID NO: 768638 - DNA, 18 bp, Homo sapiens
atctgatctttttataca

SEQ ID NO: 768639 - DNA, 21 bp, Homo sapiens
atctgatggccttaatttcct

SEQ ID NO: 768640 - DNA, 22 bp, Homo sapiens
atctgatggccttaatttcctt

SEQ ID NO: 768641 - DNA, 13 bp, Homo sapiens
atctgattagaag

SEQ ID NO: 768642 - DNA, 17 bp, Homo sapiens
atctgattcctttaaaa

SEQ ID NO: 768643 - DNA, 14 bp, Homo sapiens
atctgattgcactg

SEQ ID NO: 768644 - DNA, 18 bp, Homo sapiens
atctgattggacattttc

SEQ ID NO: 768645 - DNA, 19 bp, Homo sapiens
atctgattggacattttct

SEQ ID NO: 768646 - DNA, 15 bp, Homo sapiens
atctgatttaatgtt

SEQ ID NO: 768647 - DNA, 13 bp, Homo sapiens
atctgatttcatt

SEQ ID NO: 768648 - DNA, 11 bp, Homo sapiens
atctgcaaaag

SEQ ID NO: 768649 - DNA, 22 bp, Homo sapiens
atctgcaaaaggcctcttgtaa

SEQ ID NO: 768650 - DNA, 22 bp, Homo sapiens
atctgcacccttcttttctcat

SEQ ID NO: 768651 - DNA, 17 bp, Homo sapiens
atctgcactctaaactg

SEQ ID NO: 768652 - DNA, 18 bp, Homo sapiens
atctgcactctaaactgc

SEQ ID NO: 768653 - DNA, 21 bp, Homo sapiens
atctgcactctaaactgcaaa

SEQ ID NO: 768654 - DNA, 11 bp, Homo sapiens
atctgcagaac

SEQ ID NO: 768655 - DNA, 22 bp, Homo sapiens
atctgcagaaggaaaaatgtgt

SEQ ID NO: 768656 - DNA, 23 bp, Homo sapiens
atctgcagaaggaaaaatgtgta

SEQ ID NO: 768657 - DNA, 18 bp, Homo sapiens
atctgcagccattcttca

SEQ ID NO: 768658 - DNA, 23 bp, Homo sapiens
atctgcaggcaccgggctggctg

SEQ ID NO: 768659 - DNA, 17 bp, Homo sapiens
atctgcaggcagacacg

SEQ ID NO: 768660 - DNA, 19 bp, Homo sapiens
atctgcaggcagacacgga

SEQ ID NO: 768661 - DNA, 22 bp, Homo sapiens
atctgcatatttctgtatattt

SEQ ID NO: 768662 - DNA, 12 bp, Homo sapiens
atctgcattatc

SEQ ID NO: 768663 - DNA, 13 bp, Homo sapiens
atctgcattatct

SEQ ID NO: 768664 - DNA, 14 bp, Homo sapiens
atctgccaccgtgg

SEQ ID NO: 768665 - DNA, 17 bp, Homo sapiens
atctgccagacttaaaa

SEQ ID NO: 768666 - DNA, 23 bp, Homo sapiens
atctgcccaggggtgccccctcc

SEQ ID NO: 768667 - DNA, 12 bp, Homo sapiens
atctgcccctcc

SEQ ID NO: 768668 - DNA, 15 bp, Homo sapiens
atctgcccctccccc

SEQ ID NO: 768669 - DNA, 12 bp, Homo sapiens
atctgcctcccc

SEQ ID NO: 768670 - DNA, 14 bp, Homo sapiens
atctgcctcctctc

SEQ ID NO: 768671 - DNA, 13 bp, Homo sapiens
atctgcctgggcc

SEQ ID NO: 768672 - DNA, 16 bp, Homo sapiens
atctgcctgggcctgt

SEQ ID NO: 768673 - DNA, 15 bp, Homo sapiens
atctgcctgtggcct

SEQ ID NO: 768674 - DNA, 19 bp, Homo sapiens
atctgccttaaaaccaaag

SEQ ID NO: 768675 - DNA, 21 bp, Homo sapiens
atctgccttaaaaccaaagag

SEQ ID NO: 768676 - DNA, 17 bp, Homo sapiens
atctgcgtgacaataaa

SEQ ID NO: 768677 - DNA, 20 bp, Homo sapiens
atctgctaagtaatttagaa

SEQ ID NO: 768678 - DNA, 13 bp, Homo sapiens
atctgctagaaag

SEQ ID NO: 768679 - DNA, 22 bp, Homo sapiens
cccagaataagttattgcagtt

SEQ ID NO: 768680 - DNA, 17 bp, Homo sapiens
cccagaatggagcctgc

SEQ ID NO: 768681 - DNA, 19 bp, Homo sapiens
cccagaatggagcctgctc

SEQ ID NO: 768682 - DNA, 16 bp, Homo sapiens
cccagacaacagccca

SEQ ID NO: 768683 - DNA, 17 bp, Homo sapiens
cccagacaacagcccag

SEQ ID NO: 768684 - DNA, 19 bp, Homo sapiens
cccagacacagactggcaa

SEQ ID NO: 768685 - DNA, 21 bp, Homo sapiens
cccagacaccatgtgcaataa

SEQ ID NO: 768686 - DNA, 23 bp, Homo sapiens
cccagacagacatctctgcaccc

SEQ ID NO: 768687 - DNA, 22 bp, Homo sapiens
cccagacaggccctccctgtct

SEQ ID NO: 768688 - DNA, 13 bp, Homo sapiens
cccagaccactgt

SEQ ID NO: 768689 - DNA, 17 bp, Homo sapiens
cccagacccatgtgctg

SEQ ID NO: 768690 - DNA, 18 bp, Homo sapiens
cccagacccatgtgctgg

SEQ ID NO: 768691 - DNA, 14 bp, Homo sapiens
cccagaccccgccc

SEQ ID NO: 768692 - DNA, 14 bp, Homo sapiens
cccagacccctctc

SEQ ID NO: 768693 - DNA, 13 bp, Homo sapiens
cccagaccggctt

SEQ ID NO: 768694 - DNA, 16 bp, Homo sapiens
cccagaccggcttctc

SEQ ID NO: 768695 - DNA, 17 bp, Homo sapiens
cccagacctgcgaagga

SEQ ID NO: 768696 - DNA, 21 bp, Homo sapiens
cccagacctgttagcagacag

SEQ ID NO: 768697 - DNA, 20 bp, Homo sapiens
cccagactcctttcctctga

SEQ ID NO: 768698 - DNA, 13 bp, Homo sapiens
cccagactctttt

SEQ ID NO: 768699 - DNA, 20 bp, Homo sapiens
cccagactgagctctccagg

SEQ ID NO: 768700 - DNA, 14 bp, Homo sapiens
cccagactgatgag

SEQ ID NO: 768701 - DNA, 15 bp, Homo sapiens
cccagactgatgagc

SEQ ID NO: 768702 - DNA, 22 bp, Homo sapiens
cccagactgggcccaggcaggt

SEQ ID NO: 768703 - DNA, 20 bp, Homo sapiens
cccagactgtagagattttt

SEQ ID NO: 768704 - DNA, 21 bp, Homo sapiens
cccagactgtagagattttta

SEQ ID NO: 768705 - DNA, 16 bp, Homo sapiens
cccagagaacaatcac

SEQ ID NO: 768706 - DNA, 22 bp, Homo sapiens
cccagagaacaatcactattct

SEQ ID NO: 768707 - DNA, 20 bp, Homo sapiens
cccagagaaggacggtgcca

SEQ ID NO: 768708 - DNA, 23 bp, Homo sapiens
cccagagaccccttcctttcctc

SEQ ID NO: 768709 - DNA, 16 bp, Homo sapiens
cccagagagaccctgc

SEQ ID NO: 768710 - DNA, 15 bp, Homo sapiens
cccagagagaggagg

SEQ ID NO: 768711 - DNA, 16 bp, Homo sapiens
cccagagagaggaggg

SEQ ID NO: 768712 - DNA, 15 bp, Homo sapiens
cccagagaggaatca

SEQ ID NO: 768713 - DNA, 21 bp, Homo sapiens
cccagagaggaatcagacttc

SEQ ID NO: 768714 - DNA, 12 bp, Homo sapiens
cccagagaggca

SEQ ID NO: 768715 - DNA, 17 bp, Homo sapiens
cccagagatgcctccac

SEQ ID NO: 768716 - DNA, 18 bp, Homo sapiens
cccagagatgcctccacc

SEQ ID NO: 768717 - DNA, 23 bp, Homo sapiens
cccagagatgcctccaccgctgc

SEQ ID NO: 768718 - DNA, 17 bp, Homo sapiens
cccagagcacctcacct

SEQ ID NO: 768719 - DNA, 12 bp, Homo sapiens
cccagagccagg

SEQ ID NO: 768720 - DNA, 17 bp, Homo sapiens
cccagagcccagctctt

SEQ ID NO: 768721 - DNA, 15 bp, Homo sapiens
cccagagccccactc

SEQ ID NO: 768722 - DNA, 17 bp, Homo sapiens
cccagagccctctgagc

SEQ ID NO: 768723 - DNA, 18 bp, Homo sapiens
cccagagccctctgagcc

SEQ ID NO: 768724 - DNA, 15 bp, Homo sapiens
cccagagccctggac

SEQ ID NO: 768725 - DNA, 16 bp, Homo sapiens
cccagagctggcctcc

SEQ ID NO: 768726 - DNA, 11 bp, Homo sapiens
cccagagctgt

SEQ ID NO: 768727 - DNA, 17 bp, Homo sapiens
cccagagctgtgccagc

SEQ ID NO: 768728 - DNA, 18 bp, Homo sapiens
cccagagcttattggcca

SEQ ID NO: 768729 - DNA, 19 bp, Homo sapiens
cccagagcttattggccac

SEQ ID NO: 768730 - DNA, 22 bp, Homo sapiens
cccagagcttattggccactgg

SEQ ID NO: 768731 - DNA, 21 bp, Homo sapiens
cccagaggaaggggccagagg

SEQ ID NO: 768732 - DNA, 16 bp, Homo sapiens
cccagaggacacaggc

SEQ ID NO: 768733 - DNA, 20 bp, Homo sapiens
cccagaggagccaccagttc

SEQ ID NO: 768734 - DNA, 12 bp, Homo sapiens
cccagaggccct

SEQ ID NO: 768735 - DNA, 23 bp, Homo sapiens
cccagaggctcccaatcagcttt

SEQ ID NO: 768736 - DNA, 18 bp, Homo sapiens
cccagagggcccaggcag

SEQ ID NO: 768737 - DNA, 22 bp, Homo sapiens
cccagagggcccaggcaggcca

SEQ ID NO: 768738 - DNA, 13 bp, Homo sapiens
cccagaggtccag

SEQ ID NO: 768739 - DNA, 16 bp, Homo sapiens
cccagaggtccagccc

SEQ ID NO: 768740 - DNA, 17 bp, Homo sapiens
cccagaggtccagccca

SEQ ID NO: 768741 - DNA, 15 bp, Homo sapiens
cccagaggtggccct

SEQ ID NO: 768742 - DNA, 23 bp, Homo sapiens
cccagaggtgggatcctccctca

SEQ ID NO: 768743 - DNA, 23 bp, Homo sapiens
cccagaggttatctgcctggcct

SEQ ID NO: 768744 - DNA, 22 bp, Homo sapiens
cccagagtagagccaggtgctt

SEQ ID NO: 768745 - DNA, 20 bp, Homo sapiens
cccagagtcagaggagaaga

SEQ ID NO: 768746 - DNA, 12 bp, Homo sapiens
cccagagtgctg

SEQ ID NO: 768747 - DNA, 15 bp, Homo sapiens
atttgttttcacact

SEQ ID NO: 768748 - DNA, 17 bp, Homo sapiens
atttgttttgaattttg

SEQ ID NO: 768749 - DNA, 14 bp, Homo sapiens
atttgttttgcttt

SEQ ID NO: 768750 - DNA, 16 bp, Homo sapiens
atttgttttgcttttg

SEQ ID NO: 768751 - DNA, 15 bp, Homo sapiens
atttgttttggatat

SEQ ID NO: 768752 - DNA, 16 bp, Homo sapiens
atttgtttttcattca

SEQ ID NO: 768753 - DNA, 22 bp, Homo sapiens
atttgtttttgtatttttaatg

SEQ ID NO: 768754 - DNA, 18 bp, Homo sapiens
attttaaaaaagccttcc

SEQ ID NO: 768755 - DNA, 17 bp, Homo sapiens
attttaaaaaatggtca

SEQ ID NO: 768756 - DNA, 23 bp, Homo sapiens
attttaaaaagtccataccttat

SEQ ID NO: 768757 - DNA, 14 bp, Homo sapiens
attttaaaaagtct

SEQ ID NO: 768758 - DNA, 17 bp, Homo sapiens
attttaaaaatacatat

SEQ ID NO: 768759 - DNA, 20 bp, Homo sapiens
attttaaaatagcgttcttg

SEQ ID NO: 768760 - DNA, 22 bp, Homo sapiens
attttaaaatagcgttcttgta

SEQ ID NO: 768761 - DNA, 12 bp, Homo sapiens
attttaaaatct

SEQ ID NO: 768762 - DNA, 13 bp, Homo sapiens
attttaaaatctg

SEQ ID NO: 768763 - DNA, 14 bp, Homo sapiens
attttaaaatctga

SEQ ID NO: 768764 - DNA, 22 bp, Homo sapiens
attttaaaatctgagggaaatg

SEQ ID NO: 768765 - DNA, 16 bp, Homo sapiens
attttaaaatctgatt

SEQ ID NO: 768766 - DNA, 15 bp, Homo sapiens
attttaaaatttcat

SEQ ID NO: 768767 - DNA, 13 bp, Homo sapiens
attttaaaatttg

SEQ ID NO: 768768 - DNA, 15 bp, Homo sapiens
attttaaacaaaata

SEQ ID NO: 768769 - DNA, 13 bp, Homo sapiens
attttaaacaaag

SEQ ID NO: 768770 - DNA, 15 bp, Homo sapiens
attttaaacagagga

SEQ ID NO: 768771 - DNA, 17 bp, Homo sapiens
attttaaagaacagtga

SEQ ID NO: 768772 - DNA, 17 bp, Homo sapiens
attttaaagaattgtgt

SEQ ID NO: 768773 - DNA, 21 bp, Homo sapiens
attttaaagacccaacttgcc

SEQ ID NO: 768774 - DNA, 13 bp, Homo sapiens
attttaaagtatg

SEQ ID NO: 768775 - DNA, 18 bp, Homo sapiens
attttaaagttagtatct

SEQ ID NO: 768776 - DNA, 21 bp, Homo sapiens
attttaaagttagtatctttt

SEQ ID NO: 768777 - DNA, 14 bp, Homo sapiens
attttaaataaaag

SEQ ID NO: 768778 - DNA, 20 bp, Homo sapiens
attttaaataaaagtgatca

SEQ ID NO: 768779 - DNA, 15 bp, Homo sapiens
attttaaataacctc

SEQ ID NO: 768780 - DNA, 19 bp, Homo sapiens
attttaaataacctctggc

SEQ ID NO: 768781 - DNA, 22 bp, Homo sapiens
attttaaataacctctggccct

SEQ ID NO: 768782 - DNA, 19 bp, Homo sapiens
attttaaatctaaatctat

SEQ ID NO: 768783 - DNA, 12 bp, Homo sapiens
attttaaatgaa

SEQ ID NO: 768784 - DNA, 18 bp, Homo sapiens
attttaacaaaagcaaga

SEQ ID NO: 768785 - DNA, 14 bp, Homo sapiens
attttaacaataac

SEQ ID NO: 768786 - DNA, 16 bp, Homo sapiens
attttaacaataacta

SEQ ID NO: 768787 - DNA, 19 bp, Homo sapiens
attttaacatgatttcaaa

SEQ ID NO: 768788 - DNA, 16 bp, Homo sapiens
attttaacgctgccta

SEQ ID NO: 768789 - DNA, 18 bp, Homo sapiens
attttaacttaactgaaa

SEQ ID NO: 768790 - DNA, 20 bp, Homo sapiens
attttaacttaactgaaatg

SEQ ID NO: 768791 - DNA, 15 bp, Homo sapiens
attttaactttatca

SEQ ID NO: 768792 - DNA, 13 bp, Homo sapiens
attttaagaaaga

SEQ ID NO: 768793 - DNA, 20 bp, Homo sapiens
attttaagaaagagaatgaa

SEQ ID NO: 768794 - DNA, 18 bp, Homo sapiens
attttaagaagacatact

SEQ ID NO: 768795 - DNA, 19 bp, Homo sapiens
attttaagaagacatgaca

SEQ ID NO: 768796 - DNA, 19 bp, Homo sapiens
attttaagacgtgtttgtg

SEQ ID NO: 768797 - DNA, 21 bp, Homo sapiens
attttaagacgtgtttgtgtt

SEQ ID NO: 768798 - DNA, 16 bp, Homo sapiens
attttaagactgattt

SEQ ID NO: 768799 - DNA, 16 bp, Homo sapiens
attttaagaggctttg

SEQ ID NO: 768800 - DNA, 22 bp, Homo sapiens
attttaagccatctcagattct

SEQ ID NO: 768801 - DNA, 23 bp, Homo sapiens
attttaagccatctcagattctg

SEQ ID NO: 768802 - DNA, 17 bp, Homo sapiens
attttaagccttcattt

SEQ ID NO: 768803 - DNA, 18 bp, Homo sapiens
attttaagccttcatttg

SEQ ID NO: 768804 - DNA, 19 bp, Homo sapiens
attttaagccttcatttgc

SEQ ID NO: 768805 - DNA, 18 bp, Homo sapiens
attttaagggggaaaact

SEQ ID NO: 768806 - DNA, 19 bp, Homo sapiens
attttaagtattgcatctg

SEQ ID NO: 768807 - DNA, 22 bp, Homo sapiens
attttaagtattgcatctgtat

SEQ ID NO: 768808 - DNA, 12 bp, Homo sapiens
attttaagtgct

SEQ ID NO: 768809 - DNA, 15 bp, Homo sapiens
attttaagtgcttca

SEQ ID NO: 768810 - DNA, 14 bp, Homo sapiens
attttaagtgcttt

SEQ ID NO: 768811 - DNA, 13 bp, Homo sapiens
attttaatacaag

SEQ ID NO: 768812 - DNA, 12 bp, Homo sapiens
attttaatacat

SEQ ID NO: 768813 - DNA, 16 bp, Homo sapiens
attttaatagaatttt

SEQ ID NO: 768814 - DNA, 13 bp, Homo sapiens
attttaatcccct

SEQ ID NO: 768815 - DNA, 23 bp, Homo sapiens
attttaatgaagaaagtggaaaa

SEQ ID NO: 768816 - DNA, 17 bp, Homo sapiens
attttaatgatggtgtt

SEQ ID NO: 768817 - DNA, 22 bp, Homo sapiens
attttaatgcagttgcttacta

SEQ ID NO: 768818 - DNA, 18 bp, Homo sapiens
attttaatgctgtttcta

SEQ ID NO: 768819 - DNA, 19 bp, Homo sapiens
attttaatgctgtttctaa

SEQ ID NO: 768820 - DNA, 16 bp, Homo sapiens
attttaatgtatattt

SEQ ID NO: 768821 - DNA, 20 bp, Homo sapiens
attttaatgtatatttgctg

SEQ ID NO: 768822 - DNA, 21 bp, Homo sapiens
attttaatgtatatttgctgc

SEQ ID NO: 768823 - DNA, 13 bp, Homo sapiens
attttaatgtgaa

SEQ ID NO: 768824 - DNA, 14 bp, Homo sapiens
attttaatgtgaag

SEQ ID NO: 768825 - DNA, 15 bp, Homo sapiens
attttaatgtgaaga

SEQ ID NO: 768826 - DNA, 21 bp, Homo sapiens
attttaatgtgaagacatttt

SEQ ID NO: 768827 - DNA, 20 bp, Homo sapiens
attttaattactgctataaa

SEQ ID NO: 768828 - DNA, 23 bp, Homo sapiens
attttaattattattcttcataa

SEQ ID NO: 768829 - DNA, 24 bp, Homo sapiens
attttaattcatcccaactgtctt

SEQ ID NO: 768830 - DNA, 15 bp, Homo sapiens
attttaatttctaca

SEQ ID NO: 768831 - DNA, 19 bp, Homo sapiens
attttaatttttgctttta

SEQ ID NO: 768832 - DNA, 13 bp, Homo sapiens
attttacaattga

SEQ ID NO: 768833 - DNA, 17 bp, Homo sapiens
attttacaattgaaatg

SEQ ID NO: 768834 - DNA, 12 bp, Homo sapiens
attttacaattt

SEQ ID NO: 768835 - DNA, 13 bp, Homo sapiens
attttacacatta

SEQ ID NO: 768836 - DNA, 18 bp, Homo sapiens
attttacagctcattaaa

SEQ ID NO: 768837 - DNA, 22 bp, Homo sapiens
attttacagctcattaaacttt

SEQ ID NO: 768838 - DNA, 19 bp, Homo sapiens
attttacatttagagtatt

SEQ ID NO: 768839 - DNA, 14 bp, Homo sapiens
attttacatttcta

SEQ ID NO: 768840 - DNA, 13 bp, Homo sapiens
attttaccaaagc

SEQ ID NO: 768841 - DNA, 15 bp, Homo sapiens
attttaccaaagcat

SEQ ID NO: 768842 - DNA, 16 bp, Homo sapiens
attttaccaaagcatc

SEQ ID NO: 768843 - DNA, 18 bp, Homo sapiens
attttaccaaagcatcaa

SEQ ID NO: 768844 - DNA, 19 bp, Homo sapiens
attttacctagctaattat

SEQ ID NO: 768845 - DNA, 22 bp, Homo sapiens
attttacctagctaattattta

SEQ ID NO: 768846 - DNA, 19 bp, Homo sapiens
attttactcagaatagctg

SEQ ID NO: 768847 - DNA, 18 bp, Homo sapiens
attttagaaactacaaat

SEQ ID NO: 768848 - DNA, 20 bp, Homo sapiens
attttagaaactacaaatat

SEQ ID NO: 768849 - DNA, 17 bp, Homo sapiens
attttagaaatattcac

SEQ ID NO: 768850 - DNA, 19 bp, Homo sapiens
attttagacttaccttgaa

SEQ ID NO: 768851 - DNA, 23 bp, Homo sapiens
attttagatgttattatgctaat

SEQ ID NO: 768852 - DNA, 19 bp, Homo sapiens
attttagcagttctgcaaa

SEQ ID NO: 768853 - DNA, 21 bp, Homo sapiens
attttagcagttctgcaaata

SEQ ID NO: 768854 - DNA, 16 bp, Homo sapiens
attttagcctcttccc

SEQ ID NO: 768855 - DNA, 18 bp, Homo sapiens
attttagcgtgctcactg

SEQ ID NO: 768856 - DNA, 18 bp, Homo sapiens
attttagctggtgtcagc

SEQ ID NO: 768857 - DNA, 20 bp, Homo sapiens
attttagcttcagttgttct

SEQ ID NO: 768858 - DNA, 21 bp, Homo sapiens
attttagcttcagttgttctt

SEQ ID NO: 768859 - DNA, 19 bp, Homo sapiens
attttaggaacttcagaga

SEQ ID NO: 768860 - DNA, 18 bp, Homo sapiens
attttaggaataataaat

SEQ ID NO: 768861 - DNA, 19 bp, Homo sapiens
attttaggaataataaatt

SEQ ID NO: 768862 - DNA, 18 bp, Homo sapiens
attttagggctgtagact

SEQ ID NO: 768863 - DNA, 16 bp, Homo sapiens
attttaggtgttgatt

SEQ ID NO: 768864 - DNA, 23 bp, Homo sapiens
attttaggtgttgattttctgtt

SEQ ID NO: 768865 - DNA, 17 bp, Homo sapiens
attttagtaatttccta

SEQ ID NO: 768866 - DNA, 20 bp, Homo sapiens
attttagtattcattctgca

SEQ ID NO: 768867 - DNA, 19 bp, Homo sapiens
attttagtcactaagactt

SEQ ID NO: 768868 - DNA, 15 bp, Homo sapiens
attttagtgactgta

SEQ ID NO: 768869 - DNA, 18 bp, Homo sapiens
cctgggacacagacccag

SEQ ID NO: 768870 - DNA, 20 bp, Homo sapiens
cctgggacacagacccagga

SEQ ID NO: 768871 - DNA, 23 bp, Homo sapiens
cctgggacacttccctgggcctc

SEQ ID NO: 768872 - DNA, 23 bp, Homo sapiens
cctgggacccagctactctgtcc

SEQ ID NO: 768873 - DNA, 16 bp, Homo sapiens
cctgggaccccctcgc

SEQ ID NO: 768874 - DNA, 16 bp, Homo sapiens
attttataagaaaaac

SEQ ID NO: 768875 - DNA, 12 bp, Homo sapiens
attttatacaat

SEQ ID NO: 768876 - DNA, 21 bp, Homo sapiens
attttatactgtacatgctat

SEQ ID NO: 768877 - DNA, 19 bp, Homo sapiens
attttatagctcagtttat

SEQ ID NO: 768878 - DNA, 21 bp, Homo sapiens
attttatataaagtattcttt

SEQ ID NO: 768879 - DNA, 19 bp, Homo sapiens
attttatatcatacagttt

SEQ ID NO: 768880 - DNA, 13 bp, Homo sapiens
attttatatgaga

SEQ ID NO: 768881 - DNA, 14 bp, Homo sapiens
attttatatgtaaa

SEQ ID NO: 768882 - DNA, 16 bp, Homo sapiens
attttatatgtaaatg

SEQ ID NO: 768883 - DNA, 21 bp, Homo sapiens
attttatatgtaaatgtgtta

SEQ ID NO: 768884 - DNA, 15 bp, Homo sapiens
attttatattacact

SEQ ID NO: 768885 - DNA, 18 bp, Homo sapiens
attttatattttctattt

SEQ ID NO: 768886 - DNA, 15 bp, Homo sapiens
attttatatttttgt

SEQ ID NO: 768887 - DNA, 18 bp, Homo sapiens
attttatatttttgtaca

SEQ ID NO: 768888 - DNA, 12 bp, Homo sapiens
attttatcatta

SEQ ID NO: 768889 - DNA, 13 bp, Homo sapiens
attttatctgtga

SEQ ID NO: 768890 - DNA, 21 bp, Homo sapiens
attttatgaaaggtttacatt

SEQ ID NO: 768891 - DNA, 20 bp, Homo sapiens
attttatgaacattgtactg

SEQ ID NO: 768892 - DNA, 19 bp, Homo sapiens
attttatgaatatcattga

SEQ ID NO: 768893 - DNA, 15 bp, Homo sapiens
attttatgagacagg

SEQ ID NO: 768894 - DNA, 22 bp, Homo sapiens
attttatggttatgtttttctg

SEQ ID NO: 768895 - DNA, 18 bp, Homo sapiens
attttattactgtttatt

SEQ ID NO: 768896 - DNA, 13 bp, Homo sapiens
attttattgaaat

SEQ ID NO: 768897 - DNA, 16 bp, Homo sapiens
attttattgaaatgta

SEQ ID NO: 768898 - DNA, 11 bp, Homo sapiens
attttatttat

SEQ ID NO: 768899 - DNA, 13 bp, Homo sapiens
attttatttgctt

SEQ ID NO: 768900 - DNA, 18 bp, Homo sapiens
attttattttattatgca

SEQ ID NO: 768901 - DNA, 21 bp, Homo sapiens
attttattttgtgctcattta

SEQ ID NO: 768902 - DNA, 15 bp, Homo sapiens
attttatttttatta

SEQ ID NO: 768903 - DNA, 20 bp, Homo sapiens
attttatttttattactttt

SEQ ID NO: 768904 - DNA, 21 bp, Homo sapiens
attttatttttattacttttt

SEQ ID NO: 768905 - DNA, 17 bp, Homo sapiens
attttatttttgcaaaa

SEQ ID NO: 768906 - DNA, 16 bp, Homo sapiens
attttattttttgggc

SEQ ID NO: 768907 - DNA, 23 bp, Homo sapiens
attttattttttgggccattacc

SEQ ID NO: 768908 - DNA, 16 bp, Homo sapiens
attttattttttgtga

SEQ ID NO: 768909 - DNA, 13 bp, Homo sapiens
attttcaaaagat

SEQ ID NO: 768910 - DNA, 11 bp, Homo sapiens
attttcaaaga

SEQ ID NO: 768911 - DNA, 16 bp, Homo sapiens
attttcaaagagatgg

SEQ ID NO: 768912 - DNA, 14 bp, Homo sapiens
attttcaaatcctt

SEQ ID NO: 768913 - DNA, 18 bp, Homo sapiens
attttcaacaacatcaga

SEQ ID NO: 768914 - DNA, 17 bp, Homo sapiens
attttcaagaaactgag

SEQ ID NO: 768915 - DNA, 23 bp, Homo sapiens
attttcaagaaactgaggaattt

SEQ ID NO: 768916 - DNA, 15 bp, Homo sapiens
attttcaagattcta

SEQ ID NO: 768917 - DNA, 18 bp, Homo sapiens
attttcaagattctaaag

SEQ ID NO: 768918 - DNA, 20 bp, Homo sapiens
attttcaagattctaaagct

SEQ ID NO: 768919 - DNA, 15 bp, Homo sapiens
attttcaagctttca

SEQ ID NO: 768920 - DNA, 20 bp, Homo sapiens
attttcaaggccctcagcat

SEQ ID NO: 768921 - DNA, 13 bp, Homo sapiens
attttcaaggcct

SEQ ID NO: 768922 - DNA, 14 bp, Homo sapiens
attttcaaggcctt

SEQ ID NO: 768923 - DNA, 15 bp, Homo sapiens
attttcaaggccttc

SEQ ID NO: 768924 - DNA, 18 bp, Homo sapiens
attttcaaggccttcagt

SEQ ID NO: 768925 - DNA, 16 bp, Homo sapiens
attttcaagtaattgt

SEQ ID NO: 768926 - DNA, 13 bp, Homo sapiens
attttcaagttta

SEQ ID NO: 768927 - DNA, 16 bp, Homo sapiens
attttcaatagccact

SEQ ID NO: 768928 - DNA, 20 bp, Homo sapiens
attttcaatagccactaacc

SEQ ID NO: 768929 - DNA, 15 bp, Homo sapiens
attttcacattcttg

SEQ ID NO: 768930 - DNA, 19 bp, Homo sapiens
attttcacattcttggctt

SEQ ID NO: 768931 - DNA, 14 bp, Homo sapiens
attttcaccgagca

SEQ ID NO: 768932 - DNA, 12 bp, Homo sapiens
attttcagaccc

SEQ ID NO: 768933 - DNA, 16 bp, Homo sapiens
attttcagcaaagaat

SEQ ID NO: 768934 - DNA, 19 bp, Homo sapiens
attttcagcattaagctgt

SEQ ID NO: 768935 - DNA, 11 bp, Homo sapiens
attttcagtat

SEQ ID NO: 768936 - DNA, 19 bp, Homo sapiens
attttcagtataatttaac

SEQ ID NO: 768937 - DNA, 23 bp, Homo sapiens
attttcagtatactgtgtgggat

SEQ ID NO: 768938 - DNA, 12 bp, Homo sapiens
attttcagtatt

SEQ ID NO: 768939 - DNA, 12 bp, Homo sapiens
attttcagtccc

SEQ ID NO: 768940 - DNA, 20 bp, Homo sapiens
attttcagtcccctctctct

SEQ ID NO: 768941 - DNA, 16 bp, Homo sapiens
attttcagtcttgtag

SEQ ID NO: 768942 - DNA, 15 bp, Homo sapiens
attttcagtgcatca

SEQ ID NO: 768943 - DNA, 16 bp, Homo sapiens
attttcagtgcatcat

SEQ ID NO: 768944 - DNA, 18 bp, Homo sapiens
attttcagtgcatcatta

SEQ ID NO: 768945 - DNA, 11 bp, Homo sapiens
attttcatagt

SEQ ID NO: 768946 - DNA, 14 bp, Homo sapiens
attttcatcactgg

SEQ ID NO: 768947 - DNA, 12 bp, Homo sapiens
attttcatcccg

SEQ ID NO: 768948 - DNA, 17 bp, Homo sapiens
attttcatgaatgtgct

SEQ ID NO: 768949 - DNA, 11 bp, Homo sapiens
attttcatgtg

SEQ ID NO: 768950 - DNA, 15 bp, Homo sapiens
attttcatgttgatg

SEQ ID NO: 768951 - DNA, 15 bp, Homo sapiens
attttcattaaactt

SEQ ID NO: 768952 - DNA, 12 bp, Homo sapiens
attttcattgtg

SEQ ID NO: 768953 - DNA, 13 bp, Homo sapiens
attttcatttgta

SEQ ID NO: 768954 - DNA, 14 bp, Homo sapiens
attttcatttgtac

SEQ ID NO: 768955 - DNA, 14 bp, Homo sapiens
attttccaaagagt

SEQ ID NO: 768956 - DNA, 20 bp, Homo sapiens
attttccacaagattcccag

SEQ ID NO: 768957 - DNA, 23 bp, Homo sapiens
attttccacaagattcccagaga

SEQ ID NO: 768958 - DNA, 15 bp, Homo sapiens
attttccacggaaac

SEQ ID NO: 768959 - DNA, 20 bp, Homo sapiens
attttccagccttatgtgtt

SEQ ID NO: 768960 - DNA, 22 bp, Homo sapiens
attttcccactcattctgaatt

SEQ ID NO: 768961 - DNA, 18 bp, Homo sapiens
attttcccatcatccttt

SEQ ID NO: 768962 - DNA, 16 bp, Homo sapiens
attttccccaatacag

SEQ ID NO: 768963 - DNA, 20 bp, Homo sapiens
attttccccccactctcccc

SEQ ID NO: 768964 - DNA, 20 bp, Homo sapiens
attttcccccttttctgcat

SEQ ID NO: 768965 - DNA, 22 bp, Homo sapiens
attttcccccttttctgcattt

SEQ ID NO: 768966 - DNA, 23 bp, Homo sapiens
attttccccgtgacattcactgg

SEQ ID NO: 768967 - DNA, 18 bp, Homo sapiens
attttcctaatgtgatca

SEQ ID NO: 768968 - DNA, 12 bp, Homo sapiens
attttcctctga

SEQ ID NO: 768969 - DNA, 13 bp, Homo sapiens
attttcctggatt

SEQ ID NO: 768970 - DNA, 17 bp, Homo sapiens
attttcctggatttata

SEQ ID NO: 768971 - DNA, 22 bp, Homo sapiens
attttcctggatttatagtatg

SEQ ID NO: 768972 - DNA, 17 bp, Homo sapiens
attttcctgttcagtga

SEQ ID NO: 768973 - DNA, 20 bp, Homo sapiens
attttcctgttcagtgagat

SEQ ID NO: 768974 - DNA, 17 bp, Homo sapiens
attttcctgtttactga

SEQ ID NO: 768975 - DNA, 19 bp, Homo sapiens
attttcctgtttactgatt

SEQ ID NO: 768976 - DNA, 13 bp, Homo sapiens
attttccttgctt

SEQ ID NO: 768977 - DNA, 17 bp, Homo sapiens
attttccttgcttttct

SEQ ID NO: 768978 - DNA, 18 bp, Homo sapiens
attttctacgtcatgtat

SEQ ID NO: 768979 - DNA, 16 bp, Homo sapiens
attttctagatacaat

SEQ ID NO: 768980 - DNA, 19 bp, Homo sapiens
attttctagatacaataaa

SEQ ID NO: 768981 - DNA, 20 bp, Homo sapiens
attttctattgttactctgg

SEQ ID NO: 768982 - DNA, 20 bp, Homo sapiens
attttctatttctctgtgta

SEQ ID NO: 768983 - DNA, 16 bp, Homo sapiens
attttctattttaaga

SEQ ID NO: 768984 - DNA, 15 bp, Homo sapiens
attttctcccaggaa

SEQ ID NO: 768985 - DNA, 17 bp, Homo sapiens
attttctcccaggaagc

SEQ ID NO: 768986 - DNA, 15 bp, Homo sapiens
attttctctggaaat

SEQ ID NO: 768987 - DNA, 14 bp, Homo sapiens
attttctctgtatg

SEQ ID NO: 768988 - DNA, 23 bp, Homo sapiens
attttctctgtatgaatgtgatt

SEQ ID NO: 768989 - DNA, 18 bp, Homo sapiens
attttctggaatacatga

SEQ ID NO: 768990 - DNA, 17 bp, Homo sapiens
attttctggtagataga

SEQ ID NO: 768991 - DNA, 13 bp, Homo sapiens
attttctgtcaga

SEQ ID NO: 768992 - DNA, 17 bp, Homo sapiens
cctggggcctggacctg

SEQ ID NO: 768993 - DNA, 14 bp, Homo sapiens
cctggggctccctc

SEQ ID NO: 768994 - DNA, 14 bp, Homo sapiens
cctggggctccctt

SEQ ID NO: 768995 - DNA, 15 bp, Homo sapiens
cctggggctcctttc

SEQ ID NO: 768996 - DNA, 17 bp, Homo sapiens
cctggggctctctgacc

SEQ ID NO: 768997 - DNA, 17 bp, Homo sapiens
cctgggggaagccctgg

SEQ ID NO: 768998 - DNA, 18 bp, Homo sapiens
cctgggggaagccctgga

SEQ ID NO: 768999 - DNA, 19 bp, Homo sapiens
cctgggggaagccctggat

SEQ ID NO: 769000 - DNA, 13 bp, Homo sapiens
cctgggggacctt

SEQ ID NO: 769001 - DNA, 17 bp, Homo sapiens
cctgggggagccgacca

SEQ ID NO: 769002 - DNA, 19 bp, Homo sapiens
cctgggggcagtgactggc

SEQ ID NO: 769003 - DNA, 23 bp, Homo sapiens
attttctttctttttctggaaat

SEQ ID NO: 769004 - DNA, 15 bp, Homo sapiens
attttctttgggggt

SEQ ID NO: 769005 - DNA, 16 bp, Homo sapiens
attttcttttaagcat

SEQ ID NO: 769006 - DNA, 19 bp, Homo sapiens
attttcttttgtaaatgtt

SEQ ID NO: 769007 - DNA, 16 bp, Homo sapiens
attttgaaaaagagaa

SEQ ID NO: 769008 - DNA, 14 bp, Homo sapiens
attttgaaaagtat

SEQ ID NO: 769009 - DNA, 20 bp, Homo sapiens
attttgaaagtctgtccttg

SEQ ID NO: 769010 - DNA, 15 bp, Homo sapiens
attttgaaatgtggt

SEQ ID NO: 769011 - DNA, 13 bp, Homo sapiens
attttgaagtgct

SEQ ID NO: 769012 - DNA, 14 bp, Homo sapiens
attttgaataccat

SEQ ID NO: 769013 - DNA, 15 bp, Homo sapiens
attttgaataccatt

SEQ ID NO: 769014 - DNA, 11 bp, Homo sapiens
attttgaatca

SEQ ID NO: 769015 - DNA, 15 bp, Homo sapiens
attttgaatcaataa

SEQ ID NO: 769016 - DNA, 15 bp, Homo sapiens
attttgaatgtcaca

SEQ ID NO: 769017 - DNA, 22 bp, Homo sapiens
attttgaatgtcacaaattgat

SEQ ID NO: 769018 - DNA, 19 bp, Homo sapiens
attttgacttaatgtgatt

SEQ ID NO: 769019 - DNA, 21 bp, Homo sapiens
attttgagctgaaatgctgca

SEQ ID NO: 769020 - DNA, 15 bp, Homo sapiens
attttgagtattcca

SEQ ID NO: 769021 - DNA, 19 bp, Homo sapiens
attttgagtcctaggactt

SEQ ID NO: 769022 - DNA, 13 bp, Homo sapiens
attttgagtgact

SEQ ID NO: 769023 - DNA, 20 bp, Homo sapiens
attttgatataatctttcaa

SEQ ID NO: 769024 - DNA, 16 bp, Homo sapiens
attttgatatacattg

SEQ ID NO: 769025 - DNA, 21 bp, Homo sapiens
attttgatcactgcattttgt

SEQ ID NO: 769026 - DNA, 16 bp, Homo sapiens
attttgatgcagataa

SEQ ID NO: 769027 - DNA, 14 bp, Homo sapiens
attttgcaaaattt

SEQ ID NO: 769028 - DNA, 15 bp, Homo sapiens
attttgcaaaatttc

SEQ ID NO: 769029 - DNA, 16 bp, Homo sapiens
attttgcaaagattta

SEQ ID NO: 769030 - DNA, 21 bp, Homo sapiens
attttgcagaaggaaatgatg

SEQ ID NO: 769031 - DNA, 12 bp, Homo sapiens
attttgcagcag

SEQ ID NO: 769032 - DNA, 15 bp, Homo sapiens
attttgcagcagtga

SEQ ID NO: 769033 - DNA, 16 bp, Homo sapiens
attttgcagcagtgag

SEQ ID NO: 769034 - DNA, 16 bp, Homo sapiens
attttgcattccagaa

SEQ ID NO: 769035 - DNA, 19 bp, Homo sapiens
attttgcattccagaatct

SEQ ID NO: 769036 - DNA, 13 bp, Homo sapiens
attttgccctcct

SEQ ID NO: 769037 - DNA, 13 bp, Homo sapiens
attttgcctttaa

SEQ ID NO: 769038 - DNA, 23 bp, Homo sapiens
attttgctattgtaaatatgttt

SEQ ID NO: 769039 - DNA, 14 bp, Homo sapiens
attttgctgagttg

SEQ ID NO: 769040 - DNA, 20 bp, Homo sapiens
attttgctgagttgttctaa

SEQ ID NO: 769041 - DNA, 18 bp, Homo sapiens
attttgctgcttgatgat

SEQ ID NO: 769042 - DNA, 20 bp, Homo sapiens
attttgctgcttgatgatga

SEQ ID NO: 769043 - DNA, 12 bp, Homo sapiens
attttgctttgt

SEQ ID NO: 769044 - DNA, 20 bp, Homo sapiens
attttggaaaataaattatt

SEQ ID NO: 769045 - DNA, 22 bp, Homo sapiens
attttggaataatttctattaa

SEQ ID NO: 769046 - DNA, 18 bp, Homo sapiens
attttggaatatttgctt

SEQ ID NO: 769047 - DNA, 11 bp, Homo sapiens
attttggaatt

SEQ ID NO: 769048 - DNA, 13 bp, Homo sapiens
attttggaattgg

SEQ ID NO: 769049 - DNA, 19 bp, Homo sapiens
attttggaattggtgtata

SEQ ID NO: 769050 - DNA, 20 bp, Homo sapiens
attttggaattggtgtatat

SEQ ID NO: 769051 - DNA, 20 bp, Homo sapiens
attttggatttttacacaac

SEQ ID NO: 769052 - DNA, 21 bp, Homo sapiens
attttggcgaatctcaaaatt

SEQ ID NO: 769053 - DNA, 16 bp, Homo sapiens
attttggcttcatttc

SEQ ID NO: 769054 - DNA, 21 bp, Homo sapiens
attttggcttcatttcaatca

SEQ ID NO: 769055 - DNA, 17 bp, Homo sapiens
attttggctttctccct

SEQ ID NO: 769056 - DNA, 20 bp, Homo sapiens
attttggggttgtgttgtca

SEQ ID NO: 769057 - DNA, 19 bp, Homo sapiens
attttgggttttgggtctt

SEQ ID NO: 769058 - DNA, 22 bp, Homo sapiens
attttggtaaaatacttcttga

SEQ ID NO: 769059 - DNA, 20 bp, Homo sapiens
attttggtattacactgtat

SEQ ID NO: 769060 - DNA, 18 bp, Homo sapiens
attttggtccaagttgtg

SEQ ID NO: 769061 - DNA, 15 bp, Homo sapiens
attttggtctgtttt

SEQ ID NO: 769062 - DNA, 14 bp, Homo sapiens
attttggtgagaaa

SEQ ID NO: 769063 - DNA, 16 bp, Homo sapiens
attttggtgagaaatg

SEQ ID NO: 769064 - DNA, 20 bp, Homo sapiens
attttggtgcacaaatacaa

SEQ ID NO: 769065 - DNA, 22 bp, Homo sapiens
attttggttgaagacaccagac

SEQ ID NO: 769066 - DNA, 13 bp, Homo sapiens
attttgtaaaata

SEQ ID NO: 769067 - DNA, 14 bp, Homo sapiens
attttgtaaaatgt

SEQ ID NO: 769068 - DNA, 19 bp, Homo sapiens
attttgtaaactcaaaata

SEQ ID NO: 769069 - DNA, 17 bp, Homo sapiens
attttgtaagaaggcaa

SEQ ID NO: 769070 - DNA, 21 bp, Homo sapiens
attttgtaagaaggcaatatt

SEQ ID NO: 769071 - DNA, 12 bp, Homo sapiens
attttgtaagtt

SEQ ID NO: 769072 - DNA, 14 bp, Homo sapiens
attttgtaataata

SEQ ID NO: 769073 - DNA, 17 bp, Homo sapiens
attttgtaatattctgt

SEQ ID NO: 769074 - DNA, 20 bp, Homo sapiens
attttgtaatattctgtttt

SEQ ID NO: 769075 - DNA, 16 bp, Homo sapiens
attttgtaatgaattc

SEQ ID NO: 769076 - DNA, 17 bp, Homo sapiens
attttgtaattcttatg

SEQ ID NO: 769077 - DNA, 20 bp, Homo sapiens
attttgtacaaatttgttat

SEQ ID NO: 769078 - DNA, 18 bp, Homo sapiens
attttgtacgtatgaatg

SEQ ID NO: 769079 - DNA, 21 bp, Homo sapiens
attttgtatctgcaggcagac

SEQ ID NO: 769080 - DNA, 23 bp, Homo sapiens
attttgtatctgcaggcagacac

SEQ ID NO: 769081 - DNA, 14 bp, Homo sapiens
attttgtatgaaat

SEQ ID NO: 769082 - DNA, 22 bp, Homo sapiens
attttgtatgtaaataccaaga

SEQ ID NO: 769083 - DNA, 10 bp, Homo sapiens
attttgtatt

SEQ ID NO: 769084 - DNA, 18 bp, Homo sapiens
attttgtattttcaactt

SEQ ID NO: 769085 - DNA, 22 bp, Homo sapiens
attttgtattttcaactttata

SEQ ID NO: 769086 - DNA, 20 bp, Homo sapiens
attttgtccaagttcacagt

SEQ ID NO: 769087 - DNA, 19 bp, Homo sapiens
attttgtccattttaaaaa

SEQ ID NO: 769088 - DNA, 17 bp, Homo sapiens
attttgtcttattctta

SEQ ID NO: 769089 - DNA, 18 bp, Homo sapiens
attttgtcttattcttaa

SEQ ID NO: 769090 - DNA, 20 bp, Homo sapiens
attttgtgatgatgctgtga

SEQ ID NO: 769091 - DNA, 22 bp, Homo sapiens
attttgtgatgatgctgtgaca

SEQ ID NO: 769092 - DNA, 13 bp, Homo sapiens
attttgtgcattc

SEQ ID NO: 769093 - DNA, 15 bp, Homo sapiens
attttgtgcattctt

SEQ ID NO: 769094 - DNA, 17 bp, Homo sapiens
attttgtgcattctttg

SEQ ID NO: 769095 - DNA, 15 bp, Homo sapiens
attttgtggttctat

SEQ ID NO: 769096 - DNA, 18 bp, Homo sapiens
attttgtggttctatttt

SEQ ID NO: 769097 - DNA, 21 bp, Homo sapiens
attttgtggttctattttact

SEQ ID NO: 769098 - DNA, 20 bp, Homo sapiens
attttgtgtaagaaatacag

SEQ ID NO: 769099 - DNA, 21 bp, Homo sapiens
attttgtgtcctccaggagct

SEQ ID NO: 769100 - DNA, 20 bp, Homo sapiens
attttgtgtgaccaactgtg

SEQ ID NO: 769101 - DNA, 22 bp, Homo sapiens
attttgtgtgaccaactgtgtt

SEQ ID NO: 769102 - DNA, 15 bp, Homo sapiens
attttgttaaaatct

SEQ ID NO: 769103 - DNA, 14 bp, Homo sapiens
attttgttaagaag

SEQ ID NO: 769104 - DNA, 22 bp, Homo sapiens
attttgttatagaatacttttt

SEQ ID NO: 769105 - DNA, 18 bp, Homo sapiens
attttgttctagttttca

SEQ ID NO: 769106 - DNA, 16 bp, Homo sapiens
attttgttctctggga

SEQ ID NO: 769107 - DNA, 21 bp, Homo sapiens
attttgttctctgggagaaaa

SEQ ID NO: 769108 - DNA, 23 bp, Homo sapiens
attttgttgctgttttgatttgt

SEQ ID NO: 769109 - DNA, 12 bp, Homo sapiens
attttgtttaca

SEQ ID NO: 769110 - DNA, 13 bp, Homo sapiens
attttgtttcaaa

SEQ ID NO: 769111 - DNA, 17 bp, Homo sapiens
attttgttttacttttt

SEQ ID NO: 769112 - DNA, 16 bp, Homo sapiens
attttgttttgttgga

SEQ ID NO: 769113 - DNA, 14 bp, Homo sapiens
atttttaaaaaata

SEQ ID NO: 769114 - DNA, 13 bp, Homo sapiens
cctgtaagaaaaa

SEQ ID NO: 769115 - DNA, 14 bp, Homo sapiens
cctgtaagcctgca

SEQ ID NO: 769116 - DNA, 16 bp, Homo sapiens
cctgtaagcctgcaag

SEQ ID NO: 769117 - DNA, 19 bp, Homo sapiens
cctgtaaggtttcaatgca

SEQ ID NO: 769118 - DNA, 14 bp, Homo sapiens
cctgtaatcccagc

SEQ ID NO: 769119 - DNA, 17 bp, Homo sapiens
cctgtaatcccagcact

SEQ ID NO: 769120 - DNA, 20 bp, Homo sapiens
cctgtaatcccagcactttg

SEQ ID NO: 769121 - DNA, 15 bp, Homo sapiens
cctgtaatctttttc

SEQ ID NO: 769122 - DNA, 23 bp, Homo sapiens
cctgtaattgttgtttgtatgta

SEQ ID NO: 769123 - DNA, 17 bp, Homo sapiens
cctgtacacaactcact

SEQ ID NO: 769124 - DNA, 12 bp, Homo sapiens
cctgtacactga

SEQ ID NO: 769125 - DNA, 15 bp, Homo sapiens
cctgtacagtgaatg

SEQ ID NO: 769126 - DNA, 12 bp, Homo sapiens
cctgtacattct

SEQ ID NO: 769127 - DNA, 13 bp, Homo sapiens
cctgtacccaccc

SEQ ID NO: 769128 - DNA, 15 bp, Homo sapiens
cctgtacccacccca

SEQ ID NO: 769129 - DNA, 19 bp, Homo sapiens
cctgtacccaccccagcac

SEQ ID NO: 769130 - DNA, 14 bp, Homo sapiens
cctgtaccccagca

SEQ ID NO: 769131 - DNA, 16 bp, Homo sapiens
atttttaagtgctgca

SEQ ID NO: 769132 - DNA, 14 bp, Homo sapiens
atttttaatttaaa

SEQ ID NO: 769133 - DNA, 14 bp, Homo sapiens
atttttacaaaact

SEQ ID NO: 769134 - DNA, 17 bp, Homo sapiens
atttttacaaataggta

SEQ ID NO: 769135 - DNA, 13 bp, Homo sapiens
atttttacactat

SEQ ID NO: 769136 - DNA, 16 bp, Homo sapiens
atttttacactattgt

SEQ ID NO: 769137 - DNA, 19 bp, Homo sapiens
atttttacactattgtgaa

SEQ ID NO: 769138 - DNA, 21 bp, Homo sapiens
atttttacgtagaagctcttg

SEQ ID NO: 769139 - DNA, 15 bp, Homo sapiens
atttttactattgaa

SEQ ID NO: 769140 - DNA, 18 bp, Homo sapiens
atttttactcagtgactg

SEQ ID NO: 769141 - DNA, 22 bp, Homo sapiens
atttttagaataagaatttgca

SEQ ID NO: 769142 - DNA, 24 bp, Homo sapiens
atttttagaataagaatttgcata

SEQ ID NO: 769143 - DNA, 21 bp, Homo sapiens
atttttagatagttagaacct

SEQ ID NO: 769144 - DNA, 13 bp, Homo sapiens
atttttagtagag

SEQ ID NO: 769145 - DNA, 21 bp, Homo sapiens
atttttataattaaagatgcc

SEQ ID NO: 769146 - DNA, 23 bp, Homo sapiens
atttttataattaaagatgccat

SEQ ID NO: 769147 - DNA, 20 bp, Homo sapiens
atttttatactttattgaaa

SEQ ID NO: 769148 - DNA, 17 bp, Homo sapiens
atttttataggaataga

SEQ ID NO: 769149 - DNA, 21 bp, Homo sapiens
atttttatataatatctaaag

SEQ ID NO: 769150 - DNA, 18 bp, Homo sapiens
atttttatatcagcctga

SEQ ID NO: 769151 - DNA, 20 bp, Homo sapiens
atttttatatcagcctgagt

SEQ ID NO: 769152 - DNA, 19 bp, Homo sapiens
atttttatatcatgcaaaa

SEQ ID NO: 769153 - DNA, 22 bp, Homo sapiens
atttttatatcatgcaaaatat

SEQ ID NO: 769154 - DNA, 22 bp, Homo sapiens
atttttatatctatatgtactt

SEQ ID NO: 769155 - DNA, 16 bp, Homo sapiens
atttttatatttcctt

SEQ ID NO: 769156 - DNA, 17 bp, Homo sapiens
atttttatatttccttt

SEQ ID NO: 769157 - DNA, 18 bp, Homo sapiens
atttttatccatttcttt

SEQ ID NO: 769158 - DNA, 15 bp, Homo sapiens
atttttatctatata

SEQ ID NO: 769159 - DNA, 19 bp, Homo sapiens
atttttatctatataaaat

SEQ ID NO: 769160 - DNA, 17 bp, Homo sapiens
atttttatgcagacagt

SEQ ID NO: 769161 - DNA, 16 bp, Homo sapiens
atttttatgtgcagcg

SEQ ID NO: 769162 - DNA, 16 bp, Homo sapiens
atttttatgttttctt

SEQ ID NO: 769163 - DNA, 16 bp, Homo sapiens
atttttattaaattat

SEQ ID NO: 769164 - DNA, 12 bp, Homo sapiens
atttttattact

SEQ ID NO: 769165 - DNA, 21 bp, Homo sapiens
atttttatttctttttaatta

SEQ ID NO: 769166 - DNA, 14 bp, Homo sapiens
atttttatttttga

SEQ ID NO: 769167 - DNA, 14 bp, Homo sapiens
atttttcaaataga

SEQ ID NO: 769168 - DNA, 12 bp, Homo sapiens
atttttcaaggc

SEQ ID NO: 769169 - DNA, 17 bp, Homo sapiens
atttttcaataataaaa

SEQ ID NO: 769170 - DNA, 20 bp, Homo sapiens
atttttcaatagcacatatg

SEQ ID NO: 769171 - DNA, 22 bp, Homo sapiens
atttttcaatagcacatatgga

SEQ ID NO: 769172 - DNA, 14 bp, Homo sapiens
atttttcaatatat

SEQ ID NO: 769173 - DNA, 18 bp, Homo sapiens
atttttcaatatattgaa

SEQ ID NO: 769174 - DNA, 22 bp, Homo sapiens
atttttcactctaagtcatgta

SEQ ID NO: 769175 - DNA, 17 bp, Homo sapiens
atttttcactgtacatt

SEQ ID NO: 769176 - DNA, 15 bp, Homo sapiens
atttttcagaaaaat

SEQ ID NO: 769177 - DNA, 16 bp, Homo sapiens
atttttcagatataaa

SEQ ID NO: 769178 - DNA, 16 bp, Homo sapiens
atttttcagttccaag

SEQ ID NO: 769179 - DNA, 12 bp, Homo sapiens
atttttcataga

SEQ ID NO: 769180 - DNA, 19 bp, Homo sapiens
atttttcatattgtgccaa

SEQ ID NO: 769181 - DNA, 18 bp, Homo sapiens
atttttccaggactcttt

SEQ ID NO: 769182 - DNA, 16 bp, Homo sapiens
atttttccatctgtgt

SEQ ID NO: 769183 - DNA, 12 bp, Homo sapiens
atttttccctcc

SEQ ID NO: 769184 - DNA, 17 bp, Homo sapiens
atttttctaaaaaaaga

SEQ ID NO: 769185 - DNA, 19 bp, Homo sapiens
atttttctaaagaaatata

SEQ ID NO: 769186 - DNA, 18 bp, Homo sapiens
atttttctaaccttgaat

SEQ ID NO: 769187 - DNA, 23 bp, Homo sapiens
atttttctaagtgtaacctcagt

SEQ ID NO: 769188 - DNA, 13 bp, Homo sapiens
atttttctataaa

SEQ ID NO: 769189 - DNA, 17 bp, Homo sapiens
atttttctataaatcag

SEQ ID NO: 769190 - DNA, 15 bp, Homo sapiens
atttttctcttcatt

SEQ ID NO: 769191 - DNA, 15 bp, Homo sapiens
atttttctcttgtac

SEQ ID NO: 769192 - DNA, 15 bp, Homo sapiens
atttttctgactttt

SEQ ID NO: 769193 - DNA, 14 bp, Homo sapiens
atttttctgagatt

SEQ ID NO: 769194 - DNA, 22 bp, Homo sapiens
atttttcttagggaaggataca

SEQ ID NO: 769195 - DNA, 21 bp, Homo sapiens
atttttcttcaggtaacacta

SEQ ID NO: 769196 - DNA, 16 bp, Homo sapiens
atttttctttaactgc

SEQ ID NO: 769197 - DNA, 13 bp, Homo sapiens
atttttctttaca

SEQ ID NO: 769198 - DNA, 17 bp, Homo sapiens
atttttcttttcctggg

SEQ ID NO: 769199 - DNA, 16 bp, Homo sapiens
atttttctttttaaga

SEQ ID NO: 769200 - DNA, 14 bp, Homo sapiens
atttttgaaaaggc

SEQ ID NO: 769201 - DNA, 18 bp, Homo sapiens
atttttgaaaatcctgaa

SEQ ID NO: 769202 - DNA, 21 bp, Homo sapiens
atttttgaaaatcctgaataa

SEQ ID NO: 769203 - DNA, 22 bp, Homo sapiens
atttttgaaaatcctgaataaa

SEQ ID NO: 769204 - DNA, 18 bp, Homo sapiens
atttttgaaactgcattt

SEQ ID NO: 769205 - DNA, 21 bp, Homo sapiens
atttttgaagtaaattaaaca

SEQ ID NO: 769206 - DNA, 15 bp, Homo sapiens
atttttgacactttt

SEQ ID NO: 769207 - DNA, 17 bp, Homo sapiens
atttttgatgtatatat

SEQ ID NO: 769208 - DNA, 15 bp, Homo sapiens
atttttgattcagct

SEQ ID NO: 769209 - DNA, 12 bp, Homo sapiens
atttttgcctat

SEQ ID NO: 769210 - DNA, 12 bp, Homo sapiens
atttttgcctct

SEQ ID NO: 769211 - DNA, 21 bp, Homo sapiens
atttttgcctcttccagtctt

SEQ ID NO: 769212 - DNA, 21 bp, Homo sapiens
atttttgctgaattcctttac

SEQ ID NO: 769213 - DNA, 15 bp, Homo sapiens
atttttgcttaacat

SEQ ID NO: 769214 - DNA, 16 bp, Homo sapiens
atttttgcttaacatt

SEQ ID NO: 769215 - DNA, 15 bp, Homo sapiens
atttttgcttttaga

SEQ ID NO: 769216 - DNA, 20 bp, Homo sapiens
atttttgggtttggccaggg

SEQ ID NO: 769217 - DNA, 17 bp, Homo sapiens
atttttggttgaataaa

SEQ ID NO: 769218 - DNA, 19 bp, Homo sapiens
atttttggttgaataaact

SEQ ID NO: 769219 - DNA, 17 bp, Homo sapiens
atttttggtttccaaag

SEQ ID NO: 769220 - DNA, 18 bp, Homo sapiens
atttttgtacttgatttg

SEQ ID NO: 769221 - DNA, 21 bp, Homo sapiens
atttttgtacttgatttgatg

SEQ ID NO: 769222 - DNA, 16 bp, Homo sapiens
atttttgtatgccttt

SEQ ID NO: 769223 - DNA, 13 bp, Homo sapiens
atttttgtatgtc

SEQ ID NO: 769224 - DNA, 17 bp, Homo sapiens
atttttgtatgttatga

SEQ ID NO: 769225 - DNA, 20 bp, Homo sapiens
atttttgtatgttatgaaca

SEQ ID NO: 769226 - DNA, 23 bp, Homo sapiens
atttttgtcattttaaaatctga

SEQ ID NO: 769227 - DNA, 15 bp, Homo sapiens
atttttgtgtttcta

SEQ ID NO: 769228 - DNA, 18 bp, Homo sapiens
atttttgtgttttcttgt

SEQ ID NO: 769229 - DNA, 12 bp, Homo sapiens
atttttgttaat

SEQ ID NO: 769230 - DNA, 16 bp, Homo sapiens
atttttgttagcaaag

SEQ ID NO: 769231 - DNA, 17 bp, Homo sapiens
atttttgtttcttccaa

SEQ ID NO: 769232 - DNA, 20 bp, Homo sapiens
atttttgttttccactgtgc

SEQ ID NO: 769233 - DNA, 22 bp, Homo sapiens
atttttgttttccactgtgcta

SEQ ID NO: 769234 - DNA, 16 bp, Homo sapiens
atttttgttttcccca

SEQ ID NO: 769235 - DNA, 15 bp, Homo sapiens
atttttgttttgaaa

SEQ ID NO: 769236 - DNA, 20 bp, Homo sapiens
caaaaataacactgttggca

SEQ ID NO: 769237 - DNA, 12 bp, Homo sapiens
caaaaataatgt

SEQ ID NO: 769238 - DNA, 11 bp, Homo sapiens
caaaaatataa

SEQ ID NO: 769239 - DNA, 21 bp, Homo sapiens
caaaaatcaaagaacagatgg

SEQ ID NO: 769240 - DNA, 20 bp, Homo sapiens
caaaaatcactcacaagcaa

SEQ ID NO: 769241 - DNA, 17 bp, Homo sapiens
caaaaatgaactgaagt

SEQ ID NO: 769242 - DNA, 22 bp, Homo sapiens
caaaaatggtgagcgatcattt

SEQ ID NO: 769243 - DNA, 17 bp, Homo sapiens
caaaaatgtttccactg

SEQ ID NO: 769244 - DNA, 20 bp, Homo sapiens
caaaaattagccgggcgtgg

SEQ ID NO: 769245 - DNA, 14 bp, Homo sapiens
caaaaattttgtga

SEQ ID NO: 769246 - DNA, 17 bp, Homo sapiens
caaaaattttgtgacat

SEQ ID NO: 769247 - DNA, 18 bp, Homo sapiens
caaaacaaaaattaggta

SEQ ID NO: 769248 - DNA, 22 bp, Homo sapiens
caaaacaaaaattaggtatttt

SEQ ID NO: 769249 - DNA, 13 bp, Homo sapiens
caaaacaaaatgt

SEQ ID NO: 769250 - DNA, 14 bp, Homo sapiens
caaaacaaactcat

SEQ ID NO: 769251 - DNA, 13 bp, Homo sapiens
caaaacaaacttc

SEQ ID NO: 769252 - DNA, 14 bp, Homo sapiens
caaaacaaacttcc

SEQ ID NO: 769253 - DNA, 16 bp, Homo sapiens
caaaacaaaggcctaa

SEQ ID NO: 769254 - DNA, 15 bp, Homo sapiens
caaaacaacaaaaac

SEQ ID NO: 769255 - DNA, 23 bp, Homo sapiens
caaaacaagtgacatgaagggag

SEQ ID NO: 769256 - DNA, 19 bp, Homo sapiens
caaaacactcggcatttca

SEQ ID NO: 769257 - DNA, 13 bp, Homo sapiens
caaaacactgtgg

SEQ ID NO: 769258 - DNA, 15 bp, Homo sapiens
caaaacactgtggaa

SEQ ID NO: 769259 - DNA, 19 bp, Homo sapiens
caaaacagaagcagcttct

SEQ ID NO: 769260 - DNA, 19 bp, Homo sapiens
caaaacagagatgtgataa

SEQ ID NO: 769261 - DNA, 20 bp, Homo sapiens
caaaacaggaggggaaaaaa

SEQ ID NO: 769262 - DNA, 19 bp, Homo sapiens
cctgtctaggtctcctcag

SEQ ID NO: 769263 - DNA, 15 bp, Homo sapiens
cctgtctcagcctcc

SEQ ID NO: 769264 - DNA, 16 bp, Homo sapiens
cctgtctccagctgcc

SEQ ID NO: 769265 - DNA, 21 bp, Homo sapiens
cctgtctccagctgcctgggc

SEQ ID NO: 769266 - DNA, 23 bp, Homo sapiens
cctgtctcgggctgacccttttc

SEQ ID NO: 769267 - DNA, 20 bp, Homo sapiens
cctgtctcggggcttgcccc

SEQ ID NO: 769268 - DNA, 20 bp, Homo sapiens
cctgtctctattagctgggt

SEQ ID NO: 769269 - DNA, 14 bp, Homo sapiens
cctgtctctgcctg

SEQ ID NO: 769270 - DNA, 15 bp, Homo sapiens
cctgtctctgcctgc

SEQ ID NO: 769271 - DNA, 16 bp, Homo sapiens
cctgtctctgcctgcg

SEQ ID NO: 769272 - DNA, 13 bp, Homo sapiens
cctgtctctttcc

SEQ ID NO: 769273 - DNA, 20 bp, Homo sapiens
cctgtctctttccactttgt

SEQ ID NO: 769274 - DNA, 19 bp, Homo sapiens
cctgtctgaacctgccctt

SEQ ID NO: 769275 - DNA, 21 bp, Homo sapiens
cctgtctgaaggacacttcct

SEQ ID NO: 769276 - DNA, 15 bp, Homo sapiens
cctgtctgccagcca

SEQ ID NO: 769277 - DNA, 20 bp, Homo sapiens
cctgtctgccagccagcagc

SEQ ID NO: 769278 - DNA, 21 bp, Homo sapiens
cctgtctgccagccagcagcc

SEQ ID NO: 769279 - DNA, 23 bp, Homo sapiens
cctgtctgccagccagcagccag

SEQ ID NO: 769280 - DNA, 15 bp, Homo sapiens
cctgtctgcgtgggt

SEQ ID NO: 769281 - DNA, 19 bp, Homo sapiens
cctgtctggaagacgtggc

SEQ ID NO: 769282 - DNA, 19 bp, Homo sapiens
cctgtctgtctctccatct

SEQ ID NO: 769283 - DNA, 21 bp, Homo sapiens
cctgtctgtctctccatctgt

SEQ ID NO: 769284 - DNA, 17 bp, Homo sapiens
cctgtcttatcctccac

SEQ ID NO: 769285 - DNA, 21 bp, Homo sapiens
cctgtcttatggtccagaaac

SEQ ID NO: 769286 - DNA, 15 bp, Homo sapiens
cctgtcttccaagga

SEQ ID NO: 769287 - DNA, 14 bp, Homo sapiens
cctgtcttctgggc

SEQ ID NO: 769288 - DNA, 21 bp, Homo sapiens
cctgtcttctgggcacagtgg

SEQ ID NO: 769289 - DNA, 19 bp, Homo sapiens
cctgtcttgctcctgggga

SEQ ID NO: 769290 - DNA, 20 bp, Homo sapiens
cctgtcttgctcctggggag

SEQ ID NO: 769291 - DNA, 19 bp, Homo sapiens
cctgtgaaatagttcaaag

SEQ ID NO: 769292 - DNA, 16 bp, Homo sapiens
cctgtgaatgccactg

SEQ ID NO: 769293 - DNA, 23 bp, Homo sapiens
cctgtgaatggaggcagagacct

SEQ ID NO: 769294 - DNA, 19 bp, Homo sapiens
cctgtgacatggtgcctga

SEQ ID NO: 769295 - DNA, 23 bp, Homo sapiens
cctgtgacatggtgcctgagagg

SEQ ID NO: 769296 - DNA, 16 bp, Homo sapiens
cctgtgaccagcactg

SEQ ID NO: 769297 - DNA, 22 bp, Homo sapiens
cctgtgaccctctcactttggt

SEQ ID NO: 769298 - DNA, 18 bp, Homo sapiens
cctgtgacttcagctctg

SEQ ID NO: 769299 - DNA, 17 bp, Homo sapiens
cctgtgagccattgtcc

SEQ ID NO: 769300 - DNA, 15 bp, Homo sapiens
cctgtgagcccagct

SEQ ID NO: 769301 - DNA, 19 bp, Homo sapiens
cctgtgaggtaactgggat

SEQ ID NO: 769302 - DNA, 23 bp, Homo sapiens
cctgtgagtaggctgggcctccc

SEQ ID NO: 769303 - DNA, 20 bp, Homo sapiens
cctgtgatccacccaaccct

SEQ ID NO: 769304 - DNA, 17 bp, Homo sapiens
cctgtgcaaaaaaatta

SEQ ID NO: 769305 - DNA, 18 bp, Homo sapiens
cctgtgcacaccccactc

SEQ ID NO: 769306 - DNA, 17 bp, Homo sapiens
cctgtgcactgggcagg

SEQ ID NO: 769307 - DNA, 23 bp, Homo sapiens
cctgtgcactgggcaggttcctg

SEQ ID NO: 769308 - DNA, 13 bp, Homo sapiens
cctgtgcagcagc

SEQ ID NO: 769309 - DNA, 13 bp, Homo sapiens
cctgtgccagcac

SEQ ID NO: 769310 - DNA, 13 bp, Homo sapiens
cctgtgccatgcc

SEQ ID NO: 769311 - DNA, 19 bp, Homo sapiens
cctgtgccatgcccaaggc

SEQ ID NO: 769312 - DNA, 21 bp, Homo sapiens
cctgtgccatgcccaaggcct

SEQ ID NO: 769313 - DNA, 23 bp, Homo sapiens
cctgtgcccacatcccaggcttc

SEQ ID NO: 769314 - DNA, 14 bp, Homo sapiens
cctgtgccccagct

SEQ ID NO: 769315 - DNA, 16 bp, Homo sapiens
cctgtgccccagctgc

SEQ ID NO: 769316 - DNA, 19 bp, Homo sapiens
cctgtgccccagctgccag

SEQ ID NO: 769317 - DNA, 21 bp, Homo sapiens
cctgtgcccccagcctcagcc

SEQ ID NO: 769318 - DNA, 21 bp, Homo sapiens
cctgtgcccgcatgtgtgcct

SEQ ID NO: 769319 - DNA, 13 bp, Homo sapiens
cctgtgccctcac

SEQ ID NO: 769320 - DNA, 16 bp, Homo sapiens
cctgtgccctcaccac

SEQ ID NO: 769321 - DNA, 17 bp, Homo sapiens
cctgtgccctcacccca

SEQ ID NO: 769322 - DNA, 22 bp, Homo sapiens
cctgtgccctcaccccaatccc

SEQ ID NO: 769323 - DNA, 19 bp, Homo sapiens
cctgtgccgcactctggcg

SEQ ID NO: 769324 - DNA, 18 bp, Homo sapiens
cctgtgcctcccttttct

SEQ ID NO: 769325 - DNA, 20 bp, Homo sapiens
cctgtgcctcctcaccccca

SEQ ID NO: 769326 - DNA, 15 bp, Homo sapiens
cctgtgcctctggga

SEQ ID NO: 769327 - DNA, 19 bp, Homo sapiens
cctgtgcctctgggactgg

SEQ ID NO: 769328 - DNA, 15 bp, Homo sapiens
cctgtgcctgaccct

SEQ ID NO: 769329 - DNA, 12 bp, Homo sapiens
cctgtgcctggc

SEQ ID NO: 769330 - DNA, 17 bp, Homo sapiens
cctgtgcctggccccag

SEQ ID NO: 769331 - DNA, 21 bp, Homo sapiens
cctgtgcctgggccctgggct

SEQ ID NO: 769332 - DNA, 14 bp, Homo sapiens
cctgtgccttcctc

SEQ ID NO: 769333 - DNA, 19 bp, Homo sapiens
cctgtgctcccctgccaca

SEQ ID NO: 769334 - DNA, 22 bp, Homo sapiens
cctgtgctcccctgccacactg

SEQ ID NO: 769335 - DNA, 17 bp, Homo sapiens
cctgtgctccgtgcctc

SEQ ID NO: 769336 - DNA, 21 bp, Homo sapiens
cctgtgctgcccgtcttcagc

SEQ ID NO: 769337 - DNA, 22 bp, Homo sapiens
cctgtgctgcccgtcttcagcc

SEQ ID NO: 769338 - DNA, 16 bp, Homo sapiens
cctgtgctgctgcacc

SEQ ID NO: 769339 - DNA, 12 bp, Homo sapiens
cctgtgctggtg

SEQ ID NO: 769340 - DNA, 22 bp, Homo sapiens
cctgtgcttcgggcccttccca

SEQ ID NO: 769341 - DNA, 17 bp, Homo sapiens
cctgtggaagcatggct

SEQ ID NO: 769342 - DNA, 22 bp, Homo sapiens
cctgtggaagcatggctgtctg

SEQ ID NO: 769343 - DNA, 19 bp, Homo sapiens
cctgtggaagggactagga

SEQ ID NO: 769344 - DNA, 23 bp, Homo sapiens
cctgtggaatgagtgtgcatgga

SEQ ID NO: 769345 - DNA, 17 bp, Homo sapiens
cctgtggaatgggctca

SEQ ID NO: 769346 - DNA, 11 bp, Homo sapiens
cctgtggagac

SEQ ID NO: 769347 - DNA, 15 bp, Homo sapiens
cctgtggagcccgca

SEQ ID NO: 769348 - DNA, 18 bp, Homo sapiens
cctgtggagcccgcaccc

SEQ ID NO: 769349 - DNA, 18 bp, Homo sapiens
cctgtggagctcagcccc

SEQ ID NO: 769350 - DNA, 19 bp, Homo sapiens
cctgtggagctcagccccg

SEQ ID NO: 769351 - DNA, 20 bp, Homo sapiens
cctgtggagtccagctctac

SEQ ID NO: 769352 - DNA, 12 bp, Homo sapiens
cctgtggatatt

SEQ ID NO: 769353 - DNA, 17 bp, Homo sapiens
cctgtggattagaatag

SEQ ID NO: 769354 - DNA, 20 bp, Homo sapiens
cctgtggcagaaaagaggag

SEQ ID NO: 769355 - DNA, 15 bp, Homo sapiens
cctgtggccctggcc

SEQ ID NO: 769356 - DNA, 17 bp, Homo sapiens
cctgtggccctggccac

SEQ ID NO: 769357 - DNA, 18 bp, Homo sapiens
caaaataaaacatagcaa

SEQ ID NO: 769358 - DNA, 19 bp, Homo sapiens
caaaataaaacatagcaaa

SEQ ID NO: 769359 - DNA, 14 bp, Homo sapiens
caaaataaaacttt

SEQ ID NO: 769360 - DNA, 14 bp, Homo sapiens
caaaataaatgttg

SEQ ID NO: 769361 - DNA, 16 bp, Homo sapiens
caaaataagaaaagat

SEQ ID NO: 769362 - DNA, 18 bp, Homo sapiens
caaaataagaaaagatgt

SEQ ID NO: 769363 - DNA, 22 bp, Homo sapiens
caaaataagaaaagatgtagat

SEQ ID NO: 769364 - DNA, 14 bp, Homo sapiens
caaaataagttttt

SEQ ID NO: 769365 - DNA, 22 bp, Homo sapiens
caaaataagtttttctttaata

SEQ ID NO: 769366 - DNA, 19 bp, Homo sapiens
caaaataatctatattaaa

SEQ ID NO: 769367 - DNA, 16 bp, Homo sapiens
caaaatacaatcctgt

SEQ ID NO: 769368 - DNA, 20 bp, Homo sapiens
caaaatacaatgttatcaac

SEQ ID NO: 769369 - DNA, 19 bp, Homo sapiens
caaaatacacgtttatctt

SEQ ID NO: 769370 - DNA, 14 bp, Homo sapiens
caaaatacatgaag

SEQ ID NO: 769371 - DNA, 22 bp, Homo sapiens
caaaatacatgaagcttcatgc

SEQ ID NO: 769372 - DNA, 14 bp, Homo sapiens
caaaatagaaaagt

SEQ ID NO: 769373 - DNA, 17 bp, Homo sapiens
caaaatagaaaagttat

SEQ ID NO: 769374 - DNA, 21 bp, Homo sapiens
caaaatagaaagttgcaaggc

SEQ ID NO: 769375 - DNA, 15 bp, Homo sapiens
caaaatagcatttgt

SEQ ID NO: 769376 - DNA, 16 bp, Homo sapiens
caaaatagcatttgtt

SEQ ID NO: 769377 - DNA, 21 bp, Homo sapiens
caaaatagggtatattttcct

SEQ ID NO: 769378 - DNA, 14 bp, Homo sapiens
caaaatagtattgc

SEQ ID NO: 769379 - DNA, 14 bp, Homo sapiens
caaaatatacaaaa

SEQ ID NO: 769380 - DNA, 14 bp, Homo sapiens
caaaatatattttg

SEQ ID NO: 769381 - DNA, 20 bp, Homo sapiens
caaaatatattttgtttaca

SEQ ID NO: 769382 - DNA, 22 bp, Homo sapiens
caaaatatattttgtttacaaa

SEQ ID NO: 769383 - DNA, 21 bp, Homo sapiens
caaaatatgccccttcttggg

SEQ ID NO: 769384 - DNA, 22 bp, Homo sapiens
caaaatatgccccttcttgggc

SEQ ID NO: 769385 - DNA, 17 bp, Homo sapiens
caaaatatggtttggtt

SEQ ID NO: 769386 - DNA, 17 bp, Homo sapiens
caaaatatttaaaaatg

SEQ ID NO: 769387 - DNA, 18 bp, Homo sapiens
caaaatatttaaaaatgt

SEQ ID NO: 769388 - DNA, 18 bp, Homo sapiens
cctgtggtaactttgcag

SEQ ID NO: 769389 - DNA, 22 bp, Homo sapiens
cctgtggtggctccccctctgc

SEQ ID NO: 769390 - DNA, 15 bp, Homo sapiens
cctgtggttacagtg

SEQ ID NO: 769391 - DNA, 17 bp, Homo sapiens
cctgtgtaaaaacaaca

SEQ ID NO: 769392 - DNA, 20 bp, Homo sapiens
cctgtgtatggaaaaaccat

SEQ ID NO: 769393 - DNA, 13 bp, Homo sapiens
cctgtgtcagagc

SEQ ID NO: 769394 - DNA, 14 bp, Homo sapiens
cctgtgtcagagcc

SEQ ID NO: 769395 - DNA, 19 bp, Homo sapiens
cctgtgtcagagcctacct

SEQ ID NO: 769396 - DNA, 19 bp, Homo sapiens
cctgtgtccacctgtgggt

SEQ ID NO: 769397 - DNA, 16 bp, Homo sapiens
cctgtgtccagcagct

SEQ ID NO: 769398 - DNA, 18 bp, Homo sapiens
cctgtgtcccatgaccca

SEQ ID NO: 769399 - DNA, 19 bp, Homo sapiens
cctgtgtcccatgacccac

SEQ ID NO: 769400 - DNA, 22 bp, Homo sapiens
cctgtgtcccatgacccacccc

SEQ ID NO: 769401 - DNA, 21 bp, Homo sapiens
cctgtgtcccctgacctgtcc

SEQ ID NO: 769402 - DNA, 16 bp, Homo sapiens
cctgtgtctgtcacag

SEQ ID NO: 769403 - DNA, 21 bp, Homo sapiens
cctgtgtctgtcacaggctgg

SEQ ID NO: 769404 - DNA, 18 bp, Homo sapiens
cctgtgtgattgacagct

SEQ ID NO: 769405 - DNA, 22 bp, Homo sapiens
cctgtgtgattgacagctttgc

SEQ ID NO: 769406 - DNA, 19 bp, Homo sapiens
cctgtgtggatgctgagct

SEQ ID NO: 769407 - DNA, 15 bp, Homo sapiens
cctgtgttacccagg

SEQ ID NO: 769408 - DNA, 16 bp, Homo sapiens
cctgtgttagtgtctg

SEQ ID NO: 769409 - DNA, 15 bp, Homo sapiens
cctgtgttcatttgg

SEQ ID NO: 769410 - DNA, 18 bp, Homo sapiens
cctgtgttctgggctggg

SEQ ID NO: 769411 - DNA, 17 bp, Homo sapiens
cctgtgttgtcccatct

SEQ ID NO: 769412 - DNA, 21 bp, Homo sapiens
cctgtgttgtcccatctgccc

SEQ ID NO: 769413 - DNA, 22 bp, Homo sapiens
cctgtgttgtcccatctgccct

SEQ ID NO: 769414 - DNA, 15 bp, Homo sapiens
cctgtgtttgtcctg

SEQ ID NO: 769415 - DNA, 14 bp, Homo sapiens
cctgttaaaacaac

SEQ ID NO: 769416 - DNA, 16 bp, Homo sapiens
cctgttaatttataat

SEQ ID NO: 769417 - DNA, 21 bp, Homo sapiens
cctgttagaaatgttagtgcc

SEQ ID NO: 769418 - DNA, 23 bp, Homo sapiens
cctgttagacgtcctccgtccat

SEQ ID NO: 769419 - DNA, 17 bp, Homo sapiens
cctgttatgtatgaagg

SEQ ID NO: 769420 - DNA, 14 bp, Homo sapiens
cctgttatttatca

SEQ ID NO: 769421 - DNA, 21 bp, Homo sapiens
cctgttcacagaaaaagcatg

SEQ ID NO: 769422 - DNA, 14 bp, Homo sapiens
cctgttcacggtga

SEQ ID NO: 769423 - DNA, 16 bp, Homo sapiens
cctgttcattgtaagc

SEQ ID NO: 769424 - DNA, 20 bp, Homo sapiens
cctgttccattgttgtcaaa

SEQ ID NO: 769425 - DNA, 13 bp, Homo sapiens
cctgttcccctct

SEQ ID NO: 769426 - DNA, 14 bp, Homo sapiens
cctgttcccctctc

SEQ ID NO: 769427 - DNA, 16 bp, Homo sapiens
cctgttcccctctccc

SEQ ID NO: 769428 - DNA, 17 bp, Homo sapiens
cctgttcccctctccct

SEQ ID NO: 769429 - DNA, 18 bp, Homo sapiens
cctgttcccctctccctt

SEQ ID NO: 769430 - DNA, 19 bp, Homo sapiens
cctgttcccctctcccttc

SEQ ID NO: 769431 - DNA, 14 bp, Homo sapiens
cctgttccctcctg

SEQ ID NO: 769432 - DNA, 16 bp, Homo sapiens
cctgttccctcctggt

SEQ ID NO: 769433 - DNA, 17 bp, Homo sapiens
cctgttccctcctggtc

SEQ ID NO: 769434 - DNA, 20 bp, Homo sapiens
cctgttccctcctggtcctg

SEQ ID NO: 769435 - DNA, 15 bp, Homo sapiens
cctgttccctggagt

SEQ ID NO: 769436 - DNA, 20 bp, Homo sapiens
cctgttcggttccagacact

SEQ ID NO: 769437 - DNA, 14 bp, Homo sapiens
cctgttctcccttt

SEQ ID NO: 769438 - DNA, 24 bp, Homo sapiens
cctgttctccctttctctctcctc

SEQ ID NO: 769439 - DNA, 16 bp, Homo sapiens
cctgttctgaaacctt

SEQ ID NO: 769440 - DNA, 13 bp, Homo sapiens
cctgttctgaaat

SEQ ID NO: 769441 - DNA, 17 bp, Homo sapiens
cctgttctgaaatgttc

SEQ ID NO: 769442 - DNA, 21 bp, Homo sapiens
cctgttctgcttcgaagtatt

SEQ ID NO: 769443 - DNA, 20 bp, Homo sapiens
cctgttcttagagtgtagct

SEQ ID NO: 769444 - DNA, 20 bp, Homo sapiens
cctgttcttcctccagctgc

SEQ ID NO: 769445 - DNA, 24 bp, Homo sapiens
cctgttcttcctccagctgcacca

SEQ ID NO: 769446 - DNA, 12 bp, Homo sapiens
cctgttgaagac

SEQ ID NO: 769447 - DNA, 15 bp, Homo sapiens
cctgttgaagacttc

SEQ ID NO: 769448 - DNA, 21 bp, Homo sapiens
cctgttgaattttgttctctg

SEQ ID NO: 769449 - DNA, 23 bp, Homo sapiens
cctgttgaattttgttctctggg

SEQ ID NO: 769450 - DNA, 19 bp, Homo sapiens
cctgttgacacaggtcttt

SEQ ID NO: 769451 - DNA, 23 bp, Homo sapiens
cctgttgattaatttctgccatt

SEQ ID NO: 769452 - DNA, 18 bp, Homo sapiens
cctgttgattatcttcag

SEQ ID NO: 769453 - DNA, 17 bp, Homo sapiens
cctgttgctttcttcct

SEQ ID NO: 769454 - DNA, 16 bp, Homo sapiens
cctgttggcagctcta

SEQ ID NO: 769455 - DNA, 16 bp, Homo sapiens
cctgttggcaggccca

SEQ ID NO: 769456 - DNA, 14 bp, Homo sapiens
cctgttggcctgtg

SEQ ID NO: 769457 - DNA, 17 bp, Homo sapiens
cctgttggcctgtgggc

SEQ ID NO: 769458 - DNA, 17 bp, Homo sapiens
cctgtttaaataaaatt

SEQ ID NO: 769459 - DNA, 19 bp, Homo sapiens
cctgtttaaataaaattta

SEQ ID NO: 769460 - DNA, 15 bp, Homo sapiens
cctgtttaatattta

SEQ ID NO: 769461 - DNA, 21 bp, Homo sapiens
cctgtttaatatttaaacagc

SEQ ID NO: 769462 - DNA, 21 bp, Homo sapiens
cctgtttataatctgaagata

SEQ ID NO: 769463 - DNA, 19 bp, Homo sapiens
cctgtttattcccatcttt

SEQ ID NO: 769464 - DNA, 18 bp, Homo sapiens
cctgtttcagaccccccc

SEQ ID NO: 769465 - DNA, 18 bp, Homo sapiens
cctgtttctgcagccctt

SEQ ID NO: 769466 - DNA, 14 bp, Homo sapiens
cctgtttgaaagta

SEQ ID NO: 769467 - DNA, 13 bp, Homo sapiens
cctgtttgaaata

SEQ ID NO: 769468 - DNA, 13 bp, Homo sapiens
cctgtttgatgta

SEQ ID NO: 769469 - DNA, 21 bp, Homo sapiens
cctgtttgatgtatgtgtgaa

SEQ ID NO: 769470 - DNA, 17 bp, Homo sapiens
cctgtttgcatgagaaa

SEQ ID NO: 769471 - DNA, 18 bp, Homo sapiens
cctgttttcactcagctt

SEQ ID NO: 769472 - DNA, 23 bp, Homo sapiens
cctgttttcccacgaggaatctg

SEQ ID NO: 769473 - DNA, 16 bp, Homo sapiens
cctgttttctccctct

SEQ ID NO: 769474 - DNA, 20 bp, Homo sapiens
cctgttttctccctctcatg

SEQ ID NO: 769475 - DNA, 23 bp, Homo sapiens
cctgttttctccctctcatgtcc

SEQ ID NO: 769476 - DNA, 14 bp, Homo sapiens
cctgttttctctgt

SEQ ID NO: 769477 - DNA, 14 bp, Homo sapiens
cctgttttctgaaa

SEQ ID NO: 769478 - DNA, 21 bp, Homo sapiens
caaagaaatgggcctgcctgc

SEQ ID NO: 769479 - DNA, 19 bp, Homo sapiens
caaagaaattcagaacagc

SEQ ID NO: 769480 - DNA, 14 bp, Homo sapiens
caaagaaccaaaga

SEQ ID NO: 769481 - DNA, 20 bp, Homo sapiens
caaagaacttgatttgcatg

SEQ ID NO: 769482 - DNA, 11 bp, Homo sapiens
caaagaagctt

SEQ ID NO: 769483 - DNA, 20 bp, Homo sapiens
caaagaagcttccacaaaat

SEQ ID NO: 769484 - DNA, 17 bp, Homo sapiens
caaagaaggagctgaga

SEQ ID NO: 769485 - DNA, 14 bp, Homo sapiens
caaagaaggcaggg

SEQ ID NO: 769486 - DNA, 22 bp, Homo sapiens
caaagaaggcatttgcagggtc

SEQ ID NO: 769487 - DNA, 12 bp, Homo sapiens
caaagaatattt

SEQ ID NO: 769488 - DNA, 15 bp, Homo sapiens
caaagaattacagta

SEQ ID NO: 769489 - DNA, 18 bp, Homo sapiens
caaagaattccaaagcaa

SEQ ID NO: 769490 - DNA, 19 bp, Homo sapiens
caaagaattccaaagcaaa

SEQ ID NO: 769491 - DNA, 21 bp, Homo sapiens
caaagaattcctgaagccaga

SEQ ID NO: 769492 - DNA, 13 bp, Homo sapiens
caaagacaaaaga

SEQ ID NO: 769493 - DNA, 17 bp, Homo sapiens
caaagacaaaagaaact

SEQ ID NO: 769494 - DNA, 14 bp, Homo sapiens
caaagacaaaagtc

SEQ ID NO: 769495 - DNA, 16 bp, Homo sapiens
caaagacagagcggaa

SEQ ID NO: 769496 - DNA, 14 bp, Homo sapiens
caaagaccacctcc

SEQ ID NO: 769497 - DNA, 19 bp, Homo sapiens
caaagaccacctccaaccc

SEQ ID NO: 769498 - DNA, 17 bp, Homo sapiens
caaagactatttcaaaa

SEQ ID NO: 769499 - DNA, 22 bp, Homo sapiens
caaagactatttcaaaatgtcc

SEQ ID NO: 769500 - DNA, 16 bp, Homo sapiens
caaagactcctctggg

SEQ ID NO: 769501 - DNA, 19 bp, Homo sapiens
caaagactcctctgggcct

SEQ ID NO: 769502 - DNA, 17 bp, Homo sapiens
caaagactccttgtgga

SEQ ID NO: 769503 - DNA, 17 bp, Homo sapiens
caaagactgtgaacagc

SEQ ID NO: 769504 - DNA, 17 bp, Homo sapiens
caaagagaaaaagaaat

SEQ ID NO: 769505 - DNA, 19 bp, Homo sapiens
caaagagaaaaagaaatgc

SEQ ID NO: 769506 - DNA, 15 bp, Homo sapiens
caaagagaaaccgct

SEQ ID NO: 769507 - DNA, 13 bp, Homo sapiens
caaagagaagatg

SEQ ID NO: 769508 - DNA, 18 bp, Homo sapiens
caaagagaagatgcctgt

SEQ ID NO: 769509 - DNA, 23 bp, Homo sapiens
caaagagaatgcccttctcctta

SEQ ID NO: 769510 - DNA, 14 bp, Homo sapiens
caaagagactggag

SEQ ID NO: 769511 - DNA, 14 bp, Homo sapiens
caaagagatattga

SEQ ID NO: 769512 - DNA, 11 bp, Homo sapiens
caaagagatgg

SEQ ID NO: 769513 - DNA, 23 bp, Homo sapiens
caaagagatgggccttttcttga

SEQ ID NO: 769514 - DNA, 16 bp, Homo sapiens
caaagagcctggagaa

SEQ ID NO: 769515 - DNA, 18 bp, Homo sapiens
caaagagcctggagaagc

SEQ ID NO: 769516 - DNA, 16 bp, Homo sapiens
caaagagcctttccaa

SEQ ID NO: 769517 - DNA, 17 bp, Homo sapiens
caaagagcctttccaaa

SEQ ID NO: 769518 - DNA, 20 bp, Homo sapiens
caaagaggctgaggctggca

SEQ ID NO: 769519 - DNA, 23 bp, Homo sapiens
ccttcagctcctgagtagctggg

SEQ ID NO: 769520 - DNA, 14 bp, Homo sapiens
ccttcaggactctg

SEQ ID NO: 769521 - DNA, 18 bp, Homo sapiens
ccttcagggccagaagga

SEQ ID NO: 769522 - DNA, 23 bp, Homo sapiens
ccttcagtaccctctcagctcca

SEQ ID NO: 769523 - DNA, 20 bp, Homo sapiens
ccttcagtaggaacaagctg

SEQ ID NO: 769524 - DNA, 22 bp, Homo sapiens
ccttcagtaggaacaagctggc

SEQ ID NO: 769525 - DNA, 19 bp, Homo sapiens
ccttcagtctgctccacca

SEQ ID NO: 769526 - DNA, 20 bp, Homo sapiens
ccttcagtcttgaatttcta

SEQ ID NO: 769527 - DNA, 21 bp, Homo sapiens
ccttcagtcttgaatttctaa

SEQ ID NO: 769528 - DNA, 22 bp, Homo sapiens
ccttcagtgagcccctccccag

SEQ ID NO: 769529 - DNA, 11 bp, Homo sapiens
ccttcagtgcc

SEQ ID NO: 769530 - DNA, 15 bp, Homo sapiens
ccttcagtgcccacc

SEQ ID NO: 769531 - DNA, 18 bp, Homo sapiens
ccttcataccgcctcgtg

SEQ ID NO: 769532 - DNA, 19 bp, Homo sapiens
ccttcataccgcctcgtgc

SEQ ID NO: 769533 - DNA, 22 bp, Homo sapiens
ccttcataggcggtcatgtgtg

SEQ ID NO: 769534 - DNA, 14 bp, Homo sapiens
ccttcatctccagg

SEQ ID NO: 769535 - DNA, 19 bp, Homo sapiens
ccttcatgaatctttcata

SEQ ID NO: 769536 - DNA, 16 bp, Homo sapiens
ccttcatggccccagc

SEQ ID NO: 769537 - DNA, 23 bp, Homo sapiens
ccttcattctgcaagtatactag

SEQ ID NO: 769538 - DNA, 11 bp, Homo sapiens
ccttcatttaa

SEQ ID NO: 769539 - DNA, 17 bp, Homo sapiens
ccttcatttaaactaaa

SEQ ID NO: 769540 - DNA, 18 bp, Homo sapiens
ccttcatttaaactaaat

SEQ ID NO: 769541 - DNA, 18 bp, Homo sapiens
ccttccaaaacctgcttc

SEQ ID NO: 769542 - DNA, 17 bp, Homo sapiens
ccttccaaacctgagaa

SEQ ID NO: 769543 - DNA, 15 bp, Homo sapiens
ccttccaagactgaa

SEQ ID NO: 769544 - DNA, 17 bp, Homo sapiens
ccttccaagactgaaga

SEQ ID NO: 769545 - DNA, 19 bp, Homo sapiens
ccttccaagactgaagact

SEQ ID NO: 769546 - DNA, 18 bp, Homo sapiens
ccttccaaggtcactctt

SEQ ID NO: 769547 - DNA, 22 bp, Homo sapiens
ccttccacagttatcttagctg

SEQ ID NO: 769548 - DNA, 16 bp, Homo sapiens
ccttccacatgtacat

SEQ ID NO: 769549 - DNA, 12 bp, Homo sapiens
ccttccacctcc

SEQ ID NO: 769550 - DNA, 20 bp, Homo sapiens
ccttccacgctgtctccaga

SEQ ID NO: 769551 - DNA, 20 bp, Homo sapiens
ccttccacggatccatgtag

SEQ ID NO: 769552 - DNA, 11 bp, Homo sapiens
ccttccactgt

SEQ ID NO: 769553 - DNA, 14 bp, Homo sapiens
ccttccactgtagc

SEQ ID NO: 769554 - DNA, 15 bp, Homo sapiens
ccttccactgtagct

SEQ ID NO: 769555 - DNA, 16 bp, Homo sapiens
ccttccactgtagcta

SEQ ID NO: 769556 - DNA, 20 bp, Homo sapiens
ccttccactgtgcacctgcg

SEQ ID NO: 769557 - DNA, 15 bp, Homo sapiens
ccttccagctcctgt

SEQ ID NO: 769558 - DNA, 13 bp, Homo sapiens
ccttccaggtcag

SEQ ID NO: 769559 - DNA, 16 bp, Homo sapiens
ccttccaggtgggtgt

SEQ ID NO: 769560 - DNA, 11 bp, Homo sapiens
ccttccataat

SEQ ID NO: 769561 - DNA, 17 bp, Homo sapiens
ccttccatatccctgcc

SEQ ID NO: 769562 - DNA, 19 bp, Homo sapiens
ccttccatcagcgggtctc

SEQ ID NO: 769563 - DNA, 15 bp, Homo sapiens
ccttccatgacctcc

SEQ ID NO: 769564 - DNA, 19 bp, Homo sapiens
ccttccatggtactgtagc

SEQ ID NO: 769565 - DNA, 22 bp, Homo sapiens
ccttccatgtcaggccagcctg

SEQ ID NO: 769566 - DNA, 18 bp, Homo sapiens
ccttccatgtcgcctctg

SEQ ID NO: 769567 - DNA, 23 bp, Homo sapiens
ccttccatgtcgcctctgcattc

SEQ ID NO: 769568 - DNA, 16 bp, Homo sapiens
ccttccattcacacca

SEQ ID NO: 769569 - DNA, 11 bp, Homo sapiens
ccttccatttt

SEQ ID NO: 769570 - DNA, 20 bp, Homo sapiens
ccttccattttcccccacta

SEQ ID NO: 769571 - DNA, 15 bp, Homo sapiens
ccttcccacaaaaga

SEQ ID NO: 769572 - DNA, 15 bp, Homo sapiens
ccttcccacatgcct

SEQ ID NO: 769573 - DNA, 20 bp, Homo sapiens
ccttcccacatgcctgcgcc

SEQ ID NO: 769574 - DNA, 22 bp, Homo sapiens
ccttcccacccatcgctgtgtg

SEQ ID NO: 769575 - DNA, 13 bp, Homo sapiens
ccttcccacccct

SEQ ID NO: 769576 - DNA, 19 bp, Homo sapiens
ccttcccacctactgcact

SEQ ID NO: 769577 - DNA, 23 bp, Homo sapiens
ccttcccacctactgcactttcc

SEQ ID NO: 769578 - DNA, 13 bp, Homo sapiens
ccttcccagctct

SEQ ID NO: 769579 - DNA, 14 bp, Homo sapiens
ccttcccagctctc

SEQ ID NO: 769580 - DNA, 14 bp, Homo sapiens
ccttcccagggacc

SEQ ID NO: 769581 - DNA, 15 bp, Homo sapiens
ccttcccatggccat

SEQ ID NO: 769582 - DNA, 18 bp, Homo sapiens
ccttcccatttctctaca

SEQ ID NO: 769583 - DNA, 19 bp, Homo sapiens
ccttccccactgcacacac

SEQ ID NO: 769584 - DNA, 22 bp, Homo sapiens
ccttccccactgcctgcccacc

SEQ ID NO: 769585 - DNA, 13 bp, Homo sapiens
ccttccccagcat

SEQ ID NO: 769586 - DNA, 19 bp, Homo sapiens
ccttccccagcccttagca

SEQ ID NO: 769587 - DNA, 12 bp, Homo sapiens
ccttccccaggc

SEQ ID NO: 769588 - DNA, 13 bp, Homo sapiens
ccttccccaggcc

SEQ ID NO: 769589 - DNA, 21 bp, Homo sapiens
ccttcccccaccggtccagct

SEQ ID NO: 769590 - DNA, 22 bp, Homo sapiens
ccttcccccaccggtccagctg

SEQ ID NO: 769591 - DNA, 22 bp, Homo sapiens
ccttcccccatccctaccactg

SEQ ID NO: 769592 - DNA, 17 bp, Homo sapiens
ccttccccgtcccctgc

SEQ ID NO: 769593 - DNA, 23 bp, Homo sapiens
ccttccccgtcccctgcagcctg

SEQ ID NO: 769594 - DNA, 22 bp, Homo sapiens
ccttcccctcccgacagcccat

SEQ ID NO: 769595 - DNA, 17 bp, Homo sapiens
ccttcccctccctggct

SEQ ID NO: 769596 - DNA, 22 bp, Homo sapiens
ccttcccctccctggctcccat

SEQ ID NO: 769597 - DNA, 14 bp, Homo sapiens
ccttcccctgcacc

SEQ ID NO: 769598 - DNA, 17 bp, Homo sapiens
ccttcccctgcacctgg

SEQ ID NO: 769599 - DNA, 12 bp, Homo sapiens
ccttcccctgct

SEQ ID NO: 769600 - DNA, 15 bp, Homo sapiens
caaagttgttgtaac

SEQ ID NO: 769601 - DNA, 23 bp, Homo sapiens
caaagtttacattgtcctgtagc

SEQ ID NO: 769602 - DNA, 16 bp, Homo sapiens
caaagtttcagagtat

SEQ ID NO: 769603 - DNA, 17 bp, Homo sapiens
caaagtttcagagtata

SEQ ID NO: 769604 - DNA, 20 bp, Homo sapiens
caaagtttcagagtatattg

SEQ ID NO: 769605 - DNA, 19 bp, Homo sapiens
caaataaaacccaatactt

SEQ ID NO: 769606 - DNA, 16 bp, Homo sapiens
caaataaaatatcata

SEQ ID NO: 769607 - DNA, 15 bp, Homo sapiens
caaataaaattattt

SEQ ID NO: 769608 - DNA, 13 bp, Homo sapiens
caaataaacagtt

SEQ ID NO: 769609 - DNA, 15 bp, Homo sapiens
caaataaacagttgt

SEQ ID NO: 769610 - DNA, 13 bp, Homo sapiens
caaataaagcctt

SEQ ID NO: 769611 - DNA, 14 bp, Homo sapiens
caaataaagccttt

SEQ ID NO: 769612 - DNA, 22 bp, Homo sapiens
caaataaagccttttaaatcat

SEQ ID NO: 769613 - DNA, 17 bp, Homo sapiens
caaataaataattttca

SEQ ID NO: 769614 - DNA, 23 bp, Homo sapiens
caaataaatgattatattcacag

SEQ ID NO: 769615 - DNA, 23 bp, Homo sapiens
caaataaatgccttccacctcac

SEQ ID NO: 769616 - DNA, 15 bp, Homo sapiens
caaataaatttctgg

SEQ ID NO: 769617 - DNA, 13 bp, Homo sapiens
caaataagacttc

SEQ ID NO: 769618 - DNA, 17 bp, Homo sapiens
caaataagtatttataa

SEQ ID NO: 769619 - DNA, 13 bp, Homo sapiens
caaataagtgtat

SEQ ID NO: 769620 - DNA, 18 bp, Homo sapiens
caaataagtgtattttga

SEQ ID NO: 769621 - DNA, 22 bp, Homo sapiens
caaataataaagtagcaaaaca

SEQ ID NO: 769622 - DNA, 21 bp, Homo sapiens
caaataatccattccaaaata

SEQ ID NO: 769623 - DNA, 23 bp, Homo sapiens
caaataatgatcgaaaaaataat

SEQ ID NO: 769624 - DNA, 19 bp, Homo sapiens
caaataatggaaaaatagt

SEQ ID NO: 769625 - DNA, 13 bp, Homo sapiens
caaataattaaat

SEQ ID NO: 769626 - DNA, 19 bp, Homo sapiens
caaatacaaagtggaaact

SEQ ID NO: 769627 - DNA, 19 bp, Homo sapiens
caaatacatttaaaacatt

SEQ ID NO: 769628 - DNA, 20 bp, Homo sapiens
caaatacctcaatttttgtt

SEQ ID NO: 769629 - DNA, 12 bp, Homo sapiens
caaatagaaaac

SEQ ID NO: 769630 - DNA, 16 bp, Homo sapiens
caaatagatttttgat

SEQ ID NO: 769631 - DNA, 22 bp, Homo sapiens
caaatagatttttgattcagct

SEQ ID NO: 769632 - DNA, 13 bp, Homo sapiens
caaatagcaaaga

SEQ ID NO: 769633 - DNA, 15 bp, Homo sapiens
caaatagccccagac

SEQ ID NO: 769634 - DNA, 16 bp, Homo sapiens
caaatagccccagact

SEQ ID NO: 769635 - DNA, 22 bp, Homo sapiens
caaataggagtgagtgtatgtg

SEQ ID NO: 769636 - DNA, 20 bp, Homo sapiens
caaataggctattaaaaaag

SEQ ID NO: 769637 - DNA, 21 bp, Homo sapiens
caaatagtgtgaaatatatta

SEQ ID NO: 769638 - DNA, 13 bp, Homo sapiens
caaatagttgcat

SEQ ID NO: 769639 - DNA, 18 bp, Homo sapiens
caaatataaccatttaaa

SEQ ID NO: 769640 - DNA, 14 bp, Homo sapiens
caaatataagaata

SEQ ID NO: 769641 - DNA, 18 bp, Homo sapiens
caaatataagaataaaat

SEQ ID NO: 769642 - DNA, 22 bp, Homo sapiens
caaatataagaataaaatgttg

SEQ ID NO: 769643 - DNA, 15 bp, Homo sapiens
caaatataagacatt

SEQ ID NO: 769644 - DNA, 19 bp, Homo sapiens
caaatatacattttctaaa

SEQ ID NO: 769645 - DNA, 14 bp, Homo sapiens
caaatatagaaagt

SEQ ID NO: 769646 - DNA, 17 bp, Homo sapiens
caaatatctctatttaa

SEQ ID NO: 769647 - DNA, 15 bp, Homo sapiens
caaatatgaaaaatg

SEQ ID NO: 769648 - DNA, 21 bp, Homo sapiens
caaatatgaaaaatgtaaata

SEQ ID NO: 769649 - DNA, 13 bp, Homo sapiens
caaatatgctttg

SEQ ID NO: 769650 - DNA, 14 bp, Homo sapiens
caaatatgtcctgg

SEQ ID NO: 769651 - DNA, 21 bp, Homo sapiens
caaatattattcaagtgcctc

SEQ ID NO: 769652 - DNA, 18 bp, Homo sapiens
caaatattcactggcccc

SEQ ID NO: 769653 - DNA, 15 bp, Homo sapiens
caaatattgtcatct

SEQ ID NO: 769654 - DNA, 21 bp, Homo sapiens
caaatatttagatgtaatttt

SEQ ID NO: 769655 - DNA, 14 bp, Homo sapiens
caaatatttatttt

SEQ ID NO: 769656 - DNA, 15 bp, Homo sapiens
caaatatttattttc

SEQ ID NO: 769657 - DNA, 16 bp, Homo sapiens
caaatatttattttct

SEQ ID NO: 769658 - DNA, 22 bp, Homo sapiens
caaatcaaagcaagggctccag

SEQ ID NO: 769659 - DNA, 13 bp, Homo sapiens
caaatcaacagaa

SEQ ID NO: 769660 - DNA, 15 bp, Homo sapiens
caaatcaacagaagc

SEQ ID NO: 769661 - DNA, 15 bp, Homo sapiens
caaatcaatacacta

SEQ ID NO: 769662 - DNA, 18 bp, Homo sapiens
caaatcacacctctgggc

SEQ ID NO: 769663 - DNA, 14 bp, Homo sapiens
caaatcacatattt

SEQ ID NO: 769664 - DNA, 14 bp, Homo sapiens
caaatcacttcaat

SEQ ID NO: 769665 - DNA, 12 bp, Homo sapiens
caaatcaggggc

SEQ ID NO: 769666 - DNA, 19 bp, Homo sapiens
caaatcaggggccagagag

SEQ ID NO: 769667 - DNA, 13 bp, Homo sapiens
caaatcatagctg

SEQ ID NO: 769668 - DNA, 13 bp, Homo sapiens
caaatcatcctga

SEQ ID NO: 769669 - DNA, 14 bp, Homo sapiens
caaatcatcctgaa

SEQ ID NO: 769670 - DNA, 15 bp, Homo sapiens
caaatcattccttag

SEQ ID NO: 769671 - DNA, 14 bp, Homo sapiens
caaatcatttgttt

SEQ ID NO: 769672 - DNA, 18 bp, Homo sapiens
caaatcatttgtttaaaa

SEQ ID NO: 769673 - DNA, 14 bp, Homo sapiens
caaatcccagggaa

SEQ ID NO: 769674 - DNA, 18 bp, Homo sapiens
caaatccgctctcttcct

SEQ ID NO: 769675 - DNA, 20 bp, Homo sapiens
caaatcctccctacttccaa

SEQ ID NO: 769676 - DNA, 22 bp, Homo sapiens
caaatcctccctacttccaaga

SEQ ID NO: 769677 - DNA, 13 bp, Homo sapiens
caaatcctggaag

SEQ ID NO: 769678 - DNA, 23 bp, Homo sapiens
caaatcctggaaggacacagtga

SEQ ID NO: 769679 - DNA, 22 bp, Homo sapiens
caaatcctttctgccccccagg

SEQ ID NO: 769680 - DNA, 23 bp, Homo sapiens
caaatcctttctgccccccaggg

SEQ ID NO: 769681 - DNA, 19 bp, Homo sapiens
caaatcgtccagcgacctt

SEQ ID NO: 769682 - DNA, 21 bp, Homo sapiens
caaatcgtggcacgtattgct

SEQ ID NO: 769683 - DNA, 23 bp, Homo sapiens
caaatctaatctcttattctaat

SEQ ID NO: 769684 - DNA, 14 bp, Homo sapiens
caaatctaccactg

SEQ ID NO: 769685 - DNA, 15 bp, Homo sapiens
caaatctataaatat

SEQ ID NO: 769686 - DNA, 16 bp, Homo sapiens
caaatctattcagaca

SEQ ID NO: 769687 - DNA, 16 bp, Homo sapiens
caaatctgatggcctt

SEQ ID NO: 769688 - DNA, 17 bp, Homo sapiens
caaatctgatttcatta

SEQ ID NO: 769689 - DNA, 20 bp, Homo sapiens
caaatctgggtatctttcca

SEQ ID NO: 769690 - DNA, 23 bp, Homo sapiens
caaatctgtatatgttgtaataa

SEQ ID NO: 769691 - DNA, 18 bp, Homo sapiens
caaatctgtcagcatctg

SEQ ID NO: 769692 - DNA, 16 bp, Homo sapiens
caaatctgtcctctgt

SEQ ID NO: 769693 - DNA, 17 bp, Homo sapiens
caaatctgtcctctgta

SEQ ID NO: 769694 - DNA, 19 bp, Homo sapiens
caaatctgtcctctgtagt

SEQ ID NO: 769695 - DNA, 20 bp, Homo sapiens
caaatctgtcctctgtagta

SEQ ID NO: 769696 - DNA, 13 bp, Homo sapiens
caaatcttgaaat

SEQ ID NO: 769697 - DNA, 16 bp, Homo sapiens
caaatcttgaatttct

SEQ ID NO: 769698 - DNA, 22 bp, Homo sapiens
caaatcttggttgatgccaaaa

SEQ ID NO: 769699 - DNA, 14 bp, Homo sapiens
caaatgaactttaa

SEQ ID NO: 769700 - DNA, 15 bp, Homo sapiens
caaatgaactttaaa

SEQ ID NO: 769701 - DNA, 23 bp, Homo sapiens
caaatgaacttttacagaatgca

SEQ ID NO: 769702 - DNA, 15 bp, Homo sapiens
caaatgaagaaagtc

SEQ ID NO: 769703 - DNA, 16 bp, Homo sapiens
caaatgaagaaagtca

SEQ ID NO: 769704 - DNA, 22 bp, Homo sapiens
caaatgaagaaagtcaaaaaat

SEQ ID NO: 769705 - DNA, 19 bp, Homo sapiens
caaatgaatttcatgtgaa

SEQ ID NO: 769706 - DNA, 17 bp, Homo sapiens
caaatgacccaaagacc

SEQ ID NO: 769707 - DNA, 20 bp, Homo sapiens
caaatgagatctaagccttt

SEQ ID NO: 769708 - DNA, 12 bp, Homo sapiens
caaatgagccat

SEQ ID NO: 769709 - DNA, 21 bp, Homo sapiens
caaatgagtaacatttgctgt

SEQ ID NO: 769710 - DNA, 21 bp, Homo sapiens
caaatgcaaaaactctttgag

SEQ ID NO: 769711 - DNA, 14 bp, Homo sapiens
caaatgcaaaatta

SEQ ID NO: 769712 - DNA, 16 bp, Homo sapiens
caaatgcagtatattt

SEQ ID NO: 769713 - DNA, 23 bp, Homo sapiens
caaatgcctgttgtatttatgga

SEQ ID NO: 769714 - DNA, 21 bp, Homo sapiens
caaatgccttcatgaatcttt

SEQ ID NO: 769715 - DNA, 21 bp, Homo sapiens
caaatggaaaatgtatatttt

SEQ ID NO: 769716 - DNA, 19 bp, Homo sapiens
caaatggagaagctgcagg

SEQ ID NO: 769717 - DNA, 14 bp, Homo sapiens
caaatggaggaata

SEQ ID NO: 769718 - DNA, 18 bp, Homo sapiens
caaatggcgtctggaagt

SEQ ID NO: 769719 - DNA, 21 bp, Homo sapiens
caaatggcgtctggaagtcca

SEQ ID NO: 769720 - DNA, 15 bp, Homo sapiens
caaatggctgagatg

SEQ ID NO: 769721 - DNA, 14 bp, Homo sapiens
caaatggctgcttt

SEQ ID NO: 769722 - DNA, 22 bp, Homo sapiens
caacaataaaccaaacccagcc

SEQ ID NO: 769723 - DNA, 23 bp, Homo sapiens
caacaataaaccaaacccagcca

SEQ ID NO: 769724 - DNA, 22 bp, Homo sapiens
caacaatctggagatactaaat

SEQ ID NO: 769725 - DNA, 19 bp, Homo sapiens
caacaatgaatcagaacag

SEQ ID NO: 769726 - DNA, 18 bp, Homo sapiens
caacaattggtaaaactc

SEQ ID NO: 769727 - DNA, 19 bp, Homo sapiens
caacaattggtaaaactca

SEQ ID NO: 769728 - DNA, 18 bp, Homo sapiens
caacaatttatgaattga

SEQ ID NO: 769729 - DNA, 19 bp, Homo sapiens
caacaatttctactttgaa

SEQ ID NO: 769730 - DNA, 20 bp, Homo sapiens
caacaatttctactttgaag

SEQ ID NO: 769731 - DNA, 13 bp, Homo sapiens
caacacaaagaga

SEQ ID NO: 769732 - DNA, 15 bp, Homo sapiens
caacacaaagagaaa

SEQ ID NO: 769733 - DNA, 13 bp, Homo sapiens
caacacaaagatt

SEQ ID NO: 769734 - DNA, 20 bp, Homo sapiens
caacacaagctggaagcaca

SEQ ID NO: 769735 - DNA, 11 bp, Homo sapiens
caacacacaga

SEQ ID NO: 769736 - DNA, 13 bp, Homo sapiens
caacaccaagcac

SEQ ID NO: 769737 - DNA, 15 bp, Homo sapiens
caacaccaagcacag

SEQ ID NO: 769738 - DNA, 14 bp, Homo sapiens
caacaccacagaca

SEQ ID NO: 769739 - DNA, 15 bp, Homo sapiens
caacaccacagacac

SEQ ID NO: 769740 - DNA, 17 bp, Homo sapiens
caacaccacagacacac

SEQ ID NO: 769741 - DNA, 20 bp, Homo sapiens
caacaccacagacacacaca

SEQ ID NO: 769742 - DNA, 15 bp, Homo sapiens
caacaccctgcttct

SEQ ID NO: 769743 - DNA, 21 bp, Homo sapiens
caacaccctgcttctcccggg

SEQ ID NO: 769744 - DNA, 22 bp, Homo sapiens
caacacctgcctctgaccccag

SEQ ID NO: 769745 - DNA, 16 bp, Homo sapiens
caacacctgctgcgct

SEQ ID NO: 769746 - DNA, 22 bp, Homo sapiens
caacaccttcagaggctgaggt

SEQ ID NO: 769747 - DNA, 23 bp, Homo sapiens
caacaccttcagaggctgaggtg

SEQ ID NO: 769748 - DNA, 15 bp, Homo sapiens
caacaccttcctcct

SEQ ID NO: 769749 - DNA, 20 bp, Homo sapiens
caacaccttcctcctgcaga

SEQ ID NO: 769750 - DNA, 15 bp, Homo sapiens
caacacgcacctgcc

SEQ ID NO: 769751 - DNA, 17 bp, Homo sapiens
caacactatataaataa

SEQ ID NO: 769752 - DNA, 19 bp, Homo sapiens
caacactattgtaatcatt

SEQ ID NO: 769753 - DNA, 18 bp, Homo sapiens
caacactccggtcagccc

SEQ ID NO: 769754 - DNA, 23 bp, Homo sapiens
caacactccggtcagcccctggc

SEQ ID NO: 769755 - DNA, 20 bp, Homo sapiens
caacactgggaaacagaggc

SEQ ID NO: 769756 - DNA, 14 bp, Homo sapiens
caacactgtgccct

SEQ ID NO: 769757 - DNA, 16 bp, Homo sapiens
caacactgtgccctgg

SEQ ID NO: 769758 - DNA, 22 bp, Homo sapiens
caacactgtgccctggtggaga

SEQ ID NO: 769759 - DNA, 19 bp, Homo sapiens
caacacttaatagcaacag

SEQ ID NO: 769760 - DNA, 23 bp, Homo sapiens
caacacttgcaggggtccctgct

SEQ ID NO: 769761 - DNA, 18 bp, Homo sapiens
caacactttgagcatttt

SEQ ID NO: 769762 - DNA, 20 bp, Homo sapiens
caacactttgagcattttta

SEQ ID NO: 769763 - DNA, 21 bp, Homo sapiens
caacagaaaaacaatcttatt

SEQ ID NO: 769764 - DNA, 20 bp, Homo sapiens
caacagagactgaatagata

SEQ ID NO: 769765 - DNA, 13 bp, Homo sapiens
caacagagcactt

SEQ ID NO: 769766 - DNA, 14 bp, Homo sapiens
caacagatactgga

SEQ ID NO: 769767 - DNA, 14 bp, Homo sapiens
caacagatcagtaa

SEQ ID NO: 769768 - DNA, 15 bp, Homo sapiens
caacagcaaacaggt

SEQ ID NO: 769769 - DNA, 14 bp, Homo sapiens
caacagcaaaccct

SEQ ID NO: 769770 - DNA, 16 bp, Homo sapiens
caacagcaaaccctga

SEQ ID NO: 769771 - DNA, 16 bp, Homo sapiens
caacagcaaaggaact

SEQ ID NO: 769772 - DNA, 17 bp, Homo sapiens
caacagcaaaggaacta

SEQ ID NO: 769773 - DNA, 17 bp, Homo sapiens
caacagcaaatcacgac

SEQ ID NO: 769774 - DNA, 15 bp, Homo sapiens
caacagcaagtgttt

SEQ ID NO: 769775 - DNA, 17 bp, Homo sapiens
caacagcacctccccgc

SEQ ID NO: 769776 - DNA, 20 bp, Homo sapiens
caacagcacctccccgctgg

SEQ ID NO: 769777 - DNA, 22 bp, Homo sapiens
caacagcacctccccgctggga

SEQ ID NO: 769778 - DNA, 22 bp, Homo sapiens
caacagcactggctctctccag

SEQ ID NO: 769779 - DNA, 15 bp, Homo sapiens
caacagcagtgagtt

SEQ ID NO: 769780 - DNA, 23 bp, Homo sapiens
caacagcagtgatctcagggcag

SEQ ID NO: 769781 - DNA, 15 bp, Homo sapiens
ccttgcggaagccat

SEQ ID NO: 769782 - DNA, 14 bp, Homo sapiens
ccttgctacctcaa

SEQ ID NO: 769783 - DNA, 17 bp, Homo sapiens
ccttgctacctcaaggg

SEQ ID NO: 769784 - DNA, 21 bp, Homo sapiens
ccttgctcactcactcactcc

SEQ ID NO: 769785 - DNA, 23 bp, Homo sapiens
ccttgctcactcactcactccaa

SEQ ID NO: 769786 - DNA, 18 bp, Homo sapiens
ccttgctcagtgcctcct

SEQ ID NO: 769787 - DNA, 15 bp, Homo sapiens
ccttgctcattcttg

SEQ ID NO: 769788 - DNA, 13 bp, Homo sapiens
ccttgctcccttc

SEQ ID NO: 769789 - DNA, 16 bp, Homo sapiens
ccttgctcctagcaga

SEQ ID NO: 769790 - DNA, 13 bp, Homo sapiens
ccttgctctccct

SEQ ID NO: 769791 - DNA, 14 bp, Homo sapiens
ccttgctctccctc

SEQ ID NO: 769792 - DNA, 13 bp, Homo sapiens
ccttgctctgagc

SEQ ID NO: 769793 - DNA, 15 bp, Homo sapiens
ccttgctctgagcac

SEQ ID NO: 769794 - DNA, 19 bp, Homo sapiens
ccttgctcttctttctgag

SEQ ID NO: 769795 - DNA, 12 bp, Homo sapiens
ccttgctgaccc

SEQ ID NO: 769796 - DNA, 13 bp, Homo sapiens
ccttgctgacccc

SEQ ID NO: 769797 - DNA, 16 bp, Homo sapiens
ccttgctgaccccagg

SEQ ID NO: 769798 - DNA, 17 bp, Homo sapiens
ccttgctgatggcttga

SEQ ID NO: 769799 - DNA, 15 bp, Homo sapiens
ccttgctgcagcttc

SEQ ID NO: 769800 - DNA, 20 bp, Homo sapiens
ccttgctgccacaacctgtg

SEQ ID NO: 769801 - DNA, 22 bp, Homo sapiens
ccttgctggacggggactgggg

SEQ ID NO: 769802 - DNA, 13 bp, Homo sapiens
ccttgctggcccc

SEQ ID NO: 769803 - DNA, 14 bp, Homo sapiens
ccttgctggcccca

SEQ ID NO: 769804 - DNA, 15 bp, Homo sapiens
ccttgctggccccag

SEQ ID NO: 769805 - DNA, 19 bp, Homo sapiens
ccttgctggccccagccct

SEQ ID NO: 769806 - DNA, 13 bp, Homo sapiens
ccttgctgggact

SEQ ID NO: 769807 - DNA, 16 bp, Homo sapiens
ccttgctgggccaggg

SEQ ID NO: 769808 - DNA, 21 bp, Homo sapiens
ccttgctggggtccagggctg

SEQ ID NO: 769809 - DNA, 16 bp, Homo sapiens
ccttgctgtcctaggc

SEQ ID NO: 769810 - DNA, 13 bp, Homo sapiens
ccttgctgtcctg

SEQ ID NO: 769811 - DNA, 20 bp, Homo sapiens
ccttgctgttggtcatgtgg

SEQ ID NO: 769812 - DNA, 19 bp, Homo sapiens
ccttgctgtttgtcctgag

SEQ ID NO: 769813 - DNA, 17 bp, Homo sapiens
ccttgcttacctctcag

SEQ ID NO: 769814 - DNA, 16 bp, Homo sapiens
ccttgcttagcctgtg

SEQ ID NO: 769815 - DNA, 17 bp, Homo sapiens
ccttgcttagcctgtgc

SEQ ID NO: 769816 - DNA, 19 bp, Homo sapiens
ccttgcttagcctgtgctg

SEQ ID NO: 769817 - DNA, 18 bp, Homo sapiens
ccttgcttatgacatcac

SEQ ID NO: 769818 - DNA, 11 bp, Homo sapiens
ccttgcttctc

SEQ ID NO: 769819 - DNA, 12 bp, Homo sapiens
ccttgcttctcc

SEQ ID NO: 769820 - DNA, 22 bp, Homo sapiens
ccttgcttctcccatttcctga

SEQ ID NO: 769821 - DNA, 13 bp, Homo sapiens
ccttgcttctctt

SEQ ID NO: 769822 - DNA, 16 bp, Homo sapiens
ccttgcttctcttctt

SEQ ID NO: 769823 - DNA, 20 bp, Homo sapiens
ccttgcttctcttctttcca

SEQ ID NO: 769824 - DNA, 20 bp, Homo sapiens
ccttgcttcttactgataat

SEQ ID NO: 769825 - DNA, 21 bp, Homo sapiens
ccttgcttgttgggattcctg

SEQ ID NO: 769826 - DNA, 16 bp, Homo sapiens
ccttgctttcctgggc

SEQ ID NO: 769827 - DNA, 18 bp, Homo sapiens
ccttgctttgggctttgc

SEQ ID NO: 769828 - DNA, 17 bp, Homo sapiens
ccttgcttttccctctt

SEQ ID NO: 769829 - DNA, 22 bp, Homo sapiens
ccttgcttttccctcttttctt

SEQ ID NO: 769830 - DNA, 17 bp, Homo sapiens
ccttgcttttgcttcta

SEQ ID NO: 769831 - DNA, 21 bp, Homo sapiens
ccttgcttttgcttctagagc

SEQ ID NO: 769832 - DNA, 11 bp, Homo sapiens
ccttggaaacc

SEQ ID NO: 769833 - DNA, 17 bp, Homo sapiens
ccttggaaacctgccct

SEQ ID NO: 769834 - DNA, 20 bp, Homo sapiens
ccttggaaacctgccctgcc

SEQ ID NO: 769835 - DNA, 11 bp, Homo sapiens
ccttggaaatg

SEQ ID NO: 769836 - DNA, 15 bp, Homo sapiens
ccttggaataaagtt

SEQ ID NO: 769837 - DNA, 16 bp, Homo sapiens
ccttggacaccatccc

SEQ ID NO: 769838 - DNA, 16 bp, Homo sapiens
ccttggaccactcctg

SEQ ID NO: 769839 - DNA, 15 bp, Homo sapiens
ccttggacctccagg

SEQ ID NO: 769840 - DNA, 18 bp, Homo sapiens
ccttggactcctcccaca

SEQ ID NO: 769841 - DNA, 19 bp, Homo sapiens
ccttggagagcagctggct

SEQ ID NO: 769842 - DNA, 21 bp, Homo sapiens
ccttggagagcagctggctct

SEQ ID NO: 769843 - DNA, 22 bp, Homo sapiens
ccttggagagcagctggctctc

SEQ ID NO: 769844 - DNA, 18 bp, Homo sapiens
caacctttccctcacccc

SEQ ID NO: 769845 - DNA, 12 bp, Homo sapiens
caacctttctgt

SEQ ID NO: 769846 - DNA, 13 bp, Homo sapiens
caacctttctgta

SEQ ID NO: 769847 - DNA, 20 bp, Homo sapiens
caacgaagaaaaaaaataac

SEQ ID NO: 769848 - DNA, 13 bp, Homo sapiens
caacgacaaagcc

SEQ ID NO: 769849 - DNA, 21 bp, Homo sapiens
caacgagacacattgccttct

SEQ ID NO: 769850 - DNA, 13 bp, Homo sapiens
caacgcagccctg

SEQ ID NO: 769851 - DNA, 14 bp, Homo sapiens
caacgcccctccaa

SEQ ID NO: 769852 - DNA, 17 bp, Homo sapiens
caacgcccctccaaacc

SEQ ID NO: 769853 - DNA, 22 bp, Homo sapiens
caacggaagccccctcttcctc

SEQ ID NO: 769854 - DNA, 14 bp, Homo sapiens
caacggcagtgaag

SEQ ID NO: 769855 - DNA, 18 bp, Homo sapiens
caacggccctgcagccag

SEQ ID NO: 769856 - DNA, 23 bp, Homo sapiens
caacgggattgaagggtcctgcc

SEQ ID NO: 769857 - DNA, 15 bp, Homo sapiens
caacgtagcttctac

SEQ ID NO: 769858 - DNA, 15 bp, Homo sapiens
caacgttactcaggg

SEQ ID NO: 769859 - DNA, 17 bp, Homo sapiens
caacgttactcagggct

SEQ ID NO: 769860 - DNA, 23 bp, Homo sapiens
caacgtttacaccgactagccag

SEQ ID NO: 769861 - DNA, 13 bp, Homo sapiens
caactaaaaataa

SEQ ID NO: 769862 - DNA, 16 bp, Homo sapiens
caactaaaaataaatt

SEQ ID NO: 769863 - DNA, 22 bp, Homo sapiens
caactaaaacccccaataaacc

SEQ ID NO: 769864 - DNA, 22 bp, Homo sapiens
caactaaaatgtgtcttgctgt

SEQ ID NO: 769865 - DNA, 12 bp, Homo sapiens
caactaaataac

SEQ ID NO: 769866 - DNA, 14 bp, Homo sapiens
caactaaataacac

SEQ ID NO: 769867 - DNA, 18 bp, Homo sapiens
caactaacagtcaagaaa

SEQ ID NO: 769868 - DNA, 17 bp, Homo sapiens
caactaaggacaaatta

SEQ ID NO: 769869 - DNA, 20 bp, Homo sapiens
caactaaggacaaattagca

SEQ ID NO: 769870 - DNA, 19 bp, Homo sapiens
caactacagtctaaagctg

SEQ ID NO: 769871 - DNA, 15 bp, Homo sapiens
caactactaatagaa

SEQ ID NO: 769872 - DNA, 21 bp, Homo sapiens
caactactaatagaataaagg

SEQ ID NO: 769873 - DNA, 19 bp, Homo sapiens
caactactacctgtaatga

SEQ ID NO: 769874 - DNA, 13 bp, Homo sapiens
caactagccaagg

SEQ ID NO: 769875 - DNA, 13 bp, Homo sapiens
caactagctggga

SEQ ID NO: 769876 - DNA, 17 bp, Homo sapiens
caactatggatcagaat

SEQ ID NO: 769877 - DNA, 18 bp, Homo sapiens
caactattatgattattt

SEQ ID NO: 769878 - DNA, 15 bp, Homo sapiens
caactcacagcttct

SEQ ID NO: 769879 - DNA, 15 bp, Homo sapiens
caactcactcctttt

SEQ ID NO: 769880 - DNA, 16 bp, Homo sapiens
caactcactcctttta

SEQ ID NO: 769881 - DNA, 17 bp, Homo sapiens
caactcactccttttaa

SEQ ID NO: 769882 - DNA, 20 bp, Homo sapiens
caactcactccttttaaaga

SEQ ID NO: 769883 - DNA, 22 bp, Homo sapiens
caactcactccttttaaagaaa

SEQ ID NO: 769884 - DNA, 21 bp, Homo sapiens
caactcagaatgggggctttc

SEQ ID NO: 769885 - DNA, 20 bp, Homo sapiens
caactccaacctctcggccc

SEQ ID NO: 769886 - DNA, 23 bp, Homo sapiens
caactccaccagatagcagaggg

SEQ ID NO: 769887 - DNA, 15 bp, Homo sapiens
caactccaggaaaga

SEQ ID NO: 769888 - DNA, 12 bp, Homo sapiens
caactccctgcc

SEQ ID NO: 769889 - DNA, 22 bp, Homo sapiens
caactccctgccattttttaag

SEQ ID NO: 769890 - DNA, 19 bp, Homo sapiens
caactccctgccccccagc

SEQ ID NO: 769891 - DNA, 17 bp, Homo sapiens
caactccgcccagcctc

SEQ ID NO: 769892 - DNA, 18 bp, Homo sapiens
caactccgcccagcctct

SEQ ID NO: 769893 - DNA, 19 bp, Homo sapiens
caactccgcccagcctctc

SEQ ID NO: 769894 - DNA, 17 bp, Homo sapiens
caactccgtgtgcctgg

SEQ ID NO: 769895 - DNA, 14 bp, Homo sapiens
caactcctaatttt

SEQ ID NO: 769896 - DNA, 15 bp, Homo sapiens
caactcctaatttta

SEQ ID NO: 769897 - DNA, 13 bp, Homo sapiens
caactcctggctc

SEQ ID NO: 769898 - DNA, 21 bp, Homo sapiens
caactcctggctccgcagggg

SEQ ID NO: 769899 - DNA, 15 bp, Homo sapiens
caactccttttactg

SEQ ID NO: 769900 - DNA, 15 bp, Homo sapiens
caactctccactcca

SEQ ID NO: 769901 - DNA, 13 bp, Homo sapiens
caactctccccag

SEQ ID NO: 769902 - DNA, 15 bp, Homo sapiens
caactctccccagtg

SEQ ID NO: 769903 - DNA, 18 bp, Homo sapiens
caactctccccagtgcct

SEQ ID NO: 769904 - DNA, 12 bp, Homo sapiens
caactctgaagc

SEQ ID NO: 769905 - DNA, 23 bp, Homo sapiens
caactctgaagctaattgtacta

SEQ ID NO: 769906 - DNA, 14 bp, Homo sapiens
caactctgagccca

SEQ ID NO: 769907 - DNA, 15 bp, Homo sapiens
caactctgagcccat

SEQ ID NO: 769908 - DNA, 13 bp, Homo sapiens
caactctgcactc

SEQ ID NO: 769909 - DNA, 14 bp, Homo sapiens
caactctgccttta

SEQ ID NO: 769910 - DNA, 16 bp, Homo sapiens
caactcttgattatcc

SEQ ID NO: 769911 - DNA, 18 bp, Homo sapiens
caactcttgattatccat

SEQ ID NO: 769912 - DNA, 21 bp, Homo sapiens
caactgaaggggtgcacccac

SEQ ID NO: 769913 - DNA, 23 bp, Homo sapiens
caactgaaggggtgcacccacct

SEQ ID NO: 769914 - DNA, 14 bp, Homo sapiens
caactgaataaatt

SEQ ID NO: 769915 - DNA, 12 bp, Homo sapiens
cctttcctcccc

SEQ ID NO: 769916 - DNA, 13 bp, Homo sapiens
cctttcctcccca

SEQ ID NO: 769917 - DNA, 19 bp, Homo sapiens
cctttcctccccatacaca

SEQ ID NO: 769918 - DNA, 18 bp, Homo sapiens
cctttcctcccccagcgt

SEQ ID NO: 769919 - DNA, 16 bp, Homo sapiens
cctttcctcggtctcc

SEQ ID NO: 769920 - DNA, 22 bp, Homo sapiens
cctttcctctccctcaggggca

SEQ ID NO: 769921 - DNA, 12 bp, Homo sapiens
cctttcctctga

SEQ ID NO: 769922 - DNA, 14 bp, Homo sapiens
cctttcctctgcag

SEQ ID NO: 769923 - DNA, 13 bp, Homo sapiens
cctttcctgatgc

SEQ ID NO: 769924 - DNA, 18 bp, Homo sapiens
cctttcctgatgcccctg

SEQ ID NO: 769925 - DNA, 19 bp, Homo sapiens
cctttcctgtgccaacctg

SEQ ID NO: 769926 - DNA, 24 bp, Homo sapiens
cctttcctgtgtgtactctgtcca

SEQ ID NO: 769927 - DNA, 14 bp, Homo sapiens
cctttcgaggcctg

SEQ ID NO: 769928 - DNA, 15 bp, Homo sapiens
cctttcgaggcctga

SEQ ID NO: 769929 - DNA, 18 bp, Homo sapiens
cctttcgaggcctgaagc

SEQ ID NO: 769930 - DNA, 21 bp, Homo sapiens
cctttcgttctgctgaccaaa

SEQ ID NO: 769931 - DNA, 14 bp, Homo sapiens
cctttctagttgaa

SEQ ID NO: 769932 - DNA, 15 bp, Homo sapiens
cctttctagttgaaa

SEQ ID NO: 769933 - DNA, 20 bp, Homo sapiens
cctttctccctgcagccttt

SEQ ID NO: 769934 - DNA, 17 bp, Homo sapiens
cctttctcctccccacc

SEQ ID NO: 769935 - DNA, 15 bp, Homo sapiens
cctttctctcctggc

SEQ ID NO: 769936 - DNA, 18 bp, Homo sapiens
cctttctctctcctctct

SEQ ID NO: 769937 - DNA, 20 bp, Homo sapiens
cctttctcttttcccctttc

SEQ ID NO: 769938 - DNA, 11 bp, Homo sapiens
cctttctgccc

SEQ ID NO: 769939 - DNA, 19 bp, Homo sapiens
cctttctgccccccagggc

SEQ ID NO: 769940 - DNA, 14 bp, Homo sapiens
cctttctggcctgt

SEQ ID NO: 769941 - DNA, 18 bp, Homo sapiens
cctttctggcctgttatg

SEQ ID NO: 769942 - DNA, 13 bp, Homo sapiens
cctttctgggctt

SEQ ID NO: 769943 - DNA, 22 bp, Homo sapiens
cctttctgggctttctcctgga

SEQ ID NO: 769944 - DNA, 11 bp, Homo sapiens
cctttctgtgt

SEQ ID NO: 769945 - DNA, 13 bp, Homo sapiens
cctttctgtgtgc

SEQ ID NO: 769946 - DNA, 19 bp, Homo sapiens
cctttcttaattttgtctt

SEQ ID NO: 769947 - DNA, 21 bp, Homo sapiens
cctttcttcctatttatcata

SEQ ID NO: 769948 - DNA, 15 bp, Homo sapiens
cctttcttctgccct

SEQ ID NO: 769949 - DNA, 17 bp, Homo sapiens
cctttcttgtctttcct

SEQ ID NO: 769950 - DNA, 19 bp, Homo sapiens
cctttcttttccccctttg

SEQ ID NO: 769951 - DNA, 17 bp, Homo sapiens
cctttctttttcttctt

SEQ ID NO: 769952 - DNA, 19 bp, Homo sapiens
cctttgagatctggggagg

SEQ ID NO: 769953 - DNA, 20 bp, Homo sapiens
cctttgagatctggggaggc

SEQ ID NO: 769954 - DNA, 22 bp, Homo sapiens
cctttgagcccacaaagcctta

SEQ ID NO: 769955 - DNA, 13 bp, Homo sapiens
cctttgaggtcta

SEQ ID NO: 769956 - DNA, 18 bp, Homo sapiens
cctttgatcccagaaagt

SEQ ID NO: 769957 - DNA, 22 bp, Homo sapiens
cctttgatgaattcttcctctc

SEQ ID NO: 769958 - DNA, 23 bp, Homo sapiens
cctttgatgaattcttcctctcc

SEQ ID NO: 769959 - DNA, 20 bp, Homo sapiens
cctttgcaagatgcttggtt

SEQ ID NO: 769960 - DNA, 22 bp, Homo sapiens
cctttgcaattgctcttctcca

SEQ ID NO: 769961 - DNA, 17 bp, Homo sapiens
cctttgcacctgagacc

SEQ ID NO: 769962 - DNA, 14 bp, Homo sapiens
cctttgcactgagg

SEQ ID NO: 769963 - DNA, 23 bp, Homo sapiens
cctttgcagttggactctcaggg

SEQ ID NO: 769964 - DNA, 21 bp, Homo sapiens
cctttgcatagctctccttcc

SEQ ID NO: 769965 - DNA, 23 bp, Homo sapiens
cctttgcatggcagggcctcatc

SEQ ID NO: 769966 - DNA, 13 bp, Homo sapiens
ccttttttaaaag

SEQ ID NO: 769967 - DNA, 18 bp, Homo sapiens
ccttttttatacataaac

SEQ ID NO: 769968 - DNA, 19 bp, Homo sapiens
ccttttttatacataaaca

SEQ ID NO: 769969 - DNA, 17 bp, Homo sapiens
ccttttttcaatatgca

SEQ ID NO: 769970 - DNA, 22 bp, Homo sapiens
ccttttttctatatcaaaaaac

SEQ ID NO: 769971 - DNA, 12 bp, Homo sapiens
ccttttttctct

SEQ ID NO: 769972 - DNA, 17 bp, Homo sapiens
ccttttttctcttctgt

SEQ ID NO: 769973 - DNA, 14 bp, Homo sapiens
ccttttttcttttc

SEQ ID NO: 769974 - DNA, 14 bp, Homo sapiens
ccttttttcttttt

SEQ ID NO: 769975 - DNA, 14 bp, Homo sapiens
ccttttttgaacca

SEQ ID NO: 769976 - DNA, 10 bp, Homo sapiens
ccttttttgt

SEQ ID NO: 769977 - DNA, 18 bp, Homo sapiens
ccttttttgtcattttat

SEQ ID NO: 769978 - DNA, 16 bp, Homo sapiens
ccttttttgtctatga

SEQ ID NO: 769979 - DNA, 14 bp, Homo sapiens
ccttttttgtctta

SEQ ID NO: 769980 - DNA, 21 bp, Homo sapiens
ccttttttgtcttattgaaaa

SEQ ID NO: 769981 - DNA, 18 bp, Homo sapiens
cctttttttccatcttta

SEQ ID NO: 769982 - DNA, 16 bp, Homo sapiens
ccttttttttctgatt

SEQ ID NO: 769983 - DNA, 16 bp, Homo sapiens
ccttttttttttttcc

SEQ ID NO: 769984 - DNA, 17 bp, Homo sapiens
ccttttttttttttcca

SEQ ID NO: 769985 - DNA, 10 bp, Homo sapiens
cgaaaaatgt

SEQ ID NO: 769986 - DNA, 19 bp, Homo sapiens
cgaaaacaaccgtcctgct

SEQ ID NO: 769987 - DNA, 21 bp, Homo sapiens
cgaaaacaaccgtcctgctgt

SEQ ID NO: 769988 - DNA, 22 bp, Homo sapiens
cgaaaaccaggccttatctcca

SEQ ID NO: 769989 - DNA, 14 bp, Homo sapiens
cgaaaagccagctt

SEQ ID NO: 769990 - DNA, 14 bp, Homo sapiens
cgaaactaagccag

SEQ ID NO: 769991 - DNA, 10 bp, Homo sapiens
cgaaactgcc

SEQ ID NO: 769992 - DNA, 17 bp, Homo sapiens
cgaaacttgttattgtg

SEQ ID NO: 769993 - DNA, 16 bp, Homo sapiens
cgaaagaagacacaga

SEQ ID NO: 769994 - DNA, 15 bp, Homo sapiens
cgaaagcatcactgc

SEQ ID NO: 769995 - DNA, 23 bp, Homo sapiens
cgaaagcatcactgccttggccc

SEQ ID NO: 769996 - DNA, 15 bp, Homo sapiens
cgaaagcctttcctc

SEQ ID NO: 769997 - DNA, 23 bp, Homo sapiens
cgaaaggaggccctgttccctgg

SEQ ID NO: 769998 - DNA, 23 bp, Homo sapiens
cgaaaggatgtaaacagtgcctg

SEQ ID NO: 769999 - DNA, 11 bp, Homo sapiens
cgaaaggcctt

SEQ ID NO: 770000 - DNA, 19 bp, Homo sapiens
cgaaaggccttcagacaca

SEQ ID NO: 770001 - DNA, 23 bp, Homo sapiens
cgaaaggcgagtccaggagctca

SEQ ID NO: 770002 - DNA, 16 bp, Homo sapiens
cgaaataattgttgtt

SEQ ID NO: 770003 - DNA, 21 bp, Homo sapiens
cgaaataattgttgttctgtt

SEQ ID NO: 770004 - DNA, 22 bp, Homo sapiens
cgaaataattgttgttctgtta

SEQ ID NO: 770005 - DNA, 18 bp, Homo sapiens
cgaaatagatatcctctc

SEQ ID NO: 770006 - DNA, 13 bp, Homo sapiens
cgaaatgttattt

SEQ ID NO: 770007 - DNA, 22 bp, Homo sapiens
cgaaatgttattttttaattat

SEQ ID NO: 770008 - DNA, 22 bp, Homo sapiens
cgaacatatcatttgtgaagaa

SEQ ID NO: 770009 - DNA, 23 bp, Homo sapiens
cgaacatatcatttgtgaagaat

SEQ ID NO: 770010 - DNA, 19 bp, Homo sapiens
cgaacatccaaccttccca

SEQ ID NO: 770011 - DNA, 12 bp, Homo sapiens
cgaacatgtgtt

SEQ ID NO: 770012 - DNA, 15 bp, Homo sapiens
cgaacattaggaatt

SEQ ID NO: 770013 - DNA, 22 bp, Homo sapiens
cgaaccaaggcagcctccagag

SEQ ID NO: 770014 - DNA, 14 bp, Homo sapiens
cgaaccacccaaaa

SEQ ID NO: 770015 - DNA, 18 bp, Homo sapiens
cgaacgtatttctccaga

SEQ ID NO: 770016 - DNA, 19 bp, Homo sapiens
cgaacgtatttctccagac

SEQ ID NO: 770017 - DNA, 22 bp, Homo sapiens
cgaacgtatttctccagaccca

SEQ ID NO: 770018 - DNA, 16 bp, Homo sapiens
cgaactgttgtataaa

SEQ ID NO: 770019 - DNA, 18 bp, Homo sapiens
cgaagaaaaaaaataaca

SEQ ID NO: 770020 - DNA, 19 bp, Homo sapiens
cgaagaaaaaaaataacac

SEQ ID NO: 770021 - DNA, 20 bp, Homo sapiens
cgaagaccctcttgcccatc

SEQ ID NO: 770022 - DNA, 15 bp, Homo sapiens
cgaagagtcagcccc

SEQ ID NO: 770023 - DNA, 16 bp, Homo sapiens
cgaagatggtggccac

SEQ ID NO: 770024 - DNA, 20 bp, Homo sapiens
cgaagccatcacttctcccc

SEQ ID NO: 770025 - DNA, 16 bp, Homo sapiens
cgaagctcagcccacc

SEQ ID NO: 770026 - DNA, 18 bp, Homo sapiens
cgaagctcagcccacccc

SEQ ID NO: 770027 - DNA, 12 bp, Homo sapiens
cgaagctctggc

SEQ ID NO: 770028 - DNA, 14 bp, Homo sapiens
cgaagctctggctg

SEQ ID NO: 770029 - DNA, 15 bp, Homo sapiens
cgaagctctggctga

SEQ ID NO: 770030 - DNA, 18 bp, Homo sapiens
cgaaggaacctctcgcca

SEQ ID NO: 770031 - DNA, 18 bp, Homo sapiens
cgaaggagcagtgtgacc

SEQ ID NO: 770032 - DNA, 17 bp, Homo sapiens
cgaaggccccgcctggg

SEQ ID NO: 770033 - DNA, 16 bp, Homo sapiens
cgaaggggccccgggg

SEQ ID NO: 770034 - DNA, 13 bp, Homo sapiens
cgaaggggccctg

SEQ ID NO: 770035 - DNA, 11 bp, Homo sapiens
cgaagtggctc

SEQ ID NO: 770036 - DNA, 21 bp, Homo sapiens
cgaagtgtagggcaagggtgc

SEQ ID NO: 770037 - DNA, 13 bp, Homo sapiens
cgaagtgttgcat

SEQ ID NO: 770038 - DNA, 22 bp, Homo sapiens
cgaagtgtttatgtaatagttc

SEQ ID NO: 770039 - DNA, 14 bp, Homo sapiens
cgaagttgatgcaa

SEQ ID NO: 770040 - DNA, 15 bp, Homo sapiens
cgaatagacatcaaa

SEQ ID NO: 770041 - DNA, 17 bp, Homo sapiens
cgaatagacatcaaact

SEQ ID NO: 770042 - DNA, 23 bp, Homo sapiens
cgaatagggaagtaaaaaaacaa

SEQ ID NO: 770043 - DNA, 16 bp, Homo sapiens
cgaatatagttctgtg

SEQ ID NO: 770044 - DNA, 17 bp, Homo sapiens
cgaatatgaatgtcaca

SEQ ID NO: 770045 - DNA, 23 bp, Homo sapiens
caagaataattcaattttaaaga

SEQ ID NO: 770046 - DNA, 16 bp, Homo sapiens
caagaataattttgga

SEQ ID NO: 770047 - DNA, 17 bp, Homo sapiens
caagaataattttggaa

SEQ ID NO: 770048 - DNA, 20 bp, Homo sapiens
caagaatattgcaaaataca

SEQ ID NO: 770049 - DNA, 21 bp, Homo sapiens
caagaatattgcaaaatacat

SEQ ID NO: 770050 - DNA, 16 bp, Homo sapiens
caagaatattgtccct

SEQ ID NO: 770051 - DNA, 10 bp, Homo sapiens
caagaatcta

SEQ ID NO: 770052 - DNA, 19 bp, Homo sapiens
caagaatctagaagatgtg

SEQ ID NO: 770053 - DNA, 21 bp, Homo sapiens
caagaatggatcacaagatgg

SEQ ID NO: 770054 - DNA, 15 bp, Homo sapiens
caagaattaaaactg

SEQ ID NO: 770055 - DNA, 18 bp, Homo sapiens
caagaattaaaactgagt

SEQ ID NO: 770056 - DNA, 22 bp, Homo sapiens
caagaattaaaactgagtccat

SEQ ID NO: 770057 - DNA, 21 bp, Homo sapiens
caagaattctccaaaacaatt

SEQ ID NO: 770058 - DNA, 18 bp, Homo sapiens
caagaattcttatgctta

SEQ ID NO: 770059 - DNA, 20 bp, Homo sapiens
caagaatttgacttggaaaa

SEQ ID NO: 770060 - DNA, 20 bp, Homo sapiens
caagacaaatcaacagaagc

SEQ ID NO: 770061 - DNA, 13 bp, Homo sapiens
caagacacatgct

SEQ ID NO: 770062 - DNA, 19 bp, Homo sapiens
caagacacatgctgaggtt

SEQ ID NO: 770063 - DNA, 15 bp, Homo sapiens
caagacagaaaagtg

SEQ ID NO: 770064 - DNA, 19 bp, Homo sapiens
caagacagaaaagtgcctg

SEQ ID NO: 770065 - DNA, 17 bp, Homo sapiens
caagacagaagctgaag

SEQ ID NO: 770066 - DNA, 12 bp, Homo sapiens
caagacagagac

SEQ ID NO: 770067 - DNA, 13 bp, Homo sapiens
caagacagatgcc

SEQ ID NO: 770068 - DNA, 21 bp, Homo sapiens
caagacagatgccccagagct

SEQ ID NO: 770069 - DNA, 21 bp, Homo sapiens
caagacagtgagacagtctgg

SEQ ID NO: 770070 - DNA, 14 bp, Homo sapiens
caagacatgtctgt

SEQ ID NO: 770071 - DNA, 11 bp, Homo sapiens
caagacattgt

SEQ ID NO: 770072 - DNA, 11 bp, Homo sapiens
caagacatttg

SEQ ID NO: 770073 - DNA, 11 bp, Homo sapiens
caagaccaaaa

SEQ ID NO: 770074 - DNA, 18 bp, Homo sapiens
caagaccaccagggtccc

SEQ ID NO: 770075 - DNA, 18 bp, Homo sapiens
caagaccacggagggagc

SEQ ID NO: 770076 - DNA, 14 bp, Homo sapiens
caagaccacgtttc

SEQ ID NO: 770077 - DNA, 16 bp, Homo sapiens
caagaccacgtttcta

SEQ ID NO: 770078 - DNA, 17 bp, Homo sapiens
caagaccacgtttctaa

SEQ ID NO: 770079 - DNA, 13 bp, Homo sapiens
caagaccagcctg

SEQ ID NO: 770080 - DNA, 14 bp, Homo sapiens
caagaccagcctgg

SEQ ID NO: 770081 - DNA, 15 bp, Homo sapiens
caagacccccagcac

SEQ ID NO: 770082 - DNA, 22 bp, Homo sapiens
caagacccccatttgtcccaga

SEQ ID NO: 770083 - DNA, 16 bp, Homo sapiens
caagaccgccccaggg

SEQ ID NO: 770084 - DNA, 21 bp, Homo sapiens
caagacctagtcccctttcct

SEQ ID NO: 770085 - DNA, 13 bp, Homo sapiens
caagacgtaaaga

SEQ ID NO: 770086 - DNA, 14 bp, Homo sapiens
caagactatctaca

SEQ ID NO: 770087 - DNA, 18 bp, Homo sapiens
caagactatctacaaaaa

SEQ ID NO: 770088 - DNA, 15 bp, Homo sapiens
caagactcctcaggc

SEQ ID NO: 770089 - DNA, 13 bp, Homo sapiens
cgaccatctgatt

SEQ ID NO: 770090 - DNA, 14 bp, Homo sapiens
cgacccagccagct

SEQ ID NO: 770091 - DNA, 20 bp, Homo sapiens
cgacccagccagctgcaggg

SEQ ID NO: 770092 - DNA, 15 bp, Homo sapiens
cgacccccctacccc

SEQ ID NO: 770093 - DNA, 21 bp, Homo sapiens
cgacccccctaccccatgctg

SEQ ID NO: 770094 - DNA, 14 bp, Homo sapiens
cgacccctgcctcg

SEQ ID NO: 770095 - DNA, 21 bp, Homo sapiens
cgacccctgcctcgagggccg

SEQ ID NO: 770096 - DNA, 14 bp, Homo sapiens
cgacccgaggccca

SEQ ID NO: 770097 - DNA, 15 bp, Homo sapiens
cgacccgaggcccag

SEQ ID NO: 770098 - DNA, 17 bp, Homo sapiens
cgaccctcctggccttc

SEQ ID NO: 770099 - DNA, 22 bp, Homo sapiens
cgaccctctgggaacctcccag

SEQ ID NO: 770100 - DNA, 23 bp, Homo sapiens
cgacccttggtgtttcccttcct

SEQ ID NO: 770101 - DNA, 15 bp, Homo sapiens
cgaccgaggctggag

SEQ ID NO: 770102 - DNA, 13 bp, Homo sapiens
cgaccgccccagt

SEQ ID NO: 770103 - DNA, 12 bp, Homo sapiens
cgacctcagcct

SEQ ID NO: 770104 - DNA, 13 bp, Homo sapiens
cgacctcagcctt

SEQ ID NO: 770105 - DNA, 22 bp, Homo sapiens
cgacctcgtcctccccctgcca

SEQ ID NO: 770106 - DNA, 15 bp, Homo sapiens
cgacctctctgcctc

SEQ ID NO: 770107 - DNA, 13 bp, Homo sapiens
cgacctggccgcg

SEQ ID NO: 770108 - DNA, 12 bp, Homo sapiens
cgacggcctcca

SEQ ID NO: 770109 - DNA, 15 bp, Homo sapiens
cgacggcctccagga

SEQ ID NO: 770110 - DNA, 12 bp, Homo sapiens
cgactcagcacc

SEQ ID NO: 770111 - DNA, 15 bp, Homo sapiens
cgactccagccagcg

SEQ ID NO: 770112 - DNA, 17 bp, Homo sapiens
cgactccagccagcgcc

SEQ ID NO: 770113 - DNA, 20 bp, Homo sapiens
cgactccagccagcgcctcc

SEQ ID NO: 770114 - DNA, 23 bp, Homo sapiens
cgactcccccaaccaaggaagga

SEQ ID NO: 770115 - DNA, 19 bp, Homo sapiens
cgactccgttggccactcc

SEQ ID NO: 770116 - DNA, 13 bp, Homo sapiens
cgactctgctgct

SEQ ID NO: 770117 - DNA, 16 bp, Homo sapiens
cgactctggccctggc

SEQ ID NO: 770118 - DNA, 18 bp, Homo sapiens
cgactctggccctggccc

SEQ ID NO: 770119 - DNA, 16 bp, Homo sapiens
cgactgaccctgagga

SEQ ID NO: 770120 - DNA, 22 bp, Homo sapiens
cgactgaccctgaggaggccgc

SEQ ID NO: 770121 - DNA, 23 bp, Homo sapiens
cgactgcccagccactccaagcc

SEQ ID NO: 770122 - DNA, 13 bp, Homo sapiens
cgactgcccctgc

SEQ ID NO: 770123 - DNA, 17 bp, Homo sapiens
cgactgcccggcagggt

SEQ ID NO: 770124 - DNA, 13 bp, Homo sapiens
cgactgcctgtct

SEQ ID NO: 770125 - DNA, 13 bp, Homo sapiens
cgactggactgtc

SEQ ID NO: 770126 - DNA, 15 bp, Homo sapiens
cgactggccagggcc

SEQ ID NO: 770127 - DNA, 20 bp, Homo sapiens
cgactggccagggccacgct

SEQ ID NO: 770128 - DNA, 16 bp, Homo sapiens
cgactggtccagctct

SEQ ID NO: 770129 - DNA, 19 bp, Homo sapiens
cgactggtccagctctgac

SEQ ID NO: 770130 - DNA, 11 bp, Homo sapiens
cgactgtctcc

SEQ ID NO: 770131 - DNA, 19 bp, Homo sapiens
cgactgtgacctgtgggga

SEQ ID NO: 770132 - DNA, 16 bp, Homo sapiens
cgacttatttcttaaa

SEQ ID NO: 770133 - DNA, 22 bp, Homo sapiens
cgacttgaatattcctggactt

SEQ ID NO: 770134 - DNA, 16 bp, Homo sapiens
cgacttgcatttttgc

SEQ ID NO: 770135 - DNA, 19 bp, Homo sapiens
cgacttggagactcctggt

SEQ ID NO: 770136 - DNA, 19 bp, Homo sapiens
cgacttgtttttgcacatg

SEQ ID NO: 770137 - DNA, 13 bp, Homo sapiens
cgactttctgcct

SEQ ID NO: 770138 - DNA, 14 bp, Homo sapiens
cgactttctgcctg

SEQ ID NO: 770139 - DNA, 15 bp, Homo sapiens
cgactttctgcctgg

SEQ ID NO: 770140 - DNA, 20 bp, Homo sapiens
cgacttttgttctcttctgc

SEQ ID NO: 770141 - DNA, 22 bp, Homo sapiens
cgacttttttgagacatgggat

SEQ ID NO: 770142 - DNA, 12 bp, Homo sapiens
cgagaaattggg

SEQ ID NO: 770143 - DNA, 18 bp, Homo sapiens
cgagaagtgctcttggct

SEQ ID NO: 770144 - DNA, 22 bp, Homo sapiens
cgagaatattcaaaattccaaa

SEQ ID NO: 770145 - DNA, 16 bp, Homo sapiens
cgagacacattgcctt

SEQ ID NO: 770146 - DNA, 13 bp, Homo sapiens
cgagacactttat

SEQ ID NO: 770147 - DNA, 17 bp, Homo sapiens
cgagaccaacctgacca

SEQ ID NO: 770148 - DNA, 15 bp, Homo sapiens
cgagaccagcctggc

SEQ ID NO: 770149 - DNA, 17 bp, Homo sapiens
cgagaccagcctggcca

SEQ ID NO: 770150 - DNA, 13 bp, Homo sapiens
cgagaccagtctg

SEQ ID NO: 770151 - DNA, 18 bp, Homo sapiens
cgagaccatcctggcccc

SEQ ID NO: 770152 - DNA, 21 bp, Homo sapiens
cgagacgcacacagctgagca

SEQ ID NO: 770153 - DNA, 17 bp, Homo sapiens
cgagactgagaggcaga

SEQ ID NO: 770154 - DNA, 18 bp, Homo sapiens
cgagactgagaggcagaa

SEQ ID NO: 770155 - DNA, 12 bp, Homo sapiens
cgagagaggcgc

SEQ ID NO: 770156 - DNA, 14 bp, Homo sapiens
cgagagcagtgggc

SEQ ID NO: 770157 - DNA, 20 bp, Homo sapiens
cgagagcctgctcccccacc

SEQ ID NO: 770158 - DNA, 21 bp, Homo sapiens
cgagagcctgctcccccaccc

SEQ ID NO: 770159 - DNA, 14 bp, Homo sapiens
cgagagctggccaa

SEQ ID NO: 770160 - DNA, 23 bp, Homo sapiens
cgagagctggccaaagagccttt

SEQ ID NO: 770161 - DNA, 22 bp, Homo sapiens
cgagaggccagttgatctgctc

SEQ ID NO: 770162 - DNA, 23 bp, Homo sapiens
cgagaggctggtgtatgcactgc

SEQ ID NO: 770163 - DNA, 14 bp, Homo sapiens
cgagaggtgggcca

SEQ ID NO: 770164 - DNA, 19 bp, Homo sapiens
cgagagtagccgagagcct

SEQ ID NO: 770165 - DNA, 15 bp, Homo sapiens
cgagagtctgtctca

SEQ ID NO: 770166 - DNA, 15 bp, Homo sapiens
cgagataggggaggg

SEQ ID NO: 770167 - DNA, 16 bp, Homo sapiens
cgagataggggagggg

SEQ ID NO: 770168 - DNA, 17 bp, Homo sapiens
cgagataggggaggggg

SEQ ID NO: 770169 - DNA, 16 bp, Homo sapiens
cgagatcacgccactg

SEQ ID NO: 770170 - DNA, 17 bp, Homo sapiens
cgagatccccagggcag

SEQ ID NO: 770171 - DNA, 15 bp, Homo sapiens
cgagatcttccttcc

SEQ ID NO: 770172 - DNA, 20 bp, Homo sapiens
cgagattgcaccactgcact

SEQ ID NO: 770173 - DNA, 12 bp, Homo sapiens
cgagatttcttt

SEQ ID NO: 770174 - DNA, 14 bp, Homo sapiens
cgagcaaagatcaa

SEQ ID NO: 770175 - DNA, 15 bp, Homo sapiens
cgagcaaagatcaaa

SEQ ID NO: 770176 - DNA, 14 bp, Homo sapiens
cgagcaagccggca

SEQ ID NO: 770177 - DNA, 18 bp, Homo sapiens
cgagcacctccagcctga

SEQ ID NO: 770178 - DNA, 16 bp, Homo sapiens
cgagcactggccagag

SEQ ID NO: 770179 - DNA, 21 bp, Homo sapiens
cgagcatcccccaaagttcac

SEQ ID NO: 770180 - DNA, 13 bp, Homo sapiens
cgagcatccccct

SEQ ID NO: 770181 - DNA, 16 bp, Homo sapiens
cgagcatccccctcct

SEQ ID NO: 770182 - DNA, 19 bp, Homo sapiens
cgagcatgcggagccagca

SEQ ID NO: 770183 - DNA, 16 bp, Homo sapiens
cgagccacaagctgca

SEQ ID NO: 770184 - DNA, 19 bp, Homo sapiens
cgagccacaagctgcactg

SEQ ID NO: 770185 - DNA, 21 bp, Homo sapiens
cgagccacaagctgcactgtg

SEQ ID NO: 770186 - DNA, 13 bp, Homo sapiens
cgagccacaggaa

SEQ ID NO: 770187 - DNA, 15 bp, Homo sapiens
cgagccacaggaacg

SEQ ID NO: 770188 - DNA, 20 bp, Homo sapiens
cgagccaccatgcttgcctg

SEQ ID NO: 770189 - DNA, 16 bp, Homo sapiens
cgagccacgcagtgcc

SEQ ID NO: 770190 - DNA, 15 bp, Homo sapiens
cgagcccctcggctc

SEQ ID NO: 770191 - DNA, 21 bp, Homo sapiens
cgagcccctcggctctggagg

SEQ ID NO: 770192 - DNA, 22 bp, Homo sapiens
cgagcccctcggctctggaggc

SEQ ID NO: 770193 - DNA, 14 bp, Homo sapiens
cgagccctgactcc

SEQ ID NO: 770194 - DNA, 14 bp, Homo sapiens
cgagccgggcctgg

SEQ ID NO: 770195 - DNA, 14 bp, Homo sapiens
cgagcctcctcagg

SEQ ID NO: 770196 - DNA, 15 bp, Homo sapiens
cgagcctcctcaggg

SEQ ID NO: 770197 - DNA, 17 bp, Homo sapiens
cgagcctcctcaggggg

SEQ ID NO: 770198 - DNA, 12 bp, Homo sapiens
cgagcctgtgcc

SEQ ID NO: 770199 - DNA, 21 bp, Homo sapiens
cgagcctgtgccttcctcccc

SEQ ID NO: 770200 - DNA, 15 bp, Homo sapiens
cgagcgacggctcct

SEQ ID NO: 770201 - DNA, 23 bp, Homo sapiens
cgagcgctttctggaaaagagga

SEQ ID NO: 770202 - DNA, 16 bp, Homo sapiens
cgagctactctcttgc

SEQ ID NO: 770203 - DNA, 19 bp, Homo sapiens
cgagctcctggggagctcc

SEQ ID NO: 770204 - DNA, 22 bp, Homo sapiens
cgagctcctggggagctcctgg

SEQ ID NO: 770205 - DNA, 17 bp, Homo sapiens
cgagctcgtgtatcctg

SEQ ID NO: 770206 - DNA, 19 bp, Homo sapiens
cgagctcgtgtatcctggg

SEQ ID NO: 770207 - DNA, 14 bp, Homo sapiens
cgagctgctctgct

SEQ ID NO: 770208 - DNA, 10 bp, Homo sapiens
cgagctgctt

SEQ ID NO: 770209 - DNA, 15 bp, Homo sapiens
cgagctgctttgtgg

SEQ ID NO: 770210 - DNA, 17 bp, Homo sapiens
cgagctgctttgtgggc

SEQ ID NO: 770211 - DNA, 13 bp, Homo sapiens
cgagctggtgcat

SEQ ID NO: 770212 - DNA, 15 bp, Homo sapiens
cgatgtacagtatca

SEQ ID NO: 770213 - DNA, 16 bp, Homo sapiens
cgatgtgctcagccaa

SEQ ID NO: 770214 - DNA, 22 bp, Homo sapiens
cgatgtggccctggcctgctgg

SEQ ID NO: 770215 - DNA, 16 bp, Homo sapiens
cgatgtgtctcccaga

SEQ ID NO: 770216 - DNA, 15 bp, Homo sapiens
cgattcatattgaat

SEQ ID NO: 770217 - DNA, 18 bp, Homo sapiens
cgattgattgatgtacag

SEQ ID NO: 770218 - DNA, 21 bp, Homo sapiens
cgattgattgatgtacagaac

SEQ ID NO: 770219 - DNA, 22 bp, Homo sapiens
cgattgattgatgtacagaaca

SEQ ID NO: 770220 - DNA, 21 bp, Homo sapiens
cgatttcctcccacctccgtg

SEQ ID NO: 770221 - DNA, 17 bp, Homo sapiens
cgatttctgtaaactct

SEQ ID NO: 770222 - DNA, 20 bp, Homo sapiens
cgatttctgtttagataata

SEQ ID NO: 770223 - DNA, 20 bp, Homo sapiens
cgatttgcaggattcccttc

SEQ ID NO: 770224 - DNA, 14 bp, Homo sapiens
cgatttgtcccagg

SEQ ID NO: 770225 - DNA, 23 bp, Homo sapiens
cgattttgtatctgcaggcagac

SEQ ID NO: 770226 - DNA, 12 bp, Homo sapiens
cgatttttgtat

SEQ ID NO: 770227 - DNA, 15 bp, Homo sapiens
cgcaaaccacactgg

SEQ ID NO: 770228 - DNA, 16 bp, Homo sapiens
cgcaagagggtctctt

SEQ ID NO: 770229 - DNA, 21 bp, Homo sapiens
cgcaagcctgtaatcccagct

SEQ ID NO: 770230 - DNA, 21 bp, Homo sapiens
cgcaaggcctctcagacccag

SEQ ID NO: 770231 - DNA, 20 bp, Homo sapiens
cgcaagggcatcaggcactg

SEQ ID NO: 770232 - DNA, 15 bp, Homo sapiens
cgcaagggcctggac

SEQ ID NO: 770233 - DNA, 17 bp, Homo sapiens
cgcaatagttttttact

SEQ ID NO: 770234 - DNA, 15 bp, Homo sapiens
cgcaatgtggagcag

SEQ ID NO: 770235 - DNA, 21 bp, Homo sapiens
cgcacaaggctgaccaagaga

SEQ ID NO: 770236 - DNA, 17 bp, Homo sapiens
cgcacacagctgagcac

SEQ ID NO: 770237 - DNA, 14 bp, Homo sapiens
cgcacacagggctc

SEQ ID NO: 770238 - DNA, 23 bp, Homo sapiens
cgcacacatcttacctctcatgc

SEQ ID NO: 770239 - DNA, 13 bp, Homo sapiens
cgcaccagctgct

SEQ ID NO: 770240 - DNA, 16 bp, Homo sapiens
cgcaccagctgctctg

SEQ ID NO: 770241 - DNA, 14 bp, Homo sapiens
cgcaccattctgac

SEQ ID NO: 770242 - DNA, 13 bp, Homo sapiens
cgcaccccagtgc

SEQ ID NO: 770243 - DNA, 14 bp, Homo sapiens
cgcacccccaccct

SEQ ID NO: 770244 - DNA, 21 bp, Homo sapiens
cgcaccggagtgtctggaatt

SEQ ID NO: 770245 - DNA, 19 bp, Homo sapiens
cgcacctccacgccactgc

SEQ ID NO: 770246 - DNA, 16 bp, Homo sapiens
cgcacctgccccctgg

SEQ ID NO: 770247 - DNA, 15 bp, Homo sapiens
cgcacctgcctcagg

SEQ ID NO: 770248 - DNA, 14 bp, Homo sapiens
cgcaccttcctcct

SEQ ID NO: 770249 - DNA, 16 bp, Homo sapiens
cgcaccttcctcctcc

SEQ ID NO: 770250 - DNA, 16 bp, Homo sapiens
cgcaccttgctgtgtg

SEQ ID NO: 770251 - DNA, 17 bp, Homo sapiens
cgcaccttgctgtgtga

SEQ ID NO: 770252 - DNA, 16 bp, Homo sapiens
cgcacgcacacacaca

SEQ ID NO: 770253 - DNA, 14 bp, Homo sapiens
cgcactctgccccc

SEQ ID NO: 770254 - DNA, 17 bp, Homo sapiens
cgcacttaccgccctgc

SEQ ID NO: 770255 - DNA, 23 bp, Homo sapiens
cgcacttgcagaggagcccagtg

SEQ ID NO: 770256 - DNA, 20 bp, Homo sapiens
cgcactttccacttcttcct

SEQ ID NO: 770257 - DNA, 15 bp, Homo sapiens
cgcagaagcagcccc

SEQ ID NO: 770258 - DNA, 16 bp, Homo sapiens
cgcagaagcagcccct

SEQ ID NO: 770259 - DNA, 17 bp, Homo sapiens
cgcagacctaagccctg

SEQ ID NO: 770260 - DNA, 18 bp, Homo sapiens
cgcagactgcttggccag

SEQ ID NO: 770261 - DNA, 13 bp, Homo sapiens
cgcagagaggctc

SEQ ID NO: 770262 - DNA, 12 bp, Homo sapiens
cgcagagcccac

SEQ ID NO: 770263 - DNA, 16 bp, Homo sapiens
cgcagagcttttcaga

SEQ ID NO: 770264 - DNA, 15 bp, Homo sapiens
cgcagatgaggggcc

SEQ ID NO: 770265 - DNA, 10 bp, Homo sapiens
cgcagcagct

SEQ ID NO: 770266 - DNA, 20 bp, Homo sapiens
cgcagcagctgggacccctc

SEQ ID NO: 770267 - DNA, 13 bp, Homo sapiens
cgcagccaaggcc

SEQ ID NO: 770268 - DNA, 21 bp, Homo sapiens
cgcagccaaggccgaagctct

SEQ ID NO: 770269 - DNA, 23 bp, Homo sapiens
cgcagcccccgcgccctccctcc

SEQ ID NO: 770270 - DNA, 15 bp, Homo sapiens
cgcagcccgcctgcc

SEQ ID NO: 770271 - DNA, 16 bp, Homo sapiens
cgcagcccgcctgccg

SEQ ID NO: 770272 - DNA, 23 bp, Homo sapiens
cgcagcctctcagtgccctccag

SEQ ID NO: 770273 - DNA, 13 bp, Homo sapiens
cgcagcctgaagc

SEQ ID NO: 770274 - DNA, 15 bp, Homo sapiens
cgcagcctgaagcct

SEQ ID NO: 770275 - DNA, 18 bp, Homo sapiens
cgcagcctgaagcctgga

SEQ ID NO: 770276 - DNA, 17 bp, Homo sapiens
cgcagcctggcatctgt

SEQ ID NO: 770277 - DNA, 18 bp, Homo sapiens
cgcagcggtgggaaggaa

SEQ ID NO: 770278 - DNA, 17 bp, Homo sapiens
cgcagctcttgcccttc

SEQ ID NO: 770279 - DNA, 18 bp, Homo sapiens
cgcagctcttgcccttcc

SEQ ID NO: 770280 - DNA, 20 bp, Homo sapiens
cgcaggaactgggctgggcc

SEQ ID NO: 770281 - DNA, 13 bp, Homo sapiens
cgcaggaaggcag

SEQ ID NO: 770282 - DNA, 19 bp, Homo sapiens
cgcaggaccaagggggcgg

SEQ ID NO: 770283 - DNA, 21 bp, Homo sapiens
cgcaggagtctctgccaccca

SEQ ID NO: 770284 - DNA, 23 bp, Homo sapiens
cgcaggagtctctgccacccact

SEQ ID NO: 770285 - DNA, 17 bp, Homo sapiens
cgcaggatccgctgcca

SEQ ID NO: 770286 - DNA, 19 bp, Homo sapiens
cgcaggatccgctgccacc

SEQ ID NO: 770287 - DNA, 19 bp, Homo sapiens
cgcaggcagcgcagggctg

SEQ ID NO: 770288 - DNA, 14 bp, Homo sapiens
cgcaggcccagtga

SEQ ID NO: 770289 - DNA, 16 bp, Homo sapiens
cgcaggccctgtccag

SEQ ID NO: 770290 - DNA, 18 bp, Homo sapiens
cgcaggccctgtccagcc

SEQ ID NO: 770291 - DNA, 16 bp, Homo sapiens
cgcaggcggccagggc

SEQ ID NO: 770292 - DNA, 19 bp, Homo sapiens
cgcagggaatgcagcagga

SEQ ID NO: 770293 - DNA, 22 bp, Homo sapiens
cgcagggacatggggcaagcca

SEQ ID NO: 770294 - DNA, 16 bp, Homo sapiens
cgcagggccatgcaga

SEQ ID NO: 770295 - DNA, 15 bp, Homo sapiens
cgcagggctggcacg

SEQ ID NO: 770296 - DNA, 22 bp, Homo sapiens
cgcaggggtttgggtgggggct

SEQ ID NO: 770297 - DNA, 21 bp, Homo sapiens
cgcagggtccaaaggccagcg

SEQ ID NO: 770298 - DNA, 23 bp, Homo sapiens
cgcagggtggtggtattctgtca

SEQ ID NO: 770299 - DNA, 12 bp, Homo sapiens
cgcagtccccag

SEQ ID NO: 770300 - DNA, 15 bp, Homo sapiens
cgcagtccccagccc

SEQ ID NO: 770301 - DNA, 16 bp, Homo sapiens
cgcagtccccagccct

SEQ ID NO: 770302 - DNA, 17 bp, Homo sapiens
cgcagtccccagccctt

SEQ ID NO: 770303 - DNA, 23 bp, Homo sapiens
cgcagtcgcaggatccgctgcca

SEQ ID NO: 770304 - DNA, 16 bp, Homo sapiens
caagctccctggagcc

SEQ ID NO: 770305 - DNA, 17 bp, Homo sapiens
caagctcctcctccctg

SEQ ID NO: 770306 - DNA, 16 bp, Homo sapiens
caagctcctcctcgga

SEQ ID NO: 770307 - DNA, 19 bp, Homo sapiens
caagctccttaaccttcca

SEQ ID NO: 770308 - DNA, 17 bp, Homo sapiens
caagctctagtgggaag

SEQ ID NO: 770309 - DNA, 23 bp, Homo sapiens
caagctctctgttgcgctcccgc

SEQ ID NO: 770310 - DNA, 21 bp, Homo sapiens
caagctgaaattttagaaata

SEQ ID NO: 770311 - DNA, 12 bp, Homo sapiens
caagctgaagct

SEQ ID NO: 770312 - DNA, 17 bp, Homo sapiens
caagctgacttggcact

SEQ ID NO: 770313 - DNA, 16 bp, Homo sapiens
caagctgagaaaagta

SEQ ID NO: 770314 - DNA, 14 bp, Homo sapiens
caagctgagcagga

SEQ ID NO: 770315 - DNA, 13 bp, Homo sapiens
caagctgcaccct

SEQ ID NO: 770316 - DNA, 21 bp, Homo sapiens
caagctgcaccctcaggcagg

SEQ ID NO: 770317 - DNA, 16 bp, Homo sapiens
caagctgcactgtgaa

SEQ ID NO: 770318 - DNA, 17 bp, Homo sapiens
caagctgcactgtgaac

SEQ ID NO: 770319 - DNA, 16 bp, Homo sapiens
caagctgcctctgaca

SEQ ID NO: 770320 - DNA, 23 bp, Homo sapiens
caagctgcctctgacagcagcct

SEQ ID NO: 770321 - DNA, 21 bp, Homo sapiens
caagctgctctgagccacagt

SEQ ID NO: 770322 - DNA, 14 bp, Homo sapiens
caagctggaagcac

SEQ ID NO: 770323 - DNA, 19 bp, Homo sapiens
caagctggtggcctctgca

SEQ ID NO: 770324 - DNA, 12 bp, Homo sapiens
caagctgtcccc

SEQ ID NO: 770325 - DNA, 16 bp, Homo sapiens
caagctgtcccctctg

SEQ ID NO: 770326 - DNA, 19 bp, Homo sapiens
caagctgtcccctctgtca

SEQ ID NO: 770327 - DNA, 20 bp, Homo sapiens
caagctgtcccctctgtcat

SEQ ID NO: 770328 - DNA, 18 bp, Homo sapiens
caagctgtgagacagtgg

SEQ ID NO: 770329 - DNA, 19 bp, Homo sapiens
caagctgtgcaggcatggt

SEQ ID NO: 770330 - DNA, 14 bp, Homo sapiens
caagctgttttctt

SEQ ID NO: 770331 - DNA, 14 bp, Homo sapiens
caagcttaaagctt

SEQ ID NO: 770332 - DNA, 15 bp, Homo sapiens
caagcttaatagccc

SEQ ID NO: 770333 - DNA, 19 bp, Homo sapiens
caagcttaatagccctccc

SEQ ID NO: 770334 - DNA, 20 bp, Homo sapiens
cgcccctgtggccaactgca

SEQ ID NO: 770335 - DNA, 17 bp, Homo sapiens
cgcccctgtggccctgg

SEQ ID NO: 770336 - DNA, 17 bp, Homo sapiens
cgcccgactagcaggca

SEQ ID NO: 770337 - DNA, 21 bp, Homo sapiens
cgcccgccaccaccacgcagc

SEQ ID NO: 770338 - DNA, 16 bp, Homo sapiens
cgcccgcccactgtcc

SEQ ID NO: 770339 - DNA, 18 bp, Homo sapiens
cgcccgctcccttcctgc

SEQ ID NO: 770340 - DNA, 18 bp, Homo sapiens
cgcccgctgagctgagtg

SEQ ID NO: 770341 - DNA, 13 bp, Homo sapiens
cgcccgctgggct

SEQ ID NO: 770342 - DNA, 23 bp, Homo sapiens
cgcccgctgggctgagcccctac

SEQ ID NO: 770343 - DNA, 21 bp, Homo sapiens
cgccctactccactgccctgg

SEQ ID NO: 770344 - DNA, 16 bp, Homo sapiens
cgccctatttctatgt

SEQ ID NO: 770345 - DNA, 13 bp, Homo sapiens
cgccctcacctgc

SEQ ID NO: 770346 - DNA, 13 bp, Homo sapiens
cgccctcaggggc

SEQ ID NO: 770347 - DNA, 20 bp, Homo sapiens
cgccctccctccgcctccca

SEQ ID NO: 770348 - DNA, 19 bp, Homo sapiens
cgccctccgacctctctcg

SEQ ID NO: 770349 - DNA, 16 bp, Homo sapiens
cgccctcctttctgtg

SEQ ID NO: 770350 - DNA, 24 bp, Homo sapiens
cgccctctcctccccctcctaggg

SEQ ID NO: 770351 - DNA, 16 bp, Homo sapiens
cgccctctctgctcct

SEQ ID NO: 770352 - DNA, 17 bp, Homo sapiens
cgccctctctgctcctt

SEQ ID NO: 770353 - DNA, 17 bp, Homo sapiens
cgccctctgcctcctca

SEQ ID NO: 770354 - DNA, 16 bp, Homo sapiens
cgccctgcgggccaca

SEQ ID NO: 770355 - DNA, 21 bp, Homo sapiens
cgccctgcgttggagccactc

SEQ ID NO: 770356 - DNA, 18 bp, Homo sapiens
cgccctgctcctccctgg

SEQ ID NO: 770357 - DNA, 12 bp, Homo sapiens
cgccctggaagc

SEQ ID NO: 770358 - DNA, 13 bp, Homo sapiens
cgccctggaagcc

SEQ ID NO: 770359 - DNA, 16 bp, Homo sapiens
cgccctggacagatgg

SEQ ID NO: 770360 - DNA, 14 bp, Homo sapiens
cgccctgggctgtc

SEQ ID NO: 770361 - DNA, 19 bp, Homo sapiens
cgccctgggctgtctgtca

SEQ ID NO: 770362 - DNA, 15 bp, Homo sapiens
cgcccttaccttccc

SEQ ID NO: 770363 - DNA, 19 bp, Homo sapiens
cgcccttagtcccccaact

SEQ ID NO: 770364 - DNA, 17 bp, Homo sapiens
cgcccttgaggggcccc

SEQ ID NO: 770365 - DNA, 20 bp, Homo sapiens
cgcccttgaggggccccagc

SEQ ID NO: 770366 - DNA, 19 bp, Homo sapiens
cgccctttcctcctcaggc

SEQ ID NO: 770367 - DNA, 14 bp, Homo sapiens
cgccgactccctga

SEQ ID NO: 770368 - DNA, 12 bp, Homo sapiens
cgccgatgccac

SEQ ID NO: 770369 - DNA, 20 bp, Homo sapiens
cgccgcaaaccacactggac

SEQ ID NO: 770370 - DNA, 22 bp, Homo sapiens
cgccgcaaaccacactggactc

SEQ ID NO: 770371 - DNA, 13 bp, Homo sapiens
cgccgccaccgcg

SEQ ID NO: 770372 - DNA, 13 bp, Homo sapiens
cgccgccaggact

SEQ ID NO: 770373 - DNA, 16 bp, Homo sapiens
cgccgcccgcccctca

SEQ ID NO: 770374 - DNA, 14 bp, Homo sapiens
cgccgcctggtact

SEQ ID NO: 770375 - DNA, 17 bp, Homo sapiens
cgccggcctctgctgcc

SEQ ID NO: 770376 - DNA, 16 bp, Homo sapiens
cgccgggcaggcctgc

SEQ ID NO: 770377 - DNA, 14 bp, Homo sapiens
cgccgtctgcaggg

SEQ ID NO: 770378 - DNA, 21 bp, Homo sapiens
cgccgtctgcaggggcctgga

SEQ ID NO: 770379 - DNA, 23 bp, Homo sapiens
cgccgtctgcaggggcctggagg

SEQ ID NO: 770380 - DNA, 16 bp, Homo sapiens
cgccgtgctgtaaata

SEQ ID NO: 770381 - DNA, 22 bp, Homo sapiens
cgcctacccttcccgcctccct

SEQ ID NO: 770382 - DNA, 16 bp, Homo sapiens
cgcctatgccctgccc

SEQ ID NO: 770383 - DNA, 15 bp, Homo sapiens
cgcctcactttccac

SEQ ID NO: 770384 - DNA, 16 bp, Homo sapiens
cgcctcagccctcagt

SEQ ID NO: 770385 - DNA, 14 bp, Homo sapiens
cgcctccactctag

SEQ ID NO: 770386 - DNA, 11 bp, Homo sapiens
cgcctccagga

SEQ ID NO: 770387 - DNA, 16 bp, Homo sapiens
cgcctccatccaaggc

SEQ ID NO: 770388 - DNA, 13 bp, Homo sapiens
cgcctcccactgg

SEQ ID NO: 770389 - DNA, 15 bp, Homo sapiens
cgcctcccactgggg

SEQ ID NO: 770390 - DNA, 14 bp, Homo sapiens
cgcctcccagcctg

SEQ ID NO: 770391 - DNA, 14 bp, Homo sapiens
cgcctcccatcccg

SEQ ID NO: 770392 - DNA, 12 bp, Homo sapiens
cgcctccccacc

SEQ ID NO: 770393 - DNA, 22 bp, Homo sapiens
cgcctccccgaaacaggctact

SEQ ID NO: 770394 - DNA, 20 bp, Homo sapiens
cgcctccctccaccccagga

SEQ ID NO: 770395 - DNA, 16 bp, Homo sapiens
cgcctcctcccactgg

SEQ ID NO: 770396 - DNA, 18 bp, Homo sapiens
cgcctcctcccactggga

SEQ ID NO: 770397 - DNA, 13 bp, Homo sapiens
cgcctcctggcca

SEQ ID NO: 770398 - DNA, 15 bp, Homo sapiens
cgcctcctggccaga

SEQ ID NO: 770399 - DNA, 17 bp, Homo sapiens
cgcctcgtgccagcagc

SEQ ID NO: 770400 - DNA, 15 bp, Homo sapiens
cgcctctcccgtcag

SEQ ID NO: 770401 - DNA, 16 bp, Homo sapiens
cgcctctgcccgcaga

SEQ ID NO: 770402 - DNA, 19 bp, Homo sapiens
cgcctctgcccgcagagcc

SEQ ID NO: 770403 - DNA, 15 bp, Homo sapiens
cgcctcttcctctgg

SEQ ID NO: 770404 - DNA, 18 bp, Homo sapiens
cgcctcttcctctgggca

SEQ ID NO: 770405 - DNA, 16 bp, Homo sapiens
cgcctcttttccctct

SEQ ID NO: 770406 - DNA, 16 bp, Homo sapiens
cgcctgaaagccacaa

SEQ ID NO: 770407 - DNA, 23 bp, Homo sapiens
cgcctgacaaccactggtctgta

SEQ ID NO: 770408 - DNA, 17 bp, Homo sapiens
cgcctgagacagcacca

SEQ ID NO: 770409 - DNA, 19 bp, Homo sapiens
cgcctgagacagcaccact

SEQ ID NO: 770410 - DNA, 22 bp, Homo sapiens
cgcctgagacagcaccactgct

SEQ ID NO: 770411 - DNA, 24 bp, Homo sapiens
cgcctgagacagcaccactgctga

SEQ ID NO: 770412 - DNA, 20 bp, Homo sapiens
cgcctgaggaacccttacag

SEQ ID NO: 770413 - DNA, 17 bp, Homo sapiens
cgcctgaggcaattaga

SEQ ID NO: 770414 - DNA, 17 bp, Homo sapiens
cgcctgagtcagtgctc

SEQ ID NO: 770415 - DNA, 13 bp, Homo sapiens
cgcctgagtgagt

SEQ ID NO: 770416 - DNA, 19 bp, Homo sapiens
cgcctgagtgagtgtgtgt

SEQ ID NO: 770417 - DNA, 13 bp, Homo sapiens
cgcctgcaggcag

SEQ ID NO: 770418 - DNA, 17 bp, Homo sapiens
cgcctgcaggctggaga

SEQ ID NO: 770419 - DNA, 14 bp, Homo sapiens
cgcctgccatcttc

SEQ ID NO: 770420 - DNA, 15 bp, Homo sapiens
cgcctgcccagactg

SEQ ID NO: 770421 - DNA, 22 bp, Homo sapiens
cgcctgccctcatggcccctct

SEQ ID NO: 770422 - DNA, 20 bp, Homo sapiens
cgcctgccctccccagagca

SEQ ID NO: 770423 - DNA, 15 bp, Homo sapiens
cgcctgccctgccca

SEQ ID NO: 770424 - DNA, 16 bp, Homo sapiens
cgcctgccctgcccaa

SEQ ID NO: 770425 - DNA, 17 bp, Homo sapiens
cgcctgccctgcccaag

SEQ ID NO: 770426 - DNA, 16 bp, Homo sapiens
cgcctgccctgcctgg

SEQ ID NO: 770427 - DNA, 23 bp, Homo sapiens
cgcctgccgtgcatggctcctgt

SEQ ID NO: 770428 - DNA, 18 bp, Homo sapiens
cgcctgcgcctccatcca

SEQ ID NO: 770429 - DNA, 22 bp, Homo sapiens
cgcctgctggccgacccactga

SEQ ID NO: 770430 - DNA, 18 bp, Homo sapiens
cgcctggagggatgcccc

SEQ ID NO: 770431 - DNA, 23 bp, Homo sapiens
cgcctggagggatgcccccaggc

SEQ ID NO: 770432 - DNA, 15 bp, Homo sapiens
cgcctggccaggagc

SEQ ID NO: 770433 - DNA, 16 bp, Homo sapiens
cgcctggccaggagca

SEQ ID NO: 770434 - DNA, 14 bp, Homo sapiens
cgcctggcctggcc

SEQ ID NO: 770435 - DNA, 15 bp, Homo sapiens
cgcctggctgctgct

SEQ ID NO: 770436 - DNA, 10 bp, Homo sapiens
cgcctgggat

SEQ ID NO: 770437 - DNA, 22 bp, Homo sapiens
caaggtttataaagcagattac

SEQ ID NO: 770438 - DNA, 13 bp, Homo sapiens
caagtaacacttt

SEQ ID NO: 770439 - DNA, 15 bp, Homo sapiens
caagtaacactttaa

SEQ ID NO: 770440 - DNA, 18 bp, Homo sapiens
caagtaagaaaaataagc

SEQ ID NO: 770441 - DNA, 13 bp, Homo sapiens
caagtaagaagac

SEQ ID NO: 770442 - DNA, 18 bp, Homo sapiens
caagtaagaagacatgaa

SEQ ID NO: 770443 - DNA, 15 bp, Homo sapiens
caagtaatacaaact

SEQ ID NO: 770444 - DNA, 15 bp, Homo sapiens
caagtaattttcata

SEQ ID NO: 770445 - DNA, 16 bp, Homo sapiens
caagtacaagtatata

SEQ ID NO: 770446 - DNA, 21 bp, Homo sapiens
caagtactggctctttattca

SEQ ID NO: 770447 - DNA, 14 bp, Homo sapiens
caagtagcaggact

SEQ ID NO: 770448 - DNA, 21 bp, Homo sapiens
caagtagctgggaccacaggc

SEQ ID NO: 770449 - DNA, 14 bp, Homo sapiens
caagtagctgggat

SEQ ID NO: 770450 - DNA, 16 bp, Homo sapiens
caagtagctgggatta

SEQ ID NO: 770451 - DNA, 15 bp, Homo sapiens
caagtatcttctatt

SEQ ID NO: 770452 - DNA, 14 bp, Homo sapiens
caagtatgccttaa

SEQ ID NO: 770453 - DNA, 15 bp, Homo sapiens
caagtatgtgagtgt

SEQ ID NO: 770454 - DNA, 17 bp, Homo sapiens
caagtattatacctttt

SEQ ID NO: 770455 - DNA, 22 bp, Homo sapiens
caagtattataccttttttaga

SEQ ID NO: 770456 - DNA, 19 bp, Homo sapiens
caagtatttgggaagtgaa

SEQ ID NO: 770457 - DNA, 13 bp, Homo sapiens
caagttgtgcttg

SEQ ID NO: 770458 - DNA, 18 bp, Homo sapiens
caagttgttgactgtgat

SEQ ID NO: 770459 - DNA, 22 bp, Homo sapiens
caagttgttgactgtgattaga

SEQ ID NO: 770460 - DNA, 13 bp, Homo sapiens
caagttgtttatg

SEQ ID NO: 770461 - DNA, 13 bp, Homo sapiens
caagtttactttt

SEQ ID NO: 770462 - DNA, 16 bp, Homo sapiens
caagtttcagacaggg

SEQ ID NO: 770463 - DNA, 16 bp, Homo sapiens
caagtttccatagcaa

SEQ ID NO: 770464 - DNA, 17 bp, Homo sapiens
caagtttccatagcaac

SEQ ID NO: 770465 - DNA, 20 bp, Homo sapiens
caagtttccatagcaacagg

SEQ ID NO: 770466 - DNA, 17 bp, Homo sapiens
caagtttctgtttcaaa

SEQ ID NO: 770467 - DNA, 22 bp, Homo sapiens
caagtttctgtttcaaagcaca

SEQ ID NO: 770468 - DNA, 11 bp, Homo sapiens
caagtttgcta

SEQ ID NO: 770469 - DNA, 14 bp, Homo sapiens
caagtttgctaaaa

SEQ ID NO: 770470 - DNA, 17 bp, Homo sapiens
caagtttgctaaaagaa

SEQ ID NO: 770471 - DNA, 20 bp, Homo sapiens
caagtttgctaaaagaagag

SEQ ID NO: 770472 - DNA, 21 bp, Homo sapiens
caagttttttaattaagcaga

SEQ ID NO: 770473 - DNA, 13 bp, Homo sapiens
caataaaactgat

SEQ ID NO: 770474 - DNA, 15 bp, Homo sapiens
caataaaagagctgt

SEQ ID NO: 770475 - DNA, 16 bp, Homo sapiens
caataaaagagcttta

SEQ ID NO: 770476 - DNA, 17 bp, Homo sapiens
caataaaagagctttat

SEQ ID NO: 770477 - DNA, 11 bp, Homo sapiens
caataaaagtg

SEQ ID NO: 770478 - DNA, 12 bp, Homo sapiens
caataaaagtga

SEQ ID NO: 770479 - DNA, 13 bp, Homo sapiens
caataaaagtgac

SEQ ID NO: 770480 - DNA, 20 bp, Homo sapiens
caataaaagttttctccaac

SEQ ID NO: 770481 - DNA, 17 bp, Homo sapiens
caataaaatgaacctga

SEQ ID NO: 770482 - DNA, 20 bp, Homo sapiens
caataaaatttttttaaagt

SEQ ID NO: 770483 - DNA, 15 bp, Homo sapiens
caataaacagctccc

SEQ ID NO: 770484 - DNA, 19 bp, Homo sapiens
caataaacaggaattttat

SEQ ID NO: 770485 - DNA, 19 bp, Homo sapiens
caataaaccaaacccagcc

SEQ ID NO: 770486 - DNA, 23 bp, Homo sapiens
caataaaccaggtttagacagta

SEQ ID NO: 770487 - DNA, 17 bp, Homo sapiens
caataaacctcttttct

SEQ ID NO: 770488 - DNA, 14 bp, Homo sapiens
caataaactgagcg

SEQ ID NO: 770489 - DNA, 15 bp, Homo sapiens
caataaactgagcga

SEQ ID NO: 770490 - DNA, 20 bp, Homo sapiens
caataaactgagcgacccca

SEQ ID NO: 770491 - DNA, 16 bp, Homo sapiens
caataaagatttttca

SEQ ID NO: 770492 - DNA, 15 bp, Homo sapiens
caataaagcactgag

SEQ ID NO: 770493 - DNA, 16 bp, Homo sapiens
caataaagcagagcca

SEQ ID NO: 770494 - DNA, 17 bp, Homo sapiens
caataaagcagagccaa

SEQ ID NO: 770495 - DNA, 19 bp, Homo sapiens
caataaagcagagccaagg

SEQ ID NO: 770496 - DNA, 21 bp, Homo sapiens
caataaagcagagccaaggcc

SEQ ID NO: 770497 - DNA, 22 bp, Homo sapiens
caataaagcagcctcattctga

SEQ ID NO: 770498 - DNA, 23 bp, Homo sapiens
caataaagcagttaatttatata

SEQ ID NO: 770499 - DNA, 15 bp, Homo sapiens
caataaaggcagctg

SEQ ID NO: 770500 - DNA, 21 bp, Homo sapiens
caataaaggcagctgcctctg

SEQ ID NO: 770501 - DNA, 16 bp, Homo sapiens
caataaagtataatgt

SEQ ID NO: 770502 - DNA, 18 bp, Homo sapiens
caataaagtataatgttt

SEQ ID NO: 770503 - DNA, 16 bp, Homo sapiens
caataaagtgccttct

SEQ ID NO: 770504 - DNA, 18 bp, Homo sapiens
caataaagttattcagaa

SEQ ID NO: 770505 - DNA, 13 bp, Homo sapiens
caataaatagaca

SEQ ID NO: 770506 - DNA, 13 bp, Homo sapiens
caataaatattct

SEQ ID NO: 770507 - DNA, 14 bp, Homo sapiens
caataaatccacac

SEQ ID NO: 770508 - DNA, 20 bp, Homo sapiens
caataaatgacacccagacc

SEQ ID NO: 770509 - DNA, 18 bp, Homo sapiens
caataaatggccagtgct

SEQ ID NO: 770510 - DNA, 20 bp, Homo sapiens
caataaattgttttttaatt

SEQ ID NO: 770511 - DNA, 11 bp, Homo sapiens
caataacaaag

SEQ ID NO: 770512 - DNA, 18 bp, Homo sapiens
caataacactatatttat

SEQ ID NO: 770513 - DNA, 14 bp, Homo sapiens
caataacagctgca

SEQ ID NO: 770514 - DNA, 16 bp, Homo sapiens
caataacccagttact

SEQ ID NO: 770515 - DNA, 15 bp, Homo sapiens
caataactccaagca

SEQ ID NO: 770516 - DNA, 16 bp, Homo sapiens
caataacttctatatt

SEQ ID NO: 770517 - DNA, 18 bp, Homo sapiens
caataacttctatatttt

SEQ ID NO: 770518 - DNA, 20 bp, Homo sapiens
caataacttctatattttaa

SEQ ID NO: 770519 - DNA, 21 bp, Homo sapiens
caataacttctatattttaat

SEQ ID NO: 770520 - DNA, 16 bp, Homo sapiens
caataacttctatgtt

SEQ ID NO: 770521 - DNA, 21 bp, Homo sapiens
caataagaaaatgtaaaggtt

SEQ ID NO: 770522 - DNA, 20 bp, Homo sapiens
caataagaatttagggagaa

SEQ ID NO: 770523 - DNA, 20 bp, Homo sapiens
caataagattggtgttcgtt

SEQ ID NO: 770524 - DNA, 23 bp, Homo sapiens
caataaggtcaagggaaaacccc

SEQ ID NO: 770525 - DNA, 16 bp, Homo sapiens
caataataaaaaacaa

SEQ ID NO: 770526 - DNA, 24 bp, Homo sapiens
caataataaaaaatattcttgtca

SEQ ID NO: 770527 - DNA, 13 bp, Homo sapiens
caataataaagac

SEQ ID NO: 770528 - DNA, 13 bp, Homo sapiens
caataatcagaaa

SEQ ID NO: 770529 - DNA, 17 bp, Homo sapiens
caataatccacccccag

SEQ ID NO: 770530 - DNA, 17 bp, Homo sapiens
caataatggtcccatcc

SEQ ID NO: 770531 - DNA, 19 bp, Homo sapiens
caataatggtcccatccag

SEQ ID NO: 770532 - DNA, 18 bp, Homo sapiens
caataatttgtacaatgg

SEQ ID NO: 770533 - DNA, 13 bp, Homo sapiens
caatacaacttta

SEQ ID NO: 770534 - DNA, 17 bp, Homo sapiens
caatacaactttaccat

SEQ ID NO: 770535 - DNA, 15 bp, Homo sapiens
caatacatatatcta

SEQ ID NO: 770536 - DNA, 21 bp, Homo sapiens
caatacatatatctacacata

SEQ ID NO: 770537 - DNA, 15 bp, Homo sapiens
caatacatgctgcta

SEQ ID NO: 770538 - DNA, 19 bp, Homo sapiens
caataccctactgtgggga

SEQ ID NO: 770539 - DNA, 12 bp, Homo sapiens
caataccctaga

SEQ ID NO: 770540 - DNA, 23 bp, Homo sapiens
caataccctagaagaaaacccga

SEQ ID NO: 770541 - DNA, 17 bp, Homo sapiens
caataccgctcagtatt

SEQ ID NO: 770542 - DNA, 19 bp, Homo sapiens
caataccgctcagtatttt

SEQ ID NO: 770543 - DNA, 16 bp, Homo sapiens
caatacgcctttaaag

SEQ ID NO: 770544 - DNA, 22 bp, Homo sapiens
caatacgggagtgacccagcta

SEQ ID NO: 770545 - DNA, 13 bp, Homo sapiens
caatactcccttt

SEQ ID NO: 770546 - DNA, 20 bp, Homo sapiens
caatactccctttaaagaga

SEQ ID NO: 770547 - DNA, 14 bp, Homo sapiens
caatactgagccat

SEQ ID NO: 770548 - DNA, 18 bp, Homo sapiens
caatagaataatctatta

SEQ ID NO: 770549 - DNA, 19 bp, Homo sapiens
caatagaataatctattat

SEQ ID NO: 770550 - DNA, 16 bp, Homo sapiens
caatagagactgtaga

SEQ ID NO: 770551 - DNA, 22 bp, Homo sapiens
caatagagactgtagattgctt

SEQ ID NO: 770552 - DNA, 23 bp, Homo sapiens
caatagctttaccctcaggcata

SEQ ID NO: 770553 - DNA, 22 bp, Homo sapiens
caataggcagactgggtttcta

SEQ ID NO: 770554 - DNA, 17 bp, Homo sapiens
caatagggctaaatgtt

SEQ ID NO: 770555 - DNA, 16 bp, Homo sapiens
caatagggtagaatga

SEQ ID NO: 770556 - DNA, 23 bp, Homo sapiens
caatagggtagaatgattaatca

SEQ ID NO: 770557 - DNA, 15 bp, Homo sapiens
caatagggtgcagtt

SEQ ID NO: 770558 - DNA, 19 bp, Homo sapiens
caataggtctttctctcag

SEQ ID NO: 770559 - DNA, 22 bp, Homo sapiens
caataggtgctgagtgtacaga

SEQ ID NO: 770560 - DNA, 13 bp, Homo sapiens
caatagtgcaaca

SEQ ID NO: 770561 - DNA, 20 bp, Homo sapiens
caatagtgcaacatctctga

SEQ ID NO: 770562 - DNA, 21 bp, Homo sapiens
caatagtgcaacatctctgaa

SEQ ID NO: 770563 - DNA, 16 bp, Homo sapiens
caatagtttgcataga

SEQ ID NO: 770564 - DNA, 16 bp, Homo sapiens
caatagttttttactt

SEQ ID NO: 770565 - DNA, 20 bp, Homo sapiens
caatataaaactgtacttca

SEQ ID NO: 770566 - DNA, 18 bp, Homo sapiens
caatataacattctattg

SEQ ID NO: 770567 - DNA, 16 bp, Homo sapiens
cgctgacttcatggaa

SEQ ID NO: 770568 - DNA, 16 bp, Homo sapiens
cgctgagactgtgctg

SEQ ID NO: 770569 - DNA, 20 bp, Homo sapiens
cgctgagcgcccccgagccc

SEQ ID NO: 770570 - DNA, 13 bp, Homo sapiens
cgctgagctgagt

SEQ ID NO: 770571 - DNA, 17 bp, Homo sapiens
cgctgagctgagtggcc

SEQ ID NO: 770572 - DNA, 13 bp, Homo sapiens
cgctgagtggcag

SEQ ID NO: 770573 - DNA, 14 bp, Homo sapiens
cgctgagtggcagg

SEQ ID NO: 770574 - DNA, 20 bp, Homo sapiens
cgctgagtgggagaaggcag

SEQ ID NO: 770575 - DNA, 14 bp, Homo sapiens
cgctgcaccacggc

SEQ ID NO: 770576 - DNA, 14 bp, Homo sapiens
cgctgcaggaaaca

SEQ ID NO: 770577 - DNA, 22 bp, Homo sapiens
cgctgcaggtacttcctcctga

SEQ ID NO: 770578 - DNA, 22 bp, Homo sapiens
cgctgccaccacgtctgccagg

SEQ ID NO: 770579 - DNA, 14 bp, Homo sapiens
cggacctacctccc

SEQ ID NO: 770580 - DNA, 15 bp, Homo sapiens
cggacctacctccct

SEQ ID NO: 770581 - DNA, 21 bp, Homo sapiens
cggaccttgtagtgagccgag

SEQ ID NO: 770582 - DNA, 13 bp, Homo sapiens
cggacgcatctca

SEQ ID NO: 770583 - DNA, 16 bp, Homo sapiens
cggacgtttccatcag

SEQ ID NO: 770584 - DNA, 18 bp, Homo sapiens
cggacgtttccatcaggt

SEQ ID NO: 770585 - DNA, 20 bp, Homo sapiens
cggactcaccaacttgccac

SEQ ID NO: 770586 - DNA, 15 bp, Homo sapiens
cggactcccgggcca

SEQ ID NO: 770587 - DNA, 22 bp, Homo sapiens
cggactcccgggccacgcccca

SEQ ID NO: 770588 - DNA, 17 bp, Homo sapiens
cggactctcccaggcct

SEQ ID NO: 770589 - DNA, 12 bp, Homo sapiens
cggactctgccc

SEQ ID NO: 770590 - DNA, 21 bp, Homo sapiens
cggactgaggtgcctgctcag

SEQ ID NO: 770591 - DNA, 16 bp, Homo sapiens
cggactgcccccagaa

SEQ ID NO: 770592 - DNA, 17 bp, Homo sapiens
cggagaagagcgcagtg

SEQ ID NO: 770593 - DNA, 18 bp, Homo sapiens
cggagactatggcctcgc

SEQ ID NO: 770594 - DNA, 19 bp, Homo sapiens
cggagactatggcctcgcc

SEQ ID NO: 770595 - DNA, 14 bp, Homo sapiens
cggagagaaaaaag

SEQ ID NO: 770596 - DNA, 15 bp, Homo sapiens
cggagagcagcagca

SEQ ID NO: 770597 - DNA, 23 bp, Homo sapiens
cggagagctggtgactttgggga

SEQ ID NO: 770598 - DNA, 16 bp, Homo sapiens
cggagaggctgtctgg

SEQ ID NO: 770599 - DNA, 19 bp, Homo sapiens
cggagaggctgtctggggc

SEQ ID NO: 770600 - DNA, 17 bp, Homo sapiens
cggagagggctagccct

SEQ ID NO: 770601 - DNA, 17 bp, Homo sapiens
cggagcaaactctgctg

SEQ ID NO: 770602 - DNA, 21 bp, Homo sapiens
cggagcacagccctgggaggg

SEQ ID NO: 770603 - DNA, 15 bp, Homo sapiens
cggagcccagcctgg

SEQ ID NO: 770604 - DNA, 12 bp, Homo sapiens
cggagccccagg

SEQ ID NO: 770605 - DNA, 20 bp, Homo sapiens
cggagcccctgaaagcctca

SEQ ID NO: 770606 - DNA, 21 bp, Homo sapiens
cggagcctcatccgaggcagg

SEQ ID NO: 770607 - DNA, 22 bp, Homo sapiens
cggagcctcatccgaggcaggg

SEQ ID NO: 770608 - DNA, 23 bp, Homo sapiens
cggagcctgtgttagtgtctgtc

SEQ ID NO: 770609 - DNA, 22 bp, Homo sapiens
cggagcgttctctgtcctactt

SEQ ID NO: 770610 - DNA, 18 bp, Homo sapiens
cggagctaacactggccc

SEQ ID NO: 770611 - DNA, 19 bp, Homo sapiens
cggagctaacactggcccc

SEQ ID NO: 770612 - DNA, 21 bp, Homo sapiens
cggagctaacactggccccta

SEQ ID NO: 770613 - DNA, 23 bp, Homo sapiens
cggagctaagtcacccagagcac

SEQ ID NO: 770614 - DNA, 20 bp, Homo sapiens
cggagctgcctgcagcacat

SEQ ID NO: 770615 - DNA, 17 bp, Homo sapiens
cggagctggctgtgcct

SEQ ID NO: 770616 - DNA, 22 bp, Homo sapiens
cggagctggctgtgcctgcttc

SEQ ID NO: 770617 - DNA, 15 bp, Homo sapiens
cggagctggttcctc

SEQ ID NO: 770618 - DNA, 19 bp, Homo sapiens
cggaggaaggaggacccag

SEQ ID NO: 770619 - DNA, 13 bp, Homo sapiens
cggaggactgagc

SEQ ID NO: 770620 - DNA, 17 bp, Homo sapiens
cggaggactgagccccc

SEQ ID NO: 770621 - DNA, 18 bp, Homo sapiens
cggaggatagtatgagcc

SEQ ID NO: 770622 - DNA, 15 bp, Homo sapiens
cggaggccgggccct

SEQ ID NO: 770623 - DNA, 13 bp, Homo sapiens
cggaggccttggg

SEQ ID NO: 770624 - DNA, 19 bp, Homo sapiens
cggaggcgtggaggagagg

SEQ ID NO: 770625 - DNA, 22 bp, Homo sapiens
cggaggctcggccgtgggccgg

SEQ ID NO: 770626 - DNA, 19 bp, Homo sapiens
cggaggcttgtcagagctg

SEQ ID NO: 770627 - DNA, 19 bp, Homo sapiens
cggagggacgcggaggagg

SEQ ID NO: 770628 - DNA, 13 bp, Homo sapiens
cggagggaggcac

SEQ ID NO: 770629 - DNA, 14 bp, Homo sapiens
cggagggaggcacc

SEQ ID NO: 770630 - DNA, 13 bp, Homo sapiens
cggagggatggag

SEQ ID NO: 770631 - DNA, 16 bp, Homo sapiens
cggagggatggagaaa

SEQ ID NO: 770632 - DNA, 17 bp, Homo sapiens
cggagggattcccctaa

SEQ ID NO: 770633 - DNA, 22 bp, Homo sapiens
cggagggcccctgcgtgggggc

SEQ ID NO: 770634 - DNA, 19 bp, Homo sapiens
cggaggggacccagctcct

SEQ ID NO: 770635 - DNA, 20 bp, Homo sapiens
cggaggggactggtcccggt

SEQ ID NO: 770636 - DNA, 22 bp, Homo sapiens
cggagggggtcctcctcgctcc

SEQ ID NO: 770637 - DNA, 21 bp, Homo sapiens
cggagggtgggggccacctgc

SEQ ID NO: 770638 - DNA, 22 bp, Homo sapiens
cggagggtgggggccacctgcc

SEQ ID NO: 770639 - DNA, 22 bp, Homo sapiens
cggaggttgggtgggccggctt

SEQ ID NO: 770640 - DNA, 23 bp, Homo sapiens
cggagtcgtggggtgtgctggga

SEQ ID NO: 770641 - DNA, 14 bp, Homo sapiens
cggagtgaagaggg

SEQ ID NO: 770642 - DNA, 23 bp, Homo sapiens
cggagtgcggaccaccctcactg

SEQ ID NO: 770643 - DNA, 23 bp, Homo sapiens
cggagtggacaccgctcagtatt

SEQ ID NO: 770644 - DNA, 20 bp, Homo sapiens
cggataggcaggaacataca

SEQ ID NO: 770645 - DNA, 19 bp, Homo sapiens
cggatcacaaggtcaggag

SEQ ID NO: 770646 - DNA, 18 bp, Homo sapiens
cggatcaccgagagtagc

SEQ ID NO: 770647 - DNA, 14 bp, Homo sapiens
cggatcctgtgagt

SEQ ID NO: 770648 - DNA, 19 bp, Homo sapiens
cggatcctgtgagtaggct

SEQ ID NO: 770649 - DNA, 14 bp, Homo sapiens
cggatctgagaatc

SEQ ID NO: 770650 - DNA, 19 bp, Homo sapiens
cggatgacaccctggcctg

SEQ ID NO: 770651 - DNA, 15 bp, Homo sapiens
cggatgagttattat

SEQ ID NO: 770652 - DNA, 19 bp, Homo sapiens
cggatgctccgaggactgg

SEQ ID NO: 770653 - DNA, 16 bp, Homo sapiens
cggattccagcccaca

SEQ ID NO: 770654 - DNA, 18 bp, Homo sapiens
cggattgctctggagcag

SEQ ID NO: 770655 - DNA, 17 bp, Homo sapiens
cggatttattatataaa

SEQ ID NO: 770656 - DNA, 16 bp, Homo sapiens
cggattttttccaaaa

SEQ ID NO: 770657 - DNA, 17 bp, Homo sapiens
cggattttttccaaaat

SEQ ID NO: 770658 - DNA, 16 bp, Homo sapiens
cggcaaacctttcccc

SEQ ID NO: 770659 - DNA, 14 bp, Homo sapiens
cggcaaccacatgt

SEQ ID NO: 770660 - DNA, 17 bp, Homo sapiens
cggcaaccccagttctg

SEQ ID NO: 770661 - DNA, 13 bp, Homo sapiens
cggcaagccacag

SEQ ID NO: 770662 - DNA, 20 bp, Homo sapiens
cggcacccacaagtgccact

SEQ ID NO: 770663 - DNA, 15 bp, Homo sapiens
cggcaccctggtctg

SEQ ID NO: 770664 - DNA, 18 bp, Homo sapiens
cggcactgcagtctgcag

SEQ ID NO: 770665 - DNA, 18 bp, Homo sapiens
cggcagcatcccagccag

SEQ ID NO: 770666 - DNA, 21 bp, Homo sapiens
cggcagcccccccctcaaggg

SEQ ID NO: 770667 - DNA, 14 bp, Homo sapiens
cggcagctcttctg

SEQ ID NO: 770668 - DNA, 16 bp, Homo sapiens
cggcagctcttctggg

SEQ ID NO: 770669 - DNA, 16 bp, Homo sapiens
cggcaggcctgagaat

SEQ ID NO: 770670 - DNA, 19 bp, Homo sapiens
cggcaggctcactgccagg

SEQ ID NO: 770671 - DNA, 23 bp, Homo sapiens
cggcaggctcactgccaggccag

SEQ ID NO: 770672 - DNA, 22 bp, Homo sapiens
cggcagggcgggcagagggctg

SEQ ID NO: 770673 - DNA, 17 bp, Homo sapiens
cggcaggggcctggaga

SEQ ID NO: 770674 - DNA, 21 bp, Homo sapiens
cggcatccttgcctgtctaaa

SEQ ID NO: 770675 - DNA, 14 bp, Homo sapiens
cggcattcctgctt

SEQ ID NO: 770676 - DNA, 20 bp, Homo sapiens
cggcatttaacttacatttg

SEQ ID NO: 770677 - DNA, 22 bp, Homo sapiens
cggcatttaacttacatttgta

SEQ ID NO: 770678 - DNA, 18 bp, Homo sapiens
cggccaagataggacctt

SEQ ID NO: 770679 - DNA, 23 bp, Homo sapiens
cggccaagataggaccttgggcc

SEQ ID NO: 770680 - DNA, 14 bp, Homo sapiens
cggccaatggaaac

SEQ ID NO: 770681 - DNA, 21 bp, Homo sapiens
cggccaatggtgcttccccca

SEQ ID NO: 770682 - DNA, 21 bp, Homo sapiens
cggccacagggcggtaccttg

SEQ ID NO: 770683 - DNA, 12 bp, Homo sapiens
cggccactgtgt

SEQ ID NO: 770684 - DNA, 14 bp, Homo sapiens
cggccactgtgtct

SEQ ID NO: 770685 - DNA, 21 bp, Homo sapiens
cggccagaggggctgctccag

SEQ ID NO: 770686 - DNA, 22 bp, Homo sapiens
cggccagcccctggccccagga

SEQ ID NO: 770687 - DNA, 22 bp, Homo sapiens
cggccagcccgtcctcctctac

SEQ ID NO: 770688 - DNA, 11 bp, Homo sapiens
cggccaggcat

SEQ ID NO: 770689 - DNA, 15 bp, Homo sapiens
cggccaggcgggaga

SEQ ID NO: 770690 - DNA, 20 bp, Homo sapiens
cggccaggctggagtgcagt

SEQ ID NO: 770691 - DNA, 16 bp, Homo sapiens
cggcccaagcccgact

SEQ ID NO: 770692 - DNA, 15 bp, Homo sapiens
cggcccacagctccc

SEQ ID NO: 770693 - DNA, 21 bp, Homo sapiens
cggcccagaagtttccctcaa

SEQ ID NO: 770694 - DNA, 12 bp, Homo sapiens
cggcccagagac

SEQ ID NO: 770695 - DNA, 19 bp, Homo sapiens
cggcccagagaccccttcc

SEQ ID NO: 770696 - DNA, 21 bp, Homo sapiens
caatgaagccagctcacagtg

SEQ ID NO: 770697 - DNA, 19 bp, Homo sapiens
caatgaagggaaattgttt

SEQ ID NO: 770698 - DNA, 17 bp, Homo sapiens
caatgaatccccgaccc

SEQ ID NO: 770699 - DNA, 18 bp, Homo sapiens
caatgaatccccgacccc

SEQ ID NO: 770700 - DNA, 12 bp, Homo sapiens
caattttaaaca

SEQ ID NO: 770701 - DNA, 19 bp, Homo sapiens
caattttaatcccctgcac

SEQ ID NO: 770702 - DNA, 22 bp, Homo sapiens
caattttaatttagtaaatgtt

SEQ ID NO: 770703 - DNA, 17 bp, Homo sapiens
caattttagtgtattaa

SEQ ID NO: 770704 - DNA, 15 bp, Homo sapiens
caattttatctgttt

SEQ ID NO: 770705 - DNA, 20 bp, Homo sapiens
cggctgggtcggccctgccc

SEQ ID NO: 770706 - DNA, 22 bp, Homo sapiens
cggctgggtcggccctgcccaa

SEQ ID NO: 770707 - DNA, 16 bp, Homo sapiens
cggctggtcactctgc

SEQ ID NO: 770708 - DNA, 17 bp, Homo sapiens
cggctggtcactctgcc

SEQ ID NO: 770709 - DNA, 16 bp, Homo sapiens
cggctgtgacgcagcc

SEQ ID NO: 770710 - DNA, 14 bp, Homo sapiens
cggctgtgctcaga

SEQ ID NO: 770711 - DNA, 23 bp, Homo sapiens
cggctgtggagcaaaaggcagct

SEQ ID NO: 770712 - DNA, 17 bp, Homo sapiens
cggcttaccatctctac

SEQ ID NO: 770713 - DNA, 23 bp, Homo sapiens
cggcttagacttcgactcaggat

SEQ ID NO: 770714 - DNA, 17 bp, Homo sapiens
cggcttcttggaccttg

SEQ ID NO: 770715 - DNA, 16 bp, Homo sapiens
cggcttgccacacccc

SEQ ID NO: 770716 - DNA, 18 bp, Homo sapiens
cggcttggatcctgggct

SEQ ID NO: 770717 - DNA, 21 bp, Homo sapiens
cggcttggatcctgggctggg

SEQ ID NO: 770718 - DNA, 16 bp, Homo sapiens
cggcttgtgggctggt

SEQ ID NO: 770719 - DNA, 17 bp, Homo sapiens
cggcttgtgggctggtg

SEQ ID NO: 770720 - DNA, 19 bp, Homo sapiens
cggcttgtgggctggtgcc

SEQ ID NO: 770721 - DNA, 18 bp, Homo sapiens
cggcttgttcttgcagca

SEQ ID NO: 770722 - DNA, 13 bp, Homo sapiens
cggctttcctccg

SEQ ID NO: 770723 - DNA, 19 bp, Homo sapiens
cggctttctaatagagaga

SEQ ID NO: 770724 - DNA, 13 bp, Homo sapiens
cggctttctctgc

SEQ ID NO: 770725 - DNA, 20 bp, Homo sapiens
cgggaaaaggagaggaaact

SEQ ID NO: 770726 - DNA, 17 bp, Homo sapiens
cgggaaagaagaaactc

SEQ ID NO: 770727 - DNA, 15 bp, Homo sapiens
cgggaacagacaaca

SEQ ID NO: 770728 - DNA, 16 bp, Homo sapiens
cgggaagagccacctg

SEQ ID NO: 770729 - DNA, 17 bp, Homo sapiens
cgggaagagccacctgg

SEQ ID NO: 770730 - DNA, 14 bp, Homo sapiens
cgggaaggagggtt

SEQ ID NO: 770731 - DNA, 23 bp, Homo sapiens
cgggaaggagggttagggagggg

SEQ ID NO: 770732 - DNA, 17 bp, Homo sapiens
cgggaatgcctaggtcc

SEQ ID NO: 770733 - DNA, 17 bp, Homo sapiens
cgggacaccgtggggaa

SEQ ID NO: 770734 - DNA, 19 bp, Homo sapiens
cgggacatggttgggggaa

SEQ ID NO: 770735 - DNA, 15 bp, Homo sapiens
cgggaccacatctgt

SEQ ID NO: 770736 - DNA, 17 bp, Homo sapiens
cgggaccacatctgtcc

SEQ ID NO: 770737 - DNA, 18 bp, Homo sapiens
cgggaccacatctgtcct

SEQ ID NO: 770738 - DNA, 23 bp, Homo sapiens
cgggaccacatctgtcctcaccc

SEQ ID NO: 770739 - DNA, 16 bp, Homo sapiens
cgggaccaccctgagc

SEQ ID NO: 770740 - DNA, 17 bp, Homo sapiens
cgggaccaccctgagcc

SEQ ID NO: 770741 - DNA, 18 bp, Homo sapiens
cgggaccaccctgagccg

SEQ ID NO: 770742 - DNA, 20 bp, Homo sapiens
cgggaccctgctcacaggca

SEQ ID NO: 770743 - DNA, 23 bp, Homo sapiens
cgggaccctgctcacaggcaggc

SEQ ID NO: 770744 - DNA, 14 bp, Homo sapiens
cgggaccgtcagca

SEQ ID NO: 770745 - DNA, 19 bp, Homo sapiens
cgggaccgtcagcatgggc

SEQ ID NO: 770746 - DNA, 17 bp, Homo sapiens
cgggacctcccaggaca

SEQ ID NO: 770747 - DNA, 18 bp, Homo sapiens
cgggacctcccaggacaa

SEQ ID NO: 770748 - DNA, 13 bp, Homo sapiens
cgggacctggtgc

SEQ ID NO: 770749 - DNA, 21 bp, Homo sapiens
cgggacgagaccctacaggag

SEQ ID NO: 770750 - DNA, 13 bp, Homo sapiens
cgggagaaaagac

SEQ ID NO: 770751 - DNA, 16 bp, Homo sapiens
cgggagaatcatgtga

SEQ ID NO: 770752 - DNA, 21 bp, Homo sapiens
cgggagaatcatgtgaacccg

SEQ ID NO: 770753 - DNA, 14 bp, Homo sapiens
cgggagagccaggc

SEQ ID NO: 770754 - DNA, 13 bp, Homo sapiens
cgggagcacccag

SEQ ID NO: 770755 - DNA, 17 bp, Homo sapiens
cgggagcacccagagca

SEQ ID NO: 770756 - DNA, 15 bp, Homo sapiens
cgggagcagtgtctt

SEQ ID NO: 770757 - DNA, 19 bp, Homo sapiens
cgggagcattggcccctga

SEQ ID NO: 770758 - DNA, 20 bp, Homo sapiens
cgggagcattggcccctgag

SEQ ID NO: 770759 - DNA, 18 bp, Homo sapiens
cgggagccgctggcagaa

SEQ ID NO: 770760 - DNA, 22 bp, Homo sapiens
cgggagcctgatcacctgccct

SEQ ID NO: 770761 - DNA, 11 bp, Homo sapiens
cgggagctgca

SEQ ID NO: 770762 - DNA, 14 bp, Homo sapiens
cgggagctgcacac

SEQ ID NO: 770763 - DNA, 11 bp, Homo sapiens
cgggagctggt

SEQ ID NO: 770764 - DNA, 21 bp, Homo sapiens
cgggaggcaccagctctgtgg

SEQ ID NO: 770765 - DNA, 20 bp, Homo sapiens
cgggaggcagaggttgcagt

SEQ ID NO: 770766 - DNA, 22 bp, Homo sapiens
cgggaggcagaggttgcagtgt

SEQ ID NO: 770767 - DNA, 22 bp, Homo sapiens
cgggaggcggagcttgcagtga

SEQ ID NO: 770768 - DNA, 16 bp, Homo sapiens
cgggaggctgagacag

SEQ ID NO: 770769 - DNA, 17 bp, Homo sapiens
cgggaggctgagacagg

SEQ ID NO: 770770 - DNA, 20 bp, Homo sapiens
cgggaggctgagacaggaga

SEQ ID NO: 770771 - DNA, 17 bp, Homo sapiens
cgggaggctgaggcagg

SEQ ID NO: 770772 - DNA, 13 bp, Homo sapiens
cgggaggctgggg

SEQ ID NO: 770773 - DNA, 14 bp, Homo sapiens
cgggaggctggggc

SEQ ID NO: 770774 - DNA, 11 bp, Homo sapiens
cgggagggagt

SEQ ID NO: 770775 - DNA, 18 bp, Homo sapiens
cgggaggtcgaggcagga

SEQ ID NO: 770776 - DNA, 20 bp, Homo sapiens
cgggaggtcgaggcaggagg

SEQ ID NO: 770777 - DNA, 19 bp, Homo sapiens
cgggatcaaacctttctgg

SEQ ID NO: 770778 - DNA, 23 bp, Homo sapiens
cgggatcaaacctttctggcctg

SEQ ID NO: 770779 - DNA, 15 bp, Homo sapiens
cgggatcctgccccc

SEQ ID NO: 770780 - DNA, 18 bp, Homo sapiens
cgggatgcgtgggaggca

SEQ ID NO: 770781 - DNA, 18 bp, Homo sapiens
cgggatggtcctggggct

SEQ ID NO: 770782 - DNA, 16 bp, Homo sapiens
cgggcaaagagctccc

SEQ ID NO: 770783 - DNA, 18 bp, Homo sapiens
cgggcaaagagctcccga

SEQ ID NO: 770784 - DNA, 17 bp, Homo sapiens
cgggcaaatgccagggc

SEQ ID NO: 770785 - DNA, 17 bp, Homo sapiens
cgggcaagtgagagggg

SEQ ID NO: 770786 - DNA, 20 bp, Homo sapiens
cgggcaagtgagaggggagg

SEQ ID NO: 770787 - DNA, 15 bp, Homo sapiens
cgggcaatcatgagc

SEQ ID NO: 770788 - DNA, 17 bp, Homo sapiens
cgggcacccacaagccc

SEQ ID NO: 770789 - DNA, 13 bp, Homo sapiens
cgggcactggcac

SEQ ID NO: 770790 - DNA, 13 bp, Homo sapiens
cgggcagccacag

SEQ ID NO: 770791 - DNA, 17 bp, Homo sapiens
cgggcagccacaggact

SEQ ID NO: 770792 - DNA, 15 bp, Homo sapiens
cgggcagccacccaa

SEQ ID NO: 770793 - DNA, 22 bp, Homo sapiens
cgggcagccacccaagcctgct

SEQ ID NO: 770794 - DNA, 23 bp, Homo sapiens
cgggcagccacccaagcctgctg

SEQ ID NO: 770795 - DNA, 15 bp, Homo sapiens
cgggcagccaggctg

SEQ ID NO: 770796 - DNA, 22 bp, Homo sapiens
cgggcaggggagccagggtaga

SEQ ID NO: 770797 - DNA, 21 bp, Homo sapiens
cgggcaggtcctgcccatgtg

SEQ ID NO: 770798 - DNA, 23 bp, Homo sapiens
cgggcaggtcctgcccatgtgtc

SEQ ID NO: 770799 - DNA, 14 bp, Homo sapiens
cgggcagtcctgtg

SEQ ID NO: 770800 - DNA, 17 bp, Homo sapiens
cgggcagtcctgtgtga

SEQ ID NO: 770801 - DNA, 14 bp, Homo sapiens
cgggcagtctgctc

SEQ ID NO: 770802 - DNA, 18 bp, Homo sapiens
cgggcagtctgctctgct

SEQ ID NO: 770803 - DNA, 15 bp, Homo sapiens
cgggcatcgcaggag

SEQ ID NO: 770804 - DNA, 23 bp, Homo sapiens
cgggcatgcacacggctggtcac

SEQ ID NO: 770805 - DNA, 17 bp, Homo sapiens
cgggcatgggcactccc

SEQ ID NO: 770806 - DNA, 21 bp, Homo sapiens
cgggcatgggcctctctgggg

SEQ ID NO: 770807 - DNA, 14 bp, Homo sapiens
cgggcattcacaac

SEQ ID NO: 770808 - DNA, 12 bp, Homo sapiens
cgggccaaggac

SEQ ID NO: 770809 - DNA, 20 bp, Homo sapiens
cgggccaaggactgccgacc

SEQ ID NO: 770810 - DNA, 14 bp, Homo sapiens
cgggccacagggca

SEQ ID NO: 770811 - DNA, 20 bp, Homo sapiens
cgggccagccaggcgggctc

SEQ ID NO: 770812 - DNA, 13 bp, Homo sapiens
cgggccaggcact

SEQ ID NO: 770813 - DNA, 10 bp, Homo sapiens
cgggccaggg

SEQ ID NO: 770814 - DNA, 17 bp, Homo sapiens
cgggccagggctgcccc

SEQ ID NO: 770815 - DNA, 18 bp, Homo sapiens
cgggccagggctgcccct

SEQ ID NO: 770816 - DNA, 11 bp, Homo sapiens
cgggccagggt

SEQ ID NO: 770817 - DNA, 13 bp, Homo sapiens
cgggccagggtgg

SEQ ID NO: 770818 - DNA, 19 bp, Homo sapiens
cgggccagtttctctgcct

SEQ ID NO: 770819 - DNA, 11 bp, Homo sapiens
cgggcccacct

SEQ ID NO: 770820 - DNA, 18 bp, Homo sapiens
cgggcccacctggccacc

SEQ ID NO: 770821 - DNA, 19 bp, Homo sapiens
cgggcccacctggccacct

SEQ ID NO: 770822 - DNA, 17 bp, Homo sapiens
cacacccctgtcccacc

SEQ ID NO: 770823 - DNA, 20 bp, Homo sapiens
cacacccgaagtcctgtcac

SEQ ID NO: 770824 - DNA, 23 bp, Homo sapiens
cacacccgaagtcctgtcactga

SEQ ID NO: 770825 - DNA, 15 bp, Homo sapiens
cacacccgcctgaca

SEQ ID NO: 770826 - DNA, 21 bp, Homo sapiens
cacaccctcccccgccactcc

SEQ ID NO: 770827 - DNA, 13 bp, Homo sapiens
cacaccctgaggt

SEQ ID NO: 770828 - DNA, 21 bp, Homo sapiens
cacaccctgaggtcagggagt

SEQ ID NO: 770829 - DNA, 18 bp, Homo sapiens
cacacctcagttcccttg

SEQ ID NO: 770830 - DNA, 15 bp, Homo sapiens
cacacctccccctgc

SEQ ID NO: 770831 - DNA, 16 bp, Homo sapiens
cacacctccctgaacc

SEQ ID NO: 770832 - DNA, 16 bp, Homo sapiens
cacacctctgggcttc

SEQ ID NO: 770833 - DNA, 18 bp, Homo sapiens
cacacctgaatcagctgg

SEQ ID NO: 770834 - DNA, 16 bp, Homo sapiens
cacacctgactctgaa

SEQ ID NO: 770835 - DNA, 18 bp, Homo sapiens
cacacctggactgaccct

SEQ ID NO: 770836 - DNA, 23 bp, Homo sapiens
cacacctgggcatcagggccttt

SEQ ID NO: 770837 - DNA, 15 bp, Homo sapiens
cacacctgggcattt

SEQ ID NO: 770838 - DNA, 22 bp, Homo sapiens
cggtaccttccatacacagagg

SEQ ID NO: 770839 - DNA, 14 bp, Homo sapiens
cggtcacctgttgg

SEQ ID NO: 770840 - DNA, 12 bp, Homo sapiens
cggtcactgatg

SEQ ID NO: 770841 - DNA, 16 bp, Homo sapiens
cggtcagaggagcgca

SEQ ID NO: 770842 - DNA, 18 bp, Homo sapiens
cggtcagaggagcgcagg

SEQ ID NO: 770843 - DNA, 14 bp, Homo sapiens
cggtcaggtttaac

SEQ ID NO: 770844 - DNA, 13 bp, Homo sapiens
cggtcagtgcctt

SEQ ID NO: 770845 - DNA, 19 bp, Homo sapiens
cggtcagtgccttttggaa

SEQ ID NO: 770846 - DNA, 15 bp, Homo sapiens
cggtcatgtgtgcat

SEQ ID NO: 770847 - DNA, 17 bp, Homo sapiens
cggtcatgtgtgcatgt

SEQ ID NO: 770848 - DNA, 21 bp, Homo sapiens
cggtccagctggcctggacag

SEQ ID NO: 770849 - DNA, 14 bp, Homo sapiens
cggtccccacagac

SEQ ID NO: 770850 - DNA, 19 bp, Homo sapiens
cggtccccatccccaccag

SEQ ID NO: 770851 - DNA, 17 bp, Homo sapiens
cggtcccctgcctggaa

SEQ ID NO: 770852 - DNA, 21 bp, Homo sapiens
cggtccctgcagaagccagaa

SEQ ID NO: 770853 - DNA, 13 bp, Homo sapiens
cggtccctgtccc

SEQ ID NO: 770854 - DNA, 22 bp, Homo sapiens
cggtcccttgagacctcagcca

SEQ ID NO: 770855 - DNA, 13 bp, Homo sapiens
cggtccgcggcct

SEQ ID NO: 770856 - DNA, 15 bp, Homo sapiens
cggtccgcggcctgc

SEQ ID NO: 770857 - DNA, 13 bp, Homo sapiens
cggtccggcgccc

SEQ ID NO: 770858 - DNA, 20 bp, Homo sapiens
cggtcctttaggcagcctgc

SEQ ID NO: 770859 - DNA, 15 bp, Homo sapiens
cggtcgggcagccag

SEQ ID NO: 770860 - DNA, 19 bp, Homo sapiens
cggtctcccaaagtgctgg

SEQ ID NO: 770861 - DNA, 15 bp, Homo sapiens
cggtctcccttccgt

SEQ ID NO: 770862 - DNA, 15 bp, Homo sapiens
cggtctgacagtcct

SEQ ID NO: 770863 - DNA, 20 bp, Homo sapiens
cggtctgagctagctagcgc

SEQ ID NO: 770864 - DNA, 12 bp, Homo sapiens
cggtctgtgtgc

SEQ ID NO: 770865 - DNA, 18 bp, Homo sapiens
cggtgaaggtgacagcag

SEQ ID NO: 770866 - DNA, 18 bp, Homo sapiens
cggtgacacaggtcaggg

SEQ ID NO: 770867 - DNA, 19 bp, Homo sapiens
cggtgacacaggtcagggc

SEQ ID NO: 770868 - DNA, 22 bp, Homo sapiens
cggtgacacaggtcagggctca

SEQ ID NO: 770869 - DNA, 11 bp, Homo sapiens
cggtgagggga

SEQ ID NO: 770870 - DNA, 13 bp, Homo sapiens
cggtgaggggagg

SEQ ID NO: 770871 - DNA, 14 bp, Homo sapiens
cggtgcagtctggg

SEQ ID NO: 770872 - DNA, 16 bp, Homo sapiens
cggtgccaagggcccc

SEQ ID NO: 770873 - DNA, 17 bp, Homo sapiens
cggtgcccatcctgcca

SEQ ID NO: 770874 - DNA, 20 bp, Homo sapiens
cggtgcctgggtggggctgc

SEQ ID NO: 770875 - DNA, 24 bp, Homo sapiens
cggtgcgtggctgtggcacagact

SEQ ID NO: 770876 - DNA, 19 bp, Homo sapiens
cggtgctaaaaatgaaaat

SEQ ID NO: 770877 - DNA, 21 bp, Homo sapiens
cggtgctatatccagttcctg

SEQ ID NO: 770878 - DNA, 15 bp, Homo sapiens
cggtgctctggcggc

SEQ ID NO: 770879 - DNA, 16 bp, Homo sapiens
cggtgctgcaggagtg

SEQ ID NO: 770880 - DNA, 16 bp, Homo sapiens
cggtgctgtcctcagg

SEQ ID NO: 770881 - DNA, 18 bp, Homo sapiens
cggtgctgtgagggaggg

SEQ ID NO: 770882 - DNA, 23 bp, Homo sapiens
cggtgcttccaacaaggacagcc

SEQ ID NO: 770883 - DNA, 20 bp, Homo sapiens
cggtggaggaaggctctgtc

SEQ ID NO: 770884 - DNA, 13 bp, Homo sapiens
cggtggaggccag

SEQ ID NO: 770885 - DNA, 14 bp, Homo sapiens
cggtggcagtaggg

SEQ ID NO: 770886 - DNA, 15 bp, Homo sapiens
cggtggcgggcacct

SEQ ID NO: 770887 - DNA, 20 bp, Homo sapiens
cggtggctcacgcctgtaat

SEQ ID NO: 770888 - DNA, 20 bp, Homo sapiens
cggtggctcatgcctgtaat

SEQ ID NO: 770889 - DNA, 16 bp, Homo sapiens
cggtggctctggggta

SEQ ID NO: 770890 - DNA, 15 bp, Homo sapiens
cggtggctgcacaga

SEQ ID NO: 770891 - DNA, 14 bp, Homo sapiens
cggtgggaaggaaa

SEQ ID NO: 770892 - DNA, 15 bp, Homo sapiens
cggtgggcacccacc

SEQ ID NO: 770893 - DNA, 19 bp, Homo sapiens
cggtgggcacccaccctgg

SEQ ID NO: 770894 - DNA, 14 bp, Homo sapiens
cggtggtgcccgtg

SEQ ID NO: 770895 - DNA, 21 bp, Homo sapiens
cggtggtgcccgtgcccgcag

SEQ ID NO: 770896 - DNA, 22 bp, Homo sapiens
cggtgtatcctggccctggggg

SEQ ID NO: 770897 - DNA, 21 bp, Homo sapiens
cggtgtcaggtcccagcgagc

SEQ ID NO: 770898 - DNA, 14 bp, Homo sapiens
cggtgtccccagag

SEQ ID NO: 770899 - DNA, 16 bp, Homo sapiens
cggtgtgcaccagggt

SEQ ID NO: 770900 - DNA, 14 bp, Homo sapiens
cggtgtgctgccaa

SEQ ID NO: 770901 - DNA, 20 bp, Homo sapiens
cggtgtggtgcagtgtgaaa

SEQ ID NO: 770902 - DNA, 18 bp, Homo sapiens
cggtgttattccaaggga

SEQ ID NO: 770903 - DNA, 18 bp, Homo sapiens
cggttataaaaaatggtt

SEQ ID NO: 770904 - DNA, 20 bp, Homo sapiens
cggttataaaaaatggttca

SEQ ID NO: 770905 - DNA, 21 bp, Homo sapiens
cggttataaaaaatggttcag

SEQ ID NO: 770906 - DNA, 17 bp, Homo sapiens
cggttattcgcccaccc

SEQ ID NO: 770907 - DNA, 17 bp, Homo sapiens
cggttcagacccctgcc

SEQ ID NO: 770908 - DNA, 14 bp, Homo sapiens
cggttccagacact

SEQ ID NO: 770909 - DNA, 17 bp, Homo sapiens
cggttcttacagcacat

SEQ ID NO: 770910 - DNA, 12 bp, Homo sapiens
cggttcttccag

SEQ ID NO: 770911 - DNA, 13 bp, Homo sapiens
cggttgcagggct

SEQ ID NO: 770912 - DNA, 17 bp, Homo sapiens
cggttgcagtcactgtg

SEQ ID NO: 770913 - DNA, 15 bp, Homo sapiens
cggttgccccagtag

SEQ ID NO: 770914 - DNA, 13 bp, Homo sapiens
cgtaaagaatttt

SEQ ID NO: 770915 - DNA, 12 bp, Homo sapiens
cgtaaagatttg

SEQ ID NO: 770916 - DNA, 20 bp, Homo sapiens
cgtaaatcatattttagctg

SEQ ID NO: 770917 - DNA, 24 bp, Homo sapiens
cgtaagatacaagtttcagacagg

SEQ ID NO: 770918 - DNA, 13 bp, Homo sapiens
cgtaatgggcctg

SEQ ID NO: 770919 - DNA, 12 bp, Homo sapiens
cgtaatttaact

SEQ ID NO: 770920 - DNA, 14 bp, Homo sapiens
cgtaatttaatggg

SEQ ID NO: 770921 - DNA, 22 bp, Homo sapiens
cgtacacaccacgtcctggtct

SEQ ID NO: 770922 - DNA, 11 bp, Homo sapiens
cgtacacagag

SEQ ID NO: 770923 - DNA, 23 bp, Homo sapiens
cgtacacagagaaggctatgtaa

SEQ ID NO: 770924 - DNA, 16 bp, Homo sapiens
cgtacacattttattt

SEQ ID NO: 770925 - DNA, 15 bp, Homo sapiens
cgtacataataagtt

SEQ ID NO: 770926 - DNA, 23 bp, Homo sapiens
cgtaccaccatgcactgtaaata

SEQ ID NO: 770927 - DNA, 13 bp, Homo sapiens
cgtaccccaccct

SEQ ID NO: 770928 - DNA, 16 bp, Homo sapiens
cgtactcggcttcctg

SEQ ID NO: 770929 - DNA, 16 bp, Homo sapiens
cgtactgtaactgctc

SEQ ID NO: 770930 - DNA, 15 bp, Homo sapiens
cgtagcctgggctca

SEQ ID NO: 770931 - DNA, 20 bp, Homo sapiens
cgtagggagtacctgctgcc

SEQ ID NO: 770932 - DNA, 18 bp, Homo sapiens
cgtaggttccccagagag

SEQ ID NO: 770933 - DNA, 22 bp, Homo sapiens
cgtaggttccccagagagcagg

SEQ ID NO: 770934 - DNA, 14 bp, Homo sapiens
cgtagtctcctggg

SEQ ID NO: 770935 - DNA, 17 bp, Homo sapiens
cgtagtctcctgggtgt

SEQ ID NO: 770936 - DNA, 13 bp, Homo sapiens
cgtagttccctga

SEQ ID NO: 770937 - DNA, 14 bp, Homo sapiens
cgtataaatatcag

SEQ ID NO: 770938 - DNA, 15 bp, Homo sapiens
cgtataaatatcagt

SEQ ID NO: 770939 - DNA, 20 bp, Homo sapiens
cgtatacttaaaatgacaaa

SEQ ID NO: 770940 - DNA, 19 bp, Homo sapiens
cgtataggatgtcagacaa

SEQ ID NO: 770941 - DNA, 20 bp, Homo sapiens
cgtatatacttaagaataca

SEQ ID NO: 770942 - DNA, 14 bp, Homo sapiens
cgtatatataaaca

SEQ ID NO: 770943 - DNA, 14 bp, Homo sapiens
cgtatctgcagaat

SEQ ID NO: 770944 - DNA, 22 bp, Homo sapiens
cgtatgatcagtactgactttc

SEQ ID NO: 770945 - DNA, 23 bp, Homo sapiens
cgtgggccagtccccgaggagct

SEQ ID NO: 770946 - DNA, 19 bp, Homo sapiens
cgtgggcgcaaaggtgcct

SEQ ID NO: 770947 - DNA, 15 bp, Homo sapiens
cgtgggctcccctct

SEQ ID NO: 770948 - DNA, 14 bp, Homo sapiens
cgtgggctctgcca

SEQ ID NO: 770949 - DNA, 17 bp, Homo sapiens
cgtgggctctgccaatg

SEQ ID NO: 770950 - DNA, 17 bp, Homo sapiens
cgtgggcttaaagcaga

SEQ ID NO: 770951 - DNA, 18 bp, Homo sapiens
cgtgggcttgtgctcggg

SEQ ID NO: 770952 - DNA, 16 bp, Homo sapiens
cgtggggaaggggtgc

SEQ ID NO: 770953 - DNA, 13 bp, Homo sapiens
cgtggggcccact

SEQ ID NO: 770954 - DNA, 23 bp, Homo sapiens
cgtgggggcactgaccaggccca

SEQ ID NO: 770955 - DNA, 18 bp, Homo sapiens
cgtggggtgtgctgggag

SEQ ID NO: 770956 - DNA, 13 bp, Homo sapiens
cgtgggtgtgtgc

SEQ ID NO: 770957 - DNA, 17 bp, Homo sapiens
cgtggtagaagccagta

SEQ ID NO: 770958 - DNA, 19 bp, Homo sapiens
cgtggtggcggtggctgcc

SEQ ID NO: 770959 - DNA, 16 bp, Homo sapiens
cgtggtgggactccag

SEQ ID NO: 770960 - DNA, 22 bp, Homo sapiens
cgtggtgggggaggagcctctg

SEQ ID NO: 770961 - DNA, 14 bp, Homo sapiens
cgtggtgtggcccg

SEQ ID NO: 770962 - DNA, 19 bp, Homo sapiens
cgtggtgttatttaaagaa

SEQ ID NO: 770963 - DNA, 23 bp, Homo sapiens
cgtggttattagcaaggctgggt

SEQ ID NO: 770964 - DNA, 13 bp, Homo sapiens
cgtggttcttaaa

SEQ ID NO: 770965 - DNA, 10 bp, Homo sapiens
cgtggtttgc

SEQ ID NO: 770966 - DNA, 15 bp, Homo sapiens
cgtgtaaaccaaagc

SEQ ID NO: 770967 - DNA, 14 bp, Homo sapiens
cgtgtaaataattt

SEQ ID NO: 770968 - DNA, 20 bp, Homo sapiens
cgtgtaaataatttattaca

SEQ ID NO: 770969 - DNA, 14 bp, Homo sapiens
cgtgtacagcacag

SEQ ID NO: 770970 - DNA, 15 bp, Homo sapiens
cgtgtacagcacaga

SEQ ID NO: 770971 - DNA, 20 bp, Homo sapiens
cgtgtacagctcccttccct

SEQ ID NO: 770972 - DNA, 15 bp, Homo sapiens
cacagaggaagagca

SEQ ID NO: 770973 - DNA, 17 bp, Homo sapiens
cacagaggaagagcagg

SEQ ID NO: 770974 - DNA, 16 bp, Homo sapiens
cacagaggagtgcagc

SEQ ID NO: 770975 - DNA, 21 bp, Homo sapiens
cacagaggcagcccgcacacc

SEQ ID NO: 770976 - DNA, 16 bp, Homo sapiens
cacagaggctggcact

SEQ ID NO: 770977 - DNA, 19 bp, Homo sapiens
cacagaggtctttcagctc

SEQ ID NO: 770978 - DNA, 18 bp, Homo sapiens
cacagagtgagccagtga

SEQ ID NO: 770979 - DNA, 17 bp, Homo sapiens
cacagagtgctggactg

SEQ ID NO: 770980 - DNA, 19 bp, Homo sapiens
cacagataactgaaaatta

SEQ ID NO: 770981 - DNA, 13 bp, Homo sapiens
cacagatacctca

SEQ ID NO: 770982 - DNA, 15 bp, Homo sapiens
cacagatacctcatc

SEQ ID NO: 770983 - DNA, 17 bp, Homo sapiens
cacagatgaccaaagtc

SEQ ID NO: 770984 - DNA, 13 bp, Homo sapiens
cacagatgctcca

SEQ ID NO: 770985 - DNA, 12 bp, Homo sapiens
cacagatggatt

SEQ ID NO: 770986 - DNA, 20 bp, Homo sapiens
cacagatggctttcagggca

SEQ ID NO: 770987 - DNA, 21 bp, Homo sapiens
cacagatggctttcagggcag

SEQ ID NO: 770988 - DNA, 22 bp, Homo sapiens
cacagatgggtattaaacttgt

SEQ ID NO: 770989 - DNA, 17 bp, Homo sapiens
cacagatgtctctgggg

SEQ ID NO: 770990 - DNA, 16 bp, Homo sapiens
cacagatgtgtctggg

SEQ ID NO: 770991 - DNA, 13 bp, Homo sapiens
cacagattgaaga

SEQ ID NO: 770992 - DNA, 14 bp, Homo sapiens
cacagattgaagaa

SEQ ID NO: 770993 - DNA, 21 bp, Homo sapiens
cacagattgaagaatctgccc

SEQ ID NO: 770994 - DNA, 22 bp, Homo sapiens
cacagattgaagaatctgcccc

SEQ ID NO: 770995 - DNA, 17 bp, Homo sapiens
cacagatttgagctcag

SEQ ID NO: 770996 - DNA, 14 bp, Homo sapiens
cacagatttgtgcc

SEQ ID NO: 770997 - DNA, 12 bp, Homo sapiens
cacagattttta

SEQ ID NO: 770998 - DNA, 18 bp, Homo sapiens
cacagatttttacactaa

SEQ ID NO: 770999 - DNA, 19 bp, Homo sapiens
cacagatttttatgttttc

SEQ ID NO: 771000 - DNA, 14 bp, Homo sapiens
cacagcaaccccag

SEQ ID NO: 771001 - DNA, 17 bp, Homo sapiens
cacagcaaccccaggct

SEQ ID NO: 771002 - DNA, 18 bp, Homo sapiens
cacagcaaccccaggctg

SEQ ID NO: 771003 - DNA, 13 bp, Homo sapiens
cacagcaagccat

SEQ ID NO: 771004 - DNA, 21 bp, Homo sapiens
cacagcaagtacagcggctcc

SEQ ID NO: 771005 - DNA, 23 bp, Homo sapiens
cacagcacaaattagttatatat

SEQ ID NO: 771006 - DNA, 17 bp, Homo sapiens
cacagcacaaccggtcc

SEQ ID NO: 771007 - DNA, 20 bp, Homo sapiens
cacagcacaccagccgctgc

SEQ ID NO: 771008 - DNA, 17 bp, Homo sapiens
cacagcaccaaaggctc

SEQ ID NO: 771009 - DNA, 19 bp, Homo sapiens
cacagcaccagaatgtata

SEQ ID NO: 771010 - DNA, 18 bp, Homo sapiens
cacagcagcatcttcaaa

SEQ ID NO: 771011 - DNA, 15 bp, Homo sapiens
cacagcagcccccca

SEQ ID NO: 771012 - DNA, 20 bp, Homo sapiens
cacagcagccccccagcact

SEQ ID NO: 771013 - DNA, 23 bp, Homo sapiens
cacagcagcttataatgggctct

SEQ ID NO: 771014 - DNA, 19 bp, Homo sapiens
cacagcagcttcaccagag

SEQ ID NO: 771015 - DNA, 22 bp, Homo sapiens
cacagcagcttcaccagagcat

SEQ ID NO: 771016 - DNA, 21 bp, Homo sapiens
cacagcaggatgctaatggaa

SEQ ID NO: 771017 - DNA, 18 bp, Homo sapiens
cacagcaggggctggccc

SEQ ID NO: 771018 - DNA, 12 bp, Homo sapiens
cacagcagtgag

SEQ ID NO: 771019 - DNA, 13 bp, Homo sapiens
cacagcagtgagt

SEQ ID NO: 771020 - DNA, 20 bp, Homo sapiens
cacagcatggaggaggaggg

SEQ ID NO: 771021 - DNA, 18 bp, Homo sapiens
cacagcatgtgccaagat

SEQ ID NO: 771022 - DNA, 14 bp, Homo sapiens
cacagccacacctg

SEQ ID NO: 771023 - DNA, 22 bp, Homo sapiens
cacagccacccgtggggtgctg

SEQ ID NO: 771024 - DNA, 14 bp, Homo sapiens
cacagccacctccg

SEQ ID NO: 771025 - DNA, 16 bp, Homo sapiens
cacagccagaggaggg

SEQ ID NO: 771026 - DNA, 15 bp, Homo sapiens
cacagccagcacctg

SEQ ID NO: 771027 - DNA, 20 bp, Homo sapiens
cacagccagcacctggcatc

SEQ ID NO: 771028 - DNA, 11 bp, Homo sapiens
cacagccagcc

SEQ ID NO: 771029 - DNA, 21 bp, Homo sapiens
cacagccagcccaaaccttgg

SEQ ID NO: 771030 - DNA, 12 bp, Homo sapiens
cacagcccaggg

SEQ ID NO: 771031 - DNA, 23 bp, Homo sapiens
cacagcccccgggacaccgtggg

SEQ ID NO: 771032 - DNA, 23 bp, Homo sapiens
cacagccccgatgattcttaaca

SEQ ID NO: 771033 - DNA, 18 bp, Homo sapiens
cacagcccgctctctggc

SEQ ID NO: 771034 - DNA, 13 bp, Homo sapiens
cacagcccgggtg

SEQ ID NO: 771035 - DNA, 11 bp, Homo sapiens
cacagccctgg

SEQ ID NO: 771036 - DNA, 14 bp, Homo sapiens
cacagccctgggag

SEQ ID NO: 771037 - DNA, 12 bp, Homo sapiens
cacagccctgtc

SEQ ID NO: 771038 - DNA, 13 bp, Homo sapiens
cacagccctgtca

SEQ ID NO: 771039 - DNA, 21 bp, Homo sapiens
cacagccgcagcctccctctg

SEQ ID NO: 771040 - DNA, 13 bp, Homo sapiens
cacagcctagcac

SEQ ID NO: 771041 - DNA, 18 bp, Homo sapiens
cacagcctagcacagcag

SEQ ID NO: 771042 - DNA, 23 bp, Homo sapiens
cacagcctcacgcccccaggaat

SEQ ID NO: 771043 - DNA, 16 bp, Homo sapiens
cacagcctccagggcc

SEQ ID NO: 771044 - DNA, 11 bp, Homo sapiens
cacagcctccc

SEQ ID NO: 771045 - DNA, 14 bp, Homo sapiens
cacagcctcccccg

SEQ ID NO: 771046 - DNA, 19 bp, Homo sapiens
cacagcctccctgagcctg

SEQ ID NO: 771047 - DNA, 22 bp, Homo sapiens
cacagcctccctgagcctgcat

SEQ ID NO: 771048 - DNA, 17 bp, Homo sapiens
cacagcctcggggatgg

SEQ ID NO: 771049 - DNA, 23 bp, Homo sapiens
cacagcctcggggatggggaggg

SEQ ID NO: 771050 - DNA, 22 bp, Homo sapiens
cacagcctctaagcgtgctgac

SEQ ID NO: 771051 - DNA, 14 bp, Homo sapiens
cacagcctgctggc

SEQ ID NO: 771052 - DNA, 16 bp, Homo sapiens
cacagcctgctggcag

SEQ ID NO: 771053 - DNA, 21 bp, Homo sapiens
cacagcctgctggcagggcca

SEQ ID NO: 771054 - DNA, 20 bp, Homo sapiens
cacagcgagcctgtgccttc

SEQ ID NO: 771055 - DNA, 14 bp, Homo sapiens
cacagcgagggcag

SEQ ID NO: 771056 - DNA, 16 bp, Homo sapiens
cacagcgccagcctca

SEQ ID NO: 771057 - DNA, 23 bp, Homo sapiens
cacagcggagtctgtcctgtgac

SEQ ID NO: 771058 - DNA, 20 bp, Homo sapiens
cacagcggggccccagggct

SEQ ID NO: 771059 - DNA, 18 bp, Homo sapiens
cacagcgtccctggcgca

SEQ ID NO: 771060 - DNA, 22 bp, Homo sapiens
cacagcgtccctggcgcaggtg

SEQ ID NO: 771061 - DNA, 19 bp, Homo sapiens
cacagcgtcctgtccacac

SEQ ID NO: 771062 - DNA, 20 bp, Homo sapiens
cacagctacttggtttgtgt

SEQ ID NO: 771063 - DNA, 15 bp, Homo sapiens
cacagctcccacccc

SEQ ID NO: 771064 - DNA, 19 bp, Homo sapiens
cacagctcccaccccaccc

SEQ ID NO: 771065 - DNA, 10 bp, Homo sapiens
cacagctcct

SEQ ID NO: 771066 - DNA, 22 bp, Homo sapiens
cacagctcctcttaccgtagcc

SEQ ID NO: 771067 - DNA, 18 bp, Homo sapiens
ctaaaggcatccttgtct

SEQ ID NO: 771068 - DNA, 23 bp, Homo sapiens
ctaaaggcatccttgtcttttga

SEQ ID NO: 771069 - DNA, 19 bp, Homo sapiens
ctaaaggctacctttgtat

SEQ ID NO: 771070 - DNA, 13 bp, Homo sapiens
ctaaagggaccat

SEQ ID NO: 771071 - DNA, 17 bp, Homo sapiens
ctaaagggagaaggaag

SEQ ID NO: 771072 - DNA, 15 bp, Homo sapiens
ctaaagggcagggcc

SEQ ID NO: 771073 - DNA, 16 bp, Homo sapiens
ctaaaggggagaaact

SEQ ID NO: 771074 - DNA, 21 bp, Homo sapiens
ctaaaggggttttttgggaag

SEQ ID NO: 771075 - DNA, 22 bp, Homo sapiens
ctaaaggtaccaaacaaggaag

SEQ ID NO: 771076 - DNA, 13 bp, Homo sapiens
ctaaagtaaaatt

SEQ ID NO: 771077 - DNA, 17 bp, Homo sapiens
ctaaagtaaaattgaag

SEQ ID NO: 771078 - DNA, 18 bp, Homo sapiens
ctaaagtatacaactgcc

SEQ ID NO: 771079 - DNA, 21 bp, Homo sapiens
ctaaagtatacaactgcctgg

SEQ ID NO: 771080 - DNA, 19 bp, Homo sapiens
ctaaagtgtatttttttac

SEQ ID NO: 771081 - DNA, 17 bp, Homo sapiens
ctaaagtgttggtcttt

SEQ ID NO: 771082 - DNA, 23 bp, Homo sapiens
ctaaagttactactgattttaaa

SEQ ID NO: 771083 - DNA, 14 bp, Homo sapiens
ctaaagttatattt

SEQ ID NO: 771084 - DNA, 22 bp, Homo sapiens
ctaaagttatatttcagatgta

SEQ ID NO: 771085 - DNA, 17 bp, Homo sapiens
ctaaagttgaagcattt

SEQ ID NO: 771086 - DNA, 14 bp, Homo sapiens
ctaaagttttgcaa

SEQ ID NO: 771087 - DNA, 16 bp, Homo sapiens
ctaaataaaaatatgt

SEQ ID NO: 771088 - DNA, 15 bp, Homo sapiens
ctaaataaaatttgt

SEQ ID NO: 771089 - DNA, 20 bp, Homo sapiens
ctaaataaaatttgttgcat

SEQ ID NO: 771090 - DNA, 22 bp, Homo sapiens
ctaaataaacacatagattcac

SEQ ID NO: 771091 - DNA, 19 bp, Homo sapiens
ctaaataaacagatgtatt

SEQ ID NO: 771092 - DNA, 16 bp, Homo sapiens
ctaaataaagatattg

SEQ ID NO: 771093 - DNA, 23 bp, Homo sapiens
ctaaataaagcttgcaacaaaat

SEQ ID NO: 771094 - DNA, 22 bp, Homo sapiens
ctaaataaggaatttcctccca

SEQ ID NO: 771095 - DNA, 16 bp, Homo sapiens
ctaaataatgaataaa

SEQ ID NO: 771096 - DNA, 18 bp, Homo sapiens
ctaaataggatcctggag

SEQ ID NO: 771097 - DNA, 12 bp, Homo sapiens
ctaaatatatgt

SEQ ID NO: 771098 - DNA, 19 bp, Homo sapiens
ctaaatatccaaagactgt

SEQ ID NO: 771099 - DNA, 22 bp, Homo sapiens
ctaaatatccaaagactgtact

SEQ ID NO: 771100 - DNA, 22 bp, Homo sapiens
ctaaatatggactgctcaggaa

SEQ ID NO: 771101 - DNA, 20 bp, Homo sapiens
ctaaatatttaccttgaaaa

SEQ ID NO: 771102 - DNA, 19 bp, Homo sapiens
ctaaatcagagacaaaata

SEQ ID NO: 771103 - DNA, 16 bp, Homo sapiens
ctaaatcccaagaaat

SEQ ID NO: 771104 - DNA, 12 bp, Homo sapiens
ctaaatctattt

SEQ ID NO: 771105 - DNA, 14 bp, Homo sapiens
cacagctttgcacc

SEQ ID NO: 771106 - DNA, 16 bp, Homo sapiens
cacagctttgcacccc

SEQ ID NO: 771107 - DNA, 13 bp, Homo sapiens
cacagcttttgca

SEQ ID NO: 771108 - DNA, 18 bp, Homo sapiens
cacaggaaaaataaacgt

SEQ ID NO: 771109 - DNA, 16 bp, Homo sapiens
cacaggaaaagaattt

SEQ ID NO: 771110 - DNA, 22 bp, Homo sapiens
cacaggaaaatgtatccagagg

SEQ ID NO: 771111 - DNA, 15 bp, Homo sapiens
cacaggaaagagtca

SEQ ID NO: 771112 - DNA, 17 bp, Homo sapiens
cacaggaaccctaaagc

SEQ ID NO: 771113 - DNA, 22 bp, Homo sapiens
cacaggaacggccctgcaggag

SEQ ID NO: 771114 - DNA, 19 bp, Homo sapiens
cacaggaagtttggagcct

SEQ ID NO: 771115 - DNA, 18 bp, Homo sapiens
cacaggacacgaaggctg

SEQ ID NO: 771116 - DNA, 13 bp, Homo sapiens
cacaggacagcgg

SEQ ID NO: 771117 - DNA, 15 bp, Homo sapiens
cacaggacagcggga

SEQ ID NO: 771118 - DNA, 20 bp, Homo sapiens
cacaggacatgcggtagcca

SEQ ID NO: 771119 - DNA, 23 bp, Homo sapiens
cacaggacatgcggtagccagca

SEQ ID NO: 771120 - DNA, 18 bp, Homo sapiens
cacaggactgagccctct

SEQ ID NO: 771121 - DNA, 22 bp, Homo sapiens
cacaggactgagccctctcact

SEQ ID NO: 771122 - DNA, 19 bp, Homo sapiens
cacaggagactccaaggag

SEQ ID NO: 771123 - DNA, 18 bp, Homo sapiens
cacaggagcaatcacagg

SEQ ID NO: 771124 - DNA, 19 bp, Homo sapiens
cacaggagcaatcacagga

SEQ ID NO: 771125 - DNA, 22 bp, Homo sapiens
cacaggaggagaaatctcactt

SEQ ID NO: 771126 - DNA, 12 bp, Homo sapiens
cacaggagggcc

SEQ ID NO: 771127 - DNA, 16 bp, Homo sapiens
cacaggagtgtcctct

SEQ ID NO: 771128 - DNA, 22 bp, Homo sapiens
cacaggagtgtcctcttccctc

SEQ ID NO: 771129 - DNA, 19 bp, Homo sapiens
cacaggagttgtgagccct

SEQ ID NO: 771130 - DNA, 20 bp, Homo sapiens
cacaggagttgtgagccctc

SEQ ID NO: 771131 - DNA, 21 bp, Homo sapiens
cacaggatattaaacgtgtaa

SEQ ID NO: 771132 - DNA, 22 bp, Homo sapiens
cacaggatattaaacgtgtaaa

SEQ ID NO: 771133 - DNA, 19 bp, Homo sapiens
cacaggatcctattctcac

SEQ ID NO: 771134 - DNA, 20 bp, Homo sapiens
cacaggatcctattctcacc

SEQ ID NO: 771135 - DNA, 24 bp, Homo sapiens
cacaggatcctattctcaccagga

SEQ ID NO: 771136 - DNA, 16 bp, Homo sapiens
cacaggatgctggcct

SEQ ID NO: 771137 - DNA, 17 bp, Homo sapiens
cacaggatgctgtgttg

SEQ ID NO: 771138 - DNA, 19 bp, Homo sapiens
cacaggcaactgaggcaga

SEQ ID NO: 771139 - DNA, 20 bp, Homo sapiens
cacaggcaactgaggcagac

SEQ ID NO: 771140 - DNA, 13 bp, Homo sapiens
cacaggcacacag

SEQ ID NO: 771141 - DNA, 17 bp, Homo sapiens
cacaggcacacagggcc

SEQ ID NO: 771142 - DNA, 11 bp, Homo sapiens
cacaggcagct

SEQ ID NO: 771143 - DNA, 22 bp, Homo sapiens
cacaggcagtccaggcctctct

SEQ ID NO: 771144 - DNA, 16 bp, Homo sapiens
cacaggcagtgcatgt

SEQ ID NO: 771145 - DNA, 18 bp, Homo sapiens
cacaggcagtgcatgtga

SEQ ID NO: 771146 - DNA, 23 bp, Homo sapiens
cacaggcagtgcatgtgaagcat

SEQ ID NO: 771147 - DNA, 13 bp, Homo sapiens
cacaggccccctt

SEQ ID NO: 771148 - DNA, 14 bp, Homo sapiens
cacaggccctagct

SEQ ID NO: 771149 - DNA, 15 bp, Homo sapiens
cacaggcccttcctc

SEQ ID NO: 771150 - DNA, 18 bp, Homo sapiens
cacaggcccttcctctcc

SEQ ID NO: 771151 - DNA, 23 bp, Homo sapiens
cacaggcccttcctctccactgc

SEQ ID NO: 771152 - DNA, 17 bp, Homo sapiens
cacaggccttctgtggg

SEQ ID NO: 771153 - DNA, 21 bp, Homo sapiens
cacaggccttctgtggggctg

SEQ ID NO: 771154 - DNA, 23 bp, Homo sapiens
cacaggccttctgtggggctggg

SEQ ID NO: 771155 - DNA, 21 bp, Homo sapiens
cacaggctgaaatatccaccc

SEQ ID NO: 771156 - DNA, 12 bp, Homo sapiens
cacaggctgggt

SEQ ID NO: 771157 - DNA, 13 bp, Homo sapiens
cacaggctgggtc

SEQ ID NO: 771158 - DNA, 23 bp, Homo sapiens
cacagggatgctggtggctggtg

SEQ ID NO: 771159 - DNA, 17 bp, Homo sapiens
cacagggcagagccggg

SEQ ID NO: 771160 - DNA, 23 bp, Homo sapiens
cacagggcaggccttgctggggt

SEQ ID NO: 771161 - DNA, 14 bp, Homo sapiens
cacagggcggtacc

SEQ ID NO: 771162 - DNA, 21 bp, Homo sapiens
cacagggcggtaccttgtgcc

SEQ ID NO: 771163 - DNA, 13 bp, Homo sapiens
cacagggctaaga

SEQ ID NO: 771164 - DNA, 20 bp, Homo sapiens
cacagggcttgttttccaaa

SEQ ID NO: 771165 - DNA, 18 bp, Homo sapiens
cacaggggccccagatct

SEQ ID NO: 771166 - DNA, 21 bp, Homo sapiens
cacaggggccctgtacagtga

SEQ ID NO: 771167 - DNA, 14 bp, Homo sapiens
cacaggggcggggc

SEQ ID NO: 771168 - DNA, 15 bp, Homo sapiens
cacaggggcggggca

SEQ ID NO: 771169 - DNA, 18 bp, Homo sapiens
cacaggggcggggcagga

SEQ ID NO: 771170 - DNA, 19 bp, Homo sapiens
cacaggggcggggcaggaa

SEQ ID NO: 771171 - DNA, 21 bp, Homo sapiens
cacaggggtgtttgtgtgtgt

SEQ ID NO: 771172 - DNA, 21 bp, Homo sapiens
cacagggtccccgagtgccta

SEQ ID NO: 771173 - DNA, 16 bp, Homo sapiens
cacagggttgggccca

SEQ ID NO: 771174 - DNA, 18 bp, Homo sapiens
cacaggtcaataaactta

SEQ ID NO: 771175 - DNA, 16 bp, Homo sapiens
cacaggtcagggctca

SEQ ID NO: 771176 - DNA, 17 bp, Homo sapiens
cacaggtcagggctcag

SEQ ID NO: 771177 - DNA, 12 bp, Homo sapiens
cacaggtcccac

SEQ ID NO: 771178 - DNA, 19 bp, Homo sapiens
cacaggtcccacctccagc

SEQ ID NO: 771179 - DNA, 21 bp, Homo sapiens
cacaggtcccacctccagccc

SEQ ID NO: 771180 - DNA, 22 bp, Homo sapiens
cacaggtcccacctccagcccg

SEQ ID NO: 771181 - DNA, 18 bp, Homo sapiens
cacaggtctttcctaagg

SEQ ID NO: 771182 - DNA, 20 bp, Homo sapiens
cacaggtctttcctaaggct

SEQ ID NO: 771183 - DNA, 17 bp, Homo sapiens
cacaggtgaggggcagg

SEQ ID NO: 771184 - DNA, 19 bp, Homo sapiens
cacaggtgaggggcaggac

SEQ ID NO: 771185 - DNA, 22 bp, Homo sapiens
cacaggtgaggggcaggacctg

SEQ ID NO: 771186 - DNA, 19 bp, Homo sapiens
cacaggtgcaacagacttg

SEQ ID NO: 771187 - DNA, 19 bp, Homo sapiens
cacatctaaagctttatct

SEQ ID NO: 771188 - DNA, 13 bp, Homo sapiens
cacatctaagcct

SEQ ID NO: 771189 - DNA, 14 bp, Homo sapiens
cacatctaagcctg

SEQ ID NO: 771190 - DNA, 16 bp, Homo sapiens
cacatctaatgtctct

SEQ ID NO: 771191 - DNA, 22 bp, Homo sapiens
cacatctagtagttgttctgaa

SEQ ID NO: 771192 - DNA, 23 bp, Homo sapiens
cacatctagtagttgttctgaaa

SEQ ID NO: 771193 - DNA, 20 bp, Homo sapiens
cacatctccagaaaaatgaa

SEQ ID NO: 771194 - DNA, 13 bp, Homo sapiens
cacatctctctgc

SEQ ID NO: 771195 - DNA, 21 bp, Homo sapiens
cacatctgcattttcacccca

SEQ ID NO: 771196 - DNA, 15 bp, Homo sapiens
cacatctgccagacc

SEQ ID NO: 771197 - DNA, 15 bp, Homo sapiens
cacatctgcctcctc

SEQ ID NO: 771198 - DNA, 12 bp, Homo sapiens
cacatctgcctt

SEQ ID NO: 771199 - DNA, 13 bp, Homo sapiens
cacatctgctcta

SEQ ID NO: 771200 - DNA, 19 bp, Homo sapiens
cacatctgctggtgggtgg

SEQ ID NO: 771201 - DNA, 14 bp, Homo sapiens
cacatctggccctg

SEQ ID NO: 771202 - DNA, 22 bp, Homo sapiens
cacatctggccctgacttctgg

SEQ ID NO: 771203 - DNA, 19 bp, Homo sapiens
cacatctggctgcacaggc

SEQ ID NO: 771204 - DNA, 22 bp, Homo sapiens
cacatctggctgcacaggctga

SEQ ID NO: 771205 - DNA, 13 bp, Homo sapiens
cacatctgtcctc

SEQ ID NO: 771206 - DNA, 18 bp, Homo sapiens
cacatctgtgtcttgttt

SEQ ID NO: 771207 - DNA, 14 bp, Homo sapiens
cacatcttgctctg

SEQ ID NO: 771208 - DNA, 22 bp, Homo sapiens
cacatctttatctgttcttgct

SEQ ID NO: 771209 - DNA, 21 bp, Homo sapiens
cacatctttcctcaagtatct

SEQ ID NO: 771210 - DNA, 14 bp, Homo sapiens
cacatctttcctgt

SEQ ID NO: 771211 - DNA, 15 bp, Homo sapiens
cacatctttcctgtc

SEQ ID NO: 771212 - DNA, 14 bp, Homo sapiens
cacatgacctccat

SEQ ID NO: 771213 - DNA, 19 bp, Homo sapiens
cacatgacttattatgcat

SEQ ID NO: 771214 - DNA, 15 bp, Homo sapiens
cacatgaggccatct

SEQ ID NO: 771215 - DNA, 22 bp, Homo sapiens
cacatgaggccatctcaggaga

SEQ ID NO: 771216 - DNA, 14 bp, Homo sapiens
cacatgcccctccc

SEQ ID NO: 771217 - DNA, 17 bp, Homo sapiens
cacatgccctcctggac

SEQ ID NO: 771218 - DNA, 22 bp, Homo sapiens
cacatgcccttggtgacagctg

SEQ ID NO: 771219 - DNA, 18 bp, Homo sapiens
cacatgcgggctcgccca

SEQ ID NO: 771220 - DNA, 21 bp, Homo sapiens
cacatgcgggctcgcccatac

SEQ ID NO: 771221 - DNA, 16 bp, Homo sapiens
cacatgcgtatatgtg

SEQ ID NO: 771222 - DNA, 9 bp, Homo sapiens
cacatgcta

SEQ ID NO: 771223 - DNA, 15 bp, Homo sapiens
cacatgctatgttct

SEQ ID NO: 771224 - DNA, 19 bp, Homo sapiens
cacatgctatgttctgtct

SEQ ID NO: 771225 - DNA, 19 bp, Homo sapiens
cacatgctgaggttttgaa

SEQ ID NO: 771226 - DNA, 16 bp, Homo sapiens
cacatgctgcctggca

SEQ ID NO: 771227 - DNA, 17 bp, Homo sapiens
cacatgctgcctggcac

SEQ ID NO: 771228 - DNA, 18 bp, Homo sapiens
cacatgctgcctggcaca

SEQ ID NO: 771229 - DNA, 21 bp, Homo sapiens
cacatgctgcctggcacagac

SEQ ID NO: 771230 - DNA, 21 bp, Homo sapiens
cacatgctgtctggccctggg

SEQ ID NO: 771231 - DNA, 23 bp, Homo sapiens
cacatgcttagcttatctttctt

SEQ ID NO: 771232 - DNA, 20 bp, Homo sapiens
cacatggagccccctctgcc

SEQ ID NO: 771233 - DNA, 14 bp, Homo sapiens
cacatgggacctgg

SEQ ID NO: 771234 - DNA, 15 bp, Homo sapiens
cacatgggacctggc

SEQ ID NO: 771235 - DNA, 14 bp, Homo sapiens
cacatggtgtctcc

SEQ ID NO: 771236 - DNA, 17 bp, Homo sapiens
cacatggtgtctcccaa

SEQ ID NO: 771237 - DNA, 13 bp, Homo sapiens
cacatgtaaaata

SEQ ID NO: 771238 - DNA, 16 bp, Homo sapiens
cacatgtaaaatatgt

SEQ ID NO: 771239 - DNA, 12 bp, Homo sapiens
cacatgtacata

SEQ ID NO: 771240 - DNA, 20 bp, Homo sapiens
cacatgtcagtaccttcaaa

SEQ ID NO: 771241 - DNA, 18 bp, Homo sapiens
cacatgtcccagatcgtc

SEQ ID NO: 771242 - DNA, 17 bp, Homo sapiens
cacatgtccttgtgtgt

SEQ ID NO: 771243 - DNA, 21 bp, Homo sapiens
cacatgtctgtcctcagagca

SEQ ID NO: 771244 - DNA, 17 bp, Homo sapiens
cacatgtgccacacagt

SEQ ID NO: 771245 - DNA, 19 bp, Homo sapiens
cacatgtgccacacagtga

SEQ ID NO: 771246 - DNA, 14 bp, Homo sapiens
cacatgtgctgatg

SEQ ID NO: 771247 - DNA, 12 bp, Homo sapiens
cacatgtgtggt

SEQ ID NO: 771248 - DNA, 19 bp, Homo sapiens
cacatgttactgcttcatt

SEQ ID NO: 771249 - DNA, 17 bp, Homo sapiens
cacattaagtggctttt

SEQ ID NO: 771250 - DNA, 18 bp, Homo sapiens
cacattaatatttgctga

SEQ ID NO: 771251 - DNA, 23 bp, Homo sapiens
cacattaccattcatagtaagaa

SEQ ID NO: 771252 - DNA, 17 bp, Homo sapiens
cacattagactatccat

SEQ ID NO: 771253 - DNA, 21 bp, Homo sapiens
cacattagattttattttact

SEQ ID NO: 771254 - DNA, 23 bp, Homo sapiens
cacattagattttattttactat

SEQ ID NO: 771255 - DNA, 16 bp, Homo sapiens
cacattatcgggagca

SEQ ID NO: 771256 - DNA, 20 bp, Homo sapiens
cacattatcgggagcagtgt

SEQ ID NO: 771257 - DNA, 15 bp, Homo sapiens
cacattatcttctgg

SEQ ID NO: 771258 - DNA, 18 bp, Homo sapiens
cacattatgttagagagg

SEQ ID NO: 771259 - DNA, 13 bp, Homo sapiens
cacattatttcta

SEQ ID NO: 771260 - DNA, 15 bp, Homo sapiens
cacattatttgcatg

SEQ ID NO: 771261 - DNA, 22 bp, Homo sapiens
cacattcaaaatagggtatatt

SEQ ID NO: 771262 - DNA, 17 bp, Homo sapiens
cacattcaggaagatga

SEQ ID NO: 771263 - DNA, 13 bp, Homo sapiens
cacattccagcca

SEQ ID NO: 771264 - DNA, 22 bp, Homo sapiens
cacattccagccaggcccaggc

SEQ ID NO: 771265 - DNA, 14 bp, Homo sapiens
cacattccagggct

SEQ ID NO: 771266 - DNA, 16 bp, Homo sapiens
cacattccagggctgg

SEQ ID NO: 771267 - DNA, 21 bp, Homo sapiens
cacattcccatggtggcctca

SEQ ID NO: 771268 - DNA, 17 bp, Homo sapiens
cacattcggctccctgg

SEQ ID NO: 771269 - DNA, 20 bp, Homo sapiens
cacattcgggaccaatatat

SEQ ID NO: 771270 - DNA, 22 bp, Homo sapiens
cacattcttaacacatgtcctt

SEQ ID NO: 771271 - DNA, 23 bp, Homo sapiens
cacattgaagaatgttagagtaa

SEQ ID NO: 771272 - DNA, 11 bp, Homo sapiens
cacattgcctt

SEQ ID NO: 771273 - DNA, 12 bp, Homo sapiens
cacattgccttc

SEQ ID NO: 771274 - DNA, 13 bp, Homo sapiens
cacattgccttct

SEQ ID NO: 771275 - DNA, 16 bp, Homo sapiens
cacattgccttctgga

SEQ ID NO: 771276 - DNA, 22 bp, Homo sapiens
cacattggggaaatttttaagt

SEQ ID NO: 771277 - DNA, 18 bp, Homo sapiens
cacattgtgcttggcccc

SEQ ID NO: 771278 - DNA, 17 bp, Homo sapiens
cacattgttgttttttt

SEQ ID NO: 771279 - DNA, 22 bp, Homo sapiens
cacattgttgtttttttaatag

SEQ ID NO: 771280 - DNA, 18 bp, Homo sapiens
cacattgtttgctgctat

SEQ ID NO: 771281 - DNA, 17 bp, Homo sapiens
cacatttaaaacatttg

SEQ ID NO: 771282 - DNA, 20 bp, Homo sapiens
cacatttacactagaggcca

SEQ ID NO: 771283 - DNA, 18 bp, Homo sapiens
cacatttaccctttggcc

SEQ ID NO: 771284 - DNA, 20 bp, Homo sapiens
cacatttatatatatatgta

SEQ ID NO: 771285 - DNA, 12 bp, Homo sapiens
cacatttctgga

SEQ ID NO: 771286 - DNA, 19 bp, Homo sapiens
cacatttgccttcagtctt

SEQ ID NO: 771287 - DNA, 16 bp, Homo sapiens
cacatttggaatactt

SEQ ID NO: 771288 - DNA, 20 bp, Homo sapiens
cacatttgggatgttccttt

SEQ ID NO: 771289 - DNA, 17 bp, Homo sapiens
cacatttgtcagtattt

SEQ ID NO: 771290 - DNA, 13 bp, Homo sapiens
cacattttaagtg

SEQ ID NO: 771291 - DNA, 13 bp, Homo sapiens
cacattttatgag

SEQ ID NO: 771292 - DNA, 15 bp, Homo sapiens
cacattttattttat

SEQ ID NO: 771293 - DNA, 14 bp, Homo sapiens
cacatttttttcta

SEQ ID NO: 771294 - DNA, 12 bp, Homo sapiens
caccaaaataag

SEQ ID NO: 771295 - DNA, 21 bp, Homo sapiens
caccaaactgcacacacagct

SEQ ID NO: 771296 - DNA, 13 bp, Homo sapiens
caccaaagctgcc

SEQ ID NO: 771297 - DNA, 14 bp, Homo sapiens
caccaaagctgccc

SEQ ID NO: 771298 - DNA, 16 bp, Homo sapiens
caccaaaggtcaatgt

SEQ ID NO: 771299 - DNA, 18 bp, Homo sapiens
caccaaatcatcctgaat

SEQ ID NO: 771300 - DNA, 19 bp, Homo sapiens
caccaaatcatcctgaatc

SEQ ID NO: 771301 - DNA, 14 bp, Homo sapiens
caccaacatcccat

SEQ ID NO: 771302 - DNA, 17 bp, Homo sapiens
caccaacatcccattgc

SEQ ID NO: 771303 - DNA, 23 bp, Homo sapiens
caccaacatcccattgccctggt

SEQ ID NO: 771304 - DNA, 22 bp, Homo sapiens
caccaaccacagcatcgggagc

SEQ ID NO: 771305 - DNA, 19 bp, Homo sapiens
caccaacccatcagaagga

SEQ ID NO: 771306 - DNA, 18 bp, Homo sapiens
caccaacctcactgccct

SEQ ID NO: 771307 - DNA, 18 bp, Homo sapiens
caccaactcctaatttta

SEQ ID NO: 771308 - DNA, 16 bp, Homo sapiens
caccaactctgcactc

SEQ ID NO: 771309 - DNA, 20 bp, Homo sapiens
caccagctgctgtgccccac

SEQ ID NO: 771310 - DNA, 16 bp, Homo sapiens
caccagcttaagcgtt

SEQ ID NO: 771311 - DNA, 13 bp, Homo sapiens
caccaggaagccg

SEQ ID NO: 771312 - DNA, 17 bp, Homo sapiens
caccaggaatgttaaag

SEQ ID NO: 771313 - DNA, 23 bp, Homo sapiens
caccaggaatgttaaagtcagtg

SEQ ID NO: 771314 - DNA, 11 bp, Homo sapiens
caccaggactt

SEQ ID NO: 771315 - DNA, 21 bp, Homo sapiens
caccaggacttggggtcagga

SEQ ID NO: 771316 - DNA, 16 bp, Homo sapiens
caccaggagaaccact

SEQ ID NO: 771317 - DNA, 17 bp, Homo sapiens
caccaggagaaccacta

SEQ ID NO: 771318 - DNA, 20 bp, Homo sapiens
caccaggagcacctggaccc

SEQ ID NO: 771319 - DNA, 22 bp, Homo sapiens
caccaggagcacctggaccccc

SEQ ID NO: 771320 - DNA, 18 bp, Homo sapiens
caccaggagcagcagcca

SEQ ID NO: 771321 - DNA, 17 bp, Homo sapiens
caccaggagtccctggt

SEQ ID NO: 771322 - DNA, 22 bp, Homo sapiens
caccaggcacgaacccacctgc

SEQ ID NO: 771323 - DNA, 23 bp, Homo sapiens
caccaggcacgaacccacctgct

SEQ ID NO: 771324 - DNA, 24 bp, Homo sapiens
caccaggcacgaacccacctgctg

SEQ ID NO: 771325 - DNA, 13 bp, Homo sapiens
caccaggccacct

SEQ ID NO: 771326 - DNA, 13 bp, Homo sapiens
caccaggcccacg

SEQ ID NO: 771327 - DNA, 14 bp, Homo sapiens
caccaggcccacga

SEQ ID NO: 771328 - DNA, 18 bp, Homo sapiens
caccaggcccacgaggag

SEQ ID NO: 771329 - DNA, 23 bp, Homo sapiens
caccaggcgctaattcaaggaat

SEQ ID NO: 771330 - DNA, 17 bp, Homo sapiens
caccaggctggcgcagc

SEQ ID NO: 771331 - DNA, 16 bp, Homo sapiens
caccaggctgtgggcc

SEQ ID NO: 771332 - DNA, 14 bp, Homo sapiens
caccagggactgca

SEQ ID NO: 771333 - DNA, 22 bp, Homo sapiens
caccagggagcttcctggctct

SEQ ID NO: 771334 - DNA, 23 bp, Homo sapiens
caccagggcaactcttggaagaa

SEQ ID NO: 771335 - DNA, 22 bp, Homo sapiens
caccagggccagctaatttttg

SEQ ID NO: 771336 - DNA, 18 bp, Homo sapiens
caccagggcgctgggaag

SEQ ID NO: 771337 - DNA, 19 bp, Homo sapiens
caccagggcgctgggaagg

SEQ ID NO: 771338 - DNA, 22 bp, Homo sapiens
caccagggcgctgggaaggggt

SEQ ID NO: 771339 - DNA, 19 bp, Homo sapiens
caccagggtcccaggaagc

SEQ ID NO: 771340 - DNA, 20 bp, Homo sapiens
caccagggtccgcaccagct

SEQ ID NO: 771341 - DNA, 24 bp, Homo sapiens
caccagggtccgcaccagctgctc

SEQ ID NO: 771342 - DNA, 21 bp, Homo sapiens
caccagggtggaccaggcctg

SEQ ID NO: 771343 - DNA, 23 bp, Homo sapiens
caccagggttgaccccagaggat

SEQ ID NO: 771344 - DNA, 16 bp, Homo sapiens
caccaggtgcatctgc

SEQ ID NO: 771345 - DNA, 15 bp, Homo sapiens
caccagtcactgtcc

SEQ ID NO: 771346 - DNA, 16 bp, Homo sapiens
caccagtctgtctact

SEQ ID NO: 771347 - DNA, 14 bp, Homo sapiens
caccagtgcaagca

SEQ ID NO: 771348 - DNA, 14 bp, Homo sapiens
caccagtggccttt

SEQ ID NO: 771349 - DNA, 15 bp, Homo sapiens
caccagtggcctttc

SEQ ID NO: 771350 - DNA, 22 bp, Homo sapiens
caccagtggcctttcagtgtag

SEQ ID NO: 771351 - DNA, 14 bp, Homo sapiens
caccagtgtcccct

SEQ ID NO: 771352 - DNA, 16 bp, Homo sapiens
caccagtgtgtggggg

SEQ ID NO: 771353 - DNA, 18 bp, Homo sapiens
caccagtgtgtgggggag

SEQ ID NO: 771354 - DNA, 15 bp, Homo sapiens
caccagtgttcctga

SEQ ID NO: 771355 - DNA, 17 bp, Homo sapiens
caccagtgttcctgaag

SEQ ID NO: 771356 - DNA, 20 bp, Homo sapiens
caccagttctcatgggtggc

SEQ ID NO: 771357 - DNA, 22 bp, Homo sapiens
caccagttttgagtgtactgtg

SEQ ID NO: 771358 - DNA, 21 bp, Homo sapiens
caccatagagaggcgctagag

SEQ ID NO: 771359 - DNA, 14 bp, Homo sapiens
caccatagtcaatc

SEQ ID NO: 771360 - DNA, 16 bp, Homo sapiens
caccatattcagtgct

SEQ ID NO: 771361 - DNA, 21 bp, Homo sapiens
caccatattcagtgctgtggc

SEQ ID NO: 771362 - DNA, 21 bp, Homo sapiens
caccatattggccagtctggt

SEQ ID NO: 771363 - DNA, 17 bp, Homo sapiens
ctaatgtaggactgtat

SEQ ID NO: 771364 - DNA, 17 bp, Homo sapiens
ctaatgtctcttcctct

SEQ ID NO: 771365 - DNA, 21 bp, Homo sapiens
ctaatgtcttcatttcattgt

SEQ ID NO: 771366 - DNA, 22 bp, Homo sapiens
ctaatgtcttcatttcattgta

SEQ ID NO: 771367 - DNA, 22 bp, Homo sapiens
ctaatgtgagtgtgaagctttg

SEQ ID NO: 771368 - DNA, 13 bp, Homo sapiens
ctaatgtgatcat

SEQ ID NO: 771369 - DNA, 17 bp, Homo sapiens
ctaatgtgatcatatga

SEQ ID NO: 771370 - DNA, 16 bp, Homo sapiens
ctaatgtgttatgaga

SEQ ID NO: 771371 - DNA, 17 bp, Homo sapiens
ctaatgtttatgagcca

SEQ ID NO: 771372 - DNA, 13 bp, Homo sapiens
ctaatgttttgct

SEQ ID NO: 771373 - DNA, 15 bp, Homo sapiens
ctaattaaataatac

SEQ ID NO: 771374 - DNA, 13 bp, Homo sapiens
ctaattaatatat

SEQ ID NO: 771375 - DNA, 15 bp, Homo sapiens
ctaattaatatatta

SEQ ID NO: 771376 - DNA, 23 bp, Homo sapiens
ctaattaatatattaaaattcca

SEQ ID NO: 771377 - DNA, 16 bp, Homo sapiens
ctaattaatctggaat

SEQ ID NO: 771378 - DNA, 14 bp, Homo sapiens
ctaattagaaatca

SEQ ID NO: 771379 - DNA, 16 bp, Homo sapiens
ctaattagaaatcaac

SEQ ID NO: 771380 - DNA, 18 bp, Homo sapiens
ctaattagagaactggag

SEQ ID NO: 771381 - DNA, 22 bp, Homo sapiens
ctaattataccccctgcaaagc

SEQ ID NO: 771382 - DNA, 18 bp, Homo sapiens
ctaattatcaatattgag

SEQ ID NO: 771383 - DNA, 21 bp, Homo sapiens
ctaattatcaatattgaggat

SEQ ID NO: 771384 - DNA, 13 bp, Homo sapiens
ctaattatttaaa

SEQ ID NO: 771385 - DNA, 14 bp, Homo sapiens
ctaattatttaatt

SEQ ID NO: 771386 - DNA, 18 bp, Homo sapiens
ctaattcaaggaatttct

SEQ ID NO: 771387 - DNA, 15 bp, Homo sapiens
ctaattcaattcaaa

SEQ ID NO: 771388 - DNA, 21 bp, Homo sapiens
ctaattcacacaaagactcct

SEQ ID NO: 771389 - DNA, 16 bp, Homo sapiens
ctaattcagacagaga

SEQ ID NO: 771390 - DNA, 14 bp, Homo sapiens
ctaattccacagct

SEQ ID NO: 771391 - DNA, 16 bp, Homo sapiens
ctaattccacagctgc

SEQ ID NO: 771392 - DNA, 19 bp, Homo sapiens
ctaattccacaggtcatca

SEQ ID NO: 771393 - DNA, 14 bp, Homo sapiens
ctaattctaatgtg

SEQ ID NO: 771394 - DNA, 15 bp, Homo sapiens
ctaattctatgcctg

SEQ ID NO: 771395 - DNA, 15 bp, Homo sapiens
ctaattctatttctc

SEQ ID NO: 771396 - DNA, 18 bp, Homo sapiens
ctaattctatttctctat

SEQ ID NO: 771397 - DNA, 19 bp, Homo sapiens
ctaattctgggaagggaga

SEQ ID NO: 771398 - DNA, 16 bp, Homo sapiens
ctaattcttctgtcct

SEQ ID NO: 771399 - DNA, 17 bp, Homo sapiens
ctaattgggagtccagg

SEQ ID NO: 771400 - DNA, 16 bp, Homo sapiens
ctaattgtaagtgaaa

SEQ ID NO: 771401 - DNA, 18 bp, Homo sapiens
ctaattgtactaatctga

SEQ ID NO: 771402 - DNA, 20 bp, Homo sapiens
ctaattgtactaatctgaga

SEQ ID NO: 771403 - DNA, 15 bp, Homo sapiens
ctaatttaaagagac

SEQ ID NO: 771404 - DNA, 17 bp, Homo sapiens
ctaatttataaaaaggt

SEQ ID NO: 771405 - DNA, 22 bp, Homo sapiens
ctaatttatagcaagatattga

SEQ ID NO: 771406 - DNA, 22 bp, Homo sapiens
ctaatttattaatctaaaaaag

SEQ ID NO: 771407 - DNA, 19 bp, Homo sapiens
ctaatttcaaaaatataac

SEQ ID NO: 771408 - DNA, 21 bp, Homo sapiens
ctaatttcaaaaatataactt

SEQ ID NO: 771409 - DNA, 17 bp, Homo sapiens
ctaatttcaaaatgctt

SEQ ID NO: 771410 - DNA, 18 bp, Homo sapiens
ctaatttcaaaatgcttt

SEQ ID NO: 771411 - DNA, 22 bp, Homo sapiens
ctaatttcaaaatgctttttat

SEQ ID NO: 771412 - DNA, 11 bp, Homo sapiens
ctaatttcata

SEQ ID NO: 771413 - DNA, 18 bp, Homo sapiens
ctaatttctcctcccttc

SEQ ID NO: 771414 - DNA, 19 bp, Homo sapiens
ctaatttctcctcccttcc

SEQ ID NO: 771415 - DNA, 16 bp, Homo sapiens
ctaatttgatgtttac

SEQ ID NO: 771416 - DNA, 12 bp, Homo sapiens
ctaatttgcatt

SEQ ID NO: 771417 - DNA, 19 bp, Homo sapiens
ctaatttgcattaaattca

SEQ ID NO: 771418 - DNA, 21 bp, Homo sapiens
ctaatttgcattaaattcaca

SEQ ID NO: 771419 - DNA, 15 bp, Homo sapiens
ctaattttacactct

SEQ ID NO: 771420 - DNA, 14 bp, Homo sapiens
ctaattttctttcc

SEQ ID NO: 771421 - DNA, 14 bp, Homo sapiens
ctaattttgtacat

SEQ ID NO: 771422 - DNA, 16 bp, Homo sapiens
ctaattttgtacatac

SEQ ID NO: 771423 - DNA, 12 bp, Homo sapiens
ctaatttttaag

SEQ ID NO: 771424 - DNA, 17 bp, Homo sapiens
ctaatttttattaattt

SEQ ID NO: 771425 - DNA, 22 bp, Homo sapiens
ctaatttttattaattttagtt

SEQ ID NO: 771426 - DNA, 18 bp, Homo sapiens
ctaatttttgcttaacat

SEQ ID NO: 771427 - DNA, 22 bp, Homo sapiens
ctaatttttgcttaacattaga

SEQ ID NO: 771428 - DNA, 14 bp, Homo sapiens
ctaattttttgttg

SEQ ID NO: 771429 - DNA, 16 bp, Homo sapiens
ctaattttttgttgtt

SEQ ID NO: 771430 - DNA, 19 bp, Homo sapiens
ctacattggaagcctgagc

SEQ ID NO: 771431 - DNA, 18 bp, Homo sapiens
ctacatttctactatgat

SEQ ID NO: 771432 - DNA, 16 bp, Homo sapiens
ctaccaaaaattgcca

SEQ ID NO: 771433 - DNA, 14 bp, Homo sapiens
ctaccaaagcacct

SEQ ID NO: 771434 - DNA, 15 bp, Homo sapiens
ctaccaaagcacctt

SEQ ID NO: 771435 - DNA, 14 bp, Homo sapiens
ctaccaatgcatgc

SEQ ID NO: 771436 - DNA, 15 bp, Homo sapiens
ctaccaatgcatgca

SEQ ID NO: 771437 - DNA, 13 bp, Homo sapiens
ctaccacaaggaa

SEQ ID NO: 771438 - DNA, 15 bp, Homo sapiens
ctaccacaaggaaaa

SEQ ID NO: 771439 - DNA, 14 bp, Homo sapiens
ctaccacagtgtct

SEQ ID NO: 771440 - DNA, 15 bp, Homo sapiens
ctaccacagtgtctg

SEQ ID NO: 771441 - DNA, 18 bp, Homo sapiens
ctaccaccccttcctgtc

SEQ ID NO: 771442 - DNA, 22 bp, Homo sapiens
ctaccaccccttcctgtcccac

SEQ ID NO: 771443 - DNA, 20 bp, Homo sapiens
ctaccactggtacttccttt

SEQ ID NO: 771444 - DNA, 22 bp, Homo sapiens
ctaccactgtggccccaagagg

SEQ ID NO: 771445 - DNA, 23 bp, Homo sapiens
ctaccactgtggccccaagaggg

SEQ ID NO: 771446 - DNA, 16 bp, Homo sapiens
ctaccagaagggcttc

SEQ ID NO: 771447 - DNA, 11 bp, Homo sapiens
ctaccagccag

SEQ ID NO: 771448 - DNA, 20 bp, Homo sapiens
ctaccagccagcctcagaag

SEQ ID NO: 771449 - DNA, 20 bp, Homo sapiens
ctaccagcgccaaatgttca

SEQ ID NO: 771450 - DNA, 22 bp, Homo sapiens
ctaccagcgccaaatgttcatc

SEQ ID NO: 771451 - DNA, 17 bp, Homo sapiens
ctaccagcgcccgctgg

SEQ ID NO: 771452 - DNA, 21 bp, Homo sapiens
ctaccagcgcccgctgggctg

SEQ ID NO: 771453 - DNA, 12 bp, Homo sapiens
ctaccagctcct

SEQ ID NO: 771454 - DNA, 14 bp, Homo sapiens
ctaccagctcctcc

SEQ ID NO: 771455 - DNA, 17 bp, Homo sapiens
ctaccagctcctccagc

SEQ ID NO: 771456 - DNA, 23 bp, Homo sapiens
ctaccagctcctccagccctgcc

SEQ ID NO: 771457 - DNA, 17 bp, Homo sapiens
ctaccaggacagaactt

SEQ ID NO: 771458 - DNA, 12 bp, Homo sapiens
ctaccaggactc

SEQ ID NO: 771459 - DNA, 13 bp, Homo sapiens
ctaccagtattta

SEQ ID NO: 771460 - DNA, 19 bp, Homo sapiens
ctaccagtatttagaagcc

SEQ ID NO: 771461 - DNA, 20 bp, Homo sapiens
ctaccagtatttagaagcca

SEQ ID NO: 771462 - DNA, 16 bp, Homo sapiens
ctaccagtctatttcc

SEQ ID NO: 771463 - DNA, 18 bp, Homo sapiens
ctaccatcagggacagga

SEQ ID NO: 771464 - DNA, 16 bp, Homo sapiens
ctaccatcatccggtt

SEQ ID NO: 771465 - DNA, 21 bp, Homo sapiens
ctaccatgtgaaactctaccc

SEQ ID NO: 771466 - DNA, 13 bp, Homo sapiens
ctaccatttcaga

SEQ ID NO: 771467 - DNA, 19 bp, Homo sapiens
ctaccattttacatttcta

SEQ ID NO: 771468 - DNA, 14 bp, Homo sapiens
ctacccaatgtctc

SEQ ID NO: 771469 - DNA, 17 bp, Homo sapiens
ctacccaatgtctccca

SEQ ID NO: 771470 - DNA, 19 bp, Homo sapiens
ctacccacctttcccagaa

SEQ ID NO: 771471 - DNA, 23 bp, Homo sapiens
ctacccacgttctcacacccacc

SEQ ID NO: 771472 - DNA, 22 bp, Homo sapiens
ctacccacttctaaatagcaat

SEQ ID NO: 771473 - DNA, 19 bp, Homo sapiens
ctacccagcgtggcccagg

SEQ ID NO: 771474 - DNA, 21 bp, Homo sapiens
ctacccagcgtggcccaggcc

SEQ ID NO: 771475 - DNA, 19 bp, Homo sapiens
ctacccaggaggctgaggt

SEQ ID NO: 771476 - DNA, 19 bp, Homo sapiens
ctacccatatccctcccgt

SEQ ID NO: 771477 - DNA, 13 bp, Homo sapiens
ctacccatccccg

SEQ ID NO: 771478 - DNA, 18 bp, Homo sapiens
ctacccatgagcctgccc

SEQ ID NO: 771479 - DNA, 18 bp, Homo sapiens
ctaccccacaacacgcct

SEQ ID NO: 771480 - DNA, 13 bp, Homo sapiens
ctaccccagtccc

SEQ ID NO: 771481 - DNA, 18 bp, Homo sapiens
ctaccccatgctgtactt

SEQ ID NO: 771482 - DNA, 19 bp, Homo sapiens
ctaccccatggtgctagga

SEQ ID NO: 771483 - DNA, 17 bp, Homo sapiens
ctaccccctcctctctg

SEQ ID NO: 771484 - DNA, 15 bp, Homo sapiens
ctaccccgcagacac

SEQ ID NO: 771485 - DNA, 22 bp, Homo sapiens
ctacccctcaaactgcacatct

SEQ ID NO: 771486 - DNA, 23 bp, Homo sapiens
ctacccctcgactcagcaccaca

SEQ ID NO: 771487 - DNA, 13 bp, Homo sapiens
ctacccctcttcc

SEQ ID NO: 771488 - DNA, 17 bp, Homo sapiens
ctacccctcttccagct

SEQ ID NO: 771489 - DNA, 13 bp, Homo sapiens
ctaccccttcctg

SEQ ID NO: 771490 - DNA, 14 bp, Homo sapiens
ctaccccttcctgt

SEQ ID NO: 771491 - DNA, 19 bp, Homo sapiens
ctaccccttcctgtcctgc

SEQ ID NO: 771492 - DNA, 20 bp, Homo sapiens
ctaccccttcctgtcctgcc

SEQ ID NO: 771493 - DNA, 21 bp, Homo sapiens
caccccagaaatcactgtgaa

SEQ ID NO: 771494 - DNA, 22 bp, Homo sapiens
caccccagaaatcactgtgaaa

SEQ ID NO: 771495 - DNA, 17 bp, Homo sapiens
caccccagacctgcgaa

SEQ ID NO: 771496 - DNA, 19 bp, Homo sapiens
caccccagacctgcgaagg

SEQ ID NO: 771497 - DNA, 20 bp, Homo sapiens
caccccagaggacacaggca

SEQ ID NO: 771498 - DNA, 17 bp, Homo sapiens
caccccagaggccttgt

SEQ ID NO: 771499 - DNA, 16 bp, Homo sapiens
caccccagcacagcca

SEQ ID NO: 771500 - DNA, 19 bp, Homo sapiens
caccccagcacagccacct

SEQ ID NO: 771501 - DNA, 16 bp, Homo sapiens
caccccagcattccag

SEQ ID NO: 771502 - DNA, 23 bp, Homo sapiens
caccccagcattccagctctgcc

SEQ ID NO: 771503 - DNA, 14 bp, Homo sapiens
caccccagcccacc

SEQ ID NO: 771504 - DNA, 19 bp, Homo sapiens
caccccagcctaagatgaa

SEQ ID NO: 771505 - DNA, 23 bp, Homo sapiens
caccccataataaccctgccagt

SEQ ID NO: 771506 - DNA, 15 bp, Homo sapiens
caccccatcccacac

SEQ ID NO: 771507 - DNA, 14 bp, Homo sapiens
caccccatcccacc

SEQ ID NO: 771508 - DNA, 18 bp, Homo sapiens
cacccccaacccccagag

SEQ ID NO: 771509 - DNA, 14 bp, Homo sapiens
cacccccaacttca

SEQ ID NO: 771510 - DNA, 14 bp, Homo sapiens
cacccccaagcctg

SEQ ID NO: 771511 - DNA, 12 bp, Homo sapiens
cacccccaaggt

SEQ ID NO: 771512 - DNA, 17 bp, Homo sapiens
cacccccacccccagct

SEQ ID NO: 771513 - DNA, 17 bp, Homo sapiens
cacccccacccccagtg

SEQ ID NO: 771514 - DNA, 12 bp, Homo sapiens
cacccccactgg

SEQ ID NO: 771515 - DNA, 16 bp, Homo sapiens
cacccccactggtgag

SEQ ID NO: 771516 - DNA, 9 bp, Homo sapiens
cacccccag

SEQ ID NO: 771517 - DNA, 16 bp, Homo sapiens
cacccccagccaggct

SEQ ID NO: 771518 - DNA, 12 bp, Homo sapiens
cacccccagccc

SEQ ID NO: 771519 - DNA, 19 bp, Homo sapiens
cacccccagccccgactcc

SEQ ID NO: 771520 - DNA, 12 bp, Homo sapiens
cacccccagctt

SEQ ID NO: 771521 - DNA, 23 bp, Homo sapiens
cacccccaggcaaggctgacttc

SEQ ID NO: 771522 - DNA, 15 bp, Homo sapiens
cacccccaggcatct

SEQ ID NO: 771523 - DNA, 17 bp, Homo sapiens
cacccccaggtcttcct

SEQ ID NO: 771524 - DNA, 20 bp, Homo sapiens
cacccccaggtcttcctgct

SEQ ID NO: 771525 - DNA, 18 bp, Homo sapiens
cacccccagtctccaggg

SEQ ID NO: 771526 - DNA, 13 bp, Homo sapiens
cacccccatccct

SEQ ID NO: 771527 - DNA, 16 bp, Homo sapiens
cacccccatgctgcct

SEQ ID NO: 771528 - DNA, 20 bp, Homo sapiens
cacccccatgctgccttcag

SEQ ID NO: 771529 - DNA, 14 bp, Homo sapiens
caccccccagcctc

SEQ ID NO: 771530 - DNA, 19 bp, Homo sapiens
cacccccctcctccccctt

SEQ ID NO: 771531 - DNA, 16 bp, Homo sapiens
cacccccctctctttc

SEQ ID NO: 771532 - DNA, 21 bp, Homo sapiens
cacccccctctctttctctgg

SEQ ID NO: 771533 - DNA, 17 bp, Homo sapiens
cacccccgccacggcca

SEQ ID NO: 771534 - DNA, 11 bp, Homo sapiens
caccccctccc

SEQ ID NO: 771535 - DNA, 14 bp, Homo sapiens
caccccctcccacc

SEQ ID NO: 771536 - DNA, 17 bp, Homo sapiens
caccccctccccagggg

SEQ ID NO: 771537 - DNA, 16 bp, Homo sapiens
caccccctccctggcc

SEQ ID NO: 771538 - DNA, 23 bp, Homo sapiens
caccccctccctggcctgttctg

SEQ ID NO: 771539 - DNA, 14 bp, Homo sapiens
caccccctcctggc

SEQ ID NO: 771540 - DNA, 13 bp, Homo sapiens
caccccctgccct

SEQ ID NO: 771541 - DNA, 13 bp, Homo sapiens
caccccctgctcc

SEQ ID NO: 771542 - DNA, 18 bp, Homo sapiens
caccccctgctccaccag

SEQ ID NO: 771543 - DNA, 22 bp, Homo sapiens
caccccctgctccaccagcagc

SEQ ID NO: 771544 - DNA, 15 bp, Homo sapiens
caccccctgggcaga

SEQ ID NO: 771545 - DNA, 17 bp, Homo sapiens
caccccctgggcagatg

SEQ ID NO: 771546 - DNA, 23 bp, Homo sapiens
caccccctgtcccattctagatc

SEQ ID NO: 771547 - DNA, 20 bp, Homo sapiens
cacccccttcagtgcccacc

SEQ ID NO: 771548 - DNA, 12 bp, Homo sapiens
cacccccttccc

SEQ ID NO: 771549 - DNA, 18 bp, Homo sapiens
cacccccttctccatcca

SEQ ID NO: 771550 - DNA, 18 bp, Homo sapiens
cacccccttctctgctcc

SEQ ID NO: 771551 - DNA, 12 bp, Homo sapiens
caccccctttcc

SEQ ID NO: 771552 - DNA, 22 bp, Homo sapiens
ctacgctgaagatggcatcctg

SEQ ID NO: 771553 - DNA, 18 bp, Homo sapiens
ctacggggaaaatgcatt

SEQ ID NO: 771554 - DNA, 20 bp, Homo sapiens
ctacgtcatgtattttatga

SEQ ID NO: 771555 - DNA, 13 bp, Homo sapiens
ctacgtccaaggt

SEQ ID NO: 771556 - DNA, 21 bp, Homo sapiens
ctacgtgaattagctttttct

SEQ ID NO: 771557 - DNA, 13 bp, Homo sapiens
ctacgtgcctccc

SEQ ID NO: 771558 - DNA, 19 bp, Homo sapiens
ctacgttcctattgtcatt

SEQ ID NO: 771559 - DNA, 19 bp, Homo sapiens
ctacgtttgcaccgcctgc

SEQ ID NO: 771560 - DNA, 22 bp, Homo sapiens
ctacgtttgcaccgcctgccct

SEQ ID NO: 771561 - DNA, 18 bp, Homo sapiens
ctactaaagtgcctaccc

SEQ ID NO: 771562 - DNA, 23 bp, Homo sapiens
ctactaacaatcagctccttcct

SEQ ID NO: 771563 - DNA, 15 bp, Homo sapiens
ctactaacttttcaa

SEQ ID NO: 771564 - DNA, 17 bp, Homo sapiens
ctactaccacaaggaaa

SEQ ID NO: 771565 - DNA, 14 bp, Homo sapiens
ctactactctgcca

SEQ ID NO: 771566 - DNA, 15 bp, Homo sapiens
ctactagatgtcttt

SEQ ID NO: 771567 - DNA, 17 bp, Homo sapiens
ctactataaagagaaga

SEQ ID NO: 771568 - DNA, 19 bp, Homo sapiens
ctactatatacatatatat

SEQ ID NO: 771569 - DNA, 20 bp, Homo sapiens
ctactcaagcgggtggctct

SEQ ID NO: 771570 - DNA, 17 bp, Homo sapiens
ctactcacagtctcttt

SEQ ID NO: 771571 - DNA, 17 bp, Homo sapiens
ctactcagaagcctgag

SEQ ID NO: 771572 - DNA, 21 bp, Homo sapiens
ctactcagaagcctgaggctg

SEQ ID NO: 771573 - DNA, 15 bp, Homo sapiens
ctactcagcagccct

SEQ ID NO: 771574 - DNA, 16 bp, Homo sapiens
ctactcagcagccctc

SEQ ID NO: 771575 - DNA, 19 bp, Homo sapiens
ctactcagcagccctcctc

SEQ ID NO: 771576 - DNA, 21 bp, Homo sapiens
ctactcatacttaagcaaaag

SEQ ID NO: 771577 - DNA, 13 bp, Homo sapiens
ctactcccctggg

SEQ ID NO: 771578 - DNA, 13 bp, Homo sapiens
ctactccctgcag

SEQ ID NO: 771579 - DNA, 17 bp, Homo sapiens
ctactccctgcagatgc

SEQ ID NO: 771580 - DNA, 22 bp, Homo sapiens
ctactccctgcagatgccaccc

SEQ ID NO: 771581 - DNA, 15 bp, Homo sapiens
ctactccgttcctgg

SEQ ID NO: 771582 - DNA, 21 bp, Homo sapiens
ctactcctacctcagcctaga

SEQ ID NO: 771583 - DNA, 14 bp, Homo sapiens
ctactcctagaaga

SEQ ID NO: 771584 - DNA, 21 bp, Homo sapiens
ctactcctctgcagtgccttg

SEQ ID NO: 771585 - DNA, 19 bp, Homo sapiens
ctactcctgcggctgcctg

SEQ ID NO: 771586 - DNA, 18 bp, Homo sapiens
ctactcctgtaattccta

SEQ ID NO: 771587 - DNA, 11 bp, Homo sapiens
ctactcctttg

SEQ ID NO: 771588 - DNA, 18 bp, Homo sapiens
ctactctaaagaaaaatg

SEQ ID NO: 771589 - DNA, 21 bp, Homo sapiens
ctactctcacactggttctca

SEQ ID NO: 771590 - DNA, 23 bp, Homo sapiens
ctactctccccacgagggctggc

SEQ ID NO: 771591 - DNA, 15 bp, Homo sapiens
ctactctcttgccag

SEQ ID NO: 771592 - DNA, 14 bp, Homo sapiens
ctactctgccaatc

SEQ ID NO: 771593 - DNA, 15 bp, Homo sapiens
ctactctgtccaggc

SEQ ID NO: 771594 - DNA, 18 bp, Homo sapiens
ctactctgtccaggccac

SEQ ID NO: 771595 - DNA, 20 bp, Homo sapiens
ctactctgtccaggccactg

SEQ ID NO: 771596 - DNA, 12 bp, Homo sapiens
ctactctgtgta

SEQ ID NO: 771597 - DNA, 19 bp, Homo sapiens
ctactctgttccttcacat

SEQ ID NO: 771598 - DNA, 11 bp, Homo sapiens
ctactcttcct

SEQ ID NO: 771599 - DNA, 23 bp, Homo sapiens
ctactcttgggtgaaggtgcatc

SEQ ID NO: 771600 - DNA, 14 bp, Homo sapiens
ctactcttgtcatt

SEQ ID NO: 771601 - DNA, 12 bp, Homo sapiens
ctactgaaacag

SEQ ID NO: 771602 - DNA, 20 bp, Homo sapiens
ctactgaaacagatttcata

SEQ ID NO: 771603 - DNA, 18 bp, Homo sapiens
ctactgaacacatgtgta

SEQ ID NO: 771604 - DNA, 20 bp, Homo sapiens
ctactgaacacatgtgtatg

SEQ ID NO: 771605 - DNA, 18 bp, Homo sapiens
ctactgaaccctgcctct

SEQ ID NO: 771606 - DNA, 19 bp, Homo sapiens
ctactgaaccctgcctctt

SEQ ID NO: 771607 - DNA, 15 bp, Homo sapiens
ctactgaatgtcatt

SEQ ID NO: 771608 - DNA, 18 bp, Homo sapiens
ctactgacaacattataa

SEQ ID NO: 771609 - DNA, 14 bp, Homo sapiens
ctactgacagggag

SEQ ID NO: 771610 - DNA, 22 bp, Homo sapiens
ctactgacggagtcctgtgttt

SEQ ID NO: 771611 - DNA, 17 bp, Homo sapiens
ctactgagtaaacccta

SEQ ID NO: 771612 - DNA, 23 bp, Homo sapiens
ctactgatgaaatctgctagaaa

SEQ ID NO: 771613 - DNA, 20 bp, Homo sapiens
ctactgattttaaaatgaat

SEQ ID NO: 771614 - DNA, 19 bp, Homo sapiens
ctactgcactccagcctgg

SEQ ID NO: 771615 - DNA, 20 bp, Homo sapiens
ctactgcactccagcctggg

SEQ ID NO: 771616 - DNA, 14 bp, Homo sapiens
ctactgcactgagt

SEQ ID NO: 771617 - DNA, 21 bp, Homo sapiens
ctactgcagcacctccaggcc

SEQ ID NO: 771618 - DNA, 17 bp, Homo sapiens
ctactgcagctttacat

SEQ ID NO: 771619 - DNA, 15 bp, Homo sapiens
ctactgccactgtgt

SEQ ID NO: 771620 - DNA, 16 bp, Homo sapiens
ctactgccactgtgtg

SEQ ID NO: 771621 - DNA, 21 bp, Homo sapiens
caccctatccctgtacagagt

SEQ ID NO: 771622 - DNA, 16 bp, Homo sapiens
caccctcaaatgtcag

SEQ ID NO: 771623 - DNA, 20 bp, Homo sapiens
caccctcaaatgtcagagct

SEQ ID NO: 771624 - DNA, 21 bp, Homo sapiens
caccctcaaatgtcagagcta

SEQ ID NO: 771625 - DNA, 17 bp, Homo sapiens
caccctcacacacacag

SEQ ID NO: 771626 - DNA, 15 bp, Homo sapiens
caccctcacccactc

SEQ ID NO: 771627 - DNA, 22 bp, Homo sapiens
caccctcagcaccccttccatg

SEQ ID NO: 771628 - DNA, 14 bp, Homo sapiens
caccctcaggcagg

SEQ ID NO: 771629 - DNA, 14 bp, Homo sapiens
caccctcaggtgcc

SEQ ID NO: 771630 - DNA, 14 bp, Homo sapiens
caccctcatgaaaa

SEQ ID NO: 771631 - DNA, 20 bp, Homo sapiens
caccctccacaaagcaaagg

SEQ ID NO: 771632 - DNA, 11 bp, Homo sapiens
caccctccacc

SEQ ID NO: 771633 - DNA, 14 bp, Homo sapiens
caccctccaccctg

SEQ ID NO: 771634 - DNA, 16 bp, Homo sapiens
caccctccaccctgtc

SEQ ID NO: 771635 - DNA, 18 bp, Homo sapiens
caccctccaccctgtccc

SEQ ID NO: 771636 - DNA, 17 bp, Homo sapiens
caccctccacctctcac

SEQ ID NO: 771637 - DNA, 17 bp, Homo sapiens
caccctccacctcttca

SEQ ID NO: 771638 - DNA, 14 bp, Homo sapiens
caccctccacttcc

SEQ ID NO: 771639 - DNA, 16 bp, Homo sapiens
caccctccagagacaa

SEQ ID NO: 771640 - DNA, 14 bp, Homo sapiens
caccctccatgctc

SEQ ID NO: 771641 - DNA, 20 bp, Homo sapiens
caccctcccccgccactcct

SEQ ID NO: 771642 - DNA, 16 bp, Homo sapiens
caccctcccctctctt

SEQ ID NO: 771643 - DNA, 22 bp, Homo sapiens
caccctccctccgatccttcct

SEQ ID NO: 771644 - DNA, 13 bp, Homo sapiens
caccctcctactg

SEQ ID NO: 771645 - DNA, 15 bp, Homo sapiens
caccctcctcacaga

SEQ ID NO: 771646 - DNA, 18 bp, Homo sapiens
caccctcctccctccaag

SEQ ID NO: 771647 - DNA, 20 bp, Homo sapiens
caccctcctccctccaagcc

SEQ ID NO: 771648 - DNA, 22 bp, Homo sapiens
caccctcctccctccaagcctg

SEQ ID NO: 771649 - DNA, 16 bp, Homo sapiens
caccctcctctagcca

SEQ ID NO: 771650 - DNA, 15 bp, Homo sapiens
caccctcctcttgga

SEQ ID NO: 771651 - DNA, 18 bp, Homo sapiens
caccctcctcttggaatt

SEQ ID NO: 771652 - DNA, 15 bp, Homo sapiens
caccctccttcccgc

SEQ ID NO: 771653 - DNA, 15 bp, Homo sapiens
caccctctgcccagg

SEQ ID NO: 771654 - DNA, 16 bp, Homo sapiens
caccctctgcccaggg

SEQ ID NO: 771655 - DNA, 13 bp, Homo sapiens
caccctctgtccc

SEQ ID NO: 771656 - DNA, 18 bp, Homo sapiens
caccctctgtccccacga

SEQ ID NO: 771657 - DNA, 19 bp, Homo sapiens
caccctctgtccccacgag

SEQ ID NO: 771658 - DNA, 17 bp, Homo sapiens
caccctgaaagccctga

SEQ ID NO: 771659 - DNA, 12 bp, Homo sapiens
caccctgagccg

SEQ ID NO: 771660 - DNA, 14 bp, Homo sapiens
caccctgagccggc

SEQ ID NO: 771661 - DNA, 17 bp, Homo sapiens
caccctgaggtcaggga

SEQ ID NO: 771662 - DNA, 16 bp, Homo sapiens
caccctgcacctgctg

SEQ ID NO: 771663 - DNA, 19 bp, Homo sapiens
caccctgcagagctatggt

SEQ ID NO: 771664 - DNA, 20 bp, Homo sapiens
caccctgccctcatgggacc

SEQ ID NO: 771665 - DNA, 16 bp, Homo sapiens
caccctgcgcctccag

SEQ ID NO: 771666 - DNA, 17 bp, Homo sapiens
caccctgcgcctccaga

SEQ ID NO: 771667 - DNA, 18 bp, Homo sapiens
caccctgcgcctccagag

SEQ ID NO: 771668 - DNA, 15 bp, Homo sapiens
caccctgcttctccc

SEQ ID NO: 771669 - DNA, 16 bp, Homo sapiens
caccctgcttctcccg

SEQ ID NO: 771670 - DNA, 17 bp, Homo sapiens
caccctggaaaggggag

SEQ ID NO: 771671 - DNA, 23 bp, Homo sapiens
caccctggcctagaccagcagac

SEQ ID NO: 771672 - DNA, 12 bp, Homo sapiens
caccctggcctg

SEQ ID NO: 771673 - DNA, 13 bp, Homo sapiens
caccctggcctga

SEQ ID NO: 771674 - DNA, 18 bp, Homo sapiens
ctagaaaaataaaatgtt

SEQ ID NO: 771675 - DNA, 20 bp, Homo sapiens
ctagaaaaataaaatgtttc

SEQ ID NO: 771676 - DNA, 24 bp, Homo sapiens
ctagaaaacctctcgcttcctcag

SEQ ID NO: 771677 - DNA, 19 bp, Homo sapiens
ctagaaaatttagcccttt

SEQ ID NO: 771678 - DNA, 21 bp, Homo sapiens
ctagaaaatttagccctttaa

SEQ ID NO: 771679 - DNA, 18 bp, Homo sapiens
ctagaaacccaagctcct

SEQ ID NO: 771680 - DNA, 20 bp, Homo sapiens
ctagaaactctggctcagcc

SEQ ID NO: 771681 - DNA, 22 bp, Homo sapiens
ctagaaagaaaagaccctgaga

SEQ ID NO: 771682 - DNA, 15 bp, Homo sapiens
ctagaaagccatatt

SEQ ID NO: 771683 - DNA, 15 bp, Homo sapiens
ctagaaatatgattt

SEQ ID NO: 771684 - DNA, 16 bp, Homo sapiens
ctagaaattgacacaa

SEQ ID NO: 771685 - DNA, 20 bp, Homo sapiens
ctagaaattgacacaagtgg

SEQ ID NO: 771686 - DNA, 13 bp, Homo sapiens
ctagaaattttca

SEQ ID NO: 771687 - DNA, 23 bp, Homo sapiens
ctagaaatttttcagatgcttct

SEQ ID NO: 771688 - DNA, 23 bp, Homo sapiens
ctagaacgtgcatccttgtaata

SEQ ID NO: 771689 - DNA, 17 bp, Homo sapiens
ctagaactatcattttt

SEQ ID NO: 771690 - DNA, 18 bp, Homo sapiens
ctagaagaaaacccgagg

SEQ ID NO: 771691 - DNA, 20 bp, Homo sapiens
ctagaagaaccaaatacctc

SEQ ID NO: 771692 - DNA, 15 bp, Homo sapiens
ctagaagagcacaga

SEQ ID NO: 771693 - DNA, 21 bp, Homo sapiens
ctagaagagcacagagccctg

SEQ ID NO: 771694 - DNA, 17 bp, Homo sapiens
ctagaagagtctattgt

SEQ ID NO: 771695 - DNA, 15 bp, Homo sapiens
ctagaagatgtgtaa

SEQ ID NO: 771696 - DNA, 22 bp, Homo sapiens
ctagaagattttgaaattttta

SEQ ID NO: 771697 - DNA, 12 bp, Homo sapiens
ctagaagccaag

SEQ ID NO: 771698 - DNA, 16 bp, Homo sapiens
ctagaagccaagggaa

SEQ ID NO: 771699 - DNA, 21 bp, Homo sapiens
ctagaagccaagggaaagggg

SEQ ID NO: 771700 - DNA, 16 bp, Homo sapiens
ctagaagcccctgtcg

SEQ ID NO: 771701 - DNA, 19 bp, Homo sapiens
ctagaaggccacatgtcac

SEQ ID NO: 771702 - DNA, 20 bp, Homo sapiens
ctagaagggccagtcctgcc

SEQ ID NO: 771703 - DNA, 23 bp, Homo sapiens
ctagaagggccagtcctgcctgg

SEQ ID NO: 771704 - DNA, 17 bp, Homo sapiens
ctagaagtgggccagga

SEQ ID NO: 771705 - DNA, 21 bp, Homo sapiens
ctagaataatctcatcccccc

SEQ ID NO: 771706 - DNA, 12 bp, Homo sapiens
ctagaatacttt

SEQ ID NO: 771707 - DNA, 14 bp, Homo sapiens
ctagaatgtcagat

SEQ ID NO: 771708 - DNA, 17 bp, Homo sapiens
ctagaatgtcagatttc

SEQ ID NO: 771709 - DNA, 19 bp, Homo sapiens
ctagaatgtcagatttctg

SEQ ID NO: 771710 - DNA, 21 bp, Homo sapiens
ctagaatgtctgaagtacaaa

SEQ ID NO: 771711 - DNA, 15 bp, Homo sapiens
ctagaattctagtgc

SEQ ID NO: 771712 - DNA, 16 bp, Homo sapiens
ctagaattctagtgct

SEQ ID NO: 771713 - DNA, 19 bp, Homo sapiens
ctagaattctagtgctgct

SEQ ID NO: 771714 - DNA, 16 bp, Homo sapiens
ctagaattgagtgttt

SEQ ID NO: 771715 - DNA, 21 bp, Homo sapiens
ctagaatttatcacacttctg

SEQ ID NO: 771716 - DNA, 22 bp, Homo sapiens
ctagaatttattcaattcctct

SEQ ID NO: 771717 - DNA, 14 bp, Homo sapiens
ctagacaaacaagg

SEQ ID NO: 771718 - DNA, 15 bp, Homo sapiens
ctagacaaccctgca

SEQ ID NO: 771719 - DNA, 18 bp, Homo sapiens
ctagacaagatattgtac

SEQ ID NO: 771720 - DNA, 20 bp, Homo sapiens
ctagacaagatattgtacat

SEQ ID NO: 771721 - DNA, 13 bp, Homo sapiens
ctagacactgcca

SEQ ID NO: 771722 - DNA, 21 bp, Homo sapiens
ctagacagaaaccaagccatt

SEQ ID NO: 771723 - DNA, 16 bp, Homo sapiens
ctagaccagtttgcat

SEQ ID NO: 771724 - DNA, 18 bp, Homo sapiens
ctagaccagtttgcatga

SEQ ID NO: 771725 - DNA, 23 bp, Homo sapiens
ctagaccgcgtgataaaactggg

SEQ ID NO: 771726 - DNA, 15 bp, Homo sapiens
ctagacgcccctccc

SEQ ID NO: 771727 - DNA, 23 bp, Homo sapiens
ctagactaattaaaatctggaaa

SEQ ID NO: 771728 - DNA, 20 bp, Homo sapiens
ctagactcaaaacctggaga

SEQ ID NO: 771729 - DNA, 20 bp, Homo sapiens
ctagactgcatcccgtacct

SEQ ID NO: 771730 - DNA, 16 bp, Homo sapiens
ctagactggagtgagg

SEQ ID NO: 771731 - DNA, 19 bp, Homo sapiens
ctagactggagtgaggctt

SEQ ID NO: 771732 - DNA, 23 bp, Homo sapiens
ctagactggagtgaggcttccag

SEQ ID NO: 771733 - DNA, 24 bp, Homo sapiens
ctagactggagtgaggcttccagg

SEQ ID NO: 771734 - DNA, 20 bp, Homo sapiens
ctagacttcccaacagcctt

SEQ ID NO: 771735 - DNA, 21 bp, Homo sapiens
ctagacttcccaacagcctta

SEQ ID NO: 771736 - DNA, 20 bp, Homo sapiens
ctagacttgaaagttttcca

SEQ ID NO: 771737 - DNA, 22 bp, Homo sapiens
ctagacttgaaagttttccagt

SEQ ID NO: 771738 - DNA, 12 bp, Homo sapiens
ctagactttctc

SEQ ID NO: 771739 - DNA, 23 bp, Homo sapiens
ctagactttgggatcaaataact

SEQ ID NO: 771740 - DNA, 16 bp, Homo sapiens
ctagagaaattcttgt

SEQ ID NO: 771741 - DNA, 15 bp, Homo sapiens
ctagagaagaggctg

SEQ ID NO: 771742 - DNA, 15 bp, Homo sapiens
ctagagacagaagca

SEQ ID NO: 771743 - DNA, 12 bp, Homo sapiens
ctagagagggag

SEQ ID NO: 771744 - DNA, 13 bp, Homo sapiens
ctagagagggagg

SEQ ID NO: 771745 - DNA, 14 bp, Homo sapiens
ctagagataaaaca

SEQ ID NO: 771746 - DNA, 20 bp, Homo sapiens
ctagagatgtgcctgtggga

SEQ ID NO: 771747 - DNA, 14 bp, Homo sapiens
ctagagcagggatt

SEQ ID NO: 771748 - DNA, 17 bp, Homo sapiens
caccgtcgaccaggaaa

SEQ ID NO: 771749 - DNA, 18 bp, Homo sapiens
caccgtcgaccaggaaag

SEQ ID NO: 771750 - DNA, 22 bp, Homo sapiens
caccgtctcggccctgaaccac

SEQ ID NO: 771751 - DNA, 13 bp, Homo sapiens
caccgtcttcctt

SEQ ID NO: 771752 - DNA, 16 bp, Homo sapiens
caccgtgaaccagagg

SEQ ID NO: 771753 - DNA, 18 bp, Homo sapiens
caccgtgaaccagagggt

SEQ ID NO: 771754 - DNA, 16 bp, Homo sapiens
caccgtgatggagagg

SEQ ID NO: 771755 - DNA, 17 bp, Homo sapiens
caccgtgatggagagga

SEQ ID NO: 771756 - DNA, 22 bp, Homo sapiens
caccgtgccaaccccacccagc

SEQ ID NO: 771757 - DNA, 16 bp, Homo sapiens
caccgtggcctgggct

SEQ ID NO: 771758 - DNA, 20 bp, Homo sapiens
caccgtgggcagtgccaccc

SEQ ID NO: 771759 - DNA, 13 bp, Homo sapiens
caccgtgggctcc

SEQ ID NO: 771760 - DNA, 14 bp, Homo sapiens
caccgtggggaagg

SEQ ID NO: 771761 - DNA, 15 bp, Homo sapiens
caccgtgtaaaccaa

SEQ ID NO: 771762 - DNA, 14 bp, Homo sapiens
caccgtgtcctcct

SEQ ID NO: 771763 - DNA, 23 bp, Homo sapiens
caccgtgtcctcctctgaggaag

SEQ ID NO: 771764 - DNA, 13 bp, Homo sapiens
caccgttcagtca

SEQ ID NO: 771765 - DNA, 14 bp, Homo sapiens
caccgttctgtgca

SEQ ID NO: 771766 - DNA, 17 bp, Homo sapiens
caccgtttcttcctgcc

SEQ ID NO: 771767 - DNA, 21 bp, Homo sapiens
caccgtttgtcccccggggca

SEQ ID NO: 771768 - DNA, 17 bp, Homo sapiens
cacctaaagaaaaacaa

SEQ ID NO: 771769 - DNA, 21 bp, Homo sapiens
cacctaaaggtgtatttaaac

SEQ ID NO: 771770 - DNA, 16 bp, Homo sapiens
cacctaagcacttcta

SEQ ID NO: 771771 - DNA, 15 bp, Homo sapiens
cacctaagtctctgt

SEQ ID NO: 771772 - DNA, 19 bp, Homo sapiens
cacctaatcaggctgaggt

SEQ ID NO: 771773 - DNA, 23 bp, Homo sapiens
cacctaattcgatgaaggctgcc

SEQ ID NO: 771774 - DNA, 13 bp, Homo sapiens
cacctacacagga

SEQ ID NO: 771775 - DNA, 18 bp, Homo sapiens
cacctacacccctgtgct

SEQ ID NO: 771776 - DNA, 19 bp, Homo sapiens
cacctacacccctgtgctc

SEQ ID NO: 771777 - DNA, 13 bp, Homo sapiens
cacctacagtgta

SEQ ID NO: 771778 - DNA, 17 bp, Homo sapiens
cacctacagtgtacagt

SEQ ID NO: 771779 - DNA, 18 bp, Homo sapiens
cacctacatgttattcta

SEQ ID NO: 771780 - DNA, 18 bp, Homo sapiens
cacctaccatcagggaca

SEQ ID NO: 771781 - DNA, 13 bp, Homo sapiens
cacctaccatgct

SEQ ID NO: 771782 - DNA, 14 bp, Homo sapiens
cacctaccatgctg

SEQ ID NO: 771783 - DNA, 21 bp, Homo sapiens
cacctactatgtgctgggtgc

SEQ ID NO: 771784 - DNA, 12 bp, Homo sapiens
cacctactgagt

SEQ ID NO: 771785 - DNA, 21 bp, Homo sapiens
cacctacttgtgactgaaggg

SEQ ID NO: 771786 - DNA, 21 bp, Homo sapiens
cacctagcatgtgtaattttt

SEQ ID NO: 771787 - DNA, 16 bp, Homo sapiens
cacctagctttattct

SEQ ID NO: 771788 - DNA, 16 bp, Homo sapiens
cacctaggccactcct

SEQ ID NO: 771789 - DNA, 15 bp, Homo sapiens
cacctagtccagtga

SEQ ID NO: 771790 - DNA, 12 bp, Homo sapiens
cacctagtgccc

SEQ ID NO: 771791 - DNA, 16 bp, Homo sapiens
cacctagtgccccaga

SEQ ID NO: 771792 - DNA, 20 bp, Homo sapiens
cacctagtgccccagactga

SEQ ID NO: 771793 - DNA, 13 bp, Homo sapiens
cacctatctcagc

SEQ ID NO: 771794 - DNA, 14 bp, Homo sapiens
cacctatctcagcc

SEQ ID NO: 771795 - DNA, 20 bp, Homo sapiens
cacctgacctcttgctgcca

SEQ ID NO: 771796 - DNA, 21 bp, Homo sapiens
cacctgacctcttgctgccag

SEQ ID NO: 771797 - DNA, 23 bp, Homo sapiens
cacctgactctgaaatctgaaga

SEQ ID NO: 771798 - DNA, 11 bp, Homo sapiens
cacctgagacc

SEQ ID NO: 771799 - DNA, 21 bp, Homo sapiens
cacctgagcccggatgcttct

SEQ ID NO: 771800 - DNA, 16 bp, Homo sapiens
cacctgagcgctgtgg

SEQ ID NO: 771801 - DNA, 11 bp, Homo sapiens
cacctgaggaa

SEQ ID NO: 771802 - DNA, 14 bp, Homo sapiens
cacctgaggaactg

SEQ ID NO: 771803 - DNA, 15 bp, Homo sapiens
cacctgaggtgggcc

SEQ ID NO: 771804 - DNA, 21 bp, Homo sapiens
cacctgaggtgggctggggct

SEQ ID NO: 771805 - DNA, 17 bp, Homo sapiens
cacctgattttgaaggt

SEQ ID NO: 771806 - DNA, 14 bp, Homo sapiens
cacctgcaagcccc

SEQ ID NO: 771807 - DNA, 21 bp, Homo sapiens
cacctgcaagccccagggcct

SEQ ID NO: 771808 - DNA, 23 bp, Homo sapiens
cacctgcaagccccagggcctgg

SEQ ID NO: 771809 - DNA, 16 bp, Homo sapiens
cacctgcactaacaga

SEQ ID NO: 771810 - DNA, 21 bp, Homo sapiens
cacctgcactaacagagtggc

SEQ ID NO: 771811 - DNA, 13 bp, Homo sapiens
cacctgcaggacc

SEQ ID NO: 771812 - DNA, 23 bp, Homo sapiens
cacctgcaggaccctgtcctgca

SEQ ID NO: 771813 - DNA, 22 bp, Homo sapiens
cacctgcatccgtagttccctg

SEQ ID NO: 771814 - DNA, 14 bp, Homo sapiens
cacctgccagcctg

SEQ ID NO: 771815 - DNA, 22 bp, Homo sapiens
cacctgccagcctggcttctgg

SEQ ID NO: 771816 - DNA, 17 bp, Homo sapiens
cacctgccatttgcacc

SEQ ID NO: 771817 - DNA, 19 bp, Homo sapiens
cacctgcccaacctgctct

SEQ ID NO: 771818 - DNA, 13 bp, Homo sapiens
cacctgccccctt

SEQ ID NO: 771819 - DNA, 19 bp, Homo sapiens
cacctgcccccttctccca

SEQ ID NO: 771820 - DNA, 20 bp, Homo sapiens
cacctgcccccttctcccac

SEQ ID NO: 771821 - DNA, 23 bp, Homo sapiens
cacctgcccccttctcccacact

SEQ ID NO: 771822 - DNA, 22 bp, Homo sapiens
cacctgcccctctgttctctcc

SEQ ID NO: 771823 - DNA, 14 bp, Homo sapiens
cacctgccctgccc

SEQ ID NO: 771824 - DNA, 23 bp, Homo sapiens
cacctgccgacctcgtcctcccc

SEQ ID NO: 771825 - DNA, 17 bp, Homo sapiens
cacctgccgcatgctcc

SEQ ID NO: 771826 - DNA, 16 bp, Homo sapiens
cacctgcctgcgtctt

SEQ ID NO: 771827 - DNA, 23 bp, Homo sapiens
cacctgcctgcgtcttccgcccc

SEQ ID NO: 771828 - DNA, 16 bp, Homo sapiens
cacctgccttggcctc

SEQ ID NO: 771829 - DNA, 13 bp, Homo sapiens
cacctgcgcacag

SEQ ID NO: 771830 - DNA, 16 bp, Homo sapiens
cacctgcgcacaggtg

SEQ ID NO: 771831 - DNA, 21 bp, Homo sapiens
cacctgcggccgccccccgcc

SEQ ID NO: 771832 - DNA, 18 bp, Homo sapiens
cacctgcggggccaccca

SEQ ID NO: 771833 - DNA, 14 bp, Homo sapiens
cacctgctcacagg

SEQ ID NO: 771834 - DNA, 18 bp, Homo sapiens
cacctgctcacagggatg

SEQ ID NO: 771835 - DNA, 15 bp, Homo sapiens
cacctgctccagaag

SEQ ID NO: 771836 - DNA, 15 bp, Homo sapiens
cacctgctgcgcttg

SEQ ID NO: 771837 - DNA, 19 bp, Homo sapiens
cacctgctgcgtccccact

SEQ ID NO: 771838 - DNA, 21 bp, Homo sapiens
cacctggaagcatttgtttct

SEQ ID NO: 771839 - DNA, 22 bp, Homo sapiens
cacctggactgagccaaggagg

SEQ ID NO: 771840 - DNA, 15 bp, Homo sapiens
cacctggagcccgct

SEQ ID NO: 771841 - DNA, 21 bp, Homo sapiens
cacctggagcccgcttcaagc

SEQ ID NO: 771842 - DNA, 19 bp, Homo sapiens
cacctggaggcaagaggga

SEQ ID NO: 771843 - DNA, 21 bp, Homo sapiens
cacctggaggcaagagggagg

SEQ ID NO: 771844 - DNA, 19 bp, Homo sapiens
cacctggatctatccctgc

SEQ ID NO: 771845 - DNA, 20 bp, Homo sapiens
cacctggcagggctcacact

SEQ ID NO: 771846 - DNA, 13 bp, Homo sapiens
cacctggccacct

SEQ ID NO: 771847 - DNA, 17 bp, Homo sapiens
cacctggccacctgagg

SEQ ID NO: 771848 - DNA, 21 bp, Homo sapiens
cacctggccacctgaggtggg

SEQ ID NO: 771849 - DNA, 15 bp, Homo sapiens
cacctggccccatgt

SEQ ID NO: 771850 - DNA, 19 bp, Homo sapiens
cacctggccgggtcaccct

SEQ ID NO: 771851 - DNA, 20 bp, Homo sapiens
cacctggccgggtcaccctg

SEQ ID NO: 771852 - DNA, 22 bp, Homo sapiens
cacctggccgggtcaccctgtg

SEQ ID NO: 771853 - DNA, 15 bp, Homo sapiens
cacctggcctgctgg

SEQ ID NO: 771854 - DNA, 17 bp, Homo sapiens
cacctggcctgctggga

SEQ ID NO: 771855 - DNA, 20 bp, Homo sapiens
cacctggccttaaagaggga

SEQ ID NO: 771856 - DNA, 22 bp, Homo sapiens
cacctggctgaggttcctctgc

SEQ ID NO: 771857 - DNA, 18 bp, Homo sapiens
cacctggctgctaggcca

SEQ ID NO: 771858 - DNA, 15 bp, Homo sapiens
cacctgggaacacag

SEQ ID NO: 771859 - DNA, 16 bp, Homo sapiens
cacctgggaacacagt

SEQ ID NO: 771860 - DNA, 23 bp, Homo sapiens
cacctgggaacacagttctgggc

SEQ ID NO: 771861 - DNA, 22 bp, Homo sapiens
cacctgggagaaggtctccaag

SEQ ID NO: 771862 - DNA, 23 bp, Homo sapiens
cacctgggagaaggtctccaagg

SEQ ID NO: 771863 - DNA, 15 bp, Homo sapiens
cacctgggcacctgg

SEQ ID NO: 771864 - DNA, 23 bp, Homo sapiens
cacctgggcagggatgatggcag

SEQ ID NO: 771865 - DNA, 18 bp, Homo sapiens
cacctgggccccactgga

SEQ ID NO: 771866 - DNA, 20 bp, Homo sapiens
cacctgggccccactggaca

SEQ ID NO: 771867 - DNA, 21 bp, Homo sapiens
cacctgggccccactggacaa

SEQ ID NO: 771868 - DNA, 21 bp, Homo sapiens
cacctgggcccgggcaggcca

SEQ ID NO: 771869 - DNA, 22 bp, Homo sapiens
cacctgggcccgggcaggccag

SEQ ID NO: 771870 - DNA, 23 bp, Homo sapiens
cacctgggcccgggcaggccagc

SEQ ID NO: 771871 - DNA, 18 bp, Homo sapiens
cacctgggccgggctgta

SEQ ID NO: 771872 - DNA, 14 bp, Homo sapiens
cacctgggctgggc

SEQ ID NO: 771873 - DNA, 16 bp, Homo sapiens
cacctgggcttaagaa

SEQ ID NO: 771874 - DNA, 19 bp, Homo sapiens
cacctgggcttaagaaatc

SEQ ID NO: 771875 - DNA, 20 bp, Homo sapiens
cacctggggtctctctccct

SEQ ID NO: 771876 - DNA, 18 bp, Homo sapiens
cacctggtttctgttctg

SEQ ID NO: 771877 - DNA, 21 bp, Homo sapiens
ctagctatgctgtatctgtgc

SEQ ID NO: 771878 - DNA, 17 bp, Homo sapiens
ctagctcctgccacatg

SEQ ID NO: 771879 - DNA, 21 bp, Homo sapiens
ctagctcctgccacatggagc

SEQ ID NO: 771880 - DNA, 21 bp, Homo sapiens
ctagctctttggtctattttc

SEQ ID NO: 771881 - DNA, 22 bp, Homo sapiens
ctagctgaccccgagaagtgct

SEQ ID NO: 771882 - DNA, 19 bp, Homo sapiens
ctagctgcagatgcctctg

SEQ ID NO: 771883 - DNA, 12 bp, Homo sapiens
ctagctgccact

SEQ ID NO: 771884 - DNA, 13 bp, Homo sapiens
ctagctgccactt

SEQ ID NO: 771885 - DNA, 14 bp, Homo sapiens
ctagctggatttgt

SEQ ID NO: 771886 - DNA, 13 bp, Homo sapiens
ctagctggcagga

SEQ ID NO: 771887 - DNA, 22 bp, Homo sapiens
ctagctggcaggacacatcccg

SEQ ID NO: 771888 - DNA, 14 bp, Homo sapiens
ctagctggctctgt

SEQ ID NO: 771889 - DNA, 18 bp, Homo sapiens
ctagctgggggtgggcca

SEQ ID NO: 771890 - DNA, 22 bp, Homo sapiens
ctagctgggggtgggccaggct

SEQ ID NO: 771891 - DNA, 16 bp, Homo sapiens
ctagctgtcccatggg

SEQ ID NO: 771892 - DNA, 14 bp, Homo sapiens
ctagctgtgcaaga

SEQ ID NO: 771893 - DNA, 20 bp, Homo sapiens
ctagctgtgccccctctggt

SEQ ID NO: 771894 - DNA, 18 bp, Homo sapiens
ctagctgttgagctgttt

SEQ ID NO: 771895 - DNA, 15 bp, Homo sapiens
ctagctgttgtaaag

SEQ ID NO: 771896 - DNA, 18 bp, Homo sapiens
ctagcttctgcttttctg

SEQ ID NO: 771897 - DNA, 22 bp, Homo sapiens
ctagcttctgcttttctgccct

SEQ ID NO: 771898 - DNA, 15 bp, Homo sapiens
ctagctttagaccct

SEQ ID NO: 771899 - DNA, 19 bp, Homo sapiens
ctagctttatatatggaca

SEQ ID NO: 771900 - DNA, 22 bp, Homo sapiens
ctagctttatatatggacatgg

SEQ ID NO: 771901 - DNA, 13 bp, Homo sapiens
ctaggaaagaaat

SEQ ID NO: 771902 - DNA, 20 bp, Homo sapiens
ctaggaacattttttaagga

SEQ ID NO: 771903 - DNA, 19 bp, Homo sapiens
ctaggaagagcaggactcc

SEQ ID NO: 771904 - DNA, 23 bp, Homo sapiens
ctaggaagagcaggactccaggc

SEQ ID NO: 771905 - DNA, 16 bp, Homo sapiens
ctaggaatcccagagg

SEQ ID NO: 771906 - DNA, 15 bp, Homo sapiens
ctaggacacagttcc

SEQ ID NO: 771907 - DNA, 20 bp, Homo sapiens
ctaggacacagttcctggga

SEQ ID NO: 771908 - DNA, 19 bp, Homo sapiens
ctaggaccactcagcccct

SEQ ID NO: 771909 - DNA, 22 bp, Homo sapiens
ctaggacgcaataaatttatat

SEQ ID NO: 771910 - DNA, 13 bp, Homo sapiens
ctaggacgccaac

SEQ ID NO: 771911 - DNA, 17 bp, Homo sapiens
ctaggacgccaacttct

SEQ ID NO: 771912 - DNA, 21 bp, Homo sapiens
ctaggacgccaacttctccca

SEQ ID NO: 771913 - DNA, 14 bp, Homo sapiens
ctaggactcagaaa

SEQ ID NO: 771914 - DNA, 12 bp, Homo sapiens
ctaggactctga

SEQ ID NO: 771915 - DNA, 12 bp, Homo sapiens
ctataggcagct

SEQ ID NO: 771916 - DNA, 15 bp, Homo sapiens
ctataggctggagaa

SEQ ID NO: 771917 - DNA, 15 bp, Homo sapiens
ctataggtccagaag

SEQ ID NO: 771918 - DNA, 13 bp, Homo sapiens
ctatagtaaatgt

SEQ ID NO: 771919 - DNA, 23 bp, Homo sapiens
ctatagtatttgattcaaaatat

SEQ ID NO: 771920 - DNA, 21 bp, Homo sapiens
ctatagtgtataccacctgta

SEQ ID NO: 771921 - DNA, 13 bp, Homo sapiens
ctatagttactgt

SEQ ID NO: 771922 - DNA, 21 bp, Homo sapiens
ctatagttcactgacacagta

SEQ ID NO: 771923 - DNA, 20 bp, Homo sapiens
ctatagtttcaccactcctc

SEQ ID NO: 771924 - DNA, 12 bp, Homo sapiens
ctatataaaata

SEQ ID NO: 771925 - DNA, 14 bp, Homo sapiens
ctatataaaataac

SEQ ID NO: 771926 - DNA, 17 bp, Homo sapiens
ctatataaaataactaa

SEQ ID NO: 771927 - DNA, 13 bp, Homo sapiens
ctatataaaatgt

SEQ ID NO: 771928 - DNA, 14 bp, Homo sapiens
ctatataattgtga

SEQ ID NO: 771929 - DNA, 19 bp, Homo sapiens
ctatatagttccttgcctt

SEQ ID NO: 771930 - DNA, 22 bp, Homo sapiens
ctatatagtttattgacaataa

SEQ ID NO: 771931 - DNA, 19 bp, Homo sapiens
ctatatataaaacggtgct

SEQ ID NO: 771932 - DNA, 18 bp, Homo sapiens
ctatatatacatatgtaa

SEQ ID NO: 771933 - DNA, 15 bp, Homo sapiens
ctatatatgtgtatg

SEQ ID NO: 771934 - DNA, 17 bp, Homo sapiens
ctatatatgtgtatgta

SEQ ID NO: 771935 - DNA, 13 bp, Homo sapiens
ctatatatttcta

SEQ ID NO: 771936 - DNA, 14 bp, Homo sapiens
ctatatatttctat

SEQ ID NO: 771937 - DNA, 15 bp, Homo sapiens
ctatatcattattta

SEQ ID NO: 771938 - DNA, 19 bp, Homo sapiens
ctatatccagaaggggagc

SEQ ID NO: 771939 - DNA, 14 bp, Homo sapiens
ctatatccatgtac

SEQ ID NO: 771940 - DNA, 16 bp, Homo sapiens
ctatatccatgtactg

SEQ ID NO: 771941 - DNA, 18 bp, Homo sapiens
ctatatccatgtactgta

SEQ ID NO: 771942 - DNA, 23 bp, Homo sapiens
ctatatcgaatatagttctgtgt

SEQ ID NO: 771943 - DNA, 13 bp, Homo sapiens
ctatatctgtttg

SEQ ID NO: 771944 - DNA, 19 bp, Homo sapiens
ctatatctgtttgtatatt

SEQ ID NO: 771945 - DNA, 21 bp, Homo sapiens
ctatatctgtttgtatatttg

SEQ ID NO: 771946 - DNA, 20 bp, Homo sapiens
ctatatgaatttaaatataa

SEQ ID NO: 771947 - DNA, 16 bp, Homo sapiens
ctatatgatttatagt

SEQ ID NO: 771948 - DNA, 18 bp, Homo sapiens
ctatatgatttatagttt

SEQ ID NO: 771949 - DNA, 15 bp, Homo sapiens
ctatatgcacccctg

SEQ ID NO: 771950 - DNA, 21 bp, Homo sapiens
ctatatgtacagctctcccct

SEQ ID NO: 771951 - DNA, 14 bp, Homo sapiens
ctatatgtacttgt

SEQ ID NO: 771952 - DNA, 19 bp, Homo sapiens
ctatatgtagctttatcct

SEQ ID NO: 771953 - DNA, 21 bp, Homo sapiens
ctatatgtagtataaagaaaa

SEQ ID NO: 771954 - DNA, 22 bp, Homo sapiens
ctatatgtagtgcatttttaaa

SEQ ID NO: 771955 - DNA, 14 bp, Homo sapiens
ctatattaaatgag

SEQ ID NO: 771956 - DNA, 19 bp, Homo sapiens
ctatattacggtttgcccc

SEQ ID NO: 771957 - DNA, 16 bp, Homo sapiens
ctatattattatatat

SEQ ID NO: 771958 - DNA, 14 bp, Homo sapiens
ctatattgatttaa

SEQ ID NO: 771959 - DNA, 16 bp, Homo sapiens
ctatattgatttaaaa

SEQ ID NO: 771960 - DNA, 23 bp, Homo sapiens
ctatattgatttaaaagtgtatt

SEQ ID NO: 771961 - DNA, 22 bp, Homo sapiens
ctatattgcccaggctggtctt

SEQ ID NO: 771962 - DNA, 23 bp, Homo sapiens
ctatattgttttcagtgtacatg

SEQ ID NO: 771963 - DNA, 22 bp, Homo sapiens
ctatatttagattgttaaaata

SEQ ID NO: 771964 - DNA, 23 bp, Homo sapiens
ctatatttagattgttaaaataa

SEQ ID NO: 771965 - DNA, 15 bp, Homo sapiens
ctatatttcagtgac

SEQ ID NO: 771966 - DNA, 22 bp, Homo sapiens
ctatatttgctagactctagac

SEQ ID NO: 771967 - DNA, 19 bp, Homo sapiens
ctatatttgtatatatttt

SEQ ID NO: 771968 - DNA, 15 bp, Homo sapiens
ctatatttgtcttcc

SEQ ID NO: 771969 - DNA, 14 bp, Homo sapiens
ctatattttaatag

SEQ ID NO: 771970 - DNA, 13 bp, Homo sapiens
ctatcaaactgaa

SEQ ID NO: 771971 - DNA, 16 bp, Homo sapiens
ctatcaaactgaagcc

SEQ ID NO: 771972 - DNA, 20 bp, Homo sapiens
ctatcaaactgaagccagaa

SEQ ID NO: 771973 - DNA, 12 bp, Homo sapiens
ctatcaaatgaa

SEQ ID NO: 771974 - DNA, 15 bp, Homo sapiens
ctatcaaatgaaact

SEQ ID NO: 771975 - DNA, 19 bp, Homo sapiens
ctatcaacaataaaatttt

SEQ ID NO: 771976 - DNA, 19 bp, Homo sapiens
ctatcaaccccagacactg

SEQ ID NO: 771977 - DNA, 20 bp, Homo sapiens
ctatcaagagagtaaacaga

SEQ ID NO: 771978 - DNA, 22 bp, Homo sapiens
ctatcaatcaccgtctgtgttt

SEQ ID NO: 771979 - DNA, 17 bp, Homo sapiens
ctatcacctcccctcct

SEQ ID NO: 771980 - DNA, 19 bp, Homo sapiens
ctatcagcaatactcatca

SEQ ID NO: 771981 - DNA, 21 bp, Homo sapiens
ctatcagcaatactcatcaga

SEQ ID NO: 771982 - DNA, 16 bp, Homo sapiens
ctatcaggtaataaaa

SEQ ID NO: 771983 - DNA, 14 bp, Homo sapiens
ctatcatggagtga

SEQ ID NO: 771984 - DNA, 22 bp, Homo sapiens
ctatcatggtgaaaagctccat

SEQ ID NO: 771985 - DNA, 14 bp, Homo sapiens
ctatcattctcagt

SEQ ID NO: 771986 - DNA, 19 bp, Homo sapiens
ctatccaaagaacttgatt

SEQ ID NO: 771987 - DNA, 13 bp, Homo sapiens
ctatccaagtgtt

SEQ ID NO: 771988 - DNA, 12 bp, Homo sapiens
ctatccacccag

SEQ ID NO: 771989 - DNA, 14 bp, Homo sapiens
ctatccacccagcc

SEQ ID NO: 771990 - DNA, 15 bp, Homo sapiens
ctatccacccagccc

SEQ ID NO: 771991 - DNA, 17 bp, Homo sapiens
ctatccacccagcccat

SEQ ID NO: 771992 - DNA, 20 bp, Homo sapiens
ctatccagtgacttgttctg

SEQ ID NO: 771993 - DNA, 22 bp, Homo sapiens
ctatccatcatgaccagcaaat

SEQ ID NO: 771994 - DNA, 14 bp, Homo sapiens
ctatccatgtaata

SEQ ID NO: 771995 - DNA, 18 bp, Homo sapiens
ctatcccacccaacagct

SEQ ID NO: 771996 - DNA, 23 bp, Homo sapiens
ctatcccacccaacagctcagag

SEQ ID NO: 771997 - DNA, 18 bp, Homo sapiens
ctatccccatctccctgc

SEQ ID NO: 771998 - DNA, 23 bp, Homo sapiens
ctatccccatctccctgcctggc

SEQ ID NO: 771999 - DNA, 14 bp, Homo sapiens
ctatcccccttaaa

SEQ ID NO: 772000 - DNA, 18 bp, Homo sapiens
ctatccctaggcacttaa

SEQ ID NO: 772001 - DNA, 15 bp, Homo sapiens
ctatccgctgccagc

SEQ ID NO: 772002 - DNA, 17 bp, Homo sapiens
ctatccgctgccagcct

SEQ ID NO: 772003 - DNA, 17 bp, Homo sapiens
ctatccgtgttgcaggt

SEQ ID NO: 772004 - DNA, 12 bp, Homo sapiens
ctatcctctctc

SEQ ID NO: 772005 - DNA, 13 bp, Homo sapiens
ctatcctctgtaa

SEQ ID NO: 772006 - DNA, 19 bp, Homo sapiens
ctatcctgaaaattctgta

SEQ ID NO: 772007 - DNA, 14 bp, Homo sapiens
ctatcctgctgaaa

SEQ ID NO: 772008 - DNA, 18 bp, Homo sapiens
ctatcctgtaaatatatc

SEQ ID NO: 772009 - DNA, 19 bp, Homo sapiens
ctatccttggagagcagct

SEQ ID NO: 772010 - DNA, 20 bp, Homo sapiens
ctatccttggagagcagctg

SEQ ID NO: 772011 - DNA, 14 bp, Homo sapiens
ctatctaaagtttg

SEQ ID NO: 772012 - DNA, 22 bp, Homo sapiens
cacgtcccagcatccctggagc

SEQ ID NO: 772013 - DNA, 15 bp, Homo sapiens
cacgtccccctgggg

SEQ ID NO: 772014 - DNA, 18 bp, Homo sapiens
cacgtcccgctgcctcct

SEQ ID NO: 772015 - DNA, 14 bp, Homo sapiens
cacgtctgccaggc

SEQ ID NO: 772016 - DNA, 15 bp, Homo sapiens
cacgtctgccaggcc

SEQ ID NO: 772017 - DNA, 16 bp, Homo sapiens
cacgtctgccaggccc

SEQ ID NO: 772018 - DNA, 22 bp, Homo sapiens
cacgtctgccaggcccatctca

SEQ ID NO: 772019 - DNA, 12 bp, Homo sapiens
cacgtctggcca

SEQ ID NO: 772020 - DNA, 20 bp, Homo sapiens
cacgtctggctccctgcccc

SEQ ID NO: 772021 - DNA, 16 bp, Homo sapiens
cacgtcttggtgcctt

SEQ ID NO: 772022 - DNA, 16 bp, Homo sapiens
cacgtctttcctgcta

SEQ ID NO: 772023 - DNA, 20 bp, Homo sapiens
cacgtgaaatatttaagtat

SEQ ID NO: 772024 - DNA, 23 bp, Homo sapiens
cacgtgaaatatttaagtatata

SEQ ID NO: 772025 - DNA, 18 bp, Homo sapiens
cacgtgacagtgcctggg

SEQ ID NO: 772026 - DNA, 20 bp, Homo sapiens
cacgtgagagaatctgcctg

SEQ ID NO: 772027 - DNA, 13 bp, Homo sapiens
cacgtgccaggcc

SEQ ID NO: 772028 - DNA, 19 bp, Homo sapiens
cacgtgctacccccatgct

SEQ ID NO: 772029 - DNA, 23 bp, Homo sapiens
cacgtggagagctggtgcccgga

SEQ ID NO: 772030 - DNA, 19 bp, Homo sapiens
cacgtggcatgtggcctgt

SEQ ID NO: 772031 - DNA, 20 bp, Homo sapiens
cacgtggcctcttgagcagt

SEQ ID NO: 772032 - DNA, 18 bp, Homo sapiens
cacgtgggctcccctctt

SEQ ID NO: 772033 - DNA, 21 bp, Homo sapiens
cacgtgggctcccctcttcct

SEQ ID NO: 772034 - DNA, 21 bp, Homo sapiens
cacgtgtgctgtggccaggcc

SEQ ID NO: 772035 - DNA, 12 bp, Homo sapiens
cacgtgtggcct

SEQ ID NO: 772036 - DNA, 13 bp, Homo sapiens
cacgtgtgtatga

SEQ ID NO: 772037 - DNA, 19 bp, Homo sapiens
cccagggaggcagcgtggg

SEQ ID NO: 772038 - DNA, 23 bp, Homo sapiens
cccagggaggcagcgtgggctct

SEQ ID NO: 772039 - DNA, 14 bp, Homo sapiens
cccagggagtccag

SEQ ID NO: 772040 - DNA, 14 bp, Homo sapiens
cccagggagtgagc

SEQ ID NO: 772041 - DNA, 15 bp, Homo sapiens
cccagggagtgagca

SEQ ID NO: 772042 - DNA, 23 bp, Homo sapiens
cccagggcagggtgggcagccta

SEQ ID NO: 772043 - DNA, 21 bp, Homo sapiens
cccagggcatcttgctggcta

SEQ ID NO: 772044 - DNA, 13 bp, Homo sapiens
cccagggcccctc

SEQ ID NO: 772045 - DNA, 22 bp, Homo sapiens
cccagggcccctccctctgccc

SEQ ID NO: 772046 - DNA, 16 bp, Homo sapiens
cccagggccctcccag

SEQ ID NO: 772047 - DNA, 17 bp, Homo sapiens
cccagggccctcccagc

SEQ ID NO: 772048 - DNA, 17 bp, Homo sapiens
cccagggcctccagggc

SEQ ID NO: 772049 - DNA, 21 bp, Homo sapiens
cccagggcctgacttgagcca

SEQ ID NO: 772050 - DNA, 24 bp, Homo sapiens
cccagggcctgacttgagccactc

SEQ ID NO: 772051 - DNA, 12 bp, Homo sapiens
cccagggcctgg

SEQ ID NO: 772052 - DNA, 13 bp, Homo sapiens
cccagggcctggg

SEQ ID NO: 772053 - DNA, 20 bp, Homo sapiens
cccagggcctgggggcagtg

SEQ ID NO: 772054 - DNA, 23 bp, Homo sapiens
cccagggcctgggggcagtgact

SEQ ID NO: 772055 - DNA, 17 bp, Homo sapiens
cccagggcctgtctccc

SEQ ID NO: 772056 - DNA, 15 bp, Homo sapiens
cccagggctaccctc

SEQ ID NO: 772057 - DNA, 17 bp, Homo sapiens
cccagggctcagcctgg

SEQ ID NO: 772058 - DNA, 18 bp, Homo sapiens
cccagggctcagcctggt

SEQ ID NO: 772059 - DNA, 21 bp, Homo sapiens
cccagggctccctcctggagc

SEQ ID NO: 772060 - DNA, 14 bp, Homo sapiens
cccagggctcctgc

SEQ ID NO: 772061 - DNA, 16 bp, Homo sapiens
cccagggctctgcccc

SEQ ID NO: 772062 - DNA, 23 bp, Homo sapiens
cccagggctgcaaaactggaagc

SEQ ID NO: 772063 - DNA, 14 bp, Homo sapiens
cccagggctggaga

SEQ ID NO: 772064 - DNA, 17 bp, Homo sapiens
cccaggggaaaatgaag

SEQ ID NO: 772065 - DNA, 21 bp, Homo sapiens
cccaggggaaggccctgaggc

SEQ ID NO: 772066 - DNA, 20 bp, Homo sapiens
cccaggggacgtgggccctg

SEQ ID NO: 772067 - DNA, 23 bp, Homo sapiens
cccaggggagagggtctggagaa

SEQ ID NO: 772068 - DNA, 17 bp, Homo sapiens
cccaggggagccagctg

SEQ ID NO: 772069 - DNA, 19 bp, Homo sapiens
cccaggggagccagctgct

SEQ ID NO: 772070 - DNA, 13 bp, Homo sapiens
atctgtgaattaa

SEQ ID NO: 772071 - DNA, 16 bp, Homo sapiens
atctgtgatttcttct

SEQ ID NO: 772072 - DNA, 17 bp, Homo sapiens
atctgtgatttcttctc

SEQ ID NO: 772073 - DNA, 12 bp, Homo sapiens
atctgtgcccca

SEQ ID NO: 772074 - DNA, 12 bp, Homo sapiens
atctgtgcctgg

SEQ ID NO: 772075 - DNA, 14 bp, Homo sapiens
atctgtgcctggga

SEQ ID NO: 772076 - DNA, 17 bp, Homo sapiens
atctgtgcgtgaaacac

SEQ ID NO: 772077 - DNA, 19 bp, Homo sapiens
atctgtgcgtgaaacacac

SEQ ID NO: 772078 - DNA, 13 bp, Homo sapiens
atctgtggagctg

SEQ ID NO: 772079 - DNA, 14 bp, Homo sapiens
atctgtggagctgc

SEQ ID NO: 772080 - DNA, 19 bp, Homo sapiens
atctgtggagctgccacag

SEQ ID NO: 772081 - DNA, 20 bp, Homo sapiens
atctgtggagttcctgctcc

SEQ ID NO: 772082 - DNA, 22 bp, Homo sapiens
atctgtgggcatggtcaaaggc

SEQ ID NO: 772083 - DNA, 22 bp, Homo sapiens
atctgtgtacaaagaaataaca

SEQ ID NO: 772084 - DNA, 14 bp, Homo sapiens
atctgtgtcttgtt

SEQ ID NO: 772085 - DNA, 15 bp, Homo sapiens
atctgtgtcttgttt

SEQ ID NO: 772086 - DNA, 15 bp, Homo sapiens
atctgtgtgaaaatg

SEQ ID NO: 772087 - DNA, 23 bp, Homo sapiens
atctgtgtgcatatttgttactt

SEQ ID NO: 772088 - DNA, 15 bp, Homo sapiens
atctgttagcagagt

SEQ ID NO: 772089 - DNA, 18 bp, Homo sapiens
atctgttagcagagtctg

SEQ ID NO: 772090 - DNA, 23 bp, Homo sapiens
atctgttagcagagtctgtctct

SEQ ID NO: 772091 - DNA, 18 bp, Homo sapiens
atctgttcaacctcagta

SEQ ID NO: 772092 - DNA, 19 bp, Homo sapiens
atctgttgcaagcccctct

SEQ ID NO: 772093 - DNA, 15 bp, Homo sapiens
atctgtttctctgct

SEQ ID NO: 772094 - DNA, 14 bp, Homo sapiens
atctgtttgtatat

SEQ ID NO: 772095 - DNA, 15 bp, Homo sapiens
atctgtttgtatatt

SEQ ID NO: 772096 - DNA, 17 bp, Homo sapiens
atctgtttgtatatttg

SEQ ID NO: 772097 - DNA, 20 bp, Homo sapiens
atctgtttgtatatttgcaa

SEQ ID NO: 772098 - DNA, 18 bp, Homo sapiens
atctgttttgtatatgat

SEQ ID NO: 772099 - DNA, 20 bp, Homo sapiens
atctgttttgtatatgatct

SEQ ID NO: 772100 - DNA, 20 bp, Homo sapiens
atcttaaaagctatcttcat

SEQ ID NO: 772101 - DNA, 15 bp, Homo sapiens
atcttaaaagtgtaa

SEQ ID NO: 772102 - DNA, 19 bp, Homo sapiens
atcttaaacaatgtataaa

SEQ ID NO: 772103 - DNA, 12 bp, Homo sapiens
atcttaaactaa

SEQ ID NO: 772104 - DNA, 20 bp, Homo sapiens
atcttaaagaaacagctttc

SEQ ID NO: 772105 - DNA, 21 bp, Homo sapiens
atcttaaagaaacagctttca

SEQ ID NO: 772106 - DNA, 19 bp, Homo sapiens
atcttaaagtgtgtttcta

SEQ ID NO: 772107 - DNA, 15 bp, Homo sapiens
atcttaaatgacagt

SEQ ID NO: 772108 - DNA, 15 bp, Homo sapiens
atcttaagagcttga

SEQ ID NO: 772109 - DNA, 18 bp, Homo sapiens
atcttaagagcttgatct

SEQ ID NO: 772110 - DNA, 22 bp, Homo sapiens
atcttaagagcttgatctgtga

SEQ ID NO: 772111 - DNA, 19 bp, Homo sapiens
atcttaagcaggtttgttt

SEQ ID NO: 772112 - DNA, 17 bp, Homo sapiens
atcttaagtaccaatgg

SEQ ID NO: 772113 - DNA, 14 bp, Homo sapiens
atcttaatataaat

SEQ ID NO: 772114 - DNA, 16 bp, Homo sapiens
atcttaatatatttga

SEQ ID NO: 772115 - DNA, 20 bp, Homo sapiens
atcttaatcgatgaatgtaa

SEQ ID NO: 772116 - DNA, 21 bp, Homo sapiens
atcttaatgttcctcaaagct

SEQ ID NO: 772117 - DNA, 22 bp, Homo sapiens
atcttaattctttgttctgttt

SEQ ID NO: 772118 - DNA, 16 bp, Homo sapiens
atcttacaaaatcctg

SEQ ID NO: 772119 - DNA, 21 bp, Homo sapiens
atcttacagaagagtaaactg

SEQ ID NO: 772120 - DNA, 16 bp, Homo sapiens
atcttagactttgcaa

SEQ ID NO: 772121 - DNA, 17 bp, Homo sapiens
atcttagagtttacagt

SEQ ID NO: 772122 - DNA, 15 bp, Homo sapiens
atcttagctggatat

SEQ ID NO: 772123 - DNA, 13 bp, Homo sapiens
atcttagtgtatg

SEQ ID NO: 772124 - DNA, 13 bp, Homo sapiens
atcttagtgttca

SEQ ID NO: 772125 - DNA, 14 bp, Homo sapiens
atcttagtttggat

SEQ ID NO: 772126 - DNA, 22 bp, Homo sapiens
atcttagtttggattcttatgt

SEQ ID NO: 772127 - DNA, 24 bp, Homo sapiens
atcttataaagtggaagtatgtat

SEQ ID NO: 772128 - DNA, 18 bp, Homo sapiens
atcttataactgttttag

SEQ ID NO: 772129 - DNA, 12 bp, Homo sapiens
atcttatacaac

SEQ ID NO: 772130 - DNA, 13 bp, Homo sapiens
atcttattcattt

SEQ ID NO: 772131 - DNA, 13 bp, Homo sapiens
atcttatttagga

SEQ ID NO: 772132 - DNA, 16 bp, Homo sapiens
atcttattttcatgta

SEQ ID NO: 772133 - DNA, 18 bp, Homo sapiens
atcttattttgtgaacta

SEQ ID NO: 772134 - DNA, 17 bp, Homo sapiens
atcttcaaactttcact

SEQ ID NO: 772135 - DNA, 19 bp, Homo sapiens
atcttcaaactttcacttt

SEQ ID NO: 772136 - DNA, 15 bp, Homo sapiens
atcttcacattgtgt

SEQ ID NO: 772137 - DNA, 21 bp, Homo sapiens
atcttcacgacaatgttgaga

SEQ ID NO: 772138 - DNA, 13 bp, Homo sapiens
atcttcacttcta

SEQ ID NO: 772139 - DNA, 17 bp, Homo sapiens
atcttcagaactgccct

SEQ ID NO: 772140 - DNA, 18 bp, Homo sapiens
atcttcagaactgccctt

SEQ ID NO: 772141 - DNA, 15 bp, Homo sapiens
atcttcaggtgaaca

SEQ ID NO: 772142 - DNA, 16 bp, Homo sapiens
atcttcagttgtctct

SEQ ID NO: 772143 - DNA, 14 bp, Homo sapiens
atcttcatgatgtg

SEQ ID NO: 772144 - DNA, 23 bp, Homo sapiens
atcttcatggaattcacaaagta

SEQ ID NO: 772145 - DNA, 19 bp, Homo sapiens
atcttccaactcaaactct

SEQ ID NO: 772146 - DNA, 13 bp, Homo sapiens
atcttccacctgt

SEQ ID NO: 772147 - DNA, 23 bp, Homo sapiens
atcttccacctgtgccctcacca

SEQ ID NO: 772148 - DNA, 20 bp, Homo sapiens
atcttcccagcagggccact

SEQ ID NO: 772149 - DNA, 14 bp, Homo sapiens
atcttccctctccc

SEQ ID NO: 772150 - DNA, 14 bp, Homo sapiens
atcttcctctgcag

SEQ ID NO: 772151 - DNA, 12 bp, Homo sapiens
atcttcctgctg

SEQ ID NO: 772152 - DNA, 14 bp, Homo sapiens
atcttcctgctgct

SEQ ID NO: 772153 - DNA, 16 bp, Homo sapiens
atcttcctgctgctgt

SEQ ID NO: 772154 - DNA, 13 bp, Homo sapiens
atcttcctttctt

SEQ ID NO: 772155 - DNA, 22 bp, Homo sapiens
atcttcgttagtaatctgtata

SEQ ID NO: 772156 - DNA, 13 bp, Homo sapiens
atcttctaaatgg

SEQ ID NO: 772157 - DNA, 18 bp, Homo sapiens
atcttctatcattccaat

SEQ ID NO: 772158 - DNA, 19 bp, Homo sapiens
atcttctatttttatcatg

SEQ ID NO: 772159 - DNA, 19 bp, Homo sapiens
atcttctcaaccttatcaa

SEQ ID NO: 772160 - DNA, 20 bp, Homo sapiens
atcttctcaaccttatcaag

SEQ ID NO: 772161 - DNA, 22 bp, Homo sapiens
atcttctcaaccttatcaagga

SEQ ID NO: 772162 - DNA, 13 bp, Homo sapiens
atcttctcattgt

SEQ ID NO: 772163 - DNA, 15 bp, Homo sapiens
atcttctccatctgg

SEQ ID NO: 772164 - DNA, 22 bp, Homo sapiens
atcttctccatctggcagggtg

SEQ ID NO: 772165 - DNA, 17 bp, Homo sapiens
atcttctccccgaggct

SEQ ID NO: 772166 - DNA, 20 bp, Homo sapiens
atcttctccccgaggctgcc

SEQ ID NO: 772167 - DNA, 20 bp, Homo sapiens
cccatggacaggctggctcc

SEQ ID NO: 772168 - DNA, 13 bp, Homo sapiens
cccatggagccag

SEQ ID NO: 772169 - DNA, 14 bp, Homo sapiens
cccatggccatttc

SEQ ID NO: 772170 - DNA, 13 bp, Homo sapiens
cccatggccccca

SEQ ID NO: 772171 - DNA, 14 bp, Homo sapiens
cccatggcccccaa

SEQ ID NO: 772172 - DNA, 17 bp, Homo sapiens
cccatggcccccaataa

SEQ ID NO: 772173 - DNA, 23 bp, Homo sapiens
cccatggcccccaataaaggcag

SEQ ID NO: 772174 - DNA, 11 bp, Homo sapiens
cccatggcctt

SEQ ID NO: 772175 - DNA, 22 bp, Homo sapiens
cccatggctgaagctggagcag

SEQ ID NO: 772176 - DNA, 15 bp, Homo sapiens
cccatgggcacagtg

SEQ ID NO: 772177 - DNA, 16 bp, Homo sapiens
cccatgggcttggact

SEQ ID NO: 772178 - DNA, 14 bp, Homo sapiens
cccatggggaggag

SEQ ID NO: 772179 - DNA, 18 bp, Homo sapiens
cccatgggggctgtcttt

SEQ ID NO: 772180 - DNA, 13 bp, Homo sapiens
cccatggggtcct

SEQ ID NO: 772181 - DNA, 18 bp, Homo sapiens
cccatggggtccttggag

SEQ ID NO: 772182 - DNA, 17 bp, Homo sapiens
cccatggtggcctcaag

SEQ ID NO: 772183 - DNA, 19 bp, Homo sapiens
cccatggtgtatgtggttt

SEQ ID NO: 772184 - DNA, 20 bp, Homo sapiens
cccatggtgtatgtggtttt

SEQ ID NO: 772185 - DNA, 14 bp, Homo sapiens
cccatgtagccccc

SEQ ID NO: 772186 - DNA, 15 bp, Homo sapiens
cccatgtagccccct

SEQ ID NO: 772187 - DNA, 21 bp, Homo sapiens
cccatgtagccccctggcctc

SEQ ID NO: 772188 - DNA, 22 bp, Homo sapiens
cccatgtagccccctggcctct

SEQ ID NO: 772189 - DNA, 16 bp, Homo sapiens
cccatgtcaccggtca

SEQ ID NO: 772190 - DNA, 22 bp, Homo sapiens
cccatgtcaccggtcagtgcct

SEQ ID NO: 772191 - DNA, 13 bp, Homo sapiens
cccatgtcacctc

SEQ ID NO: 772192 - DNA, 19 bp, Homo sapiens
atcttggactgacatttag

SEQ ID NO: 772193 - DNA, 17 bp, Homo sapiens
atcttggagaccctgca

SEQ ID NO: 772194 - DNA, 21 bp, Homo sapiens
atcttggcctaaacctcagtt

SEQ ID NO: 772195 - DNA, 14 bp, Homo sapiens
atcttggctcactg

SEQ ID NO: 772196 - DNA, 15 bp, Homo sapiens
atcttggctcactgc

SEQ ID NO: 772197 - DNA, 17 bp, Homo sapiens
atcttggcttaatttaa

SEQ ID NO: 772198 - DNA, 15 bp, Homo sapiens
atcttggcttcttaa

SEQ ID NO: 772199 - DNA, 20 bp, Homo sapiens
atcttggcttcttaaaaact

SEQ ID NO: 772200 - DNA, 13 bp, Homo sapiens
atcttgggactgg

SEQ ID NO: 772201 - DNA, 21 bp, Homo sapiens
atcttggggcaagactgcaaa

SEQ ID NO: 772202 - DNA, 23 bp, Homo sapiens
atcttgggggggtggccgctgag

SEQ ID NO: 772203 - DNA, 15 bp, Homo sapiens
atcttgggtgtattc

SEQ ID NO: 772204 - DNA, 22 bp, Homo sapiens
atcttggtactactagatgtct

SEQ ID NO: 772205 - DNA, 20 bp, Homo sapiens
atcttggtcagatttgaact

SEQ ID NO: 772206 - DNA, 18 bp, Homo sapiens
atcttgtaggatctactt

SEQ ID NO: 772207 - DNA, 23 bp, Homo sapiens
atcttgtatttgggccaaggtgt

SEQ ID NO: 772208 - DNA, 14 bp, Homo sapiens
atcttgtctctggg

SEQ ID NO: 772209 - DNA, 16 bp, Homo sapiens
atcttgtgagtggata

SEQ ID NO: 772210 - DNA, 21 bp, Homo sapiens
atcttgtgagtggataatcag

SEQ ID NO: 772211 - DNA, 22 bp, Homo sapiens
atcttgtgctagaatacttttt

SEQ ID NO: 772212 - DNA, 13 bp, Homo sapiens
atcttgtgcttct

SEQ ID NO: 772213 - DNA, 22 bp, Homo sapiens
atcttgtgcttcttcacttacc

SEQ ID NO: 772214 - DNA, 15 bp, Homo sapiens
atcttgtggggccag

SEQ ID NO: 772215 - DNA, 16 bp, Homo sapiens
atcttgtggggccagg

SEQ ID NO: 772216 - DNA, 18 bp, Homo sapiens
atcttgtgtgattaactt

SEQ ID NO: 772217 - DNA, 23 bp, Homo sapiens
atcttgtgtgattaacttattta

SEQ ID NO: 772218 - DNA, 20 bp, Homo sapiens
atcttgttattaatgtttct

SEQ ID NO: 772219 - DNA, 21 bp, Homo sapiens
atcttgttattgaagtgttct

SEQ ID NO: 772220 - DNA, 19 bp, Homo sapiens
atcttgttcaaaatgcaga

SEQ ID NO: 772221 - DNA, 19 bp, Homo sapiens
atcttgttcaggaaaaggt

SEQ ID NO: 772222 - DNA, 20 bp, Homo sapiens
atcttgttggtacctttcta

SEQ ID NO: 772223 - DNA, 14 bp, Homo sapiens
atcttgtttacaat

SEQ ID NO: 772224 - DNA, 22 bp, Homo sapiens
atcttgttttgtttgcttccat

SEQ ID NO: 772225 - DNA, 20 bp, Homo sapiens
atctttaacaattgtcttaa

SEQ ID NO: 772226 - DNA, 21 bp, Homo sapiens
atctttaacaattgtcttaaa

SEQ ID NO: 772227 - DNA, 18 bp, Homo sapiens
atctttaccaaaaaccat

SEQ ID NO: 772228 - DNA, 15 bp, Homo sapiens
atctttaggccaggc

SEQ ID NO: 772229 - DNA, 19 bp, Homo sapiens
atctttatacagattttct

SEQ ID NO: 772230 - DNA, 23 bp, Homo sapiens
atctttatacagattttctagaa

SEQ ID NO: 772231 - DNA, 22 bp, Homo sapiens
atctttatagaaggaatttgta

SEQ ID NO: 772232 - DNA, 15 bp, Homo sapiens
atctttatgctgtat

SEQ ID NO: 772233 - DNA, 13 bp, Homo sapiens
atctttattaatc

SEQ ID NO: 772234 - DNA, 15 bp, Homo sapiens
atctttattgaaatt

SEQ ID NO: 772235 - DNA, 16 bp, Homo sapiens
atctttattgagaaag

SEQ ID NO: 772236 - DNA, 22 bp, Homo sapiens
atctttattttagtcttgatgt

SEQ ID NO: 772237 - DNA, 18 bp, Homo sapiens
atctttcaaaccagcttc

SEQ ID NO: 772238 - DNA, 17 bp, Homo sapiens
atctttcatacatatat

SEQ ID NO: 772239 - DNA, 14 bp, Homo sapiens
atctttctaaaact

SEQ ID NO: 772240 - DNA, 18 bp, Homo sapiens
atctttctatagccaact

SEQ ID NO: 772241 - DNA, 22 bp, Homo sapiens
atctttctatataaaatgtatt

SEQ ID NO: 772242 - DNA, 16 bp, Homo sapiens
atctttctattccaaa

SEQ ID NO: 772243 - DNA, 22 bp, Homo sapiens
atctttctccttgaatatcttt

SEQ ID NO: 772244 - DNA, 18 bp, Homo sapiens
atctttctcttacctgtt

SEQ ID NO: 772245 - DNA, 20 bp, Homo sapiens
atctttctcttacctgttat

SEQ ID NO: 772246 - DNA, 14 bp, Homo sapiens
atctttctcttccc

SEQ ID NO: 772247 - DNA, 15 bp, Homo sapiens
atctttctcttccct

SEQ ID NO: 772248 - DNA, 18 bp, Homo sapiens
atctttctcttccctgaa

SEQ ID NO: 772249 - DNA, 13 bp, Homo sapiens
atctttctgcaga

SEQ ID NO: 772250 - DNA, 11 bp, Homo sapiens
atctttcttct

SEQ ID NO: 772251 - DNA, 19 bp, Homo sapiens
atctttcttctattttatt

SEQ ID NO: 772252 - DNA, 21 bp, Homo sapiens
atctttctttacctgagacca

SEQ ID NO: 772253 - DNA, 22 bp, Homo sapiens
atctttctttacctgagaccag

SEQ ID NO: 772254 - DNA, 15 bp, Homo sapiens
atctttctttccaaa

SEQ ID NO: 772255 - DNA, 20 bp, Homo sapiens
atctttctttccaaaacatt

SEQ ID NO: 772256 - DNA, 22 bp, Homo sapiens
atctttctttccaaaacatttc

SEQ ID NO: 772257 - DNA, 14 bp, Homo sapiens
atctttctttccat

SEQ ID NO: 772258 - DNA, 13 bp, Homo sapiens
atctttgaaataa

SEQ ID NO: 772259 - DNA, 11 bp, Homo sapiens
atctttgagcc

SEQ ID NO: 772260 - DNA, 17 bp, Homo sapiens
atctttgccaacatggt

SEQ ID NO: 772261 - DNA, 13 bp, Homo sapiens
atctttgccttgg

SEQ ID NO: 772262 - DNA, 14 bp, Homo sapiens
atctttgccttggg

SEQ ID NO: 772263 - DNA, 22 bp, Homo sapiens
atctttgccttgggctgctcct

SEQ ID NO: 772264 - DNA, 18 bp, Homo sapiens
atctttgcgaaaagataa

SEQ ID NO: 772265 - DNA, 20 bp, Homo sapiens
atctttgtaccaaaatttta

SEQ ID NO: 772266 - DNA, 21 bp, Homo sapiens
atctttgtaccaaaattttaa

SEQ ID NO: 772267 - DNA, 14 bp, Homo sapiens
atctttgtggccaa

SEQ ID NO: 772268 - DNA, 19 bp, Homo sapiens
atctttgtggccaaggagc

SEQ ID NO: 772269 - DNA, 23 bp, Homo sapiens
atctttgtggccaaggagctgct

SEQ ID NO: 772270 - DNA, 16 bp, Homo sapiens
atctttgtttaaatgc

SEQ ID NO: 772271 - DNA, 18 bp, Homo sapiens
atcttttaaagtgttact

SEQ ID NO: 772272 - DNA, 22 bp, Homo sapiens
atcttttaaagtgttacttttt

SEQ ID NO: 772273 - DNA, 11 bp, Homo sapiens
atcttttacat

SEQ ID NO: 772274 - DNA, 16 bp, Homo sapiens
atcttttagtgtttac

SEQ ID NO: 772275 - DNA, 16 bp, Homo sapiens
atcttttataatgatt

SEQ ID NO: 772276 - DNA, 14 bp, Homo sapiens
atcttttattcttt

SEQ ID NO: 772277 - DNA, 14 bp, Homo sapiens
atcttttctaatca

SEQ ID NO: 772278 - DNA, 19 bp, Homo sapiens
atcttttctaatcacagtg

SEQ ID NO: 772279 - DNA, 22 bp, Homo sapiens
atcttttctaatcacagtgttg

SEQ ID NO: 772280 - DNA, 19 bp, Homo sapiens
atcttttctagagacacat

SEQ ID NO: 772281 - DNA, 22 bp, Homo sapiens
atcttttctttaaaataaaaaa

SEQ ID NO: 772282 - DNA, 13 bp, Homo sapiens
atcttttgaattc

SEQ ID NO: 772283 - DNA, 23 bp, Homo sapiens
atcttttgatatgcatatttgtt

SEQ ID NO: 772284 - DNA, 14 bp, Homo sapiens
atcttttggcttct

SEQ ID NO: 772285 - DNA, 14 bp, Homo sapiens
atctttttacagtt

SEQ ID NO: 772286 - DNA, 12 bp, Homo sapiens
atctttttctcc

SEQ ID NO: 772287 - DNA, 17 bp, Homo sapiens
atctttttctccaccca

SEQ ID NO: 772288 - DNA, 18 bp, Homo sapiens
atcttttttagcataaaa

SEQ ID NO: 772289 - DNA, 23 bp, Homo sapiens
atctttttttcatttttaaatgt

SEQ ID NO: 772290 - DNA, 23 bp, Homo sapiens
atcttttttttatataaatatat

SEQ ID NO: 772291 - DNA, 16 bp, Homo sapiens
atgaaaaaatgtatat

SEQ ID NO: 772292 - DNA, 20 bp, Homo sapiens
atgaaaaacaaaaataacat

SEQ ID NO: 772293 - DNA, 11 bp, Homo sapiens
atgaaaaacat

SEQ ID NO: 772294 - DNA, 22 bp, Homo sapiens
ccccacagaaccttcaacccag

SEQ ID NO: 772295 - DNA, 12 bp, Homo sapiens
ccccacagactg

SEQ ID NO: 772296 - DNA, 18 bp, Homo sapiens
ccccacagctacctgaga

SEQ ID NO: 772297 - DNA, 17 bp, Homo sapiens
ccccacagctttgcacc

SEQ ID NO: 772298 - DNA, 23 bp, Homo sapiens
ccccacaggagttgtgagccctc

SEQ ID NO: 772299 - DNA, 12 bp, Homo sapiens
ccccaccaccta

SEQ ID NO: 772300 - DNA, 20 bp, Homo sapiens
ccccaccacgcatgctcagt

SEQ ID NO: 772301 - DNA, 14 bp, Homo sapiens
ccccaccagctcgt

SEQ ID NO: 772302 - DNA, 14 bp, Homo sapiens
ccccacccacctcc

SEQ ID NO: 772303 - DNA, 21 bp, Homo sapiens
ccccacccacctccacccagc

SEQ ID NO: 772304 - DNA, 12 bp, Homo sapiens
ccccacccagct

SEQ ID NO: 772305 - DNA, 16 bp, Homo sapiens
ccccaccccacacttg

SEQ ID NO: 772306 - DNA, 17 bp, Homo sapiens
ccccaccccagtgggaa

SEQ ID NO: 772307 - DNA, 12 bp, Homo sapiens
ccccaccccatc

SEQ ID NO: 772308 - DNA, 16 bp, Homo sapiens
ccccacccccagccag

SEQ ID NO: 772309 - DNA, 16 bp, Homo sapiens
ccccacccccagctca

SEQ ID NO: 772310 - DNA, 22 bp, Homo sapiens
ccccacccccagttcagtctgt

SEQ ID NO: 772311 - DNA, 18 bp, Homo sapiens
ccccacccccgccatgca

SEQ ID NO: 772312 - DNA, 23 bp, Homo sapiens
ccccaccccctccccaggggaga

SEQ ID NO: 772313 - DNA, 16 bp, Homo sapiens
ccccagccctggctct

SEQ ID NO: 772314 - DNA, 15 bp, Homo sapiens
ccccagccctgggct

SEQ ID NO: 772315 - DNA, 17 bp, Homo sapiens
ccccagccctgggcttg

SEQ ID NO: 772316 - DNA, 15 bp, Homo sapiens
ccccagccctgtcct

SEQ ID NO: 772317 - DNA, 14 bp, Homo sapiens
ccccagccctgtgg

SEQ ID NO: 772318 - DNA, 19 bp, Homo sapiens
ccccagcccttagcacaga

SEQ ID NO: 772319 - DNA, 19 bp, Homo sapiens
ccccagcctaagatgaaga

SEQ ID NO: 772320 - DNA, 12 bp, Homo sapiens
ccccagcctagg

SEQ ID NO: 772321 - DNA, 13 bp, Homo sapiens
ccccagcctcagc

SEQ ID NO: 772322 - DNA, 15 bp, Homo sapiens
ccccagcctcagccc

SEQ ID NO: 772323 - DNA, 17 bp, Homo sapiens
ccccagcctcagcccaa

SEQ ID NO: 772324 - DNA, 20 bp, Homo sapiens
ccccagcctcattgtgccaa

SEQ ID NO: 772325 - DNA, 13 bp, Homo sapiens
ccccagcctccag

SEQ ID NO: 772326 - DNA, 14 bp, Homo sapiens
ccccagcctccaga

SEQ ID NO: 772327 - DNA, 18 bp, Homo sapiens
ccccagcctccagagaag

SEQ ID NO: 772328 - DNA, 21 bp, Homo sapiens
ccccagcctccagagaagccc

SEQ ID NO: 772329 - DNA, 10 bp, Homo sapiens
ccccagcctg

SEQ ID NO: 772330 - DNA, 11 bp, Homo sapiens
ccccagcctga

SEQ ID NO: 772331 - DNA, 17 bp, Homo sapiens
ccccagcctggccagac

SEQ ID NO: 772332 - DNA, 18 bp, Homo sapiens
ccccagcgtcccagtctc

SEQ ID NO: 772333 - DNA, 16 bp, Homo sapiens
ccccagcgtctgcagg

SEQ ID NO: 772334 - DNA, 18 bp, Homo sapiens
ccccagcgtctgcagggt

SEQ ID NO: 772335 - DNA, 15 bp, Homo sapiens
ccccagctccctgca

SEQ ID NO: 772336 - DNA, 20 bp, Homo sapiens
ccccagctccctgcaccgcc

SEQ ID NO: 772337 - DNA, 13 bp, Homo sapiens
ccccagctccggc

SEQ ID NO: 772338 - DNA, 13 bp, Homo sapiens
ccccagctctgga

SEQ ID NO: 772339 - DNA, 22 bp, Homo sapiens
ccccagctctggtgagtcttgg

SEQ ID NO: 772340 - DNA, 14 bp, Homo sapiens
ccccagctgactgt

SEQ ID NO: 772341 - DNA, 11 bp, Homo sapiens
ccccagctggc

SEQ ID NO: 772342 - DNA, 12 bp, Homo sapiens
ccccagctggga

SEQ ID NO: 772343 - DNA, 21 bp, Homo sapiens
ccccagctgggaggcaagagg

SEQ ID NO: 772344 - DNA, 23 bp, Homo sapiens
ccccaggacgccactcatttcat

SEQ ID NO: 772345 - DNA, 14 bp, Homo sapiens
ccccaggcactgtt

SEQ ID NO: 772346 - DNA, 15 bp, Homo sapiens
ccccaggcagccacc

SEQ ID NO: 772347 - DNA, 23 bp, Homo sapiens
ccccaggcaggctgtgcgctgac

SEQ ID NO: 772348 - DNA, 15 bp, Homo sapiens
ccccaggccaggcca

SEQ ID NO: 772349 - DNA, 13 bp, Homo sapiens
ccccaggcccacc

SEQ ID NO: 772350 - DNA, 13 bp, Homo sapiens
ccccaggcccagc

SEQ ID NO: 772351 - DNA, 15 bp, Homo sapiens
ccccaggccctacaa

SEQ ID NO: 772352 - DNA, 19 bp, Homo sapiens
ccccaggccggagcccaga

SEQ ID NO: 772353 - DNA, 10 bp, Homo sapiens
ccccaggcct

SEQ ID NO: 772354 - DNA, 16 bp, Homo sapiens
ccccaggcctccagcc

SEQ ID NO: 772355 - DNA, 17 bp, Homo sapiens
ccccaggcctctgtgtc

SEQ ID NO: 772356 - DNA, 23 bp, Homo sapiens
ccccaggcctgaaagaggctgag

SEQ ID NO: 772357 - DNA, 12 bp, Homo sapiens
ccccaggcctgg

SEQ ID NO: 772358 - DNA, 15 bp, Homo sapiens
ccccaggcctggcct

SEQ ID NO: 772359 - DNA, 21 bp, Homo sapiens
ccccaggcctgtccaccctgc

SEQ ID NO: 772360 - DNA, 23 bp, Homo sapiens
ccccaggcctgtccaccctgcca

SEQ ID NO: 772361 - DNA, 22 bp, Homo sapiens
ccccaggcttccgcgcccagcg

SEQ ID NO: 772362 - DNA, 18 bp, Homo sapiens
ccccagggacagaggcca

SEQ ID NO: 772363 - DNA, 22 bp, Homo sapiens
ccccagggacagaggccaagga

SEQ ID NO: 772364 - DNA, 17 bp, Homo sapiens
ccccagggcctccaggg

SEQ ID NO: 772365 - DNA, 19 bp, Homo sapiens
ccccagggcctccagggcc

SEQ ID NO: 772366 - DNA, 14 bp, Homo sapiens
ccccaggggcagca

SEQ ID NO: 772367 - DNA, 20 bp, Homo sapiens
ccccaggggcagcaaggcct

SEQ ID NO: 772368 - DNA, 18 bp, Homo sapiens
ccccaggtcagccctgtg

SEQ ID NO: 772369 - DNA, 19 bp, Homo sapiens
ccccaggtcagccctgtgt

SEQ ID NO: 772370 - DNA, 15 bp, Homo sapiens
ccccaggtcaggggc

SEQ ID NO: 772371 - DNA, 16 bp, Homo sapiens
ccccaggtcaggggct

SEQ ID NO: 772372 - DNA, 20 bp, Homo sapiens
ccccaggtcaggggctccct

SEQ ID NO: 772373 - DNA, 23 bp, Homo sapiens
ccccaggtcaggggctccctaca

SEQ ID NO: 772374 - DNA, 21 bp, Homo sapiens
ccccaggtccagctctggagg

SEQ ID NO: 772375 - DNA, 23 bp, Homo sapiens
ccccaggtcttcctgctttccat

SEQ ID NO: 772376 - DNA, 23 bp, Homo sapiens
ccccaggtgcagccccagggcct

SEQ ID NO: 772377 - DNA, 17 bp, Homo sapiens
ccccaggtggaaggcag

SEQ ID NO: 772378 - DNA, 23 bp, Homo sapiens
ccccaggtgtgttggggccttgg

SEQ ID NO: 772379 - DNA, 18 bp, Homo sapiens
ccccagtccccacccctg
